United States Patent 11,410,750 (METHYLATION MARKERS AND TARGETED METHYLATION PROBE PANEL) - sequence listing, part 7

SEQ ID NO: 91913 - DNA, 460 bp, Homo sapiens
  chr4:17782834-17783294
  hyper
agtccattctccagccggcgccaccgtcggctttggagccctggcaagtgccgggcgggttaattttgctgttgagagcagaagccatcgctaaaacgcgcccagcactcagactctctcgttttctccctgcccaccgtgtgcacgtgcgtgcgcgcgcgggcgtgcgagcgtgtgggtttctcgggagaggtggcactgcagtcccgtcgcctgcaccgccgcgtggccccagcttcccgaaggtctccgcctcccgggcccacccgcgcgcccaccctttttcctctcctgctggttctctggctggctggctccgcgggcacccgcaccctgcggcgaggcgtcggcgccccgcacgtgccgctggcgatcagtctgcagttccccagccagtgcaggtttcgtgtgcaaggggagagcttccgcggctaggagctgccggccttggggggtttgc

SEQ ID NO: 91914 - DNA, 27 bp, Homo sapiens
  chr4:17783295-17783322
  hyper
gtgggcgggcactgcgctcttggacac

SEQ ID NO: 91915 - DNA, 158 bp, Homo sapiens; identical to SEQ ID NO: 2390
  chr4:17783323-17783481
  hyper

SEQ ID NO: 91916 - DNA, 4 bp, Homo sapiens
  chr4:17783609-17783613
  hyper
cgcg

SEQ ID NO: 91917 - DNA, 182 bp, Homo sapiens
  chr4:177973020-177973202
  hypo
aaacagatttgctttcgttgtctgcatagcttctgctagcatcatgatccgtttaagagaatgccttattctccatttactattcctcataagattattctgattcagaatttcacaaaaatatttgcttcccatacccacaaccttgcacttgaaagacttaggggcgctagtcctaagag

SEQ ID NO: 91918 - DNA, 20 bp, Homo sapiens
  chr4:178109673-178109693
  hypo
tttttttttttgagacggag

SEQ ID NO: 91919 - DNA, 30 bp, Homo sapiens
  chr4:17818237-17818267
  hypo
actgcaaatagcaatcgtgtaatagataaa

SEQ ID NO: 91920 - DNA, 25 bp, Homo sapiens
  chr4:178599692-178599717
  hypo
tgcgcccagccgagtccatttggga

SEQ ID NO: 91921 - DNA, 30 bp, Homo sapiens
  chr4:1788923-1788953
  hypo
tgtgcccctgctgagcgtgccgggtggggg

SEQ ID NO: 91922 - DNA, 75 bp, Homo sapiens
  chr4:1791269-1791344
  hypo
tgcccacctccctgtcgggaaaggcggcagctgcctgcccggagtgctgtggggaacaggcggtgtggatctgag

SEQ ID NO: 91923 - DNA, 73 bp, Homo sapiens
  chr4:179443386-179443459
  hypo
gaactgtaagtatgacgcggtagccgctcccactgcataactaagttctattatacagcgcaggagactttaa

SEQ ID NO: 91924 - DNA, 109 bp, Homo sapiens
  chr4:1796489-1796598
  hyper
cctcgtgggccgggccgagagctccggtgccgccgccgcgtacacccgcagccggctccggacgggcgaggggggcgcgcacagctcagcccggcggccgcgcggaggg

SEQ ID NO: 91925 - DNA, 649 bp, Homo sapiens
  chr4:1803127-1803776
  hypo
caagaagctgctggccgtgccggccgccaacaccgtccgcttccgctgcccagccgctggcaaccccactccctccatctcctggctgaagaacggcagggagttccgcggcgagcaccgcattggaggcatcaaggtgggcgcggcggggtggctctgggcctggcaggcgcggtggttgctgcctccgctcactcacccgcccgcgtcccggtgcagctgcggcatcagcagtggagcctggtcatggaaagcgtggtgccctcggaccgcggcaactacacctgcgtcgtggagaacaagtttggcagcatccggcagacgtacacgctggacgtgctgggtgagggccctggggcggcgcgggggtgggggcggcagtggcggtggtggtgagggagggggtggcccctgagcgtcatctgcccccacagagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaatggcagcaaggtgggcccggacggcacaccctacgttaccgtgctcaaggtgggccaccgtgtgcacgtgggt

SEQ ID NO: 91926 - DNA, 155 bp, Homo sapiens
  chr4:1804729-1804884
  hypo
caccaatttcataggcgtggccgagaaggccttttggctgagcgttcacgggccccgagcaggtaacgactctgtcccatgccggccggcacaagagctccagctccaaggccctggccgcgcgccctgcacgccccgcacgcccagccctgctc

SEQ ID NO: 91927 - DNA, 546 bp, Homo sapiens
  chr4:1805091-1805637
  hypo
ctgcctgctcgcttccgcagcctgtgtgtccctgtgtccatcctccacctgcacccgcccggctctgcgctaacccgcatgctgcctgcccgcctgccgctcacctgggacagaggactcgccggtggaggggcctggcttcgggctcagtaccggtgtaccaggcggagggccctcagccgcgtggcggtgaccaagttggcggtggctgaggagttggtggtggcggcgttttccttgcagcggctggatcctgccgtgtggactctgtgcggtgcccgcagggcggtgctggcgctcgcctatcgctctgctctctctttgtagacggcgggcgctaacaccaccgacaaggagctagaggttctctccttgcacaacgtcacctttgaggacgccggggagtacacctgcctggcgggcaattctattgggttttctcatcactctgcgtggctggtggtgctgccaggtaccggcttctgctgctgctgctgctccgcactgtctgggggacgctggctcgggacacgccaaagctgccag

SEQ ID NO: 91928 - DNA, 106 bp, Homo sapiens
  chr4:1805886-1805992
  hypo
ctctagactcactggcgttactgactgcgagaccctccagacaaggcgcgtgctgaggttctgagcccccttccgctcccagtggtgcctgcggctctgggccagg

SEQ ID NO: 91929 - DNA, 436 bp, Homo sapiens
  chr4:1807256-1807692
  hypo
ctgacacaggccccccgctccgtgcacagacgatgccactgacaaggacctgtcggacctggtgtctgagatggagatgatgaagatgatcgggaaacacaaaaacatcatcaacctgctgggcgcctgcacgcagggcggtaggtgcggtagcggcggtggtgccggctgggcggccctcctgggcctggcagcccgtctgaggagcccgtgtccccagggcccctgtacgtgctggtggagtacgcggccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtacttggcctcccagaaggtgggcagggcggcaggtgtgggtg

SEQ ID NO: 91930 - DNA, 30 bp, Homo sapiens; identical to SEQ ID NO: 40370
  chr4:180818589-180818619
  hypo

SEQ ID NO: 91931 - DNA, 426 bp, Homo sapiens
  chr4:180979223-180979649
  hyper
acagcggtcaattgccgttttagagctcattttggggcgaatggtagcagcagagccactgccgccctggctcttgtaggtgggtctggagtgtcacgtaggcaccccaactcgcgccgggggccgtggtccgcagactcccacttcattgccccggaggcctgagcccgccccgcccggctgtggctgcacctttcccgagagtcggggcagcggcggctcgaaagtggaggcagcctaaccgcgtagcgctgaaaccaccattcacaaatgcaaacccctgtcttctgtggataaacggtggcggcgcgcgtccgagcgtccccgaggggctgtggggagcccccggggagagcaggaaaggaagcggggtggcggtggctaggaagcgactgagccttctcgcccggccggcggaagagggag

SEQ ID NO: 91932 - DNA, 406 bp, Homo sapiens
  chr4:180980004-180980410
  hyper
gaggagggatggagccgggaggaggaaataaataaataaaacaatcacctccgcgccaataagagcgagggagagagcaagacgcgaccagagagccaccggggcccgctcgcgcgcctctgagaggctgtccgcgcgcgcgcgtgtgtgcgtgagtgtggatttgccgggactggagctggaaagttcaaactaaacgtgttgctctcgccgagtgccgaggccgcggcggaggctgcccaacttccccgggccaagtgagtggcgttgcccagcgcctttggcgaggcggcggccgctcggccctgcgcccggccgcggcggcggcggctccgctcgccccgggagggagcccgcggccagggctggactctcgccccgccacctccaccgactctctcctcag

SEQ ID NO: 91933 - DNA, 40 bp, Homo sapiens
  chr4:180980984-180981024
  hyper
aaagtggggctgcctcgtcggagagcgcaactctggagct

SEQ ID NO: 91934 - DNA, 58 bp, Homo sapiens
  chr4:1811789-1811847
  hyper
gcagagcatggggctcgaagcgcgggccgggagcgccccctagcgctggctgggcagt

SEQ ID NO: 91935 - DNA, 24 bp, Homo sapiens
  chr4:181546386-181546410
  hypo
cttttttttttgagacggagtctc

SEQ ID NO: 91936 - DNA, 155 bp, Homo sapiens
  chr4:182558152-182558307
  hypo
cacacactgcacattcggtttcctctttctaaaaaggctttcccgctagatacccatatgccttgctctctgccgccttcaggtctccaagtgaaggccaccttcccatgaagaccttctctgaccacactacaagattgcgaagccccttcttc

SEQ ID NO: 91937 - DNA, 30 bp, Homo sapiens
  chr4:1827297-1827327
  hypo
agctgacccctcaggcggtcttccgtgacg

SEQ ID NO: 91938 - DNA, 30 bp, Homo sapiens
  chr4:182982724-182982754
  hypo
cctcatatatatttacgtggtaattggcat

SEQ ID NO: 91939 - DNA, 114 bp, Homo sapiens
  chr4:183062432-183062546
  hyper
cagtttttattgctgcggagggcacgacgtgagctgcccgccatccccgccctctcttgacaacagctcagtgaggtaaaaagcatgatggtcacgtagcgagctgcctctctg

SEQ ID NO: 91940 - DNA, 307 bp, Homo sapiens; identical to SEQ ID NO: 29314
  chr4:183063666-183063973
  hyper

SEQ ID NO: 91941 - DNA, 1523 bp, Homo sapiens
  chr4:183063994-183065517
  hyper
cgccccgtcccggacccgaaaggagcctgaaggatcccgccgaccacccagccagagagcggttcggctcaggtcgcccattcggagctacaaaactctggaacctccagcagtttcggaagctccgggggagggctttcctgcagacagggggcgggagctagggagccgggagccagcgctgcggtgggaacttcagtgagtagaaagtggccagtgtcttgggaggagcagcaaactttttttttccctcccacagcaaacaaaatcgaggcagggacagtgtccggccgctaatctgaggggagaatggagaggaaagaagagtagtaaaagtggggagtggagccttcggaggactcccgggtccgcccctggccaggtgatgcggggcggaggcctaggtgcttgaacctggggggcagacaattgttctgctgcagtgcccaccaggggctggtaaggaagtctgagtgtttactgcctcccttccctgtccaaaggtcatttgcgcttttcggtctcggacgaaagaacactgtggaaaggaaggcgcgggtcattttcagaggctctgcaaaggacgggccgcctaccgggggtggaaatccttaattacacccttctgcctcggaatccgtcttcccggcagtgtcttgcactgccacctcctcgggtgactcagctgacctgaaatgcccaccctacggaagatcaagaaaagtagttttctaagaaggttagaggtttgattacacagagaagtgtttccacttaagtccaaagcaattacccgccccctcccccagggccgcctccccgccacccgcagcagaaaaggacagacccccacgcacgtacccccattttgttggtgcgtgtgaatttcaaatggcgcagtaagttcattagtgttttcaatcggcggcgggcagacccctcatcagagccgaaagccggcaagagccattcatcagcgtgaagtgttattcacggatgacccctaaatcacggcgagagtagtaaaggcactgattggtcacagcatgggagcctcggtgctttcccgaacccgacgcggccgggaggagggaaggagggaggggcggcgaacgtggttcagtccggcaaatcccatttgacagaaaaaggcagtaaacggggaatctctttttttgaataaagaagaagaagaaataaagtacctgtcatcttgacaagtggcggagcggaggagtcaaggattataaatgatcacagccaggtccagctcgccccgtgattgggctctcccgcgatctgcaccgggggaagcgcatggtaggctcctctcctctcctcctctccctcgcacactcccgcacacacacacacacacacacacacggacacgtgtacgcgcccgggctcgggcacactcggcccggcgcgtcccccgccgcacaattacggtcctggatgccgctccctggccgggcgtcccgcgggcctcctcacctggcccttctcgccttcctcctccc

SEQ ID NO: 91942 - DNA, 360 bp, Homo sapiens
  chr4:183065946-183066306
  hyper
atggggtcctagtgccgggccgcggcgccgggagctggcgggcgcgagctgggacggcgcgtggccccgggaggcggcggacgcggggacatcttctcagcgcgcggattctctccacggtccggcctccccgtccccgccccgccctcgcgccagccacctccggccgccggctcaggtgggaacttcgccggcgcctctcgcccggggagccaggcgccgcgcccccgtactggggagccccggggtccctgaggaaggcagtccggaggctgggcgcccagtgggggcggggaggggagcccgccaggtcctcttcggcccccgatgtgtggcgaggccccgcgtcttctgcggggg

SEQ ID NO: 91943 - DNA, 32 bp, Homo sapiens
  chr4:183115488-183115520
  hypo
atgtgtactgatgcacgcgtgttgccaaacct

SEQ ID NO: 91944 - DNA, 24 bp, Homo sapiens
  chr4:183256665-183256689
  hypo
aaaaaaagacgaagcatttgccat

SEQ ID NO: 91945 - DNA, 297 bp, Homo sapiens; identical to SEQ ID NO: 29316
  chr4:183369261-183369558
  hyper

SEQ ID NO: 91946 - DNA, 687 bp, Homo sapiens
  chr4:183369579-183370266
  hyper
cgcgagctggagggccgagtttcgcggggccgtggggcgtgtgggtgaaggcgacacctcggatgcgggacgcatgaatggtggcagagcaggggtcgggatccgttcatgggttgggagagagatgcttttgtgagcacgggaaagtagcgctgccggagaacagctctgaggcgggatcaaaagccgccggcgaagccccgccgaggaacacggccgctgcccggggcggctcgcgagcgtgcgtgtgtggaggggaggatgccgccccgcggggtcttcggagggtgccgggagcgggttctcagtgcagttcccccgtcttcgctgggggcacggctgctcacaggccccggcccgcgtgtgtggagcggggcgagggggtgaggcgagggggtgaggcggcggccgagccggggcgctgggcgcggggctggcgggaggcggcggtggcggcccggcgcgaaggggttaagcggcgcaccgccccctcggcggccgggtgtaaacagaggagcctcagcctatcatgtctggccgccgcgcgcagcccgagcccggagccaggcgctgtaacacgatacgctccagacccaggcaacttggcagcgctgggctcggttcctcacggccacagcgagggcgcgccgcggcaaggtgggtgagcggcggcggcggcggcggcct

SEQ ID NO: 91947 - DNA, 158 bp, Homo sapiens
  chr4:183370559-183370717
  hyper
tggtgcaggtagccgcggggagaatggagtcttttgttcccggtatttttaattagatggattttttttttatgagtagtgtactgtcctaatccgtgaggcaaagctgcccttttgcctgcattcggtgacttttacgaattcgttgggagctagtc

SEQ ID NO: 91948 - DNA, 22 bp, Homo sapiens
  chr4:183447416-183447438
  hypo
gccaccgcgcccagctacattt

SEQ ID NO: 91949 - DNA, 16 bp, Homo sapiens
  chr4:183690642-183690658
  hypo
agagcagtcctaggcc

SEQ ID NO: 91950 - DNA, 30 bp, Homo sapiens
  chr4:183696298-183696328
  hypo
agctcagggtacgtacgtgttgtggagcag

SEQ ID NO: 91951 - DNA, 212 bp, Homo sapiens
  chr4:183727706-183727918
  hyper
agggaaagtcctgcacgccaaaagggcagttcccgggccagaaaccgaggtgaaaccgaagagaaggcgccgccgctcgccgctcgccactctccaccccaaccgcggcggggccggctctctgaccctctcttccccacctctgctctgccctccgagtttcacacttaaagcggagacttctgcttcagcaccgccgcaccgaggcctgg

SEQ ID NO: 91952 - DNA, 30 bp, Homo sapiens; identical to SEQ ID NO: 40371
  chr4:183959079-183959109
  hypo

SEQ ID NO: 91953 - DNA, 30 bp, Homo sapiens
  chr4:183994250-183994280
  hypo
tgcacaaacagaactcgagaaagaagaaga

SEQ ID NO: 91954 - DNA, 691 bp, Homo sapiens
  chr4:184019209-184019900
  hyper
ccagggcctgggaggcgccccctctgactgaggggctggggaccctgaagcttggcgtccaggccccgccagcgctgcacccggcattgtcccgcctggggcaggcgtccggtccctcggcagtgcgggccagcacgtacgtagtagctgctgaataaataaatgcctatgcaacagggaacgtcccggcccaccccggccgggccagggcctaggaagggcgggcgtccggcgccgccgtgggtccctccggcgtggccgcccacacctcctggccacggcggggctgcggtggggggacatcctggggcgggcggctggacggaagggactagagtcggggcgcgtccacggccaaccgccccgaaccaagcaggggaggccagggaccaggagcttccggggccccgcggctggagcgcccggacgcgaaggggcggcgggtgacggggcgcggtgcgggcggctacagggccggacgggagttcctccgctttccgccgcgcggctcgcggtctcagccgaggtcatcgagggccaggagccctggcggaggccccgccgtcccggacccaccgacgcactcccagggcttggcgctttcccaccaccccggaccgcccttggggtgccggaggggctcggggcgcggcgtggggagcctttgtgccctctccgcttgttgaggttt

SEQ ID NO: 91955 - DNA, 1152 bp, Homo sapiens
  chr4:184020126-184021278
  hyper
ccccgcggggcagtgcgtccgagctggtgcggcgacgccggcagcggcggggttaagctcaggaatgcggcgcgaggaatgcgcatgcagatgaggcgggcgggcgcatgctaatcgcatgcaaatgaggggcccgccgctgccgcggcagcgccgcagcttcccggatccgagcccagacggcggcggctccggcagcctgggcgccgcgaccctcggcggccagagggggacggggcggaggaggaggaagaggcggaggcagcggcggcgagggggaggagggttcgctcgccggctccgacgcagacatggtggactgatccgcagcggggccgcgaacagcgtttcctgaggcacctcccgcgcgtggttccgccgcgccccgcgccctgcgcccctcagcccctcgccggcgcccgcgtcgcgggttggcagcctagcccggcagccgcgttcccgccgcgtcccgcgcccggtacctatggaggcgccgctcgccggcgaggccgccgaccatgcctaggagggccgggagcggtcagctgccgctgccccggggctgggaggaggccagggactacgacggcaaggtcttctacattgaccacaacaccaggaggaccagctggatcgacccccgggacaggtgggcgccggccgcgggggcgcgggcccgttcggacacggcggctgttgtcccggagacccggccgcgcggggggctggggcggcgccggcccgcggtgccccgaggggtcccgggagggatgtggggctggctgctccggcggggccgaggagccgcccgtacccgggctcctccgcccaccggcttcccgacgcccctccggggacccggccccgaggcaaggctggagtcgctgccccgggccgacgccgcgcgccaggctaacggacccgaggggccacctgagccctgttaggaacttccctaggcttcgaggtgcccacgtggaggctgcaggacaccttcggcctctgggcggcgggggtgggctagggcctcactgccagttggggaacgagccctccgggccacctgtggcatccctcaggccgtccttggcgcgggagcctgggctgcgagctcttggcgggggcgcccagactggccggaggtcccgagct

SEQ ID NO: 91956 - DNA, 42 bp, Homo sapiens
  chr4:184205414-184205456
  hypo
gacaatatggcagttcgccccaaagagcgcagcagcctgagc

SEQ ID NO: 91957 - DNA, 30 bp, Homo sapiens
  chr4:184278109-184278139
  hypo
aaggagctgacaagacgtccatgaagcaag

SEQ ID NO: 91958 - DNA, 120 bp, Homo sapiens
  chr4:184375288-184375408
  hypo
agactggtactggaggcttgcaggttggggaccccctgctctatggtgtagcatgaatttcacctgtgtcaatatagcagagatgagagtgatgacaattttcatccaatgatcctgctg

SEQ ID NO: 91959 - DNA, 18 bp, Homo sapiens
  chr4:184375708-184375726
  hypo
ggccgatcctgcttcttt

SEQ ID NO: 91960 - DNA, 30 bp, Homo sapiens
  chr4:184532559-184532589
  hypo
acacacacacacacacgcacacacacacac

SEQ ID NO: 91961 - DNA, 36 bp, Homo sapiens
  chr4:184667629-184667665
  hypo
gaccaggcagggggccgtgcccgctggggaggcttg

SEQ ID NO: 91962 - DNA, 636 bp, Homo sapiens
  chr4:184718199-184718835
  hyper
tcattaaccagtcagcgaatccacttgttccagcgagaggtgggaggtgggggcaggggtggagcgtggggaggagcgacactcgccgctccggaatccgtgccttccaagtgtcgccgttgcgtcccccgcaacccccgctttctgatctccctcgaggcccaacacccaaaggctcacccctaggccatccgcgctccccgaccacctccctcataggactccttgggattcctcaggccgcgtccagccgagggggttcccgggcgcggtgcgcactgcccgccccctcactgcctcctcccgcgtctccgcccccgcggggccgctgggcgcccggggaggcgagggtgccgaggccggaaaatgagcgctgcccgaagggtggcccggagctgcaggtaacgcggtccagagctcaggccggagcgggccccgcacaccgtcccttccccgcagcgacccgcgggctgcgcccagggactgcgccgggcgcccgggctgcagggacgcgggcgcgggggaggcgcggccagccctgccctgggggacggtcgcgctccccgctggtcttgcagccacgtcccggcggctgttcctgggagcggcgggaggcggcctcggtgagccaggtcg

SEQ ID NO: 91963 - DNA, 213 bp, Homo sapiens
  chr4:184719200-184719413
  hyper
ctgcctgggtgagtgcgaccgccgcgcgcccgtcccgtcccttcccaccggatcgcgtccgtgccgtgcggtcgcgggtgccccgccctgccccagcccgccgcgggcaccgccgaggctcccctgggtgcccgcgtccctgccgggggaggagccgggggccctctgcgagcgtgggattggggaacttcctggcaccgaaaggagggagcc

SEQ ID NO: 91964 - DNA, 419 bp, Homo sapiens
  chr4:184826238-184826657
  hyper
tttgaaaacccaaatcgaggagataaccgtttttgaatgaacggcagtgcaaagcgtggtcggggttagcagcaacgtggctgggcgcctttaactcggcgtgacctccgggtcccaggcccgcgtcccgggcccagcgcccaggcccgggcggcgcattggcccctcctcccctcgcgcgccgcgcgcattgttgtcctttagcgattggttgttggaccagaaacagctgtgcagagccgtgccatctaaagagctgtggacctgaatgcagcgtagcgggctggcggtgacttacaccgggactccagagggagagaggaagcgctgcaggccacttgcattgcgtcttccaggctgcgtggacccggcgccccggcgtgtgcggttgtgggggagctcgccgtggcctcccctcc

SEQ ID NO: 91965 - DNA, 213 bp, Homo sapiens
  chr4:184827078-184827291
  hyper
gcacatgcgtgtcggcgcacccacccagccatccacccgcgcgcacgcacagcgcccggagcctcggcaaggggaagattgacgaggcgctgcagtcgcggggacgacgcgggctcttcctggattccgcaggagcccgcccgccgcagctgctgtctgcagagcctgctcggatcctgtgcacacgcgccccccgctcgagcctctgtgatg

SEQ ID NO: 91966 - DNA, 102 bp, Homo sapiens
  chr4:184827557-184827659
  hyper
tcgggccattgtctgcgctcccattgccttcacgctgcaagtctcggcgcccccaccccgcccgccccctccccgcctcctcccggccggggagcctcctaa

SEQ ID NO: 91967 - DNA, 208 bp, Homo sapiens
  chr4:184921881-184922089
  hypo
ggtgttatccttcctcgactctcagcacccaggtgttgttctgttctcttgtgtgcctgccacgcagcattgcgaacttcgttcgatctacttgtctgtcttctccacttaaatagaaactgagggcagagatgtttggggagaggcgcgcactctgtctctgcagctcccgttcccccagcagacacgtaaacgcgttcaatgtgtg

SEQ ID NO: 91968 - DNA, 339 bp, Homo sapiens
  chr4:185089642-185089981
  hyper
gctggaagctttgcacgggggtgaaagttacaggcagacactgcccgcggggctccggacagcaaggagcgagccctctgagcctggccacgctggcccgccactgccctctgctggcggctgcggtcttcaccaccgcccgcagccgtccccgtagtccgccgagaggcgccaggctgggccagccttgaattctgggtttgcttctcccggtttgaaggccacccccaggattcgcaggaatctgacagctgcttgtgactgtgctgaagatgccgagaatgtaggcagagcccgggcagggccggcgggcaggcggccacgcgctgcagcaaacgc

SEQ ID NO: 91969 - DNA, 30 bp, Homo sapiens
  chr4:185592328-185592358
  hypo
gtgcagtaaatgtatcgaattgcttttgtt

SEQ ID NO: 91970 - DNA, 30 bp, Homo sapiens; identical to SEQ ID NO: 40375
  chr4:185833058-185833088
  hypo

SEQ ID NO: 91971 - DNA, 30 bp, Homo sapiens; identical to SEQ ID NO: 40376
  chr4:185913935-185913965
  hypo

SEQ ID NO: 91972 - DNA, 30 bp, Homo sapiens
  chr4:185931321-185931351
  hypo
tggccagcatgagcacgacatgttcaaaag

SEQ ID NO: 91973 - DNA, 711 bp, Homo sapiens
  chr4:185937273-185937984
  hyper
ttccctatcctgaagcggagggcgttccaggtttcgcaggtagtgctgcagccgcgcaaggaccgggcgaggctgcgcccctgagcccaagtctccactcaccggccttcccttgccccctcacctgcacgcgggtacttttagccctgggcaagccttgagccaagcgccgagaccaaacccgggaaattaaacagtgtgcatggaatgaaatgtggtccgtggaaggtgcctgcagctggcggttaacaccggcagtaagaggatcaacgcccgggccgctggcttaaaaatgggagtgggagtgcgaagtgtgcgcgctcctttttacccattcacgttagttaatttggatgataagggttcgcgtttaatctctttgtgtgcgagtgaatatcctgaaatcgacaacccctgagagggcactcgcggctggcagagcaacctgggagggtgcggatcgtgtccaatctggcgtgaagcagaaaggaaacatcgtgaggagactagaggcaggaccgagagggacaccctaggggtgcgaggtgcagaccgagccctcacatctcccaggccgcagcaggtgggccgatggcttccccgaggcctggcaccccaggcctggctctgcgccctgaggctcccaggtcccaccagctagaagagcgccgcctacccacccctgccaaggtctaacgaccccaagggggg

SEQ ID NO: 91974 - DNA, 717 bp, Homo sapiens
  chr4:185938230-185938947
  hyper
ggcagcaagtgtgagcgaggcccgtcctgggggaggtggcctctggccgcggggccaggttgccctcagaggcgcaggcggccaagagagttcccagccgccgccgcccccctccttccccttgggcccgtccagcaaatttcctccctcgtttctgttcgtgccttccctccctcctcctccccccgatattttcgctttctaaaaccataaaaaagagatcaacttcccaaacttcacagggcccttttcagtgacaaatattgatgcccaaagtgtctgcgctctcccgcccccaaacgttaagaaaagacgccagcgaaagggagacataaaaagttaacaatgctgtgaaaatatgtttgcagaaaatagacaatcgttggattaaacgtattcaagtatgaaataatgcctttttgtgtcaaaacttgggcgatgggcgggtacaaaagttccctgtggcagctacttgctccctttgtgagccgtgcgctttggcgtctccacttgggcgcattactcagagccctctaagcgcgattgtttctccctttctaatgacatttaccggatcaaaacatgctgttaattcgatcagaaggcttcaccctccctgacaaagccacaataatttctcctgaagtttgttaaattgaccaaaattaggcaaatgaataggggtctgtaggcgccccctctcgcaggtgacgttgc

SEQ ID NO: 91975 - DNA, 66 bp, Homo sapiens
  chr4:185939377-185939443
  hyper
gacgtgtcaccaagtcgtgtgagaaaagcctgggaacaaacggggcgcctccgtctccaagagctc

SEQ ID NO: 91976 - DNA, 2800 bp, Homo sapiens
  chr4:185939673-185942473
  hyper
ctgcaggcgcttgctcgcccgccggccccagtttaccgcctccttttcccgcccgagctgttgccatgcaaatgttattcctgggccgatcacgtgtcctttgaagggccacgtggattaacaaagctgatctgcccccagctcgcccccctcggctgctaattttttttttttcttaacttctttaaaactgatcttgaatgcatacatcctccaaacgcagctcccctaatcctatggaataattcaactcgtgaatgcatctggagccctagatgaccgctttataaggcagccctcggagttgggaggctgcagtctacctgggacactcgaggaggcacacgaggcggaaaagtggacgggtgccccgcgccaccgcctctcccgagggcgcgtactgaccaggatgtcagacaagctcaaggaacgcaaagtgagtcggctgagcccaaatggcacttgcgccctggtggtggaggcatctgactcaccgacccgccacttgggtggaccgatggcagggaagtgcccgcacgggactttgagtgtggaggaatctcgagtggtttgggaagggggtggggtagagagaggagggtgctcaaccaggtagaagtcctgcctggaggctggcggccacctccccaaaggcctgggtagggtggctggaaggggagcgcgccagcgcgggcgtcagaaggcagagctcacctggcccgagcgtggcgggccaggagtcccttcctagagcgaatctgagcagtgtgcgcggctggagaggcggcttgcacccagctgctagagccgcgcctttgacgacttcccgggcaaagccatcctaaacatacaaccctctcttcgcagagaacccccgtttctcataaagtgatagaaaagcggaggagggacaggatcaaccgctgcttgaacgagctgggcaagacagtgcccatggccttggcgaagcaggtaacgttggcgacccggagccgggtgccaggcgttgggaggcctctgcggccactctgcggagacgcccgagcccgcggacacagaggacctcacttgcgggcccctcccaggcggggggcctgagcgcagggcgaacctcaggaggctctggcgcagatccgcagccgcgtccgctcgctggtcctctccagcgccacagtgcccgaccagcaggcgctgggccgctgcgaggggcccttcctccttttgcagagttccgggaagctggagaaggcggagatcctcgagatgaccgttcagtacctgagagcactgcactccgctgattttccccggggaagggaaaaaggtgggcacaggttagggaatgggacgcctgggccaggcgcctgcgccacccagagaccctggggctgggaggggagtgactgagtgttcccgagagctctactagagctccactctccaggagggcaggggtcctgcgaaggcgcctctccctgctcggcgacagcaaggcggcgagggagaactggttcccagggaggctggttccacctccttctcccgggtggggtgggtggggtcaggctctcagggaaagagggcgtttgcgcgtgcctcgccagtctctaagactgcgcagaggagagggcgggcctcaaatgggaactttggccagaaaatgtggtgggaggtgccctgcacccgctttgggctcgcgtggggaaggggcactcagggtgtgtccgtcctacgggctttctcgttcctccagcagaacttctagcggagtttgccaactacttccactatggctaccacgagtgcatgaagaacctggtgcattacctcaccacggtggagcggatggagaccaaggacacgaagtacgcgcgcatcctcgccttcttgcagtccaaggcccgcctgggcgcggagcccgcctttccgccgctgggttcgctcccggagccggatttctcctatcagctgcaccctgcggggcccgaattcgctggtcacagcccgggcgaggccgctgtgttcccgcagggctctggtgccgggcctttcccctggccgcctggcgcggcccgcagccccgcgctgccctacctgcccagcgcgccagtgccgctcgctagcccagcgcagcagcacagccccttcctgacaccggtgcagggcctggaccggcattacctcaacctgatcggccacgcgcaccccaacgcccttaacctgcacacgccccagcaccccccggtgctctgacgcccactcgcccgccagatttctcctcgctttgggcgcttttaggagaaatgctgtatatattgtacacataatgtgtaaatattgtaccccaaaaatctgggctgggggaggcaaagagcgaatgagtcttctgaaggatctccccctggtaataaacgttttctgataaagacccaaagagagggatttatgtattaccttctgctcatccacacccgtcccctccgcggtgcccagggcgcaaggctgacagggttcaaggtaacagccctcagtaacttggtgaggggcccgctgtggagtctgagggagggggacgttaaatggaggttcaggcagatattctaggcatcgcttaagggcgggattcgcggcttcctgcacccgccccatcttgagcattagcctcagagaaacaggggaggcgaagaacactgcccttggctctcaggaaaatgcaaattgaaggacctgccccaaactgacttaggcggaccgttgccagctgcgacccgggcgcccgtcctacccggagccaagtgcc

SEQ ID NO: 91977 - DNA, 443 bp, Homo sapiens; identical to SEQ ID NO: 7656
  chr4:185942491-185942934
  hyper

SEQ ID NO: 91978 - DNA, 30 bp, Homo sapiens
  chr4:185964663-185964693
  hypo
gtgtgtggttgcccacgctggcaccacacc

SEQ ID NO: 91979 - DNA, 277 bp, Homo sapiens
  chr4:186048714-186048991
  hyper
gggctcggtgcagtccggagcccagaccaggcagttgctgagttatgtccgggcgagatcggtgtccttcagggtgggaggctcagaaacccagcgcgcgagcctctgggcagtggtaagggcgggttgggagtcgggttcggcgagtccaaaggaggctcccgggctgcagaggccccggcaggctgtctccgccccacgagccccttctcctgcggtctcctggactgcggcgacgaagcgtcggggctggggctccagtcgcctggggatgcgc

SEQ ID NO: 91980 - DNA, 572 bp, Homo sapiens
  chr4:186049493-186050065
  hyper
ccaggcgtgagccccgcgccctccccttgcggagattcggcctggaaagctccgcggctctggccggcaccggtttccttcccgcctccccgcactcccacccccgctcctagttcagagcgctggtggcgttacccacagccgcggaatcccctttactgttcccggaggagctgcgaggtggaactggccgcgcggtgggggctttccccggccccgggacgagcactcagcgtcccctccccgcgacgctccctcggaatcccggggaagagcgcagcagaggcggggaggaggcgcgagcggaggggaccgacttccaccgcacctgggtgtcgccagccccgcctggccctcggcgccgggaccccgacgcaccccgcgcatagcgactggtggcctggtgggggactgcgcctgcgaggccttcttcgcgcagagatatcggggttctctgaaccccagaaatgggcctggcaggggaaggaagctgcaagaaaggagttaatctgcaggatgctcaattctttctatgacaaatcgcttcactccccgctcggcaggtcagagct

SEQ ID NO: 91981 - DNA, 99 bp, Homo sapiens
  chr4:186347807-186347906
  hypo
ccagcaagcttgccccgaaggggattgcagaatatctgttaaataagtgaatgaataattttgtaaatgttgctcaataagagttaagtagtggcgggc

SEQ ID NO: 91982 - DNA, 161 bp, Homo sapiens; identical to SEQ ID NO: 40377
  chr4:186348467-186348628
  hypo

SEQ ID NO: 91983 - DNA, 66 bp, Homo sapiens; identical to SEQ ID NO: 28699
  chr4:1864167-1864233
  hyper

SEQ ID NO: 91984 - DNA, 264 bp, Homo sapiens
  chr4:1864268-1864532
  hyper
cgcggcacccaggcctcgctgtcttccctttcccttcgagggacctcgcgctgcaaaatccgaagagcccggctggggcggggtcgcggggtgcgcgggaaccggggcctgggacggggcggggcctagccagggcctccacggaagcgaggccaggactggggagtggggggtgggggggtcgtggctgagtgggtgccctgagggcggtcaaggaccccgcgggcctcttctcctgcctggacactgcgcttgcctggctat

SEQ ID NO: 91985 - DNA, 214 bp, Homo sapiens; identical to SEQ ID NO: 29342
  chr4:186456012-186456226
  hyper

SEQ ID NO: 91986 - DNA, 198 bp, Homo sapiens
  chr4:186456727-186456925
  hyper
cgccccctcccaccccggagagctccaactttggaagcgagagccgcgccagccccgcgggagtgcgcagcccggccggctggggcagcctcccgggccgcggcgggcgcgggggcttcgggttacagcgtccgtcgctctcttgaagtcacacctgtctccctgtttatcttctgcttggagcgcagcagtgcactt

SEQ ID NO: 91987 - DNA, 218 bp, Homo sapiens
  chr4:187026668-187026886
  hyper
cctggccccggagagcgagagctcggcgcctgcgtggcccccggggctggccccagaaccctgttccttacgctgcctgacatcggcgaggagggggcctcggacggcgactccggggatggcgaagcgtgagtagcagcgtggtccgggcgcgtgtaccttttgccgggacccccgacccctccgcctgccgcactcaccttcgcaggtgcacttca

SEQ ID NO: 91988 - DNA, 30 bp, Homo sapiens
  chr4:187182190-187182220
  hypo
tggcggcagtgtacacgtggcatgcaagca

SEQ ID NO: 91989 - DNA, 184 bp, Homo sapiens
  chr4:187459279-187459463
  hypo
tgcttttctgtttatcgcgattatgtctctacttctccccatctcccacagccccagctatcacctcggtgaggacactgcctgtcttagatatcttctccctccaccttgaacagtacctggccgagggttaatcgatgcacagtgggtttatattgtgtcaacttcgcgaagctgaaaagac

SEQ ID NO: 91990 - DNA, 30 bp, Homo sapiens
  chr4:187647639-187647669
  hyper
taaccagagtgccaacgtccgtgccgccgg

SEQ ID NO: 91991 - DNA, 57 bp, Homo sapiens
  chr4:187648062-187648119
  hyper
ctcctccttcggctgcgtctcccgggcgccggcgagcgcgggcgttcctcgcactca

SEQ ID NO: 91992 - DNA, 16 bp, Homo sapiens
  chr4:188916865-188916881
  hyper
gcgtcagtccggaggg

SEQ ID NO: 91993 - DNA, 18 bp, Homo sapiens
  chr4:189257706-189257724
  hypo
gcccggccccccaactcc

SEQ ID NO: 91994 - DNA, 160 bp, Homo sapiens
  chr4:190474936-190475096
  hypo
gaaagtgaagaaatgcgaggccagctccagccgcagcgcacctgtccacgagtctggccgcagcgcacctgtccccgagtccggccgcagcgcacctgtccacaagtgtccacctctaaggcagtgttcttcaacacgcaccacgcgcatcctcagctgg

SEQ ID NO: 91995 - DNA, 30 bp, Homo sapiens
  chr4:190529509-190529539
  hypo
ggattcgggagtgagcgcatacttcattct

SEQ ID NO: 91996 - DNA, 30 bp, Homo sapiens
  chr4:190536670-190536700
  hypo
ggcctgcctagcctacgcccacccgcaact

SEQ ID NO: 91997 - DNA, 30 bp, Homo sapiens
  chr4:190662219-190662249
  hypo
accccggcacccccacgctgcactccacac

SEQ ID NO: 91998 - DNA, 30 bp, Homo sapiens
  chr4:190763878-190763908
  hypo
gaacacaccttgtcacgacattgagattca

SEQ ID NO: 91999 - DNA, 30 bp, Homo sapiens
  chr4:1958502-1958532
  hypo
tgtgtgcatgtggctcgttcagggagaagc

SEQ ID NO: 92000 - DNA, 291 bp, Homo sapiens
  chr4:1960087-1960378
  hypo
ggagtcagtcacatacggccagggctcagtgactgagccccaaacacgtagatcctgtacctcagagagcaagatggcggggcggcaggggagcttgccagttctgtgtttattccagtgagctcgagagccccagcaggaggaagtgcagccagggcagggctctgtgagagctccaggcccctcagggctgcctgcgctcagagctggtgcggcaagccgcatccccaggagcctcgtggccgttcctgacgagtgtttgtgataagtgtgtgccggaggtcaggtgct

SEQ ID NO: 92001 - DNA, 30 bp, Homo sapiens
  chr4:1960796-1960826
  hypo
gtcagagagatgggtcgggaagctgctcag

SEQ ID NO: 92002 - DNA, 80 bp, Homo sapiens
  chr4:1961324-1961404
  hypo
tgtttgagtgccacccgcaggtgtgtcccgcgggcgagttctgccagaaccagtgcttcaccaagcgccagtacccagag

SEQ ID NO: 92003 - DNA, 187 bp, Homo sapiens
  chr4:1976939-1977126
  hypo
tgttgacctaatacacgccccttagcttttgaagagaaaggcaggtgtttccaatttggtgtctgtctcctcttctcccagggacggagctgacttttaactacaacctcgattgtctgggcaatgaaaaaacggtctgccggtgtggagcctccaattgcagtggattcctcggggatagaccaaa

SEQ ID NO: 92004 - DNA, 100 bp, Homo sapiens
  chr4:1977425-1977525
  hypo
cccaggcctgtctcccgttcctggtggcggccacagtccttgctgctccttggcttgtagcagcaccgcccaaccattctccctgcgaacatgactgttg

SEQ ID NO: 92005 - DNA, 620 bp, Homo sapiens; identical to SEQ ID NO: 40207
  chr4:1993715-1994335
  hypo

SEQ ID NO: 92006 - DNA, 85 bp, Homo sapiens
  chr4:1994745-1994830
  hypo
cgtggctgcaggaagcgctgcgcacacgctgcctctggcagccgcacagcccggctgtttccagccagtgcggcctctccacagc

SEQ ID NO: 92007 - DNA, 98 bp, Homo sapiens
  chr4:1999785-1999883
  hypo
ggcaaggaaaacaaacgagcagaaaacgacaacagcatcaacaacaacaacaacaaccacaacaaaagcccccatccaagggtcagcagcctcaaaga

SEQ ID NO: 92008 - DNA, 30 bp, Homo sapiens; identical to SEQ ID NO: 40209
  chr4:2009272-2009302
  hypo

SEQ ID NO: 92009 - DNA, 466 bp, Homo sapiens
  chr4:20253509-20253975
  hyper
gcgccggctcaacttcggacttggtgttatttatttgggaagcgcccggacggcggagcttggcggcggcggtggtggtggctgccgcagactgtggttaaaaaaaagaaggcggcggcggcggcggcggcggaggcggaggcagctgcgaggcatgggagcgccgaagcgcccaggcgcaggccgaagctgccgcgctttctgggcacggcgggagtgctgagcagaaaggggagcgccgggggcccgcagccggctccggaggcgcgggccgggtttttgtttggctacgctgagcgccagtcagccccagcgaacaactccagttacgacaacaacccaccttccttccagacaagcgagacttgggctgctgcgtccgtcctattgtttagacacttgccaggggctccggagtcggcagagccaccgagtccccgctctgagtcgtcgccctccctctccc

SEQ ID NO: 92010 - DNA, 84 bp, Homo sapiens; identical to SEQ ID NO: 28836
  chr4:20254239-20254323
  hyper

SEQ ID NO: 92011 - DNA, 81 bp, Homo sapiens
  chr4:20254693-20254774
  hyper
ccagacatccttcagcgaagtgcatgtgtgtttgtaaaccatcgttggctgtcgggagaccgcgaggaccggtccaggctg

SEQ ID NO: 92012 - DNA, 94 bp, Homo sapiens
  chr4:20255026-20255120
  hyper
cgtgggatcagaggaccgccctccccacaacaaccggcccctgcatcttagcagccgttggaagccccagctcttttaccgccaagttcatcct

SEQ ID NO: 92013 - DNA, 41 bp, Homo sapiens
  chr4:20255327-20255368
  hyper
ctgggttgctagccccgccgggcactgggcctcagacactg

SEQ ID NO: 92014 - DNA, 762 bp, Homo sapiens; identical to SEQ ID NO: 28840
  chr4:20255524-20256286
  hyper

SEQ ID NO: 92015 - DNA, 195 bp, Homo sapiens
  chr4:20256382-20256577
  hyper
cgacccggcggtgcccggctgccccctccggcccttcctgctgaacccctgcgtccccatccacctttctggcagtttctgcgccccttcacgtggcagcagttcccctgccttcccctcttcgcgctccgttgctcgcagacgtccccgcctccctgtctttgcgagtctctaatgaagaagtaaatgcagacc

SEQ ID NO: 92016 - DNA, 89 bp, Homo sapiens
  chr4:20256841-20256930
  hyper
gctctgacccgcacgtctccacccgcgcagcccattgcacttcaagtcgcccttcttatccaacccatttctctcgcccttagttttaa

SEQ ID NO: 92017 - DNA, 30 bp, Homo sapiens
  chr4:2038336-2038366
  hypo
acaacatgttcagggcggccctcgaggaca

SEQ ID NO: 92018 - DNA, 7 bp, Homo sapiens
  chr4:2042116-2042123
  hyper
gtgggcg

SEQ ID NO: 92019 - DNA, 91 bp, Homo sapiens; identical to SEQ ID NO: 28702
  chr4:2042168-2042259
  hyper

SEQ ID NO: 92020 - DNA, 76 bp, Homo sapiens
  chr4:2042655-2042731
  hyper
gcagtcccagcttgtgccgggaagaccaccggccagaaccccgggggttgggggtagaggtcggctaggctgggga

SEQ ID NO: 92021 - DNA, 105 bp, Homo sapiens
  chr4:2043082-2043187
  hyper
tcacgggactgaaatcggcacagagaggccgaggacctgtggtcggggctccgcgcaagcggttctccggtctccgaggacaccgagaggcggagaggaggaccc

SEQ ID NO: 92022 - DNA, 30 bp, Homo sapiens
  chr4:2043417-2043447
  hyper
cagctccctcaggatcgctcctgacctgct

SEQ ID NO: 92023 - DNA, 182 bp, Homo sapiens
  chr4:2048726-2048908
  hyper
cctcggcccgccccccgccccgtctcacccgcagctccgttccaccccgccctgctccctcccaccgtggccagacccgcgccgtcctggggttcccctgggctgctcggcggctccccgcgcccctgttcttcctccccacggactcgggctcggggcgttcgcggcgggataggagcgcc

SEQ ID NO: 92024 - DNA, 171 bp, Homo sapiens
  chr4:2059984-2060155
  hyper
gtggaccagttcagccgcccctccccaccccaccagggcgctgcggcctcactcccacgtccacgggcaggcccagcccctcctggccttcaggtgacctcagctgcccggctggccccaactccaccgcacaacgcagactgcgggtccccaggcctggacccctggccc

SEQ ID NO: 92025 - DNA, 369 bp, Homo sapiens
  chr4:2060173-2060542
  hyper
cggggaagctctgctccggcagccctcggggtggtgctgggaggtcgcgcagaactgaagggggctaggttcgagaagcgccgaggatggggtctgcgaccgcctccccgcacctgagcttctccgccccagcctgcggcgtctgcaggtcctacaaggcgcagagcccccgctgcacctgcaccgaggccacggggcgcatgcgcggccgcggggggcgggggccgggccgggaggggtcctgcgggccccgcatccccgtgcccactgcggggctcggacaggggggcgccgcgccaggccgcagaccccgcccttccgcgtccccactccggctgcccgtgcggctccggacgaggcttcccgggg

SEQ ID NO: 92026 - DNA, 672 bp, Homo sapiens
  chr4:2061476-2062148
  hyper
tccgcgagttccgtgcggccgagcaggaggcggcgcgccgcatcttctacgacggcatcatggagcgcatccctaacacggccttccgcggcctgcggcagcacccgcgcgcgcagctgctctacgccctgctggcgggtcagtgcgccgggcccccggctgccgcagtccctcgggccggcgcggagctcccccgccccggcgtccacgcggaccccgcgcccggctcccggggaccagcctgggaagccccccgctttctgccgcgccgggccccgcgcagggctggctatgggcgtggggatgggcgcagggccccgagcgggccggagccggggagggtccggggtccgcacctgcgtccccgccgcgcagccccccacccccaccgcctcccctgtcccctcccgggcatcctgggtgggggcgggtgccagggcaggtagcgcccgccgcggctgggccccggcgagtgcctaaatataatctgcgggcgggggaggccgcctcccgctcggtgctaatttatgaggggaagacagccggcgccgcggggggtgcgcgcgcctggcacagccggggcggtcgcagagggcggccccttcagcgtctttgggtgcccttcccctcagagcttcctgccggggtgagggggttcgctcccattttaca

SEQ ID NO: 92027 - DNA, 712 bp, Homo sapiens
  chr4:2065587-2066299
  hypo
gtggactcacgtttccgaggcaagggcatcgccaaggcgctgggccggaaggtgctggagttcgccgtggtgcacaactactccgcggtggtgctgggcacgacggccgtcaaggtggccgcccacaagctctacgagtcgctgggcttcagacacatgggcgccagtgaccactacgtgctgccgggcatgaccctctcgctggctgagcgcctcttcttccaggtccgctaccaccgctaccgcctgcagctgcgcgaggagtgaccgccgccgctcgcccgcccgcccccccggccgccctgtccgcctttgcccgcctgcccgccgcccggcgcggcctgctttcagacgctcaattggcgtttgtgttgggtttccccttttcaacatcctgcggttgtctggctggttccggggggtgcggggctgttgttcttcggcgacactttggtgggggtgggttgtttgtcgccatagcccctcgcccttccccacctgcctgggcggcttgccacctgaagagtggcatcttggaccaccgcggctgtccatgacgctgccctgcccgccgccactggggaaggcccagccttgctcaccaagcacagaacctctgcagcagatcccggggccaggctccggccccgcctgcggccccagcgccactgcctgtggaggccccagctggccacggcgctgctttgctccg

SEQ ID NO: 92028 - DNA, 91 bp, Homo sapiens
  chr4:2129361-2129452
  hypo
ctgcccaacaaaacccgagcccatctgcctctggaattctctgtgagtgtaagccactcaggcaggatctttcacccgcagctcaagaagc

SEQ ID NO: 92029 - DNA, 209 bp, Homo sapiens
  chr4:21305986-21306195
  hyper
cgaggaaacatgaggcccggcgcggaggagatggctctgcgccccgggactctgcgcgccgcgccgccgccaccagtggctttgttgggccggccagttgccttggaaacaagagaacccaaggaagggctggactcctgctgcagacagggagcagagcaccgcaccttgaaatacggagaaaaacctgaaaacgctgagaggtggag

SEQ ID NO: 92030 - DNA, 278 bp, Homo sapiens
  chr4:21949877-21950155
  hyper
atgcataaacaacctcggaaattttcagagaaggcaaaagtacgcacaggatcgcaggggaccctgccaccggcgagtttcaaacacacttcaaacatcttttcttccccgacctggatcttgcatgcacccccctctcctttgcaccccattcctgccgctcccacctccccttcccagtcccgccaggtgactgtgtctcatgcagcgaaggcaacaagcgtccccagccgaggaagggaaggggcagccgtcttggctcgcgagggaaggagggc

SEQ ID NO: 92031 - DNA, 140 bp, Homo sapiens; identical to SEQ ID NO: 28844
  chr4:21950156-21950296
  hyper

SEQ ID NO: 92032 - DNA, 157 bp, Homo sapiens
  chr4:21950721-21950878
  hyper
cgaggtgacttcgggctgggcaggacacccccgggagttgccagcggctctcagcgggcgcctctaggaccccttgtcactgcgagcagcgcctgctctggggaggggctcgaaggcgccgcgccttctcaacgcgccgctgcgtcccccaggggct

SEQ ID NO: 92033 - DNA, 30 bp, Homo sapiens
  chr4:2251665-2251695
  hypo
tggcctgcctggccccgagagcccagccct

SEQ ID NO: 92034 - DNA, 30 bp, Homo sapiens
  chr4:22516841-22516871
  hyper
ttacttgcatcctcacgtggcaccgcgcag

SEQ ID NO: 92035 - DNA, 30 bp, Homo sapiens
  chr4:22622408-22622438
  hypo
aataagtaatagacacgataggtaagtaaa

SEQ ID NO: 92036 - DNA, 141 bp, Homo sapiens; identical to SEQ ID NO: 40213
  chr4:2278785-2278926
  hypo

SEQ ID NO: 92037 - DNA, 332 bp, Homo sapiens
  chr4:2288990-2289322
  hypo
agagcatctctcacccgctgggcgaccctgggcaggttatgtggtccagagctttgctgcctgagccacagacacggacagtaagatagccactgacgggtcagacaagtgagatcctctcagcggcgtgggtgcagtgcagatgcagcaagggcctcgggcctcacgtgcagcagccgtaggatgggctgaacgaatcctggcttaagcccctgaagggcctctgagtttgcagtcactgtttcaacatccagggaaagtgctttgcgaggaggcgttgatttgctgtattccttccacaaatcttcctttctctgcggtgactgacgtgg

SEQ ID NO: 92038 - DNA, 30 bp, Homo sapiens
  chr4:2290228-2290258
  hypo
gaggggacctgggcacgtggctgctgctcc

SEQ ID NO: 92039 - DNA, 333 bp, Homo sapiens; identical to SEQ ID NO: 40214
  chr4:2305585-2305918
  hypo

SEQ ID NO: 92040 - DNA, 107 bp, Homo sapiens; identical to SEQ ID NO: 28710
  chr4:2418673-2418780
  hyper

SEQ ID NO: 92041 - DNA, 44 bp, Homo sapiens
  chr4:2418988-2419032
  hyper
ccagggtgccaccctcggacgcccagatgcgccctggaccctgc

SEQ ID NO: 92042 - DNA, 146 bp, Homo sapiens
  chr4:24471691-24471837
  hyper
tgagtttcacggccccggggtgcaggtcggaggcacgcgcctggaaacttgtcctaacgcctctgactccaggactggggggcgcggcgctgccgaggatgcccgaatgccggccgggcttgtaccgggtgcgtggttcaagcctt

SEQ ID NO: 92043 - DNA, 209 bp, Homo sapiens
  chr4:24472371-24472580
  hyper
ctcgccgccgcctcccgctgctgctgccgcggcggcgggagcctctccaaggctccgggcggcccttatgtattattcactcggatggccgcagcgctttctggagagcccacgccggagaggtcttcacctggcagctagtagtttggcgatttgtttcttggaaacttggggtgatgcggaggcggcggcggcgaacatttttcggt

SEQ ID NO: 92044 - DNA, 407 bp, Homo sapiens
  chr4:24473331-24473738
  hyper
agggcacgatgcagccggactgcattgcacagtcatcaaagttaagtgtgtttgtggggtgcttctgtgccccaggggaggcgcggggtcaggaggagcggaggctccactctgcaccccaccccccccacctccgcgggtcaggggacgcctctacttgagattgcagccattttagggaaagaggcggctcgggccccgaggggagtggaggggggacagcacgtcgcggggggcttgcggctctgcagcccctcggcgcaactggaaggcgggtaggcgccgggcgcacaggggcgcggcgcccgcggcgacttggggaaggttgcgctcgagttccctggttctgcctggagttgttcggggtaacgcgccggctcctgcctctttctcgggttcccgctggg

SEQ ID NO: 92045 - DNA, 30 bp, Homo sapiens; identical to SEQ ID NO: 40275
  chr4:24535112-24535142
  hypo

SEQ ID NO: 92046 - DNA, 148 bp, Homo sapiens
  chr4:2459751-2459899
  hypo
gcctccctgattccacgttcccaaagagccaggaggcaccgccgccctcttctgcactcccggcctgaggcgcccagccgtctccctgtgccatggtctgacgctgtggctgcgcggggagggccggtgtggacgcctcttttctctc

SEQ ID NO: 92047 - DNA, 30 bp, Homo sapiens
  chr4:2460473-2460503
  hypo
gcagagagacggctccgggaggacaggtcc

SEQ ID NO: 92048 - DNA, 138 bp, Homo sapiens
  chr4:24801867-24802005
  hyper
cgcggcccccacccggcggcggccagggacccccgaggcccccctctgcctttgagcttctcctctgctccaacagacaccctccactctgaggtctcaccttcgcctttgctgaagtctccccgcagccctctccac

SEQ ID NO: 92049 - DNA, 398 bp, Homo sapiens
  chr4:24914406-24914804
  hyper
cccatcccgcctggccggcgccgcggcctcacctcgctcaccagcccctgccagtcgctctcagtccggtcgccgttcatggcctcctcctccatgcgctggccggcctcctggacccccgccgcctcctcctcctcgcgacgtcgcgtcgccgccgccgcccgggccccgcgcggccccgagagggcccggcgcctccgagccgctgcgccgccgcctctcgcggccgccagcgctgttgactccacgtcagcctccgccggagggaaagggaggaggggcgcggccgccggggccgcagacacagcccgggccgcagccgagccccgccgggcccgccccgcgccctcagccccgcgacctcgggctccgcgcctcctgcccggcctctaggcaag

SEQ ID NO: 92050 - DNA, 50 bp, Homo sapiens
  chr4:24967393-24967443
  hypo
ctccctgaaaagctgcgctctagtcaggagtaggccgaagcggccttctg

SEQ ID NO: 92051 - DNA, 89 bp, Homo sapiens
  chr4:25013961-25014050
  hypo
atgttgtcatagctccggaaattcatttcaatgtggtcccactccagcaccatgcagttctccatgctgggctgcgcgatggccacgta

SEQ ID NO: 92052 - DNA, 59 bp, Homo sapiens
  chr4:25032044-25032103
  hyper
cagaggcaactccctcgcggcggcggacgcagggtggggcgggacgggatgggggctgg

SEQ ID NO: 92053 - DNA, 38 bp, Homo sapiens
  chr4:25090356-25090394
  hyper
tccccgctcaggaaccgcagatgcgcccaaatgttcca

SEQ ID NO: 92054 - DNA, 69 bp, Homo sapiens
  chr4:25098014-25098083
  hypo
tgccactgcctccaacggcctgccctggccaactcccccaggggcgatgttgcccgtcccaggcaagag

SEQ ID NO: 92055 - DNA, 30 bp, Homo sapiens
  chr4:2514698-2514728
  hypo
tcaggaggccagggacgggactcttgtagg

SEQ ID NO: 92056 - DNA, 21 bp, Homo sapiens
  chr4:2526051-2526072
  hypo
agacttcgtctcaaaaaaaaa

SEQ ID NO: 92057 - DNA, 35 bp, Homo sapiens; identical to SEQ ID NO: 14672
  chr4:2527902-2527937
  hypo

SEQ ID NO: 92058 - DNA, 35 bp, Homo sapiens
  chr4:25377692-25377727
  hypo
tttatattttagagacggagtctggctctgttgcc

SEQ ID NO: 92059 - DNA, 92 bp, Homo sapiens
  chr4:2540246-2540338
  hypo
tagggtcttgggctgtagtcctggacttcagtctcccgagattgccctcatccagtatcctggagatcaaaacaggccgcagttcttgggat

SEQ ID NO: 92060 - DNA, 128 bp, Homo sapiens
  chr4:25656679-25656807
  hyper
ctgcccagcagtgcccggcacagaactggggagctgttgggataagcatgggggtggactctccctgggacagatcctatctcacagcagtttggagaactgttgtatacacacgcaggtgacacgag

SEQ ID NO: 92061 - DNA, 235 bp, Homo sapiens; identical to SEQ ID NO: 28849
  chr4:25657130-25657365
  hyper

SEQ ID NO: 92062 - DNA, 48 bp, Homo sapiens; identical to SEQ ID NO: 28850
  chr4:25657366-25657414
  hyper

SEQ ID NO: 92063 - DNA, 78 bp, Homo sapiens
  chr4:25657415-25657493
  hyper
gccagcctctttgcgcaacaccttcgccatatatacccggggcgctgcgctccacctggccgccgcctccagcccagc

SEQ ID NO: 92064 - DNA, 161 bp, Homo sapiens
  chr4:26030405-26030566
  hyper
gcctgggtgattttacgtgcggatgcagaggaggggcagcgtcggggcggcggagtccgacctcgggggattcaccctgagggttacaggcaaggccgctccaggcacgcagcacctgccgggcgccacccaggagggggcagcagcgccattcgcaaagc

SEQ ID NO: 92065 - DNA, 31 bp, Homo sapiens
  chr4:26030635-26030666
  hyper
cgtcccaggggacctccgccaggccagggga

SEQ ID NO: 92066 - DNA, 30 bp, Homo sapiens
  chr4:2626134-2626164
  hypo
tgctgggattataggcgtgagccactgccc

SEQ ID NO: 92067 - DNA, 30 bp, Homo sapiens
  chr4:26296591-26296621
  hypo
gaatcagggataaaccgtgaacccctggag

SEQ ID NO: 92068 - DNA, 60 bp, Homo sapiens
  chr4:2688393-2688453
  hypo
caaacaactcatggtcgtgtcttgaggagtccaggaggcacttaacgtagcttcagagcc

SEQ ID NO: 92069 - DNA, 52 bp, Homo sapiens
  chr4:27086432-27086484
  hyper
aaattgcaaagtaaacggcaagatgttgccgcgatagcgagcaggaaaatct

SEQ ID NO: 92070 - DNA, 90 bp, Homo sapiens
  chr4:27086750-27086840
  hyper
ggtcacttaaaggaacggcgctgactcagcgacagcagcgtggaggttgaatgtggggattagcactgagcaaaacgaatacaaaccttt

SEQ ID NO: 92071 - DNA, 30 bp, Homo sapiens
  chr4:2746348-2746378
  hypo
cctgtcccatgatttcggccaccaccggcc

SEQ ID NO: 92072 - DNA, 30 bp, Homo sapiens
  chr4:2763047-2763077
  hypo
agctgctgaggcctgcgtggtccactggcc

SEQ ID NO: 92073 - DNA, 449 bp, Homo sapiens; identical to SEQ ID NO: 28711
  chr4:2765778-2766227
  hyper

SEQ ID NO: 92074 - DNA, 30 bp, Homo sapiens
  chr4:2915308-2915338
  hypo
cccatctgtccctctcggagctctgtgtca

SEQ ID NO: 92075 - DNA, 114 bp, Homo sapiens; identical to SEQ ID NO: 40217
  chr4:2926282-2926396
  hypo

SEQ ID NO: 92076 - DNA, 52 bp, Homo sapiens
  chr4:2930363-2930415
  hypo
ctagaggtcccctcacgtgaccagccccgtgtagccccgggctgacccagtg

SEQ ID NO: 92077 - DNA, 247 bp, Homo sapiens
  chr4:2932839-2933086
  hypo
cagtgtacccatgaccgtgcccttctgccctggtgagcctgtgggaagaggcacagtcaggcaccactgcccttctcccgctcaggtggcttcggccgagggaagggggctcaccatagccagcgaccacggaggacaggcagggcaccacaacggcggcggctggtgggagacatcgaggaggtgcccgtcagcccaggggagggtgcatcacccagcccctgctgcccatcggatcccctgccag

SEQ ID NO: 92078 - DNA, 48 bp, Homo sapiens
  chr4:2978950-2978998
  hypo
gcaaaataccttcctcggtatgatgagtaacagcgcatactactgctg

SEQ ID NO: 92079 - DNA, 45 bp, Homo sapiens; identical to SEQ ID NO: 40220
  chr4:2987431-2987476
  hypo

SEQ ID NO: 92080 - DNA, 30 bp, Homo sapiens
  chr4:30718156-30718186
  hyper
acaggtttaagcaagcgaggttagtaggta

SEQ ID NO: 92081 - DNA, 30 bp, Homo sapiens
  chr4:30718953-30718983
  hyper
cccgtacccctaccccgcccatttcctttg

SEQ ID NO: 92082 - DNA, 250 bp, Homo sapiens; identical to SEQ ID NO: 28855
  chr4:30719374-30719624
  hyper

SEQ ID NO: 92083 - DNA, 184 bp, Homo sapiens
  chr4:30719850-30720034
  hyper
tccctgccctggcctcggaggaggagccaccacccctggggtgatgctactttcacagactggaaaatactcgccagctccctgacacacacttagacacacttccatccaacgggcatctacgatcccctgtagggagagcttggaaatctctgccgcctctccctcctcattcctgttcctg

SEQ ID NO: 92084 - DNA, 367 bp, Homo sapiens; identical to SEQ ID NO: 28857
  chr4:30720054-30720421
  hyper

SEQ ID NO: 92085 - DNA, 303 bp, Homo sapiens
  chr4:30720644-30720947
  hyper
ccaggcgcgcacacacggtctacccccgcaagcaagcacgacgacaggaatgtcaagcatttaaacaaagacagacatccttcaccctccacccaccgccgcccctgccccccgcaaccatccaaagtctgagctcccaaaaaaggatctttctccagctctctggagtttgatgttctctcttcactactgcagcccgtcatggtttttcagaacagagtggctttctgggcgctcgtaggttccccaggaccccgataaccatgtcctaaccaagatcctaaatcgcgaaccggagacact

SEQ ID NO: 92086 - DNA, 223 bp, Homo sapiens
  chr4:30721247-30721470
  hyper
cgggccctcctccctcgctctctcctagtgtgtagtttcggcggctcggctgctactgccgccgccgctgcagcagcagcgtcagggacaagcctgatccgtgagcgagcgagcacccagcagcaaccaccactttgggcaacttgcgggtttcctgctcgcgggtagcgaacgggagattcccactagcggttcagtgtctccgagccgctgcagcccgagg

SEQ ID NO: 92087 - DNA, 30 bp, Homo sapiens
  chr4:30721945-30721975
  hyper
gggatcgagagagagcggggagagagaggc

SEQ ID NO: 92088 - DNA, 172 bp, Homo sapiens
  chr4:30722839-30723011
  hyper
aaaagaagcatctatcgctgccctcccacccccattcccggccaactctccacgccgcttttgccccctccctcccctccctctcgctccttcctttccgggagaggggagaggactcgggggagggcaggcggccggccccggaggaggggggcgccgagggggctgtggt

SEQ ID NO: 92089 - DNA, 322 bp, Homo sapiens
  chr4:30724216-30724538
  hyper
gcagccccccaagaccgacaaggccaccgtggtccttaacatcaaagacgagaacgacaacgtgccgtccattgaaatccgcaagattgggcgcatccccctcaaggacggggtggccaacgtggccgaggacgttctggtcgacacccccatcgctctggtgcaggtgtccgaccgagaccaaggcgagaacggggtggtcacctgcaccgtggtgggcgacgtgcccttccagctcaagccagccagcgacaccgagggcgaccagaacaagaaaaagtacttcttgcacacctcgacccctctggactatgaggccacc

SEQ ID NO: 92090 - DNA, 30 bp, Homo sapiens
  chr4:3177345-3177375
  hypo
gcacaagcatttgcacgcttcccctcttga

SEQ ID NO: 92091 - DNA, 54 bp, Homo sapiens
  chr4:3252743-3252797
  hypo
ggcaggccccaaagccgggacctagggtgctgagcatgacggatgttgggtttg

SEQ ID NO: 92092 - DNA, 187 bp, Homo sapiens
  chr4:3285790-3285977
  hypo
cttgagccccaggggcggcatgagcaatctgctgggctggctgaagcccagctcaccctggccaatgggaagcgccagcaggatgccctggaggggagggctgaagggcgggtgtgggggtgaatctgtgtgtgctggctgctcagctgctccctaaactaccccaccgccccgctgggcgacatta

SEQ ID NO: 92093 - DNA, 134 bp, Homo sapiens
  chr4:3286580-3286714
  hypo
gccaatgaccttccacggtgtgggtgggcctcatctgagcagttgaagggcttgagaggaaaaaggctcccaaggaggagggaaggctgccagcacggtgctctggacttgaggggcggcggcagctcctcccc

SEQ ID NO: 92094 - DNA, 167 bp, Homo sapiens
  chr4:3292632-3292799
  hypo
ttgacaccttctctccgtctcaggcaatttctccccacttctgggggccctggctttcacggggatggactagggtgcttcctcccacagaaacagcttcttgggccacccccctgctgggcatgagttctctcacaggctcggtgacccctcgtatgagctgctcg

SEQ ID NO: 92095 - DNA, 32 bp, Homo sapiens
  chr4:3301969-3302001
  hypo
tggagacagcagtgccgcgggctctgctgagc

SEQ ID NO: 92096 - DNA, 616 bp, Homo sapiens; identical to SEQ ID NO: 28663
  chr4:330715-331331
  hyper

SEQ ID NO: 92097 - DNA, 57 bp, Homo sapiens
  chr4:3310494-3310551
  hypo
tttagctctgggaagcggctggcgccgttcagggctgggagccgctctgtcaggatt

SEQ ID NO: 92098 - DNA, 144 bp, Homo sapiens
  chr4:3313229-3313373
  hypo
gaaggagtgacagtgcgggttgagcatcccttatccagatgctccagaatcggaaaccctctgacaccgatgtggcacctcaggcatagctgagctagtgacacctttgctttctcatgggtcagtgtacacaaaccttgtttc

SEQ ID NO: 92099 - DNA, 203 bp, Homo sapiens
  chr4:3313433-3313636
  hypo
atatgaaacataaatgaatttcctgttcagacctgggtcctatccaaacatatctcattacgtatatacagatgttccgaatcagaaaaaatccacagcccttctggtcccaaaaatctcttctaagggacactcagcctgtgtgacgtggtcggtgactcctgatgggaggtggcagtgctgtgcggcgagtggggaccttc

SEQ ID NO: 92100 - DNA, 736 bp, Homo sapiens
  chr4:331562-332298
  hyper
cagccagagaggaggcggtggcttccgggatgtggcgcgggtctttgcgtctggctactaccagaccgcgggttaggggcttcatctctctgcgttctcagttgtgggaggccttggtgattcggccacagctcagcctccgtcgctctgtgacctgcgggtattggatgattggtagctaagactcccgaatacttcagaagtggggaaatggtgagtgtgcggggcagggcgtcccaaggctgaggaggtctcatcggagctggcgggaaatggcggcgggaccgagtctgcgaacggagtccccgctgccgccgctcagccctggggcctcagtaccctccggtgagggacctgggctcctgtcggtccccgcacagcggctctggcccagcctgcagccctccttgtgcagctctgcgcccgcagccccgcaccttccccaggctgtggggtgaggagtagcttatctggaagccgcccgcgcggcgtgcgcgatgccggcgtgggaggagctgtgggagaagctgtggtctggggatcccgtccctgctttaccctgttcggaatgagatcgaggccccatcaaaacagagttcatgtgagcaaatggggactcattaatgggacagcgccggccgtggctcgtggtttgggggctgccagcgggtcttgaaggaaaagcttttgtgaggtgtgtgaggaagcgaagcaaatcacccgcccgctccaactt

SEQ ID NO: 92101 - DNA, 30 bp, Homo sapiens
  chr4:3417466-3417496
  hypo
tgggctagcatcgcccgggtctttgggaca

SEQ ID NO: 92102 - DNA, 44 bp, Homo sapiens
  chr4:3418235-3418279
  hypo
ctgtgcatgtcgctgcggcacgtgggtcacgttcacagaagcat

SEQ ID NO: 92103 - DNA, 30 bp, Homo sapiens
  chr4:3425872-3425902
  hypo
gcgtggggtggtgaccgcaggtgctgggca

SEQ ID NO: 92104 - DNA, 33 bp, Homo sapiens
  chr4:3441235-3441268
  hypo
atcttgtaactggctcggcgcccgggcgggatg

SEQ ID NO: 92105 - DNA, 336 bp, Homo sapiens
  chr4:3445886-3446222
  hypo
aggtgagctgggcctcggaggtccgcaggggtccaggggccggagcaagtccccggaggatgggagaacaggtggctcccgagtgcagggcaggggccctgcacggggacagcaggtggcagggtgtgagggcttactgtgcacccctcagagaaatgctttgatgagacccgctacgagtacctggaggggggcgaccgctgggcccgcgtgcgccagggccacgtggaacagtgcgagtgcttcgggggccggacctggtgcgaaggcacccgacatacaggtgcgccacggggtgtgagccgtgccactgacccctgacgggtgtccctgtcc

SEQ ID NO: 92106 - DNA, 727 bp, Homo sapiens
  chr4:3446443-3447170
  hypo
acggctctgcaacatcggtgagtgggtcagccccccggggtgccctggggcagtgccgggtggacccaccgtgggccggcctcactgcccctctgcccgcagagcctgatgagcgctgcttcttggggaacggcactgggtaccgtggcgtggccagcacctcagcctcgggcctcagctgcctggcctggaactccgatctgctctaccaggagctgcacgtggactccgtgggcgccgcggccctgctgggcctgggcccccatgcctactgccggtcagcaccacgccgctccaggccgccgcatgcggggcaggcaggatttgtcctggggagaggccccccggctccctaggacccaggcggggccagctccgtccagacaggccccggaacctctgcctgggaggctgcccgagggagggccactctcttcccactgctccaggtgcggggaaccgccctgctgggggttccgatgccccctccccatgccctcttcgaggggcagtgtgactccctgccagcccccacttatgcaccgcaggaatccggacaatgacgagaggccctggtgctacgtggtgaaggacagcgcgctctcctgggagtactgccgcctggaggcctgcggtgcgcggctggcggggggtgctgccttgggccccaccgaggtcacagcagttttccccgtgatcctcctagcccctccgcacacctggctac

SEQ ID NO: 92107 - DNA, 235 bp, Homo sapiens
  chr4:3447780-3448015
  hypo
gagtccaactgtcaccggatctcctggcgaccctgcctgagccagcctccccggggcgccaggcctgcggcaggaggcacaagaagaggacgttcctgcggccacgtatcatcggcggctcctcctcgctgcccggctcgcacccctggctggccgccatctacatcggggacagcttctgcgccgggagcctggtccacacctgctgggtggtgtcggccgcccactgcttctc

SEQ ID NO: 92108 - DNA, 30 bp, Homo sapiens; identical to SEQ ID NO: 40229
  chr4:3449723-3449753
  hypo

SEQ ID NO: 92109 - DNA, 30 bp, Homo sapiens
  chr4:3465854-3465884
  hypo
ccaggccgcctgcagcgctgggcctgtagg

SEQ ID NO: 92110 - DNA, 195 bp, Homo sapiens
  chr4:3467304-3467499
  hypo
cctttctcctccttgcgtttttctcaatcgtgagcacgtctttctgttatgacaaggtttagcgaatgaaagggaaacccttttatcaaagggctgctcagccacagcgcctggcatggccagtggacgtcgggccgtctgcctcggtgtgggactgcagggtgccctgcagtgggaccacgttcctcaatgtct

SEQ ID NO: 92111 - DNA, 326 bp, Homo sapiens
  chr4:3475077-3475403
  hypo
aagggtgcgggcaggcggtgttggctggcgtccctgacggccacgctccttgcagactgcctgctgatgctggtctacaaggacaagtcggagcgtatcaagggcctgcgggagcgcagcagcctgacgctagaggacatctgcgggctggagcccggcctgccctacgagggcttggtccacacgctggccattgtctgcctgtcccaggccatcatgctgggctttgacagccacgaggccatgtgtgcgtgggatgcccggatccgctatgcgctcggcgagggtgagtgacgggggccggggccgggcgggggctccccgtt

SEQ ID NO: 92112 - DNA, 58 bp, Homo sapiens
  chr4:3479511-3479569
  hypo
atggatgggcagggccgctgcctatgccagctgtgagctggtgcggggggtggggtgg

SEQ ID NO: 92113 - DNA, 53 bp, Homo sapiens
  chr4:3534408-3534461
  hyper
gcctcacccagagcccggagcctggagcccgcacgactcgaggcctctttccc

SEQ ID NO: 92114 - DNA, 17 bp, Homo sapiens
  chr4:3565396-3565413
  hypo
caagactgtgacacacg

SEQ ID NO: 92115 - DNA, 155 bp, Homo sapiens
  chr4:35962570-35962725
  hypo
tttttatttttatcttttaattccatttactccatgaacttttcgaagtctccttttacattttttctccatgtcttttcatggccgaatagctaatttctttttagttttaagtaatattcgtttacatgaatgcatcacgctttatttattca

SEQ ID NO: 92116 - DNA, 133 bp, Homo sapiens
  chr4:3603530-3603663
  hypo
cagcgctggcccaggcgccttggcaggggaccggctgcacctgcttctctcttctctctccccctcccacttccccatcaggaactgggtcctgctggctcagggtagactgccatggcgacaaccacctctg

SEQ ID NO: 92117 - DNA, 142 bp, Homo sapiens
  chr4:3609066-3609208
  hypo
caagcacatcttccacggccctcaccccacgcagctgccctgcccctcaggctcttcctcagcctgctggaagctggtgcctcagggcctttgcacttgctgcctggaacaggattccctgtgtccacgtggctccctcccc

SEQ ID NO: 92118 - DNA, 30 bp, Homo sapiens
  chr4:3616292-3616322
  hypo
ccagcccccagtccacgaaggagaagcaac

SEQ ID NO: 92119 - DNA, 30 bp, Homo sapiens
  chr4:36206328-36206358
  hypo
caggccgggcacggtcgtttatgcctgtaa

SEQ ID NO: 92120 - DNA, 18 bp, Homo sapiens
  chr4:36311031-36311049
  hypo
gatcgcaggttgcagtga

SEQ ID NO: 92121 - DNA, 30 bp, Homo sapiens
  chr4:36345308-36345338
  hypo
ttcaccgacaaacttcgcctcctggctcga

SEQ ID NO: 92122 - DNA, 207 bp, Homo sapiens
  chr4:36418721-36418928
  hypo
aggaaaaattaagcacgcagatattgaaaagtgaatggagtagaatttattaagcaaaaaggtaagctctcagagaaaagacgggtcctaaaagcaggttgttggttgcccccttcacagttgaacacaagggcttttatatatccgctgatggggctgggttccctaggtgtataaagcgccaattcctggcggctccaccctgtt

SEQ ID NO: 92123 - DNA, 30 bp, Homo sapiens
  chr4:3652102-3652132
  hypo
cgaaagcagggacagcgtctctcattcaca

SEQ ID NO: 92124 - DNA, 30 bp, Homo sapiens
  chr4:3654274-3654304
  hypo
gtgcaccggtaaaggcgagcagctggtggg

SEQ ID NO: 92125 - DNA, 61 bp, Homo sapiens
  chr4:3664470-3664531
  hypo
cggtcccacctgctccggcgccccgtggctgctgtcttcttcctttcgaaacaccctggag

SEQ ID NO: 92126 - DNA, 77 bp, Homo sapiens
  chr4:3690825-3690902
  hypo
gccgtggcctgagagcgtccccagaggctcacgcggtggaagctggatcccacggccggccgcggtgctgaggggtg

SEQ ID NO: 92127 - DNA, 184 bp, Homo sapiens
  chr4:3702485-3702669
  hypo
tttggaatctaagagcgttccagcccttagtaatcctcagctgcgtgggacttggcccttcctgatgcgatggcctggggcaattgttctgtttgtggggtttgctgccagcctcacctctgtaccctccctggaaccctcccaccccaccttcagtgagcggtggaagcggcaaggcccccgt

SEQ ID NO: 92128 - DNA, 45 bp, Homo sapiens; identical to SEQ ID NO: 2391
  chr4:37245537-37245582
  hyper

SEQ ID NO: 92129 - DNA, 525 bp, Homo sapiens; identical to SEQ ID NO: 2392
  chr4:37245836-37246361
  hyper

SEQ ID NO: 92130 - DNA, 211 bp, Homo sapiens; identical to SEQ ID NO: 2393
  chr4:37246489-37246700
  hyper

SEQ ID NO: 92131 - DNA, 223 bp, Homo sapiens; identical to SEQ ID NO: 28865
  chr4:37247015-37247238
  hyper

SEQ ID NO: 92132 - DNA, 148 bp, Homo sapiens
  chr4:37247293-37247441
  hyper
cgaggtgagttccttgagactctcctcctgcaggtgcgatggtgccctttgcagaggccaagcagacttttgtgaaccggaggtcgagggggacaccctctgtgggtcccggaacaggcttcgcggtggggcgcgcaggatgggctca

SEQ ID NO: 92133 - DNA, 55 bp, Homo sapiens
  chr4:37455430-37455485
  hyper
gccgcatcctcggggcgtgcaggtaaagggttacgcgtgtcgggaaggctcaccc

SEQ ID NO: 92134 - DNA, 912 bp, Homo sapiens
  chr4:3767295-3768207
  hyper
gcgcgcgcgcgtgtgcgcgcccccgcctgcgcccatgcctgcgccgggggaggcgaaggaggctccagtcttagaaagagcagcttctggaactcaccacccaggccggccgccgctcggccccgtcccgcaggctgcaggcggccctggagggggcgccctcgccgagcgcgcgccccgcgccgccgccccggactcctccccggcgccgcgcgggcaggttcgaccaggcggccgcgggctccggttcccggccagctccccagggcccgcggcccgccccgccccgcgcgcccgccccgctgcgcaactcgacccaagttggaagccgatcgcaggcggccgcactcgcgcccagcgcagggcggcggcggcggcggcggcgcagctccggcgagcgaggcggcggccgcacggccaagcgtggaccgcggggggcgcccgcgcccgggagcagccggaggactcgcggcggcgccggcgccccgcccgggaaagtaaagttggagacggagggagcgcgcgggcgcgggggcccggaggagcggcggccggcgccccggcgcgccgagccctagccggccggatgggaggcggagcgcccgggccgccgccgcctgtcgcctgcgccccggctgggctccgggaccgcggggccgctcaggcacgcccgctcgggcgccgcgtcgccgtgggctcgacgccggggcgctccccgtgagccgggccgagggcggggccgcgcgaggaccccgggacctgcccccctccccccgcagccgcgtcgccgctcgctccgggcgcctcctgctctgcacttacacgctcggcagctgcggggagcccggcagccacgctctccggcgcgccgcccgcggagccaccacggccgagggccggctgctgggcgcc

SEQ ID NO: 92135 - DNA, 132 bp, Homo sapiens
  chr4:3768818-3768950
  hyper
gcgcacaccacgccgcgtcaaggccaccatcgtggccgtgtggctcatctcggccgtcatctccttcccgccgctggtctcgctctaccgccagcccgacggcgccgcctacccgcagtgcggcctcaacga

SEQ ID NO: 92136 - DNA, 196 bp, Homo sapiens; identical to SEQ ID NO: 28715
  chr4:3768994-3769190
  hyper

SEQ ID NO: 92137 - DNA, 63 bp, Homo sapiens; identical to SEQ ID NO: 28716
  chr4:3769559-3769622
  hyper

SEQ ID NO: 92138 - DNA, 30 bp, Homo sapiens; identical to SEQ ID NO: 40234
  chr4:3782694-3782724
  hypo

SEQ ID NO: 92139 - DNA, 270 bp, Homo sapiens
  chr4:3783050-3783320
  hypo
cgaaacacctccgcccgcaagaaactcctcccctcacatgaaactcctcccctcacacgaaactccctcctcacatgaaactcctccccacacacgaaactcctcctcccacatgaaactcttccgccacatgaaactcctcccctcacatgaaactcctccccaccacacgaaactcctcctcccacacaaaactcctccccacgtcttcctcccacacgaaactcctccccacaccaaactcctcctcccgcacgaaactcctcccct

SEQ ID NO: 92140 - DNA, 30 bp, Homo sapiens
  chr4:3783791-3783821
  hypo
tgcagtgaagccactcggccccaggggcct

SEQ ID NO: 92141 - DNA, 77 bp, Homo sapiens
  chr4:37892223-37892300
  hyper
caaggacagggtgtgcgactgtacatcccgccacgagggcctgcatcacgcgcggggccccgcgcccccggctcccc

SEQ ID NO: 92142 - DNA, 53 bp, Homo sapiens
  chr4:379992-380045
  hyper
cctcagggaggcctccgtgattcggcctcagcctccgtcgctctgtgacctgt

SEQ ID NO: 92143 - DNA, 207 bp, Homo sapiens
  chr4:380356-380563
  hyper
agctcatctggaagacgccgacgcggcgtgcgcagtgggcgcgtgggaggagctgtggtctgggggtcccgtccctacttgacctgttcggaatgatgtcaaggccccatcaaaacatagagttcatgtgagcaaacggggactcattaatgggacagcgccgaccatggctcgtggtttgggggctgctggcgggtcttaaaggaa

SEQ ID NO: 92144 - DNA, 30 bp, Homo sapiens
  chr4:3864547-3864577
  hyper
agggggaaacatcttcgcgtttcatttcct

SEQ ID NO: 92145 - DNA, 30 bp, Homo sapiens
  chr4:38650068-38650098
  hypo
aggcacagtggctcacgcctgtaatcccag

SEQ ID NO: 92146 - DNA, 771 bp, Homo sapiens
  chr4:3873077-3873848
  hyper
cagtagactggagggcgatcgcgggctccaccgggagggagcagctgtgcgccttgacgtaaaatccccaccctggctccaatggcccgcacctgccctggggtgcgccggggtgggctccgcggggacatcacgagggtgagcaacggggaggagcctcgaggagcccatcccttcggcaggtggtgggggcccggatctgggtctacgccgccccacctccctcctggccacaccgctgcggagaaggtgccgcacctgcgcgaccgctgcctggccggtctagagcccaccgcggtggagcgtcagccctcctgagtggcggttcctgtgggcgggacgcctgggttgccatggagaccgagagcccagccccgcggagccccgggtgtgcaccgggacaggaagccgaaagcagagcgggagactcgacttgcactttaataggctctcccaggagccgttgtccagagggagcggggttcgcggggctggcggggacgtggcggggcggtggaggggtgagggggaggggaaggacggcggcgggggcgggggaggtgcacggtggggccgcggggacggggcgggggcgtcgcagggcgagtgcgcgcccccactgccatccaggccgtcgcggcgcggctcgaacactcacagaggaagcacctactgtgcgccaaccctgcgcccggcagcgtgcgggagacagaggggaacccagtacttccctgccgtgggggctctcggtgggctcgaggtcatgtcctg

SEQ ID NO: 92147 - DNA, 32 bp, Homo sapiens
  chr4:38732941-38732973
  hyper
agggaggcccaggcacgcggagcttctagttc

SEQ ID NO: 92148 - DNA, 154 bp, Homo sapiens; identical to SEQ ID NO: 28718
  chr4:3882096-3882250
  hyper

SEQ ID NO: 92149 - DNA, 116 bp, Homo sapiens; identical to SEQ ID NO: 28867
  chr4:39047287-39047403
  hyper

SEQ ID NO: 92150 - DNA, 147 bp, Homo sapiens
  chr4:3925878-3926025
  hypo
ttgtccataaaatgccgattggacacttattgtagaatgccgagggcactgtagattcagatagtccccatcacaggcataggtggtgtggttttacaggagtttggttaggtaacctggaaaatattcagtcgggttacaagaggc

SEQ ID NO: 92151 - DNA, 234 bp, Homo sapiens
  chr4:39448261-39448495
  hypo
tcaccctgtattatccgacccacgcccacctaggcctccccgagcctctgttgcatgccgacgggtggctgaacccatcgacggccgaggccttccaggcctacgctgggctgtgcttccaggagctgggggacctggtgaagctctggatcaccatcaacgagcctaaccggctaagtgacatctacaaccgctctggcaacgacacctacggggcggcgcacaacctgctgg

SEQ ID NO: 92152 - DNA, 30 bp, Homo sapiens
  chr4:39697732-39697762
  hyper
gtgcccccactgattcgcctccattggcta

SEQ ID NO: 92153 - DNA, 26 bp, Homo sapiens
  chr4:39790045-39790071
  hypo
tttgtattcttaggccgggcttggtg

SEQ ID NO: 92154 - DNA, 145 bp, Homo sapiens
  chr4:39816644-39816789
  hypo
tccccaaatacaaaacgggggctcaggtactggctgggcaagaaaagacgagaaagttttcctgtcgatgtggcctcttggaggctgaactgtgtggcaatgtaactagaaactggagactttatttatttatttattttttctt

SEQ ID NO: 92155 - DNA, 24 bp, Homo sapiens
  chr4:39817089-39817113
  hypo
cgcccagcccgaaactggagactt

SEQ ID NO: 92156 - DNA, 30 bp, Homo sapiens
  chr4:39860480-39860510
  hypo
gtgatccactgtgcccggctgaaaacacag

SEQ ID NO: 92157 - DNA, 30 bp, Homo sapiens; identical to SEQ ID NO: 40281
  chr4:40479216-40479246
  hypo

SEQ ID NO: 92158 - DNA, 100 bp, Homo sapiens; identical to SEQ ID NO: 40282
  chr4:40533094-40533194
  hypo

SEQ ID NO: 92159 - DNA, 30 bp, Homo sapiens
  chr4:40543284-40543314
  hypo
aaaaaaaaaaaaaatcgcatcaaatttact

SEQ ID NO: 92160 - DNA, 206 bp, Homo sapiens
  chr4:40910280-40910486
  hypo
actgtgagaaaagaacgtttctgtagttgaagccacctcgtctgtggtattttgttatggcagccccagccaacaaacacacggtggtgtatacacttcaggtaaccatgagcatatggcagagctggcagtgaagcctgagtttgtgtcctgacacattcctgtcaccgcgccttgctgcctcctaggtgcggcaacaatgctgg

SEQ ID NO: 92161 - DNA, 73 bp, Homo sapiens; identical to SEQ ID NO: 360
  chr4:41258716-41258789
  hyper

SEQ ID NO: 92162 - DNA, 765 bp, Homo sapiens; identical to SEQ ID NO: 28869
  chr4:41259085-41259850
  hyper

SEQ ID NO: 92163 - DNA, 81 bp, Homo sapiens; identical to SEQ ID NO: 40284
  chr4:41314285-41314366
  hypo

SEQ ID NO: 92164 - DNA, 459 bp, Homo sapiens
  chr4:41362304-41362763
  hyper
ggactgcaggtgctgcgcggccagtgcccgcgcgtcctactgctccggtgccgcagcgcccgctcccccgggcccgggtgcgccccactgggcgcgcgtctcccatatgatgccagacccatccgcccgcccctcagcagccggcggggcgcagggacgtgcggggcggccagcggattccctctatcgggccgggtgtgaacgggagggagacacgcagcgctcgctccgggttatttttagtccgtagctgtgctccccctccccgggggcggagcggccctcgaaggtggggaggagaagaagctcccggcgcctccgcgctcgctcccgcgggtcactcacggcgcgttggagcccgggcggcgccgggaacagctgccgcggcgtcctctagcagcgcgcggctctcccgggacctgcgccggccgggggcggggagaggcggggaggggaggc

SEQ ID NO: 92165 - DNA, 387 bp, Homo sapiens
  chr4:41362780-41363167
  hyper
cggggagcgcgctcctgcggcggcgacggcggcggccgtcctcatcccggcgcttgagaggacgcggggctgcgcaaatggcttgtcccgctctcggtctggaagctcttcagcccctgcagcccgagccgccccccgagcccgccttctccgaggcgcagaagtggattgaggtaggtgcgggtggctggcgggcggccttgcactggcgccctgagccacggacccgcgcacgctccgaccgcaggtccagccttgcctccccccaaccgcccccactttcttttgccagctgctccaggtcacccccccgggcctcggcgagccgcgaaaccttagcgctttggcattggaatcccgggcgagggtgggcgtgaaaggggacac

SEQ ID NO: 92166 - DNA, 429 bp, Homo sapiens
  chr4:4144902-4145331
  hyper
gctccggggctggggcgcgtgctaggggcccgcggggtttcagctgtattttcgaacccctgtgcttggccgaggggttcccaaggctccactccgccttggagggggctgcggaagcccggaggtgacacgggctctgggaggggcgtccccaacgtgggggaggggtgacaggggcctttgaagacagcgcgggactaggagggggtgcccccgacctaagtcgtggtaaactgaggccggcgaggagggaggctgagtccggggaccaggcggcccctcgctgctcctcgggccagtcgcccccctgcgcctgttcgtacgggcagggccggcggccgagtccagcgggctcggggccaggccggggtcccgcgggcggcgcctcctcctccgcggcgtccccatactcgccctccgcgtcgctct

SEQ ID NO: 92167 - DNA, 67 bp, Homo sapiens
  chr4:4145386-4145453
  hyper
cgggatgtggggctagcgcggggccatgccccgccgcagcttctgctccatccgcaggtaggagacc

SEQ ID NO: 92168 - DNA, 415 bp, Homo sapiens
  chr4:41746821-41747236
  hyper
ggaagaagaaaatgccgacggggtaggcgggagcgagggggaaaaaaagagttgcgaaacatgagacacattttgcagagtttgcagatgaaaaggcatctcatggatagggcatctttcagggccgaacggctgcaaagattcggggttgggagttgcaactgtgtggggttccgatgcgctaatggcgggatggtgttcagcgaggtgggacaggcaagggggtgcgagaaagtcactccggccgccgggacagtctgagcaagtcgtcgccgcagtgacccgaacccaaggacacgataggaaggggggctggaacggcgtccctactcttccctgaagaagagccccaagagaatccgtgctgttaggagggagcggatttaggggttcacaagatcgagccttcagctcc

SEQ ID NO: 92169 - DNA, 324 bp, Homo sapiens; identical to SEQ ID NO: 28873
  chr4:41747445-41747769
  hyper

SEQ ID NO: 92170 - DNA, 124 bp, Homo sapiens; identical to SEQ ID NO: 7338
  chr4:41747888-41748012
  hyper

SEQ ID NO: 92171 - DNA, 624 bp, Homo sapiens; identical to SEQ ID NO: 28875
  chr4:41748143-41748767
  hyper

SEQ ID NO: 92172 - DNA, 691 bp, Homo sapiens
  chr4:41749079-41749770
  hyper
ggcacttcctgtccccgaaattgcatcgctcatccacgtcccaaggccccccatgtctctgctcgggtgggaaacacttcgcaactgtaaataaaatgccaagagcgtgcgctctaagcctctctcgaacgcacagccacaccaaatccagtatttctgatcggccatggggccctaggtccttctcactcgaggctccaggacttcgaatttcaccagccgcccctcaccccacacctccccggaccagtgcggcggagcggggtcggtttccaggcgcgcgtacctggactcgcgcctctgtgaggtcgatcttcagggccagctcctcccgagtgtagatgtcggggtagtgagtctccgcgaagaccctttccagctctttgagctgggcactggtgaaagtggtgcggatgcgccgctgcttgcgcttctcgttgaggccgccgtggtccgtgaagagtttgtaaggaactagagtatgacagaggagacagaaagtgagcaaatcagccggcagctcgccggccgtggagctagaatgtgaggactccaaggtcaggtcatacggcagccgctacctacacccgcgcgagagagttgccgagagaagctgcgggaagaaaccgaggaaatttgttatctgcggaaacctgggctcaaacttcgggcttggcggagtcctttctgg

SEQ ID NO: 92173 - DNA, 497 bp, Homo sapiens; identical to SEQ ID NO: 28877
  chr4:41750102-41750599
  hyper

SEQ ID NO: 92174 - DNA, 37 bp, Homo sapiens
  chr4:41751372-41751409
  hyper
gggggtttatgtgaacgataagcggatttctttaaaa

SEQ ID NO: 92175 - DNA, 181 bp, Homo sapiens; identical to SEQ ID NO: 28879
  chr4:41751719-41751900
  hyper

SEQ ID NO: 92176 - DNA, 1400 bp, Homo sapiens
  chr4:41752312-41753712
  hyper
gctctcccctgccaccgtgttttattgcgcactaaactgccgcggacgcagtaatggattaaacggggacagcggtcccccagccttgtgcttctttgcagggtgagtttcaggctcgtttcaggtggttgcaaatcctcggggcgtgaggaagcgctaaagtcgggagtgcagggagccggacctaccgaggatcctggtgatagttttatggggagggctgatagttttattgcagttgtatgttgtacaatgcgtatttgataaagaagggcccttggtgaccagtgtgcacttttttgtgcacgggggtgaaatgaaaataaatgtatacaaggttttactgcggcgggaaacaaattgcaacgctctaaatggtttttctttatggtcaccagacaagaggagaaaagggatgcaaacatctgtcttcagtcccctaaacctaaaggccagcaaagacggatgcgaatccaagtgctattacagcggagatttgtctttatttatcccgctctcatgaatatgaatttgcatttgggccgggaggtggctgtatccctttggactccacacatggaatttcccccacgctcatccccctccccaaccacttaagggaggtgggggataggttgtcaagcacaaggctgagatcgtccaagtttcttcgttccctcggatttcgggttgggggatgtgcttgctggttttctgaacgcaactctgccgccgaggcctgcactcaggagatgtggatgtagggagcacaggccggggtgtccaccgccagcccgctcctctgctgtagggtttaagcgcgtttccctgcagaagagagtgaccaggggtggtcaggaggtgatgaatttcggctccaaggcctatttttgacagtaaccaggttcacaccccgcttggcactagagccttactgcacctggggtgtgtctccgcgtggtgcagagcgcgcgctctactccggaagctacggccgggtgccgcgccaccgctgtgcgccctgggcctgatccctacgccctagtcgagtgcagggcagggcaatttcgccgtgggtcctagtttgctgacagttcccaggcccctttagcttttggggaggaggcgagactaggacctaaaaagtgctgggagctcggagtagaggggttcatgttgccagtttctgaggattgctcttaggtgaagatgtggaacttggaaatttaggtggtgcacagaggcacttcctgagcgaaagggagtgttggggtggggagttcagtgggcacctcaggggacctggatgctgacggggcatcagagggtgtcaaaaggagaagctaagggatctgggcgaggtctcagccgaagggcgctggcaagggaagtgcttggcc

SEQ ID NO: 92177 - DNA, 90 bp, Homo sapiens; identical to SEQ ID NO: 2399
  chr4:41753713-41753803
  hyper

SEQ ID NO: 92178 - DNA, 113 bp, Homo sapiens; identical to SEQ ID NO: 2400
  chr4:41753804-41753917
  hyper

SEQ ID NO: 92179 - DNA, 143 bp, Homo sapiens
  chr4:41754030-41754173
  hyper
cgtccctctgcccgtcttttgtggcccggggtcctgcttctgcttggagatgaaaggcgtgcggggctgggccaggccagagccccagccccagcgccctgttttgttccagttgtgctttctacacgcgagctctcccctaa

SEQ ID NO: 92180 - DNA, 5 bp, Homo sapiens
  chr4:41867511-41867516
  hyper
acccc

SEQ ID NO: 92181 - DNA, 561 bp, Homo sapiens
  chr4:41867612-41868173
  hyper
cgattacaaaaagagaaagtgctaaatcccgggagctggggcaagatttcaaaaggcaacacaccgaatccaagtctgtactttaacttttttaataacgatttttttttttctgggctggaagctcgcactgaatcctggaggaattgctaaatcggattaaggttatattttgcaacagactggatggagcaataaaggagagcgcgcggaaatgggacttcacccatcaattagatctctattagcagccaatgcaggcttcaccacaggaaatgtcacgtcccagccctagcggaccctttcgttccccacccccagctctcacctcccctgtccctggagttaaacaactcttctggcgcacacattggaactaaacaaacccttttgtgtggaatacggtttttgtgttttgttttttgtttttcttattgaacttgttttggaaccctgtaccacctgccttccccaaccccagcgcagcgagctaaccccgggacactcccaccccggccggctgaacaggttgcagcgcgacacctgcgctgtctgctgggt

SEQ ID NO: 92182 - DNA, 433 bp, Homo sapiens
  chr4:41875374-41875807
  hyper
acatcgcaacaaaaccgggttcctcttgaaccaacaaaccttttttgtaaccggctgaatggctgtatctacggagccagtaggttgcggaaaggcgttcgcagggtggaggagcgggtagttggggaaccgggcgcgcctgatggggcgcaggaaggaaaaactgatcgacgcaatggcccccgccaccggccatttggggctttcaaacgccctaacgaggagtccgagcggccactgaaagcctccctgttcctgggcagggcagccagagtgccctcccctctcccttcccagcctcccggcggcgccaccattaacccggagccagacccaggcggaggccccggcgccgaggcccgcggaagcaagagacagccctgatagtcttctaaacccggtccagtttcgaggacgacgcattatagtggaa

SEQ ID NO: 92183 - DNA, 230 bp, Homo sapiens
  chr4:41881201-41881431
  hyper
cgacaggaggctgcaggcacgtcctgcggctccggggcgaaggctagggaaggggatagagggaggtcgctgcggggagggggacagaggcaggcacagagtcctaaagagatttgagactcgcgctcctgcactttctatcccacgcgcccccatccgaggggacctcacccctgggaagactccaataaatgcaacccggcgccactcgattccgggataatttttaa

SEQ ID NO: 92184 - DNA, 30 bp, Homo sapiens; identical to SEQ ID NO: 28888
  chr4:41881717-41881747
  hyper

SEQ ID NO: 92185 - DNA, 15 bp, Homo sapiens
  chr4:41882098-41882113
  hyper
agagtatcacaagcc

SEQ ID NO: 92186 - DNA, 102 bp, Homo sapiens
  chr4:41882162-41882264
  hyper
cgccctgccgcggaaacccttcccgtggcctcgaactggtccccgacgactgcggggtacgcggggcccaaagccagactctactcccgcgcagatgcggga

SEQ ID NO: 92187 - DNA, 3 bp, Homo sapiens
  chr4:41882530-41882533
  hyper
gac

SEQ ID NO: 92188 - DNA, 1552 bp, Homo sapiens
  chr4:41882880-41884432
  hyper
gtcagataacaagctcgggtgttagtgagcgtaatctgaccgcagaaaagctgatgggaaacctgggcttcgcgccgcgtcccgcttttcctactttcccattccattcccatctcccttccctttccttcccttctctaccttatcctccattcccttcccttcccttcctaggcatttaaataagaacaaagattacacccacaaaaagaaccttgcctaggagcgcgtggaaacagcaagggcgcccgagcgggagaggttccctcggtgagggggtccgcgcagcggcggaccccgcaccccggcccccaacggcgcctaggaagttgtcactcctctcatttaaagcctcagaaaaatgcattcatgagattgtttctttatttttcctttctgcccctctccgcattctttgcctatttgctttacggcttttcagccttgttgaggccaagaaaagaaaccaggttcttttctcttgcgattggatccgtattcccagttagggcgccttttgatgtccccatttagcgcctttgactggtcagctgaatggggccgcctgcttttgtcctttcccacaagtcccttcagaaagatccctttaaacgcccggtacccgctgatggatccgttttcaaacggcgcggggacggcagtgccggaggccgcgtctccttagtaatcgcgcgggcagggctcggcaaggggtcgctgcaagggtcgcgctcacccgccccgggtttgggcgctgggggtggggaagggagagaaggttcgaacagttttgtctctcccgcgccccggctcccccagggtgctgcgcctccagccgccccgaggcgcttcccccggcgtccgcgcgctcctctccgcaggggtctcgcgcccacggtgccgcagccgcgcggctcagccgccctccgcacccgcgcctttccagcgcccgggttcccaaaccatcgctaaaggcggacggggggcgccaggagtaacggctgctccccggagaccccaccgagcccagcgcccgcccccgccccctgggcgccctgccccattttctccctttcccaactatcccagacccccagaagggccagaattttccagaactgtcccactccacccgcgcccagggcttctgcacattgcccttggcaggacgcgagccggtcgaggggcatttaggggtggccctgcacggccctcactgctgtcccttcttctccctccgttctccgggccagggtcctcggagaccccgttccgcggcaagtacccctcccccacccccggaggcgggtgcagtgcagggcgggggcggcggtcgcagcggctcagaagccgaccctccttgaacccgaagctgccctggcccgagtatccgcactggcctgggcccgagcgaggctgcaaccctgtgaaaccccctgcaaggcggaagcctccaaacccaaacgaccccgagggcgattccgccagaaatccaacgcgggcccaaataaagtccgaggcctttttgtcggaagcccgggaggtgcccggc

SEQ ID NO: 92189 - DNA, 30 bp, Homo sapiens
  chr4:41993805-41993835
  hypo
cctcctgaaagaagtcggaagttgcagtca

SEQ ID NO: 92190 - DNA, 87 bp, Homo sapiens
  chr4:41994052-41994139
  hypo
gacagaatgaatcatcggctgggtgcagtggctcatgctgctaatcctcaggaagattgtaaaccttaggacgctgaggtgggtgga

SEQ ID NO: 92191 - DNA, 64 bp, Homo sapiens
  chr4:42152702-42152766
  hyper
ctcaggctgtggcctcgcaaccagcccatctcgctccctgcaggcaggcagtgggctgctttgc

SEQ ID NO: 92192 - DNA, 451 bp, Homo sapiens; identical to SEQ ID NO: 365
  chr4:42152961-42153412
  hyper

SEQ ID NO: 92193 - DNA, 101 bp, Homo sapiens; identical to SEQ ID NO: 366
  chr4:42153532-42153633
  hyper

SEQ ID NO: 92194 - DNA, 504 bp, Homo sapiens; identical to SEQ ID NO: 367
  chr4:42153881-42154385
  hyper

SEQ ID NO: 92195 - DNA, 711 bp, Homo sapiens; identical to SEQ ID NO: 28895
  chr4:42154386-42155097
  hyper

SEQ ID NO: 92196 - DNA, 151 bp, Homo sapiens; identical to SEQ ID NO: 40286
  chr4:42200720-42200871
  hypo

SEQ ID NO: 92197 - DNA, 30 bp, Homo sapiens
  chr4:4221107-4221137
  hypo
tccttcctcctttatcgctacatatgataa

SEQ ID NO: 92198 - DNA, 183 bp, Homo sapiens
  chr4:4227985-4228168
  hyper
aggaggctcctgcggcgacccaagcttcagagagagagagaggaaaggaagggcagacaggaaagctaggaaagatgcacagagagaccaaggcagaaaaggctgaagggaagacggcagcggtaggaagggcgcagagcagcctcaggatgcagccagcgggcgaggaggcggagacccgct

SEQ ID NO: 92199 - DNA, 87 bp, Homo sapiens; identical to SEQ ID NO: 7235
  chr4:4228188-4228275
  hyper

SEQ ID NO: 92200 - DNA, 56 bp, Homo sapiens
  chr4:4229330-4229386
  hyper
ctgtactcgtccctgcgtatttctgtattgtcttctctgtgcgggtcactctgtgt

SEQ ID NO: 92201 - DNA, 362 bp, Homo sapiens
  chr4:4229586-4229948
  hyper
caaaggagcggcagccgttctggacccagaggagctggaatgagggacgccccggggtctgccctgttgctaccggcgcccaagcgtcttcactagccccttccaaagccccggtgcccgcctggcacccgcctgctcccggaaggggactgagtctgccagggagccccgctcgggtgccgctaagtggaggtctgggaagtttcagctgaagagcgttctacgggtctggcgtggctgacaggaggcgccggaccccagccccccagccgcaggttggagaggggagttgggagcgagcctggggcaagcccacatcccaccgtgcagcagcccggggctgggcccggaagacaccctct

SEQ ID NO: 92202 - DNA, 65 bp, Homo sapiens
  chr4:42316016-42316081
  hypo
attcccctctgggggcggtctctggttctctctagtgaggcggcgtgccccgcccccctgtggcg

SEQ ID NO: 92203 - DNA, 29 bp, Homo sapiens
  chr4:42317313-42317342
  hypo
gcccagagggagctcgtccccagatcaag

SEQ ID NO: 92204 - DNA, 2249 bp, Homo sapiens
  chr4:42398808-42401057
  hyper
tatttcctttgcgggcgtgaacggagaagtcgtgctctttgaggttttgcgagctggccttggctggcagaggtgaccggcaatccttcagccggcggaaaaagtgcgagtgtgtgtgtgtgtgtgcttgtgaaaatgtgccgttcctcccagaaaaagtggaaacgtaggtggaaagctcagcacatgttggcgacacctaaaaaccatgttctcggtcctgaacctttagaagcggtatcccaggaacgagtctgagtctgtgcaacagggcacagatgattcgacaaacttcaatgactgcaccgcattcatgcattatatccattgaaaagtaaatccagcgtctccactcgcgcgcccacgtgcgtggataaacgcgggaattcggcagccctcaacgtcactctgcagagatttccgggctgtgagagagttggggtgtgcggcgggggaggggagggtctgatatcttcaggttgagagtcaagtcctgggggagcggcatgggcgggggtggccggggggaggcggaggatggagcgcgaaccagaaagcgcagaggaccctcggcccgcgccgcacccgctgtgattagctccagaggcgcgatccgggagggcggactctttcttaaccctcattgtctcctcctccctcttcctttttaaaagacgccttgcgggcagagctgtcagcaaccccgcggccgtttgtacttggccgcggcggagctgactcctgctcctgtgacagataggggctggggctgagcggccgcctgtctggggtactcgcacgtggggaacaaattcttttcctccggctcctctcgggacccggcgatcgccacaggttgggactctgtgcggcgctggagttggcagccccgggcgctatggctcccttgaggagtggggagggaggtggccggggggttggcgcgcccctcgcgcggggagcgctatgagccgggcgaagggcggcagcgacagccccagcaactgcctctgccggcgcctcccgcaggccctcgccaactcgccccgcgcaccatgctgactcccggcctgcggaactcgtagtgcagcccctgtcgcctccccggcccctgctatcccacgcaggactggcttcggccgccggggccagcagcttgcgacgtgtccctggggaggcggaatcgctgtgcgccctgagcccgggctcagcccttcgctttccagctgcgtcctgctcccggccgcccagggagcccagtggcgatgagggcactgctggcgctttgccttctccttggctggctgcgctggggcccggcgggcgcccagcagtccggagagtactgccacggctgggtggacgtgcagggcaactaccacgagggcttccagtgcccagaggacttcgacacgctggacgctaccatctgctgcggctcctgcgcgctccgctactgttgcgccgcggccgacgccaggctggagcagggcggctgcaccaacgaccgccgcgaactggagcacccaggcatcactgcgcgtaagtgcggggccctcggggacatatccccgcccgcctaacggcggcggctgcatgtgtgcgcgggaggatgcacagacccaggcaggtctatgcgccttcctgggtctgtgcgccagggggacgcggccgggtgggggaatcaagggatgagtgggtggtcgcgtttcagatcatggtcctctattcatttgcagtcccgcttcccgccacttgcggtctctgcgggtcggcccgcagggaaagtttgccagggacagtgaggagcgcggggcttgtgcctggtagccggggggaagacagctggagctcccgggagaagggtagtgcgggtaaagccagggtagacttgggttttggtggaggggccgagggtgtcccattgctcgcccttgtcacttcgggagcttcgggaagtgccgaatgcagggaatcgcgactcttgtcgcgcgctcatttgcagcccttcagggctaagaaaccccagtcactttttttttctgtcttaatgatagcgtttctaagccacggccccgttctgcagacttcctttcaattctctgcatcgaattaccctctccggcccaccccctattgtcacgcctttcagaaatgcccaggtcttcgaggtggagatttagaaacaagggtcgaaggggcttccccgccccctattctcacttcggaaaacacgggtcaaatttccg

SEQ ID NO: 92205 - DNA, 30 bp, Homo sapiens
  chr4:42442205-42442235
  hypo
accactgctgccctccgggccccacacacc

SEQ ID NO: 92206 - DNA, 23 bp, Homo sapiens
  chr4:4251225-4251248
  hypo
gaaaagagtgccagccgcgcgcg

SEQ ID NO: 92207 - DNA, 30 bp, Homo sapiens; identical to SEQ ID NO: 40236
  chr4:4251746-4251776
  hypo

SEQ ID NO: 92208 - DNA, 82 bp, Homo sapiens; identical to SEQ ID NO: 14678
  chr4:4256159-4256241
  hypo

SEQ ID NO: 92209 - DNA, 1045 bp, Homo sapiens; identical to SEQ ID NO: 28724
  chr4:4387460-4388505
  hyper

SEQ ID NO: 92210 - DNA, 505 bp, Homo sapiens; identical to SEQ ID NO: 28725
  chr4:4388506-4389011
  hyper

SEQ ID NO: 92211 - DNA, 66 bp, Homo sapiens
  chr4:4389231-4389297
  hyper
tcgcggacgccgggacgccggtgggtgtgggtgcccacttcccccccgccccgccccgggtcttgc

SEQ ID NO: 92212 - DNA, 30 bp, Homo sapiens
  chr4:4389764-4389794
  hyper
agagggccctggccccgcagctgccctgct

SEQ ID NO: 92213 - DNA, 448 bp, Homo sapiens
  chr4:4417485-4417933
  hypo
gactctgctgggtgccgaggtgggagggaagaggggaacccttggtccgtttccctgagggatgacgagcagcagatggagaggacagcgtgaaggggcgtggcggtgaggctggaggggagtttgtctggcctgcagagcctccttcctgatgcacgcgctgctggtctgaatgggctgtttgttctgtagcgtgtcaggtgcttcccgacgtcctggtgggactgagatcaagacgctgttgataaaagggctgtacttcagtggtgtcttttggctttcttttctgtccacactgtgacctggggcacatcctggcttctttacttgagccactgtgcattgacttgagtcctcagcaacacggtggtgtgactcattggccgcattttataggtgagggacctgagattgagagagaaaacactccgcacgtgaactcagctgg

SEQ ID NO: 92214 - DNA, 53 bp, Homo sapiens
  chr4:44448607-44448660
  hyper
gaactccacatagcccgctccggaagcgcactgcaaaacgcaccccagatgct

SEQ ID NO: 92215 - DNA, 107 bp, Homo sapiens
  chr4:44448966-44449073
  hyper
ccctttccccacacccgctctcatgcccccgccccctcgaggggctctgggggcacctttatcgcttctcccctgccctctagaaaaccacccgtaactggaggctc

SEQ ID NO: 92216 - DNA, 133 bp, Homo sapiens
  chr4:44449437-44449570
  hyper
tcgtgcagggagagccgctctctataaggagttaaccagcgcctgccccggacacccccgcggggcctccagcggggctcaaactggcggcggctcagcagggggcgaggggtgctgggaaacgccggggctg

SEQ ID NO: 92217 - DNA, 91 bp, Homo sapiens; identical to SEQ ID NO: 28901
  chr4:44449652-44449743
  hyper

SEQ ID NO: 92218 - DNA, 206 bp, Homo sapiens; identical to SEQ ID NO: 28902
  chr4:44449971-44450177
  hyper

SEQ ID NO: 92219 - DNA, 373 bp, Homo sapiens
  chr4:44450741-44451114
  hyper
gagagaggagctccgccggtgcggcggcggcaatggagaggcaagaaggagctgctgctcctttggggcgagggcggggaagtgtgagagagacttgcgagaggctctagggctgctgctcggctctccgtggggagggcgggaggaggggccgaagcaaagaaaactcgccgccccggcagcttgcaagcgtgccgcgaggccggagcgccgacggtggcgctaactactcctggcagcacgggaggaggcactgacgtcaagccccggactgggacccgagcctcagctgtcatttaaagagataggctgcagccgcggctcccgggctccgacgctagggggcggggccgagagccgagcctgcaagagg

SEQ ID NO: 92220 - DNA, 52 bp, Homo sapiens
  chr4:45473410-45473462
  hypo
tgtcacagcagtctgcgtcatcgggatttgggaaagccgccctcaccaagtc

SEQ ID NO: 92221 - DNA, 20 bp, Homo sapiens
  chr4:46067754-46067774
  hypo
tttgagacagagtctcgctc

SEQ ID NO: 92222 - DNA, 146 bp, Homo sapiens
  chr4:4614181-4614327
  hypo
taaaggtacagcctccgcagccctccagagcagctggatcaggaagcccagtgtcggtggggtctttacttaagcagacagaatagttatcctcaacacgtgacatgtgtctagcccccactgtgtctgctcgctccagccaagtg

SEQ ID NO: 92223 - DNA, 32 bp, Homo sapiens; identical to SEQ ID NO: 28904
  chr4:46391678-46391710
  hyper

SEQ ID NO: 92224 - DNA, 98 bp, Homo sapiens
  chr4:46392417-46392515
  hyper
gcttgctggggctcccgagaggccccaaggttcctgacagagctgctgttgggtgttggtgtaaagccgggaatgtagtgtggcggtgatgccctaga

SEQ ID NO: 92225 - DNA, 41 bp, Homo sapiens
  chr4:4675041-4675082
  hypo
cgcccacctcctcctcggaccacgcccgttctcctcacgcc

SEQ ID NO: 92226 - DNA, 37 bp, Homo sapiens
  chr4:46783708-46783745
  hypo
tgggaacctgggctgcgcctggcgctcaccagccagc

SEQ ID NO: 92227 - DNA, 37 bp, Homo sapiens
  chr4:46806970-46807007
  hypo
gtgggctgcgggtcccgagccctgccgcatgggaggc

SEQ ID NO: 92228 - DNA, 1001 bp, Homo sapiens
  chr4:46994820-46995821
  hyper
ttgcgcgtttgaaatcgttcatacccccaaatccaggacgcagcctgttgtcataaccatcgagcaaactgtccaggatgcgggtgaaattttctgtgcacaatttctcctccttttggttctgtcctggggattcgtttaaactgcaagcgaaaaaaaaaaaaccgggggcggaggagattattttaagaatccatcagagaacaggtgcaaacaggtttgttttctagggaaagagtcgcttgccccaagctaaaggagaggaggttgggggttgggatgcagaagacagaaatggtcaggaaaagcgcgccccgccgcaagacccccagtgcccacacgcctcttggatcctgcgcccttggtgctctccgcatctatgcggtcacagaaaagcctggcttcggcccctgctcttacagctgagataagaagacctagtccacccagggaggagcgagtggccaaaggggtcccggagctagccatttctccactttccgttgcccacctcctcgcaccccagagaactcaccaaaccgccaggcacaggaagcgcaggagggcgaaactgaccccggcggacagagcgatcgcgggtaccttcttggcagaaaccatctttgcaacatgccatacttcaagcctgttcacgtttccaggctcttcagatgccctgagcagggtgcgaggagagggcagagaggctcccgcggcgtgcgcacactcgcgctcacactcgcccgcgctcagccagcccgagccgcggtgggcgtgtgtgtgcacggggccaggggaggcggaacctgccttcctcgccccctcctttctcgctcagcgctcaatgtgtatgtagagctatgtataccgctccacaccctttcgtgcccgcgcgctgaaggttctggggttcgtatccgcgcgcttgcgctgcaagactcggcaagtttgttccgactgtaactccggggatgaggaacggggtctctcgcccctcctcc

SEQ ID NO: 92229 - DNA, 567 bp, Homo sapiens; identical to SEQ ID NO: 2412
  chr4:46995822-46996389
  hyper

SEQ ID NO: 92230 - DNA, 57 bp, Homo sapiens
  chr4:47033544-47033601
  hyper
tcttttggtagtgagcgcgctctgcgcatgcgcaggtccattcgggaattactgccc

SEQ ID NO: 92231 - DNA, 742 bp, Homo sapiens
  chr4:47034011-47034753
  hyper
ggacttcggaggtaacgcttcatcttttttcaacctgtaacccatccttagttctccttttctgtcaaagataaatgtcaaaaaaaaaaaaagaaaaggcatgtcattttcgtaagcgtgcactataccctgggcacacacacacacacacacacacacacacacaccccgggtccccagtctcaggtggatgaatcctcaggcggaggcgaccttctcccgggccgacacaccctctgcatagtcactgcatcacgcgtgtgcccacacctgttttcccaggcagtcccctgaaaggggtggtggggggagcagggagggagcccgttaagaatggagtaagggctgggaagcccccagaccctccccagcctgctgtcactgagagaatctgttcctaatgtggcccacctccccggcagggccccccgtcgacgttgggatgcggatcgatgtcgccagcatagacatggtctccgaagtgaatatggtgagtggcctcccgaggggcccggcggttcggcttacgcagatgggaaatggacaggtccctttgccctctgcgtttcattggcggtcacctcgcccctggcccctgaggtcccactccgcacccgctccccgctccggcacacacacccggtcgcccctggtttgtaatttcgacacacacgggctactgcggtgttccaggggaaacgtgctcggcactattttgggaaggacgagtgactgttgcgcc

SEQ ID NO: 92232 - DNA, 222 bp, Homo sapiens; identical to SEQ ID NO: 28910
  chr4:47034754-47034976
  hyper

SEQ ID NO: 92233 - DNA, 37 bp, Homo sapiens
  chr4:4753216-4753253
  hypo
gtgcccttctccagacgcatgccgcttcttggatttt

SEQ ID NO: 92234 - DNA, 263 bp, Homo sapiens
  chr4:47839267-47839530
  hyper
tgccagcacttaggacgggcgagtgatccccaggcaccaactgggggccggggaaccaagcgcgagcccgggctgtggagggaccgacacccaggcgctcgcagctggggaagggggcttacgtctggggcaggcaagactgctgcacagtccctccagccacccggcgcccgagacgccggcgcagacaggaagctgtagatccccgaggggctggctccgacagctccacctgcagcctcccctgccgccagtgtgcagcc

SEQ ID NO: 92235 - DNA, 38 bp, Homo sapiens
  chr4:47915048-47915086
  hypo
aaagtttaccaaacctgttcacacgtctccatattgta

SEQ ID NO: 92236 - DNA, 92 bp, Homo sapiens
  chr4:48378917-48379009
  hypo
gcgcccggccgactttttttttttttttttttttaaggatttcccatgtcttgaccttaaactggcttaataatagtcggtattgctttaaa

SEQ ID NO: 92237 - DNA, 34 bp, Homo sapiens; identical to SEQ ID NO: 28912
  chr4:48485255-48485289
  hyper

SEQ ID NO: 92238 - DNA, 897 bp, Homo sapiens
  chr4:48485589-48486486
  hyper
cgacaacgtgaccctgctcttcgcccctctgctgcgggacaactacaccctggcgcccaatgccagcagcctgggccccggcacggacctcgccctcgcccctgcctccagcgccggccccggccctgggctcagcctcgggccgggtccgagcttcggcttcagccccggccccactccgaccccggagcccacgaccagcggcctcgcgggcggcgcggcgagccacggcccttccccgttccctcggccctgggcgccccacgcgctcccgttctgggacacgccgctgaaccacgggctgaacgtgttcgtgggcgccgccctgtgcatcaccatgctgggcctgggctgcacggtggacgtgaaccacttcggggcgcacgtccgtcggcccgtgggcgcgctgctggcagcgctctgccagttcggcctcctgccgctgctggccttcctgctggccctcgccttcaagctggacgaggtggccgccgtggcggtgctcctgtgtggctgctgtcccggcggcaatctctccaatcttatgtccctgctggttgacggcgacatgaacctcaggtacggatctgtctattccttgggcatctgtctcatcccagacgcgcgtttacggccgtgggctcacgacgaaggacagaggcagtggaggggttggaattaggcgtggaggaaggaggagaaaaggagaggaagttgatgacgccccggctttagaagtcaaggccgacctgcaggttgtgctgctaggggagcaagctagacggcgagggagctgctccaaggctgggattccatgcgcagcgcggcccttcagcagggtccctcgccgtcctccccgagcgtcggggtggcagcgcaggtcgttgtccagtggaa

SEQ ID NO: 92239 - DNA, 439 bp, Homo sapiens
  chr4:48492180-48492619
  hyper
cggtggcaggaagggcgtggagggcggtgcagcgtgcgagcccccgccgagggccatccccgcctccgctcggccgcccgggcaagtcgcctatttagggtgcggcggcgggcgggagcagtgcgcccatggcggccctgggggacgaggtgctggacggttacgtgttcccggcgtgccccccctgctcgtaccggtacccataccccgcggccaccaagggcaagggcgcggcgggcggcagctggcagcagcgcggcaggggctgccttcccgcctcctccccctgctcggcgggcgcggcctcgttgtccttcccgggctgcgggcggctgacggccgccgagtacttcgacagctaccagcgggagcggctcatggctctcctggcgcaggtggggccgggtctcgggccgcgcgcccgcagggccggcagctg

SEQ ID NO: 92240 - DNA, 38 bp, Homo sapiens
  chr4:4854394-4854432
  hyper
gcggtgggctgcctgcgggttcccggtgaccctttccc

SEQ ID NO: 92241 - DNA, 523 bp, Homo sapiens; identical to SEQ ID NO: 28728
  chr4:4854669-4855192
  hyper

SEQ ID NO: 92242 - DNA, 487 bp, Homo sapiens
  chr4:4855230-4855717
  hyper
cgcccctcctttccagcctcagctctggcctttctcggcatccccagcttgccttcagtttcactccatatctgggtctctcagaggcctcgggaggtcttccgttctctctgtcgccgtgtccacggaaggagcctccccaaccctctgtggctccgcgcctcttgggccggagcatctctgtcttccggagtctcttgatcattgctcctgcccgtcctcgcccatttcaaagacgaccaacagaggcttagaaaaattggccctccaccctcggctggttacctggctcgtagccctgggtctgttttcttctcagagagacctgagatcctcgacatttcctaaattcatggaaaacctcgacagtgttcaggactcccaaagaaggtggtgggcgggagggggaggagcataagagaaaagtagtgagtacgggcccaaagacccatttcgtggattgggggagggacggggaggctgttcc

SEQ ID NO: 92243 - DNA, 173 bp, Homo sapiens
  chr4:4858694-4858867
  hyper
agtctgcctattaggcgcgctgaggaatcgtgacacattgtttatccccgcaattagcgatgcggcccttttcaggccgcccgcccccgggccccccgcccccccccccccccccgcggcggagtccaggccttgctgcgctcctcaactgcgaccgccgcaagttccacact

SEQ ID NO: 92244 - DNA, 125 bp, Homo sapiens
  chr4:4859646-4859771
  hyper
gaggccccggtgcaccgcgcgtccagccggcccaactcgagctagaagccccaaccactgcccagtgcctgagttgcagtcttgggtcctttagaaacctggagatgtgcgtaaaattcagatgc

SEQ ID NO: 92245 - DNA, 15 bp, Homo sapiens
  chr4:4859810-4859825
  hyper
cggcctgtggacaga

SEQ ID NO: 92246 - DNA, 51 bp, Homo sapiens
  chr4:4861085-4861136
  hyper
gcagaagagaaggaacgagaacaagggaaaatcccccgggaacacagaaag

SEQ ID NO: 92247 - DNA, 226 bp, Homo sapiens; identical to SEQ ID NO: 28731
  chr4:4861342-4861568
  hyper

SEQ ID NO: 92248 - DNA, 1532 bp, Homo sapiens
  chr4:4861780-4863312
  hyper
ccaaagtgtccccttcgctcctgcccttcagcgtggaggcgctcatggccgaccacaggaagccgggggccaaggagagcgccctggcgccctccgagggcgtgcaggcggcgggtggctcggcgcagccactgggcgtcccgccggggtcgctgggagccccggacgcgccctcttcgccgcggccgctcggccatttctcggtggggggactcctcaagctgccagaagatgcgctcgtcaaagccgagagccccgagaagcccgagaggaccccgtggatgcagagcccccgcttctccccgccgccggccagtgagtagccagaacccaggcgcagagggagggggccgggtgggggccgggtggggtgtgggacccgagggctcctggtggcctccggcgcctgcgtacctgcagccggtgctagggagccgtgggctgcaaggccgggtcttgcgcctccctccactcccacccaggaagaaggttccagacctcctcgccttggcccagagacgctgcgggtgggagttaacggataggacaccgatgtctgggcaccctgtcctcctgcccccaccaaacgacctcaggggtccatgatccctcatctgatcccaaactctgtttcatcggcttcaccccagcggatgaatgtgtgtggtgcggtatcttccctgcacccggagtttcactttctcgcagtaggagctggtgtcccccagcccctcttccctttcaagtacctctttgcctagaggttccgaagctcctacagaattctacctccccatgccctttgagtttgaggcagatagttggtgctttgggcggatggatgattcaggggtggggacattcaggttccagtggagggggcggggcaccaagtcaattaggggaaggcgcccccgctaatcctatgggaagctcccaaacgtctaggactgagccattaaagtggactccaggtgcccaaggcggttcgctccaaggcctcacggccccctggctgctctactcagagaacacgctcggagatatttcaggagcacgggaaattcccaagttttcctcgtttcctccgattattttgctcggcataatagcagccagatttcaatggcgtgatgctgaggaatgatttttatctggggattaaacgtctttgaaaggccagtccctccctaagcctaatggccggagaaggtggccccgctctgggttgtcgccgctgaagggagtgacgtttctctcggcgcccgcccctcgggcggcccggcggaaagctagttgggggccaagcgcttcccggactcccggtggcctccagcagggaagaagcggggtgttaacacgagatttcgtttgactcacatcctggtggtctgaaagtccaaaggatcgttgtgttttctttgttttgttttgttttttctgtttgtttgtggttgttttttagagaggtgtgaaaaaatgcatacttaggcaaaacccgcgtggtgaaacatcttcgatttgaattcact

SEQ ID NO: 92249 - DNA, 185 bp, Homo sapiens; identical to SEQ ID NO: 28735
  chr4:4867591-4867776
  hyper

SEQ ID NO: 92250 - DNA, 98 bp, Homo sapiens
  chr4:4868024-4868122
  hyper
tccatcccagtccttcgaactgtgttccctggtttatcaaccgagggcggagtgggcaggggtttcctgggtctgttcctttacggaccaatttcctt

SEQ ID NO: 92251 - DNA, 256 bp, Homo sapiens
  chr4:4868537-4868793
  hyper
gaggaatgataggggcgtctcaccggccctgcacgctgtgaaagcgttttcgttttgttggggaggagacggaagcctcattttgcaaattcagcttctgaccacgcagtcaagaccaaagcagtccgtggcgtggaagcggggcagaaatgaggttacctggcggcaagggacctggggcgcctcgagctttgagcataggtccgcagggccggggcggttggggaccgggaggctggggtggggctgaagacct

SEQ ID NO: 92252 - DNA, 172 bp, Homo sapiens; identical to SEQ ID NO: 2363
  chr4:4868828-4869000
  hyper

SEQ ID NO: 92253 - DNA, 127 bp, Homo sapiens; identical to SEQ ID NO: 2364
  chr4:4869131-4869258
  hyper

SEQ ID NO: 92254 - DNA, 43 bp, Homo sapiens
  chr4:4869481-4869524
  hyper
cgcacacgaccaacacacgtcatccacacgacataccaacaca

SEQ ID NO: 92255 - DNA, 189 bp, Homo sapiens
  chr4:4870045-4870234
  hyper
gctcagagcacaaggcgtgagagcgctgggtgctctgctgtgctgacaccagagggtaagcgcggattctggctccacgcacgtggggtcaatccccggacacagaccttttactggaaggcctggagaatcgcctgagggaacgctgggagttcccccccccacccgcccccgcgcaagaacagccag

SEQ ID NO: 92256 - DNA, 69 bp, Homo sapiens
  chr4:4871315-4871384
  hyper
gagctgccccaagggcgggctggactctagtgctttgagtcgctgtttctctgacgatgctgcttttaa

SEQ ID NO: 92257 - DNA, 278 bp, Homo sapiens
  chr4:4871754-4872032
  hyper
cgcgggttatcccaacgaatcctcactaccaggtgggcacgtgccattgtgacccgtgtcatagactgaagcatagagagttgaatgactcagacaagatcacacagctagtgagagtgaaacagagcttccaactcagacagccggtgccaccatctggcgcccctaaatctcagttccctggtccgcggaatgggaacactttcgggctggtgcagaggaaactatgggtgactccaaaggcagcgcgcggtaagaactccgggtgagaaggggag

SEQ ID NO: 92258 - DNA, 156 bp, Homo sapiens
  chr4:4872059-4872215
  hyper
cggagcatagaggcaggatggtgacctgagcgctctttgctggccggctctgctctccgcagcgccattggaattccttactctccagtcccccgagggtgtgtgtgggtgaggggaggtccctgaggcggaagggatgagcggagtggaagcgga

SEQ ID NO: 92259 - DNA, 34 bp, Homo sapiens
  chr4:4872457-4872491
  hyper
aaagcagccaacagccgaccggcaactgggaagc

SEQ ID NO: 92260 - DNA, 132 bp, Homo sapiens
  chr4:4872777-4872909
  hyper
ttaaattaattcattcggcggggttgaacaagaccagcacactaagaaataacgaattcgggtagagctgaatgcttctaaggggaaaagtaacaagacgggggcaggaagcacagtcggagcctatttttg

SEQ ID NO: 92261 - DNA, 342 bp, Homo sapiens
  chr4:4873139-4873481
  hyper
cgaggtagaaggggccgcgtgcccttgtaggagagggaagtgtcaatggccgggaccaggggtggctgcctgagacgtgcctcgtctttggtgattcccctacccccaaatcagagagggttccggaagaaacttcgcagccttgcagagtgaagcatcgccgggacccaaggatgtttctcttccctacggagctcacccggattccttggcgcccagctgcggccccggagtccccgaactcggctgtgccagcccggggcggggccagctgaacctcagttgtggggcggagtccgttgcggacaccctcaccccccgggcaaccgcagctcccaactc

SEQ ID NO: 92262 - DNA, 30 bp, Homo sapiens
  chr4:48946783-48946813
  hypo
aaatgaggctggctccgggtatgttgacaa

SEQ ID NO: 92263 - DNA, 213 bp, Homo sapiens; identical to SEQ ID NO: 28916
  chr4:48987912-48988125
  hyper

SEQ ID NO: 92264 - DNA, 68 bp, Homo sapiens; identical to SEQ ID NO: 28917
  chr4:48988465-48988533
  hyper

SEQ ID NO: 92265 - DNA, 121 bp, Homo sapiens
  chr4:5052435-5052556
  hyper
cgtcctgggaacccgcgctcgccccacacgtcttggggcgcatctgccgcaccccttacttaggcacccgcaactgtggcgcgtatctcccgatccaggctcccgccgcaggagcccaggg

SEQ ID NO: 92266 - DNA, 1260 bp, Homo sapiens
  chr4:5052845-5054105
  hyper
gcaaatacaggctagcggggagtcctgggactcccttcgcagccggggccgactaaccacagacctaagagcccctctacctctagacctccgtctactgcgctctaaaatatgaacgatgctttcttactgctgggttgtcggaggcggatgtgggatggtgctaacaaagcgcgtagccgaggcctggccatagtgggtgctgacaaaccgcttactgcctgcagggaccgagctcccggccgagggaggagggccgagcagggattcagattcttccgggccgatccctttctcagctccttccgccctgccgccgcccactgcgtgctgccttcgtccgtcccctcctcccccgctccttcccctccttcccctgctcccgcgccgcctcgcgtctcccgcccgctgtagccggcgaggagcgccgcacgttggccccggcgcgaggagctcccgggttcccgggcgggcactggagtaaggagctgcgagcgcagcccgaggcggggcacggcggaaggcgcggcgagagcggggtccctgcgagcgcagtcggaagggcgtccaggagaagggggacgccgtccccgcccctgcacggtgctcggccccctcgggctccgcgcgcggctacaacccggactgggcgcgcccccggcatcccgcatctctgcgcgcgtcccacatcccgcatccggcatcccagcggccgggcatgtagcagcggcagcaacggcggaatatgggcgggaaccactcccacaagccccccgtgtttgacgagaatgaggaaggtaagagagcgagaggtgcgaattcccgcttcgcggggcatccccttcctccaccaccctcggccgagccctgcggggcaccgcatgctgcccggcgcggggacccaggcatggccacttcgcccagcgaatgcagtgtgtgcccgacccgtgccaggcgcggcgcttctgctgaggcaactcctaggtacccagtgccgtttagtagtcgggacggtgcctagcgcgggactggggaggcggcttcagagagttgaacccgaaacctgcacttgggggtgtggaagggaggagttgacttcggaggccagtcgggatggttctaggctcgggctccccaggaaaccgaggtttccttgagagcctgaggctgacggaggtggcctggaagggcgggttgcaccgtgtgtctgtgtgtgtgtgcgcgtgcccacgacgcatttggtctcgtgcaagggcctgt

SEQ ID NO: 92267 - DNA, 172 bp, Homo sapiens
  chr4:5160791-5160963
  hypo
aagctttggccaacacgggctagaactcactgacaagcggcaggaggacactgcttctcagctccccatgggcagggctgcttggctggagcacggctgggacaccgtagagctgtgcttaccaagggggtgccccatggtgcagtctctctgtgtacgctgactgaggaaa

SEQ ID NO: 92268 - DNA, 174 bp, Homo sapiens
  chr4:5171284-5171458
  hypo
gaaaatcaaggtgtgcgtgccaggtgccacagacatgggcattgccatggagaaaacccaaaccaaaccttgtctgctggagtctcagtatccaccgagagttcttcgtgtctctgtgcagtgatctaaaaactttgattgtttgggagaaataaaccccgtcatgttttgatt

SEQ ID NO: 92269 - DNA, 39 bp, Homo sapiens
  chr4:52708566-52708605
  hyper
gaggaaagaagtgtgcgaactctgcgaaacaagtatgcg

SEQ ID NO: 92270 - DNA, 23 bp, Homo sapiens
  chr4:52892709-52892732
  hypo
atcgcgcccggcctaaattgctt

SEQ ID NO: 92271 - DNA, 140 bp, Homo sapiens
  chr4:52917545-52917685
  hyper
ccctggcagccaacccgtccacgtcaaggtttgtttaataatcgccagggtatctatggccgggctcaggcggctgctggggagccaggagaccgcgcgggacggcggatgaggcgcggcggctgcggcccagggcacct

SEQ ID NO: 92272 - DNA, 123 bp, Homo sapiens
  chr4:52917964-52918087
  hyper
tgggtgaaaaacccccggggttcgccctcccataggttccagcacagcccttgtcggggatttcttagggctggagttggtggccactttgcaaagcctccgcggttgcgattcctaaccagg

SEQ ID NO: 92273 - DNA, 159 bp, Homo sapiens
  chr4:53617401-53617560
  hyper
ggcagcagaggagctcggggcgggcaaagctcgaggggacacggggcgagcccagaccctgcctgggagccctccccgccggagaccaaagggcagaaacgcactcacagtgcaactccgagggataaactggccgacgatcgccgccaggccagaaga

SEQ ID NO: 92274 - DNA, 106 bp, Homo sapiens
  chr4:53617801-53617907
  hyper
gactctgggcgagggcggggctgggaggagggccgcggggcaggcagccaatcccaggaaacttcgggacgagggcaggacgggggctggacgggcccagccattg

SEQ ID NO: 92275 - DNA, 960 bp, Homo sapiens
  chr4:53728037-53728997
  hyper
cgctccaaatcagggcgggcggcactaagccggggagcaaacaccgctcccggcccgcccagagcagacgccctaggttggggctgcagcgagtgcgcgcgtgggctgtggagccggcggaggcagcggtccggaatggctctgtggaggctgcgctctcttcctggccccgcagccacagcagctgccccatgctcgcgcggcaggacctaccaggcgcccaccctgggctgcgccgcctcggaccacccgctgctcccctccgcccgctgcctcttctccccgcgcctcacggggctccgcactgactccaggcgcctccgggggcgtcgcgcgcgcggagcggcgccgggggcggggcctcgtgtagggcgccccgggattggctgtggggagagggggcggggccggccgcggagaaaacagccggcgcgccgcgcgagtgcagtctgggtctggagcctgagccctgcggaacctcggcgctcggccccaccccgcccgtacctgcacttatttattgttgttatttcttaccgcggagccccgcagtcgggtcctcccgcccgctcccgcgcagcgctagcattctccagtccctcagtcccttcccgcgcggtgcgccgcagccgaggcgatgcgcctcattcagaacatgtgcaccatcgccgagtaccccgcgccgggcaacgccgcggcctccgactgctgtgtgggcgccgccggccgccgcctggtcaagatcgccgtggtgggcgccagcggcgtgggcaagaccggtgagtcgtcgcgcttagccctgggtctggtcttggacgacccctgacgggagttgaggctgaacaaggcgtggggagcggtgggagctgcagcccgaccgctctccgtccccgcgcagggagccgctgccccttgggagtgggcttagccgttgtctacgccacccgcctgcttccacag

SEQ ID NO: 92276 - DNA, 30 bp, Homo sapiens; identical to SEQ ID NO: 40240
  chr4:5458789-5458819
  hypo

SEQ ID NO: 92277 - DNA, 30 bp, Homo sapiens
  chr4:5464682-5464712
  hypo
caggctctgctgagccgggagtaaaggttt

SEQ ID NO: 92278 - DNA, 30 bp, Homo sapiens
  chr4:54858212-54858242
  hypo
atgacagagagtagacgaagttgatacgat

SEQ ID NO: 92279 - DNA, 40 bp, Homo sapiens
  chr4:54957438-54957478
  hyper
ccaggaccagcagagcgggtctgcgcggacagaggcactg

SEQ ID NO: 92280 - DNA, 1712 bp, Homo sapiens
  chr4:54965799-54967511
  hyper
aggggtaggtgtaaccgtggccagagctgcgctcagggactggacgactgccagtccgtcgcccgcacaatcctgctccaaaccgcaggcctcacacttcaccgcgccgcagccacccctaccacagaggagctggaaacactgagcattcctattaaataagcctccaagtccccacctggtacgctttgcggtggggcgtggggaagagttgggctgcggccagggtagcgagagggggtgggatggaggatgcagcgctgtgatttctcagtaaagcgtggagaaagagggggaggaggccggcctccccgggaaattaacaaaacctacactttgcaaagtctcccccatccccctcccccgagttcttccccgccgcgcgcccgcccctcctcgcggcttctgttgtgactcgggcagcctatcccgagggtgcggagctgccgaggagcctgagccgagcggtactccgcagcatcacgtgccagggtggggggctataaaatacccgagccggggcgccgggcgggggacgtgaggaccagccctctccggggacccctttgttcccagcccagacgccaacacctctgcgtccccaagggcttgactgcccgtgtctgcgcggctcccagggcagagcttagaacactagaggagaggggtcgccgcgaactgccggggcttccagccacccacccctctcgacatgtcgcgctccttctatgtcgactcgctcatcatcaaggacacctcacggcctgcgccctcgctgcctgaaccgcaccccgggccggatttcttcatcccgcttggcatgccgcccccattggtgatgtccgtgtccggccccggctgcccgtcccgcaagagcggcgcgttctgcgtgtgccctctctgcgtcacttcgcacctgcactcctctcgggggtctgtgggcgccggcagcgggggcgcaggggccggggttaccggggccggaggcagtggggtggcaggggccgcaggggcactgcctctgcttaagggccagttctcttcggctcctggggacgcgcagttttgcccgcgggtgaaccatgcgcatcatcaccaccacccgccgcagcaccaccatcaccatcatcagccccagcagcctggctcggccgcggcggcggcagcagcagcagcggcggcggcggccgcggcggccttggggcacccgcagcaccacgcacctgtctgcaccgccaccacctacaacgtggcggacccgcggagattccactgcctcaccatgggtagggcggggtcttggggcacctgcgctccgcgcctttcgcgctcctggagcaaactttccacctccagtggaggaagtgggagcccggggacagggtgaagagagaggacgggcttttagtgtaaccgtagagtcagccacagaagttccacgaaagtggaagttagtttgccagcttctccactcagcctggtgcgttttactcctagtagtaggtgctcgagtattgccttattaatactggggccttagggacctcgaacgtcacggcggataaaccagaggttaactgcttgggatttggggtgggtgtgtttgaacctgtgtggcatccccgcgtcggggcggctaaagcgtcttgacgtttttggctaagcctgcgcgcttctccgcttggctcaaagggaggcgatcagatagtgca

SEQ ID NO: 92281 - DNA, 24 bp, Homo sapiens
  chr4:54969747-54969771
  hyper
gagtgttgtctttagcgcgcgcgc

SEQ ID NO: 92282 - DNA, 684 bp, Homo sapiens; identical to SEQ ID NO: 28926
  chr4:54969831-54970515
  hyper

SEQ ID NO: 92283 - DNA, 164 bp, Homo sapiens; identical to SEQ ID NO: 28927
  chr4:54975768-54975932
  hyper

SEQ ID NO: 92284 - DNA, 126 bp, Homo sapiens; identical to SEQ ID NO: 370
  chr4:54975990-54976116
  hyper

SEQ ID NO: 92285 - DNA, 78 bp, Homo sapiens
  chr4:54976170-54976248
  hyper
cgtgggaaagagacgtgggaagggcatagccggattatccactcagctccaattttctccaagcgccactcaccccac

SEQ ID NO: 92286 - DNA, 22 bp, Homo sapiens
  chr4:55012635-55012657
  hypo
ttttttcagagggagcgtcgct

SEQ ID NO: 92287 - DNA, 926 bp, Homo sapiens
  chr4:55092907-55093833
  hyper
aggggagaaaagacccgcagcccgcctcaggagggcaaggtttctagccccctgcggctccgggaccacccaggacccggggcgtcgtgggaccgatctcgaaggatcttagaacgacactgggagagcgcggcaagaactagccccaccttcccccgacgccccggactgactgccgggcgcagacccgacttctcccgaaccagcctcggaccagccttagaaggcggaaaacaggattcaaacccgcctatgagcagtggtaggggcgggggctgtgggggcaggactcggtttaaggaaccaaccgcctcggttcgagggcctcctgtccggaggttgctcctgaccactgggtttattttgcttttgcagaggaggcagatgttgacctctcttctttgcacagtctctccgcaaaattttcccccaaccatttgctttcttgcgccaccccccaccggggcactatccctggagtcagctcctcaggcctttaaaccttccagaatgtcacacatggaaacctttagcaaatgtttgttaatgatcataacaaaggcatcattcaaattaggcaggtaattactaccagaaggacaactgggtgctcgcttgctcatccattgctttctgctttaaactcccgaggagtcgctgcctggagacactcccgcccggactgcttctcgggccccattaaacggctctgaaatgaactgtgaagttaccatttgtgggcggagagcgctggggccctgcggacggaagaccctggcttgaccggactaacagtgtcgccgaagcaaagcagcccctctgggtaggctgtctgtctcgcctcctaccctctggggcaactagcctaaaaacccggttctcaacttaacagcatgtggcccagcacccgcttttgccttttattc

SEQ ID NO: 92288 - DNA, 123 bp, Homo sapiens; identical to SEQ ID NO: 7383
  chr4:55093888-55094011
  hyper

SEQ ID NO: 92289 - DNA, 123 bp, Homo sapiens
  chr4:55094012-55094135
  hyper
ggtcgcgtagaagaactgcggcaatgggacccccagcgcagccccaggcgccctgttttcgaggctgacatcccaagatcctgtcctggttaggcacagcaccgcgcccgttggagtacttct

SEQ ID NO: 92290 - DNA, 170 bp, Homo sapiens
  chr4:55094514-55094684
  hyper
cgcggcgggagggaacggagggagaatcaaaaggcatcctcccccacgacgcggaggcggtggtacgattcctcaaacgcccaagcttgagctttttttgtatgcgagatagaagccagggcaacctcgcccagataaccccgaaaacaaaggcacgaccagataagtga

SEQ ID NO: 92291 - DNA, 58 bp, Homo sapiens; identical to SEQ ID NO: 28934
  chr4:55096214-55096272
  hyper

SEQ ID NO: 92292 - DNA, 103 bp, Homo sapiens; identical to SEQ ID NO: 28935
  chr4:55096538-55096641
  hyper

SEQ ID NO: 92293 - DNA, 60 bp, Homo sapiens; identical to SEQ ID NO: 28936
  chr4:55097404-55097464
  hyper

SEQ ID NO: 92294 - DNA, 281 bp, Homo sapiens
  chr4:55097812-55098093
  hyper
cgacaggcgcaaggccgaccaggctcgctttgacgccctggtcaggccctgcttcggagcttgcagttttgggttgacccaagtgcagctggacctcgttcacaagagtgaggggaagccaagaatgaacccgtcgttagcccccggtgccctggctcttgtttaaatccttagatcgagaaggacttgaaggagatcccaggctcccagctctgcgcccctgggccagtttcctctcgggacgcggactgaggagggatgcagggggaggggcattgggc

SEQ ID NO: 92295 - DNA, 591 bp, Homo sapiens
  chr4:55098197-55098788
  hyper
cgtggtggccagcgccttcctgcagaccccacagggaagtactccctttgacctccggggagctgcgaccaggttatacgttgctggtggaaaagtgacaattctaggaaaagagctaaaagccggatcggtgaccgaaaggtgtgggtctcagggttccccgggtctaactcgccgggtccaaccgcagcatcagccttggggcggcagataatctttcggtctcgcctggggcgcaagatgcaggatcgggggcaaatggcttctcccaacttccccctaattcgggttctgccagatggttgtcgtttgctgaagtggctcggcggcatttccttttgttttaaactgatcaatgagcgaacctgggatgggctgaaaaagtagattgtaggagggaataatgggaaacccgacttggggcgcctccttccctgcctcctactgcagtttctcggcccccgcgaaaggggagcgacaagcgcgggtgggcgcggactcttgagggggcagaggcggctatggcgcgtgtcgggcaaggtggcaccagaaggcacttttgtgtgtgtgtgtgacaagagtctcgctctg

SEQ ID NO: 92296 - DNA, 436 bp, Homo sapiens
  chr4:55099028-55099464
  hyper
aggcgtaagccaccgcgcccggccaggaacggttcttaaatgccgagagggcgcatgctagctctcctcagcattcccggtgagccgctacccacggccgtgcggctctcgtgcccataggaggcgctggcgagctcctgtaaccctaaacccctcggcccctttccccccacccgcccggattctcttcccgctctcccccctctctccacacccgcccggccccctctcgggtctcagttgaaaacaatgcaaacgcagagcgtcgtgcctggggcgcagcggcctctgcagctctgaggttcagagcgcggcgcgcaggggcgcaggggcgcaggtccccggagcggctgggcatcgccgccaaccccgggacaaccaagccgccgaggacttggtggaggtgggagggagagcggaccgcgcagtgttcctc

SEQ ID NO: 92297 - DNA, 278 bp, Homo sapiens
  chr4:55100066-55100344
  hyper
ggccgtcgcggccctcgccaggctggtttatgggggcggcggtggcgcgcggacagataggacagcgcggcccgggaacggcgtcgaggtccaggcggtccccctgccccgagggggcggaaatgctgaggtggcgagagcgtgggttgcacagaaccctagtagcgagtccggctgagcctctgcggcctagcccagcagcgtcgtcttcccggctccgaagacgtcttcccgaagccccgctgccccggcgcaccagctcccggtgatggggatga

SEQ ID NO: 92298 - DNA, 30 bp, Homo sapiens
  chr4:552737-552767
  hypo
ggatttccactgcagcgctgattagaatcg

SEQ ID NO: 92299 - DNA, 214 bp, Homo sapiens
  chr4:55350697-55350911
  hypo
ggaactggtgaactccgccaacggacagccagcaggtgcacaaggtattcagaactctaaaagagcacgactctcatgaaagcaagctgcagcttgcaggaggcattaggtttacactttccacccctcctaccattgcaaacaagttattagcagttttacattttcccttaggggaatcagtgttaattcaccttggcgctattctggcacc

SEQ ID NO: 92300 - DNA, 184 bp, Homo sapiens
  chr4:55393636-55393820
  hypo
atgaagagaactcaacgcccccgccgccccactcctcacgcttcctgatacattagggaacaccccttaagccataattgccgctggtgtcagtaaacattttaacaggcaaaaacatggccactgcacttctaagggaatctgagtctgtaaatgaagagaattctgtcgatactcacttcca

SEQ ID NO: 92301 - DNA, 33 bp, Homo sapiens
  chr4:55406440-55406473
  hypo
aaaaatacacatttccggccgggcgcggtggct

SEQ ID NO: 92302 - DNA, 36 bp, Homo sapiens
  chr4:55456469-55456505
  hypo
acaaatggaactaacctacagcgtgtattgtgtcga

SEQ ID NO: 92303 - DNA, 328 bp, Homo sapiens
  chr4:55523645-55523973
  hyper
cccatgccacctccacgagcagcggcgtccagcctcctcccgcccgaacgtgctcgaggggcgggcagtcgacctttattgtctggggagcacctggcaggtggcgggcccgtgccctaacgtgtgcgtggtgcccagcttcacaaagcgagcgggcagcacctccttggtccgggaacggcctcagcctggccgtccacatcccaggggtggaaaggtggagagagaaaggggctccggagtcaagagcggggagagagggcgcgcgcgccctcctcctcccggcgggcacggccccccggcattaacacgtcgaaagagcaggggc

SEQ ID NO: 92304 - DNA, 74 bp, Homo sapiens
  chr4:55524220-55524294
  hyper
ctgctcctactgcttcgcgtccagacaggtgggacaccgcggctggcaccccgaccgtgcgactactcggcgaa

SEQ ID NO: 92305 - DNA, 839 bp, Homo sapiens
  chr4:55524518-55525357
  hyper
cgaggctgcaggctccgtgcgagtttggggtggcttttgtgccgacgttgcgcggggggcggaggcggggggctcaggggtttgcaccgagcgccttctcttgccgtgcgaggcgcggccgcagcttccttttgttaaaagttgcgtgtgtgtgaccggcgcccgggaggacctgcctgcaggttctccgccgcgctgagggcaaagttagagagccctttctctgctctgcggctactgccttccaaccgcaggcgctctttgtgcccagagctggggaccgacccgctgccgcctctgctcgcggcgccacccgtggagaccaatcgaaggctgcggcgtttccccgcctccgggttaggcttttgcgctgggagtgcgcggcgtggggctgttgtggggccggactcccgcgagcctggaggtggtggcgacagggacaacttgggcagggcgtgtggaaagcagccgctaggttgcagactttttgctttcgtacatcccgtgctcgcccctttctgccgcggcgccgtttcattcctgccgcgcgccccggggcggctggaggctgtgtttgccgcctgctccgggaaggcaagggacagcgtgctgggactctgcgttccctgactccaaccgcctagcacgccggccagagtgcccggcctgcctggcgggttctgaaagcccctagttcccggtgtctgcgacctgtattcgcaggtcctgttttcttcggaaatttttgagattcgtgaccgcccgcctccccgcccccgggacttctatacttcagggctgcctgggggtggggtgggagatggcgtggaactttctgc

SEQ ID NO: 92306 - DNA, 227 bp, Homo sapiens
  chr4:55990946-55991173
  hyper
ccgatccgggagacccggcctgagattccggcaaggttttcttccccgggcccggactaggatgttgcgcgcagccagacaacttttcaccgcctgttctcgcctgcggaggcacctcctgcctgccaaccccaggcgccttcccaccccagcctcccaagagcctgagggtgtgtcggcatctcaggacatgctccagccgaggtccctgtcgcaaaccagagtcc

SEQ ID NO: 92307 - DNA, 39 bp, Homo sapiens
  chr4:55991454-55991493
  hyper
ctgcatcctgcacctcgagccgggcgaaatgcccagaac

SEQ ID NO: 92308 - DNA, 227 bp, Homo sapiens
  chr4:55991863-55992090
  hyper
cctcacccgggtacccggcggcgatctccagctccccaagcccatttacatctccccatttccccacacaactggactgcgctgggccccaagtcgcccaggagagaacatcccagagcaacaactttgtttctggtgtaaataaaaagtactcggtaacgggcgctgagcaactccaagatttaatcgcttgccggtccccgaaatttggggagcatcaccaggag

SEQ ID NO: 92309 - DNA, 69 bp, Homo sapiens
  chr4:55992152-55992221
  hyper
cgcgcgtctgaagtggccgagaatctgcagcagtttggagccacaagggagaagcggatactcagccaa

SEQ ID NO: 92310 - DNA, 23 bp, Homo sapiens
  chr4:56213501-56213524
  hypo
agatgcatcttaggccgggcgca

SEQ ID NO: 92311 - DNA, 30 bp, Homo sapiens
  chr4:56422506-56422536
  hypo
gtcacgacgcctggccgccaaatactattt

SEQ ID NO: 92312 - DNA, 121 bp, Homo sapiens
  chr4:56501604-56501725
  hyper
gcacacttgcctctccgactttatgtgatgagaagttctctattccttttcctgatctagtgcctgaaaaccgataaggcacaaagcccactccttcccttctaagcggttagcgtggggc

SEQ ID NO: 92313 - DNA, 37 bp, Homo sapiens
  chr4:56502430-56502467
  hyper
gccctggctgtgcctcggggcccggacacaggactga

SEQ ID NO: 92314 - DNA, 61 bp, Homo sapiens
  chr4:56503474-56503535
  hyper
tgctcctcctgcccccgcaccgcccctccccgccccctctcccccgcgccataggccccag

SEQ ID NO: 92315 - DNA, 246 bp, Homo sapiens
  chr4:56659621-56659867
  hyper
agtggcgagtgggcacggctctcgggagagggaaggcagcgattccaggagtcggggtcgcctcgctgcgatggcaggttcagcttcggttcactaatcgcaaccagccccaccgcgggagacggggagagccctggctgctgcaggccggcacctgggtagatgttaccttttcccgcacagggtcagtccacagacgtgcaccagcaccccggcgaccggtcacagccttcccctcgccccggg

SEQ ID NO: 92316 - DNA, 163 bp, Homo sapiens
  chr4:56659934-56660097
  hyper
cgcactccccgggtatgctgcgggccctctccatccggggaggcggggtccggggaggacacatccccggcccggcctctccgagagaccctttggatttttctcttccacaccgcctcatccgaggggagccccccaccccacaccccgcagtgatctgggg

SEQ ID NO: 92317 - DNA, 358 bp, Homo sapiens
  chr4:568295-568653
  hyper
gtcgccgtcctggggcgctcgctctgtccccctcgcctcggaccaccaggcagagcagccccagggtttggacttgccaagaaaagtgcagtcgggctagccaagcccaaacatttattgtaaacttgaaaatggaatccagatatgaacgacacaaataagaagagaaacctcccagatacagaaatggtcacatcaggggccccctcctgtggtcacggagcccgcagagggggccaggccggaggctgcaaagccacgtggaagaggcggcgcccctgaggcctggccctggaccccgccccgctgcccgtcctcccttgccgcgggggtcctgagcggggcggggtgggtggaa

SEQ ID NO: 92318 - DNA, 69 bp, Homo sapiens; identical to SEQ ID NO: 2356
  chr4:569047-569116
  hyper

SEQ ID NO: 92319 - DNA, 162 bp, Homo sapiens; identical to SEQ ID NO: 2357
  chr4:569274-569436
  hyper

SEQ ID NO: 92320 - DNA, 30 bp, Homo sapiens
  chr4:56936174-56936204
  hypo
gtggagataaggaaacggagagtcagatgt

SEQ ID NO: 92321 - DNA, 273 bp, Homo sapiens; identical to SEQ ID NO: 28670
  chr4:569460-569733
  hyper

SEQ ID NO: 92322 - DNA, 194 bp, Homo sapiens
  chr4:570063-570257
  hyper
gggaaccgatgcggcgcagagaccgcagggcgcgcgccccctccccagcccgcggggcccctcccaggaggctcgttcccccccaaccccccaccccgcccgcggccccgcgcgcctcgccctggcgccgcccttccccgcccccggcagcccccgccacccccgggacgcccctccgcttcctcctcccggag

SEQ ID NO: 92323 - DNA, 203 bp, Homo sapiens; identical to SEQ ID NO: 7201
  chr4:570298-570501
  hyper

SEQ ID NO: 92324 - DNA, 44 bp, Homo sapiens
  chr4:57063851-57063895
  hypo
tttttttttttgaaacggagtctcactctgttgccccgctggag

SEQ ID NO: 92325 - DNA, 1356 bp, Homo sapiens
  chr4:570836-572192
  hyper
ttcaagggatggggacgatcagggtctctgggaagtgctgacgtgtgcgcgtgtgcggtgtgttgcttgtgggtgcgtgtgtggtgtgtgcatgtgtgtgcgcgcgcgtgtgtgcggggtgtgccgtgagcgtgtgcccgcggttcgggggatgagtaggggcgctgacttttaggaccagccatttgagtcaagctggagacgacgtcttagaacctaggatgagtctcgtttggttttagtctgcaaagctcgtctgcatcagacaggaattttccccagacgcgggtgcacgtgaattaattcatcagaaggcggttcacggcctgagtgagggggacgagggcggcgaattcctccgcctcattcctaccctgacgattcgaggtgggtgagaggaaggcgtggggcggctgggtgcgtggggtgggggaaggtcacctcttcggcctctctgggccctccagcctcttcctgagaggagctcgcctcggccccttggttggggggatgggagcgtctccggaaggccctcggccgagcagctgggcctgcacccctggtcccttccagttcgtttctgctgcggcggcaagaggctggggagccgatgactcaccctgccggctaattgcagcgttaaataactttgcgccggattcggtggctgcagcagggaacgcgctccgggcgccgggggaggtggagggacgccctgagaacgcacctccgtccctgtcaccagccttagcaagttctggcctgtggagccgtcatccagagcgcacagcttcatgcccttgaagggcgcagtgtgtcccgtggtgcccggtgggcccggacagagaccccagaggctctgtctgaaggaagctgcacccacagactccatccaggcagcgcgggcgcggtcctgtcgcctacctttctcggaagccatctgcccatgtgaatctatgtgaaggcccttcatgcgctcctggacatctgcgtgggatttacttcaactgctatcgctgcgaggaggacgagcatgtttcactgtatttttagcagagagtgcagattttagaacctcgcgaacggtcctgtatctcctgcacgatgactctccagaacaggaatagtgacccttcctttgcatttatggtgcataggttttcaaaggacagtgtgtaaatcagcttgtgtaataattgtggcacccacgcgcgcaagcagacttaccatgagctgacttccactgattatttcagtttccagggaaacgaggtttgcagccccctccagtgagggcggagcggcctctccattcccaatgcagcaaggctgctgcagccacgatgattaggcttt

SEQ ID NO: 92326 - DNA, 253 bp, Homo sapiens
  chr4:5709732-5709985
  hyper
ccctaggtcgaagctcgtaaaatggagagcaggattcgaaccagggtcgctggtgaagtccaagccggcagctgccacaccccgaggaaggtctccagtttccctcgaagctttctggccgtgagcgggatacacctaagggccgcgaagcaccctattcagatcctgccctcccttcctcattctttgcgaaatactaagggtcctccctgccaccgccggtgtagacaaagtcaaaccactacagtcagac

SEQ ID NO: 92327 - DNA, 78 bp, Homo sapiens
  chr4:5710450-5710528
  hyper
ggcggccaggcctgggtttgcttgcgcccaaaccgaatcagagcgggtcactcccctgctccccgaggttaccaggac

SEQ ID NO: 92328 - DNA, 341 bp, Homo sapiens; identical to SEQ ID NO: 28747
  chr4:5712891-5713232
  hyper

SEQ ID NO: 92329 - DNA, 8 bp, Homo sapiens
  chr4:5713326-5713334
  hyper
cgtggctt

SEQ ID NO: 92330 - DNA, 48 bp, Homo sapiens
  chr4:57180924-57180972
  hypo
cagtgagcttctgaacgactttgaggagaggctcgaagaccaggaacg

SEQ ID NO: 92331 - DNA, 79 bp, Homo sapiens
  chr4:57182183-57182262
  hypo
aggaaaaagcctcaccgtttggaataaaattgagaaggaccaactattccttgcgcttcaactgcgaccaacaggcaga

SEQ ID NO: 92332 - DNA, 24 bp, Homo sapiens
  chr4:57252055-57252079
  hypo
gagccaccgcgcccggccgagtca

SEQ ID NO: 92333 - DNA, 101 bp, Homo sapiens
  chr4:57252411-57252512
  hypo
gctttctgcagcaggcgcttaaattatgaggaatgagttcatttcgcaacatacaggtagcgcagaagggtacctacacatctatacgataattaagatgt

SEQ ID NO: 92334 - DNA, 30 bp, Homo sapiens
  chr4:57370899-57370929
  hypo
ctttgaaaagcccttcgtgtgccttattta

SEQ ID NO: 92335 - DNA, 250 bp, Homo sapiens
  chr4:57371618-57371868
  hyper
aggttgcttagactgcggcccacgtggaaggctcttagccaccctgcctggcccgaggtaatcgcgctagggacgctttttctgcagcaatgatataccccgccgaactgtcccacgtcctggttgggacctcttggtttcgcttggctgggctcaatccatccgtacgcctccgcccttccctctttgcgaacccctgcgggttcagcgaatcggctgcaagaagccctgcatccgcgaggtaagcggc

SEQ ID NO: 92336 - DNA, 166 bp, Homo sapiens; identical to SEQ ID NO: 28950
  chr4:57371869-57372035
  hyper

SEQ ID NO: 92337 - DNA, 217 bp, Homo sapiens
  chr4:57372287-57372504
  hyper
ggaccccgctcgagccgctggtaagagacccagtgcccaggaccccttgccccaaggcttttgtcggccgttcagaccccagcgctgtctctgttacgtcggaggcccccgaccgcgtgggagcgaatggatctcaactgagggctatttacctatggatgaaagagatgcgccaaactttgaacgacccatccccttttcccgggccccctgccca

SEQ ID NO: 92338 - DNA, 866 bp, Homo sapiens
  chr4:57396459-57397325
  hyper
tccttgctctggacacggggaacagggtcagcatctcgtctcctatctccaccgacctgtctctggcttttcttagtccccagatgcgcccagaaggtcctggagagtggtgcgtccccttggcaaccgtacaacgcgcaggaaggcggagtgagatgaggctgagtccggccggggcggggctgtgtgggactagggcggggctcgggggctagaccggggcggggctgtgtagggctggggcggggctcggggcggggctcggggcggggctgggcgcggggggccccggcagcccttatcgtatcgcgcagagagcaaactgcgcctgggcaaccagtcgggagggtgagtcccgcgcgcgacagaagcttctggcgcgaatggagaaccaagagtttctaagttcatctgcgccgtccgaggtgaccgatgggcaggtctcaacagaaatatccacttgctccgaagtcttccagaagcccattgtgctcaggattctcgacactcacagagagcttgaggagtccgaggatcccgagaaacacgagaatcccgaggaacccgaggaggtcagggagcaagaccagagagacgagtccgaggaatgtgatgagcctcatgagtcctatgagccccacgctccctatgcgccccacaagccccgggactcctatgcaccttacgaactccatgggccccatgcagcccccaaactcctcaaggcccgtgaaccccgccagctccgccacacccgtgagccccgcaagtcccgcgaggccaaggaaaccgagttgcttcccagcgccgcagtaatgatctccccctctctgatcaccagagccccgccacggcctcagctgtct

SEQ ID NO: 92339 - DNA, 15 bp, Homo sapiens
  chr4:57521381-57521396
  hyper
aattttttaaaaaat

SEQ ID NO: 92340 - DNA, 159 bp, Homo sapiens; identical to SEQ ID NO: 372
  chr4:57521505-57521664
  hyper

SEQ ID NO: 92341 - DNA, 683 bp, Homo sapiens; identical to SEQ ID NO: 373
  chr4:57521700-57522383
  hyper

SEQ ID NO: 92342 - DNA, 396 bp, Homo sapiens; identical to SEQ ID NO: 374
  chr4:57522419-57522815
  hyper

SEQ ID NO: 92343 - DNA, 249 bp, Homo sapiens
  chr4:57687638-57687887
  hyper
gggaaccgccagtaacgggcgcgcgggtaccgtcgccgaggccgcccggagcagggcagggtccgccgccggtctgactcccaaacccgcttttctccggaggtccccgctcgccaggaccgctccgagcgctacctgcgaaggtaactgccaggagcagcagcgccaagcgcagcaccgacagcgccatcctcctcccgcgccggctgtcttgcccctgcggtctgttacctgcgccactcgcaggga

SEQ ID NO: 92344 - DNA, 95 bp, Homo sapiens
  chr4:57775782-57775877
  hyper
tacacttgggtgaagcgggttactttttgtattttcggtttaactttattttcttagaacttcttactttttttaatttgcgagtgaacacttcg

SEQ ID NO: 92345 - DNA, 39 bp, Homo sapiens
  chr4:57777437-57777476
  hypo
tccaagggccccattcgctgtgaccgctgcggctacaat

SEQ ID NO: 92346 - DNA, 30 bp, Homo sapiens
  chr4:57803508-57803538
  hypo
caccacgcctcttgccgcctcctctcaaaa

SEQ ID NO: 92347 - DNA, 135 bp, Homo sapiens
  chr4:57906901-57907036
  hypo
aggctgaggatttaacgttttaccatccttgtgcagtgcaagagaagcttgtcagcctaggatgtctcttaaagtctgtgccacagaccttgttccagatgaggacaggtgtcgggattccgatgacctcacagc

SEQ ID NO: 92348 - DNA, 979 bp, Homo sapiens
  chr4:57975777-57976756
  hyper
ttctacatatacacccggccctcactttctggacgcacgcagcaaactctcaaaataaaaccaccaaaaaggagaagggggggcgtcgcccaccgctcctggcattccgcggctgccaactctttccctcccatctggctcctgggatgcccgcgggggaatcgcagtgagcagcgcggggcgaggccgccgcggacgccccgtcggatgtgcccttcgctgggccgagcggcgcagggttggagagggaagcgctcgtgcccaccttgctcgcaggtgcccttgctgacctgggtgatggccttctccccgcggctctcggccctctggctggcggcgcgcagctggcagccgctcgggtaggtggtgccgtcgctgccgcacaccgggtagcggctcttgcacacgcacacgccgcttacacccggaccgccggctgctgccccggctttacccttccgcctcttgcggctcttcacgcactccatgcccggcgcgcagtaccccctgccggcgccgccacccccgcacggctcgccctcgccgcgggcgcacatagggcagcagccgcacgcgtcgcgggtctcgcccagcaggcagcccagcgggggcaggggcgggcaggaggccggctcgcaggggccgcaggtgtccgaagaggaggaagaggagaggggcaggagcaggagcagcagcccagcggcgccgaggagcagggcgcgcagcgacggccgctccatggcggggtgcggtggcagcggcaagggcgcgagtgagccgtgtcgggccggccggcgccttaaacccgccgccccgcccggcctgtccgcgggaaccacaccccggggcggtgagagcacgggggccccgcccgtgccgccctcccggccccgcggggcctgcgcgcgcgctcctgctggcgtcggggggtgagcgggcacccggcgtgaccggcccatgggcgctcggtctcacgccc

SEQ ID NO: 92349 - DNA, 350 bp, Homo sapiens
  chr4:57976757-57977107
  hyper
cttcgcagagctcaccccgccagctcctgctcggtccccagtcccctgccccgagccctcagggatcgcaccgcagtgcgagcggctcttccaccctctggtttctccccgtttccggtcaatatatttaaacttcttaacaaccacggcttcgagacgatccagggtttcatctattaaatcctccgtgggcctgagacacctgagtgctcattactctgtggtttgggaagctctcttaagaacaagctgttaaaaacccccacttgtggactgtgtccccgctggccacaggcctgctgtggtcttgggtgtcaagcactaaaaggacaaaccgttgccaaccactt

SEQ ID NO: 92350 - DNA, 30 bp, Homo sapiens
  chr4:57977334-57977364
  hyper
tcgttggagctgccacggaggcacctaaag

SEQ ID NO: 92351 - DNA, 1490 bp, Homo sapiens; identical to SEQ ID NO: 28748
  chr4:5889116-5890606
  hyper

SEQ ID NO: 92352 - DNA, 187 bp, Homo sapiens
  chr4:5891895-5892082
  hyper
aagtcctaggttccccgtaccagggcgttccctggggtcagtctggagatctgagcagaaagcccctacagcaagggacaagaccacgtgcgtatcagggggaggagcatccgcctgccactggccaaacagatcgctgctcccaagcagatttcgccggtacaaagcgccgcagccgctcagcctc

SEQ ID NO: 92353 - DNA, 120 bp, Homo sapiens; identical to SEQ ID NO: 28750
  chr4:5892109-5892229
  hyper

SEQ ID NO: 92354 - DNA, 182 bp, Homo sapiens
  chr4:5892520-5892702
  hyper
gttggtgacattgaccgcagttccagaggaactctccttgggacagctacgggccgtgcacaaagcgccctcgcctccctagtactccaccacgctttgaggaaggccggaagaagacggccacccccatctgacagatggagaagctgaggcccaagagagcaaagcgccttggctggaaa

SEQ ID NO: 92355 - DNA, 317 bp, Homo sapiens
  chr4:5893437-5893754
  hyper
gaccctggctctcgtcggtccatccaaaggctacgccgtccatccgcccttcttcccccagtttcctggtgacccccagctcaagagagaatacccgcagggcccaagccctagcgttccctctccctgatcctcccggccccatgctcaggtccgggaggccagagaccccagttcaaatcccagctctacctccaccttgctctgtgaagcaggcacatcggtgtgtgctgtggagctcaggagtgccccttgaatctactggcgcttgagggtaggggtttacggctccaactgcccgacgaactaaatcctta

SEQ ID NO: 92356 - DNA, 102 bp, Homo sapiens; identical to SEQ ID NO: 28753
  chr4:5893981-5894083
  hyper

SEQ ID NO: 92357 - DNA, 317 bp, Homo sapiens
  chr4:5894812-5895129
  hyper
cggcccagggaggggaggggcggggcgtggcgcgcgccggggcggggccggggcggggcctctgggcggctgcgggctagcggcgcggccagctacaaaggaccaggaggcggggatcgcggctggggcggggagggacggtgacgctcccgagccgcagcgcggagggcgggccgcggcaccgcagtgccctcgccgcaccccccactctccgcccccaggcggagcgcagggcgcgaggagagcgcggggcaggagccgtgtgcgtacactcgcgcgcccacacgctctggaggcacacgcgggttcatacctgc

SEQ ID NO: 92358 - DNA, 30 bp, Homo sapiens
  chr4:6019884-6019914
  hypo
cggactccgatgtcacgtacttgtcctctg

SEQ ID NO: 92359 - DNA, 160 bp, Homo sapiens
  chr4:6032062-6032222
  hypo
tggtaccagggtgaccgacagacccggtttgcccaggactttcctggtgtgagcctcaggaaacccctcagtcctgggcaaacccagactcttagttaccctccttggcaccgcacctgcagaattaattccctgggtggtttaccgatcattccttccc

SEQ ID NO: 92360 - DNA, 30 bp, Homo sapiens
  chr4:60685051-60685081
  hypo
ttttctttttatttacgtatttatttattt

SEQ ID NO: 92361 - DNA, 16 bp, Homo sapiens
  chr4:61380678-61380694
  hypo
gaagcagtctggatgc

SEQ ID NO: 92362 - DNA, 36 bp, Homo sapiens
  chr4:617245-617281
  hypo
gccaaccctcactcccgctagcgccccaaatcttca

SEQ ID NO: 92363 - DNA, 169 bp, Homo sapiens
  chr4:6176884-6177053
  hypo
aacacagcactgacacgcaggcaagtgacactctctgggcccgctgaggccctgaaggctcagaaaggttaaggaacctccccaaagtcacagaactcccatgtgatagaaccgggacacaagtaagtgagctccaaatggggtcccttcattccgcaataaaaagtaa

SEQ ID NO: 92364 - DNA, 372 bp, Homo sapiens
  chr4:619507-619879
  hypo
tgtggccgcggcctgcgaggacgggtgcccgccggactgcgacagcctccgggacctctgccaggtggaggagagcacggcgctgctggagctggtgcaggatatgcaggagagcatcaacatggagcgcgtggtcttcaaggtcctgcggcgcctctgcaccctcctgcaggccgaccgctgcagcctcttcatgtaccgccagcgcaacggcgtggccgagctggccaccaggcttttcagcgtgcagccggacagcgtcctggaggactgcctggtgccccccgactccgagatcgtcttcccactggacatcggggtcgtgggccacgtggctcagaccaaaaagatggtgaacgtcgaggacgtggc

SEQ ID NO: 92365 - DNA, 30 bp, Homo sapiens
  chr4:6195587-6195617
  hypo
gcttccaacaccagccgcaaaggtgagaac

SEQ ID NO: 92366 - DNA, 465 bp, Homo sapiens; identical to SEQ ID NO: 28755
  chr4:6200828-6201293
  hyper

SEQ ID NO: 92367 - DNA, 324 bp, Homo sapiens
  chr4:6201349-6201673
  hyper
cggcgcccacgtgggcggagcagcgcgagggtgtgcgtggcaggggccgcggcggcgtgtgccgtgcgtggggtggggtgcgggctgggcggcctcgccttcgggccccgcgccgccggggcgcggcccccagctccatcttctttgccacctgggcggagatctgggggactgtgacctaccctgcggaagacacggaggggacgggccggccacaccccccgcgccactccggcaggcaccgggtgggtccccctcccgctccttggcttgagggcggaatccggagaagagtggaaataggggtggcgtgaaggagagctg

SEQ ID NO: 92368 - DNA, 779 bp, Homo sapiens
  chr4:6201879-6202658
  hyper
cgccgcgtcccttgccgccaggtccgcccctcggtcgccgggtccacgggttccctctggccagcgctcgcctcccgccccccggcgcacctgtacccacctgctcggcgctcaggcccgagccgggcagcagcagcggacgtagcgagcgcagccccgcgccgcatcctccggccgccccctccccgctgcgagcttacgccgctgtcgccgccgccaccgccttaaaaaggacaaaacggaacagaaaatgaatgcatgcacaaaaaaaatcgtaaaaagcaattgaggaggatggcagtcgcgcgcgcggctcggcggggcgggagtcgagaggccgcggcactggtggccgcgatccgggcaggcggccggcgcgtgccgcacgcgggtggctgcagctccctcggtcgcccgcgcccggctcaggcacggcaccgcccctccccccggggagcccctccgattggtctgtcttcctgccagtcaggcaggagggcgcggcgcccgccccgccccgcccccgcccccgccccgggcagatgccgggagctctcctgccgccgtgggagggggagctgagctgccggagcgtgcgcactgggccagcgggcggccggggcagggctggggtcccggcgctgagcgcccccagccgcgccgggcagcctggcgcctcgctgagtcggagcaacccccggcaggagctttcaggctctggtcaagcctcgggacccgggaagctatccctgccctcgggggctcgagcctggagtggg

SEQ ID NO: 92369 - DNA, 268 bp, Homo sapiens
  chr4:62065803-62066071
  hyper
cgaggcgggcctcgaagccactggagaggtaccctttgtctgacaaaccctgaaagggaagcctctagtagcagccctcccgttcccacctccaagcgtttgccgaactgctaggtggagcccgcgccgcggagcccacgagcactccatatccgggttttgccggccacccctttccctggcgcgagccccctccccggctctcggagctcttgccgctggcccgcccgaccgctgctcattctggcctccgctccggccccggctg

SEQ ID NO: 92370 - DNA, 1491 bp, Homo sapiens
  chr4:62066133-62067624
  hyper
cgtcgcccccctcgcctgctggcccggcaccgctcgctccagttcccaggagcggggatgcagatgctgcagctggtcggggtgggcgccgccgccgccgccgccgccgctgctgctggtttttctcggactgctcgttgcctccgctccggcagctgctgccgccgccaccgccgcctgtgactcgccccctcccctttctttcttctctttttgccttggtcctcttcctacgggtgtgcgcgcgcgcgggttgcacggtttgctttggcaggagctcgctcgtgtgtgcgcgtgtgtgagtgtgcgtgtctggagagcgccagtgcctcgctcgctcttggggagtcgaagaagagaaagaaccgaagagacagcggcggcggcgcagagcccggggccgcgcgatgaagctcccacatgcccgcagctgcccggcccggccggcgagctaatcatccaccccacgggctcggggttcgccggcccccgggacgcagccctcggcggccgggcgcccgctctgtctgcgcgccccctccgtgcaccggggaaggagtttgtgtggctctcgctccggctgtccgcggaggttgcgggcttgagaggggaccctcggctgggagagagcctcgggaggacgaagaggaggacggtttggcggagaagccacccctggccctcgcggctccccctacctattccatcgctcccgctccgaggcggaaaggggaggacgtggaagaagaaaaagaaagagaaggggggtggggtgggagaactggatataaagatcggctggggggatggtggaagatttttggtctcttcggcagcgtcttttcttaagcggcggcggcagcagcagcagcaagagaaggagaagcagccccagctatgactgccgcatgttaatagctgccgctgggtccctcggctgctgctggagacagagcctgactccgaagttgtgcaactgtggactgggagagacatttgaaccctcttttcttttcgctccccttttgcccccttggggtgtgtgaagcgaggaacgtaaaggaaggcgaacatttggctctctttttccttcccctttctccgtggctgtgtagcggaagaaagggaagagagactttttgttgttgtttccttgactggggtctccaccctcctgctgctttctctgcgcttcgattctcgttatttgccgcgtgtggttgggggtgtctgcacaggggccggccggtcttttgccccgggctcaatggctggattgtggaaactgcacccgccttcaggttgttgagcaactgatgggacgatctcagggaccggcgtttacgaaaggtaatttattcttcgcactcttcataataggggtcgccctggccgggcgcaggcggcggcatccaccgggcgggcaacaagagggggtgcggggtgcatgcacactcgcccttccactcacacactcgccctcacacacac

SEQ ID NO: 92371 - DNA, 329 bp, Homo sapiens
  chr4:62067873-62068202
  hyper
agggcgacttttctccgtcaggctggaactggtgccgctggaggcgggagcgggctggaggacggacagggtctgggtgagaagctgggctctgggaagatggaaaatgcagggtgccgagcccggcgcgattctccctcaacgcttgcctggagcatccctggccccttttgcccaggtcgcgcccctgagtcttggagtcgcgctgcctccccgcgccctgcctgttgtgtctccttcacggcagtttggtttagacctgcgtgcccaggctttgttaggcggttttggctggagaaagctgccactttcgtgggtggcccgggctg

SEQ ID NO: 92372 - DNA, 158 bp, Homo sapiens
  chr4:62068237-62068395
  hyper
cggtgttgcacgaatccgggcggccgcggcgccggggcggggtgggcagagcattggtggtcgcggttggcgggttacaggtaggagagaaggcacctcggcgcttctctgaggagaagggaaggctccaggctgcagcgcagcgtctgagctgccgc

SEQ ID NO: 92373 - DNA, 30 bp, Homo sapiens; identical to SEQ ID NO: 28967
  chr4:62068633-62068663
  hyper

SEQ ID NO: 92374 - DNA, 457 bp, Homo sapiens
  chr4:6223447-6223904
  hyper
tctggaaaggactcccggagagcagctgctctgaattttctaatttcgctacactggtgatgtatcatgtattcctgtgtgattcgaaaatgttaaaagtcatataataatgtagaagacgacccttcgcgagcgaggccccccacctctggccactgagggcacttacgtaactgcggggcgggcgcaggcctccactgggtgagcggcaggcgggggcggggctgcccggagcctcggccccgcccacccctctcccccgcccactgtccccgcccagccccgggctgctcggaaaggccggagtccggagcacagcaacgcgcggagcggcccggcccctctggtggtcccgcccacgcgacccgggcgcagcggcgggcgccggacagctgtcccggcgggcgaacgacatgcagcggaactgcgggaggctgcggttcggtggctggacttg

SEQ ID NO: 92375 - DNA, 241 bp, Homo sapiens
  chr4:6223950-6224191
  hyper
cgtccctgggatgggatctgggcgcccggcgcagcgcggctgacaacagccgagcggttccggtgcgctggcacgtggctcgggcctgcccccccggcctggccgcctcccggcgcgttccccggtgcaggtgcctggcccgtgccccgccatctccgcccggcgccgcctgtgctgaaggagccacgccccgggctccggagcctgcctctgcaaagtccaggcccgcggcgcgcaggtc

SEQ ID NO: 92376 - DNA, 531 bp, Homo sapiens
  chr4:6247186-6247717
  hyper
tgtgccctgggtgctcgggtgtgggggtcgcccgcgctcctgggagccgagcaagggcgcgcaccccgcagtgggagaggggcttcctgcgcagcgcgggaggagcttccaggacgggagctgtctggggcagagccctggctacggtggcctcgcagcacagcgaaagcacagggactgcgcagtcgggaggcgcttgctctccgtgcagacccccgggtgcgcggccgcagtgcctgcagccatcgccctacggggcctcgcgactcgggcatcgcccctgctctccaggcaggactagagcttccagaaagtcccagggcacccctcgcgcatcccaggggccaggcgggcgctgcaaagcctgctgggaggtgtagttttcgctgaagacggggctgcccagagccaaagcagggtgggctccagagcaagaagccatcgtggacgcggcgtctgcgggaggaaagcagctccttctggcttcgcgaaggccgcctagtccaggagccccagcgcccttctcccagc

SEQ ID NO: 92377 - DNA, 638 bp, Homo sapiens
  chr4:628132-628770
  hypo
ggcatccaggaagcccgacgtggccggagggcggcaggtgcgtgaggtgccaggcagggcggggccccccatgaggcctgtccaagtctgctggactgagcactggggggcaccagcatcctccgcacaggggtgcatggagccaggctggagccacagggacaggcccagctttcaccgcccggtggccacatcccagtgcccagcagggcccctgggcacctcacacctggagggcagcagcccccacagagcttgacgacaaccccagtggtgcgggctccaggcccacggtgcgacagcctctttagcctctttcctctcttgcggcagtgccctcacttcagctcatttgctgacgagctcactgactacaagacaaagaatatgctggccacacccatcatgaatggcaaagacgtcgtggcggtgatcatggcagtgaacaagctcaacggcccattcttcaccagcgaagacgaagatgtgagtgtggggggcacctgggcagccgcgcgtctgcctccctgcctgcctgcccgcccgcctgttctgtgctgcgcatccacctctttacctgcctgcccgcctgcccgtgtgttctctgctgcgtgtctgcctccttacctgcctgcccg

SEQ ID NO: 92378 - DNA, 120 bp, Homo sapiens
  chr4:628830-628950
  hypo
tccacctccttacctgcctgcccgcctgcccgtgtgttctctgctgcgtgtctgcctccttacctgcctgcccgcgtgttctgtgctgcgtgtctgcctccttacctgcctgcccgcgtg

SEQ ID NO: 92379 - DNA, 37 bp, Homo sapiens
  chr4:629370-629407
  hypo
tgcccgcgtgttctgtgctgcgcgtctgctgggctgc

SEQ ID NO: 92380 - DNA, 901 bp, Homo sapiens
  chr4:6472218-6473119
  hyper
caccgtcatccccaacgtagagatgagcaaacagaggcttgctccaggaagccagaccacagcgagcctgggagcagcggggcaacctgccaagatccgctctcggcccgagccaggccaccgaggcacgggccagcaacccggcggcttcctccaaccctctgtcgctgcaggctgcgagcagaaaccacatcccggacccacgctgatcccgactcagcctcgccgaagcaggcgacaaaggaccgctctcagctccccgggcctcccaaagccgcggccgggtcagagccccaccggcccggaggcccgggcagccctgcccctctctcgcacacacccggcggcgaagcgtgcgtgactcagcggttctcccgccgggagcgggcgcggcccccgcagcctccctccgcccaggtcccacgcccagcctctgcctcccgggccagggcgccccgagcccgcccgcgcccgcgctcgcgctgcgctccccgggcctccgcggggctccggctccgctcggcctcatttccggcagagccaggcttcgaggaggcggacccagccgcaggagcccggtctccgccgcctggcccactcggtctccctgacacaggcacccacgcgcacctgccccgcgggacccgtgcccagggcccctcccactggggcacccacccggggaatccgcgcacacttctgcggccgggccgccagcccgtgggttagcggctgacagtccccgcactcgggcagggctccagcacaggcggccccgagcccagacctcccggtccccatcctccatcggggtcactccgcgggccctgcctgcgcacggaagctgtccccactgttcccctagcgaggcagaccagggggcccccggaagttccaggcc

SEQ ID NO: 92381 - DNA, 30 bp, Homo sapiens
  chr4:6473457-6473487
  hyper
gcctagaaaattctgcgggctttgggcagg

SEQ ID NO: 92382 - DNA, 170 bp, Homo sapiens
  chr4:6473794-6473964
  hyper
atcgcgcggtccaaaccttcggagggcattcggtgcgacggcatccccacgccgcggccggccggaggggtctcagacaacacgtacgttaccttcagtcacatagctgtggtcccgcaggaagctgtggttaattttccgcgtgtccgtgtcctcgcccattgaaggcc

SEQ ID NO: 92383 - DNA, 522 bp, Homo sapiens
  chr4:6473965-6474487
  hyper
tgcccggtgctctgggcatgccccgccgccacacaccgatgcaatccgcagaggtcgcgccgggcgcgcgggccatgccgccgcagcctagcaggggcgcgggccgccggggccccgaagggagggcatcgcggcagggggacgggcgggggcggccgggggcgggcgccgcggtcaagcgagcgcgcggtgggcgggcggcggccgcgggttcgggcgggccggggcccaggcgcgcatcccggccggcccgtgcgcgctgcgtccgtgcgcccggcggcggggcctggtgccggtgcgcctggctgcggcgacggcggcgaggggacgcgcgcggcgctgcgctgcgccgaccaagccggggccgagccgggctgcgcgggctggggccgccgccgccgccgctgtcgcaggcccctccctcgcgccgcccgctctccgcccccgcggccctgcaggtggagccggcgcccaagccgaggctgcaccgccgtgctcgggccctcgcggtgggcaccttgg

SEQ ID NO: 92384 - DNA, 33 bp, Homo sapiens
  chr4:650380-650413
  hypo
ctgcgaggccgtgaccgccgccccacacacatg

SEQ ID NO: 92385 - DNA, 510 bp, Homo sapiens
  chr4:650838-651348
  hypo
gccggggatgccctgcgaggggtggggcctgtgcggtgtgggggcctccccgccaagcattcggctgtgtgcgtgtgctcatgtgtgtgcggtatgcatgcggccagggagaggacgacaaagggcccccccgggagcaggagcctctgcagagcacccgggagaccccacacagaagcactgcgacaccatggtggcagccccaggacctgcccgccgagccacggggcctggcacacaggcacatgggagggggcgcgccgggagcgctgagcgccagtgacactgccatcccctccagtccctgacacagttcctgggctggtcagtgatgaacaccgacacctacgacaagatgaacaagctggagaaccgcaaggacatcgcacaggacatggtcctttaccacgtgaagtgcgacagggacgagatccagctcatcctggtgcggcggggcaggacgtccaggggtcacccaggggtcacggctgtgtggcaggggcaggtcgt

SEQ ID NO: 92386 - DNA, 83 bp, Homo sapiens
  chr4:6525252-6525335
  hypo
gacaacgcacacccacgaggatgtctggaatccaaatgcaaagcgagtgttggctgttgggagagacgcgggacctgcacaca

SEQ ID NO: 92387 - DNA, 30 bp, Homo sapiens
  chr4:652650-652680
  hypo
ttcctctagctcacacggggtggacgcacc

SEQ ID NO: 92388 - DNA, 87 bp, Homo sapiens
  chr4:6537147-6537234
  hypo
ttggtgcatgcacgccgccacacaccacatgcaacgcgagcaccgccacccacggccgccctggccgccgcccggcacagctccagc

SEQ ID NO: 92389 - DNA, 193 bp, Homo sapiens
  chr4:6540136-6540329
  hypo
ccccagcgacgcaagcgtttcagagcaaaacggaaacatacaaggatgatttaacaatctgtgttgatggtgctgaacacacccaatggtgggaagggaacaaaatcaatcccctgctattttcactaggcaaaggaaaatgagatgaggtcacgtcatcttccaaacgccaataacacggcaaatgaaatta

SEQ ID NO: 92390 - DNA, 614 bp, Homo sapiens
  chr4:6564642-6565256
  hyper
tcttcgggctctgggcgcgccactgtcatggactgtccctgccagccaaaaaaaaaaaaaaaaggcttctccaaaccagagcagcagccgggcctgactcagcacccaccggcgcgggcagcgggaggagcgcgtagacgctgctggatggtacccgcggccgggactgaactccgccgcattgggtcttaccccggactccgagccggaccccgcgcccgcaccttcagccgggcagcgagggggggctcgagcgcgccggttctcggccgagacgctgtggctgacaccggtggagcgatctgccctggctcgcgcggcgagcaagtgctggaggcagggttccaagccggttctgtcgggttccctcaagaccccgagagcacgcgctccggagggaccccggcacttcggaccctagcagagccagccctgccccaggaccgccccggggtcggtgcccgggctctctgagtctcgcttctggcccgcgaagacgcgccctctcctccagtcgcgggagtcccgcacccgagggccgcgtccccgggcagggtgaggtcctgcggggctgggggtgaggcggggtgggcgcgaggcggctccggagcggc

SEQ ID NO: 92391 - DNA, 46 bp, Homo sapiens
  chr4:657666-657712
  hyper
ccttccgggagggggcgcctcgcggggcgggcgggtagcctgggac

SEQ ID NO: 92392 - DNA, 46 bp, Homo sapiens
  chr4:658106-658152
  hyper
ggagcaggaagagcccgtcgcggcagcttgtcgagggctgtgaaac

SEQ ID NO: 92393 - DNA, 359 bp, Homo sapiens
  chr4:660870-661229
  hypo
caatctgccacagtccgatgccagctgagtctctgaggacgcaaggcggacatggagggggagactcgatggggcaggggtctgaccgtggggccctgtgtgatgcccataagagccagctgcctccggccacactccctggtgatggaatccacgccccaaggaggatgccacgggttccacatgaagttgtcccggagtgggctgtgcccactccccgccccatcctacccaccccgggtcgtcagtgctggggagaaggtgggacaagggtggatatttgggcctgaagtggccacaggtcacggccccactgcaggtgccccccactgccttccccaccccgccacactccatgt

SEQ ID NO: 92394 - DNA, 30 bp, Homo sapiens; identical to SEQ ID NO: 40243
  chr4:6627192-6627222
  hypo

SEQ ID NO: 92395 - DNA, 699 bp, Homo sapiens
  chr4:66533984-66534683
  hyper
aacccatgcaagtcacgaggacacacacgactccaccactgctgcttcatctttccggtctagtgtcccgtgcccaggagtggaaggaatttctgcaaggttttgagcctcacgcgtcgcatccacagccccaaaccgaaacctcaccattctagccaaagtgggtaggtttttctatgttttcatggtggagctgacagatctggatctgagatactgttcccgcccctccgcgagtaatgcgcccttgggctgagacccgagctcagtccgggtgtgggagaggagcaagcgctgctggaggggacccaaaggcagaggtctcaggtccaagaggcaggcggacagaggggctgagcactgttccgggagcacgaagagcgacacaggtgttgctcccgcgccagctctactctcccagaaaaaggcagggacagtattctgggtctggagcacaggattgggggtagggagggggactgggtactcctggatcaggtgctggccagagcaggtcttttccgtctttaagacatgcccaggtgggttttagcggcaacttcctagcagcgacactccccctcacccctcctgccgcggcatcccaccttctcgccttcttccaccttggcttgagtgtgacaatgaactcccccaagaagaagggcacccaactgtgtggggcgccttctgtccttc

SEQ ID NO: 92396 - DNA, 421 bp, Homo sapiens
  chr4:66534894-66535315
  hyper
ccactccttcaagcccgaaatgtcacttccccacgcgccttaagtgaggcccagccgcacccatccccctggaacgggcctccattccccaaaggaggcctcgacctcctttcccccaaggttttccaccttcccagccccccaaccagcctctgtccacacgcatgttccttgcccagcactccgcagctaacgtcaaacaatgcaaccaaaaaccgcagaggggagcgaaaaggccagtggaaggggacgacaaataccaatttgagatgagactgcgatttagtctgcagcagcagcgtccagcgcgctgagacctgaactcccaggccccgcctagcccctccgccccaggtcgccacggtccccacccccatctccctaccttcgttgctggggctggccaggagggtccggagtg

SEQ ID NO: 92397 - DNA, 133 bp, Homo sapiens
  chr4:66535350-66535483
  hyper
cgtcgaggtgcagagtagcagccggccagggacgctggggtgatgggggtgtcgccgccgccgcttgggggccgccggcgtcccgcaccccggggccccgagccccgcatcttctccgagcctcctccggtgc

SEQ ID NO: 92398 - DNA, 1062 bp, Homo sapiens
  chr4:66535574-66536636
  hyper
cgccttctggcacgcggctcctccaaatgtaggaaccacggatccggctgagacagctgaagtttgcttctggctcctctcgcctccccctttggtggggttaaatgaaatattagttctggttgctagtgcagatctggactcggatcaagggtgtcgagagggtcctgggtcctgttcctttgcctttcaaaaagactttttacggattgagaatttttaaataccactaggggaaaggtgaaggttctttgcagccttcagtgttgaaatggacgaaggtaaggaaggcaaatcattttaagacgaaatctccgattttttaaaaaaggaggaaaaaagcagggtggctaaggataaagaaagaggacttgagaaaatgtggagaatgaaaaacaggagagcagcgagcaaaagcaaagatccagagttcaaagagactggcagaaggaaatagctgcgggctgagtgctgaagaggggagggactgacggctgccggccggtaggagcgcggagctgcgctgcggcggcccaggagctgctgcggttcccgctgctcggggagcaggcggtgtgtgcgcggctgcgaagtcgaggttgaaactgcaccgccaaggcgcgctcctgctgtgtctggagctccggcgtctcctctgcctcccagctcagcgcctcccaccctccttccctcctcctcttcccagctcccccgccctctgctgctcgcagcctcgccagtgagaatctactgtaagtgtgagttgcttcgacgaagtcacacacccacggagggaagtaatctggaggctgccttggtgagtgttgcctagcggtctccgggaaaggcgcgtcttcctcccgggataattagggcaaggaatcctgacgacgctggcgaggactggggttcccgggaggcggaagggagatcagccccagctcagccggcggcccttagagacgcgggtccctccgtttggcatcttgcctgctgtccctcacaggctgtggcatcaacaaccttgtcgtcacatcgccgcgcattcgcaggctctgctgg

SEQ ID NO: 92399 - DNA, 34 bp, Homo sapiens
  chr4:6660444-6660478
  hyper
ggcctccctggagtgcgagcgtgcccgggcgcac

SEQ ID NO: 92400 - DNA, 93 bp, Homo sapiens
  chr4:6670121-6670214
  hypo
caattgcattgtggccgtttcttgaaaatacaacgtgcaagacaccacgttttactgccccgcccggctagcagtggacgtggagacagcttt

SEQ ID NO: 92401 - DNA, 294 bp, Homo sapiens
  chr4:671984-672278
  hypo
gtgtgtgtgaccttgcgggtgtgggctgtgctgtgttgtgggaagtacgtgcctcacgttgctctcctggtgagagtccggagcaggatgagggggttcctggctttcacaaaatcccggtacccagaacaagcccacccagagtccacttgcccctcaagccttcagaggccaagctggctcctgctggacggcgatccctgaccactgtgctctgtgggccttctggaagccactgtccctcccccagtccctgtgctgaagccagacacctgcagccgtcctgcccccaac

SEQ ID NO: 92402 - DNA, 93 bp, Homo sapiens; identical to SEQ ID NO: 40245
  chr4:6719866-6719959
  hypo

SEQ ID NO: 92403 - DNA, 228 bp, Homo sapiens
  chr4:6748346-6748574
  hypo
gatctccaaggggtgcggccagcggatgggtgatggcatggatggagggtgggtgcatcaatgctggagcatcaactctgtgtgcccctgcggggagaatcgcccctgccgaagccccggctggtccaaaaccacgccagccgctttaggggtgtctgtggacccaggaccacacagcctcaagagccaagagtcccgagtgtgtgcacctgtcggcctgggtctgga

SEQ ID NO: 92404 - DNA, 33 bp, Homo sapiens
  chr4:676071-676104
  hypo
gactcggcctgcaggcgccggtatggggtgtgg

SEQ ID NO: 92405 - DNA, 78 bp, Homo sapiens; identical to SEQ ID NO: 40163
  chr4:676743-676821
  hypo

SEQ ID NO: 92406 - DNA, 30 bp, Homo sapiens
  chr4:6771794-6771824
  hypo
taggttttattacctcggttttatcacact

SEQ ID NO: 92407 - DNA, 185 bp, Homo sapiens
  chr4:678471-678656
  hypo
aaatccaccctaccccggggatcccacggcactgaccagcttgagcccatccaggaacttctctgaggtggagctggcagccccggcagagggcggggtggggggcacactctcccacaggcagatggtggacagcaggcagacgacgccagcagggatggtatagacaccgagctggggagggg

SEQ ID NO: 92408 - DNA, 49 bp, Homo sapiens
  chr4:679019-679068
  hypo
cacaaacacaccacccgcacctgatacacatgcacgagcacacacaggt

SEQ ID NO: 92409 - DNA, 113 bp, Homo sapiens
  chr4:6896320-6896433
  hypo
aggaggagacagggacgttgctggtacccactgcctgggaacccctggtgagttctccaggatcccacagcaatccccaggctgcggggtgctgagcacgcaaggcaacccct

SEQ ID NO: 92410 - DNA, 34 bp, Homo sapiens
  chr4:692476-692510
  hypo
cggcatcctaccaggcgtccgagcatgttcctag

SEQ ID NO: 92411 - DNA, 30 bp, Homo sapiens
  chr4:6946432-6946462
  hypo
ctggtttacagaatgcggggatgtccaggt

SEQ ID NO: 92412 - DNA, 74 bp, Homo sapiens
  chr4:6957571-6957645
  hypo
gacaggtagcagcctcggacacgtaagtccgagtcgcagctctgtgttgtttaggtggacgagtctgggcccat

SEQ ID NO: 92413 - DNA, 19 bp, Homo sapiens
  chr4:7035959-7035978
  hypo
gagacgcagggaaggatgt

SEQ ID NO: 92414 - DNA, 231 bp, Homo sapiens
  chr4:7047052-7047283
  hypo
cccggctgatgtttacgtttacttcttgccttgaccactttgggagcctccttgttcgttattccccctccaccccattcccctattccacacaccataaccggagcgagctttggaagcacaaagcgcctcacaccggcctcagtggcttttacttcaattaaggcagctttagaagtgttgagcaatgagatctcatctgttacctcccttgatcgttttatatttctt

SEQ ID NO: 92415 - DNA, 30 bp, Homo sapiens
  chr4:7084525-7084555
  hypo
gtgagccgccatgcccggccccttgttcct

SEQ ID NO: 92416 - DNA, 34 bp, Homo sapiens
  chr4:7131141-7131175
  hypo
gtcacggttccctctcgcacggcagcccagtgag

SEQ ID NO: 92417 - DNA, 30 bp, Homo sapiens; identical to SEQ ID NO: 40252
  chr4:7134112-7134142
  hypo

SEQ ID NO: 92418 - DNA, 228 bp, Homo sapiens; identical to SEQ ID NO: 28972
  chr4:71600396-71600624
  hyper

SEQ ID NO: 92419 - DNA, 79 bp, Homo sapiens
  chr4:718161-718240
  hypo
gaaggtgaagctccacggagcaccctggtggacagcggtgctgtgggggccatggaccagaaggcggagcccatgctgt

SEQ ID NO: 92420 - DNA, 25 bp, Homo sapiens
  chr4:71925563-71925588
  hypo
gctcctcccccgaggtttgctcgtt

SEQ ID NO: 92421 - DNA, 770 bp, Homo sapiens
  chr4:7194112-7194882
  hyper
gcctggaggtggggccgcgctcgggtacgccgggcttcccacgagcgcctgggcggcgggccggccggcaggtggcggtgcgcgctcggcgtcgcgggtggcgccggggccgccgagtcccctcctcccgccgctccctcccctcgccggctcctttctctgcgctctcgctcgcgctccccagcgccctcctgctctcccggccgcggtcccctcgtccgcgccgccccgccgccggctccgctgccgcccctggcgaccatggcgcaccgggggccctcgcgcgcctcgaagggccccggccccaccgcccgagccccgagccccggggctccgccgccgccgcgctcgccgcgctcgcggccgctcctgctgctgctgctgctgctgggcgcctgcggggcggcggggcgctcccctgagcccgggcgcctgggtcctcacgcccaactgacccgggtgccgcggagccctcccgcggggcgcgcggagcccggtggcggcgaggaccggcaggcgcgcggcacggagccaggcgccccgggtccgagtcccggtcccgctcctggtcccggcgaggacggcgcccccgccgcgggctaccggcgctgggagcgggcggcgccgctggccggagtggcttcgcgggcgcaggtctcgctcatcagcacgtcgttcgtgctcaagggggacgcgacgcacaaccaggcgatggtgcactggacgggcgagaacagcagcgtaagtgacctccacgcgctcgccgcggc

SEQ ID NO: 92422 - DNA, 170 bp, Homo sapiens
  chr4:7195096-7195266
  hyper
atcctgggccacctccgatactcccccactggcctccaggtcttgggttacggaggaggaccccagaaccttcggaagcctgcaggtccttgagggtaccccagctcggcgttacctcccctgcccccagactccaccagctgagcgtcgcgttctgggattttgggctc

SEQ ID NO: 92423 - DNA, 150 bp, Homo sapiens
  chr4:7195308-7195458
  hyper
cgcctccgcaggctccgggacttccccggtcagctcgaatcctgttctgggactctgggatttctgggttacccctctccccggggtactctagtgcgacccgcggctgtcttgagctcttgctgccggtcgccccgcctggatgcactg

SEQ ID NO: 92424 - DNA, 237 bp, Homo sapiens
  chr4:72226735-72226972
  hypo
ggaggaggagcggcccggcttctccaccctgagaacagagggaaattcccaaggctccaccccagtgcgcactcctcccagtgcacaggccggtcagagtttctccaggaacccctctatacttggttgtgacaatatcctttataacagtaaaaatcaatgcatacacatactcacgcacgcacacgttcatgtataaatatggttctttcccctggtaaccggttttcaaacatt

SEQ ID NO: 92425 - DNA, 30 bp, Homo sapiens; identical to SEQ ID NO: 40253
  chr4:7237615-7237645
  hypo

SEQ ID NO: 92426 - DNA, 206 bp, Homo sapiens
  chr4:7261017-7261223
  hypo
gtggaagctgaggtccgcagagttcaattccatgactgggggatttgaacccaggttgtgggactcaggatctcctcagaacccacattctcaagcacagatagaatcacggggctcacaggggttgtactctgtactcgtaggcccagggtatgtggcaggtgtttgagaaatggttgctgtgctgagggcgctcttcctggtga

SEQ ID NO: 92427 - DNA, 30 bp, Homo sapiens
  chr4:7282766-7282796
  hypo
agtcgcgtgtctgaacgtgccctgcccacg

SEQ ID NO: 92428 - DNA, 35 bp, Homo sapiens
  chr4:7295601-7295636
  hypo
aggacttggctattccgaggcgctgtccagcaggg

SEQ ID NO: 92429 - DNA, 32 bp, Homo sapiens
  chr4:7302270-7302302
  hypo
tgtaagcaacgtgcacgcgttgacacagtagg

SEQ ID NO: 92430 - DNA, 264 bp, Homo sapiens
  chr4:73433899-73434163
  hyper
ggatctctccctgtccggcccaaggacttcctgaaacccccgcctccggctgcccgaaaaaaccgtgagtcagttcggaggagagaaagctccaggaacccgactctggcggcagcagccagagcgctgggatcccggacccagcgtccagaacttcattcaagcgcccagaccgccctccagaaaggggaagcccagatggcccggcgaggatgggaactggctgcggtttgtcactaggaattgttacgaatgtcgcagact

SEQ ID NO: 92431 - DNA, 439 bp, Homo sapiens
  chr4:73434804-73435243
  hyper
ccaaagcagctttttcgaggcttttcgagcaccattggtccctaaggttagcgcggagaatgcttgggttccccggagcacagcagggggaagtattagcgagagagacgagcgagcgggagcgggagaaagaggcagggagagggcgactccgccgcacacgcagaggtgggggcgggaggagcgaaggggaggaggagaaggcaggcggaggaggtgggaggagtgggccgctcgccggctcctgttgctcgcagcgcggcagtctgctggctgctggcgacccgcggggcgctaataaggcgtccggagctccccggactgcccctcccgccgtggcgcccacgtcatgcggggcccgaacccgcgccccccgcaccgtgtcaggattggagaccgctcgggggctggtgtggcccgggctcgacctcccaccctg

SEQ ID NO: 92432 - DNA, 30 bp, Homo sapiens
  chr4:7376235-7376265
  hypo
tgcgtgttgcttttccgggtgcagtggctt

SEQ ID NO: 92433 - DNA, 196 bp, Homo sapiens
  chr4:738289-738485
  hypo
ggagtgaatttttgacggcatttggagtacagtgtagttttttaaatggcttgacagtttggatttcatggtgcgctatgttctgtttgtgctaaaaggtgaaaccaaagcagacgacagttcaaacaaagaggccgcggaggagaagccggaggaggacaacgactaccaccgcagcgacgagcaggtgggcggg

SEQ ID NO: 92434 - DNA, 57 bp, Homo sapiens
  chr4:741730-741787
  hypo
tggcaggtcagtggccggctctggcctcagccccatggcccacgttttgtgcctttt

SEQ ID NO: 92435 - DNA, 32 bp, Homo sapiens; identical to SEQ ID NO: 40297
  chr4:74468507-74468539
  hypo

SEQ ID NO: 92436 - DNA, 117 bp, Homo sapiens
  chr4:74702331-74702448
  hyper
gagtttcctgccagtcgggagggatgaatgcagataaagggagtgcagaaggcacgaggaaaccaaagtgctctgtatcctccagtctccgcgcctccacccagctcaggaacccgc

SEQ ID NO: 92437 - DNA, 76 bp, Homo sapiens
  chr4:74702449-74702525
  hyper
aaccctctcttgaccactatgagcctcccgtccagccgcgcggcccgtgtcccgggtccttcgggctccttgtgcg

SEQ ID NO: 92438 - DNA, 146 bp, Homo sapiens
  chr4:7475389-7475535
  hypo
gtgatgatggctgggcggtagcaggactagaagggccttttgggaggaactgctcctggctgggaggctgtgacttggcaatggggaggtgggagggtgggcgcggtcctggcatggggtcaccagggacccggaggctggtgcag

SEQ ID NO: 92439 - DNA, 497 bp, Homo sapiens
  chr4:74809854-74810351
  hyper
agggaagaagagactcgctgggtgagcgggactgttggcgcggggtgctaccccagccgtgtcccgctccggagaccccagggcgccgggacccatctgccgctcgccggccggaggctaccaggagcaggagcagcagcgccgcccgcagtagccggggagcgcgggggacagcggggggcgcggcgcagttcaccgggctcagaaggcaggtcgggcggcggtgcgaggagcgggagagctggcagggaggtgcctgcagcccaggctctgtggctccccaagatcggtgaaccctttttatgcatgattggggctgaaaagtctggaacccccgggccagggaaattctcggagctccaggtctatcccgagtactgaagaaaagggctggccccacccccggggtgggtgggtggtgggcggtggctggttacccactggtgcagcctccccggctcgccttccagagtaactcccgtcgactgtgggatatt

SEQ ID NO: 92440 - DNA, 458 bp, Homo sapiens
  chr4:74903976-74904434
  hyper
gtggcagcggaagcgcggggcgggacttacatgacttcggtttgggcgcagtggggtccgggggaccttacattcacactttggatgttcttgaggtgaattccctgcagtgtctgcaagcactggcagcgcagttcagtgaccacggacgctcctagggaagaatagactcgctgattgagcggggctgtcggcgcggggcgcccaccccagccgcgtccggcccggggaccccagggcgccgggacccacctgctgcgcgccggctggcggccaccaggagcaggagcagcagcgccacccgcaggagccggggattgctgggggcggcggagagcgtggcgtgggccatggggctcagcagacgcgtcgggaagctgtgcgagaagcgggagagctggcggggaggtgcctgcgacccgggctgtgtggctccccaagatcggcgaacccttttt

SEQ ID NO: 92441 - DNA, 30 bp, Homo sapiens
  chr4:75200375-75200405
  hypo
gagggaagtcatctgcgtgagagggggccc

SEQ ID NO: 92442 - DNA, 30 bp, Homo sapiens
  chr4:7522096-7522126
  hypo
tgtgtgctggttttccgtgggtcaggtccg

SEQ ID NO: 92443 - DNA, 30 bp, Homo sapiens
  chr4:75230457-75230487
  hyper
ggttagtaagtcacacgcacagctctccaa

SEQ ID NO: 92444 - DNA, 394 bp, Homo sapiens
  chr4:75230736-75231130
  hyper
tgacggtcctcctgccgctcctccctcgggccaattatgaaactctgggcactcttgacctcaccccgttagggcccgggaggggctccctagtataaagttcgcagcaccagacagttgagctcacttgcctgatatttccagtgtcagagggacacagccaacgtggggtcccttctaggctgacagccgctctccagccactgccgcgagcccgtctgctcccgccctgcccgtgcactctccgcagccgccctccgccaagccccagcgcccgctcccatcgccgatgaccgcggggaggaggatggagatgctctgtgccggcagggtccctgcgctgctgctctgcctgggtaagttctccccctctggcttccggccgccccaaaga

SEQ ID NO: 92445 - DNA, 29 bp, Homo sapiens
  chr4:75241002-75241031
  hypo
taaagtaatgactagcgattctttttttt

SEQ ID NO: 92446 - DNA, 148 bp, Homo sapiens; identical to SEQ ID NO: 40299
  chr4:75241331-75241479
  hypo

SEQ ID NO: 92447 - DNA, 107 bp, Homo sapiens
  chr4:7542297-7542404
  hypo
atggtcccatggtgccgagatgctttggcgctgcgctgcatcctgctgcgcagttcttcctcccgagggtctggccagcatcacccgctccccggcccacacatctg

SEQ ID NO: 92448 - DNA, 30 bp, Homo sapiens
  chr4:757296-757326
  hypo
acgcaaggaaaactgcgtggcaccacgcgt

SEQ ID NO: 92449 - DNA, 66 bp, Homo sapiens
  chr4:75858458-75858524
  hyper
taccagcgcccagtgcgctctgtcagtccgcaaactccttgccgcccgccccgggctgggcaccaa

SEQ ID NO: 92450 - DNA, 79 bp, Homo sapiens
  chr4:75858919-75858998
  hyper
cactctgccaaagtacgggaccagacttcttgttgccgttgggccctggaagggatgaaaaagccggggaagtgggggt

SEQ ID NO: 92451 - DNA, 65 bp, Homo sapiens
  chr4:75859363-75859428
  hyper
ccagatgactgagctcggcttggcggggaccggggagagattcagaaagacgctttgaatctaga

SEQ ID NO: 92452 - DNA, 104 bp, Homo sapiens
  chr4:759737-759841
  hypo
cctcagcacccttcccgatgaagtaggtccttctcgcctccacccctgctaagcaggcactgtgcgttcttgtgtcttccagaaggcgccgctcctgctgcact

SEQ ID NO: 92453 - DNA, 30 bp, Homo sapiens
  chr4:7602064-7602094
  hypo
gaggaacccccacagcgtggaggcttccct

SEQ ID NO: 92454 - DNA, 19 bp, Homo sapiens
  chr4:76394243-76394262
  hypo
ccagcatcctgttcccgta

SEQ ID NO: 92455 - DNA, 233 bp, Homo sapiens; identical to SEQ ID NO: 40255
  chr4:7647740-7647973
  hypo

SEQ ID NO: 92456 - DNA, 216 bp, Homo sapiens
  chr4:76555331-76555547
  hyper
aactagcaattccagcgctgttgtgatttcttctgcggacgcagtcacgagtccagggcgaagcaggcagggaggcaggtgggcctcggtccgccgcaagctcacacttaggaggaccacgggccgcatgctgtcgtcgtcaaggcaacgacctcactctgtccccaaccataggcacaaagtcttgggagacagatacggcccaggtcagaatgc

SEQ ID NO: 92457 - DNA, 357 bp, Homo sapiens
  chr4:76555548-76555905
  hyper
ttcacggcaggcaccaacacctgtgaaggccaagggctagagagcaattagctgggtgagaggcaccacctcccagctcgtaaggcgcccagtacctggagcctgggaacctgcaccgctccaactacccctgggcgaaggcgttggccgcggagctgcaagggggggcggtttctcacccgccccgagagcgccaggcctcccttcttctgattggccgagccgagtcgtcacgagccatgattggctcagggccaaccaccccgccccttcacctagggctcggcccaggttctgctccctgacacgcagaggccctgcgtccccacacgccttggttctcgtcaggaggcgcct

SEQ ID NO: 92458 - DNA, 75 bp, Homo sapiens
  chr4:7679887-7679962
  hypo
gacacagcacaggggcggttggccagcctggggcaggagtcagggagtgcttcctggaggcggctgagcaggagt

SEQ ID NO: 92459 - DNA, 30 bp, Homo sapiens
  chr4:76860425-76860455
  hypo
aggataaatgcagggcgacaaataagggca

SEQ ID NO: 92460 - DNA, 44 bp, Homo sapiens
  chr4:76912367-76912411
  hypo
taaatgaggattaatcgtttatttttaatcccgcagtctaaaat

SEQ ID NO: 92461 - DNA, 223 bp, Homo sapiens
  chr4:76912711-76912934
  hypo
accgtggcgctagataacactattccctcttaggaggaaaaaagagcaacgagggtcatataagttaatgtgtatgattttagatatgtttttattttggttttggttgtttcaacttagcgtgacccatacaagggaaaagagggctggataaaatgtgatcatgttgaccattaataaatgcaattaatcgttaaaattcaaccatcgttataagctttgt

SEQ ID NO: 92462 - DNA, 39 bp, Homo sapiens
  chr4:77156176-77156215
  hypo
taaaaataaattggccggtcgcggtggctcacacctgta

SEQ ID NO: 92463 - DNA, 85 bp, Homo sapiens
  chr4:77172970-77173055
  hyper
caggtaaacactcagcgcccgggccgagggcgcatcccacgcgggccgcgcgggggcgcctggagacccgcgcttgctggggcgg

SEQ ID NO: 92464 - DNA, 52 bp, Homo sapiens
  chr4:77227473-77227525
  hyper
tccctggggagaaggcgccgaggtgcccggtgcgggccgaggcagggctggg

SEQ ID NO: 92465 - DNA, 423 bp, Homo sapiens
  chr4:77228029-77228452
  hyper
ggagcaggagaaagacgcccctcttgggggagctgcgattccgggaggccatcagagtggcagcagcggactgagccctggaccttccgggcaggagctggtcaccaaaccaggtattcttccccccgtgactccagggcacatctgccagagctttgaggttcatcgaggaagggagcaaagagacaaacccacctggagctttcctaggggcccattcctgcggacgggctctcctaaggggactgggccatccccacgcccctcggtttcccaggctggttggtacgcgcaggcaggtttcttgtctggtcctccaagggccgcgcccttgccgagtccctcagcgcccgcgcctgaggacttggtcctgcccctccggcggggatgagctcctccacttggcggcgcttggtgcagtgc

SEQ ID NO: 92466 - DNA, 413 bp, Homo sapiens
  chr4:7741281-7741694
  hypo
tgcggttgaccctcacgttagagatgaagaagccaaggcccagccaggtgaaggatgggcgaggactcaggcaaggactcaggtgtgtctgggctgtgccgcgggtgctcccagccgtgtctcccggtgcccttgaggcggggcagctctgggtcctgggtcctcgacctgtctccttgactcctaaccagcccccacccgggacacccggctcaccccttggcactgacatccctatgcccccctctctcccactctcgcctcccggggcctcgccactctacgccctgcagcgcccactgccaggagggggcggagcctcagcccctctcgcacccccttgctgccgatgccgggggcgatccccacgcaggtcagtggctgtggcgggttggggccggcctgggcctcac

SEQ ID NO: 92467 - DNA, 155 bp, Homo sapiens
  chr4:7742306-7742461
  hypo
tgggctgaggctggtcgtcctggagccctcccagtacctcgggctgcaagagctgcagacccgttcagacactgcgttgcgggctccttccccgcagaggccggggcctccctgactttgcttcttcactcccacctgtgcggccacccagtccc

SEQ ID NO: 92468 - DNA, 16 bp, Homo sapiens
  chr4:774267-774283
  hypo
gcgcccagcctgtgtt

SEQ ID NO: 92469 - DNA, 30 bp, Homo sapiens
  chr4:77488004-77488034
  hypo
tgctttgggcatcttcgcatgtggcagctc

SEQ ID NO: 92470 - DNA, 30 bp, Homo sapiens
  chr4:7758476-7758506
  hypo
ccgggccgcatcccacgtggggtgactcgc

SEQ ID NO: 92471 - DNA, 69 bp, Homo sapiens
  chr4:77610972-77611041
  hyper
tcccaggggctttcacggccagcaccccggctgatgggggcaggtggcgtgctccgagggtctcctgac

SEQ ID NO: 92472 - DNA, 177 bp, Homo sapiens
  chr4:77818008-77818185
  hyper
gcagcaccgaccaggcgcggatagggccctgatcacgggcctcgggcacctgcgggtgcctggccacccactctcgagtgcgctgctgctgctgctgcagggtcgaataatgcagggagctgggggtcagcagctccggccggtctccgcggggagcggggccgggcaggagagcag

SEQ ID NO: 92473 - DNA, 97 bp, Homo sapiens
  chr4:77818657-77818754
  hyper
cggctccccccggcgcgcgcctcgcggggagcagggcgcagctccccctgcactgggggcggccgcgggcggctcgcggggtcgctgcagcccctcc

SEQ ID NO: 92474 - DNA, 35 bp, Homo sapiens
  chr4:77819538-77819573
  hyper
gttcctctaagtctccgccacgcaggaaacaaaag

SEQ ID NO: 92475 - DNA, 101 bp, Homo sapiens
  chr4:77869970-77870071
  hyper
ctgttgccgtcgccacgccctccagccgcagccccagcgcgcattcctacgggtcgccgggtctgtcgccagcgatcgaatgaagtcggctgatcccccac

SEQ ID NO: 92476 - DNA, 126 bp, Homo sapiens
  chr4:779768-779894
  hyper
gcgagggggccaggccggggggcggagagcggccgcgtgcggacgcaaatactcacggcggagcgatccgaaccccggagtccgcgtgcaggagggggacccaggccccgccgccctcgccccgcc

SEQ ID NO: 92477 - DNA, 146 bp, Homo sapiens
  chr4:780132-780278
  hyper
gccgggtgagggaggcggcgggcgcgggcagggcgggcctggggctatggcttatatcggcgtgggggctgcgctctgctcgtccctcaggggcctccgcggaggatctgtagggggaggggcgggggctccgcggggccgctgtc

SEQ ID NO: 92478 - DNA, 152 bp, Homo sapiens
  chr4:78584348-78584500
  hypo
gaacctagctccacccgctgtctgcttctgactcactttactcttccctttattcttagaacaattaaaaagaattctcgcccggtcttgcactgggaagctatgcttgcacttgagccttcttcaaatctgtttctatcccaagtggctta

SEQ ID NO: 92479 - DNA, 156 bp, Homo sapiens
  chr4:786342-786498
  hyper
ctgggtccttctcctcgtcaccccccagcatcttccccatgtccttggtggcccctggtacagaagttggtgattcagaccgccccattcagatgtccagggccgggctagtgtctcagccacactcccccaccttctggccgaccccccaaaccc

SEQ ID NO: 92480 - DNA, 818 bp, Homo sapiens
  chr4:788774-789592
  hyper
ctgggctggtccaggcgccaaaggcttctggaaggcccacctctaaggagccgaggattcgtgctccccgcaggctgcaaagccactaggctcagagggacccgccgcgaacctggggagcgtcacagatgccgcccacgcccccccgcttttcggcccgggtactgcagggaggcgcctccagaaccacttccaaaagctgggaattgggcgcagccaggagcgcaacagaaactgcgggaagcttgttcctggcacagaaacccaaagtgccatttgctctcccggcacagacgccggagcggcgagaccggcgcagaacgggcggccccgagcactgctgcgaccccgccggcctcgacctcgacaccccgcgaccccgccggaccctggaagcatgagctgcatcccgcatccgcaggagggcggcgctgcgacccacccccgcccccgtttccagaggaggccgctgcggcgcggggcggtcccacgtggtgcctgaggctgggacaccccgactctgattgcaggggggtcggatccgaggctgggggtcccgcagtctggctggggtccgctactggcctcgacgtacaggggccgaccccacccctacctcgttctctgagcctcagcttccccccgtgagaggtggaggcggtgggggggcgcaccgggcacgaccccgcggcaatgacggggctggcaacgccccccacagcggcacaggcggataaaccctctggggagggagttcagtcccagcgggaggggcccttcccacccgggagctcgccccaaaccgggtggagaggggg

SEQ ID NO: 92481 - DNA, 30 bp, Homo sapiens
  chr4:7941161-7941191
  hyper
gggagcagtggggaccggcccccacccgca

SEQ ID NO: 92482 - DNA, 75 bp, Homo sapiens
  chr4:7941713-7941788
  hyper
caaagggaggttgggcggggcggtgctgggactgggcttgcggggtcccgcgggaggacccgcctcaaagagccg

SEQ ID NO: 92483 - DNA, 192 bp, Homo sapiens
  chr4:79472791-79472983
  hyper
tacagggatagagcccggcggcagcagggcgcggcttccctttcccggggcctggggccgcaatcaggtggagtcgagaggccggaggaggggcaggaggaaggggtgcggtcgcgatccggacccggagccagcgcggagcacctgcgcccgcggctgacaccttcgctcgcagtttgttcgcagtttact

SEQ ID NO: 92484 - DNA, 78 bp, Homo sapiens
  chr4:79473033-79473111
  hyper
cgtccccgcgagcctcgcccacagccgcctgctgacgggtggcttggggaggtcgcggcgcctcgcccagttcccccg

SEQ ID NO: 92485 - DNA, 20 bp, Homo sapiens
  chr4:7960311-7960331
  hypo
cctacaggccaggcacggtg

SEQ ID NO: 92486 - DNA, 143 bp, Homo sapiens
  chr4:7968382-7968525
  hypo
ggggccagggcacctcgagaacgctgggaaggtgggctgggctgcagccacctgtgtgctccatctgatgcccgacacagccactctacagcctctccctgacaccaagccacagcggggaagggtggcgtgaagctagccgt

SEQ ID NO: 92487 - DNA, 166 bp, Homo sapiens
  chr4:79689605-79689771
  hypo
ttttctctgctcacacgcagtgtcgtggcagcaggcacagtcttgagatgcagaaggacagcggcgagcttgtggacctgtacatgcggcagaaagtctctgctagtaaccgcgtcaccggtgccaagaaccatgcatccatccagatgaacgtggtggaggctga

SEQ ID NO: 92488 - DNA, 99 bp, Homo sapiens
  chr4:79861382-79861481
  hypo
atgtgtataatagaacgcttagtccattgtttggcattgtaagggcaagaaaaatatcttgtcctcacttatcacaaggttcacagctgacattcctat

SEQ ID NO: 92489 - DNA, 63 bp, Homo sapiens
  chr4:80329437-80329500
  hypo
agcacaaggcgcaggcgcaaggcaacctttgccctttaactggcgcggcgccttctcacccca

SEQ ID NO: 92490 - DNA, 110 bp, Homo sapiens
  chr4:8039486-8039596
  hypo
acccctcagcagggtcgggggcccttctgtcctgtctacctctggcctaccctggcccacagtggcgctcctgcccttgctgaatgaatgcgggacgctgggagaacccc

SEQ ID NO: 92491 - DNA, 506 bp, Homo sapiens
  chr4:81106086-81106592
  hyper
taaagacagcctccccggacagtcttcaccgttttttttcagaagcagttgcgctgggggtggggaaagggagggaagggacattgaaaggccgcagtggctggcaactccgcgcccgtccgatgtcctctctaatcccccagtgttctggcgcgtacccacagtgcccccagaccctccgctcgcccgtgcgccgaggtcgttgggttttagacccagagagcacgttccgtaagctcccggcccaaatcccctcggaaaaattaatcacaaccaccagcggatgcaaaatgtgtgcctgtgttgagtctgtcttttaatcccgaacgtaattctaaaaagcagcatcagacaagagctttattaatcccttacacgagcaaatgcgatctctgacctactagacttgttttcctacaatttcacaaaaagcctcgctagaggaatgtgcaaggacagaagggaaactgaggagacccgcaactcattagcgaaataatagggtg

SEQ ID NO: 92492 - DNA, 325 bp, Homo sapiens; identical to SEQ ID NO: 28986
  chr4:81123055-81123380
  hyper

SEQ ID NO: 92493 - DNA, 232 bp, Homo sapiens; identical to SEQ ID NO: 28987
  chr4:81123381-81123613
  hyper

SEQ ID NO: 92494 - DNA, 290 bp, Homo sapiens; identical to SEQ ID NO: 28988
  chr4:81123614-81123904
  hyper

SEQ ID NO: 92495 - DNA, 610 bp, Homo sapiens; identical to SEQ ID NO: 28989
  chr4:81124121-81124731
  hyper

SEQ ID NO: 92496 - DNA, 92 bp, Homo sapiens
  chr4:81186703-81186795
  hyper
ataacagtctggggacgttgcccgtacagggaaattctctgttctcaaggaaattttcccttctcgggtttcctgaggttgaaatccagcgc

SEQ ID NO: 92497 - DNA, 1002 bp, Homo sapiens
  chr4:81186796-81187798
  hyper
cacgtcattaatcattcactgaggtcggtccctcagtcaatggcaggtctgggtaagctaaagcgagcagttagctaacccttcctgccacggggatcctggggcgaaagaggacaactgggcggtcagttacatgtgctggtgtccagccgctgcctctctttccccggtcggagcgcgggggtgcgtgtgccctcactctcacgaatacagacggagagcttcccagaaggaaaaacaaattcgtcataatgttcagcgcagccgagagtttccaacaagaaagcagctccagtcgtggcatgatgactcagggtggcgttttaaacgctgaataaacccattccttagctctttaataaatcgctaataacagcaaaaacagccttctccccgaaccgcgccacaccaaaggcttcccaagttgggctgcgaatccctgtttggttttccaacgccgaaagacgtagaagcagtgggatctcctggtgggacgcatttctccaagggctcccagagagaggacgagatagcagggtttacagggcaaagagaggagaacctggaaatcgtgtcctggggggcaagagtgcgttgcccagtcacaagtgtgctgtagaggtgggagaggacaaggacccatttccacatttcaaccctccgtttctatcgctgcccctggaggactcagctgctaacgccgagctcgtttccacgcggctctggtcctagtcggggaatccgggtggccgcgcgacgcgagagaactgctgggatgcgtggccctggtatgggcgcacccagcgtccggggcgcaggttctctcagcccagcttctcctcccactcactcgctcggatctcctccctccttcacatcccccgcccccgggaccgcgaggctccctccccgcaccggccagtgagtacacaaagccgcgggtgaggggaagcttcgcaggcgtgcacggagcagtgagatcactggcgttataaatatccc

SEQ ID NO: 92498 - DNA, 517 bp, Homo sapiens; identical to SEQ ID NO: 28992
  chr4:81187799-81188316
  hyper

SEQ ID NO: 92499 - DNA, 172 bp, Homo sapiens
  chr4:81188384-81188556
  hyper
cgggagggacagcaggtattcgccgggacacaggctcaccttcctgagcccaggccactgggaccaagctgatactcagaaacagccgggcgggttgggtggagatgcatctatatggcgtgcgcacacgcacccctctcctgggcatgaggaattgcgatttctcaggtgt

SEQ ID NO: 92500 - DNA, 231 bp, Homo sapiens
  chr4:81189430-81189661
  hyper
agatcgctcttccagcgcgggttggtccaccaggcagagccccagccagggcctgtcaggtacccagggagaccggaaatgtagccaggagacagcagcgctcacagtcacctggtttcagtgtcagcctggttgctcctagatgttcctaacttgctccatctcagaccaaagactccacgggccattgggctccttcttacacaggctccagaggagcgtggacaccac

SEQ ID NO: 92501 - DNA, 306 bp, Homo sapiens
  chr4:81189713-81190019
  hyper
cgcaagtgggtaaggcggtaggctggctagcctcctccggtgggttaagggggcctaatgcggaagacctgatggttcatgctgagagaaaagcaggtctatgcccgcccctctgcgcctgtctagtctatctgatcgcgctgattcagcagcctgcggcgcacgtggtgagggcgcctggagcgcccagctggagagagggccctccgcacacgcaccagcgagtcccagggcctccctcacactcccgagaggaatctatttccatattttagagtttatttcactcatcgaataactgctcat

SEQ ID NO: 92502 - DNA, 463 bp, Homo sapiens
  chr4:81256776-81257239
  hyper
gaaactgcaacaaaccgccggggggtgggattaacgtccaaagctcacaccggcttcaactgattggcaggaacgaagtgggtggagcctcctgaccctgccctcctgcttccgttgctagggacgcttcggccgaggataccgcaatggatcaggaagaggggctgaaggccttggacaatattgtcactcaattcaacgcctatgaagatttcctggactcgcagatcactactgtggacttgtactacctggaggtaagggcggagcgcggcagagtagccgccgccgcgcgtccctcggtccctcctcgagttcccgcttcgtgggctggtcgccccctggcgctggacagctcagctgtcaggcgccgcggtttcgggaccgcgacactaaagccgctggcgaggtgaattgccgcgtccttaccgccccgcgctccccggtccggacagaacttggg

SEQ ID NO: 92503 - DNA, 76 bp, Homo sapiens
  chr4:8128936-8129012
  hypo
gtgctggagtccagacgcagctccgataccagcaccgtgtgaggttggatcagactcttcccgtccccagccttag

SEQ ID NO: 92504 - DNA, 465 bp, Homo sapiens
  chr4:81307611-81308076
  hypo
tgcgcccaccactgccgccacggcgcggggctgccctcttctcgcgggcggtggtggggggggggggtgccgccgggtttgcaggtccttttccttctgggggccgagacgacagcggtgatctttgaggtatttgtggcggaaaaagcccttggcacagccagcatagcggaacttgtagtagcccgtgtgggcgcgcaggtgctcggcgaggtgggcacggcggctgaaggacctgctgcacagggcgcatttgtggagcttcatgccggagtgggagaggacatgggccttcagcttgtccggccggttgaacaacttaccgcagcttgtgtgcgtcgataaagggcatttatatttcttgaagggctggtggatcaacatgtctctcttacagtttgtccttgaggttgaatgcggactcgcacaccgagcatttgtagggcttctcgcctgagtggttgt

SEQ ID NO: 92505 - DNA, 118 bp, Homo sapiens
  chr4:819123-819241
  hyper
agagacactgtttgacggttcacccctcgccctccgcagaggaaggagactcgcgcggggactgggagggcggcgggcggggagcgcccctcggaggctttgccgcagcgccgattct

SEQ ID NO: 92506 - DNA, 191 bp, Homo sapiens
  chr4:81951310-81951501
  hyper
aacatgatattgactcgcacatatttctcacctcgagagaagatgatgcgggagagaggggcgttatgatgggtatgctctcagaaagacaggaagctatgatgacgggctgcaggtgcaggggcccgcagtgtccgtcagaagaggctcgggaaagtaagcgagaatggtgttcacgttgtgactttgtt

SEQ ID NO: 92507 - DNA, 100 bp, Homo sapiens; identical to SEQ ID NO: 28997
  chr4:81951777-81951877
  hyper

SEQ ID NO: 92508 - DNA, 375 bp, Homo sapiens; identical to SEQ ID NO: 28998
  chr4:81951937-81952312
  hyper

SEQ ID NO: 92509 - DNA, 573 bp, Homo sapiens; identical to SEQ ID NO: 28999
  chr4:81952363-81952936
  hyper

SEQ ID NO: 92510 - DNA, 338 bp, Homo sapiens
  chr4:8201112-8201450
  hyper
ctctgaggaacacgccgcaggtatggggggctccggggcaggcggggcgtggactggccgagcaggctgctgtctgccagtcttgccatggttggatctttacactttcttgaggacttttctgacctgtttgggatgggggtggagcgaaactgcgagctgggggcctcggggaggtcgtcggcaccctcagcagaccccactcagagctcacaggtgctggcagtgccaatccgcagtgattgagggcaatgatttcagctttgaccaagcacccttgcttctgggacctggcctgaccccgtgctggcccttggcatgagcggccctgggggtct

SEQ ID NO: 92511 - DNA, 98 bp, Homo sapiens
  chr4:82135686-82135784
  hyper
caactacccagagctcgacgaagcaaagccgggagcgcaagccctgacagcaccgccaagcccctagctcggagcaacagcctccaccgcttctcctc

SEQ ID NO: 92512 - DNA, 103 bp, Homo sapiens
  chr4:82135785-82135888
  hyper
ctaaacctagagaaccctgaggactccccactggggctgagcccctcccgccctcaacagaacctctaaacacaagtagcctttccctgcctccaggagctca

SEQ ID NO: 92513 - DNA, 286 bp, Homo sapiens; identical to SEQ ID NO: 29001
  chr4:82135919-82136205
  hyper

SEQ ID NO: 92514 - DNA, 734 bp, Homo sapiens
  chr4:82136243-82136977
  hyper
cgcagcgtgggcccggggctgccggctcagtcgctccggctacgtgtgagccgggggcgcgggttagcgcgatgcgggcaggagctgcggcggcgtcggtgctgccgcctggctccgcggcgggggccggtgcagaggagacacgcagggagggagggaagagaggagggaaggaggagggagggggtcagccggggctactgcctggatagttgggcgccggcttccctaaaggtggggtcacccgcgcccgcacgcacactagcccgaacctttactcccgacacagccgcagtctgcactttataccccataccctccatagtgaggcaacttaagtagggcgataacatcgtggttgtaagcatttttgttcatgttattatttctatttcaagtgtgtgggacgaggggagaggaaagttcagggaggtgttcattttttccttcccctccctttcctccatccttccagtctgttttcactgcaggctctctccacttcgccttccctcccagagctcaaacaggcgcacgtaccctggacatgccctcctctgtcacaccaatgcctttctacgaagacatgtgaccccgaagcagctcgtcgacgcgcccctcccggactctggggccataacttacatctagtttgccagttcacgtgatgctgggggcaggggttgaatcgagtttcgagggacagagattataccttccgaatctgcaggtct

SEQ ID NO: 92515 - DNA, 86 bp, Homo sapiens
  chr4:82157454-82157540
  hypo
cgctagatgtccagccgcttgtcttcttccgcggatgtattcctctcgctgtccagcagcttcagtctctgccttgctagggtctc

SEQ ID NO: 92516 - DNA, 183 bp, Homo sapiens
  chr4:8240141-8240324
  hypo
cccttgcccagcaggcgcccgcccctactcagcatcacactggcactgcatcggtgctcgttgtgggctggggggccagggcgctccagtccagggactgagctcttgggggccttagaacaacatgaggagctgcggcaaccctaagaccccgccccgtatcccccgcggcaggcctggggc

SEQ ID NO: 92517 - DNA, 32 bp, Homo sapiens; identical to SEQ ID NO: 40261
  chr4:8252769-8252801
  hypo

SEQ ID NO: 92518 - DNA, 828 bp, Homo sapiens
  chr4:8271325-8272153
  hyper
agtcccaaggcctgccgggtgggtccaggcccggaaggccaggcggggccctgtcggggcctgggcggggctggcggaggggccgggccgccccttccagcgagggcgggctgggcggtcgcctttaaaggcgcgggacccgccgcccgcggaccgtcaggctggagggagctggtccctgcgctccctgcgccctggggatgcccctgccgccctgacgcccgccagcctgagccaccggcgcatgtgaccgcgcgtccgccccagtcccatccgtaggcgcccggcgcccggccccgcagcggcctcgttgtccccgccggcccccgcccggtctcccgcgctgccacccgccgccggccctgccgccatgcaggcgcgagcgctgctcctggccgcgttggccgcgctggcgctggcccgggagccccctgcggcgccgtgtcccgcgcgctgcgacgtgtcgcggtgtcccagcccccgctgccccggcggctacgtgcccgacctctgcaactgctgcctggtgtgcgccgccagcgagggcgagccctgtggcggccctctggactcgccttgcggcgagagcctggagtgcgtgcgcggcctatgccgctgccgctggtcgcacgccgtgtgtggcaccgacgggcacacctatgccaacgtgtgcgcgctgcaggcggccagccgccgcgcgctgcagctctccgggacgcccgtgcgccagctgcagaagggcgcctgcccgttgggtaagcgctcgggggccagggaggaagtgaagcttctttctcttggggaaactaaggccgggagttagggccg

SEQ ID NO: 92519 - DNA, 161 bp, Homo sapiens; identical to SEQ ID NO: 40169
  chr4:828951-829112
  hypo

SEQ ID NO: 92520 - DNA, 66 bp, Homo sapiens
  chr4:8293769-8293835
  hypo
tctccatgcaccaggcggtgctgcctggcctccggggtgtagatgccgaagcgtatggtttgtgca

SEQ ID NO: 92521 - DNA, 487 bp, Homo sapiens
  chr4:829521-830008
  hypo
cccagctcacatcaccgggggcccctcaggacattcaggggccaagacagctttggcagctcccactcctctcccagtggcctctgggctcagacacccggactgcgtcctcaggagtggagctccccgaggaaagagtgcctttgcttcccttgacgtgtcctgcactttgtgtcagccagcgcggcagcaagaacgagcacacggggacagaagctcatctgaacctgccggcccgtgtcggtgtccagcgcggaggcgctgtgtccgcagggcacctgcatcctcataagctggactgactgccgtggggcccggtgccccatgtccagtgcatcccagactagaacaaagacttgcacacggcgtccaccacagcacaagccacagcagccacgggggaggcagccacgggggaggccgcccagcgccatcggcagagcacagacacgcaaactgtggtcccgccacacgtggaccttgattc

SEQ ID NO: 92522 - DNA, 577 bp, Homo sapiens
  chr4:82965332-82965909
  hyper
ggctcggggctgccccgcggctgcggcggaggggctgggccgggcggggagagctcggcggccgcccgccccgcggcgtccagcggtgcgagtgcgcgcagccccgtccgcagcccgagcctccgctctgcgggagccggggcgccgtcgccgcgctagccttttcctctgaatgtcactattaccatagtaaagggaagggccccgccgagggggtggcgggagggccaacggcgcctcaggatgggcgccaagcgtgagcaagggcagccggcgggcgcagcgccttggcgcagacaccggcccgacccacgcctgggcagggccactcttgcaacactgccgggcgggagcagacgccttaagctccgagggagagcgggcggccggggcgggggagggtctgtggatggaagccgccgggctgacccacttccccagttttcccctcggcagcactcacggaggtggaaaggcgggcgcctcgctctgctgactgacccgggagagtcgctgctgccagatgccagtggcccgcaggagctcctgcactggccggcgccgccccacccttcct

SEQ ID NO: 92523 - DNA, 34 bp, Homo sapiens
  chr4:83149079-83149113
  hypo
aacaggcaatgcagccgggcgcggtggctcacac

SEQ ID NO: 92524 - DNA, 105 bp, Homo sapiens; identical to SEQ ID NO: 40262
  chr4:8327019-8327124
  hypo

SEQ ID NO: 92525 - DNA, 153 bp, Homo sapiens
  chr4:83301224-83301377
  hypo
ccatgaattgactatttttttagcctttcttggttaatttattctgagaagataaatctacaaagagggtgttatttacatgtggtcatgtgactttgcttatttttcctagaaggatatttttctgcaaagaaaaatcgtgctctaatgaca

SEQ ID NO: 92526 - DNA, 169 bp, Homo sapiens
  chr4:83323412-83323581
  hypo
tttataaagtgttctcgagcccgctgcaaatgatctagacgcttgctggagttgacttgtttcatggtgagggctccttgaaacactggcaccaccaggtacttcaggtcggtggaagcaatctcttccaaatcttcatttcggctgaacaactcgagctgcgataaca

SEQ ID NO: 92527 - DNA, 688 bp, Homo sapiens
  chr4:83482684-83483372
  hyper
acacctgtcaaaggacggggccggggccggggccggggccgcagcgggcgggctggctggcggcactgcggcggcggggaccgaggcgcgccggctcgggcgttcgcaggtcgcggggcagagccggcaccgactcctggacttgccggggagcgtgcgcccgcggagggctcgggcgggcggccccgcgcccgggacgctatgggagggggccgcagccgagcagggccccgcagccgggcggacccagccgccccagccgcgctgcagcccccgccgtccccggtctccgcctgcgggctgcgcacggggccgggccggacgccccctggctgcgcgacgggcccaggcaggggagggggcgccgcgcctacctgctctggtgcggcggggccgctgtcgcctcgaggggctgtgacctgctgcggtggcggcggcggcagcagtagcggcgggtagggcgcttccttcaggaaggggtgggatctgctcacccgcccgcccggccccctcctgccgcgccggggcccgcccccgacttattctggggtccccgctgctaggccttcggggagagttgatcccctgggtctcgggcttctgccacccccccggggcccctaatagtcacccggggcaggagccgggtgtgggcgggcgagccgcttccttccgaagcctttgtgga

SEQ ID NO: 92528 - DNA, 144 bp, Homo sapiens
  chr4:83551716-83551860
  hypo
tcaagcacatgacaacgtatatttgacgtattttagctatagcgattaaatcacatgtccacactctaatgttaaatcgtagtaatattgacttgaaaagttttttaggctgggcgcgctggctcccagctactcgggaggctg

SEQ ID NO: 92529 - DNA, 42 bp, Homo sapiens
  chr4:83718792-83718834
  hyper
ctctcgccatgggatcggtttgctcaccgagaaacttcaccg

SEQ ID NO: 92530 - DNA, 91 bp, Homo sapiens
  chr4:83719334-83719425
  hyper
gaggcgaggggagaccgggggtcgctgcgcaccgcccgcagccgaggggcgagcggcgacctcgcgcgccccagcgcggcctggccacgga

SEQ ID NO: 92531 - DNA, 30 bp, Homo sapiens; identical to SEQ ID NO: 40263
  chr4:8378202-8378232
  hypo

SEQ ID NO: 92532 - DNA, 171 bp, Homo sapiens
  chr4:8386144-8386315
  hypo
gaaaacgggcactgacgggcagtgaattctcttgctcggaatgcggctgctggcggcctgaggacacacccagcgtcaacaacctctgtcctcaagactctcccagaatcctgggtcaccacggcctttccatgtgcctcacaccagaaggactctcgaaggtgcccccag

SEQ ID NO: 92533 - DNA, 21 bp, Homo sapiens
  chr4:83955217-83955238
  hypo
tacagacgtgagccacggcgc

SEQ ID NO: 92534 - DNA, 30 bp, Homo sapiens
  chr4:84030886-84030916
  hyper
tgcccgctctgcactcgggaaggggctgtg

SEQ ID NO: 92535 - DNA, 41 bp, Homo sapiens; identical to SEQ ID NO: 14696
  chr4:84169961-84170002
  hypo

SEQ ID NO: 92536 - DNA, 97 bp, Homo sapiens
  chr4:8483866-8483963
  hypo
ccttgttcagctctgcgtccctcttccagttccagcagctcatttgtcagttcttcaggaaccgcctggaggcactcctcaacggcatcctcctcca

SEQ ID NO: 92537 - DNA, 678 bp, Homo sapiens
  chr4:85402747-85403425
  hyper
cccctctgtctaccttgcggagactattcaaacgccctcgcttgcggggtttcggagccagaagtctcgagctccgcgcctccgcgcccccgcgccgcgcccttccacctgcacccgttaggcgcgctgcgggacaacagcgcagatgcaaacagctttctcgcaaggaaaaagggaattgaggagaaagtttcctctctgagccgagggaagcggaaaaagatcaaaggtcgggggcgggtagagtgggggtggggggaaccgcgggacgccctagctgtgtgcgtttcgggaggcctcgcagtgccattctgcaagagtacctgctatctcgaaaatcttttgccaccgccgaccgcagcgggagggggcaaggggctctctctgactcagctccggatttgtgcatccccgcagtgcggcacccgcagtcttgacttccccagtctctgactgaacagatgtttttgtccctcgcggagatttgtaaccgatgttgggaacagctagtggacggtgctagcaacctgtatctgttctagaacacacctagtgggagctgcggggtagagtggagaggtaggaatgcagcgggactggggcaggggacaaatcaaggtgtgtgggtaaatgtgaacatatgaacacacgtgtgtacgcacgtctctaaatgtgtca

SEQ ID NO: 92538 - DNA, 152 bp, Homo sapiens; identical to SEQ ID NO: 29009
  chr4:85403776-85403928
  hyper

SEQ ID NO: 92539 - DNA, 30 bp, Homo sapiens; identical to SEQ ID NO: 375
  chr4:85404111-85404141
  hyper

SEQ ID NO: 92540 - DNA, 252 bp, Homo sapiens; identical to SEQ ID NO: 376
  chr4:85404224-85404476
  hyper

SEQ ID NO: 92541 - DNA, 83 bp, Homo sapiens
  chr4:85404649-85404732
  hyper
cgttcggccgggctcagtaaagaatttgccgaaaggtagaaactggaccagagaagggaacacagtgccgggcacatcctagc

SEQ ID NO: 92542 - DNA, 30 bp, Homo sapiens
  chr4:85405081-85405111
  hyper
tgggcttaaagccatcgataagcaaactac

SEQ ID NO: 92543 - DNA, 47 bp, Homo sapiens
  chr4:85414067-85414114
  hyper
ccctaccccgccgcccgcgggggcaaaatctgggggcgagggggacc

SEQ ID NO: 92544 - DNA, 189 bp, Homo sapiens; identical to SEQ ID NO: 7440
  chr4:85414148-85414337
  hyper

SEQ ID NO: 92545 - DNA, 567 bp, Homo sapiens; identical to SEQ ID NO: 29015
  chr4:85414457-85415024
  hyper

SEQ ID NO: 92546 - DNA, 30 bp, Homo sapiens
  chr4:85416612-85416642
  hyper
catcaagagtttgcccgcctgcaagacccc

SEQ ID NO: 92547 - DNA, 479 bp, Homo sapiens; identical to SEQ ID NO: 29016
  chr4:85416904-85417383
  hyper

SEQ ID NO: 92548 - DNA, 107 bp, Homo sapiens
  chr4:85417612-85417719
  hyper
ggctgccacagtccccgggcttcccaagagaacctccacttggctttcgcaacttcccgcagttactgccgctcagccgcactaaggaggtccggagacttggaaga

SEQ ID NO: 92549 - DNA, 270 bp, Homo sapiens; identical to SEQ ID NO: 29018
  chr4:85417953-85418223
  hyper

SEQ ID NO: 92550 - DNA, 106 bp, Homo sapiens; identical to SEQ ID NO: 29019
  chr4:85418264-85418370
  hyper

SEQ ID NO: 92551 - DNA, 62 bp, Homo sapiens; identical to SEQ ID NO: 29020
  chr4:85418521-85418583
  hyper

SEQ ID NO: 92552 - DNA, 521 bp, Homo sapiens; identical to SEQ ID NO: 29021
  chr4:85419120-85419641
  hyper

SEQ ID NO: 92553 - DNA, 230 bp, Homo sapiens; identical to SEQ ID NO: 29022
  chr4:85419661-85419891
  hyper

SEQ ID NO: 92554 - DNA, 30 bp, Homo sapiens
  chr4:85421883-85421913
  hyper
tttgatcagcaccaccgacggatggagttt

SEQ ID NO: 92555 - DNA, 279 bp, Homo sapiens; identical to SEQ ID NO: 29023
  chr4:85422188-85422467
  hyper

SEQ ID NO: 92556 - DNA, 158 bp, Homo sapiens
  chr4:85422771-85422929
  hyper
agtaaatagttgcaacgcttggtgtaaggatgtctccatcgttcacttttacgtatcatttgcattgccaaattaaaatggcagcattgttcttaattatgacaataaaaaattccggatccgtgtaccttgatccctggtagtgagggggtgagccc

SEQ ID NO: 92557 - DNA, 80 bp, Homo sapiens; identical to SEQ ID NO: 29024
  chr4:85422972-85423052
  hyper

SEQ ID NO: 92558 - DNA, 197 bp, Homo sapiens; identical to SEQ ID NO: 29025
  chr4:85423633-85423830
  hyper

SEQ ID NO: 92559 - DNA, 372 bp, Homo sapiens
  chr4:85424135-85424507
  hyper
ggaaggatagcagggcgagggggagaacgtgtctgtctttctttgcttcctataaacgccgtagagtggaaactgcacctttgccacaacttctgctgcccagcacttaaggtagagatttgggaagaattgaagcagacagcgtggaaaagcgccgtaggatcttgcgttcggcgctctcccagtggaggccaacaccaaacaagtggggaagcgaccagtgtaaacagccccatccattctaccacagaaaagatctcgaagtccaggacctccctcagcgatatcgtcagtgagagagaggattacagctctccatagagtcgcagaatacgtacctgggagttaagtgcgctccgaagggtggcttct

SEQ ID NO: 92560 - DNA, 36 bp, Homo sapiens
  chr4:85503856-85503892
  hyper
agcccgcgctggccccgcctccgcctcccagctcct

SEQ ID NO: 92561 - DNA, 558 bp, Homo sapiens
  chr4:85504235-85504793
  hyper
ctctgcgtggagacgcgcacctggcaaccggaggccgcgtctccgccttctctgctcgcgcctggcgcccggagcctgcccgggacctccgccggagccgcgctcgctgcaggcggcctcgagcgctctctcgttgatgccgttttggaggtgaccggcgcggcggccgctctatggtggggccgcgttagtggctgcggctccgcgggactccagggcgcggctgcgaggtggcggggcgccccgcctgcagaaccctgcttgcagctcaggtttcggggtgcttgaggaggccgccacggcagcgcgggagcggaagatgttggagctgaggcaccggggaagctgccccggccccagggaagcggtgtcgccgccacaccgcgagggagaggcggccggcggcgaccacgaaaccgagagcaccagcgacaaagtaagtggagccgagagaggcggacgccgcgccctggctgggtcctggttggaagcgggacacttgagagcaagggtggggcccgtccagcgtcaggtgaggctgcacgctgccggtgcacc

SEQ ID NO: 92562 - DNA, 113 bp, Homo sapiens
  chr4:8582115-8582228
  hyper
tataagccaccaggtcgctccagtttggtgccagcgcctggagggagaggcgtggcgagggctgtgctgcctaggatccactgagtggctcttgctggcgtgtcagctgcgcg

SEQ ID NO: 92563 - DNA, 30 bp, Homo sapiens
  chr4:8582549-8582579
  hyper
ccgccgctttcctcgcgctgctctggacct

SEQ ID NO: 92564 - DNA, 86 bp, Homo sapiens
  chr4:85887114-85887200
  hyper
ctccccaggaggcagcggaggactagggccaggccgcccaccctggcggcggcggcggctcccggccaaggcggaccctggggagg

SEQ ID NO: 92565 - DNA, 49 bp, Homo sapiens
  chr4:85887878-85887927
  hyper
ctcctcctactgagccggccgcagaaattgcagccgctcagcttctacc

SEQ ID NO: 92566 - DNA, 34 bp, Homo sapiens
  chr4:85888365-85888399
  hyper
ctcctgtgtggctcccgtccgtgatgggactgta

SEQ ID NO: 92567 - DNA, 30 bp, Homo sapiens
  chr4:8588860-8588890
  hypo
tggccgacccgttcacgtactctctgctcc

SEQ ID NO: 92568 - DNA, 62 bp, Homo sapiens
  chr4:8594397-8594459
  hyper
ctctctagcttctggcgctgcccactgtaacccgactccggcatttgcgtttggggcgccct

SEQ ID NO: 92569 - DNA, 30 bp, Homo sapiens
  chr4:8603223-8603253
  hypo
ggtaagggaaagtggcgggggcctgtgtgg

SEQ ID NO: 92570 - DNA, 258 bp, Homo sapiens
  chr4:8607707-8607965
  hypo
gcccccagtggagcccgaggtgaagctcatcggcaacattcatggcaacgaggtggcgggccgggagatgctcatctacctagcccagtacctgtgctctgagtacctgcttggtaacccccgcatccagcgcctgctcaacaccacccgcatccacctgctgccctccatgaaccctgacggctatgaggtggcagctgccgaggtgagcgcccagatgcctggatcctgtgggccaccgcccgaaccaccccctca

SEQ ID NO: 92571 - DNA, 30 bp, Homo sapiens
  chr4:8608178-8608208
  hypo
ggtcagggtagctctcggggaggtgggcaa

SEQ ID NO: 92572 - DNA, 143 bp, Homo sapiens
  chr4:8608508-8608651
  hypo
aacctggatctgaaccgaaatttcccggacctgacgtccgagtactaccggctggcggagacccgcggcgcacgcagcgaccacatccccatcccccagcactactggtggggtaaggtaggagccgccgctgcccatgctgg

SEQ ID NO: 92573 - DNA, 106 bp, Homo sapiens
  chr4:8615814-8615920
  hypo
tcatgccgccatctgcggatctgcaaagtggggatcatatggtccaccttgcagttgttcagcccctcagctgcaggaggggcgtctgtggcgagtacctgctgca

SEQ ID NO: 92574 - DNA, 30 bp, Homo sapiens
  chr4:8620407-8620437
  hypo
aggaaccagggtctgcgtctccttacagca

SEQ ID NO: 92575 - DNA, 30 bp, Homo sapiens
  chr4:8620650-8620680
  hypo
gccgatgaaaaatgacggtatgctgtgata

SEQ ID NO: 92576 - DNA, 30 bp, Homo sapiens
  chr4:8647534-8647564
  hypo
cgtgttggggaggagcgtggtgtggctggc

SEQ ID NO: 92577 - DNA, 30 bp, Homo sapiens
  chr4:8648137-8648167
  hypo
ggatctgtgagatgccgggaaggacccgga

SEQ ID NO: 92578 - DNA, 46 bp, Homo sapiens
  chr4:8648553-8648599
  hypo
tacgtggaaatgggccgtggctgggaggcggcgggcttgtgagagg

SEQ ID NO: 92579 - DNA, 203 bp, Homo sapiens
  chr4:8689984-8690187
  hyper
tcgcccaggtcctcccggacactgctgtcaatgggtatttggttctttcccgtcccttccccggaggcctggcctgcagctccccgcaaggccactgcgtggcgccctgtaccccaggcgggacggccggcgccgagcccaggattcgtccacgcctcgcgcagtggagcttacgggagatgcgcgaccgtcatccttccctt

SEQ ID NO: 92580 - DNA, 30 bp, Homo sapiens; identical to SEQ ID NO: 40312
  chr4:86922651-86922681
  hypo

SEQ ID NO: 92581 - DNA, 30 bp, Homo sapiens
  chr4:870008-870038
  hypo
cagcaggctcaggaacgtttgctaagatgc

SEQ ID NO: 92582 - DNA, 36 bp, Homo sapiens
  chr4:8700182-8700218
  hypo
cagggacagcgtgtgcgggatcggggtgagggagag

SEQ ID NO: 92583 - DNA, 495 bp, Homo sapiens
  chr4:87281168-87281663
  hyper
gaaaccattgtgcagcgtgatgctgcctgtaccattgtggaacctaccagaggagacggacagagggcttggggaatggggttgctatggcaaccgaaaggagcacacatgacgtcaaagcccagagaggtctagggagggggatgagggggaaacagaaagaggaagcgtctatgtgcagctacagctactgtgttttccggtgaaatgaggaccaggcaaatgtaaaggaataaggttcgtcggcagccaacatcagcaactacgacatcaaggcagccagcctgcacaacctgaagaaaagatccattcgatgcagttctggccctttgcacagcagcacggaggagcaaataccagcagagcaaaacaccactggaaatgcaacctctgcttttcaactatctcttgtagtatctctaaacgtcaaacaagtaagagatggtaataacctcagaggagaagcaggcatttgagtgtcgcctgaaccccgag

SEQ ID NO: 92584 - DNA, 1009 bp, Homo sapiens
  chr4:87515216-87516225
  hyper
agcctctggctagtccgaagaacgcgaaaagccaggcccaaggcactggttgtcatggcaaccggggcgctggtctccctggcgacctcgtccctagggaggaggtggagctggatgccaggcgggccaatgaggtcgaggggagctcggggtgggagatctgcggtcctcccagtgccggggaatggttgagtgacaggaccgggggggcggagccggcgcggctgcccgaggtggagccccagtggtgcgagtagctccagcggccacgctgaggcgagggtgacacaccatgctcacggcccctggagaccgtcgtgctggcgagccgtgctccgtagctccccggtccgcctcggcagcggtcagagtcgcctacaggagttgagccgcccgcgccagaaggttttggcgaagctcttggagaggcgtcgagcacagtagggcggcgggggtgcgttgagcgctcgggggtcaggcagtcggccgggatcgccgctggggagcgtttccgaggcgaggaggaggaggaggagatgctgctcctcttctccccctccccaggctccttctacagctccttcagcccacgcccgcagccgcttgtgggagaagtggtggtggctctcggcgcccgcggcggctgccggcggcccgccccgacgccgcgtccctgcagccctcgcccggcgctccagtagcaggacccggtctcgggaccagccggtaaggacgagagccgccctgggctctgcgctgcatgtgcagaagtgcaaaacaaagtacattgcgctcgttctcttcctcctctctctgctttcgctccagtccctaaacccaactcctcggttgccctggtagaaggaacttttctttggttttggtggtgggtgtttttgtacgttagagtgggggtggggtgactggagtggggaagaatgagatgaaactccattgctaattaggtagatccatctcctctgcggaagaaagccggattctcgggaat

SEQ ID NO: 92585 - DNA, 36 bp, Homo sapiens
  chr4:8774988-8775024
  hypo
ggggcaagctgttcccgagtgcgccagactccctgg

SEQ ID NO: 92586 - DNA, 30 bp, Homo sapiens
  chr4:8778539-8778569
  hypo
gtactgagcgctcaccgggtaccccctgag

SEQ ID NO: 92587 - DNA, 30 bp, Homo sapiens; identical to SEQ ID NO: 29031
  chr4:87813050-87813080
  hyper

SEQ ID NO: 92588 - DNA, 92 bp, Homo sapiens
  chr4:87813420-87813512
  hyper
ggcggcctggttacccgggctccaggggctcggagggtcgcggccggggtactgaggtaagagcgcgctgcgctaagcgcacatggccgcgc

SEQ ID NO: 92589 - DNA, 37 bp, Homo sapiens; identical to SEQ ID NO: 14697
  chr4:87899606-87899643
  hypo

SEQ ID NO: 92590 - DNA, 38 bp, Homo sapiens
  chr4:8793763-8793801
  hypo
ccgatgggagacagacgtgcacacgcacacacagaggg

SEQ ID NO: 92591 - DNA, 32 bp, Homo sapiens
  chr4:88010203-88010235
  hypo
gtattaagccagtttgccgggcaggtctgaca

SEQ ID NO: 92592 - DNA, 30 bp, Homo sapiens; identical to SEQ ID NO: 40315
  chr4:88025280-88025310
  hypo

SEQ ID NO: 92593 - DNA, 41 bp, Homo sapiens
  chr4:8822099-8822140
  hypo
cctctctcaggacaacgccatctgtgcgcccccttcaccag

SEQ ID NO: 92594 - DNA, 25 bp, Homo sapiens
  chr4:88296877-88296902
  hypo
agcaaaactccgtctcaaaaaataa

SEQ ID NO: 92595 - DNA, 258 bp, Homo sapiens
  chr4:8858790-8859048
  hyper
cacagcggaccatctcaataacaaaccgaaactctggctatctccaggtagtcgaacttgggatgccttttgttttcagtgcttgtaattttctgaatttttaaaataacgaacagagtctccttgcgacattaaatgcaatgcagccgccgaggaagcgtcggggacagatggggttggacgccgtccccacttcctcccctgcagccgcctccaggccgccaacctcgcccagccggagcctcagtcctggagggt

SEQ ID NO: 92596 - DNA, 557 bp, Homo sapiens; identical to SEQ ID NO: 351
  chr4:8859381-8859938
  hyper

SEQ ID NO: 92597 - DNA, 210 bp, Homo sapiens
  chr4:8860397-8860607
  hyper
gtgacactcaggcacacatacaccaatgccccgggcccgctagggacgctgagctccaggcaacgaaaaacgaaggtcctggagtcggtcctgagtgcattcctccactgggccccgtcgagaatgaaactctcggagcatcgtcactgggaggtcctggggggacactggggtgggcgagcttcttcaaagactcggtttccactgggc

SEQ ID NO: 92598 - DNA, 32 bp, Homo sapiens
  chr4:8861124-8861156
  hyper
atcccagaaaaggcccgcgggacttagaaaat

SEQ ID NO: 92599 - DNA, 136 bp, Homo sapiens
  chr4:8861410-8861546
  hyper
tgccttctctacacacgtgcgtggtctatgtgacgtggagtcgcactgggacccgaatgaggacatccccccgccccttcgtcatcgtgggaataccgtggaacaaggcgggcaaagggctgatcagctcccgtcc

SEQ ID NO: 92600 - DNA, 148 bp, Homo sapiens; identical to SEQ ID NO: 28781
  chr4:8861605-8861753
  hyper

SEQ ID NO: 92601 - DNA, 894 bp, Homo sapiens
  chr4:8861918-8862812
  hyper
cgccaaatggaagtgggggcgccccctggcctttcctatacccggggccaaaaccgctgggaccgatatactgcaggagtccgggcacaggctgaggggaccggcccgtgcgttgagcgcctcggaggtgctccgggtcatggtgggtgctgagcgggaacacggaaggctgtgtacacagcagcaagcaatgcacccgcgctcccgtcattacatcgcgccgccttcacccccgctacgatgaccactccgcagatgggcaagacgggctcagagagatgaagtgactttcccaaagccacacagcgggccagtgaaggcaccgcgcacggtccaggaatctaacccttcctggggagtggggagggaagggctcgacccgaaggggccaggcggcagagagccccgcgtcccccgccacgggctaagacgcaaggcggcccgccgtgtctccacctgcgcgcctcgagcttcgctccgctctagccttcgggttaacaccgcttccttccagaagcctaaggaggcccgggcggatcagacgcctcccttctccgcagccccatgccctgcccgcagcttgagctcaccgcccttctcggggtggcggtgcggagaccggacggctccactgtgcagaccccgaggggtaaggggccgggtaggggaggggagcgagaagtggcgaggtgagaactgaggggcgaggctgaaggctgagccagacttccagacgccagagagacgccaggtgagccgggcgggggcgggggcgagggcgggggagggggcggggccggaaccgcggggagggggcggggcgcccgggagggccgcgagctgggaaggtcccgggcggccggagacggtgaagaggcggggccgagtcgcgtc

SEQ ID NO: 92602 - DNA, 204 bp, Homo sapiens
  chr4:8863323-8863527
  hyper
cgtaggcggagccccgggggcacggccgaggctgcgcttcaggagtgtccgccaggcgccttcccgggcggttggcgaaacccgaggaggcccacagctctggcctggggcgccgtcgttccaggggcctctgcgcctctctctggcgtctgtctggaccctcagagccccgggatcaaggcgcccatcctcttgatggcgggg

SEQ ID NO: 92603 - DNA, 79 bp, Homo sapiens; identical to SEQ ID NO: 28785
  chr4:8863856-8863935
  hyper

SEQ ID NO: 92604 - DNA, 157 bp, Homo sapiens
  chr4:8864526-8864683
  hyper
cgtttgctccccaggcggtgaggctggctcttcgaccacttagctgttctcggcgcccgatcctgtgtgtccttccgtgcatgacacgcagagcttagctctgtgaggacagggctgtcccctctccggcccacctatgaaggggtgtccacctctc

SEQ ID NO: 92605 - DNA, 357 bp, Homo sapiens
  chr4:8864763-8865120
  hyper
cgaatttccggtggctgggacccacttcccagcgggaccctggataggcatgcccactctggctaccagaagggcagggtggccgaagggtatgaagcatatgagtgcacaggcggggaggaacagcagcagcaccagcgcaggagtagcccgctggcctccctcaggcgggtggaggagggcgccggggagcctcagtgccaccgtgctccagaattcctgcccctctcagaaccccggtttccctttccaacaagttgcaaggtggggcggaaggccacgaaagactcttgggggagaggcactgacagaaagggaaagagaagcccacccggcctctcccgcctccctggtgct

SEQ ID NO: 92606 - DNA, 30 bp, Homo sapiens
  chr4:8865644-8865674
  hyper
acgcccaaacaccaccgtagtggcctttcc

SEQ ID NO: 92607 - DNA, 146 bp, Homo sapiens
  chr4:8868700-8868846
  hyper
tgctcccaggagggacggcacccagcgcagcttgagctgtctctgccctcgtgatcacaaagcagtgaaactgtccagaaaatgtccctttttattccatacgcaaataagtagattcatttaaaaaaacaacaacccggaggctg

SEQ ID NO: 92608 - DNA, 340 bp, Homo sapiens; identical to SEQ ID NO: 28789
  chr4:8868931-8869271
  hyper

SEQ ID NO: 92609 - DNA, 788 bp, Homo sapiens
  chr4:8869368-8870156
  hyper
cgtccacacaggtccacagggtcgtggggagagggcccggcaggcggggctcacaccaggccaggcatctgcgcccgcagaaagggcacggaggcggcggccgggaaggcggccagcgggtaggcgagggccccggagaagccgagcagcggtgggggcggcgcgggcgcggcgggcgccagcgggaagggcagggtggccgggggcccagcggcggctgcggccggggggctttcgtggtagagcaccggcacgcggaccaggcgctgcgctcccggcggggacaggctggccgcctccagctcggctgccagctgccgcttccacttgttgcggcggttctggaaccagatcttaacctgcgtctcggtgagctgcagggaggcggccaggccggcgcgctcggcgctgctcaggtagcgcttcaggtcgaaggtggattccagctggaagacctggctgcgggagaagactgtgcgcgtcttcttctttcggccgccgcccacgccaacgccgccgcgtgtctccccagccgccgcagggacctcggccagctccgacgcctcctccgtgccggccgccgggccacgcgccgccagctccgctgcctcccgctgcaccgctcccggcccggggcctcgcggccaggcgccctccgcacggcccatctcctcgcccgtctccggtgagtcccggtcgctggctgcaggggagagagggcaccaccgttggttctagggcactgattaccagactcaatcactgaggccagccgtccccaccttgag

SEQ ID NO: 92610 - DNA, 395 bp, Homo sapiens
  chr4:8872678-8873073
  hyper
cagcctccctgggaccggaggagcccggcaatgggtgaagctatggcctgcaaaacctcctcgttagcggagctcctgccccagagggtgggcctccaaaccagcccaaccaggggctcctgggggccccacaaggcccagacgccgttccacagaagggagaggatggcccagaacgggcggcgacgagcccgaagtcccccagcaaatgcgcagggaggaagtcgggccccaccgcctgacccaccctccccgcgccctcactcactgtcaggactgaggccgcctccatagccaccgtgcgcccgtgggtaccagcgcgctgcgcctccgcagcccagagcgaagggcggcccgggaccggggggcggccgaggaccgaggcccagcgcgcc

SEQ ID NO: 92611 - DNA, 211 bp, Homo sapiens; identical to SEQ ID NO: 7286
  chr4:8873773-8873984
  hyper

SEQ ID NO: 92612 - DNA, 59 bp, Homo sapiens; identical to SEQ ID NO: 7287
  chr4:8874476-8874535
  hyper

SEQ ID NO: 92613 - DNA, 233 bp, Homo sapiens
  chr4:8875695-8875928
  hyper
ctgatcctataactgcggacgatacgcgtccctgacggtgccaggttgttgggagtagaggctggccaccaccaggcgggtggtggccctgagcgcataacgctcgcgggtgtcttcccactgcctctggggggcgcgcatgagaggggcgcttccacacactgccgcgtggggcctgggatgggagcgaagaggggcggtggatccgaagcgaggaccgtgcacccttttcc

SEQ ID NO: 92614 - DNA, 139 bp, Homo sapiens
  chr4:8878536-8878675
  hyper
ggagcagtacagtctcgagacattctcgttgtcttagtctgatccccacgtcgcagccagcaggaaatgtccttgcagctgtggagatgtggatcggaactagggcacctcactccagctcagccgctggcccactaag

SEQ ID NO: 92615 - DNA, 103 bp, Homo sapiens; identical to SEQ ID NO: 28797
  chr4:8879491-8879594
  hyper

SEQ ID NO: 92616 - DNA, 15 bp, Homo sapiens
  chr4:8879647-8879662
  hyper
cgggaggggacgctg

SEQ ID NO: 92617 - DNA, 335 bp, Homo sapiens
  chr4:8893391-8893726
  hyper
cggctcacagacgctccatcctatccgcggacagaaacgaatccgagccgcagctgcacgtttgaaccccgcaaagccactgtgagccggtactgaaaccccaaggaaaagtcggggtttgggggcgggatccttgccccatgtgggttgggaaaagacggtgggaaccttcgggactctggagtggtgaaatgacgggagaggacactcaacactcccgactcatgcccttcagagcggagctctgacctggcctcctccaggcagtcttcccggctgcgtcctgccctatctcctcctccccagctcggcgtttgcagccccgctgggccgcg

SEQ ID NO: 92618 - DNA, 221 bp, Homo sapiens
  chr4:8893815-8894036
  hyper
cgaagctgcgagttgtctcgggccctcccggagctgcgggcggctcctcgagaaactcagagagcccaggcgcaccacgggccagccaggacatccccaggcggccctgttagccccattttatggaggaagactgaggctttgggttgcatgggacccgcggttaccccgcaaacacagacgcttacgaagacgctatcgcgagccgaacagtctggagg

SEQ ID NO: 92619 - DNA, 317 bp, Homo sapiens; identical to SEQ ID NO: 28800
  chr4:8894641-8894958
  hyper

SEQ ID NO: 92620 - DNA, 545 bp, Homo sapiens
  chr4:8895231-8895776
  hyper
cgcccgcgctaccttcctgccctgtggcctacctgggtcccccttacacctctgctcggtgcagccctgagcctcggtttcccagacggcgcagctgaggctctcgaggtgacgagaggctgtgggggtgaggtcgcagccctgctccctcctcagttccgccacccaccccttcggtagtaacgccgttctcaaaatgggcccagggccccttccggccaaacacagcctggactcctgggcagagaccgagcgcggcagaggtggcccgaaggccgggttgcgggggatcccggcctctgcccaactgccccggaatctggcaggcagacacgctgcgccactggggacaatgcgaccccaatgagctggcgctcccctctggcgaaggaccaggtggcgaggtcgcccctgtcgtgtggcccaatgcgttaccagcaagaacaaagtcccatcttaactgctcttcgcgcggcttttgaccttgggtcggggctgcgtctcagcgctcaacagccccgcttctccccacggttttaaattac

SEQ ID NO: 92621 - DNA, 134 bp, Homo sapiens; identical to SEQ ID NO: 2375
  chr4:8895964-8896098
  hyper

SEQ ID NO: 92622 - DNA, 247 bp, Homo sapiens
  chr4:8896117-8896364
  hyper
cgctggaactccccctcctggccccctcctccgcttctgtttgtttaaccttccggcagggcggtgaccctgcgccctgccaggcgctgccatggggtcaggcgggggtggggggcgcctcaggggtccggcggcggctgggagtcccccgagcagcagagaccctcctcctgtctcctgttctgcccatcgtgggaagtgtcccaggcctggttgtgccagaggccctgggcgaccttcagcagtg

SEQ ID NO: 92623 - DNA, 30 bp, Homo sapiens
  chr4:89054393-89054423
  hypo
taatttgtggaataccggtagaagtattct

SEQ ID NO: 92624 - DNA, 128 bp, Homo sapiens; identical to SEQ ID NO: 40316
  chr4:89116521-89116649
  hypo

SEQ ID NO: 92625 - DNA, 54 bp, Homo sapiens
  chr4:8911942-8911996
  hypo
tggttgctttcctcacgcttgtgatacggccccaggcaacgggacctgactgct

SEQ ID NO: 92626 - DNA, 106 bp, Homo sapiens
  chr4:89291663-89291769
  hypo
atgggctacctgcagcgctgctttattgttgtttttaatctgggactcagtaaaatagagcagtctctctctagaaaatcacctgttgtaacggaggaaaagaaaa

SEQ ID NO: 92627 - DNA, 450 bp, Homo sapiens
  chr4:89378317-89378767
  hyper
gttcccgctctgcagcgcaacgcctgaggcagtgggcgcgctcagtcccgggaccaggcgttctctcctctcgcctctgggcctgggaccccgcaaagcggcgatggagcggaggtcgcggaggaagtcgcggcgcaacgggcgctcgaccgcgggcaaggccgccgcgacccagcccgcgaagtctccgggcgcacagctctggctctttcccagcgccgcgggcctccaccgcgcgctgctccggagggtggaggtgacgcgccaactctgctgctcgccggggcgcctcgcggtcttggaacgcggcggggcgggcgtccaggttcaccagctgctcgccgggagcggcggcgcccggacgccgagtgagtggggctggtgtgtgagggctgtgagggctgtgaggggtgagggctgagggctgtgaggggcgggcagccgggggtc

SEQ ID NO: 92628 - DNA, 114 bp, Homo sapiens
  chr4:89378831-89378945
  hyper
cggcgcacctgagctgtcttttatcccggtcagtgtcaggcgcggggtgagcgggatactggcgaccagcggatcctccgctcagcaaagtggccggtgcggggcatgcgggca

SEQ ID NO: 92629 - DNA, 52 bp, Homo sapiens
  chr4:8965616-8965668
  hyper
gcccaggcctggccccgagcccgctggactcggccgccggccctgcccgtac

SEQ ID NO: 92630 - DNA, 133 bp, Homo sapiens
  chr4:89660145-89660278
  hypo
gtgttgtaccagccacgggaaggtattctactcacaatgatgggtatggtgttagctcgggagaggatctgtttgaccagccggtacctgtcgtatagtggcttcatcacctgccgttcgttctttgttacct

SEQ ID NO: 92631 - DNA, 124 bp, Homo sapiens; identical to SEQ ID NO: 40270
  chr4:8967222-8967346
  hypo

SEQ ID NO: 92632 - DNA, 20 bp, Homo sapiens
  chr4:89912577-89912597
  hypo
gactccgtctcaaaataaaa

SEQ ID NO: 92633 - DNA, 91 bp, Homo sapiens
  chr4:90031770-90031861
  hyper
ggaaggcagcctgaccgcgtttcccaggaaacaggtggtgcaaggtggaggtgcaccactctctcctccaggaaggcggtgacccttccgc

SEQ ID NO: 92634 - DNA, 106 bp, Homo sapiens; identical to SEQ ID NO: 40318
  chr4:90043853-90043959
  hypo

SEQ ID NO: 92635 - DNA, 62 bp, Homo sapiens
  chr4:905870-905932
  hypo
cctcagggggctgtgcgcagggaggctgcggcgtggctgtgtccacccgaacccacactcag

SEQ ID NO: 92636 - DNA, 1539 bp, Homo sapiens
  chr4:90757517-90759056
  hyper
tcattatttgccaaacgcagcttgcttactttacagagaaaaaccaagagagcgggcagacagattttatgtgagagaaaagttggatgctcacgctccatggagcatcctcgcgtttcccggggaaaagcggatcccggagaagcagcctaatctctcagcccttgtggagaagggaatatcagaagcaggacgaaagccaggtcaagtctctttccttaggctccccaaagggacaagtactcacctcccagagacctggcccagcgggtcctcatggcagcaccaccccctcccggtgcccacgaccattcgtctcccatccggcgttctccaggatttccaaagacgcccgtttagatccacaggtacttacctgagtccctctgcttctccacaactccgactcctccccgcctctctctttttttaaaaaaaaaatttaaacaattcccaaataatatttaataggaaagaagaaggaaaaggagcgcacaggaagggcggaggcggcacccgggggggactgtccccagaggaggccgctgtgagccggcgacgcgaggctgggggagtgggaggcaaacccgctaacctgtcgtcgaatggccactcccagttctccgctcacgagggtggaaaggcagaaggcttgaaggcaaggcgtgagggagcgcccaggacgctctcggaggggccgggccggggtctgcgctgcagcccgcacgcacctcacttccgcgtcgcggcgctcggtcgctcgccccctctcttgggccccttctggtcgtcgccgtcctcctcctcctagtcctcctccttctccttctcctcggctctccgcccccaccgctgatttgtcagcgcttctgcccgcccctctcccggcgctcgctgctttccctgcagcgtgctcctcgtccctatctcggatggggatggggcagggggcgcggggtgagccatcaactccagccgcctgcctggccgcgcaaggcgggaaagtgggggcgcttttgcgcctcacgttaagtttagggtcacgagcactcttgtggagatcgggagcggttgggctagggatgatgcctcttcctctttccccttcccctcccttcttgtccccgcctttcctctgggtcctcccggggaccaccccctacccctcgtcagagtcgccctgggagagccgagggcctgagggtcgaccaccaagggcagagcctatcccttggggagctgctggaggagacaggcagcgccgggaggtggctcacaccgcaccgccgagagcgctttgccctcgcatcgctgaaatttaatcacggtcacaggttacaacgttaggggtcgctttagttcaaatatcttcaaggttttcgtttgctcttaatctaggaagagccggaaagggtcctgagggtgaaagggagactactaaggaagagtcacaggttgaggaggcaggagaaggctcagcaaatcctctttccacgccactatcaccattttcctttccaccaatcagcgcctgccaga

SEQ ID NO: 92637 - DNA, 269 bp, Homo sapiens
  chr4:90759130-90759399
  hyper
cgctctagaaatgggacttactttgcagacctccctttatctgggagacaaatccagcgtgatttagcctaccggaccatcatatccaatttcttcttcagccccttctgaaagggagatgctacacaccactcacctttctgacttctgattctcgttgccctcagaattgacacccccttttctctccccccacccaccacacgcacatgcacacagacatacacacgcgaacttcaagacaatttttgcatcgcttaacacatttt

SEQ ID NO: 92638 - DNA, 94 bp, Homo sapiens
  chr4:91049775-91049869
  hyper
tgtgtcccagggactcgtacacacggtgccagcaaggggtaagggtgacggagggatttgtgaatggtgcttctgcgtgcgtggaggctgagcc

SEQ ID NO: 92639 - DNA, 203 bp, Homo sapiens; identical to SEQ ID NO: 40319
  chr4:91168356-91168559
  hypo

SEQ ID NO: 92640 - DNA, 30 bp, Homo sapiens
  chr4:9153953-9153983
  hyper
aaggcggaggaactgcgagagtgcctacgt

SEQ ID NO: 92641 - DNA, 163 bp, Homo sapiens
  chr4:93225260-93225423
  hyper
ggaatctggctgctccgtttggaatctcctaatctttcctttccacttagattctggcagcgaagaccagtgattctctgcgggctgtaggggcgggggcgggggtcttttttggtccgagagggtgcggggaagggggcacatccggcgtgaggggggtgtt

SEQ ID NO: 92642 - DNA, 30 bp, Homo sapiens
  chr4:93225709-93225739
  hyper
tgcgctaaactccaccgtgacctcaaactc

SEQ ID NO: 92643 - DNA, 49 bp, Homo sapiens
  chr4:93226097-93226146
  hyper
tgttttgcagtgattcgtggaatgtggctggatgcgtgggggtctcgag

SEQ ID NO: 92644 - DNA, 46 bp, Homo sapiens
  chr4:93226463-93226509
  hyper
gctttatgatccttgcgtgtagtctttgagacggtggcaggagggg

SEQ ID NO: 92645 - DNA, 35 bp, Homo sapiens
  chr4:93226820-93226855
  hyper
cgggccgggactggccgcggcgagcaggggcgggc

SEQ ID NO: 92646 - DNA, 83 bp, Homo sapiens
  chr4:9423198-9423281
  hypo
acaaaggatccataacgatgaaaaaatatttgttttcaatgtgaattaaatttctccacctttcagatgtgattaagaacacc

SEQ ID NO: 92647 - DNA, 30 bp, Homo sapiens
  chr4:94749499-94749529
  hyper
tggcgggtccagaatcgcccagagccgccc

SEQ ID NO: 92648 - DNA, 246 bp, Homo sapiens
  chr4:94750031-94750277
  hyper
tcccagtgctgcctccgatcctgagcctccgagcctttgcagtgcaatgtcccgcctgctgcatgcagaagagtgggctgaagtgaaggagttgggagaccaccatcgccagccccagccgcatcatctcccgcaaccgccgccgccgccgcagccacctgcaactttgcaggcgagagagcatcccgtctacccgcctgagctgtccctcctggacagcaccgacccacgcgcctggctggctcc

SEQ ID NO: 92649 - DNA, 1043 bp, Homo sapiens
  chr4:94750556-94751599
  hyper
acggctagcagccaacgccagggagcggcgcaggatgcatgggctgaaccacgccttcgaccagctgcgcaatgttatcccgtcgttcaacaacgacaagaagctgtccaaatatgagaccctgcagatggcccaaatctacatcaacgccttgtccgagctgctacaaacgcccagcggaggggaacagccaccgccgcctccagcctcctgcaaaagcgaccaccaccaccttcgcaccgcggcctcctatgaagggggcgcgggcaacgcgaccgcagctggggctcagcaggcttccggagggagccagcggccgaccccgcccgggagttgccggactcgcttctcagccccagcttctgcgggagggtactcggtgcagctggacgctctgcacttctcgactttcgaggacagcgccctgacagcgatgatggcgcaaaagaatttgtctccttctctccccgggagcatcttgcagccagtgcaggaggaaaacagcaaaacttcgcctcggtcccacagaagcgacggggaattttccccccattcccattacagtgactcggatgaggcaagttaggaaggtgacagaagcctgaaaactgagacagaaacaaaactgccctttcccagtgcgcgggaagccccgcggttaaagatccccgcaccctttaatttttgctctgcgatggtcgttgtttagcaacgacttggcttcagatggcagctacatttgatggtttgcaaatgccgccgctgttccaaacttcctacggtccatattgtttgatgaaaactttctgttaaaattgtgtcctttccgcccaccttctgctccccctttagatagatacggtataattgtaggtacccgtatatggcatcattattctagttccctgctgccaatacgctgctaaaacgtcgcatcttctctgtcactggtttgggtttaatttattttacgccctgggcatccatccttgtgtgttgcgcactcaagtgtgggagatttagtcttccgaagttgttttcca

SEQ ID NO: 92650 - DNA, 20 bp, Homo sapiens
  chr4:94752906-94752926
  hyper
ggaaaagctaatagtcgtgc

SEQ ID NO: 92651 - DNA, 268 bp, Homo sapiens
  chr4:94753279-94753547
  hyper
taatgcactagggagcgcaggttctggtctccttaagtaagaaactgcagaaccagctttttactgaccacctgggtatctgtggctttcagcggaagccgaccaagagatgcagagaacgtccgccagctctctgggagaagcgagcaggcggctggtgacactttccagggcagaaataatgcacctgtcccttagataaccttttgcacccatcgagtttgccgtgctcacgataaacatcaggaatcttcgggctgctgaataa

SEQ ID NO: 92652 - DNA, 258 bp, Homo sapiens
  chr4:94755600-94755858
  hyper
aaaggggaaactgagcggagaatgggttaaatccttggaagcaggggagaggcaggggaggagagaagtcggaggagtataaagaaaaggacaggaaccaagaagcgtgggggtggtttgccgtaatgtgagtgtttcttaattagagaacggttgacaatagagggtctggcagaggctcctggccgcggtgcggagcgtctggagcggagcacgcgctgtcagctggtgagcgcactctcctttcaggcagctccc

SEQ ID NO: 92653 - DNA, 154 bp, Homo sapiens
  chr4:94756001-94756155
  hyper
cggccggggcccctctcctcccccagctgcgcagcgggagccgccactgcccactgcacctcccagcaaccagcccagcacgcaaagaagctgcgcaaagttaaagccaagcaatgccaaggggaggggaagctggaggcggcagaggcggcgg

SEQ ID NO: 92654 - DNA, 169 bp, Homo sapiens
  chr4:9499324-9499493
  hyper
agcgaggggcataggcggggaaggtgcggggcgaggcggccgcgggtccctggcatccctctccgtacacccaggctaagctggcggtgctgctggtgacgctggtggccgccgcggtctcctacctgcggatgcagcagaagctgcggcggggcgtggccccgcgcca

SEQ ID NO: 92655 - DNA, 172 bp, Homo sapiens
  chr4:9499862-9500034
  hyper
tcacctccgggcttccgaagccccctctaaggcggagtggagccttgggaacccctcggccaagcacagtggttcgaaaatacagctgaaaccctgcgggcccttagcaggcgccccagcgccggagcagggtcagggtcttcttgcgacccggccccgctccagatccccc

SEQ ID NO: 92656 - DNA, 89 bp, Homo sapiens
  chr4:95127590-95127679
  hypo
attaaaacaattgaacgtatgagaaacggtagaacgatggctaccagaggctgggaagggtagtgtggggcgggggaggaccccggtgg

SEQ ID NO: 92657 - DNA, 29 bp, Homo sapiens
  chr4:95128039-95128068
  hypo
gctgggattacaggcgtgagccaccactc

SEQ ID NO: 92658 - DNA, 360 bp, Homo sapiens
  chr4:955184-955544
  hypo
gccagctgggctcagcggggaccggggacgcccaccctgggctcgcccgcccactcggccggcggctcaccatgtgcacgacgcccgtcacgcccacaacctccagcagcccgtcgtccatgcgtggcttctcaaacctggtgtcgctgtcggagccccacaggtcggcccccgagccccagctgccgcataagagagcgggcacagaggtgtaggtgcaggcaggacgagggctgagcctgcccatggccccgccgggcagagcctctggggagccccgcccgcgagcacctggggatgttgatgaagatgaggccttcaatactgggcagctccacctcctgccgctccacctgcagc

SEQ ID NO: 92659 - DNA, 1199 bp, Homo sapiens
  chr4:955851-957050
  hypo
agttactcatctgcacgatctggggacagggcgttcatctcccaggacccggccgccctcaccaggccccctgagctccccaacagctctgccggcaggcagagacaagagcaaggaccaccctggcaccaagccgagcacccaggagagggcagcatgggcaggtcctggccaggctctgtcgccagctggctcagcacaatccccagcagtggctactttctgtgtctccctcaactgcccgctttgcagaggggatgatgcgggcgcgtacacccgagtgtggctgggaagaggacgcccgttgtgacgcgtgtagcggggtcatatgcaggagcctggaaggcaccccacgccgggctgccctgtaccttggggggctctgcgtctgccgtgtcgttctctgcactgccagcctcgtgggcatccagcaggatggtccagcggtccatgagcacggcgtcggcctcgtccacagacagcagtacggagaacgggtcctcgccgctgtagcccgccccccagcggaggactcgaccaaggtcattccctgggacacaagcagacacagagcatctgtccacacccacccgcccatcagctgggtgcagaccccaccacgaggacagccagcccaggcctcggcaaaagctgcacaggaaggggtagaccctgaggccccctcctcggctgcacggctgagcccacctgtgcccaggggcaggatggccacagaaggctccgggcaggccagtcggtaccgtgtctcctccagggcgccaagcacccagcccacagtgccatcgccaccacacaccagcacccggaagcagggcacctgggagaacaggtggagcctagcgggagacaggaagtgtcctctaccagctgcgggcgcagcccatcccccacccaggctgcctcttccaagtgcccgtcctggccgtgtggaggacttcaaggtcccagcacgggatccccgtggagctcctgccggccgagacagctgtggcagcctcctggggcccttcccgcccctgctgctgccctggaccaggggtcctgctggactcacccgggaagaggacctccgttggtcaggtcgaagacctgatgagggttcagtagcttccggaagctgcagagcaggtctcggcccttgaggcctccactcttggggttcacgaacacaaggaggg

SEQ ID NO: 92660 - DNA, 146 bp, Homo sapiens
  chr4:95678853-95678999
  hyper
cgccgctccccaagtcggctccgcactccgcacacaggcggcggcgctggggccgctccaagtgcgttgagaagtgtaatccctccgctaagtacttggctctcagtctccaatcactagtgggagctggagagggcaagtgaaaa

SEQ ID NO: 92661 - DNA, 266 bp, Homo sapiens
  chr4:95679059-95679325
  hyper
gtcccgcggtggcggcggcggcggcggcggagcggccgcggcggccagaagttgacggcgcagccgggcgcggggcgcggagtcggcggggcctcgcgggacgccgggcagtgcggagaccgcggcgctgaggacgcgggagccgggagcgcagccgcgggtaaggcgcgcgcggcggggccccgtcccctgcgggtggccgagttcccgagcgcgcgggaggcggccgagccggcgagagccgggcagagcgaggggcggcgcgg

SEQ ID NO: 92662 - DNA, 106 bp, Homo sapiens
  chr4:95679639-95679745
  hyper
ggcagtcgcggaatccgggaaatgggagggagcccggcggggcgggggcccagggccagcccaggcgggacccgcaggcacccacctgccccggacgcctcccgag

SEQ ID NO: 92663 - DNA, 30 bp, Homo sapiens
  chr4:957409-957439
  hypo
ccacgtgggactctgcgtggcactctgtgc

SEQ ID NO: 92664 - DNA, 29 bp, Homo sapiens
  chr4:95762900-95762929
  hypo
gagctgttcctattcggccatcttggctc

SEQ ID NO: 92665 - DNA, 30 bp, Homo sapiens
  chr4:96061185-96061215
  hypo
ggagctgttcctattcggccatcttgtaac

SEQ ID NO: 92666 - DNA, 25 bp, Homo sapiens
  chr4:96180202-96180227
  hypo
cgcccggcctcgaccatcttattct

SEQ ID NO: 92667 - DNA, 400 bp, Homo sapiens
  chr4:96469013-96469413
  hyper
cccatccccaactcccggccacactcttcccaacccggcttcgcccagggccccggtcacttatgttaaagttcacaggcgttaaattaaaatgtcagagttataaactggtcgactaccccggggagtttcggatttggtttgaacaagcagccggttcccccagagctccgggattttcatttctacatcccctggtgggaagcaggcatgaagcggggtatgtatgagtgcagaggcatgcacatcccgggcctgcctccagccgggtacgcggattcgggtgagctgtgtatttccacagcacctgaagcagcaggcgagggggacgggtgcttttgagtccttgacagtaatggacacatttccttagctgagcgcccttcggggtctagtgtgc

SEQ ID NO: 92668 - DNA, 496 bp, Homo sapiens
  chr4:96469768-96470264
  hyper
tccagttgaaagcaacgaggcaaattgaggaagtcaagagaactggggaggaggagaggaaggagggaaggaagaagctaagggaggtggccgcggagcttggcggacccccttaccttgggcggcggagccagtgccgctggcgctgagcagggccagggcaggtagcacgagcatttgcagcaagtatcccagtcccagtccgcagcgggccgctgtcgcccgcagacctttcctcatcgtagacagaggtgtgccggggggaggggagggggacagagagacgcgcaaacagctgaaagccccactgggcagaagctgaatccgtgcaccgcgaagcagtccgaagaaataacgacaaccaagcgccacactccactttctccaaaggcaggggccaaaagggggaggagaggagacgccgaggaggagtttgaaggtccctctttcccaatgccttctaactgacgtctcccgcgagcgactgctctgcccc

SEQ ID NO: 92669 - DNA, 194 bp, Homo sapiens
  chr4:96470693-96470887
  hyper
ttgcagggagatcagcgcccaggagaccagctgtgggtttgcccgctgaagccgaggcgagacagaccaggggacgaagcggctgcggagagtggcagcgcgcctgcctcccgcggtgcgccagacctggacgccgggagtgcagcgggcgcgccccgggccactaggctgtgtccagtggagctcagcctgcc

SEQ ID NO: 92670 - DNA, 304 bp, Homo sapiens
  chr4:96470888-96471192
  hyper
cctgccaccttcttcgccgcgccggcaaagcctcagccgaattccctaggactggactcggtctacgacttcgggtctcgcggttgacgaagccggtgcgggctcgaactgaagtccttcttggttggggaagaaggcatgaagcttttgcactgccccagccggctgctgtcctggggttgtcagcgccagtcagactgctttatgttctgagcgcgtatgacccctttgcagtggaacagaaactaaaagctcgacggaaactcattctgcaacagtgctttctttgcgtgcatgttggtgg

SEQ ID NO: 92671 - DNA, 36 bp, Homo sapiens
  chr4:967581-967617
  hyper
tgggctcggtttgaccgcagccgggccagacttctc

SEQ ID NO: 92672 - DNA, 51 bp, Homo sapiens
  chr4:967716-967767
  hyper
ggccgcgcaggacgcccccggcgaggggcagcgctgcgggcctcccacagt

SEQ ID NO: 92673 - DNA, 79 bp, Homo sapiens
  chr4:97118687-97118766
  hypo
ggggggtttagttaccggggatggctttgggatgaaactgtcccacctcagatcatcattctcataaggagcgtgcaac

SEQ ID NO: 92674 - DNA, 18 bp, Homo sapiens
  chr4:97118826-97118844
  hypo
ccgcggatctgacaggag

SEQ ID NO: 92675 - DNA, 76 bp, Homo sapiens
  chr4:9783020-9783096
  hyper
aaggctccagggatgcgccaagcacccttcggttttcccggggagaattttccccggcccggggactagggtctgg

SEQ ID NO: 92676 - DNA, 299 bp, Homo sapiens
  chr4:9783125-9783424
  hyper
cgcccctacactctggcgcgctgagggcggtgagcgagggcgccaaggcacaggtggggcgggagtcgagcgcggaggctcggggggcgggacgcggggcctgggagcggccagggaccgcggcagcgcctcagtgccagcctggcgcccgcgactgcctgccccagcccctcagtggcggcttgctctcttctctcgctccgaaccagacacagccgctgccgctgccgtccggcgcgctacagactcccgagaacagccctggctgtcagcgagcaccagccgcttcctgtccccat

SEQ ID NO: 92677 - DNA, 120 bp, Homo sapiens
  chr4:9783500-9783620
  hyper
cgcagcccggcgcagctcatggtgagcgccctctggggctcgagggtcccttggctgagggggcgcatcctcggggtgcccgatggggctgcctgggggtcgcagggctgaagttgggac

SEQ ID NO: 92678 - DNA, 21 bp, Homo sapiens
  chr4:9783681-9783702
  hyper
cgtacccggggcagttcgctc

SEQ ID NO: 92679 - DNA, 30 bp, Homo sapiens
  chr4:980454-980484
  hyper
aaatcgctgaagccccggagatggaggttg

SEQ ID NO: 92680 - DNA, 176 bp, Homo sapiens
  chr4:9847574-9847750
  hypo
tcatccatttccatccgacatttacatgtcaagtcctgtgctaggcaattgcagactctactagttgatgtaagaactatcttgggaggcagttattctaactccatttaacggtgaagaagttgcgacccagagtagagagtgacttgctcaaggtggcacgagcagtaaatgat

SEQ ID NO: 92681 - DNA, 117 bp, Homo sapiens
  chr4:994673-994790
  hypo
tgagctgatgggcagcgcctcgggccacttcactgactttgaggacaagcagcaggtgtttgagtggaaggacttggtctccagcctggccaggagatacatcggtgggcgagcgca

SEQ ID NO: 92682 - DNA, 106 bp, Homo sapiens; identical to SEQ ID NO: 40325
  chr4:99495888-99495994
  hypo

SEQ ID NO: 92683 - DNA, 30 bp, Homo sapiens
  chr4:99503312-99503342
  hypo
ttttgcaagtgattgcggttctcttgtcca

SEQ ID NO: 92684 - DNA, 30 bp, Homo sapiens
  chr4:99559227-99559257
  hypo
gtctgaccacccttgcgccttgcctctgcc

SEQ ID NO: 92685 - DNA, 171 bp, Homo sapiens
  chr4:99579127-99579298
  hyper
tgtttatctctccaacgcgcaagctggaaaggcggaaggcgaatgcctctatgctgctccggcaagcgcctgcggggctgcgaaaagtaaaggcaacgaacaacgtgggggaaatcgtcgcgaatcgatcggccacaatagttggaatcccaggagcgctccaacttaccc

SEQ ID NO: 92686 - DNA, 119 bp, Homo sapiens; identical to SEQ ID NO: 28679
  chr4:995875-995994
  hyper

SEQ ID NO: 92687 - DNA, 75 bp, Homo sapiens; identical to SEQ ID NO: 7206
  chr4:996100-996175
  hyper

SEQ ID NO: 92688 - DNA, 44 bp, Homo sapiens; identical to SEQ ID NO: 7207
  chr4:996495-996539
  hyper

SEQ ID NO: 92689 - DNA, 30 bp, Homo sapiens
  chr4:99846517-99846547
  hypo
agctacaaagaaacacgacctactggaggt

SEQ ID NO: 92690 - DNA, 1730 bp, Homo sapiens
  chr5:100236150-100237880
  hyper
ctcctccaccagaagcgctgtttgggagttgaaacgaaataatgagctcgggtcacaagcttttccacgaacctttcatcctggagaaaaaggaaagtgctcagggagcctagctgccctcgcattgttcctggcagctccaactccttgcacagtcttggtctctcaggagaccaaggcagtcaggacgctacagggcacgggtgtaagcgcgacgttcgcggccagccctctgccttgccccactgtaattgcgggttttgattaagaaggaggagccagttgccgactgagctttgaaagtgactttgggtggggggtgggggtggggtgggggtggaaggaggggagggaccaaaagagcctgagtcctgcaataaaggtttccccctatcttctcactcattctttccccctcgccgccggcgctctggcagcaggggataaccccggtgcgcgcctctcttcctgtttggtttactcaagcgcctgccccaacgccttctcagtcaagctgggaggaaactgcttcagcttgaaaaggatgcgggcaaaagcccagcccgactagctcaaccgccgcgccagtgcccgcctcctcttccttaacgcctagggctgcgcccaccagccggcaacgtccaggaaagggccacaggagaaatgacacccgtgcaatgcggagtgtcccggctccgcttccccgcagggactcgaggtgcgctccttttcctggccacggtttagggaggctcggagatggacacctcggcagtatctggcgaccctcttctcactcgctccgcccactcctgctctccagggtcccagccaagggcccgaaccctcggagtcctagtgagccttggccgctttgtctgggatcaggcttatcctcctagcccacggcccgggagggaacaaagagcctcgaccctcaagctctagcctctgcctctcatcggagccccatgcgcccattcatcacctttctaaagacccctttgtctgcctggcaagcacaggtctgcaagggatgcccacgcccctgcccaaagtcctgcttttctaacaactgagctagattggattttcaagccacccagtcttgtgtaaacgacctcataccggtcttttttaccccctcagaatagaccatgtatagattcgttgatgcatgacgaccattccagcccattccttgctagctttttcattctcttccagtccgctttgactgtgctactgttttcctggttttctacagaatagcaagtccttctgtaaggatcaacctgcatcttgctcgcttaaataaatgcttattacctagggagcaggaatattaagaaatggagtgcaggaagtttaagagcatgtgtgtgtgttagcagtcccatctctctctctctcacacacacatacacacacacgcaagggctgttttctttgttttaatcaatgtcagagaaaaatataaactgggcaggcatctctgctggtgtgtagtttctgatagaggacgcctccaaaccggaacagggaggatttccgaaacaggactttgaatagagttgacaatcaggttcacatcctcagaaaaagccttccaagctatgtcagcaacacaaagttgcaccacctcctgggtaaacttcaaagacacagaggccagcgggtggaaggaagtgtgatatttagagaacttagtggggcgggggagagtctga

SEQ ID NO: 92691 - DNA, 694 bp, Homo sapiens
  chr5:100238283-100238977
  hyper
tgacttctcctttggcgagagagcacccagggccaacacaactgtcaccacaaccacacagagcaagttgaactcatactgggaacagcttagagaagcacgcacatctcaacaacagcctttgttatttaattcatgacactaaccacgcgcaagctcaaacaaacacacatgctatcctaaccatcactctaccctctatattcacatttcatttatggcttgactttttgtcatatcctgaaatgaagctttgcatttacccgatgagttgcgtctcctggtgctcctcagttcttgctatttcttttgtcttataaaagatcaggagcagacttattgtgcagatcgtccacctcttcctaatggagcgcatcttgggtgcccgagaaagtcctggttgccccagctcccgcaccttctcttgatataaaggctccgttttggggagatagtcgcgggggtgaaatctgtaaaatgcgaggagagcttggagccgggatcccgggatcagatcactggggtcttctgtggccgagctccctctggtcctcgaacgctgcccagcgacctctcgccctgtttgcgccagctctgccagggtcgctccgcgccgcctccctggggctcaggtttcttttcagatgagacaccttgtgcattggaggtggcggcagcttctgcagctgggttc

SEQ ID NO: 92692 - DNA, 44 bp, Homo sapiens; identical to SEQ ID NO: 2619
  chr5:100238978-100239022
  hyper

SEQ ID NO: 92693 - DNA, 97 bp, Homo sapiens; identical to SEQ ID NO: 2620
  chr5:100239023-100239120
  hyper

SEQ ID NO: 92694 - DNA, 590 bp, Homo sapiens; identical to SEQ ID NO: 2621
  chr5:100239134-100239724
  hyper

SEQ ID NO: 92695 - DNA, 77 bp, Homo sapiens
  chr5:100240068-100240145
  hyper
tgttggctggtaggtcgggaggcacctctagcatgagacagtgtctggaagccaggatttccctcatctatatgcgc

SEQ ID NO: 92696 - DNA, 57 bp, Homo sapiens
  chr5:100240232-100240289
  hyper
cgctcagaaatgatgaggcccaattccaatcttccctcccgccggaagtaagaaggg

SEQ ID NO: 92697 - DNA, 95 bp, Homo sapiens; identical to SEQ ID NO: 40410
  chr5:1003105-1003200
  hypo

SEQ ID NO: 92698 - DNA, 30 bp, Homo sapiens
  chr5:1007449-1007479
  hypo
agcccatcgcaggcacggcctggccgggtg

SEQ ID NO: 92699 - DNA, 43 bp, Homo sapiens
  chr5:1008040-1008083
  hypo
ggttggagacgtgggcgtggcaacagcccgtggggaaaatgct

SEQ ID NO: 92700 - DNA, 367 bp, Homo sapiens
  chr5:1009258-1009625
  hyper
tcgttttcctctccccgcgtcccgccgtgccgcagccgccgccgcccgcaagcggagagagagcccggaaggtgagcgggcgagccgacgggcggggcggggggcggcgacccggcccgggaccctcagagctaggagcccgcgcgcgtcctgccctggagccagcagtggggggacggggccgcgggtctccaggagcgcgcgggacccccacgcctgcccctgcgcggtctccaggcgatggggacacagcgaaggcgcagcgcccgcggggctcacggcgcgtctctttccctcctcggtgcgggtttcccgcgcgtccgcccccggaccgcaggggacagcttcgtggcgtccgcgtacgcga

SEQ ID NO: 92701 - DNA, 208 bp, Homo sapiens
  chr5:101631427-101631635
  hyper
aggctggctgggggccggtaggttgaccttggtgagagcgcaagcaagttccaaacccggggccaccttgcagggcgcgtccaccgtcccacggaccccgcgcacctgccctctcccccggctggctcgccgtgcccacctcgctctccactggcccgagcctcaagcgggcgctggactttaccttgcgtgacggccaagaggcagt

SEQ ID NO: 92702 - DNA, 40 bp, Homo sapiens
  chr5:101632034-101632074
  hyper
acaggcaggtgacagcgcccccgtgcgggaagcttcccgc

SEQ ID NO: 92703 - DNA, 35 bp, Homo sapiens
  chr5:102048048-102048083
  hypo
aagtgtggccgggcgcggtggctcacgcttgtaat

SEQ ID NO: 92704 - DNA, 30 bp, Homo sapiens
  chr5:102090335-102090365
  hyper
ccaggctttcagccccggtactctgccatc

SEQ ID NO: 92705 - DNA, 177 bp, Homo sapiens
  chr5:1021313-1021490
  hypo
caaacccagaagaaccgatgggcaaaatctgcaaatgcctctcagatatggaggctccgtctgaatgtatctagggcttatgtgggaagcccggctcccctgcccggtccccccggccccccacctcccagcccctttgctcctcccgctgacccggccccccgcccctccacccac

SEQ ID NO: 92706 - DNA, 84 bp, Homo sapiens
  chr5:10248589-10248673
  hypo
cacttcaaggtctagcgcgtaagtatgccaagcatgaagagttaacagatcaccaaccatcccatgacagtcagtcctccctgt

SEQ ID NO: 92707 - DNA, 84 bp, Homo sapiens
  chr5:10248733-10248817
  hypo
cactgtaaactgaactcctgggctccacccatcctcctgcctcagccccagagtagatgggaacacagtcgccaagtctgttct

SEQ ID NO: 92708 - DNA, 16 bp, Homo sapiens
  chr5:10252583-10252599
  hypo
gggcgcggtggctcac

SEQ ID NO: 92709 - DNA, 16 bp, Homo sapiens
  chr5:10252719-10252735
  hypo
ccgtctcaaaaaaaaa

SEQ ID NO: 92710 - DNA, 299 bp, Homo sapiens
  chr5:10267147-10267446
  hypo
cagaggaaggtgacacggtagtaactgactaatcagtaatttgtaagcatggagaagtttctccaacctaggtgttccttgcaggcagtcttggcagaatggggtcatctaaaagcaccagaaaagtggggaccaaaggcaaatggccgagaaagtgttgaagggcaggaaaagtggggaaaacacgacaaggtagtaaaaatataaatgtgtgtgccctatcactgctctaaatggtttatgtacattaaaactggttttcaaagtctgctccatggatccctcggggtcctgggtct

SEQ ID NO: 92711 - DNA, 30 bp, Homo sapiens; identical to SEQ ID NO: 40498
  chr5:10269033-10269063
  hypo

SEQ ID NO: 92712 - DNA, 30 bp, Homo sapiens
  chr5:1028378-1028408
  hypo
ccttcctgagcatcccgtagggccgtggga

SEQ ID NO: 92713 - DNA, 398 bp, Homo sapiens
  chr5:10307528-10307926
  hyper
tcggacgcatgggatcgtggaggctgctgttctgcaaggacaacgtatcacttttatgaaagtcagcttctgaaaacggactatgggaagttccttacccgtgcacgcggcaaagaccttctttgccatagtcagaacacacgcgggagttcagaggagcggggcccgggcttgtgtgggcttgtgtgccccggggacgcgcacgtaccttgtcccgcggcctgagactgcgctgcaccgcgcggaggccgaacccagaggaggcggcgtggcgccgggcggggacgcgagagggacgtggacgcggcgaccgaggacgcggggatcctgcgggaccagtggctccagtcgtagcctcctgggagagccaagcccggagggggcggagaggtggagga

SEQ ID NO: 92714 - DNA, 709 bp, Homo sapiens
  chr5:10333423-10334132
  hyper
ccagagcaccccagccgtcctgggagcccccgaagccaagcatattcgaactccgaatccgctcgatcgccggggacctgccatctgggttcggttccccaaggtcgctgccgaccttagaccgcgggggtgtggggcgccggggaaggagacagaaggacaggcgccgcccagggccgcggggacacttggggctgcgtcctgggtgggcgcgatgctcccccagaacgactggagatggagagtgtcggggagggaaacgggacccacgaattcagggcgctgagtcggcggaatgcgccctgactccccctggccgagagccggctcagaatgaaagagcgcggagtgggaggtctgggaaatggcagtatttgtattagggagagaaggaaacaggagtgggagccgcacggcttggggaacgcgggagatcgcggattgcggggatagcgcagcgcggctgcccggggctgctgggaggggccggacgaggccagggcgagcggggtaactgcggccggccggacggcggcggtaaccggctgcaccgaggtggttccaccaccgcgctgggcgcttgcggttcgtctgctccaacgaaagccgcgtcccacgctccctgccgccgcgtggttttgcctcctcagaggggcagcggcgacccaggggctggcggtggatgtcaggagtgcgctttccttctagg

SEQ ID NO: 92715 - DNA, 62 bp, Homo sapiens
  chr5:1033612-1033674
  hypo
acgtgggtctctctccggcctcacttgcgggaacacgtccctggggccgggggctcagggac

SEQ ID NO: 92716 - DNA, 431 bp, Homo sapiens
  chr5:1034304-1034735
  hypo
ggcgtgggtaggaggcgaggtcccggcccccacgtccccccacaggcactccagtgcgatgtctcggtggaggaggacgaccgccaggagtggacgttcacgctctatgactttgacaactgcgggaaggtcaccagggaggtaggtgagcttgtgtttgcgtcaggtccacagtagtagacagacggggcagacagactgtgctggcctcgcgatacctcagggggcaggaggggacctgcctgctgcgaggtcctcatgccagctgggcttgcgtctccccagggcccagttcacgtgtgtttctgggccgagcctgcgccgcccatttctgcggctgtgcttcccacactgcaaggctgccctcagggcactggaggcgctcacagggccacctgggcagacccaggctgctccgagaagatgcctgt

SEQ ID NO: 92717 - DNA, 30 bp, Homo sapiens
  chr5:1037486-1037516
  hypo
gcaccctacagggctcgcactgcacgttgt

SEQ ID NO: 92718 - DNA, 40 bp, Homo sapiens
  chr5:1037995-1038035
  hypo
gccagatacacatgccgtacaccaccgcaggtcacaggtg

SEQ ID NO: 92719 - DNA, 126 bp, Homo sapiens
  chr5:1039154-1039280
  hypo
ggtagcccctggtcccggagccacagcagctcaggtgcatgcaggacacagtcaaggcggggaggggcagggcaacagatgctggggagagggagaggctcgcgctgggtgcggctcagaacacgg

SEQ ID NO: 92720 - DNA, 70 bp, Homo sapiens
  chr5:1039613-1039683
  hypo
tttttaaggataaagcggtgctgggtggggtctgtgggaggggtttgagccatggcggaagatccctggt

SEQ ID NO: 92721 - DNA, 153 bp, Homo sapiens
  chr5:10442372-10442525
  hyper
cgcacccagccggccgacgtgctgcggtggtccgcggggtaagcgcccttggcccggggagctgtccggtctacatgcccaagccagacgagcccagagagccctcctcccggaccaggggccttacgcggcactcagcgtccttaagagtat

SEQ ID NO: 92722 - DNA, 39 bp, Homo sapiens
  chr5:10464558-10464597
  hypo
ttgtgctctctgatgcggctactccgcctgacagagcca

SEQ ID NO: 92723 - DNA, 30 bp, Homo sapiens
  chr5:10538891-10538921
  hypo
gccgactccatgccacgcctgctatgaaat

SEQ ID NO: 92724 - DNA, 84 bp, Homo sapiens
  chr5:10563513-10563597
  hyper
ttttgggcagccagacgtggggtcagcgcccagtcgcagcctccgggggtgagtccgcagatccccgcacgtgacacaggccag

SEQ ID NO: 92725 - DNA, 188 bp, Homo sapiens
  chr5:10564471-10564659
  hyper
cggcttctctggggacgcagaagcgagaagcggggacctcggcgcgcgccccgcgtcccgctcttcctgcccgcgccccggcccccggcccgcgccccggccgccggcatggtgctgctggccgggaccgggccggagggcggcggggcgcgctgcatgaccccaccaccgccgtccccaccccgggg

SEQ ID NO: 92726 - DNA, 428 bp, Homo sapiens; identical to SEQ ID NO: 429
  chr5:10564800-10565228
  hyper

SEQ ID NO: 92727 - DNA, 1 bp, Homo sapiens
  chr5:10565262-10565263
  hyper
c

SEQ ID NO: 92728 - DNA, 480 bp, Homo sapiens
  chr5:10565264-10565744
  hyper
tgctgcaatccaggatgggcttcttgcggcccggtcccctcctgactattacctttccccaggtccctggcaggggaccattcctcctcccctgcaggagacagcccctcctgcccagcgccccatttggcccctgggcccctcgcgccgcccttgtcctaacacgctggggcgcagatcggctcctccagccgcaatgatttggaagcaacagtttcttccctcgccgggacagcttggtcccctaccccacctccgctgagctttgtggcccgcgccgcgaccagccaacgtgatctctgactggtctgtccgcaggtcaccttcgcgagccaatgccagccggggctccccagagtcagggcatagggagagccccagagccgcgggcatccacccgggtagggcaggaggcgtggaggcaggcacaggctatcctttcgttatgaccagattcagagaaaacgagatgtttagaaa

SEQ ID NO: 92729 - DNA, 129 bp, Homo sapiens
  chr5:10618114-10618243
  hypo
tctgccgtgctctgtcgtttatttctctacgagccccatagttggtgtgtttccctccctggagaaagcacaccccaggagggctgagaccttagcagttcactgatgttttcacgtctaggccctcac

SEQ ID NO: 92730 - DNA, 195 bp, Homo sapiens
  chr5:10630367-10630562
  hypo
tgttcttgggcacttcggctggggcagctctgctgcatgcattactcatcctcttcctgggagcagcgagccagcctgggcatgctcttcttggggagacagctgaggcacaaacatgcatgaaagtctggataagtacatttcaaccttctgcttccatcacgcctgcaaacatcccatcggccaaggttccac

SEQ ID NO: 92731 - DNA, 115 bp, Homo sapiens
  chr5:10652320-10652435
  hypo
gtggtctcccaggcacgcttctcaacaccggctacccctgctgtgaaggttctcaaggccctggtccggggagccaagccctgggagcgccctaaagctccgcaggtaactgcac

SEQ ID NO: 92732 - DNA, 193 bp, Homo sapiens
  chr5:10675371-10675564
  hypo
gctagcaggtgataacgtttgtttggtaattgaacataagcctttacggtgacactgcctgcgtgcaagtcccaagtcttccaagcctcagtttcctcatcttgtaaatgggtatgacaacatggggatccatctcctggagcagatggtgcgcgtctatggctcagacagtaacgcacgcctgcacagaagg

SEQ ID NO: 92733 - DNA, 514 bp, Homo sapiens
  chr5:107005171-107005685
  hyper
gaagcaataaaggttcggaactgctccagacccggaggaccccgccgggcactctggataacctccccactccacttccagggtccgaaaacacgggacgtctgcgactggccggtgtccagcacgcgcactaggaccgcccccggcgcccacctctagtctcccgcatacccggcgggcttcgggacgcctacaaatcggttccaggtaatcgcgcgcgttcctccggcagcacatcgccaggccgcgggcgaagggctcccacctcctggctcggccaactctggcagcttgttctgcacacatgacgtaacccggcattagatcaaactttctggcaccttgaacccactggggtgggtggagggatggagaagatgggagaatcctctccactgccaggcgcgccgggcccagactgactcaggggccgaatgatttcctcgcagttgaagaggaaaataaaaacctaaagcttccgcttcccagcccccctcacttcccccagcccgtg

SEQ ID NO: 92734 - DNA, 277 bp, Homo sapiens
  chr5:107005983-107006260
  hyper
ggtacctggcctttccgcggcggcttaacaaagaggggcgcgacgcgagcgcttcccgccgacgcctcaagccatcagcgcccgggcgacgcaggctccgagggtgcgcgccgccagcggttggtgcgcgccgatccccgccgccgctccttccgcagggccccgaggcccgggtagccctggctctccgcctgttatcggcttacctggggttgctgctgttccagtagacagcgtagcggtcggcgacggccttggagcccgggtcctggctgaa

SEQ ID NO: 92735 - DNA, 718 bp, Homo sapiens
  chr5:107006709-107007427
  hyper
ggctgcagcgcgggtcggggcaggcggcggcgcgcgctgcacagtcaccgggagttgcgcgccgcagccgcggggagacatacaccggcccgccgggcccggctcagcgtcggcgcagcaggctacgcacggctccgccaccgcccggggccctcgcactgcgccacgcttcgctccaagttactttggcggccggtgggaaactgcaggagaagggcgacgtgctgatagagggcttcgcgcttgtggtcccgggagtctgagaacccctttcctcagcctcctctgtgccttagcggggcgacccccagaaatctcagaggagtcgtaagtgctgcggtaccgggcggtgcgccgagaagggtggggatccggagccgcaacccagccttgtcggtgtcctggaactggttaagcggcagctgcgccggctttcgaagcggtcttgcctcgaaaacctcaaagaaaagtttggctcttcgcgtcttccggcaggtcccccagcagagtcggaacgcggcggtagcggaagagggcaccccgggggctggccgagcctcggggatttctcgcgcgtgctttccttggctgggtgtgggtgcaccacagtgaatgaagagcagaggttaagaccagccggcctggcagagctgggattcctaaacctgcaagacgacgccaacccaactgttcggctggagagcgggaggggaaacaa

SEQ ID NO: 92736 - DNA, 909 bp, Homo sapiens
  chr5:1073480-1074389
  hypo
ggggctcacccatggcgggaggaggcggtcccagggttcgcccttggaaagctaatggccctcacacctcccaagcttcccggggtgcggctggtgctcccaggccttagcgcgctgctctgagctcaaagccaccgccacggctaaaacacagcagcgccacgcacagcaccgtgttgacacgctgcgatgaggacatgccagggcacgtttcctgtgcagctggggtgggaaagaggcctggcccccagaccccgcccggcccacctcctcggcccgctgagcctccatgtgcttgtccaggtacgtcccctccagcaccgagcccacgatggtcaggcccttgccggccttcagctgcgacgtgaaggacagcaggcgggggtgcttcacggcctgctccgcgtccaggttcagcatcaccagcacctggggcctgcagccagggtggggcggctgttaccacggcaacgcttaccagggcacggcccatcaacaggcagggcagatgggacgggcggggcacacgacacaggtgggacgggagatacatgacaggcgggacaggggacaaaaggggcaggtgacagatgggatggggaaacgtgacacacgtggggtaagttgaacaggtgacaggtgagacaggccacagaagccaggtgggacaggcagggccgatggacaggtgggcactagccaggcaggacaggagaacaggtaggttagacaggtgggacaggtgacatgctagacaggtgagacaatggcccaggacacacacctgaagcccccaccgaggccctgaggggacaatggcccggggcacacccgaggcccccgccgaggcccctgaggggacaatggcccggggcacacacctgaggcccccgccgaggccctgagggg

SEQ ID NO: 92737 - DNA, 179 bp, Homo sapiens
  chr5:107840292-107840471
  hypo
agtaactctggcacccgttacctcctcggtgaaatctctgaaattgtcaagttgttgactatactttctcctttgtatgccaactatagttgggtatttcatgtcaattactatctaccatatactaagtgggatatgtgtatttaccagttttctctgatcaacgccgtgtgctcttt

SEQ ID NO: 92738 - DNA, 30 bp, Homo sapiens; identical to SEQ ID NO: 40501
  chr5:10864262-10864292
  hypo

SEQ ID NO: 92739 - DNA, 185 bp, Homo sapiens
  chr5:10915475-10915660
  hypo
gaaagacaagcactgcgtgggtaggtgctgataataatgatgaagacgatggtaacagtaacagcctcggctgaccttcatccaagatgcgcttggctgcttatggctggtgttcattctgaccagtcagtgcctatgctaatctggttgtaaaatatgtttaatatcaccgctgaaaataatac

SEQ ID NO: 92740 - DNA, 30 bp, Homo sapiens
  chr5:1094019-1094049
  hypo
gggttcccgtggggccggagcaccctagat

SEQ ID NO: 92741 - DNA, 33 bp, Homo sapiens
  chr5:10972987-10973020
  hypo
atagatgaggaaacacggcggcattggtgtaat

SEQ ID NO: 92742 - DNA, 36 bp, Homo sapiens; identical to SEQ ID NO: 40379
  chr5:109867-109903
  hypo

SEQ ID NO: 92743 - DNA, 30 bp, Homo sapiens
  chr5:10986789-10986819
  hypo
acgtctcaggagcagcgctgaggtgttccc

SEQ ID NO: 92744 - DNA, 197 bp, Homo sapiens
  chr5:110022402-110022599
  hypo
ttgaattaggtttagcgacatataacagaaataaaaataagggctcaaacagtatagaagcatatttctctctgatgtacgaaaataaaaaataaaagaacataaaagttcaaaaacaatgtagggtgtattgggcagcttcacagtcatgagaccaaggctctgtctaaatcttcctttcacggtcattgttaggc

SEQ ID NO: 92745 - DNA, 777 bp, Homo sapiens
  chr5:110408656-110409433
  hyper
ctttctccagggagacgccaggcattttggagagggagtatcctgctacgtgcagaactccgagaggtgcctgggctccgggacgccgccgccgggggaaaggggacatctgggctgtcagagcggggctgcgcctagcttgggacaacacttctgttccaatttagggagaggaagtctctatccggaggaaaggcaaattgggaactgggacgagggaacgttgttaggggcaccacctgctggggtccggcgcctccgcgctcgggctcggaattttggcagcctccgccccctggagacttgggaggagcgagcgtgggtgacagtcttttcgcgacgagtgccctccgccaccctcgccacgcccctgctcccccgcggttggttcttccttgctctactcaaccctgacctcttctctctgactctcgacttgtgttccccgctcctccctgaccttcctcccctcccctttcactcaattctcaccaactctttctctctctggtgttttctccttttctcgtaaactttgccgcctatgagcagccacattgccttactgaaatccagagcctaaccttcaatcccaccgccggctgcgcgtcgctcgccaaagaaatgttcgccatgaaaactaaggctgccttagctatctggtgcccaggctattcggaaactcaggtaagcccgaagcctcagacgtttgctgtaccttggggctaacctcaaattaaactggggctttggtgcagaagtcgttctcttattttt

SEQ ID NO: 92746 - DNA, 91 bp, Homo sapiens
  chr5:1104793-1104884
  hyper
ggtgcgtgtggggtgcgtgtggggtgctgcccaagaaaaccccagaacgcaggaaacaaaccaccccaggtccacacgtgattcagaagca

SEQ ID NO: 92747 - DNA, 565 bp, Homo sapiens
  chr5:110559554-110560119
  hyper
taggtgggagggactcgccacggagacgcgctcaaggagggatgagttgcgccaccaccacctaggtccctctctcgctatccggcggggccgcccggacccaggtgctgccagggtacgcctggcgcccgccatcccagagcagcgtcccgctgcgcacggtctccctccagctccggtccccgcgggagggcgcgtgggatgatgcgcgggtccttgtgccttccccaagctccagcatccggagccgccctagccggcaccgcggcagccacagcctgggagagagaaaggaaagagggagggcggcgggaaaggctcggcgcgggaggagggcgggtgaggagggaaggagcgagggggagggagcctctctcctcagcggtgcagctagtctccctccagcgggcggcgactccgggttccccctcgcgccctctcgcagaggctcgcccccttccccgcccaccgtccctgcgagcgcgggcggcggcggtgggcgtgtgcgcgcgtgaaggacgccgcctctctctcgctcctgcgttcgcaggcggcggctggcggc

SEQ ID NO: 92748 - DNA, 539 bp, Homo sapiens
  chr5:110560138-110560677
  hyper
cggcggcggcggcggcggcggcttccggagtcccgctgcgaagatgctcaaagtcacggtgccctcctgctccgcctcgtcctgctcttcggtcaccgccagtgcggccccggggaccgcgagcctcgtcccggattactggatcgacggctccaacagggatgcgctgagcgatttcttcgaggtggagtcggagctgggacggtaaggcgcgggctccggctggggaagcccgcggcgtgcactgggggttgtccctctcgcagcgacggctcggagggtgcgggagcctgccttcgtgcccttcgatttctccctacctagttagtgtcttgagagagagctaaccttcattcaggtgcggctcgagtccttcccaccccaccagagcgcctaggccggtgcagctgtaggatcagcccgactccctcccaccttccctccttctcgcaggctgccacttcccttgggtgacagctcccaccgcacgtgggccctgctttcccaattgatatctttgctcacgattatagcttgcc

SEQ ID NO: 92749 - DNA, 18 bp, Homo sapiens
  chr5:110885341-110885359
  hypo
agaagactgagaggccgg

SEQ ID NO: 92750 - DNA, 17 bp, Homo sapiens
  chr5:111306228-111306245
  hypo
gaagtcttactgggtcg

SEQ ID NO: 92751 - DNA, 30 bp, Homo sapiens
  chr5:111602040-111602070
  hypo
aaaaagagagattaacgatctcttacacta

SEQ ID NO: 92752 - DNA, 30 bp, Homo sapiens
  chr5:11169751-11169781
  hypo
ttacaaagatagagacggctattgccttgg

SEQ ID NO: 92753 - DNA, 30 bp, Homo sapiens
  chr5:111706271-111706301
  hypo
atttttagaaaagttcgattttccagttac

SEQ ID NO: 92754 - DNA, 376 bp, Homo sapiens
  chr5:111754705-111755081
  hyper
attcttccggaacagcgcagaaacagcccatgtcggttgtggtcgtctccagccaggagagaaagctaccaccgaggcgcccagccgccccctccactcaagcgcgatgcattaatttattgtccgcgccgtggcgagggtgagacgagcagctcccggcggggtccggggaccggccgccgaaccgcccggcggggcgggagcgagaaaggcggaaaagcccgggagagtcagcgcccgggagccgccggggaagcgccggcggaactgggcgcggagggcggtggcgcgtccccgcgcatcctgcggctcgagctcctccgaaggcgggggcgcggggcccctcccgcagtcctggggacgacaaaagtctcct

SEQ ID NO: 92755 - DNA, 128 bp, Homo sapiens; identical to SEQ ID NO: 40578
  chr5:111813766-111813894
  hypo

SEQ ID NO: 92756 - DNA, 79 bp, Homo sapiens; identical to SEQ ID NO: 40579
  chr5:111875281-111875360
  hypo

SEQ ID NO: 92757 - DNA, 37 bp, Homo sapiens
  chr5:1118984-1119021
  hypo
gctgaacttctgggccggctggcgggagaggcagagc

SEQ ID NO: 92758 - DNA, 31 bp, Homo sapiens
  chr5:111987787-111987818
  hypo
cgtgagccaccgcgcccggcctccaggtcac

SEQ ID NO: 92759 - DNA, 74 bp, Homo sapiens
  chr5:112073410-112073484
  hyper
ccctgtgccccactgcggagtgcgggtcgggaagcggagagagaagcagctgtgtaatccgctggatgcggacc

SEQ ID NO: 92760 - DNA, 206 bp, Homo sapiens; identical to SEQ ID NO: 40581
  chr5:112198294-112198500
  hypo

SEQ ID NO: 92761 - DNA, 36 bp, Homo sapiens
  chr5:1122889-1122925
  hypo
tgtccactgtctggacgggcacgttttgttcaccca

SEQ ID NO: 92762 - DNA, 78 bp, Homo sapiens
  chr5:112629200-112629278
  hyper
cagcacccagttctacgggcttctcatcacttttcaggtattcaaagctttgagggatgtgcccgaagcatccctaaa

SEQ ID NO: 92763 - DNA, 290 bp, Homo sapiens
  chr5:112629488-112629778
  hyper
cagacccctccccagcgcgggtcattcatctcagcctagggaagagaccaccttgcctgaacgtagccaaacgcatcgcacgtgggagccaagtgggagatgaaataatccaatgcgtccccctcaccaccaccacccccaccaaattagttaccgtcggcttaaactcatcgggaatgtccgtgtattttaccgatcagggaaataaaagggtgtatataaattagtggaagcgggtgggaaggaacaagggatgcagactgtcgtgagtaaaacgcctcgcggcttgg

SEQ ID NO: 92764 - DNA, 451 bp, Homo sapiens
  chr5:112630247-112630698
  hyper
cttaaaaagagcagccgtggctcgcgtttcacggacgagccattgctgcaggaggctcggtggcgcggcgcgctcgcagctgcggcagcggcggagcccgcgcggggaccctcccgcgcgcacccagcgccccgttccggggcagtgccaccctgggcgccgcctcgccactcctacggtgcctcgccgccccccattaccaggatggagggcacttcccagcacgagccgacaccctagagggcaccggcgagctcccgaaaaaactagggcggtggggcgaggaagatccgcgcctcggattccagagaaggaaagaaagctagagggagccggagcggagctgcacttcacgccgaagtttccccttcgaatcgtctggagttgtaagtggtttctgattgaacacagctgtctagctgctggccacggggtgcgcggaggaggcggg

SEQ ID NO: 92765 - DNA, 129 bp, Homo sapiens
  chr5:112823685-112823814
  hyper
ggagatgtctcccaacgcctagacaaagacagcgctgggaaaagttggaccaactggcacccccgcaaggcgaacagagcagtcccctcggccttcgtggccgagccggctacgcgctctcggagtcgc

SEQ ID NO: 92766 - DNA, 251 bp, Homo sapiens
  chr5:112824066-112824317
  hyper
gctgctggagctccccgcagccgctgccgccgcggccgccatcatgcgcccgctccctacttgggaggaggagtacgcgcgaccgcagctggaatccgcgcggcgcgcaagctgcctgcagccccgaacttgcctgacaacggagcatgcccagtggccgccggggcgctccgggcgagggattccacctctccgggttttgcccggactgggaagatgggcgctctggaatcgcccgaggaggcacctca

SEQ ID NO: 92767 - DNA, 164 bp, Homo sapiens
  chr5:1131227-1131391
  hypo
ctcagcgcctgtattcgcagggacacacagggactcacagggacgtcccggatcgctaggggactcacggggacacgtggggacacgctcggactcacggggacttgcaggggcccatggggatgtgcagggacaccgtccctcccggccgtcctgctccttgc

SEQ ID NO: 92768 - DNA, 83 bp, Homo sapiens
  chr5:113391056-113391139
  hyper
agagctcaaaatgctcggcgcggctggtgagttccctgcagcagctggaagtggagctataaatagagcggggagggaagcgc

SEQ ID NO: 92769 - DNA, 397 bp, Homo sapiens
  chr5:113391377-113391774
  hyper
ctctgcagctccccccggttaacacccgaaattcggccttagaatacacacacacgatggaatttgttccatatctttttttttaaccttcgataggcataaatccaaacctaaaattaaaatcatccccaaatttggttttgggaatcatgttggttttcacccttgagcggcgttccctccccagtgccgcatgctgcttaaggactgttactttcttggggagggaagtatcaaatggaaacggtgtgtgtgtgcgcgcgcgcgtttatttttggcgcatgcacacccctcggtagcctcaaggtcggcgataccctgagcattcgggcccccgcctgcaggactcgctcctgccagccaaggactcaagaaggagggagtccccagtcccggc

SEQ ID NO: 92770 - DNA, 433 bp, Homo sapiens
  chr5:113391775-113392208
  hyper
gggcgcctgggattcggttcaatatttagcacagtcagtaccgaagcaggggcagccaggtgggagctgggcgcccaaaagttggaccccaatcagcagcgagtgggcagcgggggcctggctcgcccgcgcccgcgccccggagctctccggctggctctctgctccccgaagctggggagccgggggcgctctcccgggccgcaagcaggcacggaatttgacgcccgagaggcagatggtcctggctaggactcctgattcttctcagatggaaacagtttctcccggtgaacctgccggaattctcagtggactcgatcttcagctttgtccactggcgcatttcaccaaggccgcatttaccgctttgaggcaaatttgagcttcaaatggagcgggactcctggttgcagaacgaggtaaggtcgcg

SEQ ID NO: 92771 - DNA, 315 bp, Homo sapiens; identical to SEQ ID NO: 29821
  chr5:113696418-113696733
  hyper

SEQ ID NO: 92772 - DNA, 1189 bp, Homo sapiens
  chr5:113696951-113698140
  hyper
gcccccacccacccccggccggggtgccgaggcggttaaccctacccgcgccgcagcgcacttgggctagagcgccgcgcacccaatccagattccagagcctgccggctgggaaagatccggtctcggggtcggctatgatcccgcagcggccaaggcagggctcaggccccgggattctccccacacgctgctgcactggcgcagccggtcgccaaactttttctccccaaagccagtgcccccgcagttacttggcgggcagccggcagcccactctcggcgggatgatctgggagaagcgggcgtgggacgagggggctgctgttttgcagccctgcgaggcgtgcagtcggagaagtggtcggggttccacaccgtccctgagcctgcccccggccaaggtggcccgacgtgctgcagtggctggcgcaggtgatccgggcagcgcgtccggcactagtcaagggggcagcggcacgggagggaggggcgcctttctcttttctcctccccctgcagcccagctgcactgcgtgggggctctccatctccacgcaatcagcaggcggaatccctgccctggagcgccctggctctggactgcacccccctagggtttgtcctgcagattcccctccccatctttctctgccacacacgcttccctaagccgcgcgcgccgcaaactcagtctcggtccccgcaggtgatgtcatgcccattgttttggtgcgcccaaccaatcggactcgccgcctggattctaccggagccggcatgggcccttcctcgcaccagcagcaggagtccccgctcccgaccataacgcattgcgcagggtgcaccaccgcttggtctccctgcagctttaacagccctgacatggaaaccccattgcagttccagcgcggcttcttcccagagcagccgccgccgccgccgcgctcctcacacctgcattgccagcagcagcaacagagccaggacaagccgtgcccgcccttcgcgcccctcccgcaccctcaccaccacccgcacctcgcgcaccagcagccggccagcggcggcagcagcccatgcctccggtgcaacagctgcgcctcctccggtgccccggcggcgggggcgggagataacctgtccctgctgctccgcacctcctcgcccggcggcgccttccggaccc

SEQ ID NO: 92773 - DNA, 26 bp, Homo sapiens
  chr5:113698141-113698167
  hyper
cacctcctcgccgctgtcgggctcgt

SEQ ID NO: 92774 - DNA, 198 bp, Homo sapiens; identical to SEQ ID NO: 29826
  chr5:113698386-113698584
  hyper

SEQ ID NO: 92775 - DNA, 175 bp, Homo sapiens; identical to SEQ ID NO: 29827
  chr5:113698669-113698844
  hyper

SEQ ID NO: 92776 - DNA, 168 bp, Homo sapiens
  chr5:113698951-113699119
  hyper
cgacaaggtacaggcttgaaccccagcccacgctaccggagtcgggcactgggtggttgggatgggcactggcggggaccctttgcgtgcggatccctagcctctccgggacgatcaagggagcccgccaggacagcgggcgcgtctaggacgcgcatccgtagtcag

SEQ ID NO: 92777 - DNA, 293 bp, Homo sapiens
  chr5:113699370-113699663
  hyper
ccagcagcccagccacgcgtcttcccagtctttccaggtctactctcgtctcttttggttttgaggccgagtgatctgacagatcacagagccaagacaggtgcacccctctccccttatcttccttctgtgagttcaggtccacctgtgggggactgactgactctggggacgtggaaggcggttaaaagtgcttctttcttaaaagtgcttctgtctgactgtgttgcaggcgtcgctgtattccttagctctgaaatgccttatcagtctctccacgatcatcctgctcg

SEQ ID NO: 92778 - DNA, 103 bp, Homo sapiens
  chr5:11384964-11385067
  hyper
cggatcggggacaggccggccgaggacacgacgatgttgatgggcgagctggtgctgtaggacttggccaggcggctgggcgactgcttgggcgaggagccgc

SEQ ID NO: 92779 - DNA, 520 bp, Homo sapiens
  chr5:11385068-11385588
  hyper
cggcgcggcgtaggtggcgccctcgggggccgagccgccgcgctgcagcttggtgggcgaaccgccctggggcgcggccagcggggagcccccgcgcggcggcgcgggcagcgtggagctggagtagtagagcgcggcggcggcggcggcgggcggcgcgtcgggcaggtggaaggcgctgcccaggctgggcgcgaacggctcccgcggcggcggcggcggcggcggcgcgggctcgggccccgccaggtggccggcgcggctggtcgtgccctgtgcccgggagaggagagaacacgcgcacttagcgagggagaagcacacggcccacccggcccagcccggccccgagagcagaggcacaccggggatgccgcgggcgcccggcggctctgcgatcccagctgcgctcggggcagtacgcgaacctgcgccccgaactctcctggggcggatttcttgtcctgacactggcacaggccagctgactactggagggaagtcacgtttgacaaatgag

SEQ ID NO: 92780 - DNA, 30 bp, Homo sapiens
  chr5:11397823-11397853
  hypo
taatagctctttgtacgatgtggaattcac

SEQ ID NO: 92781 - DNA, 30 bp, Homo sapiens
  chr5:114506521-114506551
  hyper
cggctccggcacccccgcacccccgcgggg

SEQ ID NO: 92782 - DNA, 571 bp, Homo sapiens; identical to SEQ ID NO: 2623
  chr5:114515009-114515580
  hyper

SEQ ID NO: 92783 - DNA, 61 bp, Homo sapiens; identical to SEQ ID NO: 2624
  chr5:114515610-114515671
  hyper

SEQ ID NO: 92784 - DNA, 374 bp, Homo sapiens
  chr5:114515900-114516274
  hyper
tgaaatgaaggccatcgagggctcccgggcagcctcgcccggcttgctaggatccgggtgcagcggtcggggctgcgcgatctaacggaacaaacgagggcggcggcggcggcagcagaggccgtgaaaccctcaccaggcggagccgggcgcgcggaggccccgcctcctcgggggtcgcggcagcggttcggaccgcagcggagacaaacaaacgcgcacacaaagcgggtccgcactcggctcagcgcggccccagctagacattccccggcctttatcgcatgccggcaggttggccgtccccggctctcggcgcgaagatctggaaaaaagccccatctcactgtctggaggtgcgagggcagacagaa

SEQ ID NO: 92785 - DNA, 157 bp, Homo sapiens
  chr5:114972859-114973016
  hypo
ttttatggcatgacacgaattagtaaatgcctgcaattccttgtgaatggaactctttattttttttttttttctactctggttctgtactttatttgttttgaattctggttactagccaagctacatataagacttagggcgtgattcttagctt

SEQ ID NO: 92786 - DNA, 30 bp, Homo sapiens
  chr5:1151152-1151182
  hypo
gccttgggagctggacggagatggcggggc

SEQ ID NO: 92787 - DNA, 195 bp, Homo sapiens; identical to SEQ ID NO: 29833
  chr5:115151163-115151358
  hyper

SEQ ID NO: 92788 - DNA, 736 bp, Homo sapiens; identical to SEQ ID NO: 478
  chr5:115151649-115152385
  hyper

SEQ ID NO: 92789 - DNA, 249 bp, Homo sapiens
  chr5:115152616-115152865
  hyper
ggcctaacgcctctccccgctccacctccgccgctgtggttcgcgacgctgggacgtagacaaaaagggtcggaggagatggctgcggggactgacgctgagtaaaggaggaaaagaaaagggaaggagagggacacttcttccaaatagagaattgtgaggagcctgcgaaaattgaggatggattccactcctaggccagagagtgcctgttttgtcgattgaaactatccacgatatgccccaggc

SEQ ID NO: 92790 - DNA, 32 bp, Homo sapiens; identical to SEQ ID NO: 40582
  chr5:115176272-115176304
  hypo

SEQ ID NO: 92791 - DNA, 135 bp, Homo sapiens
  chr5:115297158-115297293
  hyper
ttcccaattcaccagcgtgcgtgaatgcagactccagatccagcgcagacgccaagaattcgctcaggggcaccagctaaatagcaaacagatgccatgtcaaacatgtgaaagcctcagcgactagggtaccgc

SEQ ID NO: 92792 - DNA, 610 bp, Homo sapiens
  chr5:115297376-115297986
  hyper
cggttctgaaagcaggtgtcccctctcccccggcttcaggaagggaaaccccggccccaggcagttgcagagctaagaaaaaccatcccgccaggccccttcttgtggtaacgcggtcctaaccctgctctgccccacaaccccatttcacccgggagacgcagacgccaggctccctagcactttgtcgcctcttcctccagcctggcttcctgagctctggaaaagttccgggcctccggacgttgtttccatcttcgccttcgctgcctgggccgcatgcctcctgggcttatttaggaagcgaagttagcgccacacatttggctccagaaatttgttctgacggcgcggccgacgccctgcagggtcatttctgaacgcattcccaaatatcctggtcctcaagcccttaccaccccctagcacacgaagccccagctggcggtggagcaggtgtgttgctggtagctcatcgctggcttggagatagaggtgcttggtacctgtcccctttccgacaacacctgaaaccgtatcggggcacacccctcatccaaatatccacgtttaaggtgtccggattcgtttggcttgaccaccccctccc

SEQ ID NO: 92793 - DNA, 378 bp, Homo sapiens; identical to SEQ ID NO: 29839
  chr5:115298204-115298582
  hyper

SEQ ID NO: 92794 - DNA, 335 bp, Homo sapiens
  chr5:115298781-115299116
  hyper
cgaggtgcggggacccctttccccgggcactgggaacgccacagtgggccgcgtgcccgtggacgacgtgtggttcgcgctggacacggaatacatggtgctggagctcagtgagcccctgaaacctggtagcagctacgagctgcagcttagcttctcgggcctggtgaaggaagacctcagggagggactcttcctcaacgtctacaccgaccagggcgagcgcaggtaagggctgtacagcccggggcccctctcggcccccgcccctgcgtcccggtgcaggctgcgggtccagctgactaccgtgtccaggtgcgcgtctgctgcccttt

SEQ ID NO: 92795 - DNA, 884 bp, Homo sapiens
  chr5:1155674-1156558
  hyper
accccaggcagggaccgacccccgggctgaccgggagccccacccccgccggcccgccaggccgccgccgcccacctgcgcccctcgaggggaccggcacctgcgcgcacctaccgtagcggccgggctcgcggcagtagagcagaatgggaagcgggtcctcgtcaggcggctcgggcgcggctgcggggtccaggccggggtcgggggcccggcgggggctcggggtggggcgctggctgtcgccttccttggccccgggccccgcaccccccgccgcgggggtcaccacgaagcgctgggacatggtgtccgcgacggctgcggggagcggggacctgagcgcggggagggcggggccggcggggcgggcgcgggaggccgggaggaagggagggaggccgggggggagagagggaccgagcgcaccgccggggatggggccgcgcggcgcggggaggggccgggagggcgaggcggactccggctgacacctcggcagcggtccctgcccgcggggggaccacggcctcggcccccgaagaacgaagagcggcctcggctctcgctgcgtgaccttggagacgccccagccgggcgaccgggtcagcgcgcggtgcagaagcctgaggggaggaacagacctcgctctgcgccgcctggaaccgacgacgaccaaccctggcagcaacgctgcagcccgcggtctctggcgacgcccaccgagggccgggaccagggggccggtgagggtggaggtctcgctggcctttgggtccgtggggaggggcgccctgatctggggcctccacctcccccatccccagactccagcccttggccaagcagggttcagccgtgcctgcgtgcgaggcagaggcctc

SEQ ID NO: 92796 - DNA, 30 bp, Homo sapiens; identical to SEQ ID NO: 29841
  chr5:115908915-115908945
  hyper

SEQ ID NO: 92797 - DNA, 400 bp, Homo sapiens
  chr5:115909717-115910117
  hyper
ctgctcccccaggaccgggcaaggctcgggaaacagagacacaagacaaaataaaacgcaggcaccacaaagccgacagcacgcgctagccacggccccgggaccctcaggctggagtccagctgcccgggaggtggggcgcgcccgggcgcccggggcgtaccttttcggtgcatcgacggacaggcggccggggctcggagcgaactggtacagcgtgtatcccatttagtaatccattatcgaggggatctctccgggccgcgggctgcgctctctccttcgcaagcctttgtcattcctacatgtgtgcttgtctctttgggggaaatagtcgcggcgactactttctgggatgcaaacgcgatgtgttcatctccaatgacgagcggagaagggg

SEQ ID NO: 92798 - DNA, 267 bp, Homo sapiens
  chr5:115910908-115911175
  hyper
ataaataaaaatagacgtagtgcaggagcgagttacaagaaaggttttgttcatcgattttcttaaatggaaaagttttaaaggatgagggtaagtgaacggcgagcttttctgattctgattactgttatcaagaggtagattccagaagcgatggacgctctacgtagttagatgaattggatagaagccggtgcggttaaaaatacacttggaagataagaacacagctattaattacgcacatacacacgttaataaagcatg

SEQ ID NO: 92799 - DNA, 138 bp, Homo sapiens
  chr5:115911452-115911590
  hyper
aggcttgtgccaactcgtcgggccacaccacgttcccctccccctgccgctgcgccccgaaatcaactgcgcgccgcggctcttgctccccaagggggcttcgcagatggtacggatcctagtcgcaacctttaaaca

SEQ ID NO: 92800 - DNA, 279 bp, Homo sapiens
  chr5:115911835-115912114
  hyper
aacacccattccccccgcaccactaccaccacctggaaaaggtagggagaatggtaggaaaaaaagaaaaaatcagtacccctgctgttctccagagctgtcagcaggggccgctatccccacctttctcgggcaaaggcctctatagacctggggtagtggggggcgcggccctaggtgcgcgcgcagcccccgcggcttcaagagccagcctcgggagggggttggggagtgtggggcggtgggtaggattgcgctttcccgcgggttgggtggggg

SEQ ID NO: 92801 - DNA, 223 bp, Homo sapiens
  chr5:115958432-115958655
  hypo
aggcaaccctcaacacgagatgggggaaagaatgctgttgaactaaactgaatttaaataaaagccaacaccctttccagaaatgcaagaaattttgcttgtttagaatatctactgggcattgaatgggcaggtctctagcagttgtccgggaccacctagtttctgactaccacccaggcatctcccagtctccagttcaagataacgcctatcctgcaag

SEQ ID NO: 92802 - DNA, 30 bp, Homo sapiens
  chr5:116052021-116052051
  hypo
ccacacgaacaagcgcgtgtgtgaggagat

SEQ ID NO: 92803 - DNA, 35 bp, Homo sapiens
  chr5:11644483-11644518
  hypo
gtaaatgataccaagcggctgtgccgggtgcagtg

SEQ ID NO: 92804 - DNA, 30 bp, Homo sapiens
  chr5:1169521-1169551
  hypo
atgcaagcatcaccccgttgggatctgtca

SEQ ID NO: 92805 - DNA, 22 bp, Homo sapiens
  chr5:117258296-117258318
  hypo
ccgcgcccggccaaaatatccc

SEQ ID NO: 92806 - DNA, 125 bp, Homo sapiens; identical to SEQ ID NO: 5026
  chr5:1174263-1174388
  hypo

SEQ ID NO: 92807 - DNA, 149 bp, Homo sapiens
  chr5:1189557-1189706
  hypo
tcaaggccaggaggccgccatggggaccccacccagcactgtgctggacacaacgcggcaagacaagaaacacagaagaagcaaaggtgacagagtgggggaggagaaataaagccggcacctgcagttggcataattttgtattaaga

SEQ ID NO: 92808 - DNA, 357 bp, Homo sapiens
  chr5:11903368-11903725
  hyper
ggcttgctgggaagccgctaaatatagaccaagggggctcagggtctggcaagccgcgggagcctgaagacacggccatggacgcatatgactaagtctttccattttgttctagccaaacatcgtaatgacattgaacataagggcaaaagactggagggaagtcctccccacccccaccccgtctcctcccgtatattagggacgtcatgaatgcaccgagtatgttctcagggtggcggggagcagcattgtcggtgttgccctaaatacgcttcctcccggggagatgggtggcagggagggggagcacgcagggcagccacttggtaaccgctccaagaaaggcactaaccc

SEQ ID NO: 92809 - DNA, 293 bp, Homo sapiens; identical to SEQ ID NO: 7750
  chr5:11903821-11904114
  hyper

SEQ ID NO: 92810 - DNA, 59 bp, Homo sapiens; identical to SEQ ID NO: 7751
  chr5:11904115-11904174
  hyper

SEQ ID NO: 92811 - DNA, 185 bp, Homo sapiens; identical to SEQ ID NO: 29479
  chr5:11904195-11904380
  hyper

SEQ ID NO: 92812 - DNA, 537 bp, Homo sapiens
  chr5:11904455-11904992
  hyper
cggcgcgcggcagcctcagcctccacctaaacctcggcggccggcccgggcgcccggctagtgagggagcgtccgccccgccgccgaaaccggccccgggtgcggagcatgcccagtgccgccgcgagagcggcgcttcgccgcgcgcgttccacttctcctggttttcgcggcagcagcggcagccgcgggagagaggggaggaggccgcgggttgggagagggccgagcatccttgggaacgcacgccctggacctgagatgggtggatgctccggagctaggcgaaagctggaagggacccgggaagggatggaaccccaggttactccgcttccctaattcacgtgcaaggcgctgacagttgactctggtggggcagatgtcagcctgcaacaaaggaccagggtgcgaggggtcctagagtggccaggtgggttgggggagggaggctggcggaacgtgctggtgagcgcaggtagatgctcttgcagatcctgtgattccagagctaaggaggcacgaagtccagcagag

SEQ ID NO: 92813 - DNA, 30 bp, Homo sapiens; identical to SEQ ID NO: 40418
  chr5:1193360-1193390
  hypo

SEQ ID NO: 92814 - DNA, 249 bp, Homo sapiens
  chr5:1193747-1193996
  hypo
ggcagcatctcccctcgtgggcgcttacctcggagaactccgggcatgaatgtgcgaaaggcaggaacagacgtccacggcggctttcatcctcatggcgcaaacgggacccctaccgtcagcaatggagccgtgaaggagctgcagccgtggacctggagcaggcacagcgagccagggtgcgaggcccggacagctctgagcggaacagcgagccacctgcagcgtccagctcgagacagtggctcc

SEQ ID NO: 92815 - DNA, 67 bp, Homo sapiens
  chr5:1196184-1196251
  hypo
cgggcacgcagtcgacggccatcgccgacggtcacctcccacctcccgggcacgcagtcgacggcca

SEQ ID NO: 92816 - DNA, 287 bp, Homo sapiens
  chr5:119799856-119800143
  hyper
cctggcgcggcagcacggcgcccctctccgcgggcggggagcgagcgcgtgtgcgcgagagcgccgggcggcggcgggaggaggcgcaggcgcgctgctcgcccgtctgcagccccgagccgagcgccgcgtctcgggagttgatggcagcaccactgtgcggccgcccggccgagcgcggagcgcagccactcgccgctgcccagggagcgcccaagatgtggggggaccggggcggcagcggccgtagcagcgccagggacgggggcacgcagcagcctccgctc

SEQ ID NO: 92817 - DNA, 1362 bp, Homo sapiens
  chr5:119800144-119801506
  hyper
cccgcctgtcctgacctgcctcgcttgcccccaaagaatgtcagccaagtccaaggggaacccctcctcgtcctgtccagccgagggaccgccggcagcctccaaaaccaaggtgaaggaacagatcaagatcatcgtggaggatttggaattagtcctgggcgacctgaaggacgtggccaaggaacttaaggaggtgagaggcgcaggggtggggagggagttcggcacccttcgacccctccggggtcccctttccgattttcagcagggacagccagatttccaaactcctgggaaactacagaaaaggcgcctgcagacggactttctttgctcctggagtcctgagaggagttgttgttgcactttttaatttttttttttaatcaggaagaaatcaactagtgttttaatcgatggacctgggctggtgggagggatgaacgcacgcgtgtctctgaatctgtgtgtgtgacgacgggggagagggttagctgggggtgtgtcggcagaggaagtcgtgagcagcccggctggagcgtgcaagatgctcctctcctgccctattgcttccccagagtcctttggcaagtccgctgcctatctgtcagcctccccaagtcagggctgaagaggggccgggttctgggccctgggccagatcagggagggcagcctggaggaagcttggctcagactaccctccctgtctctcgagcctcgctgtagggaaggcgacccgggctgctggcagccttggggctaaggagggggtctgggactttctcactttctcagtttctgaagcatcccctgctctcctccgaacgtcgttaccagtaactctgggccttcccgccaccctacctctgcttccttccttccaccctgtcgccacttggcattgaacccgagaagcaggacgcgcaggagagtgtatgtgtggccggggtcttgccattggcgtcctggctctctgcagctgggactgcttcggttcttccccgcttttcctatcccacttcggttcagccctactcccgcccgcccctagccccaggtgatccagatggaaagaagcagagaaggtgtcagggctgaggctgcgtaactcaggcggcggctccgggcgggggcgggggccgggctgggaggggtggggtctcccgagccaggctggctgccggcggcgtcgcggagctggtagcagagtcccagcgcgccgctcactactgaatggggtcctggtgcggttctcggtgagggagtccgcagctccgctgcgtgagagctaagactagaacttcgaaggtggcggtggctgcagcgggaaaaggggtggggcgtagtctaggtcca

SEQ ID NO: 92818 - DNA, 26 bp, Homo sapiens
  chr5:120884207-120884233
  hypo
aaaaaataacttgcccgccaggcaca

SEQ ID NO: 92819 - DNA, 30 bp, Homo sapiens
  chr5:1210123-1210153
  hypo
gccacgggggcttcccggtttgggtcaggg

SEQ ID NO: 92820 - DNA, 30 bp, Homo sapiens
  chr5:1210355-1210385
  hypo
tgtgagcctggaaggcgtgtacaggctgca

SEQ ID NO: 92821 - DNA, 162 bp, Homo sapiens
  chr5:1213550-1213712
  hypo
ccatcccacatgtcccgccctccgcaggccgtgtacatcacctccacgctgccctatgtcgtcctgaccatcttcctcatccgaggcctgacgctgaagggcgccaccaatggcatcgtcttcctcttcacgcccaacgtaagtccccgaggctgccctggg

SEQ ID NO: 92822 - DNA, 1291 bp, Homo sapiens
  chr5:121412520-121413811
  hyper
aaccaggcaccagagcgccccctgaaggtagaccggggagcggggcctcagacatatcagcccgtacctggccagacagttttcctccgccgcgcatctcaggttgtacatggacatcttctgcacgtacgtggacgcctggatgtagtaggggtcggccaccaggtctgggagacctaaacgtcagcaggcgacgggcgcagcagtgaaacaacccggcgccccccgctccaactccctacccctctaggtcccttactcctcacccttcgcccaccgggactgcagagtggagcggaggacagcaagagaactggggacgcccgggactgcaaagcaatgtgaaaaggaagcaggaggggccagacgcgcggtttgcactggattccagggctgccactgcaggcgcgtgggggagggatcggatctgcgaggaccggggcccgccgcgcccaggcagccacgtcgagaagccacatagctggggaccaggtgcacgggtgcttccagcggacttgggggtacttaccgtactggaagtagccagtgccgtatccgggccggtacctgcccccaggtctgggcctttcataagtatcgtagtagttgtaataagggttgtcgtcagagtacttgtaggggttgtaagggtcgtcgcccaccatgccgtccacgcggctgggcggccgcaggttactgagcgcaggaacttctcccggcgctgtctggttctccgcgcgcgaggcgccagcttcgcgggctctagatgtcgagtagccagcttggaaccagtgacgggcggtgggcctggggcggccagcggtgactccagatgagccggccgtccgcgttcgcgccgcggcggtgcggttgtcgcggatcagcaggatcggagtgcggggctgctgggcggaggcgttggctgcaccagggacggcggcgcccgggtcccggcggcgctgaggctggtactgtgagcccaggctcagcaagctgaacacctgcccgttgttctcccattggatctgctggcgccaggcgcccggagccgccggcggctcgcgcgggggctgctgttggccggcggcgggaggggcgcagtgcactagcgcgcagagctgcaaaggcccgagcaggagcacggtccaggcgaagcgcatcactccttttgccagattgaccccgctcgaggaggacgtggctcacagaaaataaaaacggggctcaaatcacgtgagggaaggagaaatcttcaaccaaggaggcgagcggagcacgggtatctcagtct

SEQ ID NO: 92823 - DNA, 56 bp, Homo sapiens
  chr5:121414034-121414090
  hyper
tcagctatttgttcacgtaatgcgattggaaacgtgcaaggcggacagctcctcgc

SEQ ID NO: 92824 - DNA, 1112 bp, Homo sapiens
  chr5:121647381-121648493
  hyper
gagaaaagtgggaagcgcggacaaaaagtaggcggggaggagaggagagccccagctggggaaaagcaacggcagtcgaggtaaaaagagcgaaaggtaaagaaagagcaggttcgtggacaggagccggcgggcaggccgggggatccctggtgaggaagcggcgagggaggggcgtgggccgagccgggggcgccgcggggagggtcgctgtcagtcaggccgagcggggctcgctggcctgggggcggccgcaggggcgcagcgcagcctgagggcgcggcggccccggcagcctccgcagtggcagtggtggccgcgcccccgtccccggccgggcgcccgcgctgcgttccttgtcccccagcgccggcttcgggccgcggccgcccaggctgcccccgcccgcgcgcgcccgttggggggcccggggagcggcgcccgcggccgggccgcattgtgacgtagcggggccgcggcagcgcctccaccgcccgcctacttcggctgaggctgttctgctcctgccgctgcggtccgtcggtcggtcagtcagtcccttcgcgctcctgagccgccggcgcgccgggcgccccgggtgagtccaggtcccaagcggacgccgcggggaggcgggaggcgggcagccagcggctcagcctttccaagtttgcaccaggcgaccccggcgggtgtcgccccgtgctccccaagccccgggacccctttgtgccgcgagtctcggctgctccgggcagcagaggcgcctctgcagaaagggtttgagggggaggtctctatagtaacagtaacagtggtggcggcagcggctgctttactggggaaagggggaaacaacccccgcctcggtttccaaaggattgttcttttcatttgcccgcctcatgtggttcttattcttgctgtcacccgggatcttatcgcaggcagggatgggcagttccgcggctcggaaaagctgagataaggaggggcgaagtaatagtaatagcgacagtactaacaacggtaataatagctgtagaaaagggacgtctggtgttgctgccgcccctcgctcatcagcaccagctccccgactgccctgtcca

SEQ ID NO: 92825 - DNA, 292 bp, Homo sapiens
  chr5:121648747-121649039
  hyper
attctttgaggaacacgctactgcttgcagcgaagaaagtcttaggaaacaaaaaggcaacagcattgttgctcattttcaatggacggctaggaggggggaaacgtgttgttttttcctgtgggaacgttgctttccttgggaaagttaattaaggaagcattactgtcggtgccccttttcacttgctggaggcaggatcggattcctcttggctgttactgacaagtgcccatcaaagagcccggaggacgggagaactgctgcaggacagtctcgccacacaccacgt

SEQ ID NO: 92826 - DNA, 30 bp, Homo sapiens
  chr5:1218808-1218838
  hypo
tggtgatgggatccacgtgctggtcctgat

SEQ ID NO: 92827 - DNA, 223 bp, Homo sapiens
  chr5:1221121-1221344
  hypo
ccaggagggagggatcgggccctggcaaggggaggccgggcacctcgcagcacaccatctgttcgggtagcagaacgtacagaaagcttagcgagttgaagcccagctggtagcagcagtgacagctgtctctggccttggcaggttcaataaggacatcgagttcatgatcggccacaagcccaacatcttctggcaagtcacgtggcgcgtggtcagcccc

SEQ ID NO: 92828 - DNA, 37 bp, Homo sapiens; identical to SEQ ID NO: 40421
  chr5:1223271-1223308
  hypo

SEQ ID NO: 92829 - DNA, 40 bp, Homo sapiens
  chr5:122371217-122371257
  hyper
cccgtcctcaggtggcgtctgcggtcgaggatgtaagcat

SEQ ID NO: 92830 - DNA, 30 bp, Homo sapiens
  chr5:122371686-122371716
  hyper
ctcatctgaaccaggcgctttaatgcctgc

SEQ ID NO: 92831 - DNA, 30 bp, Homo sapiens
  chr5:122372558-122372588
  hyper
ccgccgcgccttaggcgggtgcggagggcg

SEQ ID NO: 92832 - DNA, 78 bp, Homo sapiens
  chr5:122422237-122422315
  hyper
cgggggtccagcttacgccgctgcgcgcccttgtgcgcaccgggtgaggatgccgagctctgcgggcatcccggaagc

SEQ ID NO: 92833 - DNA, 218 bp, Homo sapiens; identical to SEQ ID NO: 29853
  chr5:122422616-122422834
  hyper

SEQ ID NO: 92834 - DNA, 208 bp, Homo sapiens
  chr5:122423168-122423376
  hyper
caagaaggcaaatgacgggaccgccgccggagtccggacttccatccctggagttcactgtctctcccagggaacagaggagtgtcctggtttctcagcaatgaaccaggagagtgtgagaaagagcatttgtttcttctcccgtggcccgacaagccactcttcggcagttctgcgagcagattaattgaaacgggcctggaacttc

SEQ ID NO: 92835 - DNA, 30 bp, Homo sapiens
  chr5:122423599-122423629
  hyper
gaagtctgaacagcacgtttcccaggttca

SEQ ID NO: 92836 - DNA, 231 bp, Homo sapiens
  chr5:122423874-122424105
  hyper
ggcaagtgcctccttcgtgggtgcgagactgcatcgaagggctgccctggcacaaagtctggggagaggacatggtggaggtggggctgcactcccaccctgcccctctaacaccaggttttgggtagagaaacctatgcgtgacctcctgcggcagccgcaggcagctgaccgcaaacagcctcgcccgtgtcccggagcagttgtgccaccagacgtaacactggatac

SEQ ID NO: 92837 - DNA, 252 bp, Homo sapiens; identical to SEQ ID NO: 29856
  chr5:122424436-122424688
  hyper

SEQ ID NO: 92838 - DNA, 731 bp, Homo sapiens
  chr5:122424910-122425641
  hyper
aacccacgtgtccagccgggaagctgccagagcgtggaaccaaggagccaggacgcggcagcggccaagcgcagcagcccacggcggttgagtcgggcgcccaggtccgtccgcactctcgcgccctccgcgggcctcccaattttctcgcttgcaggtcgggaggtttccgggcggcacaatctctaggactctcctcccgcgctgctcaggggcatgtagcgcacgcagggcgcacactctcgcgcacccgcacgctcaccgagacacccgcacgcacccaccggcagcaccgagttttcaggtaaggtgaggctggtctgggacttaagagtctagggcttggtagataggaaggttggtggtcctaggttgggggcgggcggcgagactgttctgcctcctggcgcctgaggccaacgcggctcgggcgctgcgccacgccggctcgggtcggctccgggcgctggctgagggcgggggctgcgtcctgcagccgagttctacggggcagcgccctcctgtcgggccccagcattgctggatgggagctggacgctgcgatcggggaggcagagcagggtgcacacagctccctctgtgcggcgccgcagcttcggagtaaactttgcgcccaagcggagttgggaagagggagccgcggaaccgggcggccgccggctgaaccaccggctcgggcactttctccagggtcccagtggccctcttcc

SEQ ID NO: 92839 - DNA, 255 bp, Homo sapiens
  chr5:122425701-122425956
  hyper
cgccggacatgctgaagcccggagaccccggcggttcggccttcctcaaagtggacccagcctacctgcagcactggcagcaactcttccctcacggaggcgcaggcccgctcaagggcagcggcgccgcgggtctcctgagcgcgccgcagcctcttcagccgccgccgccgcccccgcccccggagcgcgctgagcctccgccggacagcctgcgcccgcggcccgcctctctctcctccgcctcgtccacgc

SEQ ID NO: 92840 - DNA, 703 bp, Homo sapiens
  chr5:122426004-122426707
  hyper
cggccgctgccgccgcgctggctggtctctcggccctgccggtgtcgcagctgccggtgttcgcgcctctagccgccgctgccgtcgccgccgagccgctgccccccaaggaactgtgcctcggcgccacctccggccccgggcccgtcaagtgcggtggtggtggcggcggcggcggggagggtcgcggcgccccgcgcttccgctgcagcgcagaggagctggactattacctgtatggccagcagcgcatggagatcatcccgctcaaccagcacaccagcgaccccaacaaccgtacgtagccgcagcccgcgcgctctctcccggggcgccggcgccggcgccggcgggcgcgggtgcctgtcagggaggcgggtcggataggagtgacacggggccgggtgggtggggagcacctggtcctggccgctggcccgcgcctccccgatctctgtgacaaaagttttctggcgttggagaaggaaagagaacggatgggacggccggtggcactttggggttccctctccctccctctcctcacctgcttcacagtcccaagtgtttggggccggagtctaccgtggacccggcctaacagacctctgccctcccgccggacagtgcccggggccaggcgggtactggcagcgtgtgacagggggtgtctgggtcaggccctgcctggccttagccggga

SEQ ID NO: 92841 - DNA, 53 bp, Homo sapiens; identical to SEQ ID NO: 29861
  chr5:122426796-122426849
  hyper

SEQ ID NO: 92842 - DNA, 1031 bp, Homo sapiens
  chr5:122430402-122431433
  hyper
gagccagcccagacccgcttcgatctcctctcgcggctcctattcatcatctccgcattgtatatggcagcctcgcaggggcaggggccggcgaggtttatctctgcgcaatattctctcaccctcacaaactggcgctcccatttaatttattaatacagtcatcggaagacaaataagacccacattttctccctcccaccttcttgctctcttctttttgtctctccctcttggtcccagggtcaagcccgcagccaggcagggcagagaacgcccagagcttttgcgattcgcggggagctttaaactcgcgtagagggagagttcctgagagaattcccaggagctgggccgccccgcagggtcgagactgaaatcaattggctccccttccggcggccaggcaaacctgcctcgcctctggatctgcttctagacccgctcccggggcttggaagacccctgccgggtagaggaggagggccgggtgggtggcggggtgcagtggggacgtcggatcgtgggtggtgtcggcggccacgcctcatgtcagaagagagcctttcgtgggcaggagcggggtgggaccttcaaaactcagccttcggcgctgaggcctgggcgccccaccccgcccatcgctccctttcagccatcccatctagcctatagctcgagaaggcagtggggggaccgcaggctggagccccgggggcgtgaaccccacgcgagaagttcgggcccggatgctctgcctgcccgccctctgcccggctccccagcccccacgcccctccccgcctagggcgcacgcggcactgccagcaggcggcactcccgggtcctagtcgccgggctgggatcgatgggcgccggcccctcgggtctcggcctgcgagactgagggccgcgaccttggcggcggtaggggaggatttacagccggggtggatagtggcgcccaggcggggaagcaggcttttcacctactccttgctttcctatatgcagggcgggtgagagccaac

SEQ ID NO: 92843 - DNA, 100 bp, Homo sapiens
  chr5:122434428-122434528
  hyper
aacaattaggctgatcgttaaatttgctattcctttcttccggcgtctagggagagcgtgcacaccaaaccctccagaacagcaccccggtcccccaccc

SEQ ID NO: 92844 - DNA, 125 bp, Homo sapiens
  chr5:122434605-122434730
  hyper
cgcccttggagtcctggggctgcggctcctgctctaccgggctgcaggcttgctctgccccgtcccgtggcgtttgggaggcagtcgaggaagcctccgagtctctgggtcgaaggaagtgcgaa

SEQ ID NO: 92845 - DNA, 43 bp, Homo sapiens
  chr5:122621308-122621351
  hyper
cgcaggaacccactgcccggggccccagcgctgtcagcccctc

SEQ ID NO: 92846 - DNA, 82 bp, Homo sapiens
  chr5:1228694-1228776
  hypo
cacagccacctttcccgtcttcggcagacaccactgcgtcctccatgcttatgaacgactgctaaacttcacgtaattgtta

SEQ ID NO: 92847 - DNA, 472 bp, Homo sapiens
  chr5:1232819-1233291
  hypo
gctgggaaggagccccggggccacctgacatggtccctgtccacagggctgggctgtgtcacgctgtccttcctgatcagcctgtactacaacaccatcgtggcgtgggtgctgtggtacctcctcaactccttccagcacccgctgccctggagctcctgcccaccggacctcaacagaacaggtgagctgggcgccgcctgctgtgtgggtccgtgcacggccgagagaggcatgtgctgcagcgtgtccagcatcagagcagctgcgggtggcggatgctcaccgcggggggagggccggggaaccggttgctctgtgtgcacatgcacgcgcctcggtctccccaggagcacacgtgcagtccagttcttatgacctccacgctgtgctgtgcttccctgccaggtccggaccaccgaggtccccttgcagccatgtgcatggcgtggtcatgcgagggcactgctgt

SEQ ID NO: 92848 - DNA, 27 bp, Homo sapiens
  chr5:12351623-12351650
  hypo
agccaccgcgcccgcccattttcactc

SEQ ID NO: 92849 - DNA, 30 bp, Homo sapiens
  chr5:124082412-124082442
  hyper
attccgcctgttagtcgggaagtggcattt

SEQ ID NO: 92850 - DNA, 516 bp, Homo sapiens
  chr5:124083366-124083882
  hyper
atgtgaaacatttctcggagatctaggatctccgaagttcggaaggagcgaaatgtaatgagcacaagagcaaagcagatgttttaaagaaacactttataaacctttcctcaacttatctccaatttgtcggctttcccaaggggccagggacggggacgcctgggggagggagaagggtatctccgagctacttggattttagggacccccacttcatgtattaaacaaagaaaaaccttttgcttgctccccagcctggtcctgtaataaatacaccattgttactatttgtgggtttgtttgggttgggtggggcttttattttttctcttaatggtatttttgttgcttgcttttttaaggagatggcgaatggtaattataaccattacatgtaatgagtgactattcccttgtttaatattaaattatcgggcactgggatctgacaggagacagaaatcggcttgttctgcccttgcccccattttcctggatcgctttgggaggggg

SEQ ID NO: 92851 - DNA, 107 bp, Homo sapiens
  chr5:124084195-124084302
  hyper
tatagagacacaccacgcaaccgtacttacggtctgtattggatcgagttgaccttttccttctaactgcattgaatgtgtttggttgcagccgctttattttggaa

SEQ ID NO: 92852 - DNA, 206 bp, Homo sapiens
  chr5:124084771-124084977
  hyper
ggcaaaaaaatggtgcgcccctttcaattactacatcattcacataaaacacttatttattaaaacaaatctcaaacaggctgcgaggagaggatgtcggtaaatacaagtttgattgtgttatcttgggggaaataatgtatgtgatcgctcggtggcagagagaagccaaacgagccgctagcgcgtagcgaagagaaaaggga

SEQ ID NO: 92853 - DNA, 84 bp, Homo sapiens
  chr5:124128502-124128586
  hypo
attcacttccatgtcctcatcagaagcactcacactaccgtcaaacatttaaggttaaaacaaagattacgttatgtgtagcag

SEQ ID NO: 92854 - DNA, 30 bp, Homo sapiens
  chr5:1245053-1245083
  hypo
atgggctttgtgcagcgcccgagtgcccgc

SEQ ID NO: 92855 - DNA, 30 bp, Homo sapiens
  chr5:1254554-1254584
  hypo
ggcacagccactgcacggcctcggagggca

SEQ ID NO: 92856 - DNA, 476 bp, Homo sapiens
  chr5:125930586-125931062
  hyper
ctcccatgctactaccgcatccagcgccagcggggagtcggtaggtcagtgcccgcccggcctcctcgagcgagccccggcggctgcagagatttcttgagcgcccgcgtacctctccccggcctccccagcttccattatacacgccctcgttttcctcgcggagccccagctctttcagccacgcatactggggctgattgatgaggagagtggacatgaaggcggcaggcctgctccaaggtccagagagcttgctggtctttgcagcgtgcacacacagcgcgcgaggaaggcgccacatactgagcccgggactcgggatgagcccaaggccctgagagctgctgaaatagagccccgccccccgcccgggagaacccattgggcagacccgacccctcccactgggcacgaccccgccaccgccccgtctgcccctggtcttccggaggagcctgcggctgaatcctgcc

SEQ ID NO: 92857 - DNA, 30 bp, Homo sapiens
  chr5:125931300-125931330
  hyper
cctcagcgatggtgacgcctcttgtccctg

SEQ ID NO: 92858 - DNA, 18 bp, Homo sapiens
  chr5:125937930-125937948
  hypo
gcccggcccagcttccct

SEQ ID NO: 92859 - DNA, 337 bp, Homo sapiens
  chr5:126199749-126200086
  hypo
gctggggacgataggcgaagacgggctccaaaaaattctgtcctgccctgtctgcgtgtagctcctcccacaagaggcgggcctgtgactgctttgaccaataggatacagagtaagcactgccctgggactgcctagccccgtgtttaagcaggagccttgggccgctgccactgccatttcacggagtcctacaaacagctgccacgtggagaggcgggccacatggagcagcactgtgccatcggactgtgtaagacacctggcagaggtactgcccagctgtggccagatcaacccgtggaataatgagatacaataacgtagttgttttgga

SEQ ID NO: 92860 - DNA, 35 bp, Homo sapiens
  chr5:126327499-126327534
  hypo
tccttggcaaatgtacgcctcgacctgataaaaca

SEQ ID NO: 92861 - DNA, 97 bp, Homo sapiens
  chr5:126328776-126328873
  hypo
ttttaaagcagaccatcatgatccacaataggctacagaaagacgagccctccaactcaaatagtccttgcactgatttttccgttgagtataaaag

SEQ ID NO: 92862 - DNA, 150 bp, Homo sapiens
  chr5:126339372-126339522
  hypo
cggagcttgcagtgagccgagatcgtgccagaggagtatacaaccttggtagatgaggagtgaagagaaaaacttacaaaaagtggatagtgaattatgtgtcatgagaggatcccacaaaaacgttacatttgtcgtacacagttgtgc

SEQ ID NO: 92863 - DNA, 144 bp, Homo sapiens
  chr5:126366959-126367103
  hyper
ggaggcttgggcgctcgacggcgccggaacctgtgagaccgtcgctctgggcgggctgccgtgcggggtggcatcctctgcggtgacttctgctgtcttttgggtccgccaggattccaaaatcccaggcgggtcgctagaatt

SEQ ID NO: 92864 - DNA, 30 bp, Homo sapiens; identical to SEQ ID NO: 40585
  chr5:126409452-126409482
  hypo

SEQ ID NO: 92865 - DNA, 30 bp, Homo sapiens
  chr5:1264364-1264394
  hypo
cagccccagatgggacgaggggcaccctgt

SEQ ID NO: 92866 - DNA, 385 bp, Homo sapiens
  chr5:126626332-126626717
  hyper
agatcctgcatgttgcgctagggactgcgcgcggcgccaagcgacaaccccccagcggccactgccccggcagcagcagctgcagcagcggcaactgctcgaatcccggccccggctcgggttacccgcccccaccccctccagcatctcgggccagacagagaaaaccttgttcaagtttgcagcaagtactttcccggtgcgcaaaactgggcgactgggaacgcgttgagacgttcctctttcccgcttctccacctttacgcctgaaagaagactcccaaagattgctttcttctgggacgctgcttggacgctaaccgcgttgattggaacagattttgtgtcttggctggctttgggtgaagaccggggagaaaaggtt

SEQ ID NO: 92867 - DNA, 30 bp, Homo sapiens; identical to SEQ ID NO: 40586
  chr5:126851264-126851294
  hypo

SEQ ID NO: 92868 - DNA, 30 bp, Homo sapiens
  chr5:1272253-1272283
  hypo
ccactgctgggagtccgtgcccaaccctgc

SEQ ID NO: 92869 - DNA, 146 bp, Homo sapiens
  chr5:127537084-127537230
  hyper
gatttcagtgtaactcgccgagtgaggactcttggcccacgctgggagcccgcagccggcatccgccaccgccgggcaggtgtgcgctgggcgggcgcgcggactcgcctttgcccggcccgcggctcccccgtgtggcctgagta

SEQ ID NO: 92870 - DNA, 335 bp, Homo sapiens
  chr5:127872845-127873180
  hyper
ccgcccgctgagctgcggggttgggaaggaaaagggggacgcgctcctgggggtctttggatattctggcaaagggggctgcagctctaggctccagctaaagggtctgggacggagtgggccagaaagccgccaaactgaggattcccccctcccccaagccggagccctaggtgcggagccgcttgcccacttaccctcggagcacgtcctgctgtcctcgccggcggacgcggctggccactgcggcaccctcctcgcgatactcgggcgctagaaacccgccttcagagcctgctgtagcggaccgaacctgttgcggcggcggctggggc

SEQ ID NO: 92871 - DNA, 254 bp, Homo sapiens; identical to SEQ ID NO: 29874
  chr5:127873552-127873806
  hyper

SEQ ID NO: 92872 - DNA, 497 bp, Homo sapiens; identical to SEQ ID NO: 29875
  chr5:127873981-127874478
  hyper

SEQ ID NO: 92873 - DNA, 472 bp, Homo sapiens
  chr5:127874705-127875177
  hyper
cgcagtcagccaggaatagaggctcacggggctgttggttgcagcctcaatccaagaaggaggagacctcccctttgccctcctacccccaccgccccaccgggagcggcgtcagtctgcgggaccaaattaggggctgggagtttccagattgaaatgcgccctccaccaccaagagggagctcacgcggccgcggggggccgaggcagccagccggcgccgcggtcctggggagtccgtgcaggggtgtgctctggtgtgaaacctggcaggactctgcctgggcttgcatgcagggaggggttagagactctgaaatgtactagcgggcagggtggtgacaaggcgggtaaatgaggctcggggcatgcccttgcttcctggcttggaccccttctgattgattaaatcctagcaattggtgcaaccctctgtacctcttagagtgcctctcaccggcctgctctgggt

SEQ ID NO: 92874 - DNA, 30 bp, Homo sapiens
  chr5:12805470-12805500
  hypo
cccccagcctccagacgctgcccctgggcc

SEQ ID NO: 92875 - DNA, 40 bp, Homo sapiens; identical to SEQ ID NO: 8024
  chr5:128300655-128300695
  hyper

SEQ ID NO: 92876 - DNA, 162 bp, Homo sapiens
  chr5:128300712-128300874
  hyper
cgcccaatcccagcaactctggttctcctgtgaccccaagccttccagatccctgggtttccccccacgggactgtcacattcttccccgccggagacgccagtcgcggggcctcctccctggggtgtgagcaggtcggcgcgccacacttctctaggtggc

SEQ ID NO: 92877 - DNA, 411 bp, Homo sapiens
  chr5:128300900-128301311
  hyper
cggcggggcccaggctgttccggctgcggcacgccaggggatgtggttagccctgagcctggaggccgaaggtgggcaggcaacactcccaccatgtttcggaggagaatacactaggctagcctaacgacactcggagtgcgagctgcggctggggtaggggcacccctttccagcgggcgcgtgggtcaccaaggagcagttctccgggacccgttgcgtcagagggactgggcggggctgggcggggcaggacgggggcggcgctcaggaaccctggaacccgctggccctgaggccacggaccgagacgtggtgctgagcccctgcgcggtttctggtgcgtagagactgtaaatcgctgcgcttctcagtcatcatcatcccagcttttcccggctcgaattcagc

SEQ ID NO: 92878 - DNA, 641 bp, Homo sapiens
  chr5:128795456-128796097
  hyper
acccacctctctagtcgtgtcttcccatctccctactcattccctcccgcgccgctgcgggtgagagccttcagcggtgcgtcctaaggagcgtgaggagtgtgcggagcttggcacaccaagttgctgagactgtgacaccagcctccgcccgttccgcgcgggtgcaggcggcgagcctcggctcggacaccacagctctcctgcccgcgccgggcagtcctctgcctgtccagaggcagcactcccggctctcggctggctgtgggtctgtcttgtggggctccagcactagcctgctcggcctcggaaactcctgcagcgtccagaacacagaaaatagactcatctcctaattcgccagggagctcgagggctgcggggccgcggggctgcctcccccgctcctcccccaacccgaccccaccccacccccgccagggcttcggcggcctcccggagtcacacagcctacccccccaccccaacaccccctcccccggcagacaaagggcctgggcaaattcgccgcccggcctcctagcgctccggggaggccgctgcgccccggagtggatcgcgctggaggcgtgcgccgggcgagaagccgcggccgcgggagcgcagtatggggaagaacc

SEQ ID NO: 92879 - DNA, 1372 bp, Homo sapiens
  chr5:128796098-128797470
  hyper
cgagatgcgcctgactcacatctgctgctgctgcctcctttaccagctggggttcctgtcgaatgggatcgtttcaggtaagttcttccgtgactttctcgcttcctttccagccatcccagcggagaccgcgaacgtacgggtcggcagggctggtgcaaccggtgcgtggagagcagggctcagtgggtagcaataaaaatgagcttgaggtgcaggttaaggggtcaagttcggaaatgaagcacacttctgccggcctcgttttaaccgtatgtggaatagtttccttctaattagagcaataatatttgcaaaggtacgtttacagcacctggaggaaaattagaacgtacctaagttgatagcaacgctctgctctagcatacacttcagaaatcgtttactcgtgctggagtctttgcatcggttttcttttcaacaatgaagtgcggtcaccaaactttgattccccctcccccgcccctaatataatcgtacttttactctgaaaatgctggggtctgtaatctgatcgcaaggcttctggggttgcagagtttcagggtctagacgggtggtctccattgcattcaacgcgagcgccctgtatctatggactgtgagcttggaaatgtttgtgctactggaaccgcggcactttaagccccgcacttctgtctgccccgcccgcagagctgcagttcgcccccgaccgcgaggagtgggaagtcgtgtttcctgcgctctggcgccgggagccggtggacccggctggcggcagcgggggcagcgcggacccgggctgggtgcgcggcgttgggggcggcggaagcgcccgggcgcaggctgccggcagctcacgcgaggtgcgctctgtggctccggtgcctttggaggagcccgtggagggccgatcagagtcccggctccggcccccgccgccgtcggagggtgaggaggacgaggagctcgagtcgcaggagctgccgcggggatccagcggggctgccgccttgtccccgggcgccccggcctcgtggcagccgccgcctcccccgcagccgcccccgtccccgcccccggcccagcatgccgagccggatggcgacgaagtgttgctgcggatcccggccttctctcgggacctgtacctgctgctccggagagacggccgcttcctggcgccgcgcttcgcagtggaacagcggccaaatcccggccccggccccacgggggcagcatccgccccgcaacctcccgcgccaccagacgcaggctgcttctacaccggagctgtgctgcggcaccctggctcgctggcttctttcagcacctgtggaggtggcctggtaagcgccttctttcccta

SEQ ID NO: 92880 - DNA, 31 bp, Homo sapiens
  chr5:1291862-1291893
  hypo
acgtgacagggacacccggggaccacgcctc

SEQ ID NO: 92881 - DNA, 45 bp, Homo sapiens
  chr5:129239737-129239782
  hyper
cccggacccgagctccgccgatgaggtcagcggagcctaggcgcc

SEQ ID NO: 92882 - DNA, 877 bp, Homo sapiens
  chr5:129240024-129240901
  hyper
ctctccggctggcagcggtgccgcctgcggctcctcctccgggccagctcggagcccggcggcggggggagcgggaggcgggagtgagggcgggggctcgggaaggagggaggagggagggcccaggcgcgccactgacagggtggcagcctaggagcggacgcgttgccgccgccgctgctcctcctcctcctcctgcagctcctccagctgccgctgctgccgccgctgccgccaccgccgccgccgggagaagtttcactcccgacccttgctcggagccccggcccagagctgagcgggagcccggcaggcagctgcagcccgcggcagtcgaggcgtccgcggcgcttcgacctccagccggtgtcggcgcctaggcggccggctgcggccgcggctgggggcgcaaaggcggaggaggggcgggtgtgagccggggaaaccgcgtgccgcgccgcgacagcccagcgagcgtccgcgcccgggacagccgcgatggctgtgcgctctcgccgcccgtggatgagcgtggcattagggctggtgctgggcttcaccgccgcgtcctggctcatcgcccccagggtggcggagctgagcgagaggaagagacgtggctccagcctctgctcctactacggtcgctctgctgctggcccccgcgccggcgctcagcagccgctcccccagccccagtcccgaccacggcaggagcagtcgccgccccccgcgcgccaggatctccaggggccaccgctgcccgaggcagcacccgggatcaccagttttcgaagcagcccctggcagcagccacctccgctgcagcagcggcggcgaggacgcgagcctgagggcgcgacggggcttcccggtg

SEQ ID NO: 92883 - DNA, 35 bp, Homo sapiens
  chr5:129241105-129241140
  hyper
gggcgcgtttcatcccgggccgcgtggagttcttt

SEQ ID NO: 92884 - DNA, 466 bp, Homo sapiens
  chr5:129241413-129241879
  hyper
gcttctctgccagcacgtgcttcgggctcccacaggccctggcccgccctccccaccccttgcatccgcccacaattcgtagcccgttcctcgtcttctgcaatctggaccctcctcacacctgcctggctttattcgccttcctcacttgctgttttcggtgccgcctcgcgcttgtcccttagtctttacctcgtcggagaggttagaaaaggaaccttagagctaaaccaaaggccattcccactctgccctcctctgaaagcccctgctgatggtagtttccccaatcggtccagaggggcgtggtcttcaggaagggaagacggaggatgctagctacaactagtctggagatccagtgttctggctttggatcttgctcttttgtttaaactggatctagcgcacttttggaactgctcagattgaggaatcgtcttcgctgtcccggaccctttcctat

SEQ ID NO: 92885 - DNA, 144 bp, Homo sapiens
  chr5:1294182-1294326
  hypo
accacacagaaaccacggtcactcggtccacgcgtcctgcccgggtgggcccaggacccctgcccaacgggcgtccgctccggctcaggggcagcgccacgcctgggcctcttgggcaacggcagacttcggctggcactgccc

SEQ ID NO: 92886 - DNA, 900 bp, Homo sapiens
  chr5:1294543-1295443
  hyper
gcaggtgaaccagcacgtcgtcgcccacgcggcgcagcagcagcccccacgccccgctcccccgcagtgcgtcggtcaccgtgttgggcaggtagctgcgcacgctggtggtgaaggcctcgggggggcccccgcgggccccgtccagcagcgcgaagccgaaggccagcacgttcttcgcgccgcgctcgcacagcctctgcagcactcgggccaccagctccttcaggcaggacacctgcgggggaagcgccctgagtcgcctgcgctgctctccgcatgtcgctggttccccccggccgccctcaaccccagccggacgccgaccccggggaggcccacctggcggaaggagggggcggcggggggcggccgtgcgtcccagggcacgcacaccaggcactgggccaccagcgcgcggaaagccgccgggtccccgcgctgcaccagccgccagccctggggccccaggcgccgcacgaacgtggccagcggcagcacctcgcggtagtggctgcgcagcagggagcgcacggctcggcagcggggagcgcgcggcatcgcgggggtggccggggccagggcttcccacgtgcgcagcaggacgcagcgctgcctgaaactcgcgccgcgaggagagggcggggccgcggaaaggaaggggaggggctgggagggcccggagggggctgggccggggacccgggaggggtcgggacggggcggggtccgcgcggaggaggcggagctggaaggtgaaggggcaggacgggtgcccgggtccccagtccctccgccacgtgggaagcgcggtcctgggcgtctgtgcccgcgaatccactgggagcccggcctggccccgacagcgcagctgctccgggcggacccgggggtctgggc

SEQ ID NO: 92887 - DNA, 900 bp, Homo sapiens; identical to SEQ ID NO: 92886
  chr5:1294543-1295443
  hypo

SEQ ID NO: 92888 - DNA, 115 bp, Homo sapiens
  chr5:1295604-1295719
  hyper
cgctggcctgatccggagacccagggctgcctccaggtccggacgcggggcgtcgggctccgggcaccacgaatgccggacgtgaaggggaggacggaggcgcgtagacgcggct

SEQ ID NO: 92889 - DNA, 30 bp, Homo sapiens
  chr5:130331203-130331233
  hypo
tgagaacgggaagtccgtgggtctagcggg

SEQ ID NO: 92890 - DNA, 92 bp, Homo sapiens; identical to SEQ ID NO: 40587
  chr5:131305994-131306086
  hypo

SEQ ID NO: 92891 - DNA, 403 bp, Homo sapiens
  chr5:131346834-131347237
  hyper
ggagatggacaaggacgcaatgtctgttcctggccttggctcagggcctaatctgatccgcggatggtccttgccatcagggaagggggacgcaagaactcggcgggggtttgtggtggggtcgcagagagcaagccctatatctccctccgcagacccaggtgctccccaaacccggcccggagcccgcgagaactgggggcggagggtgtacttaggcggccctggggaccttgacgggacagctcagcagcaggggatgggggctcggcggccgcggagatgtaacacctccacctcgggcgaagacctcatagcctgcgggagatgggagtccgggacgcggacaggacgggcacttacctacgaatagccagagggagccccccgacacgaggaagaa

SEQ ID NO: 92892 - DNA, 162 bp, Homo sapiens
  chr5:131347627-131347789
  hyper
ctggaagggggagcacgggcgacgagcgccagagcgtgacattgagcccaccccgccgccacccaccccatcaacacgcgaccctgcccccgcgcgactcgcagcctgggttttatggctgggcaggctcgaatggcagccgggtcgcggttacctgtccta

SEQ ID NO: 92893 - DNA, 324 bp, Homo sapiens
  chr5:131593088-131593412
  hyper
agctgggtttgggtccgcggcctgcagatccaaggcccgagcaggatccaggccgtcggggccgtccgaacgcggggatctctgagagctgagtgggggtgccgggttgccggcagccggggctgagggcgggtcctcagagccccccgaagtgggagggtcgggctggccgcggggccaatccaggcgcacagggagcgggggcgggggctgggccgagtggggacaggggcgggcgggccgggggcgggcgcggcgtccaggcggcggcggcggctgcggcggcggcggctcctcctcagagtccggctcaggctccggctg

SEQ ID NO: 92894 - DNA, 43 bp, Homo sapiens
  chr5:131593472-131593515
  hyper
cgcctggtgggcggccgggacttcagcgcgcccctcaccatct

SEQ ID NO: 92895 - DNA, 30 bp, Homo sapiens
  chr5:131608230-131608260
  hypo
ctgggatgctgcgtgcggcgcgacgacagg

SEQ ID NO: 92896 - DNA, 30 bp, Homo sapiens
  chr5:131608541-131608571
  hyper
ggtttcttccacccacgagcactttattct

SEQ ID NO: 92897 - DNA, 227 bp, Homo sapiens
  chr5:131610019-131610246
  hypo
tgcccaccctgcctccgctgacttggtcccagccccacccagtcataggtgggagaggagaggatgactggcacccaggaaagcagggaagcattattaagcacaggagtgggtggaaaaataccgggagccatgggccctggcccccacctctcactcccactcacccgcagaaactcgactctcccactggccaccacagatccactagccgctggtactcacct

SEQ ID NO: 92898 - DNA, 267 bp, Homo sapiens
  chr5:131613605-131613872
  hypo
aaaaaaaagcatcattcttgccacgcaacaggctgttctcctacagccatggtaaggactttgacttttactctgagatgaaaagccagaggagcggcatgacctggaattatgttttaactaggatcacattgtctgctgtatggagaataggccctaaggggcaaaggtagacgcagtaaaaccagttagcaagcatgactgcgttcatccctaactaattccaaactagcccactctccccagtccagacgccactgtctcatg

SEQ ID NO: 92899 - DNA, 30 bp, Homo sapiens; identical to SEQ ID NO: 40589
  chr5:131787174-131787204
  hypo

SEQ ID NO: 92900 - DNA, 532 bp, Homo sapiens
  chr5:131991814-131992346
  hyper
cagggcaggggctgccgctcggccgggcccgcggggtccctcggcctgacatggccggtgctggagcggcacgtgcgcgcctcggcccctcggccgctcccgcccctcgccggtgcgcaccggcgctcggggagccgctggcccgggtgtccagccggcccttgccctgcctggcgctcggaccgccacctttgccgccccctcgccagcctccgcagcttccagactggccggtctgcgcgcccacccctgcctcccggaccggccaccgccggaggccgcggaggagggcccggccgcgcagatcccgcttatcgggcccatctcccgttacataaggccacccccctatctccgcgggccatcgccgccgcaaccgccgcgccagcgccttctcccacgcgcgggggcgcccctgcccaccgctcccggcagggcttttggtggccatgggggataaggggcgttgactcacccgggcggggctccgggagttgcacagaccaaggtagttccccgctccttcccccat

SEQ ID NO: 92901 - DNA, 360 bp, Homo sapiens
  chr5:132083017-132083377
  hyper
aggcgcggcccggtgcgccagaggtagctccaccgcgagcgttgtgggtggggcccgccgagcccgcctccccacctcccccggcggcgccccaggctgcagtgttccgggagctgggttataaaatgccgggttaagcggcaactcagactcaggatcccgctcacgacatggcctcgggcgctcagctcccgccgcagccgtcgagctcagaggtcagcgccgtccagagcccaggcgggcgtcccggcgccggtctggaggaaacagccctgggcgttcctctcccgccgtctccgggggaggcccctctgccccgaagcaaccggagcaggtgccctgggacccgccagcccggag

SEQ ID NO: 92902 - DNA, 37 bp, Homo sapiens
  chr5:132083472-132083509
  hyper
gccccagagcaagctccgcggccggctccacagtccc

SEQ ID NO: 92903 - DNA, 98 bp, Homo sapiens
  chr5:132083866-132083964
  hypo
gggtgatgggtgagccgctgcgccggggggcgcttactcccagcgggcatgcagaggaagggacttctcactgccccaccccccgcaccttaagcagg

SEQ ID NO: 92904 - DNA, 77 bp, Homo sapiens
  chr5:132113493-132113570
  hyper
gcgcgtccggccaggcggccttcccgggcaagggaccagccttcggctccttgtgcaaccaacgagcaggatgcgca

SEQ ID NO: 92905 - DNA, 54 bp, Homo sapiens
  chr5:132201467-132201521
  hypo
caagacacctcagggcgagctgtacattgacaacagcatcgtcaagcagaatgc

SEQ ID NO: 92906 - DNA, 20 bp, Homo sapiens
  chr5:132399919-132399939
  hypo
aggtgcggtggctcacgcct

SEQ ID NO: 92907 - DNA, 30 bp, Homo sapiens
  chr5:132759633-132759663
  hyper
ggagctgaggaacagcgctggggtcccggc

SEQ ID NO: 92908 - DNA, 60 bp, Homo sapiens
  chr5:132888793-132888853
  hyper
ctgacctccagggggcgcgggagagagggtgagtcccgcggtacccggaacccacagtct

SEQ ID NO: 92909 - DNA, 1822 bp, Homo sapiens
  chr5:132946707-132948529
  hyper
cttgcaacaaatttacgaaggtaacagaccaagctgccggcgctgtttttcactggaggaaagctcggcggaagcgacacctagaggggagcggcgggctgtggccgcgccattcatcagtgtcggcggcccgcggccgcgagcgagggctgctggacagcgccccggcacccgctctcgagccgcgacaccgacctcgccgggcccgccccgctgacccgcgcactcctagtgcacttgccgcgccgcgcggaggctcgccgcgctctggaaaacaagaaaccccactgcctcggcggctttccgctcccgcaagagttgcgggcacaaagtcctcaggtggcaggcctggggttggcgccgctttgtcggctgcagggagccccaaagactagcgtcagctcgtccccaaactcgaggcgacaggcgccgaaagcagagtgctgtgcctgcctcgtccaggtccctcctgaaactcagaactcgtctttgttttgcgggcgcaaagagggcggagatcatccacagtgcaagctctcttaggaccaagcccccagcccgaacgctgaacgcccccaacacactgctccctagacacgttcaagcgggtaccccgggccgctcactctggaccgcggccggctacgcacaagcagcgccgcaggctgcctggagtcgggtcgtgccctgattccttcctccccagcctcacatgcggcggaccccggggaagccagggccaggcgaagcgcagcgggccctttgggctgcagcgaggagacgcaagtttccccgcaaagccgcggggaggaggtgctgagaatgcctgcccggcgccccaacccggagccaagggcaccgggcccgggccgaggggccgcgctcgcctggctccgccggggccgctcggggtcctgaacccaagaacggcgcctgcaggatttcggagccgggcgcgagctgcgggctcggcccgagcgcttctgcgtggcgccccgcgtgccaaccgggtcactccggtccccaccgtagaccccggccacgagcctcggcgtcccagcctctcctcgagtcctggccttggccggggtagccctgccgagccctggcccagcggtcccttccccgcgggcaaacttggctttcccggcgcgggcagtaaggacaagcaagcgcccgcgccgggccctgcagcaagatgcggggccgcgggcgccaggaccccagtggggtgcagcgggaccggctggtggcggcgccagcgacatggcaccctccccgcgcccgctgggagctgcgcccgcgtacctgagacggccggggccgaggggaagaccaggtggccggacttgggcgggagggagggagcaccccgtggcggcggcggcgaccccgccccgcgtccttcggctggtttctcgggctgtcggcgggtcccgggctcgctggaggctgttgaggctccagctccctgagccgccgctgcccgctgctgtgccaccgccgccgcggctgccctatttctgccgccgggaccggagcccgtgacgtcaccctctgggccccgcctgcccaatcgccgccacctgtgcgcgccgcccgcccgccagccggtcagacccgcgcggcggccacggcaggtgcgcggagcaggcgggcgcgcacgcggggcgcgatgactccggagcgctggggccatctagggcccggagggaggagggccagcgtagcgctcctgcctctggctagcgtggagctcggcaagtgacagcccctcttcacctctgctctcctccaggctcctttccgggccaggttcccc

SEQ ID NO: 92910 - DNA, 30 bp, Homo sapiens
  chr5:133262317-133262347
  hypo
ctccacagcacagcccgcagcccggcgagg

SEQ ID NO: 92911 - DNA, 168 bp, Homo sapiens
  chr5:133406834-133407002
  hyper
ccccgaggggatcctcggcccagccttcctgggggatgaatttacaaagagttcccagcgggtgccaccctccccttcccttggaaggcgctcagccactgccaaggtgcggacgcagcgggggcggcgccgtgcgggagggggcagccagcgcggccacttcaaagc

SEQ ID NO: 92912 - DNA, 251 bp, Homo sapiens
  chr5:133449673-133449924
  hyper
tgggacttggaggatcggctgaggtccggtgctcttggctgtgttcgcggctcggagccgtcgcctgactgaggggcccgtcacagatgtgtgatgtataagctctgcacgcaacaggagctcaataaatgtgcgaaggggggtatacttatgttcgcactgtatgcaggcggcctagaaggaagtccctgattggcacagggatggaggatggggcaagagccgcaacagcgccgcggagttccaacgct

SEQ ID NO: 92913 - DNA, 27 bp, Homo sapiens
  chr5:133682096-133682123
  hypo
ttgttaaatttgtcacgcttttctctt

SEQ ID NO: 92914 - DNA, 120 bp, Homo sapiens
  chr5:133820016-133820136
  hypo
gagccaacgcgcccggcccgtgttttgttttgttttgttttgttttttactgtgatggccagaaccgttagtataatgttaaataaaagtggtagtaatgatgccaggcgcggtggctca

SEQ ID NO: 92915 - DNA, 71 bp, Homo sapiens
  chr5:134242171-134242242
  hypo
aaatttaaaatagctcgaagacggaggaagataggcactccgccgcttcttgtccacgaaggggagaacac

SEQ ID NO: 92916 - DNA, 30 bp, Homo sapiens
  chr5:134256782-134256812
  hypo
ggttctgtcaggattcgtgaacccagcaga

SEQ ID NO: 92917 - DNA, 96 bp, Homo sapiens
  chr5:134339741-134339837
  hypo
ggagctatagactggagttgttcttattcagccatcatctcctccagtatttcgtcttttggtaaagaggggtcccccacccgcattcagttgcca

SEQ ID NO: 92918 - DNA, 67 bp, Homo sapiens
  chr5:134365027-134365094
  hyper
gagaagggtcagggccgctgcgggccgggagggaccccacccccttccccaccgcctggagccttcc

SEQ ID NO: 92919 - DNA, 548 bp, Homo sapiens
  chr5:134366718-134367266
  hyper
ggggttgccttagtccgaggatcaggtaggatgagggtcaaaggggttgaaggtccgaggcgcctggaggcctggcagacgctagtgggccagggcctaaggtggggatctccggtggagggagggagcaggtctgaatggtgggagagtgaagttctgcttgtgggtctaagctttggagggctgcagcagaggcggcccgggagccctctgcgcgggtgcccttaggcgcgcaccccttgctcacccgcacgcgcggctcggtgaggttggtccacacggcgatctcctccctcatgctcatgtcggggtagcggttcctctggaacgtggcctctagctcttgcaactgctggcttgtgaagtgcgtacgttgccgccgctgcttcttcttcttggctgggtcgtctgcgccgccgcagcccgtgcctcccgcaccactgtcctcgggccccttgggttccccgccgcgctccttctctgcagtaggcaggacggggagcgggtcacctgggcttacgccccgttgcaccccgtcccggctccac

SEQ ID NO: 92920 - DNA, 21 bp, Homo sapiens
  chr5:134367284-134367305
  hyper
cgctggcggtcttccctccct

SEQ ID NO: 92921 - DNA, 124 bp, Homo sapiens
  chr5:134368720-134368844
  hyper
caaaaaaaggcagcgcggagggagacgcgcaggagccggggcgggggccagagccgggctgctccgggcttcggccgcgcacgtgggccggatcccttgatcggcgttccggctggccttgctg

SEQ ID NO: 92922 - DNA, 59 bp, Homo sapiens
  chr5:134374447-134374506
  hyper
tcaatttcagaaatccgagacccggttcttgagaagcgactgcgtgctccgggaccctg

SEQ ID NO: 92923 - DNA, 1060 bp, Homo sapiens; identical to SEQ ID NO: 29897
  chr5:134374791-134375851
  hyper

SEQ ID NO: 92924 - DNA, 163 bp, Homo sapiens
  chr5:134376212-134376375
  hyper
ttcctggctggctgccgctgggagacgggctggacgcaagggaactgggagcctgtcctttgcccaccctcaggccacagggctccccagcgttgcctcgtggccagataaccctgtgcgcgaagcctcatggtggaaaccagttggccgaacctactcctgg

SEQ ID NO: 92925 - DNA, 132 bp, Homo sapiens
  chr5:134376731-134376863
  hyper
cgaagcgggaagccggcccgacccaagctcacagaggcctcggtgttcaggccctgccaggtggcctctgcaccctgtcgtgctgttccagggactccataccctcctctcaaccctcgacagcaggaaccc

SEQ ID NO: 92926 - DNA, 279 bp, Homo sapiens
  chr5:134385889-134386168
  hyper
caccaggagctgtctcgggacctgggaagggcaggagggcgaggggctagggcgatggaagggggagatcaagagtggcgcggcagggggagagcgccctgagcctcgctggagcccatcccggcatggctgctgggaccgacaggccgatcgcgggccgcgagcacatctcacagagcctgggcacagagggcccgaactgtgcccagcgaggaggacgcgtgtgggttttgcctgcaagggttctgaccacttggggacagcgagggcgcgtagagg

SEQ ID NO: 92927 - DNA, 199 bp, Homo sapiens
  chr5:134386184-134386383
  hyper
cgccgcctcactcttccgcgcgaggtgccgggtggcccagcagcaggtgctcgcgcgcaggtccagagcggcgcgttgcagagcccgctgtgccaccggagaaccgtggagcagccagggccgcactcgggcgtctgtccccagcctcatggttgccagcagagctggcgcaggggcgcgcaggcggtgagagcaatga

SEQ ID NO: 92928 - DNA, 120 bp, Homo sapiens
  chr5:134583042-134583162
  hypo
agagcaaatgccttacgtttagcggatgcgctaggaacggctaggacctcccagggtttgccttgtgcccatggaaccagcagttccgccccaagggaagccagccgtgtgtcctagtgc

SEQ ID NO: 92929 - DNA, 166 bp, Homo sapiens
  chr5:1346140-1346306
  hypo
cctggagcaggcacccgaggccgcgtgcaggggcggtcctgggccaccaacccctggaagctgggccaggagcttcggagccatccgaggcttttttcgctcctctcactctcatgcacctagttaccctccccacagagtcttctcacggcgcggttttcggcta

SEQ ID NO: 92930 - DNA, 50 bp, Homo sapiens; identical to SEQ ID NO: 40424
  chr5:1346659-1346709
  hypo

SEQ ID NO: 92931 - DNA, 109 bp, Homo sapiens
  chr5:134801812-134801921
  hyper
ctcttctcaagtaggcggcaaagtttactggtgattgcgaagtgattgcagagcggttggagagtgaatggatccggagcagcgtagcaaacagcgcagtctggggggc

SEQ ID NO: 92932 - DNA, 144 bp, Homo sapiens
  chr5:134802222-134802366
  hyper
gaccgcaattaggaccggagagcacttgatttctaaactgcgccttctggaagatttctaaacttgcgcctcctgggaagaaggctagagttagcgttgccgcagggctgtgcctcagacgaccaggcacgaccaagcacacag

SEQ ID NO: 92933 - DNA, 89 bp, Homo sapiens
  chr5:134824488-134824577
  hyper
gggttggctgggtgacggcctgtctccctccgctagcctcctcgggtccttcgggaggcgccagattgtgtgggcggcatcgcctgggg

SEQ ID NO: 92934 - DNA, 30 bp, Homo sapiens
  chr5:134824825-134824855
  hyper
ggccctgggctttgtcgctttcagggaact

SEQ ID NO: 92935 - DNA, 3 bp, Homo sapiens
  chr5:134825103-134825106
  hyper
ggg

SEQ ID NO: 92936 - DNA, 408 bp, Homo sapiens
  chr5:134825383-134825791
  hyper
tgtttaaaagggggccgagagcgagggcgcccaatctttgaactggtcgggttttgcatgcctccgctccgagcccgtggagcgctgcacaaaatcgtctagcgcggagcagggcggggacggggagagacacaaaacaatcctcgggctttctcgctactgagccttcggggccgtttccccaagcgcaaacagatgcaaatgtctctgcaaacattgcacaaagctattcagagagaggcagcctctcgcggcctcaatagccctttaaacctagtccaattgcccccaagtagaggtaaagagtccacatgcattttttcactttggctggaagaggggcggaggaggcgagggccttggggagcaaggtatgagggctgctctggttcagcggttcgtgccatc

SEQ ID NO: 92937 - DNA, 348 bp, Homo sapiens
  chr5:134825912-134826260
  hyper
ggagaggcccccgggacctttcaggcccacaaacgccgcgctaaatagccacgcgcacaatagcatgaaagggctcactcggaccttactgcaacacagtagattcacacccctccgaggggactaataagctcgtaactaacgcgcaacgctcagcggtgagagcgggcttgcgccctgctggcccctcgcagtacgcagactcagtctttcagcgtcactcggaggcccaagggcagccgctgcacggagggccaggcatttccttctaacctcgccagtagaggagcctggggcctgccggtgcagtccttaatgcaccccaaactcacgtggggctggcgaccc

SEQ ID NO: 92938 - DNA, 30 bp, Homo sapiens
  chr5:134826479-134826509
  hyper
cgtgcgctgagggcccggaaaagccccttc

SEQ ID NO: 92939 - DNA, 504 bp, Homo sapiens
  chr5:134870423-134870927
  hyper
tgcaaaaggaaaggccgtctaggggcgggcaggaggggcgctgggctgagggccggagaaacagaccaagagacatccgccgcgagggtgcggcgacctaacaagcggctcaggtatccccgactgctttaaagctcccgcttcctccctccgcctggagagggggtcccgaggcggcagctggggccccatctattgcctgctgactaggggagggggaaagtaacagtgtctacaaagggcctagtggtaaggaatgaaacagggcgttgtgtggagcaagtctttgggcaggcttgggaaggagaaaacagggtcgccggggcggtaggtgaagtcttcggaggcggctgggctactggggtcagagagcggggaggcggcggcggcacctgagccccaggactccgcgtcgctggcggggcttgggggaccgggcaggcaggggacgcactgcggcggcaggaggcgctcccgggcaccgcctccgggcagcccttgatc

SEQ ID NO: 92940 - DNA, 723 bp, Homo sapiens
  chr5:134871417-134872140
  hyper
cgctcagagcgctgcagcccggactgagggcagagccgccagggcgcacttacgttcccaacagcctggggttgttactctgtgccagttgcgggtgcgagagcctggaagggtgcaggggcgcacggagaacttggcctggcctcctcgcctcgcctgcaggggccacgcgcccggccggtctcctgagtgatgtcgccggcgatcagatcagctcgtgtgagcaccgagtgtggcacacgactggcctcaggaccccttaagtacccggcgcaacaatgggcgcccccctcccttgccacctccgcccccgcggcagcccgggtgaatggagcgaggcggcaggtcatccccgtgcagcgcccgggtatttgcataatttatgctcgcgggaggccgccatcgcccctcccccaacccggagtgtgcccgtaattaccgccggccaatcggcggcgtcgcgcggccccgggagtcggctcgggctaagctggccagggcgtctccaggcagtgaaacagaggcggggtcggcgggcgattagcggccgaggcacgctcctcttggggcgggctgggcgcccctcgctggggtgggacggggaggcggggcgcgagcgcgaaagtgtgagccgcccagtgagttgcggaaacctggagggtacttggagtttgggttcgcatcccctctccagctgcttagtggtcgcgtgactttggacga

SEQ ID NO: 92941 - DNA, 702 bp, Homo sapiens
  chr5:134879271-134879973
  hyper
tgcatctctttgggacgccggccgcgcccccacccttgccgccgccgtcgccgccgccacttcggttttgctctggctggggagacccggcgtttctggatttcttttatgcagccacaaataaaggctcctaggctggaagaaggggatttccccccaagtcttgagcaaacgaccctagcgccgtggctcttcctacggcgggggcctcggagaacccggcggggcgcgcggggggacgcgtgggcactgccgcgtgggcgccctgaccccgcgcccgcgtggagcgagagccgggactctgggccagcaagttccagttccccgatggggccggctcgcccggagccgcgtgaggggattagggccgcacgagaggcgaccgcgccgcggcctccagccacgtgagcacagacacggcttcaaacgtccccaacgcactaatccttgttatccggcaggataaccgcggccgcgccagcacccggcctgcctcctccgtctggctgcgggcggggagtgcgcctggctcccgagcccctgacacggatttggggcctgcaatgacgatctaccccacaccatccacattcctgggaccctcggggcaaggtcctacagtccttggtgaccaccacgcctgcaaaaagcggtgggaaagttgttacgcttagaaaactaccaacacgcgcatgcctgtaa

SEQ ID NO: 92942 - DNA, 11 bp, Homo sapiens
  chr5:134880603-134880614
  hyper
agccagtcttc

SEQ ID NO: 92943 - DNA, 885 bp, Homo sapiens
  chr5:134914192-134915077
  hyper
atcttgggtcccttccgggagcacttgcatttggaccctgcgagcgagcgcggggcaacggcttagttgctaggcggtctcctgcccctcgaccaccttggtgcccacccagaccaccccccgcgggatcccaggatgcctagaaattggcgcttgggttccccaggacaggacaagacgagacggcgacaaggggagctccccgcactcaccgtccacacgcgcggtgtacagcgccagcagcagcaggagcagcgcggccgccaggagcctcatgctgaccggaggggcgcggcgtgggagcagggacatggggagggcgctggcccgtcggagcggcggcccggagacgccacccagctctgctcggctttctctgcccggggcgcgccttccggctctgctggctccggctgcgccgtcggtggatgcccagggctgtctgtggccgtgcgctgcgctctgcgcttgtctccgcgctctctccacagcctccctccgcccgccctggcctcttttaaatccgctcctgccctcgcagcgagcgagctcattaatatgcagaaccactcggtgactcactgagatttctcaatgtggtgaggggaggagaccttcccagcccgcccgtcgcccgccccgggaaaggacccgctatcgcagcggcgcacacccggagccacgcgcgcacacgcacacacacatccgctaccctctcgctcacacaacacgccgccttcgcacacttgcacacccataccacagcgcgcacacatttccagcgtcccgctctgcctttggggagcccagacggtggagaggctgctgaagggcactgcttttctgaatcgtgtggttctctctctggcccggcaggccagcttt

SEQ ID NO: 92944 - DNA, 290 bp, Homo sapiens; identical to SEQ ID NO: 29911
  chr5:135170256-135170546
  hyper

SEQ ID NO: 92945 - DNA, 278 bp, Homo sapiens
  chr5:135170915-135171193
  hyper
tgcacacctgaattgcggacgtggctcgcgggaacttatgtatgagggtagcgcttggctgctgatcccggggcgcagggtggtgggagccaggcttcgagattaggccggcccaacggggcgtcccgactggagggagcagagctctcacagcagggagcggagcgccggctgcaggtgcccattgccaggctgcgaggagcacttattgccttcagccgccgccaaccgtcagccatcgcctacctccaaggccccttctccgggcactgttgggt

SEQ ID NO: 92946 - DNA, 159 bp, Homo sapiens; identical to SEQ ID NO: 29913
  chr5:135265701-135265860
  hyper

SEQ ID NO: 92947 - DNA, 12 bp, Homo sapiens
  chr5:135265919-135265931
  hyper
cgccaggtgggc

SEQ ID NO: 92948 - DNA, 197 bp, Homo sapiens; identical to SEQ ID NO: 485
  chr5:135265932-135266129
  hyper

SEQ ID NO: 92949 - DNA, 128 bp, Homo sapiens; identical to SEQ ID NO: 29916
  chr5:135266577-135266705
  hyper

SEQ ID NO: 92950 - DNA, 53 bp, Homo sapiens
  chr5:135364596-135364649
  hyper
ccggcccagcttccccgcccctggcgtccgctccctcccgctcgcagcttact

SEQ ID NO: 92951 - DNA, 1088 bp, Homo sapiens
  chr5:135527803-135528891
  hyper
agcgatccccggtgtcgtgccctccctaccaggctcaagctggctgctcttggctaggtcgggacggggcgcccggcggccgtggctcagtcccaagctacaccggccgcgtcttccagggcgcgcgggcgtcgcgcagcgagcggtcgtggggcagcgcggcgaaggccgaatggcgcagctggcaaccgatgaagaggacgacgagcgccaccgagagcagcagcaggaagaagagcagcaggtaggtgggcaggtcgggctttgtggccgcgccgtccctcataccgcgcgcagtggccagctccagcggcaaagcgccttctgccttgaccgtggctcctggggccagcgcgctgcctaccgccgcctcggggccgcccgtggcgttgaatatgtcgccgtacatggcccgcgggtcccgccgaccccagccggaccgcttcacttggcctggagcatactggcgcgacccggcgcctccatggcgcgcccctcccgccctgccgcgcccaactgaccgagagtcggtgccttggggccggcggggactgcaaagaccccgggacgcgtccgctcactcgcctccgcgctcagctgctttccccgccggctggcggaccccagttctcggagctggacagttctgtgcccgcgcccctcgggctcactgtttctctccgtcgccaccaggacagaggtcccagtcactgactcgcctttcggctttacaacagcccgctcagctcggaccctcagctccagtgagctccaggtgctgggcgcctctgggctgcggcggcggggagaggcactcagcaagtgcagccgcagcccggggtctctgctgagcgcccggtggcagagcgcacggagggcgggtggccagggagtcctccgcgtcctccggcgccgccgccaccgcagcgtctcggaacagtcctgcaggctctggtccctgtcgagacgcccagtgttcagcgagcttgtccccactccctccggctgctgcgctcctgttttgagcaggagactgagctttctggcggctctgagcgcgctcgtgtcccgggcgggggttcggggga

SEQ ID NO: 92952 - DNA, 28 bp, Homo sapiens
  chr5:1356625-1356653
  hypo
cggctcacgtggccacggagcagcaccg

SEQ ID NO: 92953 - DNA, 182 bp, Homo sapiens
  chr5:1357154-1357336
  hypo
ttccagcgcctctgacgaccgcaggctggggcttagacaggacatttattgctcaaagtacagtccatgaggctggcggtcccagatccaggtgtggcagggctacttcctcctgaggcctctccttggcttccagacaccgtcttctccctgagtcctcaccgggtcgcccctctctgcgt

SEQ ID NO: 92954 - DNA, 186 bp, Homo sapiens
  chr5:1362617-1362803
  hypo
aaccttccggatctgcgctagcgccgggcagtgttggagctgaattaaattgcaggacactcgggtggtgtctgcagagacccggagaattggctggtgtgcaaaacccacacgcttgttgtcagccgtgtcgtgaatcgaggaacagctttcctttatccacaaaaaaagcgagttttcattccc

SEQ ID NO: 92955 - DNA, 40 bp, Homo sapiens
  chr5:136834011-136834051
  hyper
ccctccgagaggctccgcgccccccagggccgggtggcgc

SEQ ID NO: 92956 - DNA, 203 bp, Homo sapiens; identical to SEQ ID NO: 29920
  chr5:136834289-136834492
  hyper

SEQ ID NO: 92957 - DNA, 171 bp, Homo sapiens; identical to SEQ ID NO: 29921
  chr5:136834493-136834664
  hyper

SEQ ID NO: 92958 - DNA, 175 bp, Homo sapiens; identical to SEQ ID NO: 29922
  chr5:136834706-136834881
  hyper

SEQ ID NO: 92959 - DNA, 232 bp, Homo sapiens
  chr5:136834912-136835144
  hyper
cgcggcacggtcgccgggaaggctgatcgccggctcgcgcccctgcgctcctgccacacgccgccgccgagcgtctggccgctttgtgagcccgcagcgatgtgctctgctcgctcgctggctcgggcgcggcgtccgcgggcggaggaggccgagcgcgcgagccaaggctctggcgccccctggtggccgcgcgctgcctgcccgacagcccggccgccccagcccggaa

SEQ ID NO: 92960 - DNA, 76 bp, Homo sapiens
  chr5:137225091-137225167
  hyper
cgtcagagccgggcagcgcgcgccgcaagactagcgcgcaagcgccgcggcctcaggcgaacgaacgggcggtgta

SEQ ID NO: 92961 - DNA, 30 bp, Homo sapiens
  chr5:137474889-137474919
  hyper
acagcggcgggtgagcggcctcggccagct

SEQ ID NO: 92962 - DNA, 26 bp, Homo sapiens
  chr5:137548023-137548049
  hypo
tttgagacagtgtcccgctctgccct

SEQ ID NO: 92963 - DNA, 412 bp, Homo sapiens
  chr5:137577572-137577984
  hyper
ctcccgcagtcaagccgggacctcgcccagcaaggactccagggctgcccaggcaggggcgcccgtccggcaccggactcccgccctgggcccagctccggcgctcggccagccccgtgccccgggcggccgctgatagtcggctaatgcgtatcgaatttttgtggagttcggcccgcgcagagtgcgcgcggaggcgctgcccgagcctcttaattccctttgcatcgatcctgccgttaatgacataaccttctcccctaattaactgacaactgcattaggcggcgcgcctccgccgcacgccgcccacagcttcccccacgcagttccgcccgcgccggtgcggggctggggcgcagcggctccgcctggactcaactcagggtccggctgccgtggtggaggggag

SEQ ID NO: 92964 - DNA, 51 bp, Homo sapiens
  chr5:137727606-137727657
  hypo
caaaacctttagtaacgtctttggcaggcactcaggcggctttctgtcctc

SEQ ID NO: 92965 - DNA, 23 bp, Homo sapiens
  chr5:137769715-137769738
  hypo
accgtgcccgtccaacattggtg

SEQ ID NO: 92966 - DNA, 30 bp, Homo sapiens
  chr5:1379058-1379088
  hypo
tggcccccacttctccgcaaagtggaaact

SEQ ID NO: 92967 - DNA, 30 bp, Homo sapiens
  chr5:138060847-138060877
  hypo
tgttagtgtggggagcgcatctttgttgca

SEQ ID NO: 92968 - DNA, 38 bp, Homo sapiens
  chr5:1381049-1381087
  hypo
ggctgcctcatgggacgccacatccgccagcaccctgg

SEQ ID NO: 92969 - DNA, 97 bp, Homo sapiens
  chr5:1381147-1381244
  hypo
aggcttaggcgtgttgtcacagcagcccgaatggactccagcagcagagcagccagggctgcacgtggtgcgtgaacacacccgccgccctcctcct

SEQ ID NO: 92970 - DNA, 122 bp, Homo sapiens
  chr5:138273634-138273756
  hypo
ctcctcccctccccacggaagcaagagagaaggagctgccacgtgctgggcacctcagagcctgtgtccagcctttactctcgtcaccccatttcatctgtgcgacccgagatgtcagtgcc

SEQ ID NO: 92971 - DNA, 75 bp, Homo sapiens
  chr5:1384936-1385011
  hypo
gagcaaaccaggcctcggcatgggcacgggatgaactcagggcaccggtggggtgttggccgtttctgggtaaca

SEQ ID NO: 92972 - DNA, 55 bp, Homo sapiens
  chr5:138586687-138586742
  hypo
gaaggaatggaaggacgagaagctcatggggagccatcgccgccctgcctctccc

SEQ ID NO: 92973 - DNA, 95 bp, Homo sapiens
  chr5:138627655-138627750
  hypo
gacaatgtctgactctgtagcccaggctggagtgtgcagtggtgcactaggctcacggcaacctccgcctccggctcaaacgatcctcagccccg

SEQ ID NO: 92974 - DNA, 30 bp, Homo sapiens
  chr5:138670672-138670702
  hypo
gcactccttcctcggcgacagactgagact

SEQ ID NO: 92975 - DNA, 143 bp, Homo sapiens
  chr5:138676299-138676442
  hypo
cacccatttcctagtcggtcatttgccctctccaaagggaagaaattagtttgtgtccctttttcaaagatagtatctacacatttgaacatccagatttgtaaaacacatactctcggccgggtgcggtggctcacacctgt

SEQ ID NO: 92976 - DNA, 37 bp, Homo sapiens
  chr5:138679633-138679670
  hypo
tgactttgtgatccgcccccgtcggcctcccaacaga

SEQ ID NO: 92977 - DNA, 24 bp, Homo sapiens
  chr5:138971490-138971514
  hypo
ttgaaaacctggggccgggcgcgg

SEQ ID NO: 92978 - DNA, 309 bp, Homo sapiens
  chr5:139047939-139048248
  hyper
ctgccgcctcccagccggacgcggacgtgcctgcgcggctctggcggccgcgtctgccgccccggcgcccgcccgggtcccaggccgactaattaggcccggctacctcccgcgccgcccactgcccgctccaggcccgctgcccgctccaggcccgaggtgatggcggctgttcctgccgttctggggcctgtgccccagagctggccgcgtttctcggggcgggagccagctctgctcgcctggcttaacccagacgagcccaggacgccctatccctgaaccccatcgtggcgtgcaggtctgagt

SEQ ID NO: 92979 - DNA, 32 bp, Homo sapiens
  chr5:139090340-139090372
  hyper
ggctggggcctgagccgcgagcagggcggagc

SEQ ID NO: 92980 - DNA, 172 bp, Homo sapiens
  chr5:139142327-139142499
  hypo
ccggcagacccctcccggcagagccagccccctttcctgccagggggatggcaggacaggaggcctggctggggaggtggtggggctgtggcagcagagaggggaggcaaaggttggcagagtggggagagatggcctggggggagagcagcggagtcgctggggagagagg

SEQ ID NO: 92981 - DNA, 142 bp, Homo sapiens
  chr5:139144114-139144256
  hyper
cgggaccccgttgccaggagcagtcaggatgcggcagcgtctccatggcaacgcggcatctcgagccgcgcgccgccctcccccggcgccccgcagtgggcaggaggccgagcctggcagcccctcccggcccagcagccag

SEQ ID NO: 92982 - DNA, 467 bp, Homo sapiens
  chr5:139175410-139175877
  hyper
tcagcctctccacatcgcggctccggcacctgaagggacgcgggcgggcgcgggcagctccgaccggcggcggcggggcgggacaggcagcccggcggcctccgatggccccgccgtgagaggccggacccgcggcggggaccagcagcggtgagtggggccgcggggctccgggacccgcccctccccgctggcggccaggccggggcgggacgggccggggagagggccgcgtgcgggtggggggcgtcgccctcgccctcggtgcccacccgggtccgctaacaaagctacatttccagatcaattccgcggcgtctggagcatccgaaggatacggttgtcatggagatggggccgagagaggaagcccgggctggccgggtctgggccggggagagggggcgccgcgggaaagcccgagcccagcctgagggacggtgggggctgccgggccgattgtctcc

SEQ ID NO: 92983 - DNA, 58 bp, Homo sapiens; identical to SEQ ID NO: 29929
  chr5:139175929-139175987
  hyper

SEQ ID NO: 92984 - DNA, 97 bp, Homo sapiens
  chr5:139227527-139227624
  hyper
cccgcgggggcggcccgcggctgtgtctgctgctggcccgcgtgctgtggctgtccagtgagtagtaagtcctgctgtcggccgccgggcacagtgg

SEQ ID NO: 92985 - DNA, 234 bp, Homo sapiens
  chr5:139227704-139227938
  hyper
cgtcgtccgcgtcgtcgtccgacgccgaggctgagccgccgcccgagccgctgctcagcgacagcgagtccctcgccgcccgtgcgcgctgcgccgccagcccgttgaggcgcgagcggcgccagcgccggggccccgccgacgtcctgcgggacgcaccgcgcgcgcgcggccgcggcggcggcgggggcgcgcactcctgcgtggtctcgtactcgtcgtcctcggggatgc

SEQ ID NO: 92986 - DNA, 913 bp, Homo sapiens
  chr5:139283550-139284463
  hyper
ccgccgcctttctgtcggtatccgcggctccatccccgctcgctcagggctgctcgcctgcaggccggtaccggcgtgcagcgcctcttgcccgcccctgcgtggggacgcggccgcccggggagaggcgcgcacagccactgtcgggctcctggcacgcagccccttgctctcccggccgcgacgacccgctcgcacgcaggcacgcgcgccctcggtgcctgtcaccgcggcggccgctagcgcagcctagactcacccgcgctgcgctgggggcgggtgagcgggcggcaggtttctcccagggaaaccgggtttctgggcgcgcggaggtgccctacctttctccccgggatcgggctccctctcccgcttcctcccctctgggtgcttcttgccgcggccgcggcccctcctcctggactccgacattctgcacggggtcccaggcggtgggacggcctcagctctccgctgccgcgctgcgcccccgccgcctgcagcctcagtgcccgagcgcggcgcctttcttataggcggtcacaccctccgggggaggggagcagcgagccttaactcttcccctcccgcgccctccaccctcgccccccctccaccggctcgggccgcgggggcgtgtgggcggccggtctgggccctaggccccctccctgggcccaccgaggtaggcaagaccggcgcctaaacagggcgccacagacctcctcgccgaagagggggcttgagctgggctgggggcctgagcatgattggggagggcggagtagagatcccccagcgagggccaggctaaggacagcatgggggtggggagacagcgaggaaagggcccaggaagggaccaaaatgaagcccgctagccagcccagcggggtagcgagcacccttggct

SEQ ID NO: 92987 - DNA, 62 bp, Homo sapiens
  chr5:139422801-139422863
  hyper
ggggcaggcggcaagcgggccgcgatgcgcagcgcggcgcagcgcagcgctcccaccctgtg

SEQ ID NO: 92988 - DNA, 70 bp, Homo sapiens
  chr5:139492746-139492816
  hyper
accctagccctggtgcgtctactgtcctctgctcggctccccccatcggtgagtgcgcccgcccgcccga

SEQ ID NO: 92989 - DNA, 391 bp, Homo sapiens
  chr5:139525423-139525814
  hyper
cagttcccagcctcccgccagattcttgcgtgacctcgggcggcacccagtgctgctgtggacagctcattccgccgcggcggcggctgcggctgcggcggctacaacggctcccggcgtgtccccggcgccgccagggggcgaatggggtgcccgccggctcctcggactccgggcgcgccggcactgcgctccggagaggcccggccagggaagaagcaacttccctccgccgccgcagaccagccgggcagagacttccagccccaccctcaagccctctcggtggctctgtgcgcccaggcctaggggtggggggccgtaggtgctgcgcgcccgcacaggtggtcaggccgtcagcatgcctggctcgtcgcgcacagaacactgc

SEQ ID NO: 92990 - DNA, 97 bp, Homo sapiens
  chr5:139556302-139556399
  hypo
gtggggcattggattcgctgaaaggagtcccatactatttgttgattgtagatcaaagatctctagacctggcctggtgcggtggctcacacctgta

SEQ ID NO: 92991 - DNA, 59 bp, Homo sapiens
  chr5:139686-139745
  hypo
agtcaggctccagcccggggacttctacctgcaggtcacgtcggcggggaagcagtcag

SEQ ID NO: 92992 - DNA, 32 bp, Homo sapiens
  chr5:139779839-139779871
  hypo
gcgtgagccacggcgcccgctatagaatctga

SEQ ID NO: 92993 - DNA, 30 bp, Homo sapiens
  chr5:139993-140023
  hypo
tgcacaggtcctgagcggctgcccagcagc

SEQ ID NO: 92994 - DNA, 48 bp, Homo sapiens
  chr5:140011748-140011796
  hyper
acatgcatctcggagcgctagggtttacggtggcgcgcagcgagttgt

SEQ ID NO: 92995 - DNA, 142 bp, Homo sapiens
  chr5:140012151-140012293
  hyper
ggcttccagaggcagcggaggcatggtgccggttatctttaggtcctcgagcgtcagttccttgaggcgggagtacgctagcacacgcagggcgcctaccagtagctgagcaggaacctgtgcggctcccactgtgagccgc

SEQ ID NO: 92996 - DNA, 156 bp, Homo sapiens
  chr5:140012364-140012520
  hyper
cggctctaggttgagaccgccggcatggatctccacctctactgcagacacacactggaaggcttcggaccagtcgggctgaggttcggagaagttgcagacgcagcggaaatcttcatcgtccagctcacaaggttctggcgtggtcgcagagac

SEQ ID NO: 92997 - DNA, 27 bp, Homo sapiens
  chr5:140045321-140045348
  hypo
cacgcctgtaatacccgcactttggga

SEQ ID NO: 92998 - DNA, 30 bp, Homo sapiens
  chr5:140088640-140088670
  hypo
tatcttctggggcaacgcatcaaagtccca

SEQ ID NO: 92999 - DNA, 114 bp, Homo sapiens
  chr5:140174726-140174840
  hyper
gtgccgcgcctgttccgggtggcgtccaaaagacacggggaccttctggaggtaaatctgcagaatggcattttgtttgtgaattctcggatcgaccgggaggagctgtgcggg

SEQ ID NO: 93000 - DNA, 198 bp, Homo sapiens
  chr5:140187083-140187281
  hyper
ccacctggaggtgatcgtagacaggccgctgcaggttttccatgtggacgtggaggtgagggacattaacgataacccgccggtgttcccagcaacacaaaagaacctgtccatcgcggaatccaggccgcttgactctcggtttccactagagggcgcctcggatgcagatatcggggagaacgccctgctcactta

SEQ ID NO: 93001 - DNA, 55 bp, Homo sapiens
  chr5:140214378-140214433
  hyper
aaggaatctgttcatcgcggaatccaggccgcttgactctcggtttccactagag

SEQ ID NO: 93002 - DNA, 116 bp, Homo sapiens
  chr5:140248756-140248872
  hyper
ctgggaggtggggagcggccagctccactactccgtctcggaggaggccaaacacggcaccttcgtgggccgcatcgcgcaggacctggggctggagctggcggagctggtgcagc

SEQ ID NO: 93003 - DNA, 142 bp, Homo sapiens
  chr5:140261869-140262011
  hyper
aaggaggcccaagaccgcggcaactactgctctggcttctgatcctcgcagcctgggagacgggtagtggccagctccactactccgtccccgaggaagcaaaacacggcaccttcgtgggccgcatcgctcaggacctggg

SEQ ID NO: 93004 - DNA, 770 bp, Homo sapiens
  chr5:140305402-140306172
  hyper
tctttggggacgggtcgtcaagtctttgagtttctagttattgctattgactggtttataacctcctctttcacccagatcgtcaagggccgtttgcaaagcactcccaagtagagcctcttggagaaggagaaactgctatcacgcaaaaaaaaagccttgagctcgctggctccgctgcctcgaaaagccagagtccggaggcagtttgatgcggacactattccccaaccttcttcccctccttgtcgtctctattgccctcttggcagctcctgggatacaagagggtgcaggacagacttcaacccgcagcaggatccagcgcggaaagctctgcagcaggatccagcgcggaaagccccccgcagcacttctttcggggggctcctgtttccttaagcctagaaggtgtggtcgctcacgttcaccgtcccgcctctcgccgcctccgctcggcagctccacgctgagtcccgccctctccgccggagaggtgcgccggggtcagagcgccgggacccgacgcgcggctcccaaagggcggcaggaagagcccagctgggctcagccacagttatcagcaatctgcgggcagaggatgtggaggttaagatctgggcagcctcagggcgttgtcctagaaaacaccgtttaaggagagaagtgttagtgtctcggggcgtctcccaggctccgccctgcgcccgcagccagcgtggtggtcgagaccccagcccgctgctactggagacagcacctctcgcgcc

SEQ ID NO: 93005 - DNA, 176 bp, Homo sapiens; identical to SEQ ID NO: 8069
  chr5:140306444-140306620
  hyper

SEQ ID NO: 93006 - DNA, 113 bp, Homo sapiens; identical to SEQ ID NO: 29943
  chr5:140306674-140306787
  hyper

SEQ ID NO: 93007 - DNA, 97 bp, Homo sapiens
  chr5:140307010-140307107
  hyper
cggcagcgaatacccggagttggtgttggagaaagcactggatcgcgaacagcgcgccacccacctgctggtgcttacagctcgggacggcgggcta

SEQ ID NO: 93008 - DNA, 537 bp, Homo sapiens
  chr5:140345497-140346034
  hyper
ttttaggcttgctcccggaaagagggcagcatttgccatccccctccttttgccctaggagttgagcactttctgcagtacttaagagtgtccagggaagatgtgggagtcaggtgaatagttcccatcgccagtaaccccagagcgcctccccctgcgttgtttccttttaatgttagatccgccgcctgggtgcccatacttagctaaggcccctcagtttattttcctgaattgcgcttggagatcttttcctggggagctgatagccagacttctaggggcttgactgcttttcccagactaatctccttaaagacccgttaagcaggggagagacggtggagactggatgaactggacagtgggggtagggagaaagggagtggccgtgttcctgcggtccgctgggatccggcaggtccagggtgaaggagatggggctggagaggctgagcagtccgggttcgctgtccgccacttcggcgcggaatcagagcaggacttgctgagccctcctaccgctccctttccccc

SEQ ID NO: 93009 - DNA, 307 bp, Homo sapiens
  chr5:140346506-140346813
  hyper
ggcacccggcgcgctcgtgggcaacgtggctcgcgcgctggggcttgagctgcggcgcttggggccgggttgcttgcgcatcaaccatctgggtgcgcccagtccgcgctacctggagctggacctgacgagtggagcgctcttcgtcaacgagcgcattgatcgggaggcgctgtgtgagcagcggcctcgctgcctgctcagcttggaagtgctggcgcacaaccccgtggcggtgagcgccgttgaggtggaaatattggacatcaacgacaactcaccgcgtttcccgcggcccaactaccag

SEQ ID NO: 93010 - DNA, 37 bp, Homo sapiens; identical to SEQ ID NO: 40381
  chr5:140350-140387
  hypo

SEQ ID NO: 93011 - DNA, 30 bp, Homo sapiens
  chr5:140464113-140464143
  hyper
gattttgacagtttccgcaggaaagcgctg

SEQ ID NO: 93012 - DNA, 30 bp, Homo sapiens
  chr5:140474232-140474262
  hyper
ggaggctttctaaggcggtcgctccgggaa

SEQ ID NO: 93013 - DNA, 261 bp, Homo sapiens
  chr5:140514695-140514956
  hyper
aagggtatggatacacgtcagttagaatttaggatgaaatggcaaatactatatgcaatagtaaattaggacgcctggtggcgctgcaggctaagagtgtggatagtgggctctgcggataactcagacgccattaagctggggaatccaaactctaaaagaaggacgcattttaggtaagatctagtggctagatcttcagggtgggcttcgttcttgtggaaatcagtcaagaaagatcggattcgcggttatttatgc

SEQ ID NO: 93014 - DNA, 93 bp, Homo sapiens
  chr5:140581545-140581638
  hyper
agggcatctggtggacgtgagcggcaccgggaccctttcccagagctaccagtacgaggtgtgtctgacgggaggttccgagacaaatgaatt

SEQ ID NO: 93015 - DNA, 182 bp, Homo sapiens; identical to SEQ ID NO: 29948
  chr5:140593316-140593498
  hyper

SEQ ID NO: 93016 - DNA, 75 bp, Homo sapiens; identical to SEQ ID NO: 29949
  chr5:140604438-140604513
  hyper

SEQ ID NO: 93017 - DNA, 210 bp, Homo sapiens
  chr5:140613804-140614014
  hyper
atattttgtctgaaacgtattggaatttatctaaaacctgaatatctgcagagtcgcatggtggcgctgcaggataagacggtgaaatttttgtaaccgcagatgctctggttttccttaaccatgggaactgaaagcgctggaataccaggagaaaatagtctttcaaaaggtagggcaccatcaacaccttcgcgacaggattaagag

SEQ ID NO: 93018 - DNA, 15 bp, Homo sapiens
  chr5:140614314-140614329
  hyper
cagagtcatctttga

SEQ ID NO: 93019 - DNA, 28 bp, Homo sapiens
  chr5:140614383-140614411
  hyper
cgagcagctggaccgggaggcactttgt

SEQ ID NO: 93020 - DNA, 23 bp, Homo sapiens
  chr5:140620855-140620878
  hyper
caccctgttcgtccgcgagaaca

SEQ ID NO: 93021 - DNA, 29 bp, Homo sapiens
  chr5:140624988-140625017
  hyper
cctgttagcagagcacggaccagtgtctc

SEQ ID NO: 93022 - DNA, 170 bp, Homo sapiens
  chr5:1406427-1406597
  hypo
tgtccatcagggcagcgcattcccccgatgctggacacgtgtgggggtcctcgctgactcccaagggccccacctaccggccccaggcttcggctgcacccagcctcctgcagaggaggccaggccacaccccagcccactgggtgcctcgctgacgggtgggagcccac

SEQ ID NO: 93023 - DNA, 120 bp, Homo sapiens
  chr5:140713966-140714086
  hyper
aagatccttggagccctggagttcaagaccagccggacagggcggcctgcgactgtagtcccagctacgcggggcggggaggggcggggcggggcggggcaggagctgacgtgggaggat

SEQ ID NO: 93024 - DNA, 19 bp, Homo sapiens
  chr5:140714146-140714165
  hyper
tgggcgacagagccacacc

SEQ ID NO: 93025 - DNA, 95 bp, Homo sapiens
  chr5:140767211-140767306
  hyper
aagtggagagcttggcgctccagatctcctcgcgcagccgcagcgcgctttccagggcagccccagctcagactccccagcgccagcctttacac

SEQ ID NO: 93026 - DNA, 212 bp, Homo sapiens
  chr5:140777457-140777669
  hyper
aagtgcagagcttggcgctccagatctcctcgcgcagccgcagcgcgctttccagggcagccccagctcagactccccagcgccggcctttacaccgcttcctcctcggaaaaagaatcgtttcctaaactggaactggaactaaagcccgttcggagatccaaaaatctacaatacagaggttatttgtaacctggcgtctccaggctggt

SEQ ID NO: 93027 - DNA, 85 bp, Homo sapiens; identical to SEQ ID NO: 29956
  chr5:140787848-140787933
  hyper

SEQ ID NO: 93028 - DNA, 203 bp, Homo sapiens; identical to SEQ ID NO: 29957
  chr5:140797076-140797279
  hyper

SEQ ID NO: 93029 - DNA, 312 bp, Homo sapiens
  chr5:140797327-140797639
  hyper
cgggactcctcctgtcctgggccgaatgctcttttagcgcggtagagtgcactttctccaactggaaaagcggggacccagcgagaacccgagcgaacgatgggagggagctgcgcgcagaggcgccgggccggcccgcggcaggtactatttcctttgctgctgcctttgttctaccccacgctgtgtgagccgatccgctactcgattccggaggagctggccaagggctcggtggtggggaacctcgctaaggatctagggcttagtgtcctggatgtgtcggctcgcgagctgcgagtgagcgcggag

SEQ ID NO: 93030 - DNA, 528 bp, Homo sapiens
  chr5:140800437-140800965
  hyper
agtattgtgtatcatcgtttttaagctctacaaatacgtgtgattcacaaaggtgagcgtaatcatttcttctggaatttcttagtcgttgcaataataagaatgggctctaggcgccgctgctcaccaatcagggaatgggaagctgcgcgccattgagtccctccctcccccgcctctaccacacaaagcggaatgagatggatactcacagatcctgacactggagacttagaagtattttccttcgctttctgatatattttggatgtagtcggcctaggacttcatagatacataagccgattcacaaccaaccagctcgagaaaccgcggaatatcggcttagagcctgccatggcgaatcggctacagcgcggggaccgcagtcggctgctgctgctgctgtgcattttcctggggacgctgcgggggttccgggccaggcagatccgatattcggtgccagaagagaccgaaaagggctccttcgtgggcaatatctccaaggacctggggctggagccc

SEQ ID NO: 93031 - DNA, 228 bp, Homo sapiens; identical to SEQ ID NO: 487
  chr5:140801034-140801262
  hyper

SEQ ID NO: 93032 - DNA, 10 bp, Homo sapiens
  chr5:140810974-140810984
  hyper
gggggcgacc

SEQ ID NO: 93033 - DNA, 861 bp, Homo sapiens; identical to SEQ ID NO: 488
  chr5:140855598-140856459
  hyper

SEQ ID NO: 93034 - DNA, 144 bp, Homo sapiens
  chr5:140856546-140856690
  hyper
cgccggcgtgcggcaactattcgccttagaccttgtaaccgggatgctgacaatcaagggtcggctggacttcgaggacaccaaactccatgagatttacatccaggccaaagacaagggcgccaatcccgaaggagcacattg

SEQ ID NO: 93035 - DNA, 89 bp, Homo sapiens; identical to SEQ ID NO: 29963
  chr5:140864611-140864700
  hyper

SEQ ID NO: 93036 - DNA, 30 bp, Homo sapiens
  chr5:140892846-140892876
  hyper
tgcagtctaagcttgcggctgtctccaggc

SEQ ID NO: 93037 - DNA, 77 bp, Homo sapiens
  chr5:141030807-141030884
  hyper
gggtctgaccccttccgacttcccgtctcctaccacaagtcggatgcccccttagctccctccgttcccccagcccg

SEQ ID NO: 93038 - DNA, 30 bp, Homo sapiens
  chr5:141031100-141031130
  hyper
aacctgttactgctgcgaatacgccggcag

SEQ ID NO: 93039 - DNA, 227 bp, Homo sapiens
  chr5:14108613-14108840
  hyper
ggtagaaaacacacacgcacacgcgcacacacccctatctttattttccccaactcctgaacgagagttacagtttcaagatttcttttaccagggctccccaccgccgcccccaccaccatccgccaccttggtcagcagggaccataaaataagcagttgcagatcgtgcccagtagggggaggagtgcccataagtcttccactaaatccgaggcctttctgaa

SEQ ID NO: 93040 - DNA, 33 bp, Homo sapiens
  chr5:141255658-141255691
  hyper
actcctcccagaggacgccgagtgtgtgtgtgt

SEQ ID NO: 93041 - DNA, 425 bp, Homo sapiens; identical to SEQ ID NO: 29965
  chr5:141262718-141263143
  hyper

SEQ ID NO: 93042 - DNA, 63 bp, Homo sapiens
  chr5:141263260-141263323
  hyper
cgcctggcccggatgagcttggatgcagctccgaacgtggggatccatcggtgctgagaactg

SEQ ID NO: 93043 - DNA, 345 bp, Homo sapiens
  chr5:141293717-141294062
  hyper
ttaatcagaaatgaacgctgctttccccctcaaggctggagggaacgtgatgcaggcagtggagctgcgggctcggccccgggatcgtggggagagagagccccctgccgagcgcggaggggcgccctccctcccaggccccgggccaccgtctggggtcggttccctccagatttcacagccgcggcagcagcaggagcgcgcacacgcccgcgcccactgcactgcggcggtgctccgcagctcagcctcggggccatcacgtgggtgcggcctgaccccgggcgattctggggccgtctccgcaggcagttgagcctgccgctggggcgctcctctggtcag

SEQ ID NO: 93044 - DNA, 40 bp, Homo sapiens
  chr5:141302337-141302377
  hypo
cttgaatgtaagctccgttatttcacggattcaaatgtgg

SEQ ID NO: 93045 - DNA, 118 bp, Homo sapiens
  chr5:14142698-14142816
  hyper
agcgctggtttgacacggatcttccgcaaaggaacatttcttttggcctccccagaccccgtcatcttccccattcattctggcggagtaaggactgagaaaccgtgaacccgaggtt

SEQ ID NO: 93046 - DNA, 30 bp, Homo sapiens
  chr5:141477290-141477320
  hypo
ttattttctggtcctcgtgtaatcttattt

SEQ ID NO: 93047 - DNA, 79 bp, Homo sapiens
  chr5:141703865-141703944
  hyper
gaattcagtccgtcacggctccgaagagaaagaaaaaatctacgtcgagcataggccgctacggcgggctgggagatac

SEQ ID NO: 93048 - DNA, 49 bp, Homo sapiens
  chr5:141931306-141931355
  hyper
aaatgtgctcattcccgaggaagcctcacttctccttctcgcccttaat

SEQ ID NO: 93049 - DNA, 79 bp, Homo sapiens; identical to SEQ ID NO: 29968
  chr5:141931424-141931503
  hyper

SEQ ID NO: 93050 - DNA, 95 bp, Homo sapiens; identical to SEQ ID NO: 40602
  chr5:142070580-142070675
  hypo

SEQ ID NO: 93051 - DNA, 68 bp, Homo sapiens
  chr5:1422073-1422141
  hypo
gcggaggccccaggtcgtcgatgccatggctctggtggaggtgcagcacgccacgtctgcagagggga

SEQ ID NO: 93052 - DNA, 158 bp, Homo sapiens; identical to SEQ ID NO: 40603
  chr5:142625575-142625733
  hypo

SEQ ID NO: 93053 - DNA, 30 bp, Homo sapiens
  chr5:142638926-142638956
  hypo
tcagagattcctccacggtaagtacctgcc

SEQ ID NO: 93054 - DNA, 30 bp, Homo sapiens; identical to SEQ ID NO: 40604
  chr5:142689842-142689872
  hypo

SEQ ID NO: 93055 - DNA, 30 bp, Homo sapiens
  chr5:142751146-142751176
  hypo
aaaccgtgggcttggcgagaagagccttgg

SEQ ID NO: 93056 - DNA, 155 bp, Homo sapiens; identical to SEQ ID NO: 29969
  chr5:142781720-142781875
  hyper

SEQ ID NO: 93057 - DNA, 540 bp, Homo sapiens
  chr5:142784675-142785215
  hyper
tcgggaaggcttggacgatgccgggaccgagcctcctaccttgtgcggcacagattatgatttttgtgactctgggaaaggttgtgctgtgtgggtttagggtttggggaggtaacttttgcgcccccacaggtgacatcgcttgccagctcctgacacgggcgggggctgccgcagctccacctaatcctgctcgggcgctcggccacagccactctctcacctcccgccgcgctcagactgacggcggctccccctgctctgacatcttgaagacgattggggaagcgcgtcccggaagccgcccgccgccatcttggtagggtacagtgtcgccagcccgtccccgcggccaccatcttggcaaaggttcgcgatcgcgggtagcctaagccgtccttccttggttctcaagggtaaacggttccctgtgcattgtctgatgtgaaaggaaagaagtaggctttcagcaagcctcttgtccggagacgatctacgggggccgcctccagaggattctggagccgccatcttggcaaa

SEQ ID NO: 93058 - DNA, 30 bp, Homo sapiens
  chr5:1429032-1429062
  hypo
gtcaaatttatgacacgtcatgtttcgtac

SEQ ID NO: 93059 - DNA, 30 bp, Homo sapiens
  chr5:1429795-1429825
  hypo
cagggcgttgggtaccgggaactctcaggc

SEQ ID NO: 93060 - DNA, 213 bp, Homo sapiens
  chr5:1431070-1431283
  hypo
attttggcatataaacgtgaataagatgcgtctaaccaggcaagcgagccccccaaacaggagcgccctggctgacgggaaacactggatctggggagaatcgcgcaaacgtcctctcctcctctccaaaatgacggctgagtcgaagagtccgcctgtcagaacggcgacccggcacgaggccccaggcccggctggcgagggcaggaagat

SEQ ID NO: 93061 - DNA, 287 bp, Homo sapiens; identical to SEQ ID NO: 29971
  chr5:143584834-143585121
  hyper

SEQ ID NO: 93062 - DNA, 88 bp, Homo sapiens
  chr5:1444675-1444763
  hyper
tcacgagctatgccacgcacccggtgacaacctcaaccggcacgacccctccggtgggtaaaacacccgacgaaggggttccgcggcg

SEQ ID NO: 93063 - DNA, 405 bp, Homo sapiens; identical to SEQ ID NO: 29366
  chr5:1444851-1445256
  hyper

SEQ ID NO: 93064 - DNA, 76 bp, Homo sapiens; identical to SEQ ID NO: 29367
  chr5:1445485-1445561
  hyper

SEQ ID NO: 93065 - DNA, 5 bp, Homo sapiens
  chr5:1445562-1445567
  hyper
gcctc

SEQ ID NO: 93066 - DNA, 192 bp, Homo sapiens; identical to SEQ ID NO: 29369
  chr5:1445568-1445760
  hyper

SEQ ID NO: 93067 - DNA, 261 bp, Homo sapiens; identical to SEQ ID NO: 29370
  chr5:1445840-1446101
  hyper

SEQ ID NO: 93068 - DNA, 134 bp, Homo sapiens
  chr5:1446236-1446370
  hyper
cgcactcgcctaagaaaaccatttcccgggacgggcctggaaagccctggcggttggtatccggctccagggccgaatggactccgaggctttccttccgagatgcccgggcgggatttcttccattcagcgcg

SEQ ID NO: 93069 - DNA, 157 bp, Homo sapiens
  chr5:1446442-1446599
  hyper
cgcgcccagctctgtgcgtcgcccctagggtcgcccgaaccccggcgttcctccccgtgtaccctcgatgctcccgtgagcaccctgccctgggcgtccaggcgagccctggggctctccagccattccagcctgcagcccgcgctcagcagtgagg

SEQ ID NO: 93070 - DNA, 56 bp, Homo sapiens
  chr5:14501805-14501861
  hypo
aggtgaggaagcccacgtgaagatagggatgggcagatgctcggcctgggctggac

SEQ ID NO: 93071 - DNA, 289 bp, Homo sapiens
  chr5:145214863-145215152
  hyper
agctgcccagggctccgcagaggcccggaggcgcccacactcggacagccacatgggcgtggcctttttcctccgcttttcaaactttcgaaactttattggccactcggagaaacgcgcagtcggccacgcccacgcccctactgccagagtccggggcctggggttacagagcgcgggaggcgctggagcgctcccagagcacccggggccccgcggtctccacgctggcggcgccagagcggccctggtgccctcccgcggccgcgcctgccgagaaaagcttctc

SEQ ID NO: 93072 - DNA, 21 bp, Homo sapiens
  chr5:145237564-145237585
  hypo
acggaatattcctgtcgaaaa

SEQ ID NO: 93073 - DNA, 141 bp, Homo sapiens
  chr5:145316085-145316226
  hyper
cagggctgggtaaggcgatcccttgaaatgagtaagactgagtggttaaagttttcaaagcggttggcagcagcggcgcttggaggaaaggaagccggttggagggcgcagcgcacccctgctgcgcggaggagggggctg

SEQ ID NO: 93074 - DNA, 270 bp, Homo sapiens
  chr5:145713626-145713896
  hyper
ggagggctcctggcacgtgccgagccctcacggacgctcggcctctggcccctgaatccctctgggcgtctcggatcctctgagccactttgcagacaatgcaaggcagcggccaacagacgagtcccgcagcagctgcgcaggcggcgagtacatgtgagaagtttgtgaaaggcgaccagagaaagggagaggaaggcaagtcaggcggctgcgaacacctggccaggcagccccgccagctgcctcgctgcgcgatggcatcttgag

SEQ ID NO: 93075 - DNA, 317 bp, Homo sapiens
  chr5:145716880-145717197
  hyper
attccatttaagagccgccgaaaccgaggctcagagggctttagcgaaagggttgcgcttggctctaggcacctgggctgagtctttttcccaccatcgcagggcgggaaccagcggagggggctggctcggatggggagaaaagcaactggagggcgccgaggggaagagggagcccggatctgtcagggcgtcctcttggactaagggatgttcccctaaaccacaccaccccacctcgttcagattctgggaaacccggcacgcacataccctgcacaataacaggcagggtgaggtctctaagccccgaagat

SEQ ID NO: 93076 - DNA, 189 bp, Homo sapiens
  chr5:145717248-145717437
  hyper
cggggtttctctccgaaccggagtgcagcgtagtcgaggtccaggattccccatccattattcacgatgtttactagagcggggcaagggagaggaaagaagagggaagtagagagaaaaagaggctaggggaggtggaggcgggcagtgctaacctcgagagccctcaagttccgaaactttgagaag

SEQ ID NO: 93077 - DNA, 265 bp, Homo sapiens; identical to SEQ ID NO: 29977
  chr5:145717780-145718045
  hyper

SEQ ID NO: 93078 - DNA, 70 bp, Homo sapiens
  chr5:145718431-145718501
  hyper
tctctcctcacctcccgggccgcccctgcgagtccccggcgcgtgagcacgcctgcgcgcgcccgggccc

SEQ ID NO: 93079 - DNA, 952 bp, Homo sapiens
  chr5:145718802-145719754
  hyper
gtggagcataattaccgctctaaggcacattttttgacaggcactagcttcatgtttttttcatgtcgcccagaacaatcgccgctgtctgaacccctctccttgtctcccccgcgttctctcccggcgcgctctctctctcattcatgtctctgatccacacgtctgttccagcagagccgctgcctccgtattaatttttatgacctgggctttgaggagaggcatctcggttgcttgaaaatgtgttttaatcctgtgttgacagtattccctactgaccgtgctgtgcgccttctcgcttgcagctgcagggtaatatatttggaagctttgatgagagcctgctggcacgcgccgaagctctggcggcggtggatatcgtctcccacggcaagaaccatccgttcaagcccgacgccacctaccataccatgagcagcgtgccctgcacgtccacttcgtccaccgtgcccatctcccacccagctgcgctcacctcacaccctcaccacgccgtgcaccagggcctcgaaggcgacctgctggagcacatctcgcccacgctgagtgtgagcggcctgggcgctccggaacactcggtgatgcccgcacagatccatccacaccacctgggcgccatgggccacctgcaccaggccatgggcatgagtcacccgcacaccgtggcccctcatagcgccatgcctgcatgcctcagcgacgtggagtcagacccgcgcgagctggaagccttcgccgagcgcttcaagcagcggcgcatcaagctgggggtgacccaggcggacgtgggcgcggctctggctaatctcaagatccccggcgtgggctcgctgagccaaagcaccatctgcaggttcgagtctctcactctctcgcacaacaacatgatcgctctcaagccggtgctccaggcctggttggaggaggc

SEQ ID NO: 93080 - DNA, 103 bp, Homo sapiens
  chr5:145719834-145719937
  hyper
cggcgccggagaagcgttcactcgaggcctatttcgctatccagccacgtccttcatctgagaagatcgcggccatcgctgagaaactggaccttaaaaagaa

SEQ ID NO: 93081 - DNA, 346 bp, Homo sapiens
  chr5:145720018-145720364
  hyper
cgcagcgtcgggagccgggagagcctagtgctcatccctcccgggttcgggggatggttatcgggaactccaaggcgtttcctaggcaggttaggctctctcctccgaagccacagactttccccctttgtcccgcctggttgcctccggccttctctctctttcctttctattcccaccaaaaaaattttggcgctgggaaaatattgcagaagggcgggcctgagtgtacttgtgctgtccgtggtgctgaaatttgccctcgcgcaggggccgcacgacttcagagcaggagccccaaagcagaggacagtcaattggcccaaccgcccgaagctagggtgaa

SEQ ID NO: 93082 - DNA, 30 bp, Homo sapiens; identical to SEQ ID NO: 29983
  chr5:145720837-145720867
  hyper

SEQ ID NO: 93083 - DNA, 351 bp, Homo sapiens
  chr5:145722116-145722467
  hyper
cacatttccctgcttcgtcctcaaagagttgcgggtcatcaaaccacggggccgaaattcggagcagagtgggtttgccctccgcgcagtgcgacaccccctaccgcataagctaacttgcggatctcccccagctccctgggcctcagccctttacccccgccttgcacaacagccccagcgattcctccacctccctctccatcgggtgtcctttaataataaatgcccttatgccattacattatattgtgggttttgaaaatttaaaatacggctgatgcaatattaattgcctatagtggtataaaacacagggcaggagcccagccgggctgcagaggagacaac

SEQ ID NO: 93084 - DNA, 467 bp, Homo sapiens; identical to SEQ ID NO: 491
  chr5:145722560-145723027
  hyper

SEQ ID NO: 93085 - DNA, 169 bp, Homo sapiens; identical to SEQ ID NO: 29986
  chr5:145723301-145723470
  hyper

SEQ ID NO: 93086 - DNA, 518 bp, Homo sapiens
  chr5:145724320-145724838
  hyper
aagcttaaaagaaaccgctttgcacactgtgcgtcccagctacgcaaggaacgaagtattctctccctgggagtgcctggtgcgaatacatagctcccactgagaagcttggccccggtcagcggctccaggagcccggaacctcctccctggcggaatcccgggcaccattcagccttttcgaaggctccagacttcgcgctgctcctcctcccgaggaggggcggggcgccagagggcaaaggagaagcaagggtcttggactcctcctccttcccagcgaacatcccttccccgccctgttcccactttttggccccggcgccagaatgtttgagccgaaggggcagaacgcctaaaagccgtgtttgtttatttatttatttatttatttatttttattttttaaatcgaagaaggcagtgaggcctagagagcaggacggacttagctggctccttttacctaaaacagctcttctccaatcacgttatcacaccgcccgttttatttctttc

SEQ ID NO: 93087 - DNA, 15 bp, Homo sapiens
  chr5:145725173-145725188
  hyper
tgcctttgcttcttc

SEQ ID NO: 93088 - DNA, 277 bp, Homo sapiens
  chr5:145725693-145725970
  hyper
cgcgactcccagggctccccggctgggtcagggttcgcccgctcctcccggcgcctccggataggggcttcccttcggctgcgtcccggcctgaggagtcccctggaccgcgggaggggcgattgccgggtccgcgcggctcagaatcctccccacgcgttgcttatacctttctttgtaaactgtcagatttctgccccctccctcagttcagccctgcgcagccttgcctgccactggaggcaaactgggacagaaactgcgctcgctctctttt

SEQ ID NO: 93089 - DNA, 557 bp, Homo sapiens
  chr5:146256927-146257484
  hyper
ttttaaaggccccaccgatcgcgttgctcaccccacgtgtcagcctcattcgctgcccgccagagcactatttccccagccacctttttatttttgctaatgcacttccaaaaggaaagaggttcgcccgtctgcaaagggctttttggggttttgattgtctaagcaggtaacctggccggccggggagatgaatgggcaggaaatgaaaccttgccctccctgcagccactgagagacataacatcgtttcgctcagggaggggggaccaaggtcctactgggcccctcccttcttatctccccccaagacccctgcgaacatctcggggaaggggtcatctgccttcctggggtcatctttctgggcgagagccccaccctgaaaaagcctaatccctgagggccattttaactcccgtgggcgccgggtccacctgctgctgaacgccgagctcgcctcgcggagcccggatggatgcgaggtgcactggggctgccggggccagccgagcccccgccccagccctagggcccggaggagtctccgccactac

SEQ ID NO: 93090 - DNA, 997 bp, Homo sapiens
  chr5:146257485-146258482
  hyper
cgcccagctgcccaggaagcacagtgatccgcaacttgcgcccggccccaacggcggaatgcggcggggctggcgttaccttcggtcgcatagctgtggtcgcgcaggaaactgttgttgattttgcgggtatcaatgtcctcctccattgacagcaggcttacttgcgtgggaaccagaagccggcagacaagtatccatgatccctccccgcagccagtctcacaggagaggggggcaggggagccagtgggactgcaccatggtccgagcctgaggaggagacggggaggcggagagaaaaaaaataaaaacccggcaatggagctgtcacctcctccactcgggttctgcgaggctgcggcggctcctcccgcgcggtgcgctcactccagctccagttcccagcgaggatgctgcgcctgcctccgctgcctccgggtgccaagatacgccgtgccccgaggggtctggtcccgcccgcccgccccggaggcgctcacaagcgggtctggggagatgcccaacaggttcccctccttggcagccgctccaaaatgcaaaaaagatccctcctccccctgggagagcgggcagccgcgacaaaatggtgcctttctggacccgagctgcagtggcgagatggcagggacaggattcaggcttgcctggccggaatgagggtgctggtcccacgggagggcggctccggcaggcgggggtagggaagctggcggggagctgggcagggcgctgcagccggcgccagcgcactcaccctcacacccacacgcgcgcactcgcagctgctgctgctgctgctgctgctgctgctgcaggaggctggaggcggctggtgcattaaaggcgaggctcctcccaaccgcgtcagcagccccacgactctttcccagcagcagtggtggccgaggcagaggctgcggctgctctttgctgcagtggggcgcatgcagccgcgaatcggcacctgggcagc

SEQ ID NO: 93091 - DNA, 375 bp, Homo sapiens
  chr5:146614106-146614481
  hyper
tccccctcaaccccccggcttttaggatccacatcgcaggggggtgaggcacccccggcgatatggagagtaatagcaccccccttctcccccccccccccccccggctattacgatccacatcgcagggggggtgaggcagttcccgtgatatggggcgtaatagtacccgctgtgcgtcctggtggctccggacccggcccaagcgcggcgggacctccatccgtagccctctcccccaacgtcgccctcccggggtccttgtctagtctcagcaggcggcaaacggaccccaggcgtctggcgctcacccaggagactgcccagcggtttctggagagagcgctaagcggagacgcccgctggcaagcagat

SEQ ID NO: 93092 - DNA, 65 bp, Homo sapiens
  chr5:146614703-146614768
  hyper
cctggatgaaagcatcgctccgagcctcatgggaggaatgaaggaagaatcgagactaggtgagt

SEQ ID NO: 93093 - DNA, 36 bp, Homo sapiens; identical to SEQ ID NO: 29996
  chr5:146832654-146832690
  hyper

SEQ ID NO: 93094 - DNA, 158 bp, Homo sapiens
  chr5:146833012-146833170
  hyper
ccaggccagagaagccggcgggatccgagccgaccccgcccgcagcgcagcggacagggagcgagcgaggagggagggagcagcggcgcccggactcaccgtgatccgcgggatgttcttcttgccttggtaggacatggtggcggtggtggctgcag

SEQ ID NO: 93095 - DNA, 106 bp, Homo sapiens
  chr5:146833649-146833755
  hyper
tgggagcatcagctacgccctcccggccgcggggccgagttgcgggcgccgccgcccccagccagctcctcgtcggatctcctaccttccccgccctagtttcaga

SEQ ID NO: 93096 - DNA, 372 bp, Homo sapiens
  chr5:146888811-146889183
  hyper
cccgggcatcccttccgcgcttgcacgaagatgctgcaagtggcgacacgcgcgaatccagggtctgggctaggaagtcgcgctacgctcagtggaggatgaccctttcctcctccttgtcccccagccccgtgcaaagtgagctggagaaagttgtgcccgggccatggcggccagggctggagaaaggaacgaaggcaaggagggaagtgacccggggcccccttaccttgtccttggggccgaggttctgcaacacctctttgccggtggcgctccggatctctaccccggcgggggcgggggaggcgggcgcgggctccctgctctcttcccggccttggcccctgcgcggggtgtccccctcgatcc

SEQ ID NO: 93097 - DNA, 207 bp, Homo sapiens; identical to SEQ ID NO: 8108
  chr5:146889331-146889538
  hyper

SEQ ID NO: 93098 - DNA, 303 bp, Homo sapiens
  chr5:146889539-146889842
  hyper
ccagaggcggcagtgctgctccgattcctgcttgtccctagcgagccagcgagccacacagccagctagcgcgcggagcaggggcccagagtagcgccgcgcttggctcactcgctggacctctcgcccggccgcacctcctcacgcacccccaaccctaacgtggcctcccgggctgacgcagcgtcggtgcccatcacaatcacaaaccaaacttggcgcgcgcgcacacgcacacacaggcgcacactgcccgctcgcgcaacagccttgcctcacacactttcgcgcaatttagacgtc

SEQ ID NO: 93099 - DNA, 30 bp, Homo sapiens
  chr5:14726922-14726952
  hypo
cccatttctggggaacggtgcttaaggtgt

SEQ ID NO: 93100 - DNA, 108 bp, Homo sapiens
  chr5:14731965-14732073
  hypo
tttcagcaatgcatacggccacagctgtgtgggacagggcaacgtggggagagacgagacacacgggaggcccagggagctgcgcgagtgtcacgtgaacaggggtca

SEQ ID NO: 93101 - DNA, 30 bp, Homo sapiens
  chr5:14740939-14740969
  hypo
caccttcacggcctccggtcctctttatta

SEQ ID NO: 93102 - DNA, 32 bp, Homo sapiens
  chr5:14741558-14741590
  hypo
ggaacactgaagtaacgcggattaaatttgga

SEQ ID NO: 93103 - DNA, 235 bp, Homo sapiens
  chr5:14756250-14756485
  hypo
gagtgaaggactgcacgcaggtatttatttagtaccaattgtatgtagactagtgcgctattaggtttgtatgcctggcaggaaagctgaaggaataccaagaatggaagaaacacaatctctgtctctcaagcgtctcagtcccaaagtagcatccttcccacgtgatgcagatcataatgagggctctcatttgggtctgagttattacagtcattaccggtgctcactgact

SEQ ID NO: 93104 - DNA, 83 bp, Homo sapiens; identical to SEQ ID NO: 40505
  chr5:14764724-14764807
  hypo

SEQ ID NO: 93105 - DNA, 33 bp, Homo sapiens
  chr5:14774559-14774592
  hypo
tcctcaagacacagtcgcgctctgtcgcccagt

SEQ ID NO: 93106 - DNA, 32 bp, Homo sapiens
  chr5:14774712-14774744
  hypo
atcattaagttactatacgtccttcagtcacc

SEQ ID NO: 93107 - DNA, 71 bp, Homo sapiens
  chr5:148033722-148033793
  hyper
cccagccgctgcctgcgccctccctgccgccccctcgggtgcgggctccagcccccgcgctggggagccgg

SEQ ID NO: 93108 - DNA, 234 bp, Homo sapiens
  chr5:148033820-148034054
  hyper
cgggcgcaggaccccagccccggatcacctgggctcgccgcgcatcgtccttctccccaaccgagccggactccacgggctcaacagcccccagccccggtggtccccgctgccctgcccgctgccgcccccactgggcgccagggacagcgggggtgccgctctgccggcagggcgcacaggggagtgggcacagaggcgggctggagcgatctcacccgttccgggctggcc

SEQ ID NO: 93109 - DNA, 49 bp, Homo sapiens
  chr5:148205651-148205700
  hyper
gcttctgtgtgagagcgcgcgcgagtgtgcatgtcggtgagctgggagg

SEQ ID NO: 93110 - DNA, 247 bp, Homo sapiens
  chr5:148206185-148206432
  hyper
ggcttcttcagagcacgggctggaactggcaggcaccgcgagcccctagcacccgacaagctgagtgtgcaggacgagtccccaccacacccacaccacagccgctgaatgaggcttccaggcgtccgctcgcggcccgcagagccccgccgtgggtccgcccgctgaggcgcccccagccagtgcgctcacctgccagactgcgcgccatggggcaacccgggaacggcagcgccttcttgctggc

SEQ ID NO: 93111 - DNA, 272 bp, Homo sapiens; identical to SEQ ID NO: 30002
  chr5:148521059-148521331
  hyper

SEQ ID NO: 93112 - DNA, 964 bp, Homo sapiens
  chr5:148651223-148652187
  hyper
aagcccaagtgggagcgccgcggagggcgagcgagcggcagggcgcggcggggcgtgtgcggcaccacgggacagcgggctgcggcccagggggcgaggcgtgctcgggtctattccgggagcggctctgaggggcgggcgcgggcgcgggcggggcgggggctgccggcgagcatcctgtctgggggaggggaccgcagagagcgccggccgctgggctggcctgagagcgcagcgcgccggccgctaccagccgcgccggagcccctgcgccctgcggcccgctccccggggaccgggccggcgccatggaccgaggccagggtaagaggggccgcgacgcccgcacttgttgcggcgccgggcgggaaagggagactggacgatctgaagccggagaggaggagggagagaggcgggcggtggggcgggggctgaggaacgctcggaggggactgggagacgcggcgcttatgcaaaggtgccttcggctgccgggacaacccggtgcgtgtcaacgcccgtgtcctggggccaactcgcctctcgtgtgtgaaatcagagttttcataggctaacgatttgtaacttcataaaagatccccctctagtttccggaggacagcgagctcctcccacctcattccactctaaaggggaaaacaaggtgtacaggttcaactcccgaaacacccgctgtgggcagcccctagggagaagctctaggggaccgaagtttgcagctgcctagggcattgcgagaaggaggagcgccgtgagcaggcgcgcgtgtgcatgcatgtgtgcgccagggagggaggaggcgggggtggttctatcccgcaccagctgtgtcctcggcccagcccttctctctggaccagcgacaaagttggactagatggtctccaaggcaccttgccgacccttttccagtgtatttggtagacgtttcacagaagtg

SEQ ID NO: 93113 - DNA, 33 bp, Homo sapiens
  chr5:14886060-14886093
  hypo
ggcatgagccaccgcacccggccattttcctca

SEQ ID NO: 93114 - DNA, 18 bp, Homo sapiens
  chr5:148872640-148872658
  hypo
ttgttgttgttgagacgg

SEQ ID NO: 93115 - DNA, 25 bp, Homo sapiens
  chr5:148928401-148928426
  hypo
gcgaaaactccgtcttaaagaagag

SEQ ID NO: 93116 - DNA, 34 bp, Homo sapiens
  chr5:14895452-14895486
  hypo
ctggatcacaagaatgaaacgccacctcaaaaaa

SEQ ID NO: 93117 - DNA, 63 bp, Homo sapiens
  chr5:149005075-149005138
  hypo
acctggcccaagtgccgcgaacatgggagaccttcacagcctgatatccgccacaaggctgca

SEQ ID NO: 93118 - DNA, 149 bp, Homo sapiens; identical to SEQ ID NO: 40606
  chr5:149014648-149014797
  hypo

SEQ ID NO: 93119 - DNA, 240 bp, Homo sapiens
  chr5:149311635-149311875
  hypo
atttctcttttagcacgttctttgttctcctcgtccggaagttgtagacgtctatttagtttgattatctgtcgtcttagtgaagctgcatctacaacagtcaggtcatctgatgttccttcaattgttgtatctgtatttgaaatgccataaagagaatcatttctgaccagctgtccattttggcgaacagcagtttcactcgtagaccgctctctttttagtcggccaactgcacgg

SEQ ID NO: 93120 - DNA, 30 bp, Homo sapiens
  chr5:149546573-149546603
  hyper
ctccagctactctcacgtggagccggcccc

SEQ ID NO: 93121 - DNA, 1 bp, Homo sapiens
  chr5:149546648-149546649
  hyper
c

SEQ ID NO: 93122 - DNA, 154 bp, Homo sapiens
  chr5:149547723-149547877
  hypo
tgtccggactgtgtccggcctgtcctgacaaaggccacctagccttgggggcgggaagctggcctgcccaccctttgatgtccagcccctcctccccttaccccagctgcgaataatcctgggacttctcccacctcctcgcactcttcacccc

SEQ ID NO: 93123 - DNA, 401 bp, Homo sapiens
  chr5:149569485-149569886
  hyper
ccagagagggcaggtcgcttgcccaaggtcacgcagaaagccgagggtttccgtcgcgaacccccctccccactcgctcagggctctccaatccgcagctctgcgtgcgggggcgcgcgcatccccccgccgtccgtccgtcagctgtctgtctgggtgtctatgcgggcgcagcagtgcacccttccccagcctcgggcgctgcgcagggacagacaaggcattcgcagcgccctgcccgcgctccacgcccgcagccgccagacggcagcgcctgcgtccgtgcccgccccagccggtgcgcgggagccgcgggggcaaaggcgcagtggccagcggaccatctctcgtgccctcgctctctgcgctccggggcagctgagccccggccacccgctctc

SEQ ID NO: 93124 - DNA, 30 bp, Homo sapiens; identical to SEQ ID NO: 40607
  chr5:149624264-149624294
  hypo

SEQ ID NO: 93125 - DNA, 145 bp, Homo sapiens
  chr5:14967329-14967474
  hypo
agtttgccttcatttcgtcacctttcagaggcttgttatgtttgttttatgcataacatctggggttttcaggtgtactttaacttcatttgtttagataaaaggcagtcgtgctttcctaggaatgttccggaaaagctgcata

SEQ ID NO: 93126 - DNA, 34 bp, Homo sapiens
  chr5:149681755-149681789
  hyper
cgtggtagccttggtcgtccgtgaggatgaagat

SEQ ID NO: 93127 - DNA, 682 bp, Homo sapiens
  chr5:149682009-149682691
  hyper
accggcccgccggctcggatgctgcgagggagttcagcgccccccggggacggtccagtgtctggtccgggactggctgccggacggctgggccggatctgctcggccgcagcggggcgctctggggaggtcaggcccgcgccgagctgcctcccgctgcctaagcgcaggccctgcgccgcctttgctccctcttccccagctcagcccggccagcctgagacgcggcgtggcagcttccaaaaagtgctctctaccatcctctgactcccctcttccttcttgccctggatttctcccgcctcctaatttctctctcctctgctttcccggcctctcgccccacccggagtccttaaaacagcccagctccctgcagggaggtgggcaggaccccagaggggaaggggagggaggcacaagttgggcgggtcgaggggacacggcgggagagaattcgaaaaagttgtaacatctgccgggccgggccgagccccaggtggaggggcgggacgcagagcagcggctccacctcccgggcgggaagccccggccctctcggcctgctggctccagcgcccgcccctgaccgggatggggaaaggagggagtggggctgcttggaattcgatggaacagctccagaatggctgggtcagacattcctcgatcatggagtctt

SEQ ID NO: 93128 - DNA, 211 bp, Homo sapiens
  chr5:149810703-149810914
  hypo
gaccagtcagacaagcgcagaggaaagcccggtggacttgggcacgtgaggtcgccggcgaagctgacaagagcaggcttgtgaactgcttgaggatgggtggagcagcactgggagcagcggcaggaggtgaggcagtggctggacaagatgcagccccgggtgcgagcatgcttgtccgcagagggagtgactccgtggggagggagag

SEQ ID NO: 93129 - DNA, 734 bp, Homo sapiens; identical to SEQ ID NO: 30008
  chr5:150051058-150051792
  hyper

SEQ ID NO: 93130 - DNA, 76 bp, Homo sapiens
  chr5:150052035-150052111
  hyper
agccccaacgactaccgaaatttcaacaagtaaggcggggcgggcagcccgggggacagaccgggaggggcgggaa

SEQ ID NO: 93131 - DNA, 217 bp, Homo sapiens
  chr5:150158234-150158451
  hyper
cgcaggggacgctggaggaggagctgagctggagttgccggggccccgggaccgggcgttccgggggcggtccccagcagccgcgcattccagagccagcagcgcgtcctggccgctcctgcgctctcccgcctcccggggctcggaggagccggggcacgttccaggagctgcctagggctgaggttccaggcctgggggtcgcttccagctgcca

SEQ ID NO: 93132 - DNA, 696 bp, Homo sapiens
  chr5:150399922-150400618
  hyper
aaaagaggaagggaccgcctcccacgtccacagggacctgacttccacctctctgcccagatttgcttatgtcactgtcgccccgggacggggaggtggggagctgagggcaagtcgcgcccgcccctgaaatcccagccgcctagcgattggctgcaagggtctcggcttggccgcggattggtcacacccgagggcttgaaaggtggctgggagcgccggacacctcagacggacggtggccagggatcaggcagcggctcaggcgaccctgagtgtgcccccaccccgccatggcccggctgctgcaggcgtcctgcctgctttccctgctcctggccggcttcgtctcgcagagccggggacaagagaagtcgaaggtgagtgagcctccgggccgggggccgggagaaaaaacctagcccctcggtgtccagcgctcagtgcaatgcaccccttttcccaggctccccgccagatgggcaatccccaggtgcgagagacctcctgaaccccttttgccgccccctccgccgccgggaccccgcccccgaccgtcgtcgtctcgtagttccatctgttggagagccgagacctggtgcttcaggcgggcagaatgactaagggaggaaggtctctctccccgagctcgcactttctccccactgccacctcgagggtcgccttgctacatct

SEQ ID NO: 93133 - DNA, 104 bp, Homo sapiens
  chr5:150537549-150537653
  hyper
ctttggccaaggtcacgcggcccttcagggctagaagtcagggctcctgactccgggttctggacactttcccgcaaattcttataagtcgccaaagctttgtt

SEQ ID NO: 93134 - DNA, 30 bp, Homo sapiens
  chr5:150577129-150577159
  hypo
aaaaaagtgcctgctcggtgggtgggagtt

SEQ ID NO: 93135 - DNA, 30 bp, Homo sapiens
  chr5:150829685-150829715
  hypo
tgggatggatggagccgatgtccacttact

SEQ ID NO: 93136 - DNA, 60 bp, Homo sapiens
  chr5:150901687-150901747
  hypo
cagtgctcttgcgcccgactgaggctgggcctccttgtggagctacgtttctctgcccca

SEQ ID NO: 93137 - DNA, 177 bp, Homo sapiens
  chr5:150911205-150911382
  hypo
ggtcttctctgcgcccgggcgagtgagggtggccagctgcagcacctccgtgccaggtggggcgtcctcgggcacctgcacgctgtgctcggtgttcaggaacacgggcaggtagtcttctaggcccaccaccgagactgtgacggtgcccagcgtggacagcggtattggggtgcc

SEQ ID NO: 93138 - DNA, 248 bp, Homo sapiens
  chr5:151066252-151066500
  hyper
acaggcagacaggaccgagggccatgctcttaaggggagccgtgatggagccgggaggagaggcgcatcctcagcagagcttccctcccttgcacacgagctgacggcgtgaacgggggtgtcggggttggtgcaactatagaagggaaaggctgggcgggggtcacacatacctcagtggcaggcaggcaggcggcaggcagagcgcgctctccgggcagtctgaaggaccgcgggaatgtggaggg

SEQ ID NO: 93139 - DNA, 118 bp, Homo sapiens
  chr5:151150563-151150681
  hyper
cactccactggagcacgcgcggaccaccgtgcctcagctgccacaaagggagcctcgccacacgcccgcggccgcctcgcagcgcccgccaagaagcgcctggcggaagggcgcactc

SEQ ID NO: 93140 - DNA, 28 bp, Homo sapiens
  chr5:151251400-151251428
  hypo
aggcgtgaaccaccgcgcccggccgtga

SEQ ID NO: 93141 - DNA, 428 bp, Homo sapiens
  chr5:151304211-151304639
  hyper
gatgttaaagggaggcggggaacaggggcgcggagggagagccccaggggaaattggagcgagggggtcgtagataccacggacagcggcggctgcgaggcgtttcagcaccacggagagcgtccagacctgcttttcaggagcgcgaagagtattgctgtttgttaaactccagcgtgtctgttggctccctgcggcgctggggaggcacgtttgggggtgggtatatttccttttttttttttttttttttaaacccctgtttttctgtttaaacggccagctccctgcaaggaaaaaaatcttctgtggagatcagagcgctggcctcggaccgttggattgggcgagcatcttgggtaaagagaacagagctttatggctctgggccggcctgagggggttaggggcgaggggaaagcggttga

SEQ ID NO: 93142 - DNA, 45 bp, Homo sapiens
  chr5:151304708-151304753
  hyper
cgttctcctgcctctgtgcgggtctgctgtcgccttgctattcct

SEQ ID NO: 93143 - DNA, 42 bp, Homo sapiens
  chr5:151383718-151383760
  hypo
caatgctgagacagacgcgcaagtcctcgggaggagacgcat

SEQ ID NO: 93144 - DNA, 130 bp, Homo sapiens
  chr5:151784174-151784304
  hypo
aggatcctgagggcccggcgccgggtgctctgcagtttggcgcggaacgggtgtaggatggccacgtagcgctccacgctgacggtggtgatgctgaggatggaggcgaagcacacggtctcaaagaggg

SEQ ID NO: 93145 - DNA, 30 bp, Homo sapiens
  chr5:152760944-152760974
  hypo
atatctgaagatggccgaacaggaacagct

SEQ ID NO: 93146 - DNA, 214 bp, Homo sapiens
  chr5:152870105-152870319
  hyper
gtgtgagggggagagcgagagagagcaagggagggagagagaggcaggctgcgaggggagaggagagggagtgggggagccagcgctccagctagcatgaggacgggcttcttttcccgtgctcagttaatctggctgtcagttggtgttaacgctgcagtttaagtgttcggattccaagggaaacagacaaacctcacgaaaggaaggaagc

SEQ ID NO: 93147 - DNA, 28 bp, Homo sapiens
  chr5:15292060-15292088
  hypo
aaataggaaaagctccggtttacagctc

SEQ ID NO: 93148 - DNA, 33 bp, Homo sapiens
  chr5:152979673-152979706
  hypo
cggcgcggtggctcacgcttgtaatcccagcac

SEQ ID NO: 93149 - DNA, 21 bp, Homo sapiens
  chr5:153118296-153118317
  hypo
ttggagaaggcatttcgctct

SEQ ID NO: 93150 - DNA, 188 bp, Homo sapiens
  chr5:153131278-153131466
  hypo
acaagaaatgcctatcggaaacccagagaatggtcccatcagatccttactatcttccgttagcatcaagttatgccctaaacgatacatacactattttgttaacaaaaggaaaaaagatcctttgcaaaaagagacagcctgcttccagcaccttactcccagaccatgtccgaattcatttaccc

SEQ ID NO: 93151 - DNA, 160 bp, Homo sapiens
  chr5:153558736-153558896
  hypo
tggggccagaaacagcgtgtgatgtccagccctagccctgaagggtgaggaaaggggcagttattggaatctagaaagggaggactgtttcaagaagcctgcgcgatgggagccatggacttttgtggaggacacagacagcctgcggcaaagttgcagc

SEQ ID NO: 93152 - DNA, 47 bp, Homo sapiens
  chr5:153569225-153569272
  hyper
ggctccacggccctccgcatcgcccagaagcccgactcctctgtcaa

SEQ ID NO: 93153 - DNA, 93 bp, Homo sapiens
  chr5:153785959-153786052
  hypo
gattatgtgtgggttcgcagaaccacagagatgcctgaatcaggtgcggccttttattatggtgactaacaaccctcaattacttgcagacca

SEQ ID NO: 93154 - DNA, 896 bp, Homo sapiens
  chr5:153852408-153853304
  hyper
gccgttctctgtgctcggcttttccagctgtgcggtgggagctggggatgtggcgtgggcgtgggaggccgctggagtcaggcgtggggagagtgggggactatccagtgaccctctcaatgggcgccggctccgtctcggctcccgggttcagggactgcacgtttctgagaccgagtttagggctccaaggctctcttcccaaagagggtttggggccagcaggattgggttttctgaagaggcctggttatgccagacttggctttggcggccgctggcgggtctccctcagcaccccctcttctttccccggctataagaaagctagaccagggtgcgcattcttcccgtgcctaggatacttcacggtgctaaaaatagtcctgggagctgggacctgtgtatagccagaggtttgtgtgtgagcgaagttggagtcctgggttcgaatctagataagcttccctccgtgctgtggggcttagatcacctccctccctgagtctgtttctccatgcgcgccggaatttctaaacggactcccagaaagaaacggaaagaaagaaggtaaagaaaagaaaaacaaaacaacaagaaagaaactttgatttttctctctgctcctccccaagggccctggggcctcgggccgggtactgaggccgaggaaggggtgcgtcggacaggctcattaccgccaagtgttgccctagttaaatcgcgggcctgtttgatctggcggcgggtggcgagagggaaaaaagaaaaaagtaggggggcgagagtagagagagaagctcacacctcccccactgtttcctagcgcccataaaacaccttttattaactccttcgcgtccggaaaggcccgcgtggcctctcggcccctgcta

SEQ ID NO: 93155 - DNA, 133 bp, Homo sapiens; identical to SEQ ID NO: 2667
  chr5:153853386-153853519
  hyper

SEQ ID NO: 93156 - DNA, 30 bp, Homo sapiens
  chr5:153854871-153854901
  hyper
cctttcatcttcctgcgtctggttctcttt

SEQ ID NO: 93157 - DNA, 236 bp, Homo sapiens
  chr5:153855175-153855411
  hyper
tcaaaggacattgcacgtgcgatccaagtgtgtggttgcagccgacgacctgccggcgctcagcagaagctccgcgggatgcgtagcaccagtcgccggagcccagagcctggcgttcgccgctgccttcctctcctcccggggcttcaggagtggctggcctggccaggtcctcggcgcgggcctcggctcactggtttaactccagcgcccagacttgctgcggccagccggtg

SEQ ID NO: 93158 - DNA, 270 bp, Homo sapiens; identical to SEQ ID NO: 30018
  chr5:153855657-153855927
  hyper

SEQ ID NO: 93159 - DNA, 1050 bp, Homo sapiens
  chr5:153856148-153857198
  hyper
cgtccctggatgagctttcgtcagtttaccacaggcccccgcaggttggataaaccaggtggggcgcttcagctggctccactccgctacggccttaagccccccaacctagagaaactgattggccagcctgaaaacccagcgctcagaagcccccagccccggacagccagaccgagtgccaggaagtgtcaccctaaccggagaggatcaagaaggccaagacgagactgcgctctccaaagctaaaagaagtggctcttatttacatgcaaagccactgaagtcgtcctcagaaccagtccatggggagaaccagaactggccctggactgagtagaagacccgatctgttttacctcacctccaccctggactcctcagataggtgcttttcctgccccgacccactctgggccctcagtttccctatttatacaatgatggaagtagactagccggtccagcaaaggccctttgaaaacaggaaccgagcccgggcacataaattcaaactcaaagtaaagaactttaacacatattcttaacctggcttccaggagagcccaggaatgaatcaggacttctccaaattggaagcaaaacctgtggtgtgtgcatttttggagggtccgaggctccaaacagattattcactcagtattacaaacactctcccgtattacaaatgaattctatgacgaatctgcctccctccatgcacaggatcgcacgctgtgaccaaccatctcagaactcttcccaacctttccaaatcggacacaggacaacacagcctccttcgactacctgcatggcctgaggctgctcaccgctcctgcacccttggctggagcatgcaagccccaggactcaccagctcccttttccgcttgctctcacggccgccatccgccttcttgagttcagccttgaaggcctcgggatcgccagactgtgcatccttggccagcacgtccatcaggtaggcgatgtagctggtggctaggcgcagagtcttgatcttggagagcttggtgtcggccggca

SEQ ID NO: 93160 - DNA, 597 bp, Homo sapiens; identical to SEQ ID NO: 30021
  chr5:153857284-153857881
  hyper

SEQ ID NO: 93161 - DNA, 776 bp, Homo sapiens
  chr5:153858119-153858895
  hyper
tccagaatcaccaagcgaaaagaaggcctacacctagagcccgccttttgattttacagacaaggaaactgaggcccagggaaagaaaggttcttgtttctagactgtctagaagtctaaataggaattccagcagttcccagtcccgagctccaactgctctgctcggcgtcagagctagaagatgagagggcgctgctgaagacaggataggccgctaacgttcttccctaacaccttccagccctccgcccccacccccaccccttagtcatcggccctttctggagagactgggagccgcttgtgcacggggtcgttaccagcccgccaattctgacccagcctcaggcagacgggcacgcagctactgaccagcgaagaagcctttcggaggcaggggtaggggtggggcgggaaggaggaggcggactccaggcccacgggcatcgacgggtttgttcccggcttgagggtctgagatccactccggcctcccgggtgcctgatccattccgaaggccagcccggctggcgcagagacagtctggcgtccgccttgggcccggggcatctggccagcaggtctcctctggtctgtccgcaggactcgcaccgagacctgggagcgcggctacgtcgggccgctctacccagatcatcactccttaagaatctttggttctttaaagacaccggccccgaagctcacacctcgagacaccagcattcggcgttagacacacgcagaggggaccaagactgcacagcatccg

SEQ ID NO: 93162 - DNA, 892 bp, Homo sapiens
  chr5:153858916-153859808
  hyper
cgacgtccggcatctctcacgcatcagcgcagaggcgcgactcggctgcacgaccctccgagatttcaccccgggggtagggccattccctgccagccggactctctccactgtgggctttccccaggctcgcgttggaatctgggaatcccggagtggtgacgcttcaagctggggactctcggtcttacctcccgctgtggttcctttcttggccgatgtccacctacctgggtccctcattctctcaacctttctcagctcaacgccccctccctcggtgtggtagagggagtgtgcctctcttcaaagcaaagtcgaggggagggggaaaggagaagttaatgtgagtgctctttttagaaggcaaatcattcacccattcattcaacaattatttattgatgcctactatgtgcctatcatagttactagtccaaagacagagggagaaaggcccattctctccttgaacagatatggaacgtgaagcccagagaagaagagcgattttctcgaggtccggtagggagtggatgagtggaattccactcctggacaagagagtgaatgaagggtggggggttacatacaggagtgacggagacaaaagcctgggcctgctggttccacctgtgggagctcagcagggctgtgggccctggaggtgcatgggggggtggtgcagggaggtcctggtttcctgcccgaggcgggctggaaaccccccgctctccccggcgcctggcgccagcagcgctggggtagggcagagcgcggagccggaggcacgcggggagggagcgctgggggcccgctgctgcggcggctctgcggggtcccaagcctccctggcctggaggcattctagaaagagcgcaggtagagagta

SEQ ID NO: 93163 - DNA, 143 bp, Homo sapiens; identical to SEQ ID NO: 8132
  chr5:153862037-153862180
  hyper

SEQ ID NO: 93164 - DNA, 359 bp, Homo sapiens
  chr5:153862218-153862577
  hyper
cgtgaccttgacgccacgggcaatccccgcaccggaccccttatctaaatagggcagtaaatcaaggacctgtcagggcccgggtaattacaggaactccataaaaaggacccggccggccgcctgtttatattagcgcggtgtaaaatattctcgctgtcttggggaatcgcgtcgcgcagtaacgcgccataaatcagcccgcggaccatttaccccgcagcttgagcgcgcaaatcccttaaacatttctctgccatgtctgaagaggacctaggactttccaatctggcccagcctgctcccagggatgggggacagtcggggcagggaagagataggcacggagtagattgctc

SEQ ID NO: 93165 - DNA, 44 bp, Homo sapiens; identical to SEQ ID NO: 30027
  chr5:153863373-153863417
  hyper

SEQ ID NO: 93166 - DNA, 232 bp, Homo sapiens
  chr5:153863418-153863650
  hyper
ttcaacctaaacagaacccggtctgattggaaaatgtatttatttgaaaaatcgtaactcacggttttggtgaaaacggcccccaaatttatgggatcgcttggggcgcagcgattgtaaatcaaaaggcactggacacctccctcccccatccccgaagcagctcggtcaggttctccagaacaccaggagtcctgtctcctcccggtccaccctgcggccctccgagacc

SEQ ID NO: 93167 - DNA, 30 bp, Homo sapiens; identical to SEQ ID NO: 30029
  chr5:153863972-153864002
  hyper

SEQ ID NO: 93168 - DNA, 30 bp, Homo sapiens
  chr5:153900800-153900830
  hyper
ctccctccagagcagcgcccagcattcaat

SEQ ID NO: 93169 - DNA, 530 bp, Homo sapiens
  chr5:153990744-153991274
  hyper
caagcacctggcacacgactatgtgttaaataaataaaataaataaatactgtttaaaaatgaaaatgaaatgtattaaattaataaaatagaacatttctagcgacacacacaggcacgccaatctcagtcacactcgccccaggcacagacactgtcactatgatttgccatccccgcctccccacgctggagagcagcgccctcacagaagggccgagccgcggacgggccacacacccgcgtgtacacacagtccgagaacgcacacacgtacacacacacatgcgcaaggcacggcctggccttcaggcacagagagcccatccggtttcccactcagctcccacaacttcccccacactttggtactaagggctcagctgggtccttttgaagccaccaagggagggagttgggaagggccccagtgacaaacagtggggagcaagaattttacgaacttaagggctgtaaatttcggccagcaaatccccgcccctgtccgtccgccccgccttccttctcac

SEQ ID NO: 93170 - DNA, 78 bp, Homo sapiens
  chr5:154071660-154071738
  hypo
cctttcgaaggaaaccttcgctggctccctagtgccctggaataacactgaaaccccttagaacggtggagaaggcct

SEQ ID NO: 93171 - DNA, 254 bp, Homo sapiens; identical to SEQ ID NO: 40613
  chr5:154209733-154209987
  hypo

SEQ ID NO: 93172 - DNA, 101 bp, Homo sapiens
  chr5:154318077-154318178
  hypo
cactatcccgtccaacgttttttgagcgctatgtgccagggcactttgctagttgtggaggtgttttaaagatatgcacaagaggccgggtgcggtggctc

SEQ ID NO: 93173 - DNA, 16 bp, Homo sapiens
  chr5:154376080-154376096
  hypo
agaattaagactgggc

SEQ ID NO: 93174 - DNA, 30 bp, Homo sapiens
  chr5:154393651-154393681
  hypo
aaggatataatgcaacggtcctggcctatg

SEQ ID NO: 93175 - DNA, 33 bp, Homo sapiens
  chr5:154398961-154398994
  hypo
agctggttgtcccctcgtcgtctctctgccctc

SEQ ID NO: 93176 - DNA, 180 bp, Homo sapiens
  chr5:1549177-1549357
  hypo
tgccctggagtcttccgcagccacggttgccttgagcaggcagaaaggagaaatatctgaaaatgggactccttgtgcaggaacccacatttgcaaatgggacaggtccaccccagaaggttgctgagcaagcttacatgtctgggactggcctgtcctgctgtccgaggggtccttttt

SEQ ID NO: 93177 - DNA, 109 bp, Homo sapiens
  chr5:15499838-15499947
  hyper
ctgtcttccattttccgccccagtctccaaacagggaagtcacaggagaatgccaacgcatacacctgaaaggtgtcagaattagacacggatgcgtgtttattttaaa

SEQ ID NO: 93178 - DNA, 119 bp, Homo sapiens; identical to SEQ ID NO: 29484
  chr5:15500570-15500689
  hyper

SEQ ID NO: 93179 - DNA, 98 bp, Homo sapiens; identical to SEQ ID NO: 29485
  chr5:15500735-15500833
  hyper

SEQ ID NO: 93180 - DNA, 460 bp, Homo sapiens; identical to SEQ ID NO: 29486
  chr5:15500834-15501294
  hyper

SEQ ID NO: 93181 - DNA, 22 bp, Homo sapiens
  chr5:15503235-15503257
  hypo
aacaatagctgaggtcgggcgc

SEQ ID NO: 93182 - DNA, 520 bp, Homo sapiens
  chr5:155107388-155107908
  hyper
gccggaacaagctctcgctgggaatccgcacactccttctcccggtgtttcttaacccctttcttctcccgggagtggagagggggctcaaggatactagaaacctgtccccttggcggagacacgtagtcgcctctggccgccgcggccgactgatcttgcggagtggagctccccccaccccgcccgcgtttcgctggggctccctccgctctgcaaagggagcggggagctgggggagccttgcacaccagtcttcctggagctgcagacgaggagccccgcgccttcgggagcctctcggcggcttcccctctaacgcgcgactgtgcagcctctccccgccgcccccacccgcggctcgccctcgctccctccctccagccccgccagccggagcgcgcacaccgggactccggcacgtgggcgcgcgggaggtggcggccgctgctgccgctgctgccgctgccggagcccgaacccaagccccagctggagccggagtcggagccggcgagat

SEQ ID NO: 93183 - DNA, 108 bp, Homo sapiens
  chr5:155108160-155108268
  hyper
cggcggccggcggaggctttccgcagccgcttggccggcgccggcccctattccgttggcaagtcccttgtctatcccggagggcgcacccggacgctcgagccggag

SEQ ID NO: 93184 - DNA, 494 bp, Homo sapiens; identical to SEQ ID NO: 30033
  chr5:155108355-155108849
  hyper

SEQ ID NO: 93185 - DNA, 311 bp, Homo sapiens
  chr5:155109188-155109499
  hyper
cgggcatcctgtggctaggcgcgggggaggggaacggctccctccccgagccccgggctgcctctgctgcttctaggggtgcatctgaacatggataaggaaatgcgctccctgctctcaggccctatttggggtgagtgtgtgaggcatccaaatgcctcctgtcggaaaacagcggcctcattgtgtgcccgattgaggtttcaacttgcaggcaactgagaggccattcagctgggcagcacggagttggctggtcctcggacttgagccatggccttccccacgatccctggcggcagtatcccagc

SEQ ID NO: 93186 - DNA, 35 bp, Homo sapiens
  chr5:1563387-1563422
  hypo
aacagaggcagctctcgggacgagaaggaagcttt

SEQ ID NO: 93187 - DNA, 21 bp, Homo sapiens
  chr5:156384996-156385017
  hypo
agatctggccgggcgcggtgg

SEQ ID NO: 93188 - DNA, 183 bp, Homo sapiens
  chr5:156472913-156473096
  hypo
actgacatagtatttcggagaatgattccccactcctactttcttcctccttacactctcaaagagtggggtgcagctgctcctaccactgttacgttgtgtttttatctattttcattttgcttttgtgcctggaaacagtttgcgctgaggattacactttcaaaacgaaatgtcgccatt

SEQ ID NO: 93189 - DNA, 30 bp, Homo sapiens
  chr5:156522857-156522887
  hypo
tgtcttgctatgaaacgtctatttttcaca

SEQ ID NO: 93190 - DNA, 38 bp, Homo sapiens
  chr5:156591428-156591466
  hypo
ctgggttaacaagcatgagccaccgcacccggcctaag

SEQ ID NO: 93191 - DNA, 30 bp, Homo sapiens
  chr5:156672960-156672990
  hypo
gttttctctttcagtcgctatagcagcaag

SEQ ID NO: 93192 - DNA, 584 bp, Homo sapiens
  chr5:156874096-156874680
  hypo
gactaaaggtcagaccgctctgtcagaacaggctttctggaaatgcagaccttgagataggtaagcaccaacgtatttaatgggctggctacagaataaacagctacatttttctttggggagcaaaatgcagataattatcaccacttaagctttagtgcaactgtgtaaaaaggcgcggctttttattggcccagcgcctttgtgtgcaaccaatcctgaggtgggcggctgtgtccccgccctggtgggcggagctcttcccagcccaggggcctttgcccatcaggcggttccgcctggcactggctgggcggaggtccttggtagcagaggggcaaattaaccctctgcctcacttgacaagcctgaagaaagcttaacccacgctctggattcctctggggtcccttatccaggccaggcccgcaaaccagaatttccagtgtgaccgtgttggcagagagttaatgagcagccaaggaagctgtggctgttgctgttgtagacttgccccagagggaaggacagaagaacgccaggtccttccttagcctctctgcttggaacgaggcaggtgggaa

SEQ ID NO: 93193 - DNA, 455 bp, Homo sapiens; identical to SEQ ID NO: 30035
  chr5:156887049-156887504
  hyper

SEQ ID NO: 93194 - DNA, 30 bp, Homo sapiens
  chr5:156960564-156960594
  hypo
ggggagaagaggggccgggcctgtgtggag

SEQ ID NO: 93195 - DNA, 132 bp, Homo sapiens
  chr5:157001726-157001858
  hyper
tctgcttatagcccccgagggatggagccggggaggggattggtgtctgggaaactagtcctgagaaacacggacatcacccggcatcttagctggaaacatcgagtcagaccccttcgcttcacagaaggg

SEQ ID NO: 93196 - DNA, 106 bp, Homo sapiens
  chr5:157002098-157002204
  hyper
gctaccacagtctgccgcgggcattttatgtcctaccccaccagtgtggcaggcaccgagcctggtcccaggaagccgctcccaggccacacgggcagggcgctcg

SEQ ID NO: 93197 - DNA, 370 bp, Homo sapiens
  chr5:157002447-157002817
  hyper
cgtgggaacaaagcccgggctcccaggctggggacggcgggggcgcaggccccgcggagttgcgggaggcgcaggggtcgcggtcccagcgctccggacccgcaaggctactcccaggtctccgggccacccagcctccatccccccgcgcctggccacttacttgtccatccaggctcccgcgccgcccgcggccggaggggctgcagggcaaacgccagcaagcagagccgggcggcgcctgcgccccctggcatggtggcggcggcccttagcgctcggcgctcacacgccctcagccatacctgcccactgcccggcggtggaggcgcgtctggaaccccccggctcgccccgcgcctccccaccc

SEQ ID NO: 93198 - DNA, 143 bp, Homo sapiens
  chr5:157041326-157041469
  hypo
gagagttctacttgacgtggatcttaccccaggattgtttgtcagcaaagttaacgtggtagagcagaaagagtgctgagtttggaggcagacagacttgagttcaggtcttaattcttcatcacttgcggggtggtgttgga

SEQ ID NO: 93199 - DNA, 42 bp, Homo sapiens
  chr5:157078407-157078449
  hypo
cgagcctgcagtcctcgaggagtctctcgggttcctccgttt

SEQ ID NO: 93200 - DNA, 469 bp, Homo sapiens
  chr5:157098271-157098740
  hyper
gccccgccagcaggccggggtcactgcagtccccacgtcgaagcggaaaaggtctgctcagctcaccgcaccccacttcttccagacccgtccgtcttcacagcaacgcgccgggtctcaccacggcggatgccgagggacaatattaccgcgtccgtggccgccggactctgcacgcatgtccaacagcccccgtccccttccccgcagccaatatgtgtctcccaggcaacgcgccgcgctcggttcagggctccgcccagggactcactccgcgtcagcgcgcgcccacctaggtgggctggcaaccagccaccagtttccaactctttctccaacagggaagccgcaatgacacagccgactaggccctcggtcacctgtgaccagggatcctccacgatcggcgggaccgccgcccaggcgaccaccagttccagcgccacctcgggttcgaactaccagcgcg

SEQ ID NO: 93201 - DNA, 135 bp, Homo sapiens
  chr5:157852959-157853094
  hypo
tgaaaataaaaaccacatttgagaaagcccagaatgagaaaagtgggaagggagaggtgcagtagcaagccatggtatagcaatccgcatgacctagccatcctgaggccggggaataaccgctgaaaagcattg

SEQ ID NO: 93202 - DNA, 18 bp, Homo sapiens
  chr5:157881508-157881526
  hypo
tggagcagaaaggggcgg

SEQ ID NO: 93203 - DNA, 66 bp, Homo sapiens
  chr5:158139390-158139456
  hypo
caatcctggaagactcggggaaaggaaggtctctgtttctggccccgtcgccgcaacccagaggga

SEQ ID NO: 93204 - DNA, 30 bp, Homo sapiens
  chr5:158250354-158250384
  hypo
attttaatataaaagcgtggtgggtaataa

SEQ ID NO: 93205 - DNA, 30 bp, Homo sapiens
  chr5:158398433-158398463
  hypo
aacgaaataacttcccggcatcaaggccct

SEQ ID NO: 93206 - DNA, 25 bp, Homo sapiens
  chr5:158478441-158478466
  hyper
cccacccccccaccccgccgcccgg

SEQ ID NO: 93207 - DNA, 303 bp, Homo sapiens; identical to SEQ ID NO: 30041
  chr5:158478512-158478815
  hyper

SEQ ID NO: 93208 - DNA, 108 bp, Homo sapiens
  chr5:158524640-158524748
  hyper
cgagtgcccggccttgggaagccacatccccccaccaccaaaaagcatgtggagaagggtccgagggcggggctcagaactgtcgcgggtggtcgctgtgaaaaaggg

SEQ ID NO: 93209 - DNA, 289 bp, Homo sapiens; identical to SEQ ID NO: 30043
  chr5:158526129-158526418
  hyper

SEQ ID NO: 93210 - DNA, 444 bp, Homo sapiens
  chr5:158527373-158527817
  hyper
gcggggcccgcgcatcgaggccccgccccttcatttgcataacgtcatctttccgcccaccgcagccaatcgcggcccgggagccggctcgctggcggcgccaggccacgctctctcattaacatcccgctcccggtggcgcaggggagccggccaaagttcctcgcaaagtggcgagcgaaggagcgctgagcactgacgtctgggctggggaggagcgggtccgagcgaggacggagaggggacagagggaaagggaggcgggtgtcttcctcaggaatttgagctggggatctgcatcctggccattgcagtcctttagcatcctcgccgcgccctgagcgcgctggaggctcgcaggctgcgccctcccagggctgatgccgcgtcctgctccgccgttctgggacgtcggggacaaaagtggaggagacgggagagccc

SEQ ID NO: 93211 - DNA, 309 bp, Homo sapiens
  chr5:158527818-158528127
  hyper
ggcagaaaaagcaggacgcgcgtcccaggtgcccacctcttcgctttgaggcgggggcggtgggatggaatatgggtgcgcgaggtcggggctggtaactctcggaggggcacggcctccacgctgggagggatgaatggacgctgggccccggcaaatgaggcgctgtgggtccccaggaagtggggtaccaggctctactcccaccccggcctctgaaacgcttctctctcggccgctagcctagaggctgccagggttgggcactgttctcactcacacgctcacctctctcgggcagtcctcgag

SEQ ID NO: 93212 - DNA, 246 bp, Homo sapiens
  chr5:158533542-158533788
  hyper
ggtctaggcagggtgcggaccgagggcccaagggcaggcgtgcagaccgctacgactttggctttagggagacgccttcggggcgcagggcccgcccgaagacgcgggttagcatacagctcagctccaggcaggcgatgcgggttcccaatgcgggcctacagattacgcggactgagctgggaacggtccctgctggacagttccgtgctcttaatccttcctcgcctacggtctctgattatt

SEQ ID NO: 93213 - DNA, 141 bp, Homo sapiens
  chr5:158612852-158612993
  hypo
aaactgaaaaatctacgtccctagtcctgtataacagcctcccctcttttaactcaaactggggccacaaggaatgtacaagatctatgaaaagggcctccggccatggtagctcaagcctgtaatcccagcactttggga

SEQ ID NO: 93214 - DNA, 189 bp, Homo sapiens
  chr5:158875177-158875366
  hypo
tgtgtccctgtgccacgggttgcctgtagaggtgcagggcttcttgctgtctgttatggaagcagtcgggccttttcccgactcccagtgagatggccaggagatctggggctcagttttcctgaaacaaagataaggacccagagtgtgacttcagctcaccatgttgttacacgttaaagcgtggtc

SEQ ID NO: 93215 - DNA, 324 bp, Homo sapiens
  chr5:159200128-159200452
  hyper
agcctgaatggctaacggtagagcaggtgactgaatgaggggtggacggacgcccagatgcctgcttcctggcttttctcccgctctgtcttcacagcctgcccttcctcggctccaaggcgcccccgaggggtgagcttcctgggcgcgctccgcagcgccctccgcccctagctcgcggggagggcgtcgcgcggctgttcagcggggcagcggcctagcggcgcggacctgggtctcctccctcgcaccgggccgagcgccgggctcgtctgcattgacgtctgcggcggcggcggcggcagcagccgggctctcgggagc

SEQ ID NO: 93216 - DNA, 30 bp, Homo sapiens
  chr5:15928261-15928291
  hypo
accaaccagctgtgccgctgcgcgcgagtg

SEQ ID NO: 93217 - DNA, 261 bp, Homo sapiens
  chr5:159343387-159343648
  hyper
gcggcgtcggggctgcgggcgccttggctggacccgcattgccccctagtgccgcgcggagtcagggcgccgggctcccccgcctgatgtcaccgccgtgcagtcagcccagaagcggctcattgaaagcagaccctcttcggcgctcgctgggcggaggacgcgccgcggtccgcagacccgagcgagctgggcaccgccgggcgcccccggccctgccgccccctcctccccgccgctcccccgcgagcccggccaggc

SEQ ID NO: 93218 - DNA, 34 bp, Homo sapiens
  chr5:159399066-159399100
  hyper
ccgccgtcgcctgggcggctgcgcctacacctac

SEQ ID NO: 93219 - DNA, 201 bp, Homo sapiens
  chr5:159399509-159399710
  hyper
cgcagctttctttccctggggaggaaaacatcgtgggggggaggggagggcggggcggaggggggaggggagcgtccacgccgggtagacgcgcgccccaaggggaaccggggggagggccggggagaggggcagctgcttttctggcaggggcatgggtgccaggtaccacgcggaaagccgggccgagcatgctgagag

SEQ ID NO: 93220 - DNA, 27 bp, Homo sapiens
  chr5:159437321-159437348
  hypo
cagttaaaatgacgatttgacattatt

SEQ ID NO: 93221 - DNA, 376 bp, Homo sapiens
  chr5:159615222-159615598
  hyper
ccaggaatgccctcccggcctctcctcccgattccttatcagctacaagctcgagtttcctcagccacacgcgatcaaatgctgcttcagagctctaggaagctgggtgtgtcttctgtgctttgtaaaaaagaaacgaaaaaaacattagcaaatccccagcccaggtagccggctggctgagggcggactcttggaactgggcggtgggaggtgggggacgggggagggattggggggcccttgctccaaagccaaagagcgggaaacaggaactgcagggaggccactccgcaggcgcctcccctttcccgctggggagaggccgccgccgcgcggcgctcggcctgcaccgaccctccggggaccccgctaa

SEQ ID NO: 93222 - DNA, 21 bp, Homo sapiens
  chr5:159660593-159660614
  hypo
gaaactggccgggcacggtgg

SEQ ID NO: 93223 - DNA, 28 bp, Homo sapiens
  chr5:159672080-159672108
  hypo
ggtaggggctgggtgcggtggctcacgc

SEQ ID NO: 93224 - DNA, 56 bp, Homo sapiens
  chr5:159738684-159738740
  hyper
ccagtctctaacccccgccccccaattccgctcagacactccgggagaaggtaaag

SEQ ID NO: 93225 - DNA, 137 bp, Homo sapiens
  chr5:159739049-159739186
  hyper
tctcgcccctggccccgggccccggcgggcgccccctcctgcgccgctcagaggagctggaggtcgcctctggtccgcggaaggctgcggtgccccctcccctctgctcgccggacacggggcgatatggagctgtg

SEQ ID NO: 93226 - DNA, 468 bp, Homo sapiens
  chr5:159739433-159739901
  hyper
ccctctggtgcctgccggcggttggaccctcgtccgaggcgctccgcactcccgacggccgcctccgcagcccgactagcccccgccgtcgccgcgcccctgcgtgcgctcgggtcccgccgcggctcgcaggctcccggccgccgggggcctccctccctcgctgggggaattgggggccgggcctcgcgcatgcgctgccggcgcccccgcgccccgcggggcggggggctgggaattggagcctttctttgccagctctggctccgcttcctgcccgccctcctccctcgcttcggcggaaagcttctctctcaccttcgctgaggctagtggtagccttctgggcacccctccggcttgcgcagggagcaaagggaccgcggcgccacctgcgcgcaccacgcgtgaaacgtgcggacaggacgcccccagaaagttctgccttccgcgcgcactgctctagcc

SEQ ID NO: 93227 - DNA, 262 bp, Homo sapiens
  chr5:159776326-159776588
  hypo
agcctgaggccacatcgtggttgccggtgttggcatcaaaggtccggatgcggtactggccgttgtgcaccaggccgatggccaggtgcttgttggccagcgtgatgtcgtaggtgaagtagtagatcccaggcacgccgcagacgaacttgccgctggaagcattgtagtggccaccctcgttcatcagaatcttgtcaaacttgatgggcagccgctcccgtgggtagctcttggtcactgccaccgagaaagctgactt

SEQ ID NO: 93228 - DNA, 152 bp, Homo sapiens
  chr5:16032731-16032883
  hypo
actttcaaaaatagacgtcgatcacagtttcaatatcctgatattcatgtagcatctttattaccgcactctaaaccaccatctagttagtcccctcacctgatctcttccaagtttctatattctgtttctgcctttcagaatgcttcaca

SEQ ID NO: 93229 - DNA, 40 bp, Homo sapiens
  chr5:160498377-160498417
  hypo
gaataggaacagctccggtctgcagtgccaagcatgagcg

SEQ ID NO: 93230 - DNA, 425 bp, Homo sapiens
  chr5:160973379-160973804
  hyper
cgtctctttaaccagcgacatattactagggtcattgacactaaagaaagaaatgacaataagcaggcatcaataaggaagcaggcatagcgttttcagcatcggatccctactacatttccctgctcacagaggtatgcagacagaacccttcaaagtgagaacggaaaagagaaacgctgggcacacttacctctgcgcacagacagcggcgattattaaggggaaggaccaaatcccaaagtagccccttttccgcactctccacatccctttagtttttgatggaattgagggtttcactgaagagaggagatccaacttagtctgcccagtgcagtaattctaatgtgaggcgcatgcgcacggcgtaccaaaacatcaaaggggaagcggcggctgccggggaccgagcagatttcctt

SEQ ID NO: 93231 - DNA, 249 bp, Homo sapiens; identical to SEQ ID NO: 30056
  chr5:160974612-160974861
  hyper

SEQ ID NO: 93232 - DNA, 276 bp, Homo sapiens
  chr5:160975071-160975347
  hyper
ggcactgtgttctcccgcggtctccgcgccacctcgtcctcttcttcccttccccgcgcccaggggactcgcacacccagaggctgcctcttcccttcctcctgaagctcaggccgcctcgccgtggccgccgggacccggaggaggcagcaagcttggggtggggaaattgggggagggagatactcaattcacaaaagaagtcttccctccgctccagggaaagagaggagccacgggcggcgtgaggtgctacgagtctggggacacaaggcc

SEQ ID NO: 93233 - DNA, 100 bp, Homo sapiens; identical to SEQ ID NO: 8154
  chr5:160975348-160975448
  hyper

SEQ ID NO: 93234 - DNA, 266 bp, Homo sapiens
  chr5:160975668-160975934
  hyper
tgaagtcaagaagctcgcccaaggtcactcagatggcatgaggtgaaaccaggattggacttcagagccagcgttcctaaccactgaactagacagcctacactccgaagtctcctgagtcagcgaccttgcccgctgccagcgctttgctgtggcgggtcaagctcctggcgcccgaggagcccgcggcggctgcgggtggagttgagcgcggaccgcacgagctagacccggccggtgtctgcggagaggaggggtcgccggcc

SEQ ID NO: 93235 - DNA, 43 bp, Homo sapiens
  chr5:160975955-160975998
  hyper
cggaagtagctccacaggcttgcgaccccggcagccctggggg

SEQ ID NO: 93236 - DNA, 37 bp, Homo sapiens
  chr5:161274219-161274256
  hyper
ggggaaaagtagatgcggatttcgtcctgacttctaa

SEQ ID NO: 93237 - DNA, 30 bp, Homo sapiens; identical to SEQ ID NO: 8157
  chr5:161274605-161274635
  hyper

SEQ ID NO: 93238 - DNA, 244 bp, Homo sapiens
  chr5:161275346-161275590
  hyper
cgctggctccagtctctccacgattctctctcccagacttttccccggtcttaagagatcctgtgtccagagggggccttaggtaagtgcgactttggaccacgatacacagacagagctttgaacgtggcttttcctagctggagagacaggaatgttatagtcggggggggggggcggggggagacggggggagagagagagagagagaagaaggagagcgagcgagcgagcaagggagcga

SEQ ID NO: 93239 - DNA, 58 bp, Homo sapiens
  chr5:161275813-161275871
  hyper
tgagttggggaggggcgtcgggggccatcatctaaagttaagacgctgggacggaaaa

SEQ ID NO: 93240 - DNA, 76 bp, Homo sapiens
  chr5:161495120-161495196
  hyper
tgccctttttggcgtcgttttgttctgaagaggtggggggaaggtgtggggaggggtaactcgggagaccacccag

SEQ ID NO: 93241 - DNA, 157 bp, Homo sapiens
  chr5:16178996-16179153
  hyper
gcatattggagccagcgctcacagggcagaaccagacgagcctcactggaggcaaactgggaggtaggcgtgcgctgtccgtggtgctgaaagcttgaccggcgcgagctggagccgccaccggctgcctcggggtctcgccgggccttacctgctc

SEQ ID NO: 93242 - DNA, 141 bp, Homo sapiens; identical to SEQ ID NO: 29488
  chr5:16179266-16179407
  hyper

SEQ ID NO: 93243 - DNA, 246 bp, Homo sapiens
  chr5:16179554-16179800
  hyper
cggggaccggggccggctctcccggcggcggcgtcggcggcggcggcgggggaggttgcgggggaggctcggcgtccccgctctccgccccgcgacaccgactgccgccgtggccgccctcaaagctcatggttgtgccgccgccgccctcctgccggcccggctggcgggccgggctctggctgcagggaaagagagcgcggagggggcgggagggagaggggaaaaggagggagggggcccgga

SEQ ID NO: 93244 - DNA, 139 bp, Homo sapiens; identical to SEQ ID NO: 2540
  chr5:16180182-16180321
  hyper

SEQ ID NO: 93245 - DNA, 413 bp, Homo sapiens
  chr5:16180371-16180784
  hyper
cgcgggacccgggactgtaaccgccacttccaggccctcgctccccgcgcttggagccctcaagggcactctcagggatcctcgagagccttaaaacagaagtctctggaacctgtgtcctctccctgtctgtcccgccctcgaatccctgtgtcctcctcacccgctccctcctgcagtgagcatcccgggttgttggtaaagatcttggtgcctgggaggtcggagcttcgtctcctgaaatggtttatactagtgaaccctggcgccacgttctgtggcttataatcactttcgtcgttgccgcatgaggaagcaaatgacaccgccccttaccctggaaaagtggctgcagccttccccggatcttagttttactcaccccgaagtcaatttctcggtaactccaccct

SEQ ID NO: 93246 - DNA, 97 bp, Homo sapiens
  chr5:16209234-16209331
  hypo
actgcttatacctgggaggcagaagtttcagcgagctgagatcgcaccactctggtgcagcctgcatgacagggcaagactccgtctcagaaaaaaa

SEQ ID NO: 93247 - DNA, 30 bp, Homo sapiens
  chr5:162807006-162807036
  hypo
ccatgaaggcacaaacgacaagagactcgg

SEQ ID NO: 93248 - DNA, 46 bp, Homo sapiens
  chr5:162930274-162930320
  hyper
tgaagctgctcctcacgttttggcgtgcctgcgctctctgcaggca

SEQ ID NO: 93249 - DNA, 805 bp, Homo sapiens
  chr5:162931152-162931957
  hyper
ctagaaactttaaaccgaattcccagttaagagaaaaagtagtaagatgatcttggctgctcccccggccctcttcccgccctcttctttgttgtcccctgattatgcttgtttagcgctggggcagtcctcaaggattccctaaataaagccaaactaatgaacagtaatagcctgtgtttaaaaaaaaaaaaaatcggaacataagaaacctcaggctgtcttcgattactgttctagagaaactttatgtttacacgaataaggaaatgagtttttgttgggggttgaggaggaaggaaagtcatggtgttctgacgtggaaaacttctttaaaaggctgcttagtctttagtttgaaaataaaccaaaaaggtttaggagtcggggaaaggccctaggaaaatccagacagtggtcacgtttgtggacgacgtttagagcttgctatcctgggcacacaagaacccttggactgttcggtgcaaagttggcaaatcctacacggcctgtgccagggtttactttctgcatcaatttcacaggcgtccagcctggctgaggattttttgcggtttttaactggaagggaaataagtcggcatcagcacttagggctgcttaacttttaaaaggtggtagaacgcccagccttacacgctgctgcttaaattctcggtgctcaccaaggctgggctcgtgtggcccaatcctgcaatccccgaggcggtgtttcttaaagagtgggcttgattctggttaaacccattaagaagtcggaccccgggctcgtttcttgttctgt

SEQ ID NO: 93250 - DNA, 45 bp, Homo sapiens
  chr5:163604915-163604960
  hypo
aagatgggactcggccgggcgcggtggctcacgcctgtaatccca

SEQ ID NO: 93251 - DNA, 149 bp, Homo sapiens
  chr5:164218749-164218898
  hypo
gatgaattatagctccgtgtgacacggagatgaattttaaaaatctatagagttcaaaacaaagataaacattaacgtttcaaaaatgcatacccacctagcagaactataaaagggaaagtgagaaaataaaatcaaaagaatattgg

SEQ ID NO: 93252 - DNA, 24 bp, Homo sapiens
  chr5:16466772-16466796
  hypo
gaacttcaggccaggcgcggtggc

SEQ ID NO: 93253 - DNA, 24 bp, Homo sapiens
  chr5:16467096-16467120
  hypo
tggggaggtcgtagatttcatcca

SEQ ID NO: 93254 - DNA, 55 bp, Homo sapiens
  chr5:165029934-165029989
  hypo
caaacatttatttctcgattgaacccatcaccaccacaaccgcccttgctcactg

SEQ ID NO: 93255 - DNA, 91 bp, Homo sapiens
  chr5:1654294-1654385
  hyper
ctacaggtcagtgggcgatcaacagctggacgcgtagcagggggtatccgggtggcctaaaagaattcagcaaggccgactgcaggccgag

SEQ ID NO: 93256 - DNA, 330 bp, Homo sapiens
  chr5:1662561-1662891
  hypo
ctctgcctgcccagccgcccctctgcgccgggcaccactcagcacgtgggtgggagtggatgccgctccatctttaggacacttttactttctgtacatagtcctgcctgtcgggatgcaaaacagcaggcccagtccttttccgcaagacagcattccagataccgggaagcagacactccgtcccagtgctagtcggctgcgtgacagagtgcacaggtggggccgagaacacagcaacgtgtcccacactcccgcaggctggggacacgcagacaaagtgtgtccctgtgtctgtgtgtatctgtctgtgtgcgtccctgtgtctgt

SEQ ID NO: 93257 - DNA, 28 bp, Homo sapiens
  chr5:166269144-166269172
  hypo
atctgagtcggccagcgcggtggctcac

SEQ ID NO: 93258 - DNA, 89 bp, Homo sapiens
  chr5:166363557-166363646
  hypo
ccacaagcgctgcgtgcagctgcggtttctgcccgcgcctctccacacctccctgcaagcagagggagccggctcggctgaggccttgg

SEQ ID NO: 93259 - DNA, 1007 bp, Homo sapiens
  chr5:166405469-166406476
  hyper
agcactggacatgctcgcgagagccagggcaggctcgggtcgtccgcaggactcgaaggcttgctgtgctctcctgtttgcagagacctgggtgtagctgtggtgcatagatgtggtgcatcgggtgccgagcggatccctcggtgcgtgcagctagggatccaagcctcctcaggctaaccctagagccgaactgaactctgagccgcccggggttcgcgcgctcagttcctggtcttggaaacgcccagctggggttctctctgcagacaaaggggtgcacgtgtccctagcgcccctctttctcagccgtgagcccctccctggctgcgtaccccgcagccacagcagctgcagccccagcgccaccacccaaccccggcggcctgggccggtgcgcgctctcggggcccagggattggctcgcactccccattcagggaccgcgagggctagcgggcggcgcacggcgctctgtgtgtgtgtgtgtgtgtgtgtgtgtgtgtgtgtgtttgtgtgtgcgcgcgcgcgcgtgtgttgtgcggcgcgcgggcgagcgcgtgtgtgcgcgcgagagctcgcgtgcaggagtcactgggtgtgcgtgcgtgtgttatgggtttgattccagagcaggttgcacattggtcctgggtggctcgcaggctcaggtcgtgcttgggcgtcctcctcctaatcgtttccgaagtagcagcagcagcaccaccaccagcagcagcagcagcagcagcagcagcagcagcagcagcagccgccgcggcaacatcgagctcagcggcacagcaggcagaactgtgcagaagcgagcaccgtttggggagtccggggggcgggtaagagggaggagggggaaagcctgtcttggtctttgggattattttttttccccttctttccctctctctctctttcttgagggtgtgtgttgccccctcgaagtgaaggaattttgctccaaagcgagctgggaccgaagactctaggct

SEQ ID NO: 93260 - DNA, 151 bp, Homo sapiens
  chr5:166461205-166461356
  hypo
gaggcatgatagattcgcttatacatgttagaatgagatgataaactaattcattgtcctgcattggtatcccaatattgtactccttccaatggtcagtaacaaaagatagctaagagaaaaataggtgtacatgtgaaattattttggc

SEQ ID NO: 93261 - DNA, 43 bp, Homo sapiens
  chr5:166470722-166470765
  hypo
aatactgttctaagccgggcgcggtggctcacgcctgtaatcc

SEQ ID NO: 93262 - DNA, 83 bp, Homo sapiens
  chr5:166532947-166533030
  hypo
aggaatgtgtgtgcaagcagctttgagaaatgtgaagtattataatatgaatgaaaaatgatgtgaatcgacagagttttttt

SEQ ID NO: 93263 - DNA, 129 bp, Homo sapiens
  chr5:1667514-1667643
  hyper
cgttgccctgggaaccggggactgcagccgcggacttcggggtctcggctccggcccctgcaggaccgcgggcgccgccggggaagcgaggcctttgggtctgagggtccgagcggctcccggaggtgc

SEQ ID NO: 93264 - DNA, 450 bp, Homo sapiens
  chr5:1667644-1668094
  hyper
ggcggagataggagaccccccccgagcctggggggggcgcaggaagggggcgcgcggggcgggggcgcgcaggaagggggcgcgcggggcgggggcgcgcgttctccctccgggcagcctcgtgggcggtagatgcagccaacgcgtccgtcaaagcggttcaggggcgctgggaagaggcggcggtgaccccgggacggcagtgggcccgaccgagcctcagtgggggtcccgcgtgtacgctggcctcgccctcccgcctcgcttctgggcttttgctccaactctcagccgccgtggagatcgcagggggcgtagggccaagccagggattccgctgtgccccgggctcgggagaggtgtcccgggagtctatggcagaatttccccctcatcctgcgctgggagaggggtctcgccccggatggaactccgcgttcccacctccag

SEQ ID NO: 93265 - DNA, 146 bp, Homo sapiens
  chr5:1668306-1668452
  hyper
gctctgcaggtttctcgcggccgtgggtgatccggggggttgtggcccagcctggggttgtggtgaaaatgggcttttcagtaggggttggggcagtgcctggaataacccgcagtgctcacatctgcctgcggggaccttctgca

SEQ ID NO: 93266 - DNA, 21 bp, Homo sapiens
  chr5:166865441-166865462
  hypo
gctggagtgcagtggcgccat

SEQ ID NO: 93267 - DNA, 30 bp, Homo sapiens
  chr5:166920753-166920783
  hypo
gtccactcatttattcggcatatatgttca

SEQ ID NO: 93268 - DNA, 239 bp, Homo sapiens
  chr5:167000910-167001149
  hyper
aaagaaaaaaaaaggcggggggtggacttagcagtgtaatttgagaccggtggtaaggattggagcgagctagagatgctgcacgctgctaacaagggaaggaagccttcagctgaggcaggtaagcgccgatcggagggtttgaccgagtggcttagttaaatctctgttttcaccgttttgtaattgagaaaggcatccgcagcagaagccgatttttcagtcggcttccttttgtt

SEQ ID NO: 93269 - DNA, 152 bp, Homo sapiens
  chr5:16707883-16708035
  hypo
aagcatccgacaggccgcttcaattcctagtaatgcttctccagtcctctaggtaagaatgcttgccttacaagaacaaatatgttttggataagtcagccagttcagacctggagccatgtctaattcgctgccttcgacactggctaaac

SEQ ID NO: 93270 - DNA, 247 bp, Homo sapiens
  chr5:16744440-16744687
  hypo
ctgtcaatacacacacgttaaacacagggaaaggacgcccggccacacaaggtgtagtgatgaggcctgggcgaaacctgggtgcacacctttgatctattgtatcggtggcttcatggctcctctgcacctgggtggctgtgcgatacccttcccatgccaacgggattatggtgtatcataatgtgctagacccagagcaccccgacaccctgggtctcagcaggcgcggcgcagggcttcctgt

SEQ ID NO: 93271 - DNA, 30 bp, Homo sapiens
  chr5:167449482-167449512
  hypo
cccttggccatgaggcgctgcatccggctt

SEQ ID NO: 93272 - DNA, 30 bp, Homo sapiens
  chr5:167530477-167530507
  hypo
tctgtgacagttcctcgttactccttgtct

SEQ ID NO: 93273 - DNA, 99 bp, Homo sapiens
  chr5:167689244-167689343
  hypo
gtccagcatcgccagcgaagatagccgcaaggtggcatctgtgctgaacaacgcctactacctggacaagatgcactacagcatcgagggcaaggacac

SEQ ID NO: 93274 - DNA, 286 bp, Homo sapiens
  chr5:167955981-167956267
  hyper
gcatagactagacttcgaggatgaacatgacattttggctctctgtgtatccccattcacactgaagaatcaacaacacttccttgctgatcaatagtcccagaactggtggcacagccaggaccgacgctgatgcttacctccccctctcctgcagcagagacgcccccgtccctgtggcccagggaagtgccagggatccctgggaaggcgggagatggggaaggggcagggtgagcgaagaggagcaggctgcgtctgcacgcgggctgggaagcggggcttc

SEQ ID NO: 93275 - DNA, 65 bp, Homo sapiens; identical to SEQ ID NO: 30072
  chr5:167956413-167956478
  hyper

SEQ ID NO: 93276 - DNA, 140 bp, Homo sapiens
  chr5:167956683-167956823
  hyper
gggggcggccggggccgggggcgcggcggcggcgacggcaaggatcgcggcggcggtggacagcggcggggcggcgtggccaagagcaagagccgccgcaggaagggcgccatggtggtgtcggtggagccgcaccggca

SEQ ID NO: 93277 - DNA, 152 bp, Homo sapiens
  chr5:167956844-167956996
  hyper
cggggcggaggacgcgctggtcacgctgaacatggtgccgggccagtctgtgtacggcgagaggcgcgtcacggtgaccgagggcggcgtgaagcaggagtaccgcacgtggaacccgttccgctctaagctggccgcggccatcctgggcg

SEQ ID NO: 93278 - DNA, 182 bp, Homo sapiens; identical to SEQ ID NO: 40512
  chr5:16809241-16809423
  hypo

SEQ ID NO: 93279 - DNA, 166 bp, Homo sapiens
  chr5:168192155-168192321
  hypo
cctgaaggcgtgcaccggctgggctgtggctggggacagccgcctattaaatgcattttcattttaatcaaggtgagagcagcctgtagttagcaggaatcgctctcagtagtatagttagattataactggtggacctctgcaatggagccgctgacccatttta

SEQ ID NO: 93280 - DNA, 190 bp, Homo sapiens
  chr5:168195076-168195266
  hypo
gcaggtggtgggctgcggtgctccagagcagaggagaggtgtccagcggtggtggcggcggtggcgggccatgctgcaggagagcacggtgctttccgcggtgcttgacagaaccatgttccgtttccatcgttccaccacatggttagatcaagcacaaaggaaagccccgcagcgactggtcagagtc

SEQ ID NO: 93281 - DNA, 57 bp, Homo sapiens
  chr5:168231749-168231806
  hypo
tgaagaaagaagaagcgaagtctccactccactgtggtaagtcgtatgcttcttccc

SEQ ID NO: 93282 - DNA, 197 bp, Homo sapiens
  chr5:168233348-168233545
  hypo
tccagcagccccacacgctgatggcctagtgggtgatgggctgggacagggagctgaattctccggcgacagttgttgggggtgtcagacaggtgcacttacatttcgacgatgccctccggcaagttggcaggaatctccatcaagccctttcctcgacagtccacgatgttattgctgcacgtgcagggcgaagg

SEQ ID NO: 93283 - DNA, 30 bp, Homo sapiens
  chr5:168244450-168244480
  hypo
tggttggagtggaggcgcctgggagagggc

SEQ ID NO: 93284 - DNA, 30 bp, Homo sapiens
  chr5:168250255-168250285
  hypo
cttactcacagagttcggatcttcggcatg

SEQ ID NO: 93285 - DNA, 74 bp, Homo sapiens
  chr5:168253292-168253366
  hypo
tggggctggccagcccggggatgtcagagggttggtaacctctcagacgctgattgctacgacagctacagttt

SEQ ID NO: 93286 - DNA, 30 bp, Homo sapiens
  chr5:168258418-168258448
  hypo
gatctccctgtggaccgtttaaattaaagc

SEQ ID NO: 93287 - DNA, 278 bp, Homo sapiens
  chr5:168267858-168268136
  hypo
ctatggcaatggccacgagtgggaataaatcatctctggggcgacaagtgtatcagtgaaaaagcaggacgagttccttactcctgcaagtttgatttaccttcaactttgtgggcacccgttaactgggtaaagggaatggcagggccaatttcacaagcctgtgaaaggctccgacattctccccagcgggattgtgagtcattgctagtttgcctccatcagttcttgaggccagttcacaccaccctgcagcccacagccgccatgcttcaggg

SEQ ID NO: 93288 - DNA, 24 bp, Homo sapiens
  chr5:168278312-168278336
  hypo
gtgagactccgtctcaaaaaaaaa

SEQ ID NO: 93289 - DNA, 43 bp, Homo sapiens
  chr5:168289177-168289220
  hypo
agcataagaatgatacgttggactttggggactcgggggaaag

SEQ ID NO: 93290 - DNA, 92 bp, Homo sapiens
  chr5:168337394-168337486
  hypo
gtatatttacacactcgcacacacacacatatttggccatatatcaatgatggattaaaccatcacaattgccgccgggcgtggtggctcac

SEQ ID NO: 93291 - DNA, 114 bp, Homo sapiens
  chr5:168372951-168373065
  hypo
ttggaaagtttctcgcgtactgtttctaaattccttgttacaataatagccgcactctatgtactaagttttatgtgctgtattcttatttaattcttacgacaatgctagggg

SEQ ID NO: 93292 - DNA, 22 bp, Homo sapiens
  chr5:168614854-168614876
  hypo
gctgcaacgataaattcttaaa

SEQ ID NO: 93293 - DNA, 573 bp, Homo sapiens
  chr5:168727355-168727928
  hyper
tacagacccccagctcggagagtgagggatcgtatccaggaagggatgagaatagagactgcatccagggaggccgaggggaaaggacggatctggcgcctggggccccctcggtgggacccaggtgggtggcccgcgtggggtggggcaggggtactcacaggcgctcagcgttgcgggggatgccccgaggaaccgcgcggaggcccagcccgtggcagtccacgctggcagcggagcaggtacacttggtggggcaggcgacggctggaggcccactcaggacgctcgccagcgccaaggccagcgccaggcgggcgcgcacggcggcgccgacccctgcccacccgggggccatggtgtgcagggccccgctcctggaggaggctgcctctgcggggcaagacgcgtggagcccgaggaggcgcgcggggagcgcgggcggcctggggagcgggcggcggagttagcgcggaggaggggcgagctcggtgctcaggcgcacggggcgcgggcggagcggggcgctccgggcggcggcggcggcagcaacagcagctccatcggcggggc

SEQ ID NO: 93294 - DNA, 82 bp, Homo sapiens; identical to SEQ ID NO: 8166
  chr5:168727994-168728076
  hyper

SEQ ID NO: 93295 - DNA, 276 bp, Homo sapiens; identical to SEQ ID NO: 30077
  chr5:168728077-168728353
  hyper

SEQ ID NO: 93296 - DNA, 41 bp, Homo sapiens
  chr5:168728570-168728611
  hyper
tgtcgcccacgaagccgcttccctaccgcacctagtactca

SEQ ID NO: 93297 - DNA, 30 bp, Homo sapiens
  chr5:168771979-168772009
  hypo
acatatcccaggcaccggtggacagcaatc

SEQ ID NO: 93298 - DNA, 522 bp, Homo sapiens
  chr5:169064008-169064530
  hyper
aactctctgcacttgcggtggtggtctggcgagccccaggtggggactggcctctgctccctcgcctggggaggagacaaagtgggagtggtccccaagttttgcgtgaagtggggtggggtggcgtgtcttagcctacggggcaccagccttctagtgtgcccctgcccaacgggagggaggagggagcggggagccccggcgagggaggagagggcgggccctgagaggagtttgaaaagaggaaggaagtggggccctgcggcgcccagccaccccctgacggcttccccacgggaggacgcgaggccccggcccagccatggccccctggcgcaaagctgacaaggagcggcacggcgtgggtaggtgcgggccccagggcgcggcagggagcgggacaggtggcgggagagccgcgagcaggaggatgctgcggggccggcggcgcggggtgggcagggcgcgctgcctgcaggtcagagggcgcagcctgcggcggggcctcggggcgggaaagcc

SEQ ID NO: 93299 - DNA, 274 bp, Homo sapiens; identical to SEQ ID NO: 2677
  chr5:169064531-169064805
  hyper

SEQ ID NO: 93300 - DNA, 30 bp, Homo sapiens
  chr5:169127084-169127114
  hypo
ggtggacaggaccaccgtggtggccaggaa

SEQ ID NO: 93301 - DNA, 102 bp, Homo sapiens
  chr5:169157436-169157538
  hypo
gatgaatttggacagcgagtcagaggctaccatgcagggattattctaggcacattgcaaactgctcagaggggatttaactaaaaacgcttgtatggcagg

SEQ ID NO: 93302 - DNA, 30 bp, Homo sapiens
  chr5:169158556-169158586
  hypo
tcagcaacacgaaaacggactaatacagac

SEQ ID NO: 93303 - DNA, 30 bp, Homo sapiens
  chr5:169165242-169165272
  hypo
ggaaaatgctatgatcgcatctgtgttttt

SEQ ID NO: 93304 - DNA, 194 bp, Homo sapiens
  chr5:169323759-169323953
  hypo
gatatagtccctacccgctgctcacagtgggtgtgggagtcgattgataatgtagaagaggataaatgtttataataaaatgcagatgccatagaactaaaagcaattagtagatgacagaagatgagaggtaaaaaataaagttaataaagaggagaaaaactgagcatcaactttgacgtgagcttcctagt

SEQ ID NO: 93305 - DNA, 30 bp, Homo sapiens; identical to SEQ ID NO: 29492
  chr5:16934552-16934582
  hyper

SEQ ID NO: 93306 - DNA, 61 bp, Homo sapiens
  chr5:16935556-16935617
  hyper
gggcagtcgagcgggcggatcgccccgcccgcgccccggcgcgcgccgcctcacctggcgc

SEQ ID NO: 93307 - DNA, 438 bp, Homo sapiens
  chr5:16935883-16936321
  hyper
ggagcgcacttacctcggtgaagaagttatccattgttccagcgcagtcccggactcgccgagtgccgctccgactcgcggaagtcagcgccgccgcgggtccggggaaaccatgcgtgtcacggcgccactcccgaggacgcgcgcccgcggggctcccctgctgccatcgcccggtcccttcttgtccttctcaccttttgttcgcccaaacccaagtccctaactcgcccgtcccgacggcagcctttgtctcttcttcctccaagttcctcactactgggcgcagcgctcgcaagcggagaacagctggtggcacattcttcccccaggcgggggaaggcggcggggtgctggcgagcgcggccccctccctctgcgctccggccgggggccctcggggcgggcaggaggacagcgggccgcaaagtgagcagg

SEQ ID NO: 93308 - DNA, 249 bp, Homo sapiens
  chr5:16936584-16936833
  hyper
ccgcaggctcgttagcggacccgggagggggccgcgtgtttccccaggtcttcccacgtaggcgtggggaggggatttaactcttccctctgcagagagagactaaacaatcacttagaggggaggagaagggactgggggcttctgtgcctttcatgtttagcagacccgggaaccggctcaacacggatctcattaatgcagcccggtagactagcaatctcgggaaggaagcgcggtcagcggagc

SEQ ID NO: 93309 - DNA, 223 bp, Homo sapiens
  chr5:169532899-169533122
  hypo
tgtcaggggcagctccggggtgcaggtgccaggcaggtggctccggccagcccagccccagcatgagctccttcgacctgccggcgccctccccacctcgctgcagcccccagttccccagcatcggccaggagccccccgagatgaacctctactatgagaacttcttccacccacagggcgtgcccagccctcagcggccctccttcgaggggggcggcga

SEQ ID NO: 93310 - DNA, 175 bp, Homo sapiens
  chr5:169655548-169655723
  hypo
ctgcagagtctgagacgctgtgctttaaagtgattgatgtatcatgctgagaaatcacctgacaggggttaaaattatgactaggctaaataaataatcacgaagaaataaatctcattatcattaatgttaataatccttgtaaacattttcgtagatacgcttccaaatttgc

SEQ ID NO: 93311 - DNA, 143 bp, Homo sapiens; identical to SEQ ID NO: 40633
  chr5:169658356-169658499
  hypo

SEQ ID NO: 93312 - DNA, 51 bp, Homo sapiens; identical to SEQ ID NO: 40634
  chr5:169660169-169660220
  hypo

SEQ ID NO: 93313 - DNA, 96 bp, Homo sapiens
  chr5:169660603-169660699
  hypo
caggccttgagtcagcgacatcctggcttctgaccccccattcctatggcccctacagtctggtctccgcttccccactcccggtgaattgctgtt

SEQ ID NO: 93314 - DNA, 40 bp, Homo sapiens
  chr5:169866477-169866517
  hypo
tgtgggggacgggggcgggggggtgcggagcttggcacca

SEQ ID NO: 93315 - DNA, 154 bp, Homo sapiens
  chr5:169877679-169877833
  hypo
tgctccgaccacctccgccccgatccccagaaacagtttcccccttctctttctctggccaacttctatcggttttcagaatgtctcccctggccacgcaggatcccttccattttgaggctgataaaatcctgcggatcgcaagctgagcgct

SEQ ID NO: 93316 - DNA, 82 bp, Homo sapiens
  chr5:169930863-169930945
  hyper
tgctcccggggctcccgcacataccccggcagatgagggtgcgcaggggtgagggcgcagggctgggcgtcccccgccccca

SEQ ID NO: 93317 - DNA, 104 bp, Homo sapiens; identical to SEQ ID NO: 30082
  chr5:169931223-169931327
  hyper

SEQ ID NO: 93318 - DNA, 131 bp, Homo sapiens; identical to SEQ ID NO: 30083
  chr5:169931353-169931484
  hyper

SEQ ID NO: 93319 - DNA, 30 bp, Homo sapiens; identical to SEQ ID NO: 40635
  chr5:169932029-169932059
  hypo

SEQ ID NO: 93320 - DNA, 30 bp, Homo sapiens
  chr5:170028243-170028273
  hypo
ggctgggagtcacagcggtgtagaggagaa

SEQ ID NO: 93321 - DNA, 483 bp, Homo sapiens; identical to SEQ ID NO: 30084
  chr5:170107959-170108442
  hyper

SEQ ID NO: 93322 - DNA, 41 bp, Homo sapiens
  chr5:170171099-170171140
  hyper
ctgtcagaggtgggccgggggaaacgcgggcaggagaaggg

SEQ ID NO: 93323 - DNA, 30 bp, Homo sapiens
  chr5:170171383-170171413
  hyper
ggtgcctccagagaccgcaagagaacagct

SEQ ID NO: 93324 - DNA, 32 bp, Homo sapiens
  chr5:170289702-170289734
  hyper
gctacgaagatgggacgcgtgcttgtatatcc

SEQ ID NO: 93325 - DNA, 42 bp, Homo sapiens
  chr5:1704607-1704649
  hypo
gattgtgggccgatccggctccagccccgtgaaggtgcaatg

SEQ ID NO: 93326 - DNA, 30 bp, Homo sapiens
  chr5:170675080-170675110
  hypo
cacaggaaggctgggcgcgttggctaacgc

SEQ ID NO: 93327 - DNA, 35 bp, Homo sapiens
  chr5:170687481-170687516
  hypo
aaagagatagataacagagacgaaaaggtgagtgg

SEQ ID NO: 93328 - DNA, 21 bp, Homo sapiens
  chr5:170717082-170717103
  hypo
atgactcgggccagacgcagt

SEQ ID NO: 93329 - DNA, 60 bp, Homo sapiens
  chr5:170733836-170733896
  hyper
gcgctgtgccacccacgccttaattctgtgccacaaacctctgtgcggtgggccttgttg

SEQ ID NO: 93330 - DNA, 222 bp, Homo sapiens
  chr5:170735099-170735321
  hyper
agagtttgcacctaacgattttagaattcgctggaagaaaatgattccgcttgtctccccaaagctgcagcggaaggtgactacttcgtgtgcggtcctgtccacggtgccctgggccgggtagacagtcactgaggcgcgagcagaacggggagtggttccagcgcccaaagtggactggagccgggaagggctcaccagtcgcgtttcccaaagaaatcc

SEQ ID NO: 93331 - DNA, 434 bp, Homo sapiens
  chr5:170735730-170736164
  hyper
cggtagcgtccaaggggcttctgcggattccgccgggtcgtcccggggttgcaactccattgtacctgaaaggatgcatttggtttggcttttgctcagatgaaaaaaaaaaaaaattggaagaaaacgaaaacccactcagcaaaagacaatttcacaagcggagcgctctacccacccagcgcggtgtctgggaagcggcccggcccggaggagcggggagcgtctgctaattgcagcttcgttagatttcgggtttgggaggctgtggttcgggctctaatatccgccgcccattatccctgctaataaatttgacctattgttcgtttgttaaaatgatgtcaccttggaacagtccctaagctcctatttccatgaattaggcctttattgaaagccgggagccaatgagaggagagaggcttgttgat

SEQ ID NO: 93332 - DNA, 116 bp, Homo sapiens; identical to SEQ ID NO: 496
  chr5:170736715-170736831
  hyper

SEQ ID NO: 93333 - DNA, 437 bp, Homo sapiens
  chr5:170737281-170737718
  hyper
cgcttccatcgccagaagtacctggcctctgccgagagggcggcgctcgccaagtccctcaaaatgacggacgcgcaggtcaagacctggttccaaaaccggaggaccaagtggcggtgagagaggcctgacccggcccaccttacacctgcccttcacctgtcccgccccgagccgcagcctcgcactagccctattttaaggctatccactacccccgcccccctctgcctcccccaaacacacccccaccccgccttcgcagattgtacctcttcctttcacccttctcgctggcctgtgcttctctctccatcgtggtctcccacgccttggtttctcctccatccccatccccatctttcgtgagcccctccaactctctccccgtgttttgtacggtctcctgcgttcacttgatttcctctcacccaccc

SEQ ID NO: 93334 - DNA, 86 bp, Homo sapiens
  chr5:170737778-170737864
  hyper
gcactctccttctcctccttcttccagcccgccctctcggattttcaacaatcctcgtggacgccggtttcctctccccccatctc

SEQ ID NO: 93335 - DNA, 755 bp, Homo sapiens; identical to SEQ ID NO: 499
  chr5:170737935-170738690
  hyper

SEQ ID NO: 93336 - DNA, 1154 bp, Homo sapiens
  chr5:170738823-170739977
  hyper
cgccccaggcccgggcctgacaagaaagcgccttacgtttctccgccccccgcccgcaccccccgggccgggcgcctgtattatactttgtacttttgcccaaacgtgtaaataataaaaaagttttggcttttttctttagaaaccggccacctgcttcccccgcgggggccgctggaggaagggcagccgacccggccgctgggggaagtgccaggggcccggggcaccctgcgtttaggctgggtccactcttcttcttttccgttccttttatttaagtctttttatttaataaaaaagttagctatttcacttaacgccgcttttatttcgttttcgttccaataatgctcggcgacccccggccctgcgccccacccctgcggcggtagaagccgagcggcggcgcgcagggcgcgtccacttccgcaacgttcgtctgcattcgcctcggctgcaaccccggcccgggcccccgaggaggatgcgcggtgcaggtcagttggtgccggccacccgcagcctgggtgcgcacgggatggggactggacatgggaaaggtgctccaggcccgaaggccgcgggccagcgccggggcgggctggggagtgaaaggctgggcctgggcagatgcctaggccgtccccaggtcaaatccacctggggggtgggaggcagggtggcctcgaacttcttagagctcaagtcggaactcggagccccacttcaccccgcaactcgctttccgccctctttttcccgcggagcctcagagaggacctggctctggccagtctgcgcgcgctgtgggcaggctttgcgcgcagagccgctgcaaatcctcggtctccaaacgcctggggagcaaatgcagcgcacaaccctaggggccctctccttgtcgggtttgcgtgggaccccaggtggagcgtgacgtcatgtgacgtcaccgcagcccccgcggtgtcactgggctggagtgggcggggcgcccggaactcagaactctaagcgctggtgtggtagcgtcgtggccggggtccacccagctccaccgtggctcaagagctggaagtttcagaattgcgaggtttggagcggctgaccccttccagtcacatctaacacacaaagcccgtgaacacttcctc

SEQ ID NO: 93337 - DNA, 139 bp, Homo sapiens
  chr5:170740191-170740330
  hyper
agccttttcttgttccgtcgtctcctccttcttctctccccagttctgactcttggcctctgtgtgtctctgggtttctttgtctccctcctctccacggtcctcttgtccttttgtcttccctttcttgtttcttgaa

SEQ ID NO: 93338 - DNA, 88 bp, Homo sapiens
  chr5:170740390-170740478
  hyper
tctcttctttcctttctccctgactccctctctccctcttccaggcccagctcccagtagctcctaaggcaaaacactttcggggccg

SEQ ID NO: 93339 - DNA, 99 bp, Homo sapiens; identical to SEQ ID NO: 2686
  chr5:170740574-170740673
  hyper

SEQ ID NO: 93340 - DNA, 376 bp, Homo sapiens
  chr5:170740674-170741050
  hyper
ctcccgccgtcacctccacctccaagcccagctagcctgggatctgcgcctttcaggacataaagacacccagggagggactagggtgactcagaacttcgggtctcttccgtgagtgttttcctgaaatgcttttattttctccaataaaaagcctgatgaacgccgtcatcgggttgggaaaggttggcccttcggctgaggactagagggacccttgactttgctggcggagaagcgctttcctcagagacgggtgtcgcggtccagctcccttccgttccgttttattctgttgctccataataaggcctagcggggttttttttcttaattgtttttatttcaacgcgcttttggggaacagatggtcagg

SEQ ID NO: 93341 - DNA, 806 bp, Homo sapiens
  chr5:170741470-170742276
  hyper
ggattacaggcgtgagcccccgcccccggcccaacgtatcattcttataaggcctagtatttttgtttttcaaaattacttctgttgttttgccagggtgacactcaattctttgggcctctttggagacacacgcacgttgtttttttttctttctgttgggcgcctcgctttgcgcagaaggcctctggcccggaggcccgtccggggtaggcgtccaggcaggccgggggtggggggccggtctggcttcggccctcggggggcgcctggctttcccgcacctagtgccttcgcggcgtttggcgtcttccagcgctttgccctcacccagccttgcccagccagagacgggctacgggtcttttcctgttacagagctgagcccactcatgtggtgccaagtagcgactatctctcggccacctccacccagagcaatgtgggcgcccccagcgggtgggagcgattgccgagcggcgcaagggcgtttaacgcctaaccccctcctcctgggttgccaagccgctaggtcgccgtttccaacgtggctgcgcgggactgaagtccgacgactcctcgtcctcagtaggagacacacctcccactgcccccagccacgcgagctatgggcagaatcggggcaacggtaatatctggatggggcaggctcccctgaggctgtgcttaagaaaaaaggaatctggagtagcctgaggggccccacgagggggcctcctttgcgatcgtctcccagccttaggccaaggctacggaggcaggcggccgagtgttggcgcccagcc

SEQ ID NO: 93342 - DNA, 214 bp, Homo sapiens; identical to SEQ ID NO: 30097
  chr5:170742386-170742600
  hyper

SEQ ID NO: 93343 - DNA, 178 bp, Homo sapiens
  chr5:170742672-170742850
  hyper
cgccgaaaactctggggccggccgctcgcttcccgctagtgggaatggtttccggtcatccgttcccagtccagccccgggtagggagctctgatttgcaatgcacagcacttgcgaggttcgaatgcccccgcaatttgcagatggaaatactaagcctaggccgggcgtggtggct

SEQ ID NO: 93344 - DNA, 330 bp, Homo sapiens
  chr5:170743150-170743480
  hyper
caaagaagctctgataatagttctgggtcgtgcagcggtggcggccccgcgctctcgcccctaaagcaagcgctctttgtactgggtggaggagctttgagtagtgagggtggagatgcagcttcggggtggcgcagccaccctgacactaggcccggggtcgcagtgggacagaagagtctgccgctctgacttgggctctgagttccaagggcgcccggcacttctagcctcccaggcttgcgcgctggcgcctttgccatccgtgccgaagtggggagacctagccgcgaccaccacgagcgcagcggtgacacccagaggtcccac

SEQ ID NO: 93345 - DNA, 482 bp, Homo sapiens; identical to SEQ ID NO: 504
  chr5:170743646-170744128
  hyper

SEQ ID NO: 93346 - DNA, 187 bp, Homo sapiens
  chr5:170744375-170744562
  hyper
ttgtcctctggtcaccggtagtagagacagtcgcacagtcatctgggaaacttggcctggctccatctgcctagacttatcagtgtcctggtattaccctgaggttagtggccatcacaccagttgaaacgaatgtcgttgctctgtcagacccgctgccaattaatgagttcgttattcaacccct

SEQ ID NO: 93347 - DNA, 381 bp, Homo sapiens
  chr5:170745099-170745480
  hyper
agcaccctttgcctccgtcccccatccaggaaaaatccacttcttcctccagccagcagagactcagccaacaagaggaatgcagagcactccagagaagaacagagaactgcccttccccccgcccccaccacccccagtcagggaggtagccctccattggtcctagggggcgaggtccgccctgaggcaggagaagttggtgttgagctcaggggccgatggtgattatccagcatgcgaagctgccttgcatttgcatccactgttcaggtgctacagctggggcacttttgttcctgggacgtagtgagactaagaagaaggggaggggagagcagagagggaacgcaaccccggggaagacgccaagagagggtg

SEQ ID NO: 93348 - DNA, 30 bp, Homo sapiens
  chr5:170749758-170749788
  hypo
ttacgcacattaaagcgctctttaaattct

SEQ ID NO: 93349 - DNA, 30 bp, Homo sapiens
  chr5:170763990-170764020
  hyper
cccagcaccatattacgcaaacaaaatgat

SEQ ID NO: 93350 - DNA, 30 bp, Homo sapiens
  chr5:170786850-170786880
  hypo
tgttttcatgcatcccgtgtctggggacat

SEQ ID NO: 93351 - DNA, 41 bp, Homo sapiens; identical to SEQ ID NO: 40636
  chr5:170811632-170811673
  hypo

SEQ ID NO: 93352 - DNA, 23 bp, Homo sapiens
  chr5:170813569-170813592
  hypo
caacacagcgagactctgtctcc

SEQ ID NO: 93353 - DNA, 109 bp, Homo sapiens
  chr5:170847266-170847375
  hyper
gcctggctgtctgtccgtatgcctgtgccctgtacctctgtctgcccgcccgtcggttcacctgactcttcgactgcgtgtctgtctgtccgtgcgcccccttcctcag

SEQ ID NO: 93354 - DNA, 27 bp, Homo sapiens
  chr5:170847717-170847744
  hyper
ggcgggctcagccgcaacaatataccc

SEQ ID NO: 93355 - DNA, 4 bp, Homo sapiens
  chr5:170848081-170848085
  hyper
ggtt

SEQ ID NO: 93356 - DNA, 71 bp, Homo sapiens; identical to SEQ ID NO: 40637
  chr5:170919575-170919646
  hypo

SEQ ID NO: 93357 - DNA, 143 bp, Homo sapiens
  chr5:171021838-171021981
  hypo
gatgataaacatcagcgttgattaaatctcagtggtagatcaatggatgtcacactattttctttacttttaagtatgtttgaaatattttataataaaaataaagcaagcaagctttggagaaatcagagatgtaagagtcc

SEQ ID NO: 93358 - DNA, 30 bp, Homo sapiens
  chr5:171239105-171239135
  hypo
cagaaacctcttcctcgatttttctactgg

SEQ ID NO: 93359 - DNA, 66 bp, Homo sapiens; identical to SEQ ID NO: 40638
  chr5:171247586-171247652
  hypo

SEQ ID NO: 93360 - DNA, 30 bp, Homo sapiens
  chr5:171263972-171264002
  hypo
ctacactgtggcacacgtctgtggtcccag

SEQ ID NO: 93361 - DNA, 83 bp, Homo sapiens
  chr5:171382147-171382230
  hypo
gatggtagaaacttccggaatgggtaaattatgcctaagggcaactactatcttccctccggctttttcgaaaggtaaactaa

SEQ ID NO: 93362 - DNA, 39 bp, Homo sapiens; identical to SEQ ID NO: 40639
  chr5:171533619-171533658
  hypo

SEQ ID NO: 93363 - DNA, 76 bp, Homo sapiens
  chr5:171708301-171708377
  hypo
ttcagattaaaaacacggcaaaacccacctctactaaaaattttttaaaaattagccgggtgcggtggcatgcacc

SEQ ID NO: 93364 - DNA, 151 bp, Homo sapiens
  chr5:17203026-17203177
  hypo
gcgtgagccaccgcgcccggctgggagttcttttttttttactgttggtgatgacaggactgtgaagcagtgggaattggagggctcaggctatggagaaggggaagtccttttgcatatggtattaagaaggcggcggacactgggactg

SEQ ID NO: 93365 - DNA, 30 bp, Homo sapiens
  chr5:172074582-172074612
  hypo
gctgccccttgtcctcgtcctgagcacctg

SEQ ID NO: 93366 - DNA, 475 bp, Homo sapiens
  chr5:17216663-17217138
  hyper
gctcgcaagcagcagcgtgcgggctgcctcggccaaccccgtcttctcaatattggtggcctccattaaagcacagacatcaaaaacatcgacggcccctttcccctcttctcttccctccttcctctcccaagttccgagagcatcctccgaggggcgacgtctctcgccccaccagctggacctcggcgaccgcgcctcccccgaagctgcagccttcggggctgagccccgcgggtgcgggtgcaggtgcggagccgcccaaggtgcgcaactcgtttgcagcggcgcagcccagacgcgcctgcagctggggctcaccccaacctcgctgccagccgaggtagcggaatcgtagtcgacgtcgggagcgggctggactggggtctgagaagggtagctggtgccagggggtgtcattcatcacctcgaggcagctccctaagtctgagcgagagcccgagcacttcttatc

SEQ ID NO: 93367 - DNA, 184 bp, Homo sapiens; identical to SEQ ID NO: 29496
  chr5:17217681-17217865
  hyper

SEQ ID NO: 93368 - DNA, 943 bp, Homo sapiens; identical to SEQ ID NO: 29497
  chr5:17217991-17218934
  hyper

SEQ ID NO: 93369 - DNA, 30 bp, Homo sapiens
  chr5:172189170-172189200
  hypo
gggattcagtctcatcgatttcatgatttt

SEQ ID NO: 93370 - DNA, 234 bp, Homo sapiens; identical to SEQ ID NO: 29498
  chr5:17218985-17219219
  hyper

SEQ ID NO: 93371 - DNA, 30 bp, Homo sapiens
  chr5:172204547-172204577
  hyper
gcccaggagagggaccgggaacagcagggc

SEQ ID NO: 93372 - DNA, 120 bp, Homo sapiens
  chr5:172235653-172235773
  hypo
ttcatgccattctcctgcctcagccaccacgcccagcccctaaattctttttttatttgatttttgttttgttttgttttcttttcttttcccagatggggtatcgctgtgttgtccagg

SEQ ID NO: 93373 - DNA, 36 bp, Homo sapiens
  chr5:172384947-172384983
  hypo
taactgtgaagggcccggaataaaacctagtattag

SEQ ID NO: 93374 - DNA, 96 bp, Homo sapiens
  chr5:172385283-172385379
  hypo
aaaatctagtattagtaaacgcaggtgtttaacaatgtcaccactacatgtcagggaacactgataaactaagagagagcacgggacctgcctggg

SEQ ID NO: 93375 - DNA, 157 bp, Homo sapiens
  chr5:172386958-172387115
  hyper
agatcatgtcatccccgctctccaaggagctgcggcagaagtacaatgtccgctccatgcccatccgcaaggacgacgaggtccaggtacgtctccctccggcgctagtggcgctcggacaccgttgcctaagaacgtcatgcgtggagcagtcaca

SEQ ID NO: 93376 - DNA, 736 bp, Homo sapiens; identical to SEQ ID NO: 30104
  chr5:172655825-172656561
  hyper

SEQ ID NO: 93377 - DNA, 634 bp, Homo sapiens
  chr5:172659392-172660026
  hyper
acaaactctcccgtgcgcaagaacaaacgcgcgtgggacagaaaaagttcctaggtctccgcaggagtgaatgcaaaatccaggggactcagggtcatgttgggagccccttctccccccgagagtcagggagctgttgaggtgggatcggtcagggtcgcgccacgcgggtcccttccctaccaggctcggataccatgcagcgtggacactcccgagttgctctgcggaatcccggggctctgaaccgcattcaagtccccgacgccgaagttcacgaagttgttgttggcggcggcagtggccggctgcgctggggaaggcccggcggggtaagcggcagtgcagctgtagccagggctgcaggccgcgccgccgtaacccggataggcggggtaggcgttataaccgtagggattgaggcccacgccgtaggcaggcgcgtagggcgccgagtcccctaggcatggcttgccatcgcgcaccagcactggcaccgcgatcctgcgggcaggcggcggcggcggcgggggcagccccaccagctccagagtctggtcctgccgctgccgcttgcacttgtagcgccggttctggaaccagatcttgacctgcgtggacgtgagtttcagca

SEQ ID NO: 93378 - DNA, 113 bp, Homo sapiens; identical to SEQ ID NO: 30106
  chr5:172660141-172660254
  hyper

SEQ ID NO: 93379 - DNA, 39 bp, Homo sapiens
  chr5:172660469-172660508
  hyper
ggtgagggagacagacggtgacttaaaatttcaggctgc

SEQ ID NO: 93380 - DNA, 433 bp, Homo sapiens
  chr5:172660568-172661001
  hyper
gggtgaactgaattagggctagtttggtttgagaagttaaatgaacagaggccgaggcctcactgctagggacggtcttatctcaaaattaaggaatcaagaaacagaaggccagggagtgttggtttggtgatcggaggctccagcctggccgcagcagggtttgcgcagtgtccaagaagctgcgggtgggcaggcggcctcggaacctgccttgctggcttcctcgaattggtagcgatcagttctagccgccgtgcccgcccgaatttgttcccaggcctctgctcctcaacaaacctatgaattctctcccggctggcagcggcccttcgcccagcgcttcgcccagcgcctgcggcctcccgggaatcgcccgggctcctgccttgggctggggggtctcccagaaggcccctttctgcagcggggc

SEQ ID NO: 93381 - DNA, 20 bp, Homo sapiens
  chr5:172661126-172661146
  hyper
cgcgccggcaagttgtgctg

SEQ ID NO: 93382 - DNA, 856 bp, Homo sapiens; identical to SEQ ID NO: 30109
  chr5:172661471-172662327
  hyper

SEQ ID NO: 93383 - DNA, 30 bp, Homo sapiens
  chr5:172663838-172663868
  hyper
ttgggtgctcaaacccgacagtgtgccgtc

SEQ ID NO: 93384 - DNA, 387 bp, Homo sapiens; identical to SEQ ID NO: 30110
  chr5:172664210-172664597
  hyper

SEQ ID NO: 93385 - DNA, 501 bp, Homo sapiens
  chr5:172665448-172665949
  hyper
ggaatgtcattaatgcgctggggagacgtccattggagacaggcggcgttatccgcggctttatcttcaacaacgcctcgctctcggcccgcgcgggggaaacagatgggagtttctgtctgggacgctcgccccatgtttatattttgggaagaatcgcaactcgtgggagtccccggctggccccctgataaatgaacattagcactttttcggactactgtatcaacaaaggggctgcggcgctgcaataattggcgagaaagcaaacagagggccgagagcgcgactctgctcttcgtccggctgatggatgagcagctccggctgcgcgccggactcccggcctcggcctccgcctccgcctccgcctccgcctccgcgctgggcccctccgccgcccggcttccttcctggccgggagttgggggcggggggcgactctgagggccgccgacctcgcccttggctccggaagagtccaggcggcctccgcggcac

SEQ ID NO: 93386 - DNA, 30 bp, Homo sapiens
  chr5:1726678-1726708
  hypo
tcattggggtggccccgatttgctaggtct

SEQ ID NO: 93387 - DNA, 408 bp, Homo sapiens
  chr5:172670755-172671163
  hyper
gtatgtttcccaacccgaatttgtcctggattagtggatatgatccgctttcaaactagtgttagggtttgcctcggattccgaggatccgagggagtcgctttcagacttccggtgtcctttcgcgttaatttcgtcctcttttcttctctgggctggggctggtggctgccacatcccaccccttctgccccgacggctgcaaaccgcttcagccaaaacgggcggagaggcggagagaatcgagacgctggaatcagttcctcggagtcccgtcgctggaggtcacagctgggaaaatcaggtgacattcgagtcagatggacaacgactcagatacagtgaagaggaaaatggttgtcctggggctggttcgcgcctgcccggcgggtgtgaagcccggggaac

SEQ ID NO: 93388 - DNA, 237 bp, Homo sapiens
  chr5:172671245-172671482
  hyper
cgcgggggaccagccgggccgacggcagcgctgcgggtgggttgggtcgtcggccgccgctccccggagaggtgaagagtcgcacctaccaccgggcagcctccgcggctctggccgaaaccccggctggccgcagctccgggagcccccagccctgtgctgctgcggccggctcagtgctgaattgatgctggaaacggctggccagcgggcctagggtcgccgcctttccctcct

SEQ ID NO: 93389 - DNA, 198 bp, Homo sapiens
  chr5:172671639-172671837
  hyper
cgcaagcggtgtctgtggagagcctcccgggggcatggcacgggggacccggaggccaacaagctgcgcgataccggagcaaagtcgggatcagcagccgcctttcgcggagggcgttctgcgctccaagcaaattggcgaaatgcggggattcagacacgaaacgagcgcgctagaaagggtcgtgttgacacatcc

SEQ ID NO: 93390 - DNA, 40 bp, Homo sapiens
  chr5:172672286-172672326
  hyper
cgcccggcctgatgtgctttaaattcgctaaaacgacacg

SEQ ID NO: 93391 - DNA, 225 bp, Homo sapiens
  chr5:172672668-172672893
  hyper
ctccgcgtttcctgtcgggagaggagtatcagcgcgcgcaccaaatctgctctggtatgtcaccttatctctcgtccccgctgttgtccccaaacgccgcctgtcaaaggagacgccacccgcattaggacctagactggggcccttccgctcggggtcaggcgcagcgccctcggcttgggccccgccgcccctttaggggtccgggagggtggagagaagggg

SEQ ID NO: 93392 - DNA, 156 bp, Homo sapiens
  chr5:172672960-172673116
  hyper
cgctgaaaccggcccatctgggagaaatattagggcgcatgtctctcccggagggcttccttttttttttttttcctaaccacgaaaatagggaatctttgttacaggctagttgtgagcgaatcctcctttgtccgcgtccggaggaaaatcagg

SEQ ID NO: 93393 - DNA, 30 bp, Homo sapiens
  chr5:172695117-172695147
  hypo
ttagggtcctcacgtcgtagctcagcccaa

SEQ ID NO: 93394 - DNA, 205 bp, Homo sapiens
  chr5:172704334-172704539
  hypo
tcaatctctatctcacgtgagcactcgatgcctcctatttctgagccttttctggggctctgtagaacaatttgtgggccctgccacccaaccctgaagacgcttgtgtttgccttgctacttctccgctgagtcatttacatttttccagtgctttttatctttctatgttggaattaagcgttatagacgccacgcctcctgg

SEQ ID NO: 93395 - DNA, 109 bp, Homo sapiens; identical to SEQ ID NO: 30117
  chr5:172710849-172710958
  hyper

SEQ ID NO: 93396 - DNA, 30 bp, Homo sapiens
  chr5:172726483-172726513
  hypo
ccgtctgtcttgctccgagcgccactctga

SEQ ID NO: 93397 - DNA, 877 bp, Homo sapiens
  chr5:172754086-172754963
  hyper
cccagcatgtggaggcgacaggatccgtaagaccccacgcgccgccggggcaggaccgcacagggccgccattcactcacttggggcgtccctaatgggcactcgtgcattccagctcgtgcggtgagcgcacgcacgccgccgctgccgcgttcacacggccccccaaagtcgggggaggggtcgtggagcgaaggagctgtaggcagattttctttctctttccgagctgggaaaagggccagccccgtgccctgcacgcctggctctgctttgcagcttgccggtgagccaagagccggtagagcagaggaggcgcacggttcgggtcgtgtcaccatttcttggcttgctgacctggccaggagctggggatggcggcagcaccgcggaggtacgctttgcgctgccctcacgctcccttccgaaagcagtgcccccagggggaaagttcgcaatgccatttgtctcgccggcaaagttctgggatgtcgggcatcttttgaggagggggaagacgcggcacccttactgaggccggcaggccaggaagagaagttctccgggcgcagggcgcagcccagctccggggaccctctgggcctcccgcgtgccggccgggatgaagcgcgctttgcaccggacccgggattcgggggcgggggctggcgctggcagcgtcagacgctgcttcatttcccctcgaccctggggaggacagcaacaagtcctgccccagccatttcatcaccctgctagcacgtgcagattccgggccctcggagcccggcgcggacctcgccttgcctcgcgcttccctttgcacgtcccgtgccatcccaagagtttgcgtggccctgggtgggcgcctggctcc

SEQ ID NO: 93398 - DNA, 393 bp, Homo sapiens
  chr5:172754985-172755378
  hyper
cgcgtgggtgcacggtgtcctctcccagtagctcccggctgcgggggcacatgcacttacctgtattctgcagggacaggcggcctttctgctgggagctcctgtcttggggaccctcgggtgggttggtggcgtcggtcccccgcgccgggtcaaaggtggccaacaccaaagccagggtcatgaactggcccagccgctcggcacacatggttcttggtattaacctcccgtcgggagacctggatcctttgtgctcccctcttcctcctcctcctcttcctccttcgccgcttcccctcctcctcccactcttcctttttgctcgccttttccctcctcctcgcggccgcggctcggatagaggttacccagcgccctcccgtagctctc

SEQ ID NO: 93399 - DNA, 143 bp, Homo sapiens; identical to SEQ ID NO: 30120
  chr5:172755420-172755563
  hyper

SEQ ID NO: 93400 - DNA, 69 bp, Homo sapiens; identical to SEQ ID NO: 8207
  chr5:172755594-172755663
  hyper

SEQ ID NO: 93401 - DNA, 32 bp, Homo sapiens
  chr5:17275585-17275617
  hypo
cgagaagacggagggcgcggcagaggccaagg

SEQ ID NO: 93402 - DNA, 845 bp, Homo sapiens; identical to SEQ ID NO: 30122
  chr5:172756377-172757222
  hyper

SEQ ID NO: 93403 - DNA, 30 bp, Homo sapiens
  chr5:17276405-17276435
  hypo
gagttgggagtgatgcgtttgattctgccc

SEQ ID NO: 93404 - DNA, 71 bp, Homo sapiens
  chr5:1729815-1729886
  hypo
cgagtctccaagtgccgcgtgagcgagggtgggtggctggagctcccgggccagcccgggcggaggcgctg

SEQ ID NO: 93405 - DNA, 36 bp, Homo sapiens
  chr5:172997890-172997926
  hypo
gtgacatgccacctgcggcctcggctctcctgcaca

SEQ ID NO: 93406 - DNA, 36 bp, Homo sapiens
  chr5:1730216-1730252
  hypo
tggtggagggtgccccggctccgaagggctcctgag

SEQ ID NO: 93407 - DNA, 101 bp, Homo sapiens
  chr5:17311107-17311208
  hypo
ggcgtgagccacttcgcctagcctgatgcaaacttttgaagaaactaaatactgtattcaaaaaaaattataaaggctactaggatcgtaagtgcatcgtt

SEQ ID NO: 93408 - DNA, 30 bp, Homo sapiens
  chr5:17312415-17312445
  hypo
tgaggactgctagcacgctgtcacctctca

SEQ ID NO: 93409 - DNA, 30 bp, Homo sapiens
  chr5:173165886-173165916
  hypo
aatcctttttgtgtccggagaaaaagtcag

SEQ ID NO: 93410 - DNA, 156 bp, Homo sapiens
  chr5:17327398-17327554
  hypo
agctgaaggtgtcagcggaggcggggggggctggggtgggtggggaatcttatagaagctgaaattgcaggagcgaagagctagtgttgacaatgtgagctcggcattaacacaacccaggtcagttccccttagaggccgcgttagagcatttgg

SEQ ID NO: 93411 - DNA, 30 bp, Homo sapiens
  chr5:173397062-173397092
  hypo
cagacctgggagtaacgctgtcagaatgag

SEQ ID NO: 93412 - DNA, 515 bp, Homo sapiens
  chr5:173738828-173739343
  hyper
actttcaccgcagagcgggggctgctggaggggcgggtgggctgcggcccggcggcggcggatgcctgtctctgccgaagccgaaggaaggctgcgtgggcagatcttccagctaggcccagagggacggccgacattcaacccgccagtcaaaggagggaagggctggcggcaggagcagctcaggaggcagacccgggcgcgcgggggcgcgggggctcgggggcctgtgagggatccccggacgggcagctgcggggtgcgggccgggctgcaccgcgacaaaggcggcccagcggcggcatcggaggacgcacgctgccccctggtggccaggccgctccccgcaaacgcgagctcctttgttttgcggtcccggcttctgcggcccaggcttgctggagagagtctgaagccccggcttccagagcgggtggccacgatgccagggccgcgcagggaacctggtgagccgagggtcgagtcccagccctgcagctcgctggcggcaaggg

SEQ ID NO: 93413 - DNA, 30 bp, Homo sapiens
  chr5:173846564-173846594
  hyper
tcactcatactattgcgcatgagacaggca

SEQ ID NO: 93414 - DNA, 39 bp, Homo sapiens
  chr5:173846846-173846885
  hyper
aagcaatgcaagaaacggaagtttcgcattttctctcac

SEQ ID NO: 93415 - DNA, 30 bp, Homo sapiens; identical to SEQ ID NO: 40644
  chr5:174110957-174110987
  hypo

SEQ ID NO: 93416 - DNA, 338 bp, Homo sapiens
  chr5:174115251-174115589
  hyper
gttatttaagaggaacgaagactgagcctcagggtctaggagtaacttataggggcttcttgtacttatggatagaaaatacatggataaatagagatattaaaggaagggatgccctaccctcccgaaagaaataaaaatgtgatcactctcggcaccgtagtctctgatgagaacatttaatcaattagcattgccgttgccaaaacttgcttcccaccgagcccaaaagccgccggcggcacatcccagcggcctccctcctcccgggctgggattcgcctctgcaagaaacgtcatgttttctctcccagacatcgttccgggagccccagatg

SEQ ID NO: 93417 - DNA, 30 bp, Homo sapiens
  chr5:174115938-174115968
  hyper
cacggagggtcaccacgtccgttttattga

SEQ ID NO: 93418 - DNA, 147 bp, Homo sapiens
  chr5:174119987-174120134
  hyper
taattttgaaagggtcgctgtaagacactgactaatgacacgtgacctttggattctccacgaggcagcaggcgcgggccccgagcccagcggggacccctctgccagttaggggtcactctctccattcaacgctttattagcccc

SEQ ID NO: 93419 - DNA, 39 bp, Homo sapiens
  chr5:174120367-174120406
  hyper
ctgcataaattatcccgtgattgacgctctttcttccag

SEQ ID NO: 93420 - DNA, 794 bp, Homo sapiens
  chr5:174147420-174148214
  hyper
cctctcccctctctgcgcctggacgacttcatctgtggaatggggagaaagctcaggctttagggggccttcagtaatctgcatcgtgcttttggcaaaagctccttctctccagccccggctcaaacccgggctcggtcctgactccggaccttagggggcgggaacaggagaacaggaaagaacaagcttgggcttgcagagcttcgcaagcaagacgtttgtacccccaaaacctccagctgtgaccctgaatatctatctacccgacttcctgggctgtgtaactcggaaagtgatctctctagacaccagaggaccgaaccttccccattctcactctgcaacaagccagtaagaaaaatgagctcagagacgagtagccttttgcccgaagtcacacagccaatgttttggggggtgggtgagcggtgttgtggaattcctggcggatgttggcgcccgcgggtctgcctgcttctgatacccgggctcggtagaataggccgctaacgagctcccattaggaggaattgtcactcctctgggagcgagcttgtcccattagggcgaattgtcattcctcctggagcgaggttgtcccggctccgcgcaggctgagtgctggggccgagagcaattaacgcggctccggcgcgggcagccgcctctgccccgggcagcgggggcggggcagggcgggggcggggcgcccggcgcggctggagccggtcacccggcgcagccccttcccccggagcccgcctttcatctccccgcgcctggcgcctgcc

SEQ ID NO: 93421 - DNA, 37 bp, Homo sapiens; identical to SEQ ID NO: 30127
  chr5:174150431-174150468
  hyper

SEQ ID NO: 93422 - DNA, 72 bp, Homo sapiens; identical to SEQ ID NO: 30128
  chr5:174151125-174151197
  hyper

SEQ ID NO: 93423 - DNA, 326 bp, Homo sapiens
  chr5:174151443-174151769
  hyper
ggggggcagccccttcgggaagagccaatcaggggcgagcgtctctggcgtcagcgccaggcccggcgcggattggcggcgcgcgtctcccacttcccctcggaggaaaggctcagctcccagcgcgcccctcccgtctccgcagcaaaaaagtttgagtcgccgctgccgggttgccagcggagtcgcgcgtcgggagctacgtagggcagagaagtcatggcttctccgtccaaaggcaatgacttgttttcgcccgacgaggagggcccagcagtggtggccggaccaggcccggggcctgggggcgccgagggggccgcgga

SEQ ID NO: 93424 - DNA, 23 bp, Homo sapiens
  chr5:174158665-174158688
  hyper
tcagatgggaggctccggtgact

SEQ ID NO: 93425 - DNA, 294 bp, Homo sapiens; identical to SEQ ID NO: 30130
  chr5:174159299-174159593
  hyper

SEQ ID NO: 93426 - DNA, 30 bp, Homo sapiens; identical to SEQ ID NO: 30131
  chr5:174162217-174162247
  hyper

SEQ ID NO: 93427 - DNA, 362 bp, Homo sapiens
  chr5:174162494-174162856
  hyper
agggagtgacccttgcgcaggaagggggcgcgtcacccggtttccccatagaaccgtgggcgtcgcaggcgagaagggaagcgtccaggcgctcggccccttccgccccgcccgctgccggccgcccgtttgatgtcgcgggcccggcaggaatgcggccgggttatcaatcacccagctggatcccgaaggtctctgcctaatcacatttaattgctcgtggaggcccactctcgccccgggccggccgccgcgctcaattactccccaaatacctgccatcaataaatacgcactgacaccggcccggcccgctccaccggcacggaagatcgcagccgaccaggcgccctcctccctgc

SEQ ID NO: 93428 - DNA, 80 bp, Homo sapiens
  chr5:174178168-174178248
  hyper
gggctcccccgaccccgccctggcagcgccccccgccgcgagctcccggggcggaggagccggctcggctttgattagca

SEQ ID NO: 93429 - DNA, 283 bp, Homo sapiens
  chr5:174178631-174178914
  hyper
tgaaatccacacaatcgcgcccttctctttaaagggagggagaagaggggccgcggccgcgcgccccgccatcagctgcgcgcacagagggagagttcactccggggacaagggcggcgcgaccggcccggggctcttgggcggccgcgtttcccctcccaccggctgcagcccccttctcccgcggcactttccggcgtcttttgtggggcgagtcctggcgagggtgtccgccgtcaggtgcacaggccccgtgctcccctctgttcggcaggagatcggg

SEQ ID NO: 93430 - DNA, 86 bp, Homo sapiens; identical to SEQ ID NO: 30136
  chr5:174220856-174220942
  hyper

SEQ ID NO: 93431 - DNA, 1175 bp, Homo sapiens
  chr5:1746002-1747177
  hypo
gacgacaaaggcacccggtgtccctgagccgagcacgccccgtccacttggtgggggcattagcctgtcggaaagctgcctggtccaggggggctttcagcccgcaggacgccgagagctgtctgtaaacctctccatggttgtgtgggcctcgggccgaggcagcctgcagtgaaggaagatgttttggagaagttgttggggggctgaatccctaaacgcaggggacacttcacgcccgtggaatttggaaaaccgaggcagggagcagggaagggtgtgggactcgggaaggggagcagctggtgctcctttaactcgcccggtggcagttcagggtgtttccatctgagatcctacactcagccgggggcccacggtgtagcgggtcgtcagccgggccccgggccttctgggcagcaagggccctggcaggaccctgagggctgggccaaggagggcagttcgctccggggcacctgtcaggggccccacacggctgcttttaggccaggggtggcaaagacgctgctgccgcctgctctgggctcggctcccatggctgtgaaggaccctcgtcactccccgtcgcctgcctgggctgcccggggaccctcctgctgcgtcagcacagagcctggaaccgcggccaaggcaggaagctcccctgtgaaggcaccaagcacggcagacgccctcacatcgccggggcccgtttccctgtggacgggaagtgggaacgtgacgtggacgtgacgtgggaacgtaacgtgacgtgacgtgacgtgacgtggcatggcgcgaggacagcgcggcgggagcggcgcctcagatccagcagggagggagacgaaaggcggatggaagaggggcccccggaccccgcccctcgaggcttgtgtgccgccctggctgcggcgttctgggcgacgggaaacagagtcaggacacagaccagggagggccggggcagagccagggcacctgcgggcgaggacggctgggtgctgggtccccggcgtcagggcgcaatgccgcctgctgggcgtcaccctttcccagggctgctgggacacgtggccgcagctgcttggctcaccacagcggaagtcggtctctctcatcctggagtccgcgcggctgagggcgaggtgtccttccgggggccctgaggg

SEQ ID NO: 93432 - DNA, 1267 bp, Homo sapiens
  chr5:174870699-174871966
  hyper
accttgccttggggtcgtctctctcaaagcccctggagcttggaatgtggacttcgctgggggcagcggctccgaaacgttgaggaagcgcgcctgagcccagccagctgcgcgcagcaggggttcggctcccggtgcgcaaaaatcgccggggtgcgtttggggaaaggatcccaggccaggtcccaagagaggcggcggcagcccacttccttgaagagctggagattgttcaaagggcactagaccccggctaagggctcctgggcgctcggagcttccttgggagagagcactcccaggactggtcacctgggcagcttcttttcttggcttcctttcgagagcccagagccttggcgaacctcgggcggccttcagccctacagagcagggccccgcgcctccccgcaggcactgcccgcgacctctcaggagcctgtggcaatgcgaggcagcgagccgagctggcaccagcaagcgcacaggccggcggggttcccgcggggcacagcccaccccgcccgcgcgtcccctcccctgccctgggggcggtcctcgcttgacaggcagagttgcgggcgacagccgcacgtggtccccctggatggttctgcgggcgaggtgggcggaggacgccccggtgagtgcttgccctccctggttacctcgccagtctccggatccccgcgcagcacgcgcagggcccgcgaggcaaatccaatgtcagaacctcaagtaagcttgagtcccctgaaagcaaagctcagccccgacatccagcgcctcttggggtcaacccctagccggacccaaagccctaagcgagcgggagcaccccccattccccgcacaccaactcctagaacggccggcggacgtccgacctgcgttgtctccaagtgtcccctaactagggttggagatgcccgtgggcgcctgtactcaccgctcgcagggagggcgcggcgcagctgggatccgggccagcgcgcgccgctgcgccccgaggggactcactccttccccgcccaggtggcgggcgcgtcccggctgcggtcaacgccggactccagccggtgccccgcacctcccgagcgccccaaccccagcgccgcgcgctccgtgtgcccggggcgccctctgccggcggctgcgacttcccgagcgcccgctgtgccctcgcgggcaccaacctcactcacaagggttccagcgaccgccagggacccgcgccccgactcgctcttcccggtccatgactgcc

SEQ ID NO: 93433 - DNA, 107 bp, Homo sapiens
  chr5:17492061-17492168
  hypo
ctcaggtctgtgggtcggaggccgggctgcttagtcttcccggaaggtcttgggtttccttggtctacccagcagcagccaggagtctccctcgcaggcagtctgtt

SEQ ID NO: 93434 - DNA, 44 bp, Homo sapiens
  chr5:174921456-174921500
  hypo
atatgcaagtgcagccgggcacagtgattcatgcctataatccc

SEQ ID NO: 93435 - DNA, 90 bp, Homo sapiens
  chr5:1749854-1749944
  hypo
gaggcagtggaggaccggaaccatgaccacagtgctgtggacacacatatgtacatacactgtaaaaagaaacgctgggaggctaaaccc

SEQ ID NO: 93436 - DNA, 114 bp, Homo sapiens
  chr5:17502345-17502459
  hypo
ttgccaggcctgtagcggtgaggcttcttgatccctcctgtaggcagtgcccttttgctggcggctttagtggccagggtcttcgtggcgcctgccaggcggtggctttgctgg

SEQ ID NO: 93437 - DNA, 37 bp, Homo sapiens
  chr5:1750588-1750625
  hypo
gcatcacacggttatcgtcacacggacattgtcacac

SEQ ID NO: 93438 - DNA, 496 bp, Homo sapiens
  chr5:175084819-175085315
  hyper
ggcaagtgtcagagtcggcgagatgaggagggagggtgtaggagaaaggaaaatagaaagtgggtgagaccgtgggagagggagactgggggagaaaatgtgggcgtgtgcgcgctgagagagagagagagagagagagacttggagagggaaggaagggaaggagcgttgagagcaaggaggagcgagttgggggcggagacgaggaagtgggtgcgaggcgcggggcgcaggccgtgcgcgcgccgcccgctgcatccctgcccggagcgcagccggcgcgggcgcgggaccgaggcgaaccgggtgcggagccaatacccgcggcagcagcaccaggtaacgcggccgccgcctccccgcggggcctcggctcggggtggggtcccaggcgggcttggggacccggcgtgggctggcggagccgcccgaggggctgctcgggatccccggcggccgtcgtggccccgaacccgggttcgagcctcggccccac

SEQ ID NO: 93439 - DNA, 245 bp, Homo sapiens
  chr5:175085524-175085769
  hyper
cgaaacagtccccgttttgtctccgggtctgggtggtggcattttctcgcggcgatgtgtctgtcggagcatggagcaactttctgctaaagggaagccagcggagagcgggggctgctggggaggaggcttctatgtctcaggaaaccagaacgacctgccttcatcccgctgggctgccgcccgctgccggatgaccgatgaccggagccacaacaggcagcgctcagcgggtgggagtcctt

SEQ ID NO: 93440 - DNA, 30 bp, Homo sapiens; identical to SEQ ID NO: 40645
  chr5:175115079-175115109
  hypo

SEQ ID NO: 93441 - DNA, 152 bp, Homo sapiens
  chr5:17511936-17512088
  hypo
cctcagcaccctctccgcggaggtggcgggacagctgcatgtctctgggcatgattgtgacatgccagggatggataacccatgggttgttgtctttaaatagggggaccaggtaggcctcgctgttctcctgaagtcgccagtggccgcac

SEQ ID NO: 93442 - DNA, 267 bp, Homo sapiens
  chr5:175223481-175223748
  hyper
tgccacctctgctggcgtcctctctcatctccgccgccagcccccgcctcctttctcgggaagcttgggtctccctgggagcgggtctgcccttagggggaggcctctgggctctgtgccctgcagctcggcaggcattcgaggcggacagaaacggggcttggcgccccccgcgtgcacgtgtgctagcccaggcaggagggagcgcctcggcggaggagtcaaggaagagggggagggagaaacgcgccagaacctcggcccggg

SEQ ID NO: 93443 - DNA, 115 bp, Homo sapiens
  chr5:175223835-175223950
  hyper
cgggagcggttggcggagagaccccggccacaggccccgcgctcgagagcttcctagaggcggcttcctccggcctctccccctccctggagctctcagccgccggcggctcttc

SEQ ID NO: 93444 - DNA, 532 bp, Homo sapiens
  chr5:175224441-175224973
  hyper
gggctgggcctaggctgaggtcccggcggggaggaaggagtgcgccgccccgtcttccctccagacccccaccccatcccagctcagaatcgcggacttccaagagccctgcacagaagcccgcggctggcagctgcaatcactgactccggctgtccccggaacatccctagaaagtgtgaggctgagtttccgtagggggagggggctgagaagccgcggggaagcctcacgaacgggacagctccaggctccctctctccctcactccccgggttccgcccccacctccagagaaatcccagacggcagagaaggcaggggggagggggcgacccagacagcaggttgcgaactcggcttagacctgggaggttgcaattagcaagaaaaaaggttgagggcgtctgtgaagccgggaggttcccaaacagggaagccagttccgcggcaggaaagcatacgtggaagagaaaccttttctctgagagctgaggctgggagggccctcggatcacgtgacactctagat

SEQ ID NO: 93445 - DNA, 1641 bp, Homo sapiens
  chr5:175298500-175300141
  hyper
catctggaaggggagcggtagaacgtcagggcccggctgaggggcgtgattggagggcgccttcggcagccgcccgcggcagaagccgcggctccagctcgcctggcggaattgcacgcggcggcgggagctggaatagcagaaggaaccacctcgtggagtcgggccggagccctgcagtggctcagacggttgcagggaccgccaggtcggtgctggccgagggccgggagggcggagctgggctgtgggcaacagggtcccggctctcgcctcgaggccttggggcagctcgggaagctggggagcacggctttcggggggacagctccccaaggctgcctgggcaccggatggggactgagaggcggtaaaggggacactcccgggtgcgctctccgtggtgctgaaaggacagctccttgcgaggggccgcgagcaggcagctagctgcgaactaagaggaagcgtgggccctagccggagactccgggcagagcccgaacggccggggtcccggagccaggaccgccccggctgcggcggagactcaagtctgaacccagagaacaactttgagctcgcgggagtgggggacgtcgatctaagctacttctggctgtgcttaacccgaagcccgccggagcacgcttcgccccggaggagggagtcgcccccaggggtacagtgcgcactcccggagtgagtcagagggcggcggcaggggggcggacagaccgcaggtggaggggaggagaacgtagacattgacaggggatgggggaccaaggggactatttgtccctttccgggaggagccgccgcttggacagcgcacgcccgccgcctggagtcttcgggaacgaccccttctgtgctctcgttctcgtcggcctcaatctgcccccttccccagcaaagtttgaaaccgggccgggtcttggggttggagctatgtgtgttgggggaaggggcgctctccgtggcccaccgggagatccaggacagagctgctgggggtgtgggtctccgcgggggtccgggagaggggcgccggggttcctgtcctctcttctggccgggaaacgggaacccccggccacttccgcttttcagccggagtcggctccctacctcctcccatcctccgctgcccctcccctcccccatgcgtctcccatcccgggccacggggtggggacggggcggggggagggggtggagtgacatcccctgtctctgccactgcctttggcgtagtcccctgccagaagcaaatgagtgttgaattgagttgcggtgaatatagcccagacttgaatcataaaaacagaaaaacggccataaggacaaccactgcaggttacccgagtcagcctgtcagatggcggggcccagtcccgaaaacctctaggggctcagatggtcgagcctgagtcggtgcttgggctgggacgggctcggagggagtcggagaggggaaggaagctgaaggcgcgccctgggtccccggcgcactgaaggtacggaaacctggtgctacgacggcatccctcgccgcccccggcctcccctcccccagcgcagcatcccccacccacccccactcccacccacccccaccctcaccccccttcccgc

SEQ ID NO: 93446 - DNA, 29 bp, Homo sapiens
  chr5:175300142-175300171
  hyper
cagggatagaccaaggcttcccgcagaat

SEQ ID NO: 93447 - DNA, 196 bp, Homo sapiens; identical to SEQ ID NO: 8226
  chr5:175300216-175300412
  hyper

SEQ ID NO: 93448 - DNA, 151 bp, Homo sapiens
  chr5:175488087-175488238
  hyper
gcggggcgggctacacggccaggcgggccctccccttaaggcggggtgggccgcgcgcctgcgattttccgtccgtggtcctggggcagcccgggccagccaggagaacccgcgagcccagcggcgcctgcacctgcggcttccgggagcc

SEQ ID NO: 93449 - DNA, 308 bp, Homo sapiens; identical to SEQ ID NO: 30150
  chr5:175560514-175560822
  hyper

SEQ ID NO: 93450 - DNA, 136 bp, Homo sapiens; identical to SEQ ID NO: 40646
  chr5:175605006-175605142
  hypo

SEQ ID NO: 93451 - DNA, 30 bp, Homo sapiens; identical to SEQ ID NO: 14798
  chr5:175610717-175610747
  hypo

SEQ ID NO: 93452 - DNA, 230 bp, Homo sapiens
  chr5:175621329-175621559
  hyper
agcccgctgccaggccggcgcctgctcccgcagacctgccatgccaatgctctccaagctgaggccgggtggcctgcgacgctcagcccgctgcccatcacaagaagaaaagcgcttatcagggcgctgtgcgcacggggccaccttcgcgctggcccgtgcgggcaccctcagccggcgggactttcacctttgccgagcagcggcggcagcaccggatgtctccttcg

SEQ ID NO: 93453 - DNA, 175 bp, Homo sapiens
  chr5:175626544-175626719
  hyper
gggcacggataggagcggcgcacgcgtaggagcggggcgcgggcaggtacagaacgcgggcaggagcaggacgcggaggggagcggggcgcgggctggcagaggtcagaacaggacgcggtagcagcggggcgccactaggcagggataggagcgtggggcggtagctgccagac

SEQ ID NO: 93454 - DNA, 772 bp, Homo sapiens
  chr5:175792160-175792932
  hyper
caaagcactacgatgcggcgttgggcgggttacttaactcctgggcctcggttttcccttctgcgtggtatcattgtaaggggtaacggagaaaagccgtgagctaacccctggtggatgctagcaagcaccgccgtctcccgtcctccccaggcacagcctctccttcctccaccctgcacctggcagggggaccggaggtccccgcgcgccggccagcgccccaccacccacgccgccgggtcccgggcggcctgccgtgacagcggcagtgcattgtggggcttgtagtgcgggactgggtctgggtgggtgggcgcggccgcagcagtcgcagcggggccatcttcggcgggcgagtgggctcggcctgtgcaacccgcacctgcgtccctcgcccggcccgatggcgccgcggccgctgggccccttggtgctggcgctgggcggcgccgcggcggtgctgggctcggtgctcttcatcctctggaagacctacttcggccgcggccgagagcggcgctgggaccggggagaggcctggtggggcgcggaggctgcccgcctccccgagtgggacgagtgggacgtgagtgccgggccgaggcctgcggaagggcgggcaggctgggctgcgactccgcgcatgtggccaaggggtgtgaccacggaacggccctgctggtgccgggagcttggggggtcgagggcttggcagccgcagcgcacaggccccgcgcgggtgggcggtcagagcccgggaaccgaggaa

SEQ ID NO: 93455 - DNA, 221 bp, Homo sapiens; identical to SEQ ID NO: 30155
  chr5:175792997-175793218
  hyper

SEQ ID NO: 93456 - DNA, 30 bp, Homo sapiens
  chr5:175832567-175832597
  hypo
atttgcctccatatccgtttattcactgcc

SEQ ID NO: 93457 - DNA, 30 bp, Homo sapiens
  chr5:175844227-175844257
  hypo
gcaccaggacagcaacgttttataaaatcc

SEQ ID NO: 93458 - DNA, 17 bp, Homo sapiens
  chr5:175876289-175876306
  hypo
cccccaggccaggagcg

SEQ ID NO: 93459 - DNA, 17 bp, Homo sapiens
  chr5:175876606-175876623
  hypo
ttcgggagatcaaatgg

SEQ ID NO: 93460 - DNA, 19 bp, Homo sapiens
  chr5:175879322-175879341
  hypo
tgctcggattacaggcgtg

SEQ ID NO: 93461 - DNA, 30 bp, Homo sapiens; identical to SEQ ID NO: 14801
  chr5:175924856-175924886
  hypo

SEQ ID NO: 93462 - DNA, 151 bp, Homo sapiens
  chr5:175971719-175971870
  hypo
tgagctaccgcgcccagccccgagttctttctagggtgggaggctgtgagtctgtgacatcacggggatattcttgggctggttccttgtctgtaagagcaacgaagggactttgtaccctgcaaagtgcaacttccggggatgattggga

SEQ ID NO: 93463 - DNA, 185 bp, Homo sapiens
  chr5:175972891-175973076
  hypo
caccatctggccacacgtgcctcatcgtgatgggtccaaaggtctgggcaggccaggacacacctctgtcaaccagagcagtgactcagagctgtcggcctcagccgtaagggcagggagagggggcaggggcttgggttggggtctgccctatttggggcacagcagagcgaccaggctgactc

SEQ ID NO: 93464 - DNA, 30 bp, Homo sapiens; identical to SEQ ID NO: 14803
  chr5:175975036-175975066
  hypo

SEQ ID NO: 93465 - DNA, 34 bp, Homo sapiens
  chr5:175978986-175979020
  hypo
aggcgtgagtcaccgcgcccggttaatagttccc

SEQ ID NO: 93466 - DNA, 29 bp, Homo sapiens
  chr5:176023853-176023882
  hyper
cacactctgcagcagcgcgcggaacaggc

SEQ ID NO: 93467 - DNA, 241 bp, Homo sapiens
  chr5:176024005-176024246
  hyper
gctccagatgcttctggatggccatgcccagcacctccacctccatggcggcgccgtatacctcccacgtcatgcccttctcgtcccagctcacgtctcgcacgggctcagccggctccgggggcgctacagcggccgccagcgctgagccgggccgcacccgcacttcggggaaggcgggcggcgcggcggcttgaggtgtcatgggcccagtggccacggagcgcgtctcggcggcgcc

SEQ ID NO: 93468 - DNA, 108 bp, Homo sapiens
  chr5:176038513-176038621
  hyper
ccggtttcagaaccacggacagcaccacaccagggctgcttcctcacatttccggtcctgaaaattgctcattcactgcccacaaggccatttcgcttcagagcttac

SEQ ID NO: 93469 - DNA, 324 bp, Homo sapiens
  chr5:176046278-176046602
  hyper
gacggggcggggcctcggtgcaagcgcggagagagggcctctgcggcaagagggcaggggcggggcctcgcgcagggactgcctatgccaataaaggcagcgcatggggggcggtgcctctgcgcggagccagcagtatctccgcccccatctttctcactctgaggcggtgttgggggccccctagtgctgatcctgatccgctcaaggctcccgggcggcatcccagacctctgcgggccctcgcccacctcaaactttcggcctcaaacattccggcgccttcgtgggggtgggagggtggagcaccggaggccagggctc

SEQ ID NO: 93470 - DNA, 659 bp, Homo sapiens; identical to SEQ ID NO: 30159
  chr5:176056505-176057164
  hyper

SEQ ID NO: 93471 - DNA, 454 bp, Homo sapiens
  chr5:176057373-176057827
  hyper
gaggggggatagggccgggatcaggcgctcgggtcgcgggtcctgagcaggagcgcagcagtgcccgggtctcgggtgcgtagccagccaccgctcgttcctcgcgccctgcgagctcgcgcgctccggctccggctccggctccggcgctgcggcagctctgagctcagcgcccccgctggcggccgcgccgccccttcggcctgactgacagggggcggggagggtgacagcgcgtagccgatgagcctcccggggcgggcccgggacgcgcccctgggggccccggccgtaagactcgcgtagtctgttgggagttgagggagggggacaacgcggcgtgtgaagagtggggaagaaatcacgcgactggatttggagttctgctgggctcgaatctcagctgtgctttttattaaccgtgggaccttgagctactcggctctcctttctg

SEQ ID NO: 93472 - DNA, 432 bp, Homo sapiens
  chr5:176107053-176107485
  hyper
tgcaggctgcagtgccgctctgctccggccttagcgcctccccgcagctcagaggatgggactggggtccagctccctgcccgccccgcaccccgtaccccgcagcctgtccgtccatccgccccgcttcacttcgctgtcccctgtcggggttcgagtcgcagcctccagcctcaacccgcacctcccgccctgcagctcaactctcgcctccgctgcaatttattactggaggccgcagaaccagcggcgtggagtgcgcctcccgggagccgccgctgtcggagaaaggcacccacccgcctgggccggctcccgggcgcggggcggtgtctcagggaggcgtctcagccgagctgcagggcgaggggagcgagccgggtcccgggggaaggcatccggtcagggcctcgcccacccggatggctcctg

SEQ ID NO: 93473 - DNA, 69 bp, Homo sapiens; identical to SEQ ID NO: 2710
  chr5:176107517-176107586
  hyper

SEQ ID NO: 93474 - DNA, 312 bp, Homo sapiens
  chr5:176170309-176170621
  hyper
ccgggggtgcgggtgcgccgagccctcgggaggcctggctctggtgtgggctgcggggagaaggcgcgggaaggaaggaaggaggcgaagcggtgcgggagggaggcggccgttgccatggaaggagctgcaaggtactctgggaccagaattctctctgcagagggtcgggtggggggcggccggctggggaaggtgaggggaaatccagtgccattcctttgtccttggcgcttctcagcctccctgcagaccgcgagcggagcccccgcacccccggggctggcccctggcctcccgccccagcccggc

SEQ ID NO: 93475 - DNA, 30 bp, Homo sapiens
  chr5:176170885-176170915
  hyper
ctaattttgaaaatccgcttatcagaatta

SEQ ID NO: 93476 - DNA, 160 bp, Homo sapiens
  chr5:176225826-176225986
  hypo
gtccgcaagctcatgcgaggggggttattttactaaccagatagattaagcatctctccttctaattaccggtttaattaaccttggcacacagtatgtaccagacccgagggacagagtcagaatggctgctctgggtgaacatcgcccatctgctctg

SEQ ID NO: 93477 - DNA, 567 bp, Homo sapiens
  chr5:176236431-176236998
  hyper
aggcgtttgagtttgcgaccctgccctcaccctgctcattcccctcccgacccagactaggaccctctctttttccgatcactccccccaggcacaccgcacgcggctgtcatttcctttctccttcaaggcagccctctgtttattttaacccgattagggaatgggggtggggcacaggagactccagcagcggtcactgctggaggctccaggagacgacgtgacttgaccaaggtcacagagctggaaggtgaagtcgcctggaccctacccccggtctccctagctgccaaagcccagctcgttcctttacacccacgtcgcgggcgccgtgcgctctcggggctcaaacaccgcgcgcccagtcgggtgtgctgcgcctgaaggttgttttccttcggcgaacggcgccgaggggttagggaaaccttgggtcatggtgtgaggcgcgcccctggaatccaccagcctgcgaggctgggactgcgggtgtccccgagtctggcctgccagctctggtggccagggcacctctgcgcgcgggccagggccccggggctctcc

SEQ ID NO: 93478 - DNA, 111 bp, Homo sapiens
  chr5:176237148-176237259
  hyper
cgcgccggggtcgccgcagccccgggcccctcccgggccacctgtgcgcagactggcgggcccgcgagagcccggatccggagcaccgatccactccgggtttcagactcc

SEQ ID NO: 93479 - DNA, 144 bp, Homo sapiens
  chr5:176237750-176237894
  hyper
catggccgtccggcccggcctgtggccagcgctcctgggcatagtcctcgccgcttggctccgcggctcgggtgagtcacgccgcgcgcgctctggggaggcttgcgggggaccgtgcgcgcgaacgctcgctgctctgggggt

SEQ ID NO: 93480 - DNA, 30 bp, Homo sapiens
  chr5:176244317-176244347
  hyper
tgacagcacctgaagcgccttggggaggga

SEQ ID NO: 93481 - DNA, 83 bp, Homo sapiens
  chr5:176244689-176244772
  hyper
cgagggcccttaggccggcggatctgcggggcacgtgagctgccgtggagcgcgggtgcccgagcccacggcagccggggcag

SEQ ID NO: 93482 - DNA, 103 bp, Homo sapiens
  chr5:176249208-176249311
  hypo
gcgagctgtgtggcccgcggggcgggggatgctcacttttggcccccctctgtgacacgccctggaagtatttgtgtggaggggtgtgcggagcaggatctgc

SEQ ID NO: 93483 - DNA, 105 bp, Homo sapiens
  chr5:176264795-176264900
  hyper
gcgctccacagatagcggtcctggacgtggcacgctttcagcaccgtggacagccccaggcgctccacagaggctgtccctctgcggactcggcttcctaacctc

SEQ ID NO: 93484 - DNA, 45 bp, Homo sapiens
  chr5:176289688-176289733
  hypo
cttcctggtggagcccgaggatgtgtacatcgtcaagaacaagcc

SEQ ID NO: 93485 - DNA, 74 bp, Homo sapiens
  chr5:176295173-176295247
  hypo
ggtcgagaaggtgttcgggctggaggaatactggtgccagtgcgtggcatggagctcctcgggcaccaccaaga

SEQ ID NO: 93486 - DNA, 60 bp, Homo sapiens
  chr5:176296603-176296663
  hypo
tgtccggccagtgaacggtgggtggtcgacgtggaccgagtggtccgtctgcagcgccag

SEQ ID NO: 93487 - DNA, 264 bp, Homo sapiens
  chr5:176315296-176315560
  hypo
tgccaactaatcatgcggatcacgtttccacaatacctggggtgccgctcacacactcggcctccggtggccacagcaacctggagtgtttgttgctcccggctgtgctggaggcaggagagaacagcggccagggcggcagcacagagctgggcagcccgcgtgcacacggccgcacagacgtgctgcacaagctcaacatccgaagccccagggctcaggcccaagtcctgcaggatagcatggacacgggctgccccagta

SEQ ID NO: 93488 - DNA, 30 bp, Homo sapiens
  chr5:176473003-176473033
  hypo
acacaggacataggccgggcatggtggctc

SEQ ID NO: 93489 - DNA, 30 bp, Homo sapiens
  chr5:1764822-1764852
  hypo
ctcgctctcttcacccggtcgcctgagtgg

SEQ ID NO: 93490 - DNA, 57 bp, Homo sapiens
  chr5:176558851-176558908
  hypo
gcggaatttttatggcggccggatccggctttctctgaacagcgagaaggcgcttag

SEQ ID NO: 93491 - DNA, 69 bp, Homo sapiens
  chr5:176560249-176560318
  hyper
acctaagatggaggccgggactgacgcgggcccgagcagggctggcgggacgatcggacaggcctcagc

SEQ ID NO: 93492 - DNA, 138 bp, Homo sapiens
  chr5:176764100-176764238
  hypo
tgggctgggaaccaacgcctggcccggcccactcaccagacaggtcgccggtgccggcggaggccccgaagtagtagccggtgggcaggcgcactcccgtgatgtcaatgcagttcttccactcgttcttgtcctcca

SEQ ID NO: 93493 - DNA, 163 bp, Homo sapiens; identical to SEQ ID NO: 40661
  chr5:176795125-176795288
  hypo

SEQ ID NO: 93494 - DNA, 78 bp, Homo sapiens
  chr5:176864849-176864927
  hypo
aacactggagaggcccgaaggatgggcagggcaggccaggttgatagctgtcaatgacacacacgtttattgattcag

SEQ ID NO: 93495 - DNA, 52 bp, Homo sapiens
  chr5:176884410-176884462
  hypo
gtagcctagggctggcgccaccgctaatcaccaccctcgaagccctcctcct

SEQ ID NO: 93496 - DNA, 70 bp, Homo sapiens
  chr5:176911102-176911172
  hypo
tagaaggccctgttccggatgggcgtcttgcaggcagcacaggtaaagcagtgcacgtgccaggtcatct

SEQ ID NO: 93497 - DNA, 154 bp, Homo sapiens
  chr5:177003236-177003390
  hypo
agtgctggtattacaggtgtgagccaccgtgcccggccaggaaatagatttcttaactctcagatctccattaaattggcatgtctagacctgtatttgcagtctagttatatttgcacagtaacaagtactggagcagcgccctctctgatgg

SEQ ID NO: 93498 - DNA, 94 bp, Homo sapiens
  chr5:177019952-177020046
  hypo
gtaaggatattaaaacgaacggcaaaacccttcagctctcaccttctgtcacttttcgttaaaaaactcatggcggggtgtggtggctcttgcc

SEQ ID NO: 93499 - DNA, 30 bp, Homo sapiens
  chr5:177024976-177025006
  hypo
gtcaggtattttgtacgatttctcagctag

SEQ ID NO: 93500 - DNA, 462 bp, Homo sapiens
  chr5:177031103-177031565
  hypo
ggggaggccagagaacgggtctgtcacagggccagccctgccccgccctcctgaccctgtcccgcgcttgctccaggtccgggttgctctccggcggcctccctcggaagtgttccgtcttccacctgttcgtggcctgcctctcgctgggcttcttctccctactctggctgcagctcagctgctctggggacgtggcccgggcagtcaggggacaagggcaggagacctcgggccctccccgtgcctgccccccagagccgccccctgagcactgggaagaagacgcatcctggggcccccaccgcctggcagtgctggtgcccttccgcgaacgcttcgaggagctcctggtcttcgtgccccacatgcgccgcttcctgagcaggaagaagatccggcaccacatctacgtgctcaaccaggtggaccacttcaggtagcgcccgcccccaccctctc

SEQ ID NO: 93501 - DNA, 30 bp, Homo sapiens
  chr5:177374034-177374064
  hypo
agtggctaattttatcgtggtgctcttgta

SEQ ID NO: 93502 - DNA, 30 bp, Homo sapiens
  chr5:177385531-177385561
  hypo
tgaatatgtatgccccggctgtggaggcac

SEQ ID NO: 93503 - DNA, 149 bp, Homo sapiens
  chr5:177387547-177387696
  hypo
acgagaacgtactgcaggagaaaacaggcctggcctgagacggctgtgccggctttctgaggccgtgaatggcaagacctcgagactgtcaagaggagcaagaggagtcgggatttagcgtcagtgatgaggtgcgccactcactgtgt

SEQ ID NO: 93504 - DNA, 30 bp, Homo sapiens
  chr5:177408490-177408520
  hypo
gagtataggaactcccgggtcttggcctgt

SEQ ID NO: 93505 - DNA, 95 bp, Homo sapiens; identical to SEQ ID NO: 2711
  chr5:177411327-177411422
  hyper

SEQ ID NO: 93506 - DNA, 703 bp, Homo sapiens
  chr5:177411507-177412210
  hyper
cgcggagatgggccagagtccggccatccagaagtgcctggagcgcacagcaaggccctgccctcggctccgtgaaggtgagggggtaaagtcggcccggagtccccgggggtgcaggaggggccccgcgggttccagcagaccctcgacggaacgttccaggcaggcgagatctcgcacagaatctgcccttttaaaggctcggctttgtcctcgttaaacttgcgtctggcaacgcgaccgctgcggctcccgagcaagattagagggtttccgctcgcaggggcgcgcccggggaccgcgcctccccgcctggtctcggcgccccggcccaggggtcttcagtggtgaggggcgcccagatcgctgcatcccctggagctctgcgcccggccgagccactcagagctcccgccccgcacacccacttcgagctccaagtccttccttttctatactccaagttggatcctgctgggaaggaagggcccttcctgagagaccagggattgcgatttcccagcacaaagtcgaattcatgacttcagcttcaacggggctgcattctccccttggcaggaatgggatggagcgagggtgaagctgctggaaagacactcgttttatttttttaatcgtaaacggggcaacttccaactctgccagttttaagcttctagagtatctcctcggcggagcgcgg

SEQ ID NO: 93507 - DNA, 222 bp, Homo sapiens
  chr5:177412450-177412672
  hyper
gcctgggggacagagcgagactccgtctcaaaacaacaaaaaagagcatctcctctaccgagaagggaagacaggggagtccatcgggtgcgcactccgctgtcgcccaggctgggttgctggggcgccagtctgcggtgttcaggcccaaagcctgcagcctgttcagtccagggcaccgcaggcgccagaactctggcgggcgggcgggcgggcggcgag

SEQ ID NO: 93508 - DNA, 25 bp, Homo sapiens
  chr5:177513856-177513881
  hypo
tatttttttttgagacggagtctgt

SEQ ID NO: 93509 - DNA, 30 bp, Homo sapiens
  chr5:177541524-177541554
  hyper
aagagaactgagacccgttgcctcccactg

SEQ ID NO: 93510 - DNA, 22 bp, Homo sapiens
  chr5:177571459-177571481
  hypo
aaaaaaggccaggcacggtggc

SEQ ID NO: 93511 - DNA, 28 bp, Homo sapiens
  chr5:177580093-177580121
  hypo
acaaaaacgttaacgttcagttccttaa

SEQ ID NO: 93512 - DNA, 116 bp, Homo sapiens
  chr5:177581743-177581859
  hypo
tgcagagggcctagccgagaagccagccggggctgagggaaggacggctccagcgaagccgggaacagcggagggaaggctttggggactgagctccctgccgtgcagggtgagag

SEQ ID NO: 93513 - DNA, 198 bp, Homo sapiens
  chr5:177589638-177589836
  hypo
gacagggagagaatccgggattatccgggttagcccactgtaatcccttgagaccttaaagcagagagctttctctgactgacggcagaggggcaatgacggagatcccaagagcaagcaggatctgaacgctgctcccggctgtgaggatggaggcaccatgtgtgaggaccaaaaagtaaccgcaggagctgagag

SEQ ID NO: 93514 - DNA, 36 bp, Homo sapiens
  chr5:177593271-177593307
  hypo
ttcgagggtgatgttcgggaacgttccacagcatcc

SEQ ID NO: 93515 - DNA, 30 bp, Homo sapiens; identical to SEQ ID NO: 30171
  chr5:177666777-177666807
  hyper

SEQ ID NO: 93516 - DNA, 30 bp, Homo sapiens; identical to SEQ ID NO: 40665
  chr5:177673744-177673774
  hypo

SEQ ID NO: 93517 - DNA, 21 bp, Homo sapiens
  chr5:177680874-177680895
  hypo
ccatctctggctgggcgtggt

SEQ ID NO: 93518 - DNA, 196 bp, Homo sapiens
  chr5:177713344-177713540
  hypo
gtcaagcctgagggacgcccgcggggctccacacacatccttctctccgttcccagccccgacagtcacagcgccccttctccaggccaggcccaggtgtgagggagcccgataccacccccacactcagcttcgtctttaattcccgacagtcctgtcatggccccagggacagcagccccgggtttggcctggc

SEQ ID NO: 93519 - DNA, 30 bp, Homo sapiens
  chr5:177713980-177714010
  hypo
ggttctgttagtctccggtcctcccgagcc

SEQ ID NO: 93520 - DNA, 96 bp, Homo sapiens
  chr5:177723606-177723702
  hypo
ttccccagaggtccccgggagggtgtgtggtgtgtctgaatcacccggctggtgaggcggtagtccagccagaggcagtcccgtaggaccctaaac

SEQ ID NO: 93521 - DNA, 30 bp, Homo sapiens
  chr5:177750053-177750083
  hypo
tggggtggcatgtggcgctgtaggagtagg

SEQ ID NO: 93522 - DNA, 29 bp, Homo sapiens
  chr5:177753998-177754027
  hypo
gtgagccactgcaccgggccaaaaatgac

SEQ ID NO: 93523 - DNA, 30 bp, Homo sapiens
  chr5:177767895-177767925
  hypo
ctcaaggtcagaccccgcaggggtggctgt

SEQ ID NO: 93524 - DNA, 34 bp, Homo sapiens
  chr5:177807711-177807745
  hypo
aggcagggaggatcacgtccggggccaatgtcgg

SEQ ID NO: 93525 - DNA, 48 bp, Homo sapiens
  chr5:177827431-177827479
  hypo
ttgtgttttgacaatcgagacacagaacagctccgtcagccccaaact

SEQ ID NO: 93526 - DNA, 22 bp, Homo sapiens
  chr5:177829100-177829122
  hypo
gccaccgcgcccagctgccttt

SEQ ID NO: 93527 - DNA, 40 bp, Homo sapiens
  chr5:177850350-177850390
  hypo
ggcagcaggaggacccgcagctccccgtcagccatgtgat

SEQ ID NO: 93528 - DNA, 181 bp, Homo sapiens; identical to SEQ ID NO: 40667
  chr5:177851456-177851637
  hypo

SEQ ID NO: 93529 - DNA, 30 bp, Homo sapiens
  chr5:177868563-177868593
  hypo
agagatggggggatgcggggctagagtttc

SEQ ID NO: 93530 - DNA, 30 bp, Homo sapiens
  chr5:177882733-177882763
  hypo
tcccaccaggctccacgaggaggtcagagc

SEQ ID NO: 93531 - DNA, 344 bp, Homo sapiens
  chr5:177890891-177891235
  hypo
agaaaccagcctgggcgtgcagagacctcaggctgcagaacgaacctcttgttgtgggcctcccggccgggcgtgagcacaaccacaggctcatggggagaaatctgccgcctccccaacaccagttggcaggagctgttcacctacccccttttactgccgtaacatacacataacacaaaatgtaccatcttaactacgtttaagcgtacagctcagcggcattaagtgcatccgcgataccttgtggccatcaccacgtcgactgccagagctctttcatcttcccaaactgaaatgctatacccattaaacactaactcccgattcggcactcccacagc

SEQ ID NO: 93532 - DNA, 30 bp, Homo sapiens
  chr5:1779736-1779766
  hypo
ccatgtgcgccctttcggtggggcgtggaa

SEQ ID NO: 93533 - DNA, 30 bp, Homo sapiens; identical to SEQ ID NO: 14810
  chr5:177982679-177982709
  hypo

SEQ ID NO: 93534 - DNA, 166 bp, Homo sapiens
  chr5:177984059-177984225
  hypo
agtccaaggtgtctgcggggcgggctcctcagggagagtccctcccacacccctccatagctctggtggctgcaggcattttggtgtttcttggctggcacacgcagcacgccaatccccactccgctgtcacctagccctctggtctgtgcgtctctgcctcaaa

SEQ ID NO: 93535 - DNA, 15 bp, Homo sapiens
  chr5:178003647-178003662
  hyper
ggtcgtggagggccc

SEQ ID NO: 93536 - DNA, 89 bp, Homo sapiens
  chr5:178004285-178004374
  hyper
cgcgtctcccctcttctcgggacaccagccctgttggatcagggcccccccacaacgacctgtgccacctcatccgcctctttaaagac

SEQ ID NO: 93537 - DNA, 303 bp, Homo sapiens; identical to SEQ ID NO: 509
  chr5:178016681-178016984
  hyper

SEQ ID NO: 93538 - DNA, 52 bp, Homo sapiens; identical to SEQ ID NO: 510
  chr5:178017519-178017571
  hyper

SEQ ID NO: 93539 - DNA, 364 bp, Homo sapiens
  chr5:178017572-178017936
  hyper
ggcgccggcacccgcccccgcacgcacctctgaggcttccccagcccaagcccgcactgtggaccccagaggtcggaggggagcccggcgacaccgcgccccttctgcagcccacccctggctggagcacccaccactcgtgccttagcacattcctctaaacttgtgaattacctttctgacacttgtaaaagttcaaaacttcaaatcctgcaaaaaactgagtgggtctgtcctcggtggtggattagcgccgcttcgtggcggaaagcgacctctgcgcactcacatttagagaggcagggtcgagattgcgccaaacagaaatacgccccttagaatcttctcacgagttcttagctgc

SEQ ID NO: 93540 - DNA, 30 bp, Homo sapiens; identical to SEQ ID NO: 40438
  chr5:1780761-1780791
  hypo

SEQ ID NO: 93541 - DNA, 96 bp, Homo sapiens
  chr5:178108636-178108732
  hypo
ctcatctggcataaccgaaactgtacacctgctgagcagtacacctccatttacgccgccccccagcccctgacaaccgccattctaccctctgtc

SEQ ID NO: 93542 - DNA, 153 bp, Homo sapiens; identical to SEQ ID NO: 40671
  chr5:178112320-178112473
  hypo

SEQ ID NO: 93543 - DNA, 22 bp, Homo sapiens
  chr5:178117247-178117269
  hypo
tatttatcgcctcacatagtta

SEQ ID NO: 93544 - DNA, 176 bp, Homo sapiens
  chr5:178194091-178194267
  hypo
ggtgccagttcccaccggcagcccttaagcacagcttgcctgcaagccagggactcctgcgccaggccattcaaggtttccatcctccctgtgccagccagtccgactcagaagccattcagctcagggatgtcccagtacagatgcagggcctcggggttcgagaaagcacctcg

SEQ ID NO: 93545 - DNA, 30 bp, Homo sapiens
  chr5:178195637-178195667
  hypo
cgtgggcacgaataacgccaccttccacct

SEQ ID NO: 93546 - DNA, 90 bp, Homo sapiens
  chr5:178216871-178216961
  hypo
atccagaatattccccgcactggagcctagcaacacacctccatgaagaataaaattcgtcttatcttgtctgggccgggcgcggtggct

SEQ ID NO: 93547 - DNA, 165 bp, Homo sapiens; identical to SEQ ID NO: 40672
  chr5:178288343-178288508
  hypo

SEQ ID NO: 93548 - DNA, 66 bp, Homo sapiens
  chr5:178323183-178323249
  hyper
cggcgggagcacgctggcagctgagtgtccttcggcgctgtcctgggcaggcgccgaggtggaatc

SEQ ID NO: 93549 - DNA, 241 bp, Homo sapiens
  chr5:178367881-178368122
  hyper
ccatcttcagcttttcgctgatctgcatcttcctgcgccttagtgcaaggcagagacctggttctaaagcgaacggaacggaaccgattctgtaagttgcaatgagcgcgctgaggtcggcgtggaggggtctctgggaaaggtagtttccgcgcctaaagcgccggggccgggccctgttcccgcaggcgcaaggcagcactgtctccgccgattgtccctctgggaagtggagtctggc

SEQ ID NO: 93550 - DNA, 30 bp, Homo sapiens; identical to SEQ ID NO: 40673
  chr5:178373124-178373154
  hypo

SEQ ID NO: 93551 - DNA, 30 bp, Homo sapiens
  chr5:178400566-178400596
  hypo
gggcgcagtggctcacgcctgtaatcccag

SEQ ID NO: 93552 - DNA, 94 bp, Homo sapiens
  chr5:178409975-178410069
  hypo
tgtacatggtgaagccgatgggcttggcctcgttgaaggtctcgggcacgccacgggccttgatggcgtacactgtgcacgtgaccatgagcag

SEQ ID NO: 93553 - DNA, 141 bp, Homo sapiens
  chr5:178411620-178411761
  hypo
aggagcacctcaggccgggacgtagagggcaccttctcaggatgtgcggcacacggagaccctgggcctgaccaggggacactcaggccctgttacgtggaggaagacgggagcacctcctagtcacggagaactgcatga

SEQ ID NO: 93554 - DNA, 34 bp, Homo sapiens
  chr5:178414393-178414427
  hypo
aagatgaaagcaacccgagcgtccactgacagaa

SEQ ID NO: 93555 - DNA, 164 bp, Homo sapiens
  chr5:178416046-178416210
  hypo
gggcgtgggcaatggcgtacaccgcatcaatcacaaactgcaccttgccctcctgctcgtaggtggagtcccggccgatgcgttcctcgcctgtcctagggatgcccagagaaagtgtgcccggcccccatgcaccgaacccggcctcccgccttccccctccc

SEQ ID NO: 93556 - DNA, 43 bp, Homo sapiens; identical to SEQ ID NO: 30176
  chr5:178422264-178422307
  hyper

SEQ ID NO: 93557 - DNA, 574 bp, Homo sapiens
  chr5:178450579-178451153
  hyper
caatgggtggtttagcggagggagagtagttggagcccaagctgagggactcggcttcagccttctcgaactccacagcccgaccgcgttctccgctctcggcgctgtggttctctctcggacaccgtaagtggtggtgccgcagcgacgtctgggaaatgaagtccggagggacaaacgctgcggttcagccagggaaacccgtcggctctccggcgcgcaggcgcagttgcgcccggcagcgacgggaaacgtctctgaattaggtgttccgctcgcctcttgtgcggtgtggagctgcgcgccccccgccgaggcgggcccaggtacaggctgccggtgagggcgggcccggggcgtgcggctgccgcggcgggaccaggacgagggctggcctctgcgcgtgtctgccgagtccccggctccgggcgtccgagccggggcggcctcggcaggtgaacccggccccggagggggcgtggcctgggaagggcctggcggaggccgggagggcgcttcgacgccgctggactcctgggccgcagcctgggccggactccgggggaaacggctc

SEQ ID NO: 93558 - DNA, 102 bp, Homo sapiens
  chr5:178478883-178478985
  hypo
agtccacttgaagatcttcaaagggagctgctccacaggcttgtgtgccgggaggaacaggggaccttgctttgcattgtgcatcgccgcgctactgtttta

SEQ ID NO: 93559 - DNA, 90 bp, Homo sapiens; identical to SEQ ID NO: 40678
  chr5:178481810-178481900
  hypo

SEQ ID NO: 93560 - DNA, 197 bp, Homo sapiens
  chr5:178487107-178487304
  hyper
aatgaatctaatttccggttttgttttttcaaactactccgcttgcttaacaagtgcgcgggctgtaggcagcacggccagcagctggagacctcctgcctcgtgtgcggcgtgcgtactccctcgcactgcagcccctccgcgcactgtcgcctttgagagctctcgttggcggaggcggttcctctcccggagtt

SEQ ID NO: 93561 - DNA, 435 bp, Homo sapiens
  chr5:178487341-178487776
  hyper
cggcgtggggccggaggcatgccgggagtggtagttctcccgcggttggcggggtttcggggacagctcgcggcctttcgggggttctcctggcttgggccatccaggcttggctaggattgccggcctggggttgaggcgctcgcagtggtctcttccgggccggggtggatccgggcctctccagcgagtgggcggcgtgcagcctcgtctgggcttctgggaccagccctacgcggctcgggccccttggccactgggtcccggggcgccgtccgcgagcggcctggactgccggagacccgcgggagggagcgcctcgccaggtgagctgggtgcgccgggccgctggggtggggatgccagccttttgtcgttgttcattctgcgattttcttctgtgcattttcttctgagtaacggaaataataaaag

SEQ ID NO: 93562 - DNA, 117 bp, Homo sapiens
  chr5:178488196-178488313
  hypo
gggggcaccctgagtcgccgctgcagatcgcgggcctggaggccctcacacttgcccggctgccccaggcagcctcttcccttgctttctgtggggcgggcacggtttccacctctc

SEQ ID NO: 93563 - DNA, 77 bp, Homo sapiens
  chr5:178551846-178551923
  hypo
agtgcttggcatgcacggagcgggtggtggtgttgtgtagcggctgaatgcagcgcacggagcgcacctgcatgcct

SEQ ID NO: 93564 - DNA, 30 bp, Homo sapiens
  chr5:178556809-178556839
  hypo
aggccaaaggggccacgcagagtgtcacct

SEQ ID NO: 93565 - DNA, 164 bp, Homo sapiens
  chr5:178561609-178561773
  hypo
ctgttcttgttttggcgtatttggtgtcgccatctctgagccagctgtatagcccagcctcccggccctgccgaagtcacaggagcaaatgcagagcagccctcgagcaccctcccggctccagctccagctccagctcccggctccagctccagctcccggct

SEQ ID NO: 93566 - DNA, 41 bp, Homo sapiens; identical to SEQ ID NO: 40680
  chr5:178565442-178565483
  hypo

SEQ ID NO: 93567 - DNA, 152 bp, Homo sapiens
  chr5:178566307-178566459
  hypo
cccgggagatatttacggggtgtgtgggggtgaggtgggaggaatgagaaggggcaggaggacagcacagggcatggggcctgcgtggcgggtggggctgaggtatagctgagcatggggatgcagctggcatgggccggctctacaggttg

SEQ ID NO: 93568 - DNA, 145 bp, Homo sapiens; identical to SEQ ID NO: 40681
  chr5:178576381-178576526
  hypo

SEQ ID NO: 93569 - DNA, 30 bp, Homo sapiens
  chr5:178580513-178580543
  hypo
aggccgaagtcaaagcggcattgctcgttc

SEQ ID NO: 93570 - DNA, 348 bp, Homo sapiens
  chr5:178594123-178594471
  hyper
cgacacctcgcttccacttcattttcctaccttccggatgacgaactgcgtctcagacaactgaaaggactcgcctgagtcccacagccggaaagaggtcggggtgctgccccccgcgcggggcgggcagaggaagggccgggcccgagcggccaccaggtggcgctgctgccgcgagaacagcggcccgggccggggacgcacccggcgcccagactccgcggccgcacccgggctcccggggccccagcggccccaagacagcctctgggcctcaccctaaatacatcaattatgacctgagcaaaaagttctgttccaatcgttgctctccgacatttccattgt

SEQ ID NO: 93571 - DNA, 186 bp, Homo sapiens
  chr5:178612233-178612419
  hypo
actccaggtgccttacggaaagtagatggaaggggtcaagatgtgggaatgtggggttcagctttggggatgagtgcagagaagggacggatgtgagggatgatgtggattggaataggggtcatctgccccgcctgagcagggagaggctggggctctggaagggcattccggcagctcccacag

SEQ ID NO: 93572 - DNA, 45 bp, Homo sapiens
  chr5:178634584-178634629
  hypo
cgcccagcaggacctcgatgttgtagtcatcgtccgcagcatgcc

SEQ ID NO: 93573 - DNA, 30 bp, Homo sapiens
  chr5:178635361-178635391
  hypo
ctctgggccaggtcccgggccccctcccca

SEQ ID NO: 93574 - DNA, 210 bp, Homo sapiens; identical to SEQ ID NO: 40682
  chr5:178655698-178655908
  hypo

SEQ ID NO: 93575 - DNA, 99 bp, Homo sapiens
  chr5:178665413-178665512
  hypo
gtgctctgagtatgccggagggcagtgagtgctgcgggaaggggctggagggcacagggtctgcgagtgccagggcaggtggtgcggggggagctgtct

SEQ ID NO: 93576 - DNA, 128 bp, Homo sapiens
  chr5:178684538-178684666
  hypo
tgggctggggccctgcgccctccccgctgctggctcccgctgatgcgctacagatgggcttcatcgctgcctccaagaacaacaggacgaccgcaggtttcgcctcacagaaacggaaccgctggaaa

SEQ ID NO: 93577 - DNA, 43 bp, Homo sapiens
  chr5:178699920-178699963
  hypo
gggcctgtggccccccgagaggaggggacgtgggtggccggcg

SEQ ID NO: 93578 - DNA, 64 bp, Homo sapiens
  chr5:178737203-178737267
  hypo
gtgggggcctgtggacggccctcctcccccaccaggctgcagctcccagcgggcagggatctag

SEQ ID NO: 93579 - DNA, 48 bp, Homo sapiens
  chr5:178739679-178739727
  hypo
ggagatggaggatgtcggccctgaagcccagagcgaagaggccacaag

SEQ ID NO: 93580 - DNA, 74 bp, Homo sapiens
  chr5:178740136-178740210
  hypo
agcctaaagccttaccggggctccctcctcaggagtggcctgtgaagaggggacgcacacgcattcacactcat

SEQ ID NO: 93581 - DNA, 162 bp, Homo sapiens
  chr5:178770743-178770905
  hyper
ggagctagagaagtgcgtactcaccagcccatcgcagttgctgagcgccacagaggaggcttcggctaggccggccacgtctccgacgtagagacagctcccgagcaggggctccacgcgggtggtgcccttctcgccctgccactccatagtggccccggg

SEQ ID NO: 93582 - DNA, 433 bp, Homo sapiens; identical to SEQ ID NO: 2717
  chr5:178771198-178771631
  hyper

SEQ ID NO: 93583 - DNA, 58 bp, Homo sapiens; identical to SEQ ID NO: 2718
  chr5:178771723-178771781
  hyper

SEQ ID NO: 93584 - DNA, 78 bp, Homo sapiens; identical to SEQ ID NO: 2719
  chr5:178771782-178771860
  hyper

SEQ ID NO: 93585 - DNA, 763 bp, Homo sapiens
  chr5:178771967-178772730
  hyper
cgccagtgctccgaggctcccccggcccaaggcgctcgggggcggtgcggggcgccccctgcgcgaccaacccggccccgaagttggccaacttggccccgggcggggcgcgcggagtttgcccaagtcaggctggacgacgcctggggagggggcggcggggcacgcgggacagggccaggccggcgggggtcccggggagtaggggccgggccgcacctacctggggggtcggcggcggcggcgagcctggcgttcgcgggcggcggcggcggcggcaggagcggcggcggcagcagcagcagcagcagcagcagcgcggggcagagcaggcggcgagcggctcccgccggcggatccatggcagccggactgcagccggggccccgcactcgcagccggcgcgaaagttccccgcgagccgcccagcccacatctgggggcagctggagccgcccgcagctgcagcaccgcagggcgcggggcggaggaggcgaggcgcggaggggcgggcgggggagcgcggagggaaggcggggagagggaaggagcgagcgagcgagggaggcaggcgggagggagggaggcgagcgagggggagggcggggacggcgggcgcctcagcctgcggtgacccggcgcatcttggcgcggccgccgccgccgcccgcttccctcttcgcgccgccgtcgccgcggtgccgggctcgcagcgaagcagagacaccccgaggcggcggcagagaagcgccgcgggccgggc

SEQ ID NO: 93586 - DNA, 58 bp, Homo sapiens; identical to SEQ ID NO: 2722
  chr5:178772778-178772836
  hyper

SEQ ID NO: 93587 - DNA, 30 bp, Homo sapiens
  chr5:178788838-178788868
  hypo
ggatgtcatggaatccgcaccaccctcatt

SEQ ID NO: 93588 - DNA, 30 bp, Homo sapiens
  chr5:178794198-178794228
  hypo
gtcagcaaaagcctgcgctagcagcccctt

SEQ ID NO: 93589 - DNA, 219 bp, Homo sapiens
  chr5:178836785-178837004
  hypo
aaaaagaaaaaaaaagatgcttggtcaacactgcttcctttcttggccctgctgcctaaggtggccacggctctgctgtctccagcccctgatggtaactccccgaccccctgcctgcgggttgcctcctcctgcctgcagcactgtgagtcatgcctcactcaacgccctccatctgcgccatctgagtggccctgtgtgtcccggtgggaggctgac

SEQ ID NO: 93590 - DNA, 49 bp, Homo sapiens; identical to SEQ ID NO: 40685
  chr5:178854790-178854839
  hypo

SEQ ID NO: 93591 - DNA, 17 bp, Homo sapiens
  chr5:178861589-178861606
  hypo
tttttttttttgagacg

SEQ ID NO: 93592 - DNA, 96 bp, Homo sapiens
  chr5:178877445-178877541
  hypo
acagaaaccagaaagcgtggttaatccaggagccgcacgaggactgatgccttccatatcggtgtcctgtatgtgctctgccgtattctacctcct

SEQ ID NO: 93593 - DNA, 90 bp, Homo sapiens
  chr5:178878660-178878750
  hypo
aattataacagctcccggccggcaaggctctcagtggagccgagcccagagagaaggcctgcactgccagatgggcgagctcattagaat

SEQ ID NO: 93594 - DNA, 30 bp, Homo sapiens; identical to SEQ ID NO: 40687
  chr5:178882544-178882574
  hypo

SEQ ID NO: 93595 - DNA, 86 bp, Homo sapiens
  chr5:178882941-178883027
  hypo
ccacacaggaagaggcggttcccaggttccacacaggaagaggcggttcccaggttccacacaggaagaggcggttcccaggttcc

SEQ ID NO: 93596 - DNA, 30 bp, Homo sapiens
  chr5:178883436-178883466
  hypo
tgaccagggttgacccgaggagtaacctgc

SEQ ID NO: 93597 - DNA, 37 bp, Homo sapiens
  chr5:178907047-178907084
  hypo
agcctgttttctggccgggcgcagtggcttacgcctg

SEQ ID NO: 93598 - DNA, 75 bp, Homo sapiens
  chr5:178913784-178913859
  hypo
agctgagcagagcctcgggaagctgggcttctcttctcagccctgccgccccctcttcaccgtgtctggaacaag

SEQ ID NO: 93599 - DNA, 349 bp, Homo sapiens; identical to SEQ ID NO: 30188
  chr5:178957597-178957946
  hyper

SEQ ID NO: 93600 - DNA, 19 bp, Homo sapiens
  chr5:178969579-178969598
  hypo
agaatgggccaggtgcggt

SEQ ID NO: 93601 - DNA, 120 bp, Homo sapiens
  chr5:178978788-178978908
  hypo
caggcttgagccaccgcgcccggccggattcctcaatttctaactgaatcaattgaaattcagtacttttaaattgaattaaaaattgagttcctcggccgggagcggtggctcacgcct

SEQ ID NO: 93602 - DNA, 35 bp, Homo sapiens; identical to SEQ ID NO: 40689
  chr5:178987430-178987465
  hypo

SEQ ID NO: 93603 - DNA, 379 bp, Homo sapiens
  chr5:179213899-179214278
  hypo
ccagtctgggcccaacgaaacgcaaatgatccctagcagctgacagcagtctgctgcaaacacagcaaagttgagtcccagttgcagctgcagtgaccaccagccagcctctgtcatggcccccgagtgctgggcccagcaaggcgggctcaagagcagtaagcagcagtggcaggggtggggcccagcgggatcccagcatcgtggctctggctcacccagacaaacccggatctgccacccaagtgcccaagtctccagcctgccagtgacagagaccagcgttggtctcctcaagggactgagtgaggagaccagtcaccacccggtgcaaactgagtcccttccacgcgggaaagggccacgagcaattcatgtt

SEQ ID NO: 93604 - DNA, 31 bp, Homo sapiens; identical to SEQ ID NO: 30189
  chr5:179243847-179243878
  hyper

SEQ ID NO: 93605 - DNA, 22 bp, Homo sapiens
  chr5:179244320-179244342
  hyper
gggcgttcgtcctccatccctc

SEQ ID NO: 93606 - DNA, 30 bp, Homo sapiens
  chr5:179263484-179263514
  hypo
cttctctgatgaaggcggctggctcaccag

SEQ ID NO: 93607 - DNA, 30 bp, Homo sapiens
  chr5:179401303-179401333
  hypo
aaaacgtacttctaacgactacacactccg

SEQ ID NO: 93608 - DNA, 50 bp, Homo sapiens; identical to SEQ ID NO: 40691
  chr5:179401725-179401775
  hypo

SEQ ID NO: 93609 - DNA, 30 bp, Homo sapiens
  chr5:179448856-179448886
  hypo
cgactttcccaataacgtcctttacagcag

SEQ ID NO: 93610 - DNA, 178 bp, Homo sapiens
  chr5:1794492-1794670
  hypo
tctcatgagcaggcacggaggtgctggtctgccttcgctggccgagtgcccgctgcaggctgggctggtgggagacgtacggacacaaacacggctgggaagcaggctctgcctccacgcagcatgctcatctgtccgggctgcaataacaaaattccaccaacggcttacagacaag

SEQ ID NO: 93611 - DNA, 32 bp, Homo sapiens
  chr5:1794976-1795008
  hypo
gtgggagggctgggtcgcgcctgccccctttt

SEQ ID NO: 93612 - DNA, 109 bp, Homo sapiens
  chr5:179498254-179498363
  hyper
ggaaaaacccagtcacgctcctggagcctggttcccacgggagcaggccgggctgtccacgacggaagcctcgaccctggctggggctgtcggccgggcagcgcgggag

SEQ ID NO: 93613 - DNA, 30 bp, Homo sapiens; identical to SEQ ID NO: 30192
  chr5:179498867-179498897
  hyper

SEQ ID NO: 93614 - DNA, 30 bp, Homo sapiens
  chr5:179499226-179499256
  hyper
tcccgcccgcctgcacgagggcccgggcag

SEQ ID NO: 93615 - DNA, 228 bp, Homo sapiens; identical to SEQ ID NO: 40440
  chr5:1795233-1795461
  hypo

SEQ ID NO: 93616 - DNA, 34 bp, Homo sapiens
  chr5:179535480-179535514
  hypo
acgagccaccgcgcccagccgtttcagtctattt

SEQ ID NO: 93617 - DNA, 30 bp, Homo sapiens
  chr5:179546275-179546305
  hypo
tggctgcacccactccggcctctcggggga

SEQ ID NO: 93618 - DNA, 35 bp, Homo sapiens
  chr5:179557921-179557956
  hypo
agtgttggtggatagcgcgtcggccaccagacaca

SEQ ID NO: 93619 - DNA, 333 bp, Homo sapiens
  chr5:179564509-179564842
  hypo
cccgagaggctgatgcgttgagggcatggcagggcagtgctggtacactctgagaccccctggcctgccctccgcctcaccttgtccagcaccggcttgtccagctgctgctgctcgatgcacaggtggcagacccgggccaggagctcccggggctcgatgaagaggcgagagctcagcaggaaggtgaagatgtaggctttctgggggacacacgagaaagagggcacaggctcaggagggcaccaggaggggcatgcttcccagctggccctgtaccctggcccaaggtcacgcccaaccctgatgccccccgtgcgtggtggaggagag

SEQ ID NO: 93620 - DNA, 30 bp, Homo sapiens
  chr5:179621876-179621906
  hypo
tgcagctcagagctgcggcttctcctggct

SEQ ID NO: 93621 - DNA, 335 bp, Homo sapiens
  chr5:179635756-179636091
  hyper
cccagcaggggctggcggcgcgcggcagagctgggtctcccgccaggtggccgggggtgtgccctcagggtaccctacccgctacccccgcgcctccagtcccggcggccgcgcggaccccgcccctgctgaccccggcgcacgctcccgcgccgcgcgcagcctcccgcctcccgccgaccccgccgcgccgccggcagccctccccagcccccgcgagcccgcgcccttgcccgcaccgccaggtgtccctcggccgcgcaccactcaccggctcccggcgcgccggaactccgggcccggcccatgggcagctcccggtgcgagcctcggcg

SEQ ID NO: 93622 - DNA, 4 bp, Homo sapiens
  chr5:179636151-179636155
  hyper
cgac

SEQ ID NO: 93623 - DNA, 106 bp, Homo sapiens
  chr5:179636200-179636306
  hyper
cggagcaacgcggcgctgcgccccctcgtggcactcaggcagcgcggagcgggcggggcgcgggggtggagctgcgggagcccgcgggcggcgctgcacaccaggg

SEQ ID NO: 93624 - DNA, 30 bp, Homo sapiens
  chr5:179653659-179653689
  hypo
gcacatagtaggactcgtaccactgctgat

SEQ ID NO: 93625 - DNA, 157 bp, Homo sapiens
  chr5:179742465-179742622
  hypo
ccgcgcccggccggttatatgtttttcttttgtcattttaatcatgcagcctgaagtatttatatggatgaatatcatgatgcccgggattggcttcaaagtaaccccatggagacgaggggttaatatgagtgtgtccgaccggcacaagatgggc

SEQ ID NO: 93626 - DNA, 54 bp, Homo sapiens
  chr5:179779378-179779432
  hyper
cccagcagaagttcccggctctctcccggccagcggaggcggcccagccaggag

SEQ ID NO: 93627 - DNA, 135 bp, Homo sapiens; identical to SEQ ID NO: 8263
  chr5:179779648-179779783
  hyper

SEQ ID NO: 93628 - DNA, 173 bp, Homo sapiens; identical to SEQ ID NO: 8264
  chr5:179779840-179780013
  hyper

SEQ ID NO: 93629 - DNA, 1257 bp, Homo sapiens; identical to SEQ ID NO: 30197
  chr5:179780035-179781292
  hyper

SEQ ID NO: 93630 - DNA, 34 bp, Homo sapiens
  chr5:179824602-179824636
  hypo
gtgagcccccgcgccaggccgaatttccttcatg

SEQ ID NO: 93631 - DNA, 135 bp, Homo sapiens
  chr5:179867486-179867621
  hyper
aaggggatggagggtcgcattaaacaacacctcaaggcagcccagatcgggagggagggtccctctgcaggacagaaaccagctcgtgccgcaagccaaccgcgagaagggaagagggggcgctctaggttacaa

SEQ ID NO: 93632 - DNA, 43 bp, Homo sapiens
  chr5:180011938-180011981
  hypo
gagatcgcaccactgcactccatcctggcgagagagggacact

SEQ ID NO: 93633 - DNA, 571 bp, Homo sapiens
  chr5:180017118-180017689
  hyper
tttattgagaggggccgggggaaggggatggacggtcctccccgcggcggggttttcagccctcgcgggtgggcagcgtcttgtcctcaggtgtagatgctccagtctcggctcagccaaacactgtcagggccccctggaaagcagaagccgagcttgagtgcccccagccctgccaccaagaactcaggcgggggcgcggcagcggccggctctgtggggagcgggagcggggcggttccgctggcgtctccgggggacgcgcacccgcgcggggccatctccgccttccccgcccctgcagctcggatgcgccccacccagttcccacccggagacccgggcttctcccagggacagggcttggaggggcaggacgggaaacagccctgacgtagggccgggacacctctggtgcagttttgaggctggccgggaagggatgcccgcgcaggaagggcacccggggtgcccactttaccagcagggccttcagggccttcacggcccccacggcctggggacccagctcagccacacacttctgggagccctctatgaggtggttcac

SEQ ID NO: 93634 - DNA, 442 bp, Homo sapiens; identical to SEQ ID NO: 2726
  chr5:180017690-180018132
  hyper

SEQ ID NO: 93635 - DNA, 195 bp, Homo sapiens; identical to SEQ ID NO: 30201
  chr5:180018484-180018679
  hyper

SEQ ID NO: 93636 - DNA, 30 bp, Homo sapiens
  chr5:180019434-180019464
  hypo
tactgcggcctcctccgcacctgcagacac

SEQ ID NO: 93637 - DNA, 30 bp, Homo sapiens; identical to SEQ ID NO: 40693
  chr5:180021394-180021424
  hypo

SEQ ID NO: 93638 - DNA, 82 bp, Homo sapiens
  chr5:180028458-180028540
  hypo
catttagatttattacggaagcaaaaacaataaaagcaacactcccgtccgcaacacacacaaagaccggcatcagatttat

SEQ ID NO: 93639 - DNA, 289 bp, Homo sapiens
  chr5:180033320-180033609
  hypo
ggctgcccagtgcctcgggcttggcaagggagctctcctcgcagccccatctcctccgtcacccctgggtctgtgttgccacatccccaaggacctcgtcacactctcctctcacgggacggccctatctgactctcccaccatggtgcaggctcagccgtgcgggtcctggcgttgagtccccaactcacgtttccacggagtctgtctcctagctgagccacaggcctgggctgagcggccttctttgatctcaaggagctgtgctgtttctcgaaggtgtgtagag

SEQ ID NO: 93640 - DNA, 85 bp, Homo sapiens
  chr5:180041104-180041189
  hypo
ccacacgtcactctgcgtggtgtacaccttgtcgaagatgctttcaggggccatccacttcaggggcagccgggcctggggagac

SEQ ID NO: 93641 - DNA, 36 bp, Homo sapiens
  chr5:180042128-180042164
  hypo
ccaatcggagcactgcggccccgctggtcacctccc

SEQ ID NO: 93642 - DNA, 247 bp, Homo sapiens
  chr5:180046700-180046947
  hypo
tgcccttgtggatgccgaaagcggaggcttccaccaccttcccgaaggcgccgtagccgagcactctccctgtcggggcagggggccagttgcaggtgagctgtacggggtgagcgtggagacaggtgggcggcgggggagccccgtgcagaggtccaggaggacaggcctggcagcaggaggagcgtggggagccacagcgggaagacaaggagaggtggacaggaggccgcgcatcctcccgggt

SEQ ID NO: 93643 - DNA, 30 bp, Homo sapiens
  chr5:180047720-180047750
  hypo
tgggcagaaaggggccggcgtgtgtgtgtg

SEQ ID NO: 93644 - DNA, 252 bp, Homo sapiens
  chr5:180052859-180053111
  hypo
tgtactcacagactacgctgggcaaacatcttgcagggtgtccagggccgccagtgccactggatgctgagaggcaggggcaccccgtaggccgtgcaggtgagggcctggcggctgtgacgcgagtagatgctgggggaggaggcctccttctcatgtatctgggggggcactgtgggcacacagatggccggtcagctggcctccaatgccaggccgcccacccgtgcgctctcccgtccctgacctacc

SEQ ID NO: 93645 - DNA, 252 bp, Homo sapiens
  chr5:180057419-180057671
  hypo
cctgaaccagccacccgctggagcaggtagggccccgttctctcctcctgccagcccagggtccacaggctgggggcggtgtgggccccagctgcccgggaccctgctccagcctggcccgcctccaagtctcacctctcacgaacacgtaggagctggcggccgtggtgccctcgatgcgtgccttgatgtacttgtagtagcagacgtagctgcctgtgtcgttggcatgtacctcgtgcagcagcaaca

SEQ ID NO: 93646 - DNA, 67 bp, Homo sapiens; identical to SEQ ID NO: 30202
  chr5:180075791-180075858
  hyper

SEQ ID NO: 93647 - DNA, 405 bp, Homo sapiens; identical to SEQ ID NO: 513
  chr5:180076053-180076458
  hyper

SEQ ID NO: 93648 - DNA, 552 bp, Homo sapiens; identical to SEQ ID NO: 30204
  chr5:180076532-180077084
  hyper

SEQ ID NO: 93649 - DNA, 258 bp, Homo sapiens; identical to SEQ ID NO: 30205
  chr5:180100616-180100874
  hyper

SEQ ID NO: 93650 - DNA, 153 bp, Homo sapiens; identical to SEQ ID NO: 2731
  chr5:180101015-180101168
  hyper

SEQ ID NO: 93651 - DNA, 81 bp, Homo sapiens
  chr5:180101251-180101332
  hyper
cgggaggaaaaacggaggctcccagggcccggttaactcgctctcttgacaaagaacctcctggaccggactccagccagg

SEQ ID NO: 93652 - DNA, 196 bp, Homo sapiens
  chr5:180111784-180111980
  hypo
catcttgctgacggccgacctgagcagctacctgagagctggcagcgctcgctcgatgaaggccgccgaatgacctggaagccaccctgatgggcagggccctcgaggttaatgagacacaggtaaagtgtgccccaggccatgagcaggggccctgaggaggaggactgtgagcaggaagcgagctccctcacct

SEQ ID NO: 93653 - DNA, 30 bp, Homo sapiens
  chr5:180159486-180159516
  hypo
ggagaccttcccttccggaagggggcgact

SEQ ID NO: 93654 - DNA, 23 bp, Homo sapiens
  chr5:180169497-180169520
  hypo
cggaagtgcggggatgacaggcg

SEQ ID NO: 93655 - DNA, 225 bp, Homo sapiens
  chr5:180294196-180294421
  hypo
ctccagggaaggcagcgtgcggtgtggatggacgtgcacgtactctttgccgcagcaattctcctctacgagtctaccctgctggtatagtcacacactcatgaaatggtgtgtgaaaaggttattcacaatagtgtgtctaaagtaaaagatggagaaaacctaaaggtccaaactaaagacgtgattacataaattattgtacattcacgtgtattagttttc

SEQ ID NO: 93656 - DNA, 30 bp, Homo sapiens; identical to SEQ ID NO: 40699
  chr5:180326126-180326156
  hypo

SEQ ID NO: 93657 - DNA, 64 bp, Homo sapiens
  chr5:180480238-180480302
  hyper
tcgtcgcgaccctgccgctgctgttggtcctcgcggcgctggcgctgggcgtcctccggaagca

SEQ ID NO: 93658 - DNA, 21 bp, Homo sapiens
  chr5:180486864-180486885
  hyper
cgccctcgtggccgcgggact

SEQ ID NO: 93659 - DNA, 346 bp, Homo sapiens; identical to SEQ ID NO: 30207
  chr5:180527353-180527699
  hyper

SEQ ID NO: 93660 - DNA, 56 bp, Homo sapiens
  chr5:180527793-180527849
  hyper
cgactggaaatccgggtgcacctccgccccccggggcgcttcggccttggggtccc

SEQ ID NO: 93661 - DNA, 34 bp, Homo sapiens
  chr5:180530753-180530787
  hyper
gattacaggcgtgagcccccgcgcccggccggga

SEQ ID NO: 93662 - DNA, 138 bp, Homo sapiens
  chr5:180531150-180531288
  hyper
tcctctccctgcggtcgctgccacaccctctcgtccggtctcccatgcccccttatgctaccgcgtcgggcatgaaaacttccttttctttcttctccttctttccttccttttgagacagggtcttgctctgtctcc

SEQ ID NO: 93663 - DNA, 15 bp, Homo sapiens
  chr5:180597086-180597101
  hyper
cgcagtgccgtccac

SEQ ID NO: 93664 - DNA, 256 bp, Homo sapiens
  chr5:180600774-180601030
  hyper
cctacaacactccaccgctatctccacctggttaaggaaaaaaggctatcaagggtatttatacctttgcctttccgcctcaaccattggaacctgggacgaactgaacccacttcacttgctgtggacaccagcgccgacgaacttcgcacaaagcccgtccactggacagctgcgcgctgccaaatggaatccagatcccgagcaagggtgcggcccagggagagttccaaggaactgggggacaaaatgggca

SEQ ID NO: 93665 - DNA, 315 bp, Homo sapiens
  chr5:180601090-180601405
  hyper
taatccagcgccttagaccgctcggccacgctaccttcctccgggggttcacctgcatcttttccttccttataaaacatccccagggttcccgggccaacaaggcgttggggcgaatccacagggcatcgcagaaccaccgccttccagcaggattcgcgggccagaggcaccagctgggaaacggctccaccagcgccccagcagagaagattcgcgacgcgcaggcctcggaatttgctttgggggccactcagaaagtcagaaagtcacccacattggccctctttggggaggcggcgtgagaggagggga

SEQ ID NO: 93666 - DNA, 30 bp, Homo sapiens
  chr5:180631588-180631618
  hyper
cttggcctcctgcaccgcctcgtccagcgg

SEQ ID NO: 93667 - DNA, 366 bp, Homo sapiens
  chr5:180632859-180633225
  hyper
cacaccctctctcctcgctcactctggaggccacttggatcaagctttcgcccgcaccctcctcagaaaccgcccttgccaatgtcaccgggaacttcagcaattctcacccaaaggcgaagacctcgcctcacctcatctgcccccggatgctccctccttcccgacttcccttctcagggccttccaggacccagtgtccccgatcttcttgctgttcctgaaccccgtggcctctgcgctggctgttccccttgcgtggacctcttttctcccaccacctgcatgctccctcccacctcattcaggtcttgtttcaaacgtctctgcccacgaagcccgccccgaacgcgcacactgtgtaaa

SEQ ID NO: 93668 - DNA, 30 bp, Homo sapiens
  chr5:180644604-180644634
  hyper
gatggtcctcttgaccgccctccaccgcca

SEQ ID NO: 93669 - DNA, 51 bp, Homo sapiens
  chr5:180659766-180659817
  hypo
gaagcccagctggggcgtgcgggagccgcggctagtcgccttgcagaacag

SEQ ID NO: 93670 - DNA, 97 bp, Homo sapiens
  chr5:180661531-180661628
  hypo
gtgcgtgggcaccaacggcaaacgctatcaggcccagagctccacagaacagacgctgctgagccccagtgagaaaccaaggcgctttggtgtgtac

SEQ ID NO: 93671 - DNA, 37 bp, Homo sapiens; identical to SEQ ID NO: 40701
  chr5:180708092-180708129
  hypo

SEQ ID NO: 93672 - DNA, 432 bp, Homo sapiens
  chr5:180708603-180709035
  hypo
ggcctgagcggtaggcgggagctggagcagtaagagggcggcctgagcggtaggaggggggctggagcagtaagagggcggccggggcggtaggcgggggctggagcagtaagagggcggcctgagcggtaggcgggggctggagcactaagagggcggccggggcggtaggagggggctggagcagtaagagggcggcctgagcggtaggcgggggctggagcagtaagagggcggcctgagcggtaggaggggggctggagcagtaagagggcggcctgagccgtaggagggtgggtggcagctggagatgctcttgaccggctagaggtctaggagaaggtggggaccgtgtccaacactcgtggctggagccttggccaccgcggttctcctggctgtggttggtggtggcgacggagactgcatctc

SEQ ID NO: 93673 - DNA, 30 bp, Homo sapiens
  chr5:180710021-180710051
  hypo
tctgggggccccaggcgtggagtagtgggc

SEQ ID NO: 93674 - DNA, 16 bp, Homo sapiens
  chr5:18111782-18111798
  hypo
gcgagactctgtctca

SEQ ID NO: 93675 - DNA, 105 bp, Homo sapiens
  chr5:1827709-1827814
  hypo
gctggtagcacactgcggctcctcttatggaaacatgctcctggccctgtggcctgtggggccccccctccccggatgttcgcatcatctcgccaggtcagctca

SEQ ID NO: 93676 - DNA, 211 bp, Homo sapiens
  chr5:18393745-18393956
  hypo
ctgtgtcattgaacacggctccatgtgttagtaatctaaccttccagctcctcaggagccttgcctgaggcaaggacttctaactcatcccgctgtgctcactggctttaggcacaggcagccttccagagctattgctggggctggattgctgctaccacccgcatgacaccagcagctcttggcataacaagagcggatcttcttggtg

SEQ ID NO: 93677 - DNA, 30 bp, Homo sapiens
  chr5:1839565-1839595
  hypo
tcataaccctgcttccgaaagcattgatcg

SEQ ID NO: 93678 - DNA, 62 bp, Homo sapiens
  chr5:1844450-1844512
  hypo
gaaaagactaagacacgggaacagatttctccacaaaacagtagcatcgctctagtgcatta

SEQ ID NO: 93679 - DNA, 51 bp, Homo sapiens
  chr5:1851149-1851200
  hyper
cggacttgggagggccgcccagagagaagtgggtttcggtgaggggagggg

SEQ ID NO: 93680 - DNA, 46 bp, Homo sapiens
  chr5:1851402-1851448
  hyper
tgctactccaggggccgcgccagcagcattttcccaggcagccggt

SEQ ID NO: 93681 - DNA, 467 bp, Homo sapiens; identical to SEQ ID NO: 29374
  chr5:1851534-1852001
  hyper

SEQ ID NO: 93682 - DNA, 220 bp, Homo sapiens
  chr5:1865538-1865758
  hypo
gttcagtcagaaaaacgaagccaccgcgattatgattatgggaacatagggtttacacgggggagttgctggggagggcatttcaggacagccttgatcaaagggctggggagatggtccaggcgatgccaaccggaagccccagaggaggagaggaaagccatccactaggggaccatcgctggccccgagctctgggtgggcccggtgtccggagtct

SEQ ID NO: 93683 - DNA, 34 bp, Homo sapiens; identical to SEQ ID NO: 40442
  chr5:1869209-1869243
  hypo

SEQ ID NO: 93684 - DNA, 1415 bp, Homo sapiens
  chr5:1874892-1876307
  hyper
aatggaatcatcagccgcggtttgagaggtcgataaagcttttagatttggagacgttttccgggagcccatttcctgcggctaagagttgttaatggagcttaaggaattatcttaggccgggcggccgggagagccgtatatctcccgcgcctgttcccttgtcgagcctgaatatgctgctgtcagactcgcttaatgaaaagtaacgcaccgctgattacagttttatttgggctctatgtaaagagcgccgttaatttgcatcccctccttggtgtgtttgaattcgccacgcctgaataaccgagcgcgccggccctgccggcctcccggcgccttcccagcccttctctgacaatctccctgggagcccagtcgcccgccccgacccttccccgtcacgcccccgccccactgacatcgacctccctggcgcgtccactcagacacctaaaattcaccccctccgtgtcacctctttgcaaacgccccctccccaccccgctccgacttcggaattgtcctgcctgacacctccccaccccacaagatcagccagagggtgtttgggggcgcctaaggcaaaccggctggactgtgccccaagggaagggtgtgggggaagcgcccagcgaggggatgccatttcctgcgcgtccccttagaatgtggctgaatccgcctccccacccgacgtctttatttaacacaatctcgcagcttattcaaataagccagctttgtcagccagttccaccaagatccgggggctccagcgagatggaattcctatggccagggccacggggaggggctggggtcccgagggcagcaagcttggctggcggcaggagccctgggtcctccccaggagagggacccagagcccagaccaagtccaacccgccaacctgcgccacccatgcgcgcactgggggctgcagagccccgccaggctgcccgcggccgggagcgtaaggccggggtccacgcctcgattttcagtgtccgcagcccctaccccgcctatctgcgacgcaaggcgaaaccttgtttttgcggaaaatgcctggctttgtctagggctggggtgggggcgtctgggcagccaccctcggccacattaaaattcctggcgccccagcctcgggcctcaacgctgtcccccgagacgccactttcgctattactgtcaagtacccttgactctttatttttgcccttttatctattacaactaattcgagttcttttgcccttttcagtctaagacgtgggctttctgcaaagcctccccctgccagcgagctctcggagcgcggagcctttagaaattgaggggtttactgtcaaaatgaaaatttcacttcaaattaccttggctgatgctcgctcgccaggccgggggctcc

SEQ ID NO: 93685 - DNA, 284 bp, Homo sapiens; identical to SEQ ID NO: 29376
  chr5:1876637-1876921
  hyper

SEQ ID NO: 93686 - DNA, 14 bp, Homo sapiens
  chr5:1877089-1877103
  hyper
ggaaataggagagc

SEQ ID NO: 93687 - DNA, 38 bp, Homo sapiens; identical to SEQ ID NO: 29378
  chr5:1877194-1877232
  hyper

SEQ ID NO: 93688 - DNA, 275 bp, Homo sapiens
  chr5:1877754-1878029
  hyper
gcttcagaacggaaccgccttctccatgtaaacttttgacgtaaactttatgcttcagggtatctggcctcttctgctccgagagcctctccttccgcgtcccaaatttgggaatggcccggtcaggctcaggcccaggcggtggaggccccggcgtggcagcgccgggcttgtccatgttcccaggagtccaagttcagaagccccctctccggtgggttggcggcttcgcggtggccgcgctagtcttcctctggaaactcagtgaaaagagt

SEQ ID NO: 93689 - DNA, 354 bp, Homo sapiens; identical to SEQ ID NO: 2508
  chr5:1878223-1878577
  hyper

SEQ ID NO: 93690 - DNA, 215 bp, Homo sapiens; identical to SEQ ID NO: 29381
  chr5:1878830-1879045
  hyper

SEQ ID NO: 93691 - DNA, 156 bp, Homo sapiens
  chr5:1879506-1879662
  hyper
cctaggcatggggctcggcgtttgggacccccaagacgtcctagaaccgcagagaaggcactgtgcctgcactccagggcctcagcccccagtgacaacctcccaacccacctgcgttcttggagctcttgaggggctcctcccgcgcctcctcct

SEQ ID NO: 93692 - DNA, 58 bp, Homo sapiens
  chr5:1879689-1879747
  hyper
cgtagggccgcttctcgtctgcgcacttgttccgcggcggccacgtcatcttgttctc

SEQ ID NO: 93693 - DNA, 503 bp, Homo sapiens; identical to SEQ ID NO: 2510
  chr5:1882419-1882922
  hyper

SEQ ID NO: 93694 - DNA, 83 bp, Homo sapiens; identical to SEQ ID NO: 29385
  chr5:1883131-1883214
  hyper

SEQ ID NO: 93695 - DNA, 402 bp, Homo sapiens; identical to SEQ ID NO: 29386
  chr5:1883215-1883617
  hyper

SEQ ID NO: 93696 - DNA, 1851 bp, Homo sapiens
  chr5:1883879-1885730
  hyper
cgccggccgtgctccgccggcttccccctgcccctcgcggctaagccggggactgccgggcggccctgcgcgctcggaagagcaggttcctcaacccaggccccggcccctcccgctaagctcgtccctcccggcgccccgcagggctggctgcgagggagggggcgttgggtgcctggcggaggcgccctcccctgtccattttgcccagctttctgtctggggcgcacggagcaatcggaagaggggaccgagcgcccaccccaggactccctcggccagtaccctccctgggaccttgcccaagttcaaagcggaggccagtgagcaggcggcaagggggcggcaagggggcgcccgggccatcccgaacccgttccccgccttctgcgccatcgccctccgggaccgggactcgccccggttgccctcgccccctgggccggcctcccgtggtaagttgggaaggaagccgtgcaaggcagcgttgtgcagacttgctcagaaagattcctgggttcagacctgtgaatcgccccagggtcaccctctaattaatgatgacgtcctcgccctctccccagctgcaagcctgcctcccagaaacgaaatctgcctgctcttttgacagctcggttgaaggtgattgatgactatctggagaccacagtacacatcatataatatctgctgcgtaattgctttaatttacagatgaaaatacgagttctccgatcgcgttggaccggagcgggccacgtccgagctgcttgcagagggaaaccatcggaaataatgaatagccgctccatgcaaattattcagacagtttagcgtcggtagccgcgagaaatatataaagaacacgagtcaaatgacattaataattgtttctgaattctgtattgatttcgcggcaggccgcgtttctttctttctcacctgaatcgctaatatcaccttcctgtaaataataagaaactagccaccggggtttctcgctagaaatgaatctctcaacccctttccctctcctcctgctcctcccctcccccaccctccttcctcccctctcccaccctccctcctccccactccttgcagttttctggtttttcccgagcatccttctacttcccattatttattgtttacaaactactcgctctctccaggtaatgaggcccggctgaaggaggggtgtgagcccagccgggccaagggctgggatggggagtagagacccccagaggggaggcattcagctgtggcttgtcctttcctcacctatactcggggacctggcctcggcgactgtgagcactccgccggctgagggggagagccagggcccaggggcccagccacctatgccctgcacctctgggctctagtgcaacagctcagcccacccagacctgaggctggtgcatttccttccttccagacccggcggggcttaactggagccgaagccccagaacaggcggccattcatcttctgagcagagtctgggagaagcagcctccacttcccagggcagccagtacgtgggggccctttcgggggcttcctttgaccaccaccgccaccttctcctgttctcttttgcctttccagcctgtgtgcataaatcgacgctccagtccccaccagcgggcgaccctttctccgtgacccagaaacctggcctctgaatcggctttcccaggccgccgcacacacacgctccacttcctgcccgccagcaggccccagcgcctggggtccgggcccagtcacagtcaccctgcctcgggaagctcgcaactgcccaggaggcctcctgacccgcccggcctcacccaggc

SEQ ID NO: 93697 - DNA, 143 bp, Homo sapiens
  chr5:1885934-1886077
  hyper
tgtccctttcaccaacgataggacgctcagcatctcaggtatcagctgaacgcgtctgcatagactcggagtgctgagccttcctccctctagggacccccggtactaaatacacccgtgagcaggtgggccagaagtcagcc

SEQ ID NO: 93698 - DNA, 463 bp, Homo sapiens; identical to SEQ ID NO: 29391
  chr5:1886379-1886842
  hyper

SEQ ID NO: 93699 - DNA, 149 bp, Homo sapiens; identical to SEQ ID NO: 419
  chr5:1886997-1887146
  hyper

SEQ ID NO: 93700 - DNA, 36 bp, Homo sapiens; identical to SEQ ID NO: 420
  chr5:1887546-1887582
  hyper

SEQ ID NO: 93701 - DNA, 392 bp, Homo sapiens
  chr5:1887655-1888047
  hyper
cgtttgggctgccccacccagggacgcttgggccgggcgcgaagagcccggaaatagccacccttgtcgtcggcccggtttccctccgaggtcttagtatttcccccctcccccaccccccaaggcctgtggagggcgaggctgctgctccagccaaccctcggaattggctgcagggcgctcaggtcctgcctttcttcccctgcccctctcccaagcccctccgtgctaagcggcccagttctgggttctctcctggtgcccacgctagtccctagccggctcactctcaaaacagcaggctgtggcaggggcaaagcctaggtccgggcaccaggacccgggcaagtgggcgcgaatggaccacggtgataagccgcccgaggaccaat

SEQ ID NO: 93702 - DNA, 35 bp, Homo sapiens
  chr5:1892071-1892106
  hypo
ccctgagggaggagacggagcgcagagcctgactt

SEQ ID NO: 93703 - DNA, 135 bp, Homo sapiens
  chr5:1913952-1914087
  hypo
ccacagctacacggacgcggtcttccagctcgcgagaggaaagttttcctcatgccggtggtttttcacttattaaatctcatatttcaggcaacccattgagtagagcctggagagatgcgattaaactgctag

SEQ ID NO: 93704 - DNA, 134 bp, Homo sapiens
  chr5:192173-192307
  hypo
aggctctgaggccagcgggcccggcccctctgcgggtgcactgcccctcgttccgggcggacagcctgagccccagccagctcctgcacgtgctgcgtctggctggcccgggtgccctgcgcaagctggaggtg

SEQ ID NO: 93705 - DNA, 87 bp, Homo sapiens
  chr5:1922987-1923074
  hypo
ggcaaccaggcatcacgaggcgccttctccttccactcggtggagcagggtctccagtgaatgcggcgtccacgcctgatcggggct

SEQ ID NO: 93706 - DNA, 210 bp, Homo sapiens
  chr5:1930795-1931005
  hyper
ctctgcggcgacagccgctggggtggggctacggggaagtcgcgctgcccctcgtctgagcgtgggccagggcccaggtggtgaccaaggcccggcgcagtggccccggagcgtggaggggcagctgctgggcggcctcccgggggagggtgacggcttcacccgccaacgctgcctccctcctgggattaggccggaggaatcttggat

SEQ ID NO: 93707 - DNA, 223 bp, Homo sapiens; identical to SEQ ID NO: 423
  chr5:1931064-1931287
  hyper

SEQ ID NO: 93708 - DNA, 133 bp, Homo sapiens; identical to SEQ ID NO: 424
  chr5:1931444-1931577
  hyper

SEQ ID NO: 93709 - DNA, 411 bp, Homo sapiens
  chr5:1931617-1932028
  hyper
cgcgcatcccgccgcccctcaccacgaagcgcagacacaggaggttgcagggtcagtgctgcggagaatcccagacggccccacagccgccgccacccgcggggcactcgcccgggctctgccgaggatgtgggggctttggtctccgcagagctgggactcccgaaggccttaccagaaactcaggagcagccccagccctgcagagcccgcgagggtggagacgggagacccgctgtggggcctgaggctgagatgccggcctgcggtgaagccggcgggacgttccaacccgctcagacccgcccactccgcagggcccgggcccaccccccggcctgtggcctgtgctgggctgcgcagccggcggtggagggacctgggaaaccaggtgctcgccaggtgtccctc

SEQ ID NO: 93710 - DNA, 205 bp, Homo sapiens
  chr5:1949464-1949669
  hypo
tgcgggggctcagaccggctggaccgtagcgtagtttctggccccggctagctggcgaccgtgggcctcagtaccctgtctgcggggtggggcgatgcgaacctacaccctgggatgggggtgcccgcccagggcagtgctgtctgtgatcttgccatgcccagggcacccactccatgacgctggctgtcggtgctttccaggg

SEQ ID NO: 93711 - DNA, 492 bp, Homo sapiens
  chr5:1950766-1951258
  hypo
tctgaaacagcccctcggcagcttcacgacctcaccaagtgcccgccgctctcacgagagaggtggttatggttgcgcattgaatatgcttgggagaggcaaagatggatggcgtagtctctaccctcacacccagtgctgagcgcgagtcgtccgctgtgtgtgcatcatctgctgtgcgtgtgtcatctgctgtgcatgcctgcgtcatctgctgtgtatgtgtcatctgttgtgcatgcgtgtgtcgtctgctgtgggcgcgtgagtcatctgctctgtgtgcttgtgccgtctgctgtgcctgcgtcatcgtctgctgtgcgtgtgtcatctgtgcgtgtgtcatctgctgtgcgtgagtcatctgctgtgcgtgtgtcatctgtgcgtgtgtcatctgctgtgcgtgcgtgtgccctctactgtgggtgtgttcatcatctgctgtgcgtgcgttgtctgctgtgcgtgcgccgtctgctgtgcgtg

SEQ ID NO: 93712 - DNA, 199 bp, Homo sapiens
  chr5:1951511-1951710
  hypo
catcttctgtgtgtgcgtgccgtctgctgtgcatgtgtgcattgtccattgtctgctgtgcatgcatcgtctgctctgcgtgcgtgcgtcatctgctgtgcgtgtgtcatctgctgtgcgtgtgccatctgctgcgggtgcatcatctgctgtgcgtgcgtgtgccatctgtgcctgtgtgcatcgtctgctgtgtgtg

SEQ ID NO: 93713 - DNA, 15 bp, Homo sapiens
  chr5:1952624-1952639
  hyper
tggggcctggcaggc

SEQ ID NO: 93714 - DNA, 138 bp, Homo sapiens; identical to SEQ ID NO: 29400
  chr5:1952723-1952861
  hyper

SEQ ID NO: 93715 - DNA, 68 bp, Homo sapiens
  chr5:1959631-1959699
  hypo
tcatctgcattctaccgagggcatccccagtcccaggtttcatcctggtgtcccgctcatatgttccc

SEQ ID NO: 93716 - DNA, 152 bp, Homo sapiens
  chr5:1983598-1983750
  hypo
gaagttctttcccctcggctgtcggcggagtctttgggtgtggtggatggaagaggagccgtctgctgagagaagaggaggaactccgctgtctgagtcagcacaggtccaccgaagaccaggagctcagccctccgcgcggtgctctgaat

SEQ ID NO: 93717 - DNA, 62 bp, Homo sapiens
  chr5:2007735-2007797
  hypo
ggcaacagcctcgatcgggggccgggggaagcggccgagatgtggctcggaggtggcagctg

SEQ ID NO: 93718 - DNA, 188 bp, Homo sapiens
  chr5:2024999-2025187
  hypo
aactctaagttaaaccgtactttaagttaaaccttaagtctccccataaaggtgtcctagagcagatgtccaccgatccaggcattgcaatgcctgggaatcaatggtgtaatcagcaaggtggaattggatatgtggtgatagctatcgatgtttatgacaggtgggtgcaccgtcaagttggagtc

SEQ ID NO: 93719 - DNA, 439 bp, Homo sapiens; identical to SEQ ID NO: 29401
  chr5:2038424-2038863
  hyper

SEQ ID NO: 93720 - DNA, 42 bp, Homo sapiens
  chr5:2038947-2038989
  hyper
cgctggctccagccagtgctgcactcctggcagacaggggcc

SEQ ID NO: 93721 - DNA, 35 bp, Homo sapiens; identical to SEQ ID NO: 40447
  chr5:2112239-2112274
  hypo

SEQ ID NO: 93722 - DNA, 30 bp, Homo sapiens
  chr5:21291802-21291832
  hypo
ttacgtaaagggcagcgggataactccaga

SEQ ID NO: 93723 - DNA, 504 bp, Homo sapiens
  chr5:2136910-2137414
  hypo
agaggtgactgggcccgtgtgtgtgcgtgggcagaagtgactgggcgtgcgtgtgtggacagaagtgaccgggcgcgcctgtgtgggcgggcagaggtgactgggccagcatgcgtgggtgggcagaggtgaccgggcatgcgtgcgtgggcgggcagaggtgaccgggcgtgcgtgggtggacagaggtgactaggcattgcttgcgtgggtgggcagaggtgaccgggcttgcgtgcgtgggtggacagaggtgaccaggcgtgcgtgcgtgggcagaggtgactgggcattgcgtgcgtgggtggacagacgtgactaggcgcgagtgcgtgggtggacagaagtgagtaggcgtgcatgcgtgggtggacagaagtgactaggcacgtgcgtgggtggacagaactgactaggcgtgcatgcgtgggtggacagaagtgacttcatggctcattgcagcgagggaggaggcatgctggagaaacacgggcatcaccgtga

SEQ ID NO: 93724 - DNA, 30 bp, Homo sapiens
  chr5:2155918-2155948
  hypo
agtcatctgcatactcgaacacggatagta

SEQ ID NO: 93725 - DNA, 331 bp, Homo sapiens
  chr5:2180344-2180675
  hypo
ggcaggagagctccacgcggccccccaccaccttcacggcaggagagctccacgcggccccccaccaccttcacggcaggagagctccacgcggccccccaccaccttcacggcaacactccgggaggagaggggagagagcatctccctcggccttctccgtgaagtctgggacctggagactgtccccccggccaaatgaaggaaaacggtgtttttgggagctcgatttcccttgacaagtcagattttctgttttcagattccattcagctctgcaggctgcagacctgggctcgcgtcctctcacgagatacggggctgctctccc

SEQ ID NO: 93726 - DNA, 230 bp, Homo sapiens
  chr5:2199933-2200163
  hypo
ccctggtcagtcctgcgtggggtggccatgccagccggggggctcggaatagggctctgagcgggacggcagtgcagtcatgggtaatagagactagagccgagaaatctccatctgctccgctgaacagctccatctccttcaagtaggctccagccaaacaaccctgctccccgcgtggatgcaattccgactggaagctggagaatcccacacgctggcaaggaagg

SEQ ID NO: 93727 - DNA, 180 bp, Homo sapiens
  chr5:2250142-2250322
  hypo
gctgctgcatctcctcgacgccaccggaggcttcctggtctccgaggttcctttcacaggcacacctgaaagagggttgcagagtagcaacacgtgccgcatgtttaagtaaaatagggttccttttccttaaatatttaacaaacccttcaggatatacgtggacgtaattgaagcatc

SEQ ID NO: 93728 - DNA, 82 bp, Homo sapiens
  chr5:2261231-2261313
  hypo
gctctgtggctgagacgggcaacacctctcaaatggaaacacctgacgttgcaccagatctcagatgcgaagggcgggggtc

SEQ ID NO: 93729 - DNA, 150 bp, Homo sapiens
  chr5:2261610-2261760
  hypo
accctcacaggaccacgaggccctggtcggacacaggctgcccgcagccccttcccacaggagcaccaccagtaaggcctttactgtccccttatcccttgctgtttccccaccgacaccctgacgctgagcagccggagagagtggagg

SEQ ID NO: 93730 - DNA, 32 bp, Homo sapiens
  chr5:2268219-2268251
  hypo
tggtgtaaatattcccgcggggatgctgacct

SEQ ID NO: 93731 - DNA, 288 bp, Homo sapiens
  chr5:22852968-22853256
  hyper
ttgtttagaacttaccgaagtttcccaaagcaaaaccacgcacaagctcctaattcagctgccagatctgtgtgcagcttcgttcagcttctcactacgctaggcatcactttattaatcatgtatgaatttctgtgcatgcaccctgaagcgatcacacacacgcggtgcaatcccaatcaaaaacggaagccttacctgatggcagaaaaggcagctgcaggagcagcagcaccgacggccgcagcagggtgccaacagctcagccttgcgcggaaggtgagaccc

SEQ ID NO: 93732 - DNA, 51 bp, Homo sapiens
  chr5:22853518-22853569
  hyper
ctcctgtcatctccccgccctcaaaacaaaacacagcgtgcctttgacaca

SEQ ID NO: 93733 - DNA, 30 bp, Homo sapiens
  chr5:2301052-2301082
  hypo
ccgtcattcgccatgcgtctcagaaggcag

SEQ ID NO: 93734 - DNA, 30 bp, Homo sapiens; identical to SEQ ID NO: 40452
  chr5:2324383-2324413
  hypo

SEQ ID NO: 93735 - DNA, 30 bp, Homo sapiens
  chr5:23530297-23530327
  hypo
cgagatgcagacgaacggagagagaatggg

SEQ ID NO: 93736 - DNA, 39 bp, Homo sapiens
  chr5:2367627-2367666
  hypo
aaaacaggcctggtgcggtggctcatgcctgtaatccca

SEQ ID NO: 93737 - DNA, 30 bp, Homo sapiens
  chr5:2368819-2368849
  hypo
aacatctcacacatccgtcaagtggaaacg

SEQ ID NO: 93738 - DNA, 68 bp, Homo sapiens; identical to SEQ ID NO: 14739
  chr5:2369614-2369682
  hypo

SEQ ID NO: 93739 - DNA, 164 bp, Homo sapiens; identical to SEQ ID NO: 40454
  chr5:2374826-2374990
  hypo

SEQ ID NO: 93740 - DNA, 195 bp, Homo sapiens
  chr5:2376679-2376874
  hypo
tctcagagggttgaccgttccctcaatgtgtcccttcttagtaggataagccattggccctgtggcttctcttgggcgccaagggtcaccaggccttccgcactggggtgggacacccaggaagcccagcaggatgggggcccttggtgcccaagaacagccacagggccaacggcttatcgggtgtcttgcccc

SEQ ID NO: 93741 - DNA, 30 bp, Homo sapiens
  chr5:2412208-2412238
  hypo
cggccacctcatccccggaaaggacgtacc

SEQ ID NO: 93742 - DNA, 30 bp, Homo sapiens
  chr5:24314566-24314596
  hypo
ctgcctttccctcttcgcaggatcattggc

SEQ ID NO: 93743 - DNA, 166 bp, Homo sapiens
  chr5:2493697-2493863
  hypo
gggtatagatgtcagcgcctgactgtgcattcaaatacatccatacacacttgagtgggtgtgcgcatgttagtgcctgtgtgcactcatgtgcttgtgtgcgtacttgcacttgcatacatgtgtgctcatgcatgtatgcaagcacctgcgtgagtatgtgcac

SEQ ID NO: 93744 - DNA, 190 bp, Homo sapiens
  chr5:2523561-2523751
  hypo
ccaggcggccacatgcgtgcccgaaagggaaagcataggctgtctccgcggcctcacttgtttctacttccctgacctgtttgtcccactgacttaccgcctctggaatgaacacccgacagcatggaagggagattcctgtccagtgcctgggctgtactctgcatgccgctctcggttccactttcag

SEQ ID NO: 93745 - DNA, 162 bp, Homo sapiens; identical to SEQ ID NO: 40457
  chr5:2541481-2541643
  hypo

SEQ ID NO: 93746 - DNA, 30 bp, Homo sapiens; identical to SEQ ID NO: 40458
  chr5:2547162-2547192
  hypo

SEQ ID NO: 93747 - DNA, 30 bp, Homo sapiens
  chr5:2562122-2562152
  hypo
caaaatgtgagtatccgaatttcattcatg

SEQ ID NO: 93748 - DNA, 40 bp, Homo sapiens
  chr5:25656060-25656100
  hypo
ctgttcctattcagccatcttggaacggacccccattaca

SEQ ID NO: 93749 - DNA, 25 bp, Homo sapiens
  chr5:26029110-26029135
  hypo
gcgcccggcccgaagtaaggcattt

SEQ ID NO: 93750 - DNA, 42 bp, Homo sapiens
  chr5:2642066-2642108
  hypo
tggctgtgattctctcggagagagcggcgtggccaaaggtgc

SEQ ID NO: 93751 - DNA, 17 bp, Homo sapiens
  chr5:27086133-27086150
  hypo
tccgtctcaaaaaaaaa

SEQ ID NO: 93752 - DNA, 101 bp, Homo sapiens
  chr5:27267415-27267516
  hypo
cctgtcggggatgctcgggccgtaagggagcccatggtgggggcagctgagtcctggtgagaattcaagcatggtgcgggtgggccggcagtgcaggggga

SEQ ID NO: 93753 - DNA, 314 bp, Homo sapiens; identical to SEQ ID NO: 29403
  chr5:2738816-2739130
  hyper

SEQ ID NO: 93754 - DNA, 145 bp, Homo sapiens; identical to SEQ ID NO: 29404
  chr5:2739210-2739355
  hyper

SEQ ID NO: 93755 - DNA, 252 bp, Homo sapiens; identical to SEQ ID NO: 29405
  chr5:2739551-2739803
  hyper

SEQ ID NO: 93756 - DNA, 441 bp, Homo sapiens
  chr5:2739860-2740301
  hyper
cgggcctgaggctgagggccagggagcgaggcgagcacccggggccagccacggaggagtcccgaccaccacgggagcagggggactgggaggcaagaggtcgggggaggccggggtcagggcgggaggaacccgatgggtcccgctgcggcttcaggcgcggggtatagggtaggaccaggaaggggactgaagcccgggaccagagctgggggtgccaggagcggggcctccagtgggagctcgggggtcctcgcgggttcttctgggtcggttggtggctacccatccccagaagcctggctgcattcccctataaggaggcttcggagggcccgactgggtttcccctccagggcaccgggtcgcaaaagcggcgtcgaaaactcatgaacaggcggccgggtctggggccgccggggcagtcgtggcgtgcggggg

SEQ ID NO: 93757 - DNA, 235 bp, Homo sapiens; identical to SEQ ID NO: 7705
  chr5:2740430-2740665
  hyper

SEQ ID NO: 93758 - DNA, 155 bp, Homo sapiens
  chr5:2743505-2743660
  hyper
gcgccccggtgctctcggcagcccccggcccccggggcccacctgagattaaagcgcgaattccgataaatcagctctaaggaaaccctgggccgcggagagcagaagggctgtcgcggatccaccacgcgggcgccgggccgcggagccgggag

SEQ ID NO: 93759 - DNA, 46 bp, Homo sapiens; identical to SEQ ID NO: 2526
  chr5:2743698-2743744
  hyper

SEQ ID NO: 93760 - DNA, 110 bp, Homo sapiens
  chr5:2747745-2747855
  hyper
gcagttagtcagaaccgaccccacagcctgctggctgcgcagaccaccgtgcacccaccatcctccactcccaggcaaacagcagtttgggaaaccgactgtctccaggg

SEQ ID NO: 93761 - DNA, 407 bp, Homo sapiens
  chr5:2748083-2748490
  hyper
ccaacggcagaaaagcggattcaactctgactccttaacaagacaccgaaacacacccaggctcattagggcgacacgctgtaatttgaatttcgtggcaatctgggtttgccgaaactaagacagccacgatagtaatagtcaaaataacagtaaattaagtaaaaataaataataacagggcaagtctaaaaagagggccacaccttctttggcttccatctcgccctccgccctcactctgctaattctgggtcccaggagtggccccctggatcttcttcccggaccctccctcgggtctcccgggcgctccgcctccccggggctggctctccctcccctcccgggcgccgccggccgcgggccgcctacctttcttgggctcgtagccgccgcccggggac

SEQ ID NO: 93762 - DNA, 231 bp, Homo sapiens; identical to SEQ ID NO: 29413
  chr5:2748549-2748780
  hyper

SEQ ID NO: 93763 - DNA, 342 bp, Homo sapiens
  chr5:2749065-2749407
  hyper
cgattcgcacagggggtccccggcgcggcacggaagcttctccccgtccgactcggccgagcacgagtgatccgtgagcgagtccacgtgcaggctgatccctgtgggggcgcgggcacggtgggtggcacgaggggacagcgcaggcacctggagccccctccgccccctgtcctgcggcactgggccctccccacgggacccctcacctcgcccccacccggccacgtgacaggcggagcctgacctccccgggaagggcccgaggaatcgctcgctcaaatcccggcgaccccagggcaatgtggtgcggctggggctccggcccggacctggggtgtc

SEQ ID NO: 93764 - DNA, 125 bp, Homo sapiens
  chr5:2749604-2749729
  hyper
cggggcccaggtcatcttgttctccttcttgaggcgccggcgcgcgttggcgaaccaggtggagacctgggtgagggtcatcttggtgatgatggctagcatgatcttctcgcccttggtggggt

SEQ ID NO: 93765 - DNA, 114 bp, Homo sapiens
  chr5:2750008-2750122
  hyper
ctggctctggggctgcgcttcccgccgcaaaagagcaggaaaaacgcagtgtgattcgggaccagctgttgatcacaaaaagtaccggagttttattctcgaatttctgaacta

SEQ ID NO: 93766 - DNA, 67 bp, Homo sapiens
  chr5:2750703-2750770
  hyper
tttgaaagcatggtccgctggacagagtaaggccgaaacctgggcgcctcgggccggactccggagc

SEQ ID NO: 93767 - DNA, 128 bp, Homo sapiens; identical to SEQ ID NO: 29416
  chr5:2751854-2751982
  hyper

SEQ ID NO: 93768 - DNA, 322 bp, Homo sapiens; identical to SEQ ID NO: 29417
  chr5:2752120-2752442
  hyper

SEQ ID NO: 93769 - DNA, 62 bp, Homo sapiens
  chr5:27523953-27524015
  hypo
ccaggtgcctgcacacgtgccggctgcgtgcaaggctcctgctgaaccggatgtactgcaca

SEQ ID NO: 93770 - DNA, 1064 bp, Homo sapiens
  chr5:2752508-2753572
  hyper
cggtccactccgcccagcatggacctggatccggggcgccttggttgcgaattgccaggagggccctgaggtgagctttctgcccccaaatccgcagcgcaacccccggggccctgaacgttacgactttccactgttgggaatgacgccagggcttcagctaagaagacgccgtcccctaaagagttttattttattttgtttttctaagttgactcctctttcagatttgtgttgtcaaaacactggggggatgattgttacctgacaaaccgcctctggcaggacctgaagcctcccagtcacgtcgagaacgggcaggagctcaggttggcgccgccggtgcagtgggcattacaggtagctcaggtgacgcgcggctggagtaggggggcggttgccttgcggggctcagaagcgaggcggttggcgagggttcctaggaccccagcttcctagaaccctctccccatcacgcttctccaacccttttccactcggggatggccgaagagggcgtctggctgcccactccgaagggtcacctatggggggcgctcagggggatggaagagtgtcaggtctgtgctggcctattgggagcacccacccagcaggtgcctctatcctcggaagccgtctcgggtgggtgcggtggagaagagagagcgcagtggcctggggcgggcctcagctcaggcctgcagccgactcctgcacccctgctggccctgcagcctgcggagcagccttagtgatctcaggacgcagggcatgttgcggcctccctgtggtgcggctgcagcggcgcggagggagcggagcccgggttgccagtctggtccagggcgcaagagaaacactcacggcatcaggctgtctttccccaggtgcaagggaaccagttgcaaactgcagtgctgtgcttgaggatggctcctcctgagccggcaggctcccggtaggcgcggtccaggcacgttacccctcccgccaggagctcccgagccgagccactcgccccctaccagttatcccacccaccccttcgcccacactgctcc

SEQ ID NO: 93771 - DNA, 255 bp, Homo sapiens
  chr5:2754365-2754620
  hyper
aagatggcctcttcccgtcctgtgtgtattttccccttagcaattatactcctccactgaaatctatatgttccataccgctgctgcctgttactaataaaaaccgtctaccttgcactattaaacagtcgactcttactacatgccgtttttattggtagtgactgtagcaaattaaaatgcctacgcagggacattaaaaacttaacactcgtcattgttattgaaatatataaactacgttttgctttaaag

SEQ ID NO: 93772 - DNA, 30 bp, Homo sapiens
  chr5:2754878-2754908
  hyper
tcaggcctgtggggtcgctggggagagccc

SEQ ID NO: 93773 - DNA, 1461 bp, Homo sapiens
  chr5:2755142-2756603
  hyper
ccaaagaatttagaacgagtctacgtggacacgcaagtttcagcgagcggggatttcctgcgaggccgagcgcgaggaacagccggccccggaggctcgggctcggggtctccccggggacgcggccgactgagaaggccggggcgctcgccgggcgcggcgccgtcctccgtgtcgcggggacggaaggaggcgacgcaggccaggagtcgtgcgcgcgggcggcgagggggcgctgtggcccgtgtctgccggcccgagtcccggcaacggtgggcgcgacccacctcctcccccggcggcttaattcggggaagaagaaaaaacggcatcgaggcatttcaataaaacctaagcgactcctgatcctttctcattgtggttccttatgagctttcggtgtctggcggggaaacagttaccgttcgggggtgtggcaaacttttttggcaattaagatgaaacagacgcttttatgtgggtttcctttaatgaagtaacattggaaatgtaagtagtttcagtgcatcaaatcacatcgctaccgtattcgcggtcaccggccctcccgttccagggctccccgcgtttgtcgagggagagagcgaggcaggaacagggggccggggacatgagaagtttggctaagaaatttttcttttctttgaaaacaaaagcgttgttataaatggaacaaaatttaagtcaacatggaacccacatctctttcaaacgtcgtttctaggtctagtactctgtgagtaggttggactggatttcacgctcaaccggcatttctaggctctcaaagacgcttccgaggcctaaatgttttcctggaaaacacgtgcagaggagcatccgtggaagactgaaaggtccccgcagctccagtcctggcaggatgtgcaaggcctctcgaggttttcaaatgggcccccgaggcctgggagatccccgagtagccacgcgggcgccacttcagggacgcggggcggcggctactgtgggccgggagggcccccgcacgggctgctctgagcgcctggacccgggaccctgcgcgcgctcttttctttttctttcgtttctttctttcttatttataatttacattctagggacctcgtattcagctaaccagctcttgcttacttaactgccctgttttcagctccggatttctgggaggtctccccatggctaacttgtccctcccggcatcctttagcgctctgcaaaatttgccttcctcccacagatgccccgcctccgacgtgcttcctgaagtttctctcccgctcagggtgcccacaatcctgaattctccagcatctcgccgactccgtctctaccctcctctccttcctaatctcgcgctggcttcgcccttttctctctcctcctccttcctacgcgccccgccccctccccccaggtcgcacctctccccgcccgggt

SEQ ID NO: 93774 - DNA, 1057 bp, Homo sapiens
  chr5:2756673-2757730
  hyper
cggctctcacccggcataccgtggaaacggcgcgtcccgccagctgcggctccagcctgggagggagcgcagcgcggggagcctgcagcgtctggagagtgaggaaaagggacattccttggaaatggacagagccgagttccttaaagggatcgcagttgaaagagaccctcttcaaaatcagcaacgacctggcagccttagttcctcaacaggagatggttcgaagatgaaatgtttgaaactccgccgccgtttcacctttgcacacacgcgcacggcaggcccagatccgcacagagacgcagacacgcgcgcgctcgcgcttcccggagaggtcggcgcgtctcgctgaagctgttctggtcaagtggagttgtcagggctttgttttgtttttgttttgtcttttaaatgtgttttacaagacagtcttcagcagaacttagctccctcaaccctccgtccctccagcagctcctccgtggctctgcaatcttctgtttaaacaccagagcgcacctcggtgctggcctcggcgggggtgcggggtgcgggtcgcggggtgtgcggtcacccaggaggctgcgaagagtgcaggggtcagctccatcccgacgaaagcagataggactcctcgctcgcaagaaacactggagaaaagaaaataattcctcgagtgtttttacaattattttaatccaaccagcgaggctctaaagagcgtttgtcttgaggccgtgttgaataccctttgccaactgtaaattcggcgtgtgtgcccgaaactgctagccctgaccaggggctcggcagcacatggccaggcacacaccgaactcctccttcccaaatccttctgcaggatcctacacccctggagtatataggcagcgggaggggagggttgggttttgctttctttgctttttatttttattttttaatatggctgggaatgcagaaattttaaaaatggatacatttgagtgtgttaaaagtaaaaacttctcttggacaaaacataaactgctaaccgcaacgggggagaagatat

SEQ ID NO: 93775 - DNA, 39 bp, Homo sapiens
  chr5:2865625-2865664
  hypo
gttgctattggtgtacgccattttgtttgtttgtttgtt

SEQ ID NO: 93776 - DNA, 30 bp, Homo sapiens
  chr5:2889717-2889747
  hypo
tggaaagactctgagcgggcagggaagagc

SEQ ID NO: 93777 - DNA, 196 bp, Homo sapiens
  chr5:2890721-2890917
  hypo
ataaacagccggcagcgcattatggaacataaaatttaaaacgctttctgggcctcagcttcctaaagcttctttgattgtcaaacgtcgttactaagtccaagtttaagacatctgccgctctaccttacacaccacgcacaggccgcaaggccaccgggaaatgatgaaaacatgaatgcgggcagcattgctg

SEQ ID NO: 93778 - DNA, 171 bp, Homo sapiens
  chr5:29478680-29478851
  hypo
gagaaagccaaatgccgcccaggtcattgtgcacagggggcttgcttaagcatgcccgttgtgaaaaattcaatctcttaacacatgtgcggtaagggaaagcaatcaatgtggagtggctcagactaaaagcccacctgtgcagtgggagaagggcgtggagccaccggg

SEQ ID NO: 93779 - DNA, 100 bp, Homo sapiens
  chr5:3000087-3000187
  hypo
aaaaaacttcattcccttccagaattcaatgttttagcctagtgaacaaagcacaggacagccaggaaaggataaaagaaagaaacgggaggacggaggt

SEQ ID NO: 93780 - DNA, 167 bp, Homo sapiens
  chr5:3027341-3027508
  hypo
cacgtctcagtccaccggtgaggggcagtgcccccagcgacatgcggtgttttaagcaggtctgacccctggccgcctccacatgtgcacacccatgtaaagtcagtttcctcccaggacatgtagaaggtttggaaggtgatgccaagcgacgtgccttcctcagc

SEQ ID NO: 93781 - DNA, 63 bp, Homo sapiens
  chr5:3028232-3028295
  hypo
gctctcctctttgtgcggagccgcctcaccttgctgtgcgctcgtggccgtggctcttctctc

SEQ ID NO: 93782 - DNA, 322 bp, Homo sapiens
  chr5:3031752-3032074
  hypo
gttctatttctctggcgcaccctgactcatacaccaactttatgactttccaacaaaggcagaacaatggaaatggaaaagagatctttggctgccaggggttcagcggggaggcagtgagcaggccaagcaccgagggtttcgagggtggtgaaactgttccaagcgacaggtaatgggggacacatgtcatgatacatttgtccaaaccatagaatgcacagcaccaagagggacccgcatgtgcactgcggcctttgggtgacaatcacccgtcactgtggctcatcccttgtgaccaagctgccgcacagagcagggt

SEQ ID NO: 93783 - DNA, 37 bp, Homo sapiens
  chr5:3051179-3051216
  hypo
cacacacagtcaagccgccggccgtgtttactgcagc

SEQ ID NO: 93784 - DNA, 99 bp, Homo sapiens
  chr5:30694338-30694437
  hypo
gtataatttttataacgttgccctctaatttataattatcagaaatgtattatttgagtgattttaaaatatactgcaattgcacgtgaccaatcgcat

SEQ ID NO: 93785 - DNA, 41 bp, Homo sapiens
  chr5:3078657-3078698
  hypo
atccacaggggactccgccgcgtgtccggagggatccacag

SEQ ID NO: 93786 - DNA, 16 bp, Homo sapiens
  chr5:31035761-31035777
  hypo
ccgtctaaaaaaaaaa

SEQ ID NO: 93787 - DNA, 147 bp, Homo sapiens; identical to SEQ ID NO: 40519
  chr5:31111601-31111748
  hypo

SEQ ID NO: 93788 - DNA, 23 bp, Homo sapiens
  chr5:31134444-31134467
  hypo
ttggccaggcaggtgcggtggct

SEQ ID NO: 93789 - DNA, 36 bp, Homo sapiens
  chr5:3114736-3114772
  hypo
actcagagtccagcgcggccacgtggtggaagatgt

SEQ ID NO: 93790 - DNA, 30 bp, Homo sapiens
  chr5:31182513-31182543
  hypo
ggcaaaccgcaaacccggaaatcggctcta

SEQ ID NO: 93791 - DNA, 422 bp, Homo sapiens
  chr5:31193869-31194291
  hyper
agctgcagtttcagccgcgacagcaagaacggcagagccggcgaccgcggcggcggcggcggcggaggcaggagcagcctgggcgggtcgcagggtctccgcgggcgcaggaaggcgagcagaggtgggttcgggctccgttggctatgcatacatctccctttttttttttttaattctgtagcgttgatagaagccaatcagagagagagccctctccgcccggtgggtgccgcgccggagttgggagggatgctctcagcctgcgagcccgggtcggggcgggcgcgcgggtccggctgcgcgggcggcgctgctgccgctgctcaggaccgacgccgcttcccggggagcctgggcaccgctcctccgcctcctggtaagaccgatccgccgtggggctgggtgggggcaccgggaag

SEQ ID NO: 93792 - DNA, 121 bp, Homo sapiens
  chr5:31194311-31194432
  hyper
cgctgcctttctctacgccggcagaggctgccaggggagctctggcatttgcaaagttggctggtcaattaccaaagggcgctggtgcgtgcaggtcccgccgagccgtttggggcttgat

SEQ ID NO: 93793 - DNA, 112 bp, Homo sapiens
  chr5:3122092-3122204
  hyper
ccagatccatggcagcgcggtttctctctgccatagtctcggctgtgtcatggctgcatcccacgtgggcgacacacagtgccccagcgccaggcagcggggacaatggtcc

SEQ ID NO: 93794 - DNA, 40 bp, Homo sapiens
  chr5:3142468-3142508
  hypo
gttctgatacaactgcgcacaaaaccggcattgaagtgtc

SEQ ID NO: 93795 - DNA, 84 bp, Homo sapiens
  chr5:31572153-31572237
  hypo
agtattttgcacagccgacacagagcatgtgaccgaaatgagcaaacaggaagaagagggtgtgaaaaaatgcaaagtatgaaa

SEQ ID NO: 93796 - DNA, 29 bp, Homo sapiens
  chr5:31621855-31621884
  hypo
ttgatatcacagggccgggcgtggtggct

SEQ ID NO: 93797 - DNA, 78 bp, Homo sapiens
  chr5:31629209-31629287
  hypo
cactgcattttatcccgagcgtgatgtttgtgctctgatgagtttccgaggatggtgataagacgttttaaaaagatg

SEQ ID NO: 93798 - DNA, 235 bp, Homo sapiens
  chr5:31634979-31635214
  hypo
gtataaaaaaattaccgtggcaaccaatgcttcaatagtacaaatggaaggctgagagacaaagatataaaataatgggttggcttgtaaggggaagcccaggagaaaattacaaattcttcacgtgcagtattattagaccacactggaaacaataaaacacatttgcataaaatccaacgtcacgctcatggatacagtgaaactcattttcaatgtacgtggatgaaaagtg

SEQ ID NO: 93799 - DNA, 329 bp, Homo sapiens
  chr5:31639603-31639932
  hyper
gaggcccggcacccccgagaccgtgtgtgcccaggaaagtttagctacaaatccgggtgcgggaatcccagccctggcagggcggggagtgaggacgccgaaccggggtcccacgttgggcggcgcaaactcctctagcatccggccggggacggggagggcgcagcccaggggagggggctagacagagcgggaccgagacagcgggacaaccggagacgcactgccgggggtactcaagacagggccgggacctcctgctcgggcgcgcatcccgggtccccatccctgggccgtcttctggtcccttcctccgacaggagtggagg

SEQ ID NO: 93800 - DNA, 24 bp, Homo sapiens
  chr5:31662743-31662767
  hypo
tttctttttttgagacggagtctg

SEQ ID NO: 93801 - DNA, 36 bp, Homo sapiens
  chr5:31664530-31664566
  hypo
atacacagacacatgcgcatgcatgcatacacacac

SEQ ID NO: 93802 - DNA, 101 bp, Homo sapiens
  chr5:31691579-31691680
  hypo
ggcgccacctgcttttattctcttatctggcgccacctgcttttattctcttatctggcgccacctgcttttattctcttatctggcgccacctgctttta

SEQ ID NO: 93803 - DNA, 191 bp, Homo sapiens
  chr5:31738160-31738351
  hypo
catttttggaatgttcgagagatcacaagatatgaaatctacaatgtattcagatcatgggaatttttcccagaatcgtttcgttccagagagctgagaaaatgatagcgcacctcaccacacatggagtcctcagctttaacctcagactttctcacaactgcccagtctgataacggaaattcttcacc

SEQ ID NO: 93804 - DNA, 182 bp, Homo sapiens
  chr5:31750531-31750713
  hypo
caccagatgcaggaacgctacagcgaacaaaacaaacaggaaccctgtccccgtggaggtagaggagaggagacaaagcatgaacacaatgtgcaagtgcatgtgtaacacgagggtccgccaaggatgggtgccgcgagggtgaggagtgtggtcctgaggggcgccgctccagggaggat

SEQ ID NO: 93805 - DNA, 30 bp, Homo sapiens
  chr5:31769285-31769315
  hypo
gcttgtgtgtaggtccgtactgaccagata

SEQ ID NO: 93806 - DNA, 30 bp, Homo sapiens
  chr5:31784008-31784038
  hypo
gcagggagtttttgccgagtgacgtcatgg

SEQ ID NO: 93807 - DNA, 30 bp, Homo sapiens
  chr5:31796388-31796418
  hypo
tctttctggttagggcgagggcagcaatgc

SEQ ID NO: 93808 - DNA, 30 bp, Homo sapiens
  chr5:31832893-31832923
  hypo
gcctgggtgacagagcgagactctgtctca

SEQ ID NO: 93809 - DNA, 838 bp, Homo sapiens
  chr5:31854940-31855778
  hyper
tgagcaggggagtggcgagccgagtttaggattgcattacaggcttttcctaacctcctccaccgcggcgcggagggaggaggggggggtcctcccacagacctggagccggcggagagcagccttcgggaagtcctgcaggagccgcgttccaggagggcagctggcagccgccccaggcccccgggccgcctgcaggtgattaggctaatgagctgccccgggggcgcggagaccggcctggcgagcggattacccggcgcccagctgctgccggcggagactcccaggagctccggagaggaaccctccgaaggtgacttcagaactggaggtaggaaatcggcttctcaggcgaaagcctcaggttttctgatctgatccaggtcgggtgcagactggggctgaatccacaaatgtggagatttagccacagcctcggaggcgcggagcggccacctaagcgtctgcccttctcgtctcccggatcactggggtgtgttgtttttaaagtgggggatttgcgtgttgagagacggtttgtgttcctcgggaggagtaagtgacttggagctggtttgtcaatggctggacggaaggaggcgccccggctgtgtgtgacgggcagggaaggggtgcccagaggggacaggtaatagggggttccggagccacggcggtttcagaaccttggggcctgtgccgttgaagccccggtaggggcggggggcatggcagcagcccgggaaatctgtcatactgtcccccatccctcgctagcagcagaatgactgagacggagcaaagctgctttctctacccgcgggaactgtggatg

SEQ ID NO: 93810 - DNA, 39 bp, Homo sapiens
  chr5:31863261-31863300
  hypo
cttacagccatgagccactgcgcccggccatgagacctt

SEQ ID NO: 93811 - DNA, 49 bp, Homo sapiens
  chr5:31889103-31889152
  hypo
cttgatgctcctccccgagccccctcccctatcacgtatgttttgcggg

SEQ ID NO: 93812 - DNA, 28 bp, Homo sapiens
  chr5:31920417-31920445
  hypo
aattttttctgagcgaaagatagagatt

SEQ ID NO: 93813 - DNA, 29 bp, Homo sapiens
  chr5:31921511-31921540
  hypo
gggtgcagtggctcacgcctgtaatccca

SEQ ID NO: 93814 - DNA, 30 bp, Homo sapiens
  chr5:31924663-31924693
  hypo
tggcgtgtgttgcctcgtagtggtgggaat

SEQ ID NO: 93815 - DNA, 180 bp, Homo sapiens
  chr5:3197714-3197894
  hyper
ttgcacatccgttatcgtggctgcttgatttccgtagaaatcaatctaaagaacccgcggtcctgtggcgtgatttcctgggactgacttcctggagaggctactgcgggatgtgaggggctggcaggagcggccctccctggccttggccattgtctttccggagaggcattctgcccc

SEQ ID NO: 93816 - DNA, 24 bp, Homo sapiens
  chr5:3197991-3198015
  hyper
cgcccggcacgagctccgtgacga

SEQ ID NO: 93817 - DNA, 30 bp, Homo sapiens; identical to SEQ ID NO: 40523
  chr5:31982994-31983024
  hypo

SEQ ID NO: 93818 - DNA, 55 bp, Homo sapiens
  chr5:32048718-32048773
  hypo
atgttggaggtctcccgagatggccggaaacactccctcccgcagctgctggact

SEQ ID NO: 93819 - DNA, 1394 bp, Homo sapiens
  chr5:320654-322048
  hyper
agacttttcctgagccgacagcagacagcgagtgcaaaggccccaaggcccgcacgccttattcagagaacagcaggaggcgcggggcgggttgggggcgtcagggagacggggtttgactgagaacctgggggcgccagtgacagcctcggccgcgttgctgaaaaccgaccttgcgggatgaagagggcgcggttcccccggctgggatgaggaccgcggatgctgaggagcggactccagggaccaccgactccatggccggccccagcgagggcgagaacgggtggaagccggccagggtctgtggagacgtcagggtgcgaggccaggctgaggtgtccccagggatcccctgagggtacagggaattcagccagggcctgcgcgcccggacggaggactagagggggccaaggaccaccgggagggggaaggagaaggcgcagcccgaggtcggaggggccggcgggcgcgcagagggcgcggggtgagccctaaggacctgcaggcaggaccctgctctcggccgcgcggtcccgggtgccgaccggcggggtgggcggggcaggggcacccagggccgcacacctgccgcgtgggaccctgaaatgcccaggacgaagaacgtcgcacggacgaccctgccgtgcctggcgcgcgtccgcttcctgggaagctcaggatccaaaagcatcttaatattctctataattcgccaaaaaccatgactccttttacattttcgaaacgacctcatggggcaggcgagggggcacacgctctcctcactttacctgttcgggtctacaccgcccggctctagggccggcagctcagcacagccggccgcgagcgctggggaggggacgggggcgcagggagaaccgggggaccctgggcgcacacagaccccagggggaacgcagggcctggaggggctcagcgcgcgacccccgcctcggggcacggagactccgggggatcactgggacgcgaagggcgcagggcggaccccaggggaaccggatggcgtctccggttcgccagggcagctggggcagccggacccgagacagccggacccgcgggcgccctctgccgcctcccggccctggatgctgcggggcggggcgggcggctcgcgtgccggggtggggcagtccctggagccgccgcgggttcccgggatgcgagcgccggcacccgccgccacagctcctggccagggcgcgctgccccgcgggtgtgcctgagcctccgcgccccgcaggccctgggtaagtgtcctgggcgcccccgcaggcccccgccgcgtgccgcccgcggtggagacgggatgcgctcccgggtgtggggctgagggacgggcgccggcgtcgggaccctcctca

SEQ ID NO: 93820 - DNA, 191 bp, Homo sapiens; identical to SEQ ID NO: 29354
  chr5:322061-322252
  hyper

SEQ ID NO: 93821 - DNA, 134 bp, Homo sapiens; identical to SEQ ID NO: 40464
  chr5:3221047-3221181
  hypo

SEQ ID NO: 93822 - DNA, 138 bp, Homo sapiens; identical to SEQ ID NO: 29355
  chr5:322265-322403
  hyper

SEQ ID NO: 93823 - DNA, 30 bp, Homo sapiens
  chr5:32331996-32332026
  hypo
tcacctcatgtgagacgacatcaactgaaa

SEQ ID NO: 93824 - DNA, 24 bp, Homo sapiens
  chr5:32526558-32526582
  hypo
tgaaatccttctccacgccgggcg

SEQ ID NO: 93825 - DNA, 30 bp, Homo sapiens
  chr5:32616284-32616314
  hypo
tcaagcagtctgtggcgcttgcttgctttc

SEQ ID NO: 93826 - DNA, 30 bp, Homo sapiens; identical to SEQ ID NO: 40465
  chr5:3269777-3269807
  hypo

SEQ ID NO: 93827 - DNA, 40 bp, Homo sapiens
  chr5:32709839-32709879
  hyper
tgctgttaagggaggcgagcgctgacgccagaagttgcca

SEQ ID NO: 93828 - DNA, 870 bp, Homo sapiens
  chr5:32710093-32710963
  hyper
atgtatttaaatgtgcgggacttaattgtcagaattctcccgcccagtgtagcccgttcacattgcaaatgacttggctgcagtaggcacagaaggtccagttccattttgacccgccccgccgcgcggcggactcccgcgatgctcctctggtcacggacttctccagagccgcttccctccggtctccaccgctgctgtggctatggccagtgggaggactgggtctccgaggcaggacctttcttggagtcgcggaaccccagcacagtgcctcgagcgctccagagaaggagcggttggatctttgagcactcaggttggaggggagcgtgtgtcgtacccgggggacctaccgggaacgttttgggaaagacagtccctttatttaggtacctggtttagcaaacaaagccccgaggacgctttggggatgctttccaagctttgtgacacctccagaagttgaaccattccctcgcctttgggagcaacaagtttcactttcctgctctcagtgcgctgacagagggtccgtgagctgggacactgtgacctcggcaccgctgcgattccagcgcaaacctgcgtggcccagggggagggggctggcgcggggctgaggaaggcggggtgtaggtgacgcccgggccagccgggcacaccaggtccgcgatggagccatctgcactgggaccttggtccttgttccctgaccttgcgccgagggaccaggaaggtcaggtgctcgccccgcgtcggtgcttcaggagggaatgtggccagaacgagaaaggtgagagcaagcggcacctaaggatttttgcaccgaaaccacaatttctagaaccatccctttcccccagtcct

SEQ ID NO: 93829 - DNA, 406 bp, Homo sapiens
  chr5:32711023-32711429
  hyper
atgtgtgcgtgcgcgcgcgcatttctctactttaaagcacgtttccttttttgaagccaggagctggagagcgtggaaagggagaggcggtgatcgcacaggcacgcggcgtggtgggggctcttgccggtgcagacgtgggcgatttcagctttaaggaaaaggcagagggcctgcggggagtggtggttagggacaggggcgcgatgggtagtgaaggggtgcagggaggagccctgatgtaagaatgttaatgagagactcccccagcccagcccccacatctccccacccccacccaccccacccgctggaaacacaagcccggcctcggcgcgccatgtgtggtaacacgctcagccgctgccacgctatttaaacgcgggctatggatccaggaaccggc

SEQ ID NO: 93830 - DNA, 672 bp, Homo sapiens
  chr5:32711430-32712102
  hyper
cgaatcaatgagatcaaatgcgagggagatgcaccgtcaattacaaacacttggacaagtctaactttttttttcttctacaaaaacgctttcaaaagcaaccttagcaacgcccaaataagaagccacctctaagcaaaatagtatatgtataaacggagggcgaatatatacaagtatatatatatgtatattacagacgcacaggtttacacccggtgaactttttctttttctttttcttttttttttaagaaaaactagtgacattgcagagaaggacgcttcctctctatcttttggcgcattagtgaagggggtattctattttgttaaagcgcccaagggggcgcagggaccttggagagaagagtggggaggaaagaggaagggtgggtggggggcagagggcgagtcggcggcggcgagggcaagctctttcttgcggcacgatgccgtctctgctggtgctcactttctccccgtgcgtactactcggctgggcgttgctggccggcggcaccggtggcggtggcgttggcggcggcggcggtggcgcgggcataggcggcggacgccaggagagagaggcgctgccgccacagaagatcgaggtgctggtgttactgccccaggatgactcgtacttgttttcactcacccgggtgcggc

SEQ ID NO: 93831 - DNA, 563 bp, Homo sapiens; identical to SEQ ID NO: 2546
  chr5:32712289-32712852
  hyper

SEQ ID NO: 93832 - DNA, 191 bp, Homo sapiens
  chr5:3273116-3273307
  hypo
tgctgagttgtgtggcgcccatgtggcaagacctcacagaatactttttttggttcaatttctgaaaacgaaaaacaaaaaccaaaaaaaccgataaaccagtccctccaaaaacacagtaataaaactacactaagcatggatataaatggctcctgaacctcagagggtaggagcgcactcaggtttgc

SEQ ID NO: 93833 - DNA, 79 bp, Homo sapiens; identical to SEQ ID NO: 40525
  chr5:32750220-32750299
  hypo

SEQ ID NO: 93834 - DNA, 17 bp, Homo sapiens
  chr5:3283330-3283347
  hypo
ggcgcacacacatgaac

SEQ ID NO: 93835 - DNA, 45 bp, Homo sapiens
  chr5:32835693-32835738
  hypo
catgcagtaggcaatcggtaaatatttctttttctctcttttttt

SEQ ID NO: 93836 - DNA, 113 bp, Homo sapiens
  chr5:32855659-32855772
  hypo
ctttaagtatgttttcgttattgtgagcaaatacccacaacgttttcgtcttgcagatctgaaactctatacccattaaacaaaaccttcgctttacacgccccctgcccccg

SEQ ID NO: 93837 - DNA, 21 bp, Homo sapiens
  chr5:32937597-32937618
  hypo
ccatcacgtccagcctgtgaa

SEQ ID NO: 93838 - DNA, 30 bp, Homo sapiens
  chr5:33138834-33138864
  hypo
tatcatttaattccacggaccacatgggtg

SEQ ID NO: 93839 - DNA, 96 bp, Homo sapiens
  chr5:33162506-33162602
  hypo
taaaacaaggatcatcgatgttgtctacaatgcatctaataatgagctggttcgtaccaagaccctggtgaagaattgcatcgtgctcatcgacag

SEQ ID NO: 93840 - DNA, 22 bp, Homo sapiens
  chr5:33201158-33201180
  hypo
ccgcgcccggccccagtgtctt

SEQ ID NO: 93841 - DNA, 25 bp, Homo sapiens
  chr5:33234426-33234451
  hypo
tgagctgacacgcctggctgaattt

SEQ ID NO: 93842 - DNA, 580 bp, Homo sapiens
  chr5:3324753-3325333
  hypo
tgatcccaggaccctcggccaccgcccttcctgcccaggcccgtcctgggacccgggtggccctcgtcatagaaggctgtgttgcccccagcaagagcaaagccaccgctccacgcctgcccggggaattggtggccgagcttatctgggaccactggtccacgcgatgccccgtgacgggccaggaagggttcaggcttggaaatgtcggacggggacgactctgggccttgctggttggtggagctgggagcagcttcattctcctctgactgtgtggacacagccctcaaggggagagggccgcatccctgttccccgccttcctcgccatgactggacgcagcggggcgccctgtccctgcctggagctcttccagctcagggccccatcagcgccaccaccttggactgccgccatccagggcgcagggcccgctgccccacacctgagggacacagccaggctttctgcttggcctgctgttctctacgtctcacaggcgtcttgctttccaccatgcaacttcacaatctgcccaaatgtccttttattaaaactagtcgacaaagtcccaaa

SEQ ID NO: 93843 - DNA, 79 bp, Homo sapiens
  chr5:33272980-33273059
  hypo
aacaagagcaaaactccgtcaaaaaaaaaaagaattgcatcttacccatggggcagatctaaaccgctattgttcaccc

SEQ ID NO: 93844 - DNA, 36 bp, Homo sapiens
  chr5:33286168-33286204
  hypo
cactatgaattacctagtctgcggtattctgtgata

SEQ ID NO: 93845 - DNA, 81 bp, Homo sapiens
  chr5:33298096-33298177
  hypo
tgcttctgctatcgcgcaccctgctggcgcaccctgctggcgcaccctgctggcgcaccctgctggcgcaccctgctggcg

SEQ ID NO: 93846 - DNA, 35 bp, Homo sapiens
  chr5:3339624-3339659
  hypo
caccttgaaaccacacggaacgttctaaattgtgc

SEQ ID NO: 93847 - DNA, 65 bp, Homo sapiens
  chr5:33442966-33443031
  hypo
agatgagaaagcaggcgtaggaacagtaacttgctcaaacccagtatccccgtttttttccttcc

SEQ ID NO: 93848 - DNA, 97 bp, Homo sapiens
  chr5:33509494-33509591
  hypo
aaggctgaatagtaccgtattctattgtatgtatgtataccaccttttaaaaatctattcattcaggctgggcgcggtgactcaagcctgtaatccc

SEQ ID NO: 93849 - DNA, 197 bp, Homo sapiens; identical to SEQ ID NO: 40531
  chr5:33550087-33550284
  hypo

SEQ ID NO: 93850 - DNA, 157 bp, Homo sapiens
  chr5:33596013-33596170
  hypo
agctccagctgttagcgatggttacctgggtggacaagccttttcatggcacttcttctgtctcccattgggctgtgtttctgggtcacagaatgtagctttcaccatcccgcggcccttctttatgcaatgggcagtttggcggcggatacctggg

SEQ ID NO: 93851 - DNA, 190 bp, Homo sapiens; identical to SEQ ID NO: 40532
  chr5:33880065-33880255
  hypo

SEQ ID NO: 93852 - DNA, 502 bp, Homo sapiens; identical to SEQ ID NO: 29513
  chr5:33892054-33892556
  hyper

SEQ ID NO: 93853 - DNA, 79 bp, Homo sapiens
  chr5:33936153-33936232
  hyper
agctcaactctccctcgcggcgcgggcgcggctgggttcagcacctcggaaagcgcccctcgcggcgccccgggattac

SEQ ID NO: 93854 - DNA, 129 bp, Homo sapiens; identical to SEQ ID NO: 29515
  chr5:33936233-33936362
  hyper

SEQ ID NO: 93855 - DNA, 547 bp, Homo sapiens
  chr5:33936363-33936910
  hyper
tggtggatggaactctacgatctctttctctccaaggacggaaacctcatccaagcagtcccagaggaaacggataaaggtatttgaaagggagcgagcggccccaaatcgcacaattgagcggctgggggagttatgcgccagtgccccagtgaccgcgggacacggagaggggaagtctgcgttgtacataaggacctagggactccgagcttggcctgagaacccttggacgccgagtgcttgccttacgggctgcactcctcaactctgctccaaagcagccgctgagctcaactcctgcgtccagggcgttcgctgcgcgccaggacgcgcttagtacccagttcctgggctctctcttcagtagctgctttgaaagctcccacgcacgtcccgcaggctagcctggcaacaaaactggggtaaaccgtgttatcttaggtcttgtcccccagaacatgacctagaggtacctgcgcatgcagatggccgatgcagccacgatagccaccatgaataaggcagcaggcggggacaagctagc

SEQ ID NO: 93856 - DNA, 30 bp, Homo sapiens; identical to SEQ ID NO: 40467
  chr5:3422389-3422419
  hypo

SEQ ID NO: 93857 - DNA, 262 bp, Homo sapiens
  chr5:344035-344297
  hyper
tgcacgtacgcgggccggaagcggaggaggcccctgcagaaacagtaaagtatcccgccttctgcttgtgtgggttgttgcacccatggaaggggagggttggggtttgccttgaaaacggagttttaggaacagggcgagcgaggaaggcttcgggagccgggcgggccggggctgagctccggcgcgggcggcgcaggagtcgtctccccgcagcgccccggtgcccggagcccccggcgaggctcgtccctgcgccctc

SEQ ID NO: 93858 - DNA, 30 bp, Homo sapiens
  chr5:3452425-3452455
  hypo
acactgtgcaggggacgaagaatgcagaga

SEQ ID NO: 93859 - DNA, 263 bp, Homo sapiens
  chr5:3454166-3454429
  hypo
cagataaaaaagccacgctgacaggcccctgtctgctgtcctcacccagtgaggcctctgcaacgccgcccctaacactcacactagcacagtggacatcacccactaacacacgctcccgctagcacggcaggcgtcacccactaacacacgctcccgctagcacggcgggcgtcacccactaacacacgctcccgctagcacggcgggcgtcacccactaacacacgctcccgctagcacggtgggcgtcacccactaaca

SEQ ID NO: 93860 - DNA, 209 bp, Homo sapiens
  chr5:34555944-34556153
  hypo
acctggcctatccttggagattttaatagccatagttatcatttgtttatcaccaactacgtgcctggcattttgcacacagtaatttgcacttcacattaatcctgtgaggcaagtattatcacttctatttggtggaagaggaagctgagagtcagagcagttaagtaacttgccctaacttgcaaagctagcgacagtagagaagc

SEQ ID NO: 93861 - DNA, 37 bp, Homo sapiens; identical to SEQ ID NO: 29517
  chr5:34655873-34655910
  hyper

SEQ ID NO: 93862 - DNA, 70 bp, Homo sapiens
  chr5:34656351-34656421
  hyper
gcgggggccggcgcccggcggccacgtggtggtgctgccgctgcccccgccccgccggcctagcccggga

SEQ ID NO: 93863 - DNA, 320 bp, Homo sapiens
  chr5:34656642-34656962
  hyper
tttgtgtctggagctcgggcgcgggaggcgctggggacggcgcccgggcggagcggctgagcgggctgcagccggggtcccgccacctctccctggtccaccgccggcagcccactgtctgcggagagcagatctggggacaagaggaaggagaggaaggtggagatgagggtagagcgggaagacccggccaagttaggagaagggttcttcccgggtcctccgcgactcgcaggccggctggggcggggcgcggggcaggggccgcggcggagggagcgcgggtgggaatgaatgagcagacccggagatgcaccctg

SEQ ID NO: 93864 - DNA, 105 bp, Homo sapiens
  chr5:34839926-34840031
  hypo
agaaatcacatttttcgttttgtgcttccgaggtttctcctatcatctaacagcaacaactaaaacagacacatgaatttcattttattgttttattttattttg

SEQ ID NO: 93865 - DNA, 184 bp, Homo sapiens
  chr5:3487829-3488013
  hypo
tcaggctacaacttccgaaaatgcagcttagcaagagacagctcgatgaacaggcatccagaacatggcaccttcttgcaaagaaaggctgaccttgaggaactgctgagatacgcacttgtttctgcaaagagtcactgtgtttcccacccaatacccagagtgaacgcgctcagtgcgcggg

SEQ ID NO: 93866 - DNA, 397 bp, Homo sapiens
  chr5:35229693-35230090
  hyper
cttccagcttcctcccgggctgcaattcctctgcctaggtgcctccgtccagctccggcttctggcccggaggctgctcatctgcccctacccccgctgacttttgggaggagcaacacctttcaggtcagcattgctaaccctaaactttccccgccggatgcccgcgaggctgctgcggcggcggctgctgctgatgggagagtctcgagtccggctttcatcacatcacctgtctgcgccccttccccctccccgctctttttttcttttctttttattttgacgcaaataatttgcattctgagaatcccacaatcaacgccgaaactcatgctcaaggatacaggtgaagatgcctttgacaaaggcgaatgcgagccgagtgcagtttgta

SEQ ID NO: 93867 - DNA, 158 bp, Homo sapiens
  chr5:3535627-3535785
  hypo
cagcgacttctctcccgcgagcttatgggaaacgccctgcgcagctgaccagtcatccgacgttgcggagagcagcgtgggtccgagggaaggctgcggccggggacgcccagactggaggccttgtctgccccacccagcctcggacttctcaggct

SEQ ID NO: 93868 - DNA, 30 bp, Homo sapiens
  chr5:3536520-3536550
  hypo
ggtccgagtataatacgcccggcatacact

SEQ ID NO: 93869 - DNA, 33 bp, Homo sapiens
  chr5:353889-353922
  hypo
ccgggaccgcctcaacgccgagttggaccacct

SEQ ID NO: 93870 - DNA, 327 bp, Homo sapiens
  chr5:3590331-3590658
  hyper
gtcatttcaagaaggcggagatgcaaacacaacacggagaggggatgtctcctgtctagagattccagggcagtttcagcttaaggctgcgggttaaggttagcgggacccgttgggaagccacagtgatcccagggctctgggtcactgcgggtgcgggtgcgggtgcgggtgcgcacagccagggatcctggcgggagccactgcggtttcagctgcatccgataggccccaagcgggaggcgattctgaggccagcgctggcccaaagaccagaggacctgagcaaaatgaaaagtcactttgttcctcacgccgtgcgcagcc

SEQ ID NO: 93871 - DNA, 100 bp, Homo sapiens; identical to SEQ ID NO: 29426
  chr5:3590803-3590903
  hyper

SEQ ID NO: 93872 - DNA, 347 bp, Homo sapiens
  chr5:3591111-3591458
  hyper
tttataaaatatttacgtgtgtgcacacgcatgtaattcacttccttcgacactggggacggcgtcgtagcggcactccaggccaggccactgcggtccattcctctgccctgcgtttgtgggaaatacgggcccagtgccgcagctttagggcctgggtcgcccttggtccgcccgccgcgttcccgggtggtgtccccacgctgctgaggacctggttccgcgatgcttgccgcggggggcactccccgcagcctgcgaccgtcctgcgtccttcgcttctgggcgtttccttctggggtttccttggagcggctcgagtcgactcctcccgcctgcccaactca

SEQ ID NO: 93873 - DNA, 180 bp, Homo sapiens
  chr5:3591857-3592037
  hyper
gcaggaggccagggccgcgccacccgttgcatcccgcggcaggtctgtgtcgcctggttctcggcgccaaaggctggtcccacagacggcttccgggagtgatgcgtccccacgagcatcctcctcttccttagcgacccccggactgcagagcttcaagaccagcgaactgtttcccaa

SEQ ID NO: 93874 - DNA, 239 bp, Homo sapiens
  chr5:3592642-3592881
  hyper
cgacccctagacctggttttgtcaggctcctcgtctttgtctctggcacagtgaccagggggcagccaccgggtgcggccagctccgccaggagcaacttccggagcagcggcagggcctgcctcagccaccccctttggaggcaggaaaagtggctgaggggccaacaaagtggctctctcctgcctcagaggtccagcgcctcacagctggggcgtcggtttcgaaggccaagcaga

SEQ ID NO: 93875 - DNA, 473 bp, Homo sapiens; identical to SEQ ID NO: 29430
  chr5:3594047-3594520
  hyper

SEQ ID NO: 93876 - DNA, 100 bp, Homo sapiens
  chr5:3594777-3594877
  hyper
cggagctctccagccacgaggcgcagaagtggcctgccagcgccttcccaggctcagggaggcgaggaggcccgtgcacttggcatcttctcccgggagc

SEQ ID NO: 93877 - DNA, 314 bp, Homo sapiens
  chr5:3595055-3595369
  hyper
cgcgttccacacaagtttcctgtctgcctctgcacacctggtggacaaaccgggcgtccaggccacaccgtcttcccccttcgcgggggcgcgggggatgtttccctccggctgccagggggctttctgggtgaagagaaagcccctccccccgcgtctcccccacccctccctccgagaacccgcggcgccgactgcgcctgcttcccccgagctggcgacttctccgcgggatttgccctcgctcaaagtttgcacaattgaaagagcccgcagagctcggccgctccccgcttccccaagggcggcgaggc

SEQ ID NO: 93878 - DNA, 253 bp, Homo sapiens
  chr5:3595849-3596102
  hyper
ggcgagggcgggcgggaggcagggagggggcgggaggggagccaggggcggggcctgcgctcaaggggatgccaatcaaagcatcaacttcaaattgtgtctgaaagccccgccgccgagcggagggcggccgccgcagtcggcgcgcgattgcggatccgggcgcagccgggagccgggcgcctgcgagcaccgggcagaggagccgcgaccggcctccatctcccggcccgcccgagcgcgcccggccggc

SEQ ID NO: 93879 - DNA, 170 bp, Homo sapiens; identical to SEQ ID NO: 29434
  chr5:3596555-3596725
  hyper

SEQ ID NO: 93880 - DNA, 186 bp, Homo sapiens
  chr5:3596824-3597010
  hyper
cggccagggcgcccgggcaggcccacggggttcctgcaggtcggcccggcgtagcgtagcaggacttcccttcctggccgcgggttccactcgcgcggcctctttagttttcgaaccgagtctggaaaacttggttttctccctctttagcagctccgagatagttgtatccgagtttgccagaca

SEQ ID NO: 93881 - DNA, 510 bp, Homo sapiens
  chr5:3597357-3597867
  hyper
cattggcctgtctgccggtccaaatcatccattttccttggtctgactgcaaggtcggtgcttaaacttcggacggctggtgaattgtgcggcgggcgcggggccctgggaggcagccccctcctgggtcgctgcccgcgggataaagcaatttccaagcacccgcgatatctccccgctccccgcaggagaagcggggagtaaacgcccctcaagtgtgcacaagcaaagagcgggtttccctgtaacttttcttgtagttttgaaagaaagcggcccggctgcctttcaggtctcttactatcgaaaaagatcagcccccattttgttcaggcggcggggaggccgggacgcgatgagagatttacaaggtgtcctttcaaaaagaattcccagtggagacgaggctgaaacgtcttctttacaattacaaccaaaataattagaaaagcgcaaagtacattttggaacgattgggcaaaaacgaaatctagccgcagaaatgttttc

SEQ ID NO: 93882 - DNA, 30 bp, Homo sapiens
  chr5:359746-359776
  hypo
cacccgcagcagcatcggagtcctcttgtt

SEQ ID NO: 93883 - DNA, 30 bp, Homo sapiens
  chr5:3598863-3598893
  hyper
gctctgggccctttacgtttggagaaatgg

SEQ ID NO: 93884 - DNA, 81 bp, Homo sapiens; identical to SEQ ID NO: 29437
  chr5:3599364-3599445
  hyper

SEQ ID NO: 93885 - DNA, 106 bp, Homo sapiens; identical to SEQ ID NO: 29438
  chr5:3599502-3599608
  hyper

SEQ ID NO: 93886 - DNA, 246 bp, Homo sapiens
  chr5:3600074-3600320
  hyper
cgggccaccccggcgcgcacgggccctccgccggggcgccgctgcaacaccccgccttcctgcctagccacggactgtacacctgccacatcggcaagttctccaactggaccaacagcgcattcctcgcacagggctccctgctcaacatgcgctccttcctgggcgttggcgctccccacgccgcgccccatggccctcaccttcctgcacctccaccaccgcagccgccggtcgctattgccc

SEQ ID NO: 93887 - DNA, 249 bp, Homo sapiens
  chr5:3600390-3600639
  hyper
cgtccacctgtcccctagctgggaatgcagaggcctggctaggtgtggtagcgtggggtgcagcatgagccgggagggtaccaggcagtggccgctgagccctggggctgcgcttaatccctgcttcaatttagaaagccagacaaggccctagggctctcccaagagagctttgccctaccggcgggcctgctacggggtggtggtggggtgaggggtgacgtttttcggcgaatctgcctgggcagc

SEQ ID NO: 93888 - DNA, 21 bp, Homo sapiens
  chr5:3600732-3600753
  hyper
cgtccccaggccagattcgcc

SEQ ID NO: 93889 - DNA, 346 bp, Homo sapiens
  chr5:3601025-3601371
  hyper
ggcgtcgcccggcgctgcgtcccccactcacagtgcccctgtcttcttgtctcgctgtgtttcccatgcagctctctggccccgcaggagggaacgccgcggatcctagcagccctcccgtccgcctgattaagggtcttcttttacttttgcgggggggaggggggaggagttggggagggagggaatgtgggaggaattaagacaaatatttcagactggtgtaaaggacaaatatgacaacgacgtcaaggactcgcatccgtcgctttctgcagaaaggggcttcttcggtcccgagctcgcgtccaggtggccaggcctctgccggcggctccagtggctg

SEQ ID NO: 93890 - DNA, 653 bp, Homo sapiens
  chr5:3602804-3603457
  hyper
agcgagggggaaagtcggggcgctggtgtcttttcagaggttccaggaaagagggaggctcgcgttaggactaggaggtgccagtccacggctcctacccgctcccgacgcccgcatccttctacagccctccaccccgttcctggtccctgtagaggggaaggtcctctccctgccccgaggcgggaggaaaagcggcgaagaggaggctcgaagggcgccgcgtagggcaagtgggccgaggacaccgggggcgcgtcggggagcggggagtgggcggggtgggatgaggcagggaggagccgggccggagcggagtggagtggaccgcgggcggacggactcgggccgggccccggggagcagctccgcagtcggaatggacgtgctccaggcgccctctatggtccgaaagcggaatgcggccttgagcagcgcccatctcgctcctggggtgtgggggcaactctgggggcgctgggccttggggctccgtgggcacgagcctgcatttgtagtgatgggaaccaatttgtgttccaaggctgcacccactggttctttttgtgtgttttgggggagtgccgggcctgcaggttaggctactggcatttggagggagtgggcactgggctctacgtggggtgctctta

SEQ ID NO: 93891 - DNA, 167 bp, Homo sapiens; identical to SEQ ID NO: 29443
  chr5:3606268-3606435
  hyper

SEQ ID NO: 93892 - DNA, 437 bp, Homo sapiens
  chr5:3606711-3607148
  hyper
cgccctctccgcggctgctgttgggcttctgaagacgcagcgggtgtctctgatcccctaatccatttatccagagtcccgagcgcaatggctggtgcggggacacaacggcaggaggtggcgggggtggagggagaccgggcactcagctagcgccaccctcctcccgccccacccgagacgctgagccacgacccaccctccacgggtcccacgccctcaggcagaacgcaatggtgggaatgacgccaaggtcggtgaaatcttccaaattgaagggcttttattttaaattccgattcccctttgaaacagccctttcgatgagggaagaagccagctcggtttctgcgtgcgtgtttatgatctacctgtgagcgcggcgctctggaaggtcacccaggctgcggacgccctgatagcggggtgacagcctg

SEQ ID NO: 93893 - DNA, 30 bp, Homo sapiens
  chr5:36127942-36127972
  hypo
ggaagaacaaaagctcgggtggctttgcca

SEQ ID NO: 93894 - DNA, 34 bp, Homo sapiens
  chr5:3613874-3613908
  hypo
tgtattgccaccccccgcccggtgtgtacgggat

SEQ ID NO: 93895 - DNA, 30 bp, Homo sapiens
  chr5:3623145-3623175
  hypo
gcaccctcaagcatgcggttcagggaaatg

SEQ ID NO: 93896 - DNA, 34 bp, Homo sapiens
  chr5:3639390-3639424
  hypo
gtgtgtcttgcagtagagacgcccagcatccctt

SEQ ID NO: 93897 - DNA, 20 bp, Homo sapiens
  chr5:36541411-36541431
  hypo
ttaaaacaggccgggcgtgg

SEQ ID NO: 93898 - DNA, 69 bp, Homo sapiens
  chr5:36606740-36606809
  hyper
tgcttacgcgcgctgcggattgttgctccgttgtacctgctggggaattcacctcgttactgcttgata

SEQ ID NO: 93899 - DNA, 86 bp, Homo sapiens
  chr5:36607023-36607109
  hyper
cggagttgagtcattcggggtggattgggggcagattgtggcgcgagatctagaaaaggatcaaggttgagcggatctgcttaaaa

SEQ ID NO: 93900 - DNA, 30 bp, Homo sapiens
  chr5:36607317-36607347
  hyper
gcgagaagtcatttgcgaggagtcctttgg

SEQ ID NO: 93901 - DNA, 454 bp, Homo sapiens
  chr5:36690192-36690646
  hyper
gttctgttagctgaacgggcctggaggaagcgtggcgggaaggctggatccccgccgcaggggctgcggggctgtggctgcctgcgggctgggcagggccgggcgcacgccctccttccgggtggccgcgggccccgaccccaggctgccgtcagtcgagcggcctccgcagcggccgcgcttccccttctcccacccgggtggtcccagaactggagcaacaatggccggctctgtgtggccgcgtcctggggccaaagcagtcgggacgtgtcacgccgagggagggctccgaatgaatacgctgacaataagaaggaagggagagcgagggaggtgatgggcagcgtcctagagggaaagcgggagatgagaaatctacgagatccgcgaggcggcgtccggggagcgagcctcatagtggccaccagggggaatgcggagctcaccttgg

SEQ ID NO: 93902 - DNA, 30 bp, Homo sapiens
  chr5:36693244-36693274
  hyper
cccttcgtgtgccagcgacctccccttctg

SEQ ID NO: 93903 - DNA, 176 bp, Homo sapiens; identical to SEQ ID NO: 14743
  chr5:3674048-3674224
  hypo

SEQ ID NO: 93904 - DNA, 30 bp, Homo sapiens
  chr5:36938092-36938122
  hypo
ttgcattaatagcaccggttgtttgccatg

SEQ ID NO: 93905 - DNA, 36 bp, Homo sapiens
  chr5:36985760-36985796
  hypo
aggggtgaatcagagcgacatcgaggggatcagtct

SEQ ID NO: 93906 - DNA, 178 bp, Homo sapiens
  chr5:3724955-3725133
  hypo
agcacaatcacccaccgccgcccttggcttggagtgggaaccccttttgctcatgtggctcccaggtgggccattgcaccaccctgcttttcctcactccccgcagctcgtgccagctgcctagtcagtcccaatgagagagcctggatacctcagttgctggcgcaggattcactca

SEQ ID NO: 93907 - DNA, 21 bp, Homo sapiens
  chr5:37255526-37255547
  hypo
tcttggcggtgggtgcaggac

SEQ ID NO: 93908 - DNA, 101 bp, Homo sapiens
  chr5:37371474-37371575
  hyper
gagggaggagggatacggtaggtgggagctaggtcgtgtgtctggcctaggaggttggtcaggttccgttggtttaagcgcgtgctcgacctgagtcttgg

SEQ ID NO: 93909 - DNA, 314 bp, Homo sapiens
  chr5:3740703-3741017
  hypo
ggctgcttcccaggccgtcatcccagcacggcttcctcactgggaggacgcggcttgttcccatttctggagtcaggctgtatgggcccctccacaatcttcagcgccgcgtccctgcaggtccacatgtcccccgcgggccctcccctggtttccgatgcccatcacccaacctcttctgtgtcctcagcccggggtgggggtgcagcccctgcaggtgcctcagggtgtctgtgctcccagccctacccactgctcggtcaaaccttcacatcgccttctctcctgcgcgcagctggcggcttctatcttct

SEQ ID NO: 93910 - DNA, 276 bp, Homo sapiens
  chr5:374077-374353
  hyper
cgatgccgggaggggcgcgcccctgccgccgcacctacgcgcttctcggggaaaaggccggggctgccgggtccgcggggcgcattgcgggtgggacggggtcggctccgctgcgggagcgacccctgcaatggggcttggctgcaccggccgcctgggtggtcggtctgtgtgcgggtgacccaggcgtgtgcccccacccgcgctgccccagcccgcggacctcggcggggagcgcccagggccagcacgggggtctcacggggcgaccccagc

SEQ ID NO: 93911 - DNA, 121 bp, Homo sapiens
  chr5:3761119-3761240
  hypo
gagccagaacatgcccgctgaatgcggctctagcagctgtcgtgggccttcagagaggaagaatcttaaggcgcgtccaagacaagcggagtcgaggactccgtttcggggaggtttacct

SEQ ID NO: 93912 - DNA, 56 bp, Homo sapiens
  chr5:3761567-3761623
  hypo
gtgtgggtgcacatgcgctccctccatctccgtgggctttgcgtctctgtgtgggt

SEQ ID NO: 93913 - DNA, 69 bp, Homo sapiens
  chr5:3775375-3775444
  hypo
ggaaggtggccagctcgccatcccctcaggctgacctgccgacctctcccgtggcggttgcctgttctt

SEQ ID NO: 93914 - DNA, 122 bp, Homo sapiens; identical to SEQ ID NO: 29523
  chr5:37834615-37834737
  hyper

SEQ ID NO: 93915 - DNA, 3110 bp, Homo sapiens
  chr5:37836626-37839736
  hyper
gctggtttgcaaactcgggaaaaagctaggttctgggtcgcgatgtgcagacacaggaaaactgcaccaggccatgcaaaatgagcccagaaaggtactttggcagctaggacctggggaacgcgagcttcccccctcaagccccccgccggtgccagctcccgggtgcgtgcgaaatggctggcggtccgaccggaggagcatggaggcgcggggttaatgcgccattccaaatcgcggtgcccgccagcaggaagccacagaggcactagatttcccttccgtcttaagagggttttcccttttttcctgcttggccgacggagggctttttaaattggacgtggagatcctcaattagaagtgtggcgaagctggcaaaagactacacagtggaaaactccccgcgtcgccagaggaggctcccggctgcggttcccgccctcggccgagcgccgccagcgcccggatcgagctcccctcttcccccgggacagggagggcgcattcttccctctgagcgccgccgggaccggctccagtccgaggggctctttcgttctcggtatttgctgggcgggggaaaaggggggaggttgggggactcggcacacacagcgtctactaggacgtttttcttagagtccgtgtgggctccacccctcggcttctcagtttgtctctctatcgctttcccaaaacacatctacatctgcccgacgcgcttctcctcaaccatgggcctttgcccgcggtgcaaactgctttacgcgccgccacgtgcgagaaccaagctctgctcctcaagtgacgggggctctgctctgccaggtgaccgcgcaccatttctcgtgcctggcaagctggtccccttctgggtccgggaccaccacgtcccggcagggcaaaagcagcaggccgtgggcgccggcacctgtgggtccccaggcctggggaggcaaggacgcccaggaaagccacagaagtgctcgcagaagcagccgctcgccgcgaggcacttctgagttcccggcagcagggggcaccagaaaccgtctgagccgtgtcgcgcccacgcggcccggaggctgtgttatcattttagttataaaaccggagaaccaccactccctctacgagcctcccgaaatcccattagcccgggaacctgtggaggtccttactggcatctctgcttttcaggctcccacccctccattctcgctggttttcctctccccacttcacctgagcgggtttcttggcaacctgctttcagaccatccctcaccccttccacgcgtcaccgtgacagattcgcaggaggcagcgctcccgccgtcagtgcccccgcaccttcttgtgcctggcaggctgggaggtttgtttgggctttgccttcaagatccaggtctcagagagagaaaaaggaggcggtggggcggggagacgggtttgctataaactcggtttttttttttttttttttggcggggggaggtagagacagaaattgctggaagatctattgcttttcttaactatgcttcgtgtccttgactgacagaggacttattctcccctcaaccccccataactgcggggcccaagatgagggaaggaaaaagaatttgggacacttctcgcaggcaaactgggaaagcggtctgtttaaagggccaggttccaggcccgagagcacccgaattgctagcgggaaagggctagggacacggcggacttcccagagatcggacacttgttacttgttgaaaaggcgccaccttccctgacaaagcgaaggcgcagcgaaacagtacgagtttggtcgaggccggctttgacggctttgcgggactgggtgcgtgaatgaggttggaagaaacatctcttccttgaaatacctaagcatatattccaaacactgagcaagagtcgagcgcgttctaacatctccgcagcaggggccggaagagttgcctttgtccccgcctatgagcagaagggtcgcgagctctgggatgggtaagccccccgggggcgcgcacatgggtcctggcggcggattctaccaaagccgaaactagctgggccccaggaagctggcgggaacccgcgaaagtccgtttccagcccgaagagggttcgtttttcttcgttggggcaggaaacaaaccaccagtgcggaattagcctcgaggtggtgtaaagtagtggcagtggtggtggggtgtttttggaaggcggcacagagtacaggagaaaaaggggtcattaaaataataacctcaatggcctagtggagtctcaagaatacgttcgagacagagatttgaatccaggactggcaagaaagcccctctcctaacctcgacggggatggttagttggggtggagggcgttaggaacgtgcaggcaaccgggtgaggaatgtagctttgccagacctcgcccggaggaggtgagccctccatttttaggttctcagcacctttgcagcagcccctcccccggcctgcgcttttccttggcacagatcaaaacaagctcaatagtaagttgcactcttggcaatgatagtatctctgcacgtccagagaggacacatttcgacggcggtgggttcgaagatgacccaagccctgaatcgttctgtgacttgacggaagagcacctggccgagtcggggaaggaaactgcccctcttgggcattccgggtccaggcgcatctggggctccacagatctttgcccacgtggaaaaggcaacatgcccctccgaaaggccggcctctctccggttctacttttctctctcctcgcatagcttaggttccctctagtctttccactttctactctcaccgtttgctctggggtccagacgcacccctctgactagggcgcccttcagccggccgcacccacccgcgacgcaggcaccacccgctccctgctccccggcccgctccctcacttacctcggatcgggtctccgcagaccctaggttggacattaactccaggtgccccaagtcccagccaggagacccatccgggctgatggctggagcgcggagccccgcccaacaggtcaggggcaagagtt

SEQ ID NO: 93916 - DNA, 268 bp, Homo sapiens; identical to SEQ ID NO: 2549
  chr5:37839807-37840075
  hyper

SEQ ID NO: 93917 - DNA, 144 bp, Homo sapiens; identical to SEQ ID NO: 2550
  chr5:37840076-37840220
  hyper

SEQ ID NO: 93918 - DNA, 96 bp, Homo sapiens; identical to SEQ ID NO: 2551
  chr5:37840267-37840363
  hyper

SEQ ID NO: 93919 - DNA, 210 bp, Homo sapiens; identical to SEQ ID NO: 29529
  chr5:37840529-37840739
  hyper

SEQ ID NO: 93920 - DNA, 165 bp, Homo sapiens; identical to SEQ ID NO: 14745
  chr5:3806428-3806593
  hypo

SEQ ID NO: 93921 - DNA, 17 bp, Homo sapiens
  chr5:38247048-38247065
  hypo
gcttgggactgggtgcg

SEQ ID NO: 93922 - DNA, 135 bp, Homo sapiens
  chr5:38257406-38257541
  hyper
aacattgtttcctcccgcgctcccaaacataggctaactgtgaagagccaggacgcccaccgagtcctggcagcgttgcaaggtggggagggggcgggcgcggtcctgtcgctagtgactgcagatttcctctgc

SEQ ID NO: 93923 - DNA, 367 bp, Homo sapiens; identical to SEQ ID NO: 29531
  chr5:38257542-38257909
  hyper

SEQ ID NO: 93924 - DNA, 726 bp, Homo sapiens
  chr5:38257944-38258670
  hyper
cgccaggcttaacttggagtttcatctcctccccaggagggtctcaagttgccttcctctgccgggaagggcccccactcccccgctccaggccctaatctccacccggcgtcccagtctgagcggcctggcctcagctctccatctgcgagccttaaatcccatttatcttcttagcgcctcagacccggacggtcccgcctctcttcctctcacccccaccccacttgcaaatcacagacccccgtctacccctcgcatcccccaagtgcgctggaccaactacagcaacctttgaggtgttagaaaaagtcgcctagaggggcgcggcaggaggagggcccaggtggggtggagggggggcgccccaagatttcagggtgaggaccgcggagggtcctggacccgcagtcgcctaactcctgccctgcgtctccagtgcttgaagtcggtccctcccaggtccccaatctaggtcaccagcggggaagggctgcgctgggggtcgctagagagggtgaggggcgggctgtctgcttccgaggtgggcgaggagtgaaggtttcagggcctgtccctctcacttccactcgattgtaatttcatccccgggccggtcgagcctccctccctcccgcggccagcccttccctcccagtcggcctccttcgtcgcccccgcccccgcgaaaagccctgcagcttgcagccggcttcactcgcgcac

SEQ ID NO: 93925 - DNA, 287 bp, Homo sapiens; identical to SEQ ID NO: 29534
  chr5:38258671-38258958
  hyper

SEQ ID NO: 93926 - DNA, 34 bp, Homo sapiens
  chr5:38259223-38259257
  hyper
tgacagttgggacagcgatcgtgctgtctcaatt

SEQ ID NO: 93927 - DNA, 154 bp, Homo sapiens
  chr5:38556207-38556361
  hyper
ggcagaagttctgggcgctggagtccgcgtcccccaggacacgagggtgacccaagggcgcgcggagagcggcgggacccggagcggcgctctccggggtcactcccctaggacgctccgcagagctgggagcgctgccccaccccgcccgggc

SEQ ID NO: 93928 - DNA, 24 bp, Homo sapiens
  chr5:38556411-38556435
  hyper
cgcccacccgcccccaggactcac

SEQ ID NO: 93929 - DNA, 238 bp, Homo sapiens; identical to SEQ ID NO: 29537
  chr5:38556436-38556674
  hyper

SEQ ID NO: 93930 - DNA, 212 bp, Homo sapiens
  chr5:38556773-38556985
  hyper
cgccgctcggctgggggcgcagcgggcccggccccgcccctgacccgcccctgcccccggccccggccccgccccaacccgcgcgcccccgccgatccccggccgcgcgcccgcgcgcgcgggtgctccaaggagtcggaggaacgcggccgcgcgacgggccccggacgccgagggtggtgcttcctccgagcctccggtggtgaggccgc

SEQ ID NO: 93931 - DNA, 72 bp, Homo sapiens
  chr5:38557271-38557343
  hyper
tcctggtcctcctgccgggtgtggggctcccctgcccgagatggccagcgggcgcgccgagagtatcctgga

SEQ ID NO: 93932 - DNA, 149 bp, Homo sapiens; identical to SEQ ID NO: 40475
  chr5:3856433-3856582
  hypo

SEQ ID NO: 93933 - DNA, 187 bp, Homo sapiens
  chr5:3859680-3859867
  hypo
gaatggaagagtgatcgctgattgtttgggctcagagaggcctaccagcctgactgttggaaaagcacattagacagatgggatgtagcggctagaagagcaggtgccagacggaaaatccactcatgaagtcagagctacctgtggcaccggtaccctgttggaagagcctcgctgttcttcttct

SEQ ID NO: 93934 - DNA, 30 bp, Homo sapiens
  chr5:386774-386804
  hypo
tccaggcttcagccacgggtctgtagggaa

SEQ ID NO: 93935 - DNA, 255 bp, Homo sapiens
  chr5:38845617-38845872
  hyper
cgccaaatggaaacacggccaaaatttagttaaaggacttctcttgcctgaagattttcggacggggatctcacgggtttggcctctgggttgggatgacaagtgcccctgtgggatacacagccccaggcctcatcggtcactcggcttacctctggttccgccggctggcccgtgcgtccttggccggggcaggagcagcgctgcgcgcggggcacggagcctcggccgccgagttttcggtttccaagtttc

SEQ ID NO: 93936 - DNA, 21 bp, Homo sapiens
  chr5:38846468-38846489
  hyper
cgcccccggcctgcctacctg

SEQ ID NO: 93937 - DNA, 34 bp, Homo sapiens
  chr5:39248593-39248627
  hypo
aacatggagaaacctcgaagacgtaatgctaagt

SEQ ID NO: 93938 - DNA, 36 bp, Homo sapiens; identical to SEQ ID NO: 40535
  chr5:39343165-39343201
  hypo

SEQ ID NO: 93939 - DNA, 634 bp, Homo sapiens
  chr5:39424929-39425563
  hyper
cgagcatgacttccccgcgcccggagcctccaggctacagcgcagcggatgcggcgggcctcgcttaaatagccgccggccgggagcttcggagccgcgcggccactcccggcgagagatatggttctaatcagatgctggcagctgaggactccccaggaatgtgccaggatgtttttgctgcctgggcttggtaactccccctcaacgtgtctgcagagtcttccaaacttaactgtttattaactcgcgctgcagcggcgcagaggaccccgctcccctgagctccgcgagccccaccagctgggggcgatcgcagggacccagcgacgggaggggaaatgtgttcggggagaagtcaaaagccccagaccgacgcgggcggggggcgggtgcaaataaggacaggaaagggaagctctggaggaaaggggtgggatccaccgagcttcgtttcacagatccgttccctggattgccactgcgagtgatgtggcacacggagtcatcctaaccaacccgttggggccctttgaacaaaggactgcctttactcctgacttttctgacaagggacaacggttcctgcgcagatctgcagtttctaaagttgatcgcgcgattggatttgctc

SEQ ID NO: 93940 - DNA, 130 bp, Homo sapiens
  chr5:398801-398931
  hypo
tccgttttaagctgccgacactgggaggaggcattgccgttgtcaccgatgggcttctgtgagaagggctgggctggcagggccttctgccgccaggcctgggtcctgcgggctccggaggccgtgagtg

SEQ ID NO: 93941 - DNA, 32 bp, Homo sapiens
  chr5:400157-400189
  hyper
cgcccggtgcccgctcgcgtgactagccgccg

SEQ ID NO: 93942 - DNA, 28 bp, Homo sapiens
  chr5:40066927-40066955
  hypo
ggtccgggagtctggcggcagggatggc

SEQ ID NO: 93943 - DNA, 18 bp, Homo sapiens
  chr5:40294097-40294115
  hypo
gcccggcctatttttctc

SEQ ID NO: 93944 - DNA, 93 bp, Homo sapiens
  chr5:40680534-40680627
  hyper
ctgaccctgggggctcgtgaggctgccaccgctgctgccgctacaggtgagatggcgttgggctgacgttggggtcaacgggtagagaacgca

SEQ ID NO: 93945 - DNA, 265 bp, Homo sapiens
  chr5:40680963-40681228
  hyper
cagtgtatcgtttctcgggcgcgggtctaacaccttacaagtggtaatttccgctcacggcagctttgtctctcttctaccatccccagacccagccttgcactccaaggctgcgcaccgccagccactatcatgtccactcccggggtcaattcgtccgcctccttgagccccgaccggctgaacagcccagtgaccatcccggcggtgatgttcatcttcggggtggtgggcaacctggtggccatcgtggtgctgtgcaagt

SEQ ID NO: 93946 - DNA, 579 bp, Homo sapiens; identical to SEQ ID NO: 29544
  chr5:40681261-40681840
  hyper

SEQ ID NO: 93947 - DNA, 25 bp, Homo sapiens
  chr5:40682069-40682094
  hyper
gcctttaggtcggggctgggattcc

SEQ ID NO: 93948 - DNA, 194 bp, Homo sapiens
  chr5:4083866-4084060
  hypo
ccattcctcctctcacgctttcccggggtagacaccttgaacgccaacaagcgattgtcacctggaggctgagtgtggcaccctgacaggctttttctggggtcctgaacacctggaaggcacaagtccctctgcagtggaggtgccattaggtgggtacagtgagagtcagggagaaacgccctgcaggctga

SEQ ID NO: 93949 - DNA, 25 bp, Homo sapiens
  chr5:40861757-40861782
  hypo
agagagaattcttggcggggcgcgg

SEQ ID NO: 93950 - DNA, 22 bp, Homo sapiens
  chr5:41041433-41041455
  hypo
aatacacatcttcagcggggtg

SEQ ID NO: 93951 - DNA, 30 bp, Homo sapiens
  chr5:411982-412012
  hypo
ccccagcttctacctcgtgtgggatgtgag

SEQ ID NO: 93952 - DNA, 217 bp, Homo sapiens; identical to SEQ ID NO: 40479
  chr5:4144299-4144516
  hypo

SEQ ID NO: 93953 - DNA, 30 bp, Homo sapiens
  chr5:4145036-4145066
  hypo
atgcagagtgctgaccgcacagcttactac

SEQ ID NO: 93954 - DNA, 34 bp, Homo sapiens; identical to SEQ ID NO: 29546
  chr5:41510835-41510869
  hyper

SEQ ID NO: 93955 - DNA, 49 bp, Homo sapiens
  chr5:41587836-41587885
  hypo
acctccccagtgctgcggtcttggtccccgaacacggacaaaggcccct

SEQ ID NO: 93956 - DNA, 30 bp, Homo sapiens
  chr5:41746611-41746641
  hypo
atgcacagagcatagcgataaacacacaac

SEQ ID NO: 93957 - DNA, 22 bp, Homo sapiens
  chr5:41777225-41777247
  hypo
ttacaaaaaaggggccgggtgc

SEQ ID NO: 93958 - DNA, 196 bp, Homo sapiens
  chr5:42123791-42123987
  hypo
gctttctcagatcagcgggcatatactacataataagaatttgtgttaatgcggtctggtaaatatatcacaactggcatagcaactgcagttggggctacagttggttaaactccagtagtcctttgttacgttttgatctatagaatttttgcaggaactacactggtgaagtaagtgacggaaatgatgggga

SEQ ID NO: 93959 - DNA, 30 bp, Homo sapiens
  chr5:423138-423168
  hypo
ccctgtcctctgattcggctgccacagctc

SEQ ID NO: 93960 - DNA, 75 bp, Homo sapiens
  chr5:42423455-42423530
  hyper
tgctttcatttggaacgggcaggcggagaggaaggaagtgtattgcaactaccaatattttcctctaggaggagc

SEQ ID NO: 93961 - DNA, 162 bp, Homo sapiens
  chr5:42423809-42423971
  hyper
ccaagcctgacagcccgcgagctgccaagcagggcgcagccatgggaagaggaggagggctagggagcggcggcggcggcggcagcggcagcagcagctgctacagtggcggtggcggcggcggctgctgctgagcccgggcggcggcggggaccccgggct

SEQ ID NO: 93962 - DNA, 544 bp, Homo sapiens
  chr5:42424615-42425159
  hyper
cgcgtttgtgcgggccgcagccgcacgttggcaccgatggaactggggtcagtagagtgacagccaccagtccgcatgaactggggtaagtggaaattgtggcgagccgacctcccccagcttttgacacactagtggttgtaaaatcaaccaggcttaaagttttgacagaactgccagaggctgcgggtcaatggggtggccgcgtgtctagggagagggcgctggcggcgcagagggtgcggggcagggcacttgcgagtgcgtggggaagtctatttggggcgagtgctttatatatagcccgaggggatgcctgctgagaccgagctgcgggggctctcggtctggcgcggactgtgtgtcctgaatgagtgtacgtgtgcgctgtgtgtgcgcgcgcgagtgtgcgcctggggaggcgtgtcggcgcctgagccagtagggtgtgcagggtggaagaggccacagaggtgccgcctgtctgtttgtgccgccaggagaccttggaagggacagagaaaggtaacggaaggccaaagtg

SEQ ID NO: 93963 - DNA, 30 bp, Homo sapiens
  chr5:427604-427634
  hypo
agttcgtgccacctgcgcatggggtggcac

SEQ ID NO: 93964 - DNA, 34 bp, Homo sapiens; identical to SEQ ID NO: 40480
  chr5:4278472-4278506
  hypo

SEQ ID NO: 93965 - DNA, 31 bp, Homo sapiens; identical to SEQ ID NO: 40481
  chr5:4279105-4279136
  hypo

SEQ ID NO: 93966 - DNA, 33 bp, Homo sapiens
  chr5:427958-427991
  hypo
gacagaagaagaaggcgccgtcaggagccatgc

SEQ ID NO: 93967 - DNA, 43 bp, Homo sapiens
  chr5:42915864-42915907
  hypo
aggttgaagtacacacgcccagggcacccgctgcagcccaggc

SEQ ID NO: 93968 - DNA, 88 bp, Homo sapiens; identical to SEQ ID NO: 29550
  chr5:42950080-42950168
  hyper

SEQ ID NO: 93969 - DNA, 30 bp, Homo sapiens
  chr5:42950529-42950559
  hyper
ggtaggaaaaaaagtcgctttcggcgggac

SEQ ID NO: 93970 - DNA, 467 bp, Homo sapiens
  chr5:42950845-42951312
  hyper
gaggcagggctaacccggggttgttaggattagaattccgaggctacaggaaacccggaattgctgagatgtgagtcacagggtgactcagcctcgttacgatgaaacagtaacttcctactacctagaaatcgcagccagggccagaccggtgtttgtcctaagtcggaacttgattgggctgagaaatcacattgtgactattccacgacttgaacaaggggtagaaatcgcaggcaccgcgaaatagaaacttcctaggaccaagaagccaacgacgcccgaaaccgtggggtcctgtcacagaaaccccagcagcgcagccaccggactgggttctggaggccgagccgcagtccgtgcggcggcgctgggaagagaaggcgccccggcagctcccctgccaccggccccgaggagcggctggctcccccagcccagcgccgccgccgcccggtaactccagg

SEQ ID NO: 93971 - DNA, 693 bp, Homo sapiens; identical to SEQ ID NO: 433
  chr5:42951419-42952112
  hyper

SEQ ID NO: 93972 - DNA, 126 bp, Homo sapiens
  chr5:429675-429801
  hypo
cacccgacttgtcctcggcccctcggcgctgcaggcccaggccctggtaaccaagtgcagctcagccttgccgcgcgatcctgcagccgccactgggcagcccgctttgttcgtggcctccccact

SEQ ID NO: 93973 - DNA, 457 bp, Homo sapiens; identical to SEQ ID NO: 434
  chr5:42991785-42992242
  hyper

SEQ ID NO: 93974 - DNA, 180 bp, Homo sapiens; identical to SEQ ID NO: 435
  chr5:42992375-42992555
  hyper

SEQ ID NO: 93975 - DNA, 42 bp, Homo sapiens; identical to SEQ ID NO: 436
  chr5:42992556-42992598
  hyper

SEQ ID NO: 93976 - DNA, 285 bp, Homo sapiens
  chr5:42992782-42993067
  hyper
cgctgggctaggggagcccgccgctcctccaagccggtgacaggggagctgcccgggcgccgtctcttcccagcgccgccgcagaacccgcagaacagctcgacctccagaaccctgtgctgtggcggcggggctggcgtgtctgtcgcaggaccccgcagattcgtctgtcgttggcttgttggtcctaacaagtttcgatttcagggtgcctgcgtttctttttcttttctcttcttttccttttgttttgttttgagacagagtctcgccgtgtcgcccagc

SEQ ID NO: 93977 - DNA, 240 bp, Homo sapiens
  chr5:42993307-42993547
  hyper
ctgcgcccagccggtgactacgatttctatcccctggttcaagtcggggaatagccaaaatgtgatttctcaacccaagcaagtacccacttaggacaaacaccagcctagccctggcggcgatttctaggtcgtaggaagtcgatgtttcgccacagaaaggctgagtgaccctgtgactcatttcccagcaactccgggtttcctgtagcctaatcataacaaacgcagagttagccc

SEQ ID NO: 93978 - DNA, 1136 bp, Homo sapiens
  chr5:42993847-42994983
  hyper
ccaaagcctcaagtttctaagtcgtggcaagttccggcttcctactagtacggcttgctttagctgcgcaggagatgttcaactcctgtagaaatctgtgtaccagcgaatgcgattcatttaggtttagcgatgaccagtttagcagtgcctgggagctcttacaccaaggctagctgcgcaacatcaagtcccgccttagctatgttggtgttttttaaactcccatggaagtcaggaaatgccggcaaaagcgatttctggtttacgaagctcggtttgacgatagcaatttccgccgaacgcgactttttcctcttgtggaccaagtcgggatatatcagctactacgattttttagtcgtaaacaggtttaaccatgactgggttttgttggtttcttgttgttgttgttgtttgtttttgtttttgtcctaagaaatgtagacttaggtgtaacatgtaccggtttagatctaacagggatatcctaatcacagaattgcttcttttggcaatacttgtaatttctgctttgtagggttggttctctctaatttttgcttatttttaaatgctctttttgtgtcttttgctctgagaacaatgctaccggtagtttccagtgtgtttgctttgcctttttatttgaattttagaatttattattttaaaattttatcttatttaaatgttattcatttttcttctactaattttgagtatcacagcttcgtactccttgacttgcattctctcaggagctggggagccaagctcggtctccgcttcggtggtttcaggtcccgggttctgtctggcggctctgcttctaatgcggagctggcggttttgcagcaacgcttttgccagtagcgcccactgagcggtttttcagttgctgcaccgttcttagcgcccaacggaacgtttcccgtacgcggagtccataagttgtctgtgtcgtcactttctcggttctggcaccgctagtatctcctaggaacttcctaaacccgttttacggtgcagaacggtaattgcaccgagcctctgtgccaactagtacttccgtaataccgttagccggctcttttcctgtcacaacacattaaaacgtgttaaaacacattaaa

SEQ ID NO: 93979 - DNA, 356 bp, Homo sapiens
  chr5:42995072-42995428
  hyper
cgggatggaagcacccctcctaagaatccgcagtttctttctagcagcaccgttatggcgcctaaacggatatttgtttggcaataccagcgctatccgctaggtgccggcgcttgctgagtctcagcgccgccagattcttgctagcgaggtccagagcagtgcagagacctagcggacagttttccggtggcagcaatgctcatttcccggacacagatggtttttggcccctgaagaactctttaatccctgcgttttgtagcgctcgttctctgtaaggtttgcttagtatccgtttcatttcgacttcttttctcgctgtttttctgtcggaattacgatttgttttgttt

SEQ ID NO: 93980 - DNA, 331 bp, Homo sapiens
  chr5:430042-430373
  hypo
ctgtttgccttgccccgggttacggtttccagatatgtcctgattccgatgctcctcctctgtgcatggacagccccggggatgttcacagcagatggagctgtgcagaccggagcagacgtccccgccctgttctgggcgctgcctttactgctgtacctgctgtggcaggcgcgttggggtgatcttaagttgcagtcacgtgtgttgccttgtggtccgactttgaattctagctgcattccttaacttccattagtattcaatttcattttttagatgcggtcttgactgaccttgtcagagtccaggctcccgaactagtttgaga

SEQ ID NO: 93981 - DNA, 679 bp, Homo sapiens; identical to SEQ ID NO: 7809
  chr5:43007818-43008497
  hyper

SEQ ID NO: 93982 - DNA, 199 bp, Homo sapiens; identical to SEQ ID NO: 7810
  chr5:43008737-43008936
  hyper

SEQ ID NO: 93983 - DNA, 30 bp, Homo sapiens
  chr5:43017284-43017314
  hyper
aggaggtgtatgtctcgctgtcaattctac

SEQ ID NO: 93984 - DNA, 476 bp, Homo sapiens
  chr5:43017701-43018177
  hyper
agctctctcccaggacgagccacatccgccccattcacggtccttattccagctcctttccctctgcgaatcacactgggtgggtcgctgggggcctcggtaattacggattatggcacagccaagaaaaatacaggttttcttaagcctgaagccactgacttgaggggggagagtaggagtaatgccagcagcagttttgtatttggtttttgtttttatattctagtctctaggccacaagacaatgttgcacccagtgccagtcgatccgtcacggcgccgcaaactttccctgaacggagggtttgtggctgacatctctagtttctcagagcctgggagtgatcactggctgcaccgctgatggcgcccaaaagaacgcgcatttgtctttggcaacagcgctgggtttcgcctcgtgcccgcgcctgaagggtcctagcgccgccagattctcacactcgcgggtccag

SEQ ID NO: 93985 - DNA, 378 bp, Homo sapiens
  chr5:43018326-43018704
  hyper
cgtcctccagtgccggggtcatggtcgcagcacccggcgttcccgttggctcttttgccgctgcgcggagccggcggtttttctgtcacagcacttgtacggagtttctcggcggccgaacgtctctttttttctcagagacgacggtttcttggtgacagtaccgttggttgcgccgtaacgaatgttctccttgacagccccaccagctggcgtcactcgcaggctccagacgccgccatttcgccaagccgaggtctcttggttgcggcactgcttctggctcggtgcctgtattttctcggtgcctacagcgcccaggtcgccgatctgagggcttcggagtaccggccgggcgcggtggctcacgcctgtaat

SEQ ID NO: 93986 - DNA, 343 bp, Homo sapiens
  chr5:43019004-43019347
  hyper
ccgcgaatgcgattttttttaggtttaccgatgatcagtttagcagtgcctgggagctcttataccaagtttgttttcgcaatattgagtcccaccttagctaagcttgtgtgtattttaaactcccatggaagtcaggaaatgtccgcaaacgcgatttctggttaccaagctccgtttggcaatagcaagtcctgccgaacgcgactttttcctcttgtggaccaagtctgaatagaccagctactgcgatttttaagtcgtagtaaaaaaggtttaaccgtgactgcttttttttgttggtgttgtttgtttttgtttttgttttcgtaggaaatgtaga

SEQ ID NO: 93987 - DNA, 237 bp, Homo sapiens; identical to SEQ ID NO: 29565
  chr5:43019650-43019887
  hyper

SEQ ID NO: 93988 - DNA, 30 bp, Homo sapiens
  chr5:43023202-43023232
  hypo
aggcttgagccactgcgccaggcctctctc

SEQ ID NO: 93989 - DNA, 198 bp, Homo sapiens
  chr5:43040830-43041028
  hyper
ttgtgacagaaaaagcgccggctaatggtaccacacaattactagtgcgaacagcggctcggtgcaatcaccgttctgcacggcaaaacggggttcaggaagttcctaggagatactagcggttgtaggagcgaaaaagtgacagcactgagaacctaaggaccccgcgaacgggaaatgtcacgttgggtgcagcaa

SEQ ID NO: 93990 - DNA, 32 bp, Homo sapiens; identical to SEQ ID NO: 29567
  chr5:43043256-43043288
  hyper

SEQ ID NO: 93991 - DNA, 25 bp, Homo sapiens
  chr5:43105351-43105376
  hypo
agcaagactccgtcccccccaaaaa

SEQ ID NO: 93992 - DNA, 132 bp, Homo sapiens
  chr5:43173337-43173469
  hypo
aaaagaaaaagtaaacgtttaaaattatttgctcttaggatttttcttaatttgccaacgtatcttttttcccctctaataggtgaaaaaccttttgaatgtccaaattgtcatgaacgatttgctagaaat

SEQ ID NO: 93993 - DNA, 1354 bp, Homo sapiens
  chr5:43191786-43193140
  hyper
tggcaccaggggaaccgatgtatgccaggaatccagacagagggtgacattagcacttctttctgcagaacctaaaccctgcccgactcacccggaggagctgtcacggtggtttgctggaaaccccctttctgttgggaggattactgggtcacggtttcccaaggacatggaaacccttgctgaagcgctggaaccgctcggcacgaggcgtacgtcggtgggagctgtgtcagcccgctttcggccgtgtagctgctcccatccagactctagaaggggtcctctttgcgtcaggcccaatcacccccctccccgagcgactgcactgggtgtccctgcgccgcgcgtcccctccctctcgcccctccctcctggctgccatagaaaccagcttacaaggtccaggccggcgtccgggtgcactacaggccccccgtccctccttccccacgccagcccctcgctccggattggtccttcaggaaacgctgtggggcgtctcggtccccgctgcggagccggcctaggccggagggcggggtttgccctgggccgctgccggtcaggtcggccgcccctgacagctccgggagcctcaagcgcgacagcggcgccctcacctcgggacatccacacaccgaccgctcctgctccagaggcaacaacccagcgcgcctagcctggcgccgtgcagcgaagcccaagagctggcctcgccacgaaggtaagcgaggggctgggggactcgccgccagcacccccaccccgccacccttcctctgctaggctgcagacctgggtggctgaggaggaggcgcctctcctccccgcgacccaaggaagaaaggaagccctgccacggggtgtctgcgaagtggggtcagaagaaggttaggcgctttctggggcgtacccccacacctgcccaggccgatccgcaagcgagaggagggggcattagagccagggcgagagcgtgctcgcgcgtgtgtgcccgtgtcatgtgtggtgcccgtgtcatgtgcggcgcccatgtctatgtgcgcgcgtgtgtgcacccatgtctctgtatggtgtggacactcgtgtctgcgtgcgcgtccacacgtgagccgaggagcgcagcttagcgcctagcgttgcgcacagcgggtgcgctggaccagagccctaaggcaccagaccaaatctggagcgtttgttacaagggcagaagaccggcgtgatctccccacgcgcgccggccggtgctgctggtggagagaactgacatctaacgcatgtggcccaggagaacaaaaccttccattgcaccccacgccgcgactctccccagcgaaaggtgcttctt

SEQ ID NO: 93994 - DNA, 24 bp, Homo sapiens
  chr5:43215538-43215562
  hypo
ctttttttcttttttcgagatgga

SEQ ID NO: 93995 - DNA, 30 bp, Homo sapiens
  chr5:43233280-43233310
  hypo
ctgcttcacggctgccgaggcgatggtgga

SEQ ID NO: 93996 - DNA, 302 bp, Homo sapiens
  chr5:43396928-43397230
  hyper
actggtatctgtagtcgtggctgccgtggaccaggagagactgaagtggaaaacagcgggcggtagccgaagcagagagcaaggaagagcgcgggaagtgcagagcgacagcaacaagaaaggggtggcgcgggacgtcgtttacctgggcgacgtccagccgcccttcccgcctctgcgcgtacgcaacctgcttggcgccactgacctggtgaggaggcttctttaaggccgtggacggttcctacccgcgcgcggagaggaccgacgtgaagaagctgccaaagtataacaagtactac

SEQ ID NO: 93997 - DNA, 176 bp, Homo sapiens
  chr5:43397305-43397481
  hyper
gcacgcctggacccgggggagccggctggggcgcccaggaccaggcctagcctaccgcgggctgcccttcacagagctgcaggagaaaacgttgtattgtgcacgcattccctaacccttactagtttttttttttttaattgatcggccagcttttgatgcgggtatgttaaaat

SEQ ID NO: 93998 - DNA, 42 bp, Homo sapiens
  chr5:43402630-43402672
  hypo
aaaattggtgtgtgccggttccaagatggccgaataggaaca

SEQ ID NO: 93999 - DNA, 96 bp, Homo sapiens
  chr5:435478-435574
  hypo
gtagaggccagcacacggcaaattagaaatacaacacgcggagaaaggggtccgtgagcccactcatagaggaatctagaacgttccaggcagcag

SEQ ID NO: 94000 - DNA, 197 bp, Homo sapiens
  chr5:43740546-43740743
  hypo
agtttcaacaattgtcgacaattatcaattttaagtaacgtcttcctcaatcccttgacttggttctctttcccccaacaattttatctatgaattagtcatttatagataaaacaatattattttatctgtaaatacttcagtaggtattgctaacagataagggctgaaaaacataaccacgatactattgttat

SEQ ID NO: 94001 - DNA, 837 bp, Homo sapiens
  chr5:44388215-44389052
  hyper
aaggggtgggtagagcggcaaggggtgggggatgtgaagggagcgcgcttaggggaggggatgcggcagcacaatgtatacacgggggttggggggtgaattagtgtgaaagtattccacttaatcattttacaggggttggggacgtaaatatttagctggccacatctggaacagatttttcccccccgtgtgggctgggggtggataattggaaggaggggagcatgcatttgttacttactgtacgggcagttctccttcttggtcccgctgaccttcccgttcttctcaatcttgagaaagtacttggtgaaagagaatagctttctccagcggacatctccttgaaggtgattgtagctccgcacatgccttcccgcgctggaaggagaggagaaggaggaggaagaagagttggtggcctctggtgacaccatgtcctgaccaagggcttggcaggtgacagggacggaagacaccaagaacagcaacaaaaagcagcagcagcagcagccgggcaggtggggaaaggctgaggcacaatgtgtcagtatccatttccacattgtactgaaactctcggcactggaaattgtctcatcagaaggaacatactggaagggtaagacccgatgcaaggcaaggagagagctcgaggtggtggctgctggttagctccctctgggcgcggatctggccagaagtgaatgcaccaacatccataactcctcggaaaagccggctgactcccctcgctcctttctcggatccgctgcctacgcctctggagcctcccggtaaatggtggacgtgggtggccgcagcagcaggagc

SEQ ID NO: 94002 - DNA, 174 bp, Homo sapiens; identical to SEQ ID NO: 29574
  chr5:44389326-44389500
  hyper

SEQ ID NO: 94003 - DNA, 601 bp, Homo sapiens
  chr5:44389793-44390394
  hyper
tagctctgtctaattcgctgctaaagcgtcctatgcttgcagcgcgggccacggcgctgacggtatcttcccgctttccgaattttgctgtcttccagcctgaaccaatcccttctggggagcccctttctcacttgctttccagcgtaggatctcctccccccacccccatttcttttggcagtgaagtacttgagagccacctggagcctggtgcttggctgacttttcctcccttctcactcccagaagaggagagggctgggagaaagcagaagatgctgaggattttaaaccgtccaaagcagcaggttataaactggtcagaacgagcacagaaaaggaagacataattagtgtcctttcctcctctgctgccagcttccaaggaggtctcctctttaatgaatcactgatttctcgcttccgttgctgaagtaaaaagttcacactttggccctctctgccttttaagctcagggagatttatcgtcacccttaaaagttgcctctctcggcgcaaatgaaatcagggacccaaataaccgatttctaattgctaacatgagcccttcactgaatcatgcgtgcacttcaaagc

SEQ ID NO: 94004 - DNA, 162 bp, Homo sapiens
  chr5:44492868-44493030
  hypo
tgacacacccctgttcgctgaagctgtaggcagtgggaatgaacgagagctgtaatacttcctgggttctcagatcttgggactccccaagcagaagctgtaacacctcttggggtctgcggttgctggtgtctccaagttttcaggcgccaccacatcccc

SEQ ID NO: 94005 - DNA, 43 bp, Homo sapiens; identical to SEQ ID NO: 40542
  chr5:44637083-44637126
  hypo

SEQ ID NO: 94006 - DNA, 21 bp, Homo sapiens
  chr5:44939696-44939717
  hypo
gaaggtggtgctgggcgcggt

SEQ ID NO: 94007 - DNA, 24 bp, Homo sapiens
  chr5:45225641-45225665
  hypo
aggggcccttcatcccgccactgg

SEQ ID NO: 94008 - DNA, 97 bp, Homo sapiens; identical to SEQ ID NO: 29576
  chr5:45695143-45695240
  hyper

SEQ ID NO: 94009 - DNA, 295 bp, Homo sapiens; identical to SEQ ID NO: 7824
  chr5:45695313-45695608
  hyper

SEQ ID NO: 94010 - DNA, 38 bp, Homo sapiens
  chr5:45695648-45695686
  hyper
cgccggcagcgccaccccccgcccgccctcctagtccc

SEQ ID NO: 94011 - DNA, 58 bp, Homo sapiens
  chr5:45695906-45695964
  hyper
gcctctgcatgaagccgtactgccgccggggcccctcggcgtcttcgaagccccccgc

SEQ ID NO: 94012 - DNA, 156 bp, Homo sapiens
  chr5:45696299-45696455
  hyper
agcccagctgcccgtcgcggcggcggcggcggcggcggcggctgctgcttcccgaccgcgccgctgctagctgcgcgcctggctcccgccgccgccgctgcccttagtggctgcggtccgggctccggtgcggctggtgctgaagctgaggctgcc

SEQ ID NO: 94013 - DNA, 9 bp, Homo sapiens
  chr5:45696456-45696465
  hyper
gagctaggc

SEQ ID NO: 94014 - DNA, 92 bp, Homo sapiens
  chr5:45696466-45696558
  hyper
aggctcagctcggctcagccctcgcgccccagcgcctcccctcggctgccctctgttggccagaaagggtctctccccgtccgctctccaca

SEQ ID NO: 94015 - DNA, 215 bp, Homo sapiens
  chr5:4581114-4581329
  hypo
caggcacatgctcagcgacactcttgcacacagaaacacacgtggacagacacacgcacagcgacactcttggagagcacatacacatggacaggcacacgcacagtgacactcttgcacacacacacacgtggacagacacacgcacagcgacatcttgcacacgcggacacacacgtggacaggcacacacacagcgacgctcttggagagca

SEQ ID NO: 94016 - DNA, 35 bp, Homo sapiens; identical to SEQ ID NO: 40483
  chr5:4629575-4629610
  hypo

SEQ ID NO: 94017 - DNA, 226 bp, Homo sapiens
  chr5:4629982-4630208
  hypo
ttatttgcaatagagcgtttttgaaaattaaaacaacattataagcggtgagaaatgtcagaaaagcctgtttccaatggcatgctagagccagcttgtaccagtgaggtggttgttaaacacagccatcgctgatattttaattatgtgcatttaaaattaaatatattctattatagaaaaaacggataaatctgagtgtatatcactgcggaattacttgagt

SEQ ID NO: 94018 - DNA, 30 bp, Homo sapiens; identical to SEQ ID NO: 40484
  chr5:4630470-4630500
  hypo

SEQ ID NO: 94019 - DNA, 30 bp, Homo sapiens
  chr5:465822-465852
  hypo
tgccttccagggtttcggggaagacgtgga

SEQ ID NO: 94020 - DNA, 30 bp, Homo sapiens
  chr5:475028-475058
  hyper
gccgctcctcggggccgtctgcctgcagga

SEQ ID NO: 94021 - DNA, 54 bp, Homo sapiens
  chr5:478158-478212
  hypo
cgggtgtggagggaacgtcagctcactgcactcagacctcgccaggtgggcacc

SEQ ID NO: 94022 - DNA, 298 bp, Homo sapiens
  chr5:479376-479674
  hypo
catagtgggcaggtgcgggagccagggcggcagtggcctcggggctgggtggggcgcctggcctctggtctctggagcagtcaggggctctgcagacgctgagaggcctgctcatagtggactgggagatgctggagcagcctcagagccatggccggcccacagcgggagacggccctgctgctgcccctctgcctgtgcgtgtgcacctgtgggcacctgcgtgtgctggggcaggcagggctgtattgggaccaggtcccgtaacagcctgcctgcttaccgtctgctcccatcc

SEQ ID NO: 94023 - DNA, 39 bp, Homo sapiens
  chr5:480581-480620
  hypo
ggacatgggtgcagccgccagagccgccctccagggcac

SEQ ID NO: 94024 - DNA, 164 bp, Homo sapiens; identical to SEQ ID NO: 14710
  chr5:480880-481044
  hypo

SEQ ID NO: 94025 - DNA, 38 bp, Homo sapiens
  chr5:484540-484578
  hypo
tccccctggctggctcgccctgccggacccaggagggt

SEQ ID NO: 94026 - DNA, 36 bp, Homo sapiens
  chr5:4866865-4866901
  hypo
tctacttcattgtgacgaggtcgaggctgtaagggg

SEQ ID NO: 94027 - DNA, 30 bp, Homo sapiens; identical to SEQ ID NO: 40486
  chr5:4867541-4867571
  hypo

SEQ ID NO: 94028 - DNA, 46 bp, Homo sapiens
  chr5:487718-487764
  hypo
ggtactttgtcatggcggccctggcagattacgtggttcctatggg

SEQ ID NO: 94029 - DNA, 30 bp, Homo sapiens
  chr5:4879422-4879452
  hypo
tgagggtgacagggccggctgggagggtga

SEQ ID NO: 94030 - DNA, 58 bp, Homo sapiens
  chr5:488495-488553
  hypo
ggacctcctcaaacacggccaggacggccaccgggtccacagccgccatgaggctgcc

SEQ ID NO: 94031 - DNA, 146 bp, Homo sapiens; identical to SEQ ID NO: 40391
  chr5:488846-488992
  hypo

SEQ ID NO: 94032 - DNA, 64 bp, Homo sapiens
  chr5:490702-490766
  hypo
actccatcccacactcgacacagctgggaggaagctgggatctcatgggcgaggggccatctgg

SEQ ID NO: 94033 - DNA, 948 bp, Homo sapiens
  chr5:491223-492171
  hypo
ggtgccggaggcctgcgctcagccgtggggcccagctggtcaaagctaggctctgcctgaggtccctggacccacctggtcaaagctgtagcatccccggcagcagcggcgggcatcagggctgcaccgcacctggcatgttgagaggcgccagccacgcgtggtctgggtccggggcgggaggcagtgcccgagagatgaagcatccaagaccaaaaccgcgcagcagttctggctccggctgtggctgcagcggtggccgagcggctccggcacacaggctgggagggacggtgcccgatacaccaggctctgcagtcctcctcctctccctgggacctggtggccggcgagtgtggacggacccctacctctgcccagtgccggaggaagagcggcagcccctggccacctgcagcccccaagccgagctgccgagatgggaactcctccccaagcagaacacgtgctgggacctggggacgcgcaggggactggccttggtcacgagggcctacggggctgccagccacgtttctcacctgacacttaccgcctggaggccagggtgcggcaccccgacctttctgagatgaggcagcgccgcccctcccggaccccaccctgatcccggccggggcaacagtggcgcagactcacccatgagcccactgaggaagacgccgtagagggacagcccggtggtggccgcgttccacacggtacccacgacggcgtacaacaggatggtccccaggttgccgaagaagaggcggttgggcatgaagtagccggcgtccagcacgatggggggcagcaggtagaagaagaagacggtgggcgtcagtgtgaaggacgcgatgtggtcggccgcccagacgatgccgcccagcaccaggcccagcacgatgagcagggcgctctcgggaaccacgctggtgaccttgt

SEQ ID NO: 94034 - DNA, 386 bp, Homo sapiens; identical to SEQ ID NO: 7826
  chr5:49736592-49736978
  hyper

SEQ ID NO: 94035 - DNA, 201 bp, Homo sapiens; identical to SEQ ID NO: 29584
  chr5:49737098-49737299
  hyper

SEQ ID NO: 94036 - DNA, 30 bp, Homo sapiens
  chr5:500270-500300
  hypo
gaagagaatagaactcgccccatggcacac

SEQ ID NO: 94037 - DNA, 30 bp, Homo sapiens
  chr5:500505-500535
  hypo
gggggtggcaggagacggggacgggaccct

SEQ ID NO: 94038 - DNA, 30 bp, Homo sapiens
  chr5:50217968-50217998
  hypo
catcccctctcagctcgtgcacaccagagg

SEQ ID NO: 94039 - DNA, 311 bp, Homo sapiens
  chr5:50262925-50263236
  hyper
cttggggactgagggcgtggtgggcagacagctgttgaatccaaacaaagactattctggatctgacgccgtttcggtttccatctgggagtacttttcatttccttcttcccattccaaaggaaagaaatggattaggaatggggcagtcagaattatgtgtttatggcggacagatggaacaggagaggatgaaccttcagcaacaaaaggatcattgagatttggttcctgggtgtgcaaatttggaaacaaaataaccaaggaagctatgggaataccaagactctagctatcgacaatgttgactc

SEQ ID NO: 94040 - DNA, 231 bp, Homo sapiens
  chr5:50263484-50263715
  hyper
cctcgccccaattaacgccctacagccagtcagccttacacctgctggaaaaatcttggtggcagtggtgggaggtggtggttttggtttttagcagagcgcgggagcaccctgtcacaccctcctgagaccgccctaggaccgtcctctggaatatcttggagccaggagccagggaggctttcctcagtcccagtcgttgcctgtcgccgctttcggtttctcttccct

SEQ ID NO: 94041 - DNA, 986 bp, Homo sapiens
  chr5:50264180-50265166
  hyper
ttgcttatctgtattcgaggggttagtctccatcctaggattgtccctttcaaaaaaaattttttggatgcatctgttttcactttgcactttcaacgggctggagcagacaatagtgtgaaaaacatctgaaaatatgaggcgacagagctgcatgtgtgtttcatttctgcggtgttaggggagaaaataacaaaagaaacacacactacaacacacacgcacgcacgcacacacacacaccggcccaggacctcagcacaaagggcgcgctgacccagcgctaacacacaagacaaattaaagaaaggggcaaatcggaggaggggctaaggcgagggtccaggcatttcgggaaaagatcaaggacaaggagagttaagaaactgaccgtgggccagggaagaccggagagagagaaagtaaagtgtccaggactggaactcacgtccctgaggcaggggacagtaagtttgcttgtaacacagacagttttccttgactgcaggaaacaagaaaaatagtaatcataaaacaagcacaaatcccccaaacatcaggggggtaaaacccccattattagccatcacaaaccaaaacccaaaccgagtcttttctgctgaattgctgcaagatcacaagagaccaagagatccggagtcaggctgtgaacttgggaaagataagttgcccggcgaggttggaggtagactgaggaacgcctttttttgtgaaggacacaaatatttgcagagtttaaagctgcaggaatacaaaagcaggagtgagattatctgattacggatacaggatgtccgagttgttgcctcccaaaaacgactgcgtaaaaaaaaataaataaaaggccagttcgaaaagtgaaattttaatatcagtgaaagcatcggagggactcggattgaacgcggcagctccggaactggacaacagctgcgtggtgcagccaatcccggggcctgtgggaa

SEQ ID NO: 94042 - DNA, 482 bp, Homo sapiens; identical to SEQ ID NO: 29589
  chr5:50265190-50265672
  hyper

SEQ ID NO: 94043 - DNA, 160 bp, Homo sapiens; identical to SEQ ID NO: 7831
  chr5:50265720-50265880
  hyper

SEQ ID NO: 94044 - DNA, 30 bp, Homo sapiens
  chr5:5049628-5049658
  hypo
tctgttttttgttgtcgttgttgctgttgt

SEQ ID NO: 94045 - DNA, 36 bp, Homo sapiens
  chr5:50674152-50674188
  hyper
ctttaaaagttgccccgtccacgcaccattcagctt

SEQ ID NO: 94046 - DNA, 30 bp, Homo sapiens
  chr5:50674452-50674482
  hyper
tcgcctcccctcccccgctcgtccccagta

SEQ ID NO: 94047 - DNA, 353 bp, Homo sapiens
  chr5:50674730-50675083
  hyper
gactgcaaccacttccgcgagaatctgatacatttaatgaaagctttgccaaatgtacgggtcagcgcgtccttgggccaccaccacttgggtcagcacactgcactcactagcgccaacctgggctccacgcagcagaactcggttaaaaatcgtctgttcctggtcacttaggagttctagggggcagggggaagcaagaaaaaggtttcacttgacactgccagccgcttttgataagtcatagtaaatactttcagaagcacaattttaaagggagaatacaaatttccgtcctcgcttggccgaacgcctccctgcaatcaactgcggaccttcgcatgctcaggact

SEQ ID NO: 94048 - DNA, 146 bp, Homo sapiens
  chr5:506753-506899
  hypo
ttcctatgataatctcgacttttctgggcagttgtaaagactgaaaatcagactccttcagagagagtgggttgactttgttctcaaacccaaggaaaacgaaggataaaacgtgttatttattatccttgttttaaagttattgg

SEQ ID NO: 94049 - DNA, 70 bp, Homo sapiens
  chr5:50677690-50677760
  hyper
tcaggaggaaacttacgcatctttgattccctttccgctttggagaggcattacccgttcaagcccagcc

SEQ ID NO: 94050 - DNA, 77 bp, Homo sapiens
  chr5:50678114-50678191
  hyper
attaacgcctggggacgtgaaataggtctttcactgttctgtaataaatccctccctactcgcgcccttagactaat

SEQ ID NO: 94051 - DNA, 30 bp, Homo sapiens
  chr5:50678447-50678477
  hyper
ccgcggagtcaacttcggtttaccggtgcg

SEQ ID NO: 94052 - DNA, 30 bp, Homo sapiens
  chr5:50679546-50679576
  hyper
ttaccttgtggggctcggtgtgctgttctt

SEQ ID NO: 94053 - DNA, 518 bp, Homo sapiens
  chr5:50683061-50683579
  hyper
tcatcggaaaggaaacgggagtaaaagaaagggaggagggagggaggggaaaagagagatgggggaaggaagagagacagggaaggagagagcagggtttcatttctgtccttctgtttccaacttctgtttggaaatgctgtttacttggggcgtcttgcccgggatcttgggccagggaagtgccggcctgaagtgaccccctcttcctgtacttctctccccgctctgggccgcctccgctcccccctcccccgcacaggttgtacgggatcaaatgcgccaagtgcagcatcggcttcagcaagaacgacttcgtgatgcgtgcccgctccaaggtgtatcacatcgagtgtttccgctgtgtggcctgcagccgccagctcatccctggggacgaatttgcgcttcgggaggacggtctcttctgccgagcagaccacgatgtggtggagagggccagtctaggcgctggcgacccgctcagtcccctgcatccagcgcggccactgcaaatg

SEQ ID NO: 94054 - DNA, 143 bp, Homo sapiens; identical to SEQ ID NO: 29594
  chr5:50685653-50685796
  hyper

SEQ ID NO: 94055 - DNA, 237 bp, Homo sapiens
  chr5:50685846-50686083
  hyper
cgcacggttttcaatcctgctcctgggcaggagtttggccggggctgcccctcatccttacccccctacccatgccccgggggacaggctacccggcgccggccgccagctgagggcggggaagctgggaggctccgtgcgccgggggagcagcatccaggtcccaacctcgtgggtgggctcatgcccttccacctcgcctgtacctgtgaaccggagaaacgccgtcctcccctc

SEQ ID NO: 94056 - DNA, 524 bp, Homo sapiens
  chr5:50694717-50695241
  hyper
ttctacccccaggtgcgttgcccacgtccagcgggcagggcagcgcagcgcctgtctgcactcaggttaggggtgggaagtgctgggaatgggggacccggacactggtctaaccagccccgccactcccgcgggcaagtcagcccttgatcctttaaagcagggacaatcgacgtggtccgagagaggaaaataagggtatttctgggcccttctctttcaggagttgatcaggttggcagatctggagggctaatccaaacaaggcgcttgacttgtgaggtcgcgagtctagacagagctggtggctcggcggctccttatctttccctggaatcagccgaagaggcgctccccggcccactccgctcggctcgcccgggtccggagccaccgctcgacgcagacggcacaacaaacagcacctgaggctttatagctcgctttattgtttaatggagaatgcggcataacattcatttgtcttcttggttccgcgacctggccgctttgcagccacagac

SEQ ID NO: 94057 - DNA, 113 bp, Homo sapiens; identical to SEQ ID NO: 29598
  chr5:50695350-50695463
  hyper

SEQ ID NO: 94058 - DNA, 11 bp, Homo sapiens
  chr5:5139610-5139621
  hyper
gacccccgtgg

SEQ ID NO: 94059 - DNA, 247 bp, Homo sapiens; identical to SEQ ID NO: 7729
  chr5:5139753-5140000
  hyper

SEQ ID NO: 94060 - DNA, 425 bp, Homo sapiens; identical to SEQ ID NO: 29447
  chr5:5140031-5140456
  hyper

SEQ ID NO: 94061 - DNA, 231 bp, Homo sapiens; identical to SEQ ID NO: 7732
  chr5:5140527-5140758
  hyper

SEQ ID NO: 94062 - DNA, 135 bp, Homo sapiens
  chr5:5140849-5140984
  hyper
cggagcggccgggctggatggaaaagggcggtaagtccgtgaggtgggggcttctaatccttgccatttagcagctcgtaatctccgtgccgctggtttattaggtgctgtgaatgttcacgactctgtggaacc

SEQ ID NO: 94063 - DNA, 197 bp, Homo sapiens; identical to SEQ ID NO: 40393
  chr5:516758-516955
  hypo

SEQ ID NO: 94064 - DNA, 30 bp, Homo sapiens
  chr5:51759873-51759903
  hypo
gacatgtgccgtccacgaaaaggttttttt

SEQ ID NO: 94065 - DNA, 30 bp, Homo sapiens; identical to SEQ ID NO: 40394
  chr5:519988-520018
  hypo

SEQ ID NO: 94066 - DNA, 292 bp, Homo sapiens
  chr5:52285516-52285808
  hyper
aaagagatacttcttcgttcccttcctgctatcccaggccttgcgtccccattaggcgcgtctcgccctgtctgttaagcaccctccaaagtcatctcagtgagtgctttgttttaggtacacacacgcacacacacacacacacacacagacagacacgcacgcactcaagcatggacagtgtggggatccgcgggtgtcctggagaccgcgagtcctgcagcccaacttcccctggctcagacaggtgccgcgcctgccagagaccagggaaatccggaatccattgctg

SEQ ID NO: 94067 - DNA, 25 bp, Homo sapiens
  chr5:523778-523803
  hyper
ctgctgggtttcatgcgggtagcac

SEQ ID NO: 94068 - DNA, 1024 bp, Homo sapiens
  chr5:523856-524880
  hyper
cgtttctctaaaaagcctgagaaccccgaaggaaacccggccccggggactccctgggcgcgagcagcctgcagtctgcggggctcggagcggaggcggggcggagaccccacagggacccgggagccgggagtccggggctccgaggctgtgcccccgccggggaggggagacctcgggacccgcaggggcggcttagcgcggccagagtcgctcccgagtctcgctctgctggacccgagagccggactctcccgggcggccgccgcgcggctccgacctgatgcgcgcggccacaacgaagcccccaggcccagcagaggcggccgcacaccccgcgggcagatccggagaccccggggccacttaccgatcttggccaagctggccacgaggatccagagcgcgatgacgtagggatcctgcacgtgggcccactcgaaggtgaccacctggaagcccccgctctcgccgtgcgcgccgccgggctccacctcgacgcccccggcccgcgccagcccgcccagcgccagcgccagcagcagcccccggtcggggccccgggccccgagtccccacattgccgcctgctcagcgcagggctgggacgcgcatgtcgcggggggtcccggctgggctgggccgacgcgcggggctgggacccggcgaggacccggcgcgctccggtgccggtaccggctacagtccgatccccgcccgccggggtggcctttaatcccgcggccccctcccgccccggggcggagcctgcccgcccccgccgcgcactcgcgagcgcagacaccgccgcagctcccggcacgcccgccccgcccgcgcacgcccaccccgcgctccctggtgcccaccctcccccggagcccgcggcctggaggtccgggaggtcgcggcaagagcgagcccgggactgcgcggccgccttcctggggcgtggggagcacagcgcggggcagcgggacaggcggttccgcgcagctcctgggatgcccgggcagctgtgggt

SEQ ID NO: 94069 - DNA, 30 bp, Homo sapiens
  chr5:52775107-52775137
  hyper
aatcccagtgacctgcgaatgtccaagaat

SEQ ID NO: 94070 - DNA, 531 bp, Homo sapiens
  chr5:52775392-52775923
  hyper
caatcttttttattccgcgaaaagagagaagacgagacagaaagagagagagattggagccgaggagactgagagacagacagaggcacacaggacagaaactggggagtctccaggcgggagaggaagggggggccagaccgcctacgtcggcgcccccgctccgggctccgactccagacgccgcgaagtgaaaggggagaaaagaaagggagagggcgaggctgtgccgcggggagaccgggcctgaggtgttaaacatttttgtttgcttccgactagtccagacgaagggccgcgtctcggtagcgctctgccagggtggaaggtgccggggccggggttcctagcaacacctctgggctgggggtggctgcaaagtcaggcactcacagacccagacacaaaacctcgcgggtcccgcgcccaggctgcgggtgcccggaaccgccgcgaggccggcgcgctccgacccgacccggggcgggatatttgggcagcccggggctcttcggccgtttgcaaaagtct

SEQ ID NO: 94071 - DNA, 390 bp, Homo sapiens
  chr5:52776428-52776818
  hyper
tttaaagcgcggctgcgcccggcttctgacgtccattgaatcgcgcgggcggccggcggcgagcgcggggctgcgccgggatcgctgcgccctccgccgctggcctctgcgacgcgcgccgctcgcccgagccacccgccgccgcgccggctccccgcgccgctgcgctcctcgccccgcgcctgcccccaggatggtccgcgcgaggcaccagccgggtgggctttgcctcctgctgctgctgctctgccagttcatggaggaccgcagtgcccagggtaagcgagtggggatgcgctggggaggcttggctgaggacaggggggtcgacttttctgtggtctccacttggtctgttctgagcaacgctgctctcggaagatgttgaac

SEQ ID NO: 94072 - DNA, 139 bp, Homo sapiens
  chr5:52778602-52778741
  hyper
ccccctccccatccccgccgggtctccttcgctagccacctcgctctccctgccctgccaccgctcactgctcactcacccacctccccacccttgtctcttcacagctgggaactgctggctccgtcaagcgaagaac

SEQ ID NO: 94073 - DNA, 41 bp, Homo sapiens
  chr5:52888050-52888091
  hypo
ggattacaggtgtgagccgctgcgcccggcattgttgagtt

SEQ ID NO: 94074 - DNA, 178 bp, Homo sapiens; identical to SEQ ID NO: 40487
  chr5:5296474-5296652
  hypo

SEQ ID NO: 94075 - DNA, 30 bp, Homo sapiens; identical to SEQ ID NO: 40488
  chr5:5303702-5303732
  hypo

SEQ ID NO: 94076 - DNA, 40 bp, Homo sapiens
  chr5:53147-53187
  hyper
aggtcagaacttgttcgggaccgccgggtggagacaagga

SEQ ID NO: 94077 - DNA, 30 bp, Homo sapiens
  chr5:5320109-5320139
  hypo
ttctattatagcagacgtcagccacacagc

SEQ ID NO: 94078 - DNA, 23 bp, Homo sapiens
  chr5:53300030-53300053
  hypo
ttaaatattctcggccgggtgtg

SEQ ID NO: 94079 - DNA, 399 bp, Homo sapiens
  chr5:53500-53899
  hyper
cgagtccccttctcaggcaggctgtgggggttggggttgggcttcgcgagcccaagcggacgccgcaaagagaatgagaacctcggagcgctcggggcgggcgggcccagcccaggctcttcctacccctgcgggggtccgagggccagcggcatcggcggcgggaggagggggcgggggcggggaattagggggaggcgggtgttaaagaggagaagggcgggggcggagggggaggaggagacggggcggggaggacccccaggtttccgagtctccgcccgggctttcgttcccggctgtgtggccccgcgcggttcccgagcagctccaggaactgaaacgtgaaggggacctcggtgcccggagctgctgcccaggtaaccgcgctgcgcccgg

SEQ ID NO: 94080 - DNA, 30 bp, Homo sapiens
  chr5:53674661-53674691
  hypo
acctgggtgctgctgcggggtccccatgga

SEQ ID NO: 94081 - DNA, 88 bp, Homo sapiens
  chr5:537288-537376
  hypo
gcttttctccctgagcgttgtgtgttagcgattctgtgagtctgacgctgcacaggtgggcgatgctttgctccggccggctcacctc

SEQ ID NO: 94082 - DNA, 193 bp, Homo sapiens
  chr5:537854-538047
  hypo
tggcctcgctgtggacgttctcaccgagtggcagccgtgtctgcattggcccgagggcctgggggaatcccgttcccacactggttggctgtgctgcctctagggagtcacttggcctctctgtgcccagcgttctcatctgtcaggtgggggtcacaccatgccagcccactgctgccggggaggtccctgg

SEQ ID NO: 94083 - DNA, 370 bp, Homo sapiens
  chr5:538581-538951
  hypo
cgggatgggggaccccggaaccccactggccttgggcagccatcttgggggtttcaggagatgcacagaggacagcggctggggatgctcagctctgtcccatcacctgtgcctgcctgacgatgccgcctcagccgcccagggctccctcagggaaaacgtcgccaagcaccgacggctcaagggagtaaccgcgcctctgggagatggcgtccctgacttggctgtggcaccaggctggccaggggactgttggaacatttgcggaggagcacagttgccatttccttcatgccacacctgccccagcttgtgtctgtgtgtgatggcacggtttgggctggcaggaggggcacgggtgcttgggtgt

SEQ ID NO: 94084 - DNA, 95 bp, Homo sapiens
  chr5:54002-54097
  hyper
cgccggaaccggggaggaggctggggaagagaaaggggcagaggggcgggcccgggggccggggccgagggggcggagcgcgaagtttccagagg

SEQ ID NO: 94085 - DNA, 30 bp, Homo sapiens
  chr5:54042403-54042433
  hypo
cttctgttttctaaccgagaagaatgactt

SEQ ID NO: 94086 - DNA, 4 bp, Homo sapiens
  chr5:54179554-54179558
  hyper
cctc

SEQ ID NO: 94087 - DNA, 536 bp, Homo sapiens
  chr5:54179609-54180145
  hyper
cgcaccgaccgggagatggaagtttttcgcggcggcgccccagccacttcgcagggccgagcggtctcctccaccggccgcccggctcaggaatgccctgcctgcgagtcaaagtcggggtcgcggcggggcgaacctggcccagcattgcctggggccctcaggagcgccgagggggtctccctgccagcgccctcctccccgctcgcccaccctctccaagcgggctccgcgcggccggggatgggacgaggaggggaagtttggggcgcgtacctcctagcgccccgcagaaccccaggcaggcagccagtaggacgaggcggcgggccccgaaccgccccatcccgccgcggcggccccgcgtcccgcgctcactccccagcggcggccgagctacctgcgccgccgcgacccggagcccggcaagggggcgccgccccccaacatctcgggggcagggccggggcggggagagccatttgcatcctgaagctgttgcgccccttcagcgcaaggagcgggctgggccttta

SEQ ID NO: 94088 - DNA, 166 bp, Homo sapiens
  chr5:54332-54498
  hyper
cgaacaaccaaaaaccgccccagccccccaaaccccaattgccttattctgtttccacttgctttagcccccacgctcctgtgtgcgagaggggcctggtcagactgcagaccccacccaggaggaggaagaggaaggggccgccgtggcccgggcacccccaggg

SEQ ID NO: 94089 - DNA, 336 bp, Homo sapiens
  chr5:54472206-54472542
  hyper
tattcaactaatttccgagcagtgcaaaccggagagctccccattcccagcgccaacggcaggtttgcgcgcccctccggcccgcggttactccccgccctgctccaggctggtgcctcgccctcagcccgctcgcgcctggctacgcccgcgcccgcgcccgctcccgcccctagcttctgcgcgccgccctgcagcccctgcgcgcgcctactgggccaaagggacggttgggagtttgctccaactgtccctggggcacgccttccccgcccagcaggggttggggaacgcgagctgggagtgtgagggaaagcgccacgccagtgggggctg

SEQ ID NO: 94090 - DNA, 347 bp, Homo sapiens; identical to SEQ ID NO: 441
  chr5:54516334-54516681
  hyper

SEQ ID NO: 94091 - DNA, 343 bp, Homo sapiens
  chr5:54516831-54517174
  hyper
cgccccacttacatccagcaccgaggccaggtgccgggttcggctggcgagttccttcagctgcacgttccgctccttgagcgaggcgatctcctcctgtttctgggtcaatgtcacgtgcagctgcaggaggagacccaaacattcaggggtaggtactgtgctgggtctcgtctgcatatctggcatgaatcaaacccagatcctgacgtctcatcaggaactggggacgcacaggcatttacgctagtgagaataataatcaatttactttttttttaaaacaaagcacttggacaaaatttatctccattaatcctcggtgtagcgtgctgataaagag

SEQ ID NO: 94092 - DNA, 156 bp, Homo sapiens; identical to SEQ ID NO: 443
  chr5:54519133-54519289
  hyper

SEQ ID NO: 94093 - DNA, 259 bp, Homo sapiens
  chr5:54519382-54519641
  hyper
cgactcaccagcgaccggccaccgagccgccgctgtaggagctgagagcacgtcttgaacaccggatctttccacccaagacccgacagcgtgcaggggcctcgagcagtaatttgaggccgcgtttcccgccaaggtttggccccagctaaccgccccacccatgcaaccgagcgggaagaaagctgtgattcgaggggccaggagaatacgggaaaagcttctgttctgcgcacagccagtgcggcctccattgctc

SEQ ID NO: 94094 - DNA, 216 bp, Homo sapiens
  chr5:54523786-54524002
  hyper
tccactttctgaaaacgccacagtggaaagtaccgaatccccgaaaaccctgttcctgtctttcctagtggcctcagcggcccatcgccacgtttggctggtctcttcgcagtcgtagttgccattcccaagccaacacctctccaaggaatgggcattttcctgagtccgaggcatctcctagggaggggcatccttaggcgagggacctttctc

SEQ ID NO: 94095 - DNA, 314 bp, Homo sapiens; identical to SEQ ID NO: 7839
  chr5:54527322-54527636
  hyper

SEQ ID NO: 94096 - DNA, 41 bp, Homo sapiens
  chr5:54528342-54528383
  hyper
ctgagcagcttacagcgggattccgccgtcacctgccggga

SEQ ID NO: 94097 - DNA, 46 bp, Homo sapiens
  chr5:55309312-55309358
  hypo
tgtgacctgggaatgcggttgttgttagcagcggcaacaactggta

SEQ ID NO: 94098 - DNA, 272 bp, Homo sapiens
  chr5:554299-554571
  hypo
ggcaaggaaaataaacgagccgttacctttcaccaaatcgcactgtattttattcatttagggtgtacacacctatctgctcttcaaaggaattttgggcagattgtaaaattacgctcaacatacagcaaggcgactataaatacaaaagcagcactgaggtgctggtgctgcgggtgggtcacgggataaaccaggcgtggggtctgggtcacgggatgacccgagggtgggtcacgggataaaccaggggtggggtctgggtcacagga

SEQ ID NO: 94099 - DNA, 120 bp, Homo sapiens
  chr5:554631-554751
  hypo
gggggcgggtcacaggatgaaccgtgggcgggtcatgggataaaccagggtggggtctgggtcacaggatgacccgggggtgggtcacgggataaaccaggggtggggggtgggtcacgg

SEQ ID NO: 94100 - DNA, 120 bp, Homo sapiens
  chr5:554811-554931
  hypo
gggtctgggtcacgggatgaacggggttgggggctgggtcacgggatgaaccggggggtgggtcacgggatgaacggggggggggtgggtcacgggctaaaccggggttgggggtgggtc

SEQ ID NO: 94101 - DNA, 151 bp, Homo sapiens
  chr5:555171-555322
  hypo
cacgggatgaaccggggtgaggggtgggtcaccggatgaacgggggtgggtcatgggatgaaccaggggtttccgaggtcgcaggcggcttccttgccccgtgacctggctggggctgcttaacttatgagcagttcggcttcctcgcggg

SEQ ID NO: 94102 - DNA, 789 bp, Homo sapiens
  chr5:555668-556457
  hypo
gtccctcgagccctccgcataaacctctgtgccctggaacccgacggggacacaagcgggaagttgacagccatgccctctggaacctttagaaaagaaaccggcccagtgcaaggtcgttcaatgcagagcctctcctgagcacaaacaaaatccagatgagtgtccgcacggggccgtgcggaggtcacgggagctgcagtgtgggccgtggatggctccctcccgtaccaaaggccggcgtgaagacaagaacacaggcaggcagacggcagtgaaaagcagccagaaatggaggagcttcagagaggccgaagtctgaaacagcccgaaatggagggggttcagagggcccgaagcgggacgcacctgctccctcccggggtgccggggctgtcagggaggggtgggccgagaagtgtggatgggtacatggagggtcccgggccctcggggtctggctggtagcactgggaggaggtgaaaagcaaggcttgtgagggctcagctcccagagttgcaactctgcggactgcagcggggccttggctccacctgcgcttctggtctcggctgccctgacagccactgggctccaggcaggcctgggtggtgaggacggcgctgggctgcggccaccagatccatggcttccctggacaatgacgggtcagccagacgctctagctgagtcagggcctaggaaacccccgctcccccgccccatacatgtgagtctcccaaggggagagcctaaggaatgctgagacgcagcgggtgggggagcgg

SEQ ID NO: 94103 - DNA, 185 bp, Homo sapiens
  chr5:5571260-5571445
  hypo
actcactgtgggacccggggaagttccacaaaccctctggggcctcagtctcctcatccataaagtggggacacttagaacagcacctgactcccacgtggatgggagcagctaggccctgatgcccagagagcccaggaccgggaagcaggatgtgtgccggctcttcccggtggggcatccga

SEQ ID NO: 94104 - DNA, 199 bp, Homo sapiens
  chr5:5577412-5577611
  hypo
gcctctatcctggagcgtgaatgaaaatagactgcgtgtctgttcacatattgatctgggtttatatcttccatctacagccatgctgaggcaagggctgtcttcaaacaaaggcgttgatagacctccatggggaggtcctttgaacaagctgacggatcttccaaatgagtgtgtttgcacgcggtattgatgaagg

SEQ ID NO: 94105 - DNA, 167 bp, Homo sapiens
  chr5:55776589-55776756
  hyper
aatggcctatttatccggctcttacgcacggccggcagccccggctgggaatcacgggggtggcagccgtccccggaaaacggcggcattccgacacaggaaagcccgcggatcaactgatctgcagacaacgcttcttccttcctgggaagcggccacaaaggcag

SEQ ID NO: 94106 - DNA, 30 bp, Homo sapiens
  chr5:55777140-55777170
  hyper
aaacacagacatgtgcgtcaccccgggaag

SEQ ID NO: 94107 - DNA, 30 bp, Homo sapiens
  chr5:559409-559439
  hypo
acagcttatgttttgcgaggaaattgttcg

SEQ ID NO: 94108 - DNA, 39 bp, Homo sapiens
  chr5:56346672-56346711
  hypo
attacaggcatgagccaccgcgcccggcctggggtgtta

SEQ ID NO: 94109 - DNA, 30 bp, Homo sapiens; identical to SEQ ID NO: 40491
  chr5:5652506-5652536
  hypo

SEQ ID NO: 94110 - DNA, 211 bp, Homo sapiens; identical to SEQ ID NO: 40492
  chr5:5719870-5720081
  hypo

SEQ ID NO: 94111 - DNA, 876 bp, Homo sapiens
  chr5:57877797-57878673
  hyper
ggtgcttttgggttccggtgatgaatgtgttcattttatgtggcttgctctgggtaaataacccagtgccctatcagctctgcagcccgcggccagcggcagtgtgtgcgcgctaatgacggcggaaggtgcctgggggagggcctggggaggggctggccagcgctatcgcgcccctggcacttcctaagagactgagccctttctctgcagctgcagcttggattccacgctttccctccagaggaaagaagccctccatctaaatcagctgtcttctccacatccctcctttttctctccgccagacgccacccctaccccttctattgtgttgtgccttttcattttagccccgcttcctacgtagagccctaacctcctttgtagcgagggcacttgagaatttctgaacctcgagttgtaatggagctgtatggaaaggtaagcaggcgaaaggagttccttggggtgcttagccagaaatctcgctttcacgcacttcggtgtgcgggttgtgtgtgtgactatgtacgcgcgcgcgacttctcagtgcaattatgcggataaaccactttccttatgtgtgtaccgttaatcgtctttctcccctacgtttggtgaatgagattgtaaaactgccccactctgcctaaggaaacgtagaaactttcccgattcggatggggaggggtagggcggagagtcccagagaccagctctggcttcgtttgcattggaaattagcacaaggtagtgttgtttcctaatcagaaaatcaccatctacttccgaaggcgatagttagcaaagaaaaatctccagctgagataagctggggtcacattcgcctgcccctggcgaggaaaagagcag

SEQ ID NO: 94112 - DNA, 43 bp, Homo sapiens
  chr5:57878910-57878953
  hyper
gttggagccggttagcgaaccccaagagtgcagagtgtggagc

SEQ ID NO: 94113 - DNA, 236 bp, Homo sapiens; identical to SEQ ID NO: 29611
  chr5:57878954-57879190
  hyper

SEQ ID NO: 94114 - DNA, 71 bp, Homo sapiens
  chr5:583170-583241
  hypo
cctgtgactggggatcgctctgccatcggcacaggtgtctctggccgcgggcagcccgcctgtttggggtc

SEQ ID NO: 94115 - DNA, 339 bp, Homo sapiens
  chr5:58335014-58335353
  hyper
cttggcgtctcgggtcggcctccagggagggcgtgcaaagagcggcgagccaactttcacacagcgacgcgagcggaaaaaccactatgcgacttttcaactgtgcggcgggcccgagtcccagtccaggagcccggctctagcggatggcgagggggtggcgagcgcgcttgggtgcccgccccgcagaggagcgtctggtccacagccggatctcctcggtccccaacccggagccgcggccccacgcccgccccgcctgccgagccttctgcacggcacttgaagtgaatgaatcagccgcggccgggtgcgcggccaccacgtttcctgttttct

SEQ ID NO: 94116 - DNA, 318 bp, Homo sapiens
  chr5:58335563-58335881
  hyper
gcagtgccatccccccggcgcagccgggcgccactcgctttgaagtgcagacgaggaggcgcgggcgcgagcgtgtgtgtctgtggggctgctgtgggactgtctgtgctaggagagcggcggaaaacccggcgtggagcgcctgcagtccgccgtccggggtcgcgcccgccgcggggctcaggagggaccggcacgcaggcgcgcacggccgcgcacctgtctcgctagaaccccgcgcgccccgccgagccactgccctccaggttgcccagaccgctggagcctctgcgactccacgaccggctgcttcctgcg

SEQ ID NO: 94117 - DNA, 30 bp, Homo sapiens
  chr5:5880192-5880222
  hypo
agactggagagttgacgtgggacatgaata

SEQ ID NO: 94118 - DNA, 46 bp, Homo sapiens
  chr5:5886643-5886689
  hypo
agcctgccgtggacacgtgaactgggccaggcggccacgaggccga

SEQ ID NO: 94119 - DNA, 19 bp, Homo sapiens
  chr5:5887137-5887156
  hyper
acagacccaggcatccggc

SEQ ID NO: 94120 - DNA, 15 bp, Homo sapiens
  chr5:5887231-5887246
  hyper
cggtgacacctgcca

SEQ ID NO: 94121 - DNA, 173 bp, Homo sapiens
  chr5:5890841-5891014
  hypo
aatgccccaaccctgcgttgaccttctcccctccctctcccaattcctgttcccttcttcatgcttcctcgactcagctcccaaattagccatttacccccaaaatctgatctcaagatctacttctgagagaacccaaattaagacagatgcttaaccggaaaagggaaata

SEQ ID NO: 94122 - DNA, 50 bp, Homo sapiens
  chr5:59064594-59064644
  hyper
aaggagggaaagcaccgcgctcgcacggctttgtccgtgctacaaagcag

SEQ ID NO: 94123 - DNA, 88 bp, Homo sapiens
  chr5:5907706-5907794
  hypo
taaaatttattttcacgtgtcatagacctccttctacattgtcactattttcatttaaagaatcaataaggcagccgggtgcggtggc

SEQ ID NO: 94124 - DNA, 72 bp, Homo sapiens
  chr5:59188376-59188448
  hyper
tctccaagtcacccacgtgttctccccttttgctattcaatttacttctccacctgacgaagagaaatgcga

SEQ ID NO: 94125 - DNA, 154 bp, Homo sapiens
  chr5:59188904-59189058
  hyper
ttggtggtgataagccgacttagatggagtatttgagaaaaggggaggtgaccctttgcctgaatgggggagggggcgctctccactcaccgcctgagtccctggaacgaggagggccaggacatcctggatttcttcaggccgggccggtggc

SEQ ID NO: 94126 - DNA, 319 bp, Homo sapiens
  chr5:59189188-59189507
  hyper
cggcggcgggggcggcggcagggggggcggcggcggcggctgtagcggacactggggctggggctggggcgagggtggcggcggcgggggcaggtggtgatggggatgcaggaggcggaactggggctgccggagcgggtactggtggtgctgctcgtgcctccagagatgcttgggggctttgagcgtggccccgccggcgctgtcgctgccctctccgctgcccgcccgggccggcgcgctgctgccctctgcctccatcctggctcgcggctccgcgacctgctgcccagcccgggttcaccgcgctggcccgagc

SEQ ID NO: 94127 - DNA, 375 bp, Homo sapiens
  chr5:59189708-59190083
  hyper
accaagactagggtgcgcggtgcccggtttcgccagaggttggtccttcttcctccctttcttcttcccttcctttgggcgccggcggcgagagcagggattgtcagcaactcgggctgcagaagcagcagcaacggcggcggcggcagtggtagccgcctccagggcaccggaaccctgatcccggagctgctgaaaagttggacagctccaggctggcacgcccgagctgtgactttcaccaaaaccactccagccagtcaggagtcagacctgtcctcttgatccttcccctcgccgtgcccgcgcctccctcctccacactgctccccactgccccggagccttcctcttcacctccgcttgcctcagtgc

SEQ ID NO: 94128 - DNA, 30 bp, Homo sapiens; identical to SEQ ID NO: 40403
  chr5:595300-595330
  hypo

SEQ ID NO: 94129 - DNA, 85 bp, Homo sapiens
  chr5:601137-601222
  hypo
gaccagcagctgggacgggaccagcagtgcatgcggctctggattcatgtttgttgaatgactgactgaacggaggctcccttac

SEQ ID NO: 94130 - DNA, 30 bp, Homo sapiens
  chr5:60139344-60139374
  hyper
caccaagacaggatgcggctcggggagccg

SEQ ID NO: 94131 - DNA, 30 bp, Homo sapiens
  chr5:60182155-60182185
  hypo
ctgatttatgttctacgaaaggcactgtca

SEQ ID NO: 94132 - DNA, 58 bp, Homo sapiens
  chr5:602421-602479
  hypo
cccccagtctgtggccgccgcagggcctcctcctggaccagcccgaagggcacatggg

SEQ ID NO: 94133 - DNA, 30 bp, Homo sapiens
  chr5:6029681-6029711
  hypo
attggccaaaggctccgtaaacagatcctt

SEQ ID NO: 94134 - DNA, 30 bp, Homo sapiens
  chr5:6080787-6080817
  hypo
aggttttcctagaagcgccaggagcaggct

SEQ ID NO: 94135 - DNA, 37 bp, Homo sapiens
  chr5:62077372-62077409
  hypo
tacaggcgtgagccaccgcgcccggcctgatgtaagt

SEQ ID NO: 94136 - DNA, 256 bp, Homo sapiens
  chr5:6219037-6219293
  hypo
caggcaagctccacacgtcccactgccgctgtggttgagccagccttggctgtgtgatgcctgcaagccattcctggtagcacagagggaaataatgccgaggcaaagaacaagtcagctctgacaccaaggagacggatgataaattgaaatgatgaatttctaatgccggcacaaaatcaggtaggagggatcattcgtcaaatttccagcacaacatacaatggaaaggtttttggttcgatagggaaataga

SEQ ID NO: 94137 - DNA, 30 bp, Homo sapiens
  chr5:6228545-6228575
  hypo
caccgcggtccctcccgcagctccagccat

SEQ ID NO: 94138 - DNA, 30 bp, Homo sapiens
  chr5:6264312-6264342
  hypo
aacacaggaggtttgcgagactcagctgaa

SEQ ID NO: 94139 - DNA, 340 bp, Homo sapiens
  chr5:63254903-63255243
  hyper
gcgagtgttgggacacgctaaacagaattattccccgatccaaaaaggacaagagcgtgaattaggaggaaaaattctacatcgtaaggataaaattgctctttcaggttttactgggggagccagctggagccttgggcacgcgcgccctggggaacctttcctctttgccgcccctgcgtgtcgcccctttaaagccttcttggtctctccaatcccaagagttccgcggcatcttgcgccactggctaaggcaaaaacctcaggtgtctacccgcgcttcagggcgccccagagcgtaggcggaggaacccagatcctgtaagtcagcagccgggag

SEQ ID NO: 94140 - DNA, 69 bp, Homo sapiens
  chr5:63257323-63257392
  hyper
taagataattggccacgttctgcagggagcgctccaaggcgatggcagccaccacgcacgcattgccca

SEQ ID NO: 94141 - DNA, 250 bp, Homo sapiens
  chr5:63257611-63257861
  hyper
tcccctggggtcttccgcccttctcctgggaagtttcggaggaagggaatgcagagacccaagcaggaagttcttactgcttcggcgaagggtatctccgaggagcagctttcaggcgctccctgggctctcgcagtccagcgcgttcagaagctccagctgggaaactggagttggcctgaaagcagctccaggatctcccggcggcggagaggtggctggaacgtctgtctgtcgctgtccattttac

SEQ ID NO: 94142 - DNA, 40 bp, Homo sapiens
  chr5:63373761-63373801
  hypo
atagtaatttctggccgggcgagttggctcacgcctgtaa

SEQ ID NO: 94143 - DNA, 764 bp, Homo sapiens
  chr5:63461355-63462119
  hyper
aactccagaaaaggccgagtgaggacaagggagaccacagggataatttctgtggctctggtaaggggatgacaagggagaaaaactttcccacggttccgtctggcccgcggcgcttgtctgcctgcgcggggtcaaagcccggcgccgcccacgcgcggctcgggtgggaacccgcagacgtggggcgagcagggccgctggctgtggcgggcgagcgccggggcgccacgtccgaggccgcggggtcggggctgcaggcacagctcgagcgctttccgcggggtttggctcctgtcgcttcccgtctcgccgaaccggcatcgccgccgccggagccgcagcgagtcctcagagcctggctgctggcggccgggagcgccgggacggggcgcgaagccggaggctccgggacgtggatacaggtaaaggccggcgggtcggagtcgggcggggcgcggcggcggcgcctctcggagggacctggcctcggccgggccctacccagccgcggtggcccgggcccccacgttggcccaggcggggacgtgccaaggggctgggctagggttgccgctggcctggccgcctctcgcccggcgggcctcaggtgacgcggccgcggcttaactttcgcacctgaggctctcggagcggcctcggggcgcgcccacctggaggttggaattacacagggtcgaaaaagctgagtcctggaggcgaggcgctgtaggtgtggcggaggaggccggggaaggtggggt

SEQ ID NO: 94144 - DNA, 468 bp, Homo sapiens
  chr5:63801804-63802272
  hyper
cgaacaacgtcagccggaccgattctctgcgtctgccagtcccgccacagattcatctgggatcttcaaacagacaagcccttagagacgagggatcaaggcagccgattagagccaattgcttgctttggggacggccagtccttccaggcctggcgacagtggagggaggggaaagacgaaccgagtgccgctgcgggaagacactgaagcaagagcgacacccctttccgccccccaccttgcagcgcaggctttgaaagctgctcccccacctgaatggaaactcggaaccgccgggcggcgcgttccttctcgcccagccttgcaatccatgccgagaggaaggcagtgcgagcccgcgccagcgcccagctcccgggacagggtcggcaatgctgctgagcagaacttgatcgcgctccttcctcgctgctagtggaagcgatgctgcacggcacagctagc

SEQ ID NO: 94145 - DNA, 32 bp, Homo sapiens; identical to SEQ ID NO: 2574
  chr5:63802273-63802305
  hyper

SEQ ID NO: 94146 - DNA, 268 bp, Homo sapiens
  chr5:63802339-63802607
  hyper
cgcgcctcaggtccgggctccggctgcttggcggcggcgcccagggcaacaaccgggccgcccgcgccggggcgcactgcaccagcggcttcggcttggtggatgtgtatgcatgagttctgcaccgaatgggcgcaaaaagcgccccagccggtccacccgctcctcgatcttccagatcagcaagcccccgctgcagagcggagattgggagcgcaggggcagcggctccgagagcgcccacaaaacccaacgagccctggacgac

SEQ ID NO: 94147 - DNA, 354 bp, Homo sapiens
  chr5:63986174-63986528
  hyper
aaagtggaggagagtcggcgccgagatgggcggataaaaggagcgaccgctcagcagcgagagggagaggcgagagtaaggcgcccagacaccatgtggacaaggggaggagagaaatcagaggtggcgcgcgaaggctgagcgcccaggcagccagagcccagatcggaagagccgagtccgggcagaggggtccgcgggctctggaggtgctggacgggtgcgatccgagagcagaccggggccctcgcgagcctctcccggcccctgcccgcgatgagcgaggccagccgactgtgctccggctactacagcctcaaccagagcttcgtggagcccttccagtgcccccgg

SEQ ID NO: 94148 - DNA, 415 bp, Homo sapiens
  chr5:63986569-63986984
  hyper
cgacctcaagtactgctgcagcgagccgggcagctacttcccctacaagcacagctacatgtggagcctcaggtgggctgagagcccgcgcgtgcggcggctggccgagcccggggctagggaggcgacaagcggagccacgccagggccagggaggttcccccgcgtccccgctatccgccctaggttaggtccctacggaaggacgcggagcctctgagggcgggtgagggcagggagagaaatctcgccccggctcggagctcccccgggagccaggacaggaggcgaggcgcacgctggaggagcgcgggctttgcgcccagggcgcacttggggcccgcctggctggccccgctgagttccccgcccgcctcccgggagccgactgctctcccctcgccgggaccagtcc

SEQ ID NO: 94149 - DNA, 30 bp, Homo sapiens
  chr5:643539-643569
  hypo
tggtctcagacccagcgatcagctttcacc

SEQ ID NO: 94150 - DNA, 880 bp, Homo sapiens
  chr5:6448738-6449618
  hyper
gcagcagcagcaccccgggggcgcgggcgacgccagcccgggacccggcaagggaaagggcaagcgcgcggcggagctggccccgcgcgacaaggcgccggcggctgcggcggcggcggcggcggctgcggcgggggccgggggcccccgcgagagggcagcgggcgccagggcggggccgggcccggcggtggcggcggcggcgggcggcagcctggtccccgcggcgcgccagcaacactgcacgcaggtgcgcagccggcggctcatgaaggagctgcaggacatcgcgcgccttagcgaccgcttcatctccgtggagctggtggacgagagcctgttcgactggaacgtgaagctgcaccaggtggacaaggactcggtgctgtggcaggacatgaaggagaccaacaccgagttcatcctgctcaacctcaccttccccgacaacttccccttctcgccgcccttcatgcgggtgctcagcccgcgcctggagaacggctacgtgctggacggcggcgccatctgcatggagctgctcacgccgcgcggctggtccagcgcctacaccgtggaggccgtcatgcgccagttcgcagccagcctggtcaagggccaggtaaggcgagcgcgccggggctgggggcgcggggccgagatcgggtctgcagcgccgccgggcgcccgggccccgtggtgagggccagcgccggcccctccggccatctcgctccctgctctgactacaccagcgccccacggggatgctccgagcgcctccacctcttttccctgagcgttttcttcctgcccctgctttccgtcccgtctctcccgtccccgtctggtctcagtctctgcccgtctctctggtatc

SEQ ID NO: 94151 - DNA, 30 bp, Homo sapiens
  chr5:6456111-6456141
  hypo
gatgagacgcagctgcggagggtggtgtga

SEQ ID NO: 94152 - DNA, 30 bp, Homo sapiens
  chr5:64767606-64767636
  hypo
acaaaaacaaaaacacgtcaatgggaatgt

SEQ ID NO: 94153 - DNA, 30 bp, Homo sapiens; identical to SEQ ID NO: 40494
  chr5:6478603-6478633
  hypo

SEQ ID NO: 94154 - DNA, 153 bp, Homo sapiens
  chr5:64860458-64860611
  hypo
taaagcccaaactccctcacatggcatataaagccctttatgatgtgatctctccttaccttcttagtgcatcttccattaccttcctctcccaaccccttactttgtactccacccattctaaaatcactcgagaatcggtcttgtactttt

SEQ ID NO: 94155 - DNA, 32 bp, Homo sapiens; identical to SEQ ID NO: 40549
  chr5:65181746-65181778
  hypo

SEQ ID NO: 94156 - DNA, 60 bp, Homo sapiens
  chr5:65220787-65220847
  hyper
aattattagggccagcgcaattcaacgactgcaccaccaccgaaccgctggggttggaag

SEQ ID NO: 94157 - DNA, 39 bp, Homo sapiens
  chr5:6522524-6522563
  hypo
cttatggcaagataacgaaggggacggcaagggctgctc

SEQ ID NO: 94158 - DNA, 30 bp, Homo sapiens
  chr5:6550961-6550991
  hypo
ttctcaacacccactcgccaaaagtggcca

SEQ ID NO: 94159 - DNA, 30 bp, Homo sapiens
  chr5:6582801-6582831
  hypo
ctggcgctgcctaagcgggtcaggcaagtc

SEQ ID NO: 94160 - DNA, 578 bp, Homo sapiens
  chr5:6583176-6583754
  hyper
cgctgcacaccctcccggcctagggcggcgccggcccgggactcgcgtgtctccccgcggcgccgcgcaggacccgggcctcggagcccggcagcatcccctgctggccgctgggctgaggagccgcgggaggcggggaacgcggggccgcgggggctgggcgggccggagtgcgcggtagagggggcggcgcggccggggtgcgcggtagagggggcggagcggccggggtgcgcggtaaagatggggcggcgcggccggggctcgccagcaccagccctggaaccccatgggggacctcgacaacagcgcctttgcggcgtgggcccctttctgcagctcctccacccgcgcgctgtcggctccgggacactggggctttgaagggcgccagttcccagccgcacctgcacgcctaggagggcgcaggccgcgtgtccctgtgggaggaaggccccggcaacctgcaaagacctcacgtcacagaaacttgcggcgtttgcccccgatgcgcgcgtcaggtgctccgtcccttccaggtggcagaggagagggaagggtcgcgcctggtgggggcc

SEQ ID NO: 94161 - DNA, 175 bp, Homo sapiens
  chr5:6586039-6586214
  hypo
ggctgcggtacacggcgcccatcctgagccccaggttcctcacatgtcaacagcatgaaaagtgcctctaagacatccacaggtgtgcagtgttaaagcaggtgagtgtcctagtgtagacttagcggagtggggctagggctgcgggtagtgggtgttccgcccccggcttgct

SEQ ID NO: 94162 - DNA, 30 bp, Homo sapiens; identical to SEQ ID NO: 29628
  chr5:65891802-65891832
  hyper

SEQ ID NO: 94163 - DNA, 71 bp, Homo sapiens
  chr5:65893398-65893469
  hyper
gagaagaggactccccgcgctccctcggtggcgctggcgtgcgcgcctgcagctcccgttcagacttgttt

SEQ ID NO: 94164 - DNA, 67 bp, Homo sapiens
  chr5:66511784-66511851
  hyper
acctcaaagggtcctcggtgttcaacaacaggaagtgctggcaggcttccctcgctagggaactgaa

SEQ ID NO: 94165 - DNA, 30 bp, Homo sapiens
  chr5:66673601-66673631
  hypo
tctggcaggcagtgccgcctgcgtgcaggg

SEQ ID NO: 94166 - DNA, 321 bp, Homo sapiens; identical to SEQ ID NO: 29452
  chr5:6687127-6687448
  hyper

SEQ ID NO: 94167 - DNA, 112 bp, Homo sapiens
  chr5:675631-675743
  hypo
ggggtgcagtgtggccggggatgccgtgtggccgggggtgcagtgtggctgggggtgcggtgtggccaggggtgcagcatggggggtacagtgtggccgggagtgcagtgcc

SEQ ID NO: 94168 - DNA, 145 bp, Homo sapiens
  chr5:67573236-67573381
  hypo
agtgatttaacacttcgcctcttcaccttttaaatttaataattcttttcctcaagttgacctatccatatcctattccagacctacttttcttagagctgtgtggttgtgtgactcactttcggaacgtcggcctacctagtgg

SEQ ID NO: 94169 - DNA, 496 bp, Homo sapiens
  chr5:67583945-67584441
  hyper
ctgtgcatagtgcctcgcttcactgtcggctacttgagccccgcgagccagccagcgcgctcagcagccagtgagactattttaggtcccctcacaatggccttctcatttcccaggcgaaaatgagcaagttggtcttgcattggccacttgtcagccgatgacaactttgacttgggctcccctccccctcccgaaatccctagctcagcaaatatttgaacctgcccaagttaatcatgaagctgcgatctttatctaagggagacgtgcgagcgcctgggctcctttcctccccgatacagtagcgaaatccagttggcttctcaatgaggagccggcagtgagcggcggtggcccggacgcactgccgggcggggcgtggggcggagggacgagccgagccgagccaagcggagctgggccactgtgcacgcccggagggtcctggcggcgcccccgctcctgcgcgcactctcggcgccggacacgagca

SEQ ID NO: 94170 - DNA, 30 bp, Homo sapiens
  chr5:67591271-67591301
  hypo
gcaaaagaagttgaacgagtggttgggcaa

SEQ ID NO: 94171 - DNA, 158 bp, Homo sapiens
  chr5:676768-676926
  hypo
atcatggtggggtgtcgggacatgaggtgaaatgtgctggggcgtgtgagggtgcctcagtgtgcttcccagcattcatccaggagaaaacagacaatgcgtgacacggcaacagacgtgtgcacacatgacacagaaacgcacgtgcacatgcagaa

SEQ ID NO: 94172 - DNA, 464 bp, Homo sapiens
  chr5:677630-678094
  hypo
ctgccactcaggcctcggcaccgagaagtccggcaatgcccggacccctgctccctgggggcccagatggcacgttcaggctcccatgtcagggctgcttctgagaagggcggggtcttgaagcacaaccccctccactccccatggcccgctccccacagaacccacccaggggctcagggccgcagacccccgtaagtcaggtccctcggcccgtgagcccagcgcactcacttgatcttgctgaagacgatgtccacgtcagtgacggtcacgttcctgccgtcgatcacctggcagtccttgcacagcttcgaccagttcttgccgtgcatctccctcccggtggccctggcgtccccgtgcacggcaaagcgccggaaggcctcctccagggcactgagctcaggggatgcggctgccccctcaccagcaccctccgattccagcgacagcctcttggc

SEQ ID NO: 94173 - DNA, 226 bp, Homo sapiens; identical to SEQ ID NO: 40551
  chr5:67840329-67840555
  hypo

SEQ ID NO: 94174 - DNA, 49 bp, Homo sapiens
  chr5:68370981-68371030
  hypo
gctggcgtcagtgcccgcggtgccttccagcacccgcctgtcctggagg

SEQ ID NO: 94175 - DNA, 17 bp, Homo sapiens
  chr5:68391002-68391019
  hypo
gtaatagcattataacg

SEQ ID NO: 94176 - DNA, 17 bp, Homo sapiens
  chr5:68391319-68391336
  hypo
cccgcccaacataagca

SEQ ID NO: 94177 - DNA, 54 bp, Homo sapiens; identical to SEQ ID NO: 40407
  chr5:684241-684295
  hypo

SEQ ID NO: 94178 - DNA, 78 bp, Homo sapiens
  chr5:68475607-68475685
  hypo
gcccggccctcagtaggcgatttttatatgtggtataaagtagaattcttacagatggatacccgtttatgccagtgc

SEQ ID NO: 94179 - DNA, 70 bp, Homo sapiens
  chr5:6867674-6867744
  hypo
tgcagagaagggagccggggaccccgggcagtgagccgggcagaatcaccgggaacgactgggatggaag

SEQ ID NO: 94180 - DNA, 136 bp, Homo sapiens
  chr5:697176-697312
  hypo
acctgtgtgtgtgcacgtgcctgtgtgtgtttgggctgtgattgcatctggttattctgggggtggaattgctgtggaacatggaattaaagtgcaggttccgggtcttgctgccagggagcgactctggcccccc

SEQ ID NO: 94181 - DNA, 120 bp, Homo sapiens
  chr5:6981335-6981455
  hypo
caacatcaatgccttcgagtttgagttcaggttcttttcagatgcttctcattccgatttcccgaatccccttattgttaccattttctccgcctctccagtgaacgctgttatttttga

SEQ ID NO: 94182 - DNA, 322 bp, Homo sapiens
  chr5:71014657-71014979
  hyper
cttggggttggggtgcgaggcaaggcagggctggcgaggtggatgttgcagctgtcaccactgctaggtgttgggaaacgactctcctgcctgtgcattgacccgaaggcattttccatttcctaggcccctcccgcttcccgtccctcacctctagcccctcggcttcagctcaggcccctcggggagcatcccttgccgtgagactgacagcctttgggggcgcagggtcctgttctctgcgctctagcccatctgtgcgcagagcctcgttcccaggcgcctggaacccggcgggcattgacgtcaagcgccggcggag

SEQ ID NO: 94183 - DNA, 834 bp, Homo sapiens
  chr5:71015031-71015865
  hyper
cgcctcctccctctttcctgcacgggggctcgggctcactataaaaggtgggagcgcgtggtgccccagcaacgacgagtttcagaacgatggagagctcccgcgtgaggctgctgcccctcctgggcgccgccctgctgctgatgctacctctgttgggtacccgtgcccaggaggacgccgagctccagccccgagccctggacatctactctgccgtggatgatgcctcccacgagaaggagctggtcggtattcccctcgctctcgacccccttgagctgtcgccttgtctcttctcttgcacgcctccctcctccccccacccccactcctattcccagagtcagggcgcggggagctgagcgcaacgcccaggcacccactgccatccgaagagcgtctcgagctcacgggctcctggcagtctgttgagcgaatccctcatcccggcccctctgagcaacagggaccccagcggctcagagacccgcggtcagtacctgggacagcgtccgctaagtttccacccctcgaccattccctgtgtccgcggagtcccaccgcagagtgcgtgtgggtccggggctccttataactagggctggaagtgcgcacctgggctgggctcgcagccaaggcggcaacttcaggctccgaagcggtgtgttgcagatcgaagcgctgcaagaagtcttgaagaagctcaagagtaaacgtgttcccatctatgagaagaagtatggccaagtccccatggtaaggtttgtggtcactcccttcccgtgtttttccaagagaaagtacaccgccttgaatcgtacacacagtctt

SEQ ID NO: 94184 - DNA, 1211 bp, Homo sapiens
  chr5:71402862-71404073
  hyper
ggtgtaggttgagagcgtcttcccccttcacggctgcagcaggagctcagcgggcgccccagccccttggctcgcggccctgccccgaccattgtccgcacacctcgtccctccagcttccgggccgcgggcgagatgatttgctgcagatgacatcagccccgggccaacggctggaagagcggaggcagccaccgcgtgaggatgtgccgggtggtcctttcctcctcctcttcctcctcctcccggctccctgcctagtctccatataaaagcggcgccgcctccccgccctctctcactccccgctcctctccgccgcgcactctccgcggcgctgggagagggcggagggggaggcggcgcgcggcgccagaggaggggggacgcagggggcggagcggagacagtaccttcggagataatcctttctcctgccgcagtggagaggagcggccggagcgagacacttcgccgaggcacagcagccggcaggatggcgaccgtggtggtggaagccaccgagccggagccgtccggcagcatcgccaacccggcggcgtccacctcgcctagcctgtcgcaccgcttccttgacagcaagttctacttgctggtggtcgtcggcgagatcgtgaccgaggagcacctgcggcgtgccatcggcaacatcgagctcggtaagtggccccgcgcccccagagacgcgcgctgggagacgcgcaaacacgaccccacccagggcgcgacggtcactgcgctcctcccgcgcgccccgcacccatgcctctcctcgtcacctctcatacttggtccagaccctttctgggctaattaagaataatccgaattattagatatgagacccagagggagagtctccaataaccttgagggatctgtcaccacgctgagtccgcagcctgtgctgagttggccaccgcctctcccgctaagtgaaatgcaggtgtcaggggagcagaggccacaataaagccgcaaccgcaggaggcagaagggtgggggagacctgatgcaaccactcctttcagtcctcttctggcctcaggaaaaggctgggacccccaccaccgcagacctggggccgaagcccatgtgccagggcccgcgtgggattcatcctcaccacggctacctcagcccctgagaaacgccttttctgatttcaaacctcccgatcctttctttcc

SEQ ID NO: 94185 - DNA, 350 bp, Homo sapiens
  chr5:71404392-71404742
  hyper
gccggggaccctgggcggggccgtgagggtccggcgggcacagcctcgggcgcacagagagaccgcccccagccccacccgagctgccgcagtgcctccggaccgcccgccacacctgcccccccacactgcggcgcccccgtcgggcacggctggctgggcttgcgctccgcccgggcctcgggctggcgggggccgcgcgcccccacctctcagtttgcctggctttgttgccctgggagtccctgggtgggcagctctggtctctgcctttccctttatccctggcgtcccggccctcccctcgctcctgacagaggtcgccgggtccctccgcagccccagcccgc

SEQ ID NO: 94186 - DNA, 138 bp, Homo sapiens
  chr5:71404743-71404881
  hyper
ctctattctcctggggtggtgctgaagcgtttctccgggagacaccggttggtgggcgtggtgcagtccgcactgcggtctctacggcagcccgaggcggacaaagggcgttcacgcagccctcgttccccactcccc

SEQ ID NO: 94187 - DNA, 156 bp, Homo sapiens
  chr5:71491785-71491941
  hypo
ggaaactgagccagtcgaagcctacgtcatccagaaggagagagaagtcaccaaaggtcctgccgagtcccctgatgagggaatcactaccactgaaggggagggcgaatgtgaacagacacctgaggagctggagcccgtcgagaagcagggagt

SEQ ID NO: 94188 - DNA, 30 bp, Homo sapiens; identical to SEQ ID NO: 40555
  chr5:72175493-72175523
  hypo

SEQ ID NO: 94189 - DNA, 240 bp, Homo sapiens
  chr5:72236789-72237029
  hypo
gcgacatagcgagattccatctcaaacaaacaaaacaaacttgaagacgtatttttcttcctgttgacgaaacatgagacagcagggcctagagagaagtgaaaagaatgttaaaattagcgaaagtgaacatgatgtacaagcagcacaaaggaaaacagacattgttgaaaacacagtgatgtacacagagggcaggatttttcttttttaaaaagaaaaacattttttaagtgacag

SEQ ID NO: 94190 - DNA, 164 bp, Homo sapiens
  chr5:72415759-72415923
  hyper
gagcgcacgtcgtcccgtgacctggtggctccatattcgatggggagctcgcagcgagtcgcttccctctgtaaccccactccaggtctccagagcagtaggagggccacagggctgctgggtgtagtcgccccggacctcgcggtggccaaggccaaggcggc

SEQ ID NO: 94191 - DNA, 143 bp, Homo sapiens; identical to SEQ ID NO: 29640
  chr5:72416022-72416165
  hyper

SEQ ID NO: 94192 - DNA, 294 bp, Homo sapiens
  chr5:72497893-72498187
  hyper
tgccctccgccgggccgacttcccgcgaaactgcagcggctccccctacaggacaaaggaggaaacgctagcggggccccagagccctctccaatgggacccaaagggacacatcccggcacagaccctccccactctaaggcagagcctttcgcagggcctatcacagggcggagggagggagggagggcggcaggaggactgctggcctgaaactctgctttcacaaagaggttacacttcgaagttagacctcatctgcaaatgaggttatggacacggtcccatagaagc

SEQ ID NO: 94193 - DNA, 30 bp, Homo sapiens
  chr5:72511476-72511506
  hyper
tggcagctgaaacctcgctggctgggctgg

SEQ ID NO: 94194 - DNA, 191 bp, Homo sapiens
  chr5:72512184-72512375
  hyper
aaggtccgcgggagacgatccccgacctccgggaacaggcctgcggtcggccgccttggcacccaggctctgccgcccccggagactcggatcgagcgctggaagtggccgcaagggacgcgagggagagcagagctgtgaatcagccggaaagtcactccaactccagggaattccgctccgggaagaaa

SEQ ID NO: 94195 - DNA, 29 bp, Homo sapiens
  chr5:72526037-72526066
  hyper
gctactgctagccctcgccccagactgtc

SEQ ID NO: 94196 - DNA, 279 bp, Homo sapiens
  chr5:72526136-72526415
  hyper
cgatcagattctatttactgccctcttccccaaccccggggccacctctgaggcatgaacccagagacgcgcgccctggtctgggaaagcaggaccgctgcgcccagcgcctcaggggtagaggcgggaacaggcccgcggtcgctttgctggcggggaagggcgatctgacgatcagggagttgcgcccctctctctgggcctcgtgaaggaacagagcaattacagcgctgggccggccacgtagtcctggggctaggtgggcccaatgctccgggc

SEQ ID NO: 94197 - DNA, 209 bp, Homo sapiens
  chr5:72526491-72526700
  hyper
cgcccgggactccccatcagacctttgagggggagcttctcaaaaagccctaaactcctcgaggatattctccgagtgcttctccttacccaagcgctgcttccagactccacgcctctagaactagctggcgtccacggtcggccagagcagttagggggctgcgctagcagggacatgtggggcaaaagagacgtattttaaaaccc

SEQ ID NO: 94198 - DNA, 15 bp, Homo sapiens
  chr5:72528095-72528110
  hyper
atagactcagaaacc

SEQ ID NO: 94199 - DNA, 458 bp, Homo sapiens
  chr5:72528189-72528647
  hyper
cggccgcccttaggagaccagtgatcatcccagccacctccctgcccagccccgggccgaactggaaaactcttaactttgggctttatttaaaacactcgggtttcgaaagccgggtcccctccgcaggccaggaggcctcagtgagcatcctgtgctgcgtggggagggcctggcagctggcggatccgtctgggctgcagctgcagggtcgggagctcttcttggactcggctcctttcagaaaactcttttcttgtcggatgtggtttccctttaattaatcactcatgcccgcgtgtccaccgcgccgcttccccactcttcctccagccccgcatgtgatctctatttggaggcaggagagctggtggagcatctggggttgccgcggaggtggttctgcctgccgctgggcttcgggccgccgcccagagacagagcgatatcctcccaga

SEQ ID NO: 94200 - DNA, 833 bp, Homo sapiens
  chr5:72528993-72529826
  hyper
gtgcaggctcctttccggaaagccctggccccaaaccccaacatcaagccactctcaggattgcggggcagtgggcaagacctgatccagagggtgtgcattaagccgttgccctcgttgcgtttaattctcccgtcactccccagtcactaagggaggcctcctactcgcgcctcagcttcaagggcggatgtggctgggaccaccctgggactcgggtgtctccaaatgtggctcaggccgccccacgccgaacgaggtgggatcagatattcccgcttgtgagtgttggtggggctgaagagatcacacgcggcggggtgtggaacttcgaggggtgtcacggccagggctttgcggccccagacgtcccagcggctcgcagggggcgccaggtccgcgcttccccttgggtcttcgagaggcgtgtgcgcaggacgctgccctctgttgcccaaagcccgcaccaggctcctgggcttccgcgggcttccgcaggcctcaggcgaggggcggggacgccacccgcacgctcccgagcgcagggagggctgtcgccgaagcggtgacccacgcgtggaccccgcccgcgctgggccgggccggtcccctgcccacccgcagccctgctcggccgcgttcccagcagccgggaaagcttcctccctcggtcaccgatccaggccgctggtccagctgtcaaaacagggggtgtctctttcattctggctcacaaagtcccaaaggggaacagggggccttaatgcttgtgtttggacacaagcaattatccctaattattctttttcttttgagcctgcccgtcccgccgg

SEQ ID NO: 94201 - DNA, 747 bp, Homo sapiens
  chr5:72529889-72530636
  hyper
cggcccgaggctcgggcgctttcatgtcactgcgggtttagagctgattcaaactcattgcgatgggggaattaaccccggggcccgggctttcaggggcctctgataagagattatacgtgttgatggcaagcttttcttggcaaaatgttttcaaagggcttggagttgttaaatcaaagcgccattgaattgctcgggaccaccccctcccccgcctcttgcccttcccccacctccatctttttcccttcatccctcctcccccatcaccgcccaggactgcccaaggcgagcggcccagcctccgggagtggcgagtcaccttccttggtacgattttcccccggtgcctcgcccgggaaggattgtttttgtaggtgctcctgctgctgggcactttggtaccccttcccttccccgcccctccccgccccttcacacacacttgctctggtaaagaaaacatgtcccagatgaaagacgtttttttcaaacgtacatgtgttttgcagaaaacggaggtgacagggtgggataacgaggagaaaggaagggtggctttcctgcctcccccacccccgaaaggtcatcggagtcagaggggtaaccatcgggttaaaaagtattgtgggcagagttcagatgtccggtgaatcgcacggttctgccctgggggagatctgccttccacccccacccccgcggaatgacagaaagagttgggaggaccgtggggatgtagat

SEQ ID NO: 94202 - DNA, 67 bp, Homo sapiens
  chr5:72594770-72594837
  hyper
aaagagaaaaggcaccgggcacggaggtttaatgtgaagcatgtgagcggggctcagtttacaggta

SEQ ID NO: 94203 - DNA, 150 bp, Homo sapiens; identical to SEQ ID NO: 29652
  chr5:72594867-72595017
  hyper

SEQ ID NO: 94204 - DNA, 676 bp, Homo sapiens; identical to SEQ ID NO: 29653
  chr5:72595046-72595722
  hyper

SEQ ID NO: 94205 - DNA, 199 bp, Homo sapiens
  chr5:72595773-72595972
  hyper
cgaaccaatgggcagaccggggagagcgggacgcgcaggagagggtttgaaaggaggtgtgggttttaatttttaaagagcataattgggctgaggagggttattttttccttggccacgggaaaaaaaagaggaagaaggggaaaaaaaagtcaggcgaaacacaacacatttatctatcaaccgctagacaagacaa

SEQ ID NO: 94206 - DNA, 134 bp, Homo sapiens
  chr5:72596806-72596940
  hyper
gggttgttgccttggcgtttactaaattcatttacactgaaaaccacatgtatgacacagagaggttgagcgttgccaaggactgctttgtttgctcttcccttccaggaggaagggaacgaacgacacgaacg

SEQ ID NO: 94207 - DNA, 72 bp, Homo sapiens; identical to SEQ ID NO: 7872
  chr5:72598030-72598102
  hyper

SEQ ID NO: 94208 - DNA, 383 bp, Homo sapiens; identical to SEQ ID NO: 449
  chr5:72599059-72599442
  hyper

SEQ ID NO: 94209 - DNA, 396 bp, Homo sapiens; identical to SEQ ID NO: 29658
  chr5:72599462-72599858
  hyper

SEQ ID NO: 94210 - DNA, 30 bp, Homo sapiens; identical to SEQ ID NO: 7875
  chr5:72608427-72608457
  hyper

SEQ ID NO: 94211 - DNA, 50 bp, Homo sapiens
  chr5:72677145-72677195
  hyper
gctaaaattaatctgcgctgggccacttgcagaaagcagaaccacctccc

SEQ ID NO: 94212 - DNA, 52 bp, Homo sapiens; identical to SEQ ID NO: 29660
  chr5:72677774-72677826
  hyper

SEQ ID NO: 94213 - DNA, 32 bp, Homo sapiens; identical to SEQ ID NO: 29661
  chr5:72677997-72678029
  hyper

SEQ ID NO: 94214 - DNA, 86 bp, Homo sapiens
  chr5:72715262-72715348
  hyper
gtagtggggagggggcgccaagagtaacaaagggagccagcggcctggtttgtttggattgccgggccggcgcgggagcggccggg

SEQ ID NO: 94215 - DNA, 106 bp, Homo sapiens; identical to SEQ ID NO: 29663
  chr5:72715590-72715696
  hyper

SEQ ID NO: 94216 - DNA, 406 bp, Homo sapiens
  chr5:72715730-72716136
  hyper
cgcagtactgctctcccgccccccggagccgagcctcttcgcgttcgcaccgtgaaaggaggggagcgaggggttagccatctcgaacatttttaactaatcaaaatatttgctgatgagtatttatttttacaagaactcggtttggctggagacttcccgagcaacaatatgggctgccgtattaggtttgtgacggagccaagtgtggttggggcttattgaatctgcgggccggagatcgctcgctccggagacgtttctccgttctggggaagcagctttcccaaaaccgtccttctgcagatggctcttagaacacaaccacatgtcccctaaagcacgggaagcttcgtgttttatgtttgggctgaatgaaaagaggaacgcacgctctttcctgccc

SEQ ID NO: 94217 - DNA, 30 bp, Homo sapiens
  chr5:72716375-72716405
  hyper
gtgattaaacaactacgtcaagtcattgca

SEQ ID NO: 94218 - DNA, 30 bp, Homo sapiens; identical to SEQ ID NO: 29666
  chr5:72731806-72731836
  hyper

SEQ ID NO: 94219 - DNA, 152 bp, Homo sapiens
  chr5:72732228-72732380
  hyper
ttcacaacccctaagcggttcagtccccgggcctagcgacactccagagcgctcctaattagtctaattagaaaggtggattgatagatggaaagaagacagagttgggttaggaagatgctcaatgctgccaatctcggctgggttgccgc

SEQ ID NO: 94220 - DNA, 41 bp, Homo sapiens; identical to SEQ ID NO: 29667
  chr5:72732869-72732910
  hyper

SEQ ID NO: 94221 - DNA, 173 bp, Homo sapiens
  chr5:72733012-72733185
  hyper
gctcgccacagccggcgggaggcggggaagggagcagcccgggtggcttggagaacactgaacctttaattgggctataaatcagacaggggagtgcggtggagtttatgcaggtgtaaaaacagaggggaaagcccgggccgagcagccaaagcgcccgggcaggtcagaac

SEQ ID NO: 94222 - DNA, 87 bp, Homo sapiens
  chr5:72733501-72733588
  hyper
ggggccccgggcgagcgggcagcggcccccgcgtccctcccggacacagcgccaccgagaggccgagcctcccgctcctgttgccat

SEQ ID NO: 94223 - DNA, 245 bp, Homo sapiens
  chr5:72740103-72740348
  hyper
cggcctgacggggcgcgccccgcgctcctggctcgcccatccagggtccacggctcactcgtccctcgcctgccccgcggcccacacctctcgcagctcatacctcacccgccccgcggccctgcttcccccagtctcatcctctcgggagcaggcccgcagggtctgcaaggccaagaacggaaccccaaacgcagagggtggggaggtgagcggcaggacgcaaaactcggaatcgaggcggc

SEQ ID NO: 94224 - DNA, 1912 bp, Homo sapiens
  chr5:72742569-72744481
  hyper
ggctgtagcataggtcggctttgcataaatagagggacccgcagagccaaaaggcgcgcccgggctgttgacagttttgtccgagaattcgcagcggcgaaaatgggcgcgcgaggtcgagaggggccgcgcctggaggagcgaacaaaacaccgaaccaccaagacgagaaaaggagccgggattcctaccttcttcctcgagcgcgctaacatagcgttattaacaattggaaatcctagcagtaaagttctcgacactggacagggcagtcccttggtgcagagtccccaaggcggcggacgaggagactgaggaggcggcggcggccgcggcggccacgagggatcgggtgagcgcggccgccgggcccacggccgcctgcgccgcgcagcctcctccgctggatccgggagctggcggcgccgccaccggcgagggcgagggcgaggcctgagcggcggcggcggcctgcgcggcggcggcggcagcggcggccgggcccaagctgcccccgatgatgctctcgatggagaagggcgagcgcgccagcgctgaggcgcccgggccgcccgccttggccgcggaggccggcagggggccgggtagggcggcgccgagcgggtgcggccggtagccgaaggcggtccgggccagctcggcggccgcgccgtgcggtggcgggggcggcgggggcgagtgcgggtggaaggcggcggcggcggcggcgcgctgcggcggcgaagagggccgagggcggcgcgtaaggcggcagctgcaggccgtagccgcagccgtaggggccgtagccgtaggcatgcgggggcggcgggggcgcgggcgggaagagcgcggcggcggctgccgggtcgcccgcgccccctgcggctcccgcgccgcgcagcagcagagactcggcggccgcggcgttgggtgggagcagcggctgccgcttgaagcgcttcctccggcgcaggaagctgccgttgtcgaacatgtcggcggactccgggtccagcgtccagtagttgcccttgcccgggttgccgggctcgcgggggatcttgacgaagcagtcgttgagcgagaggttgtggcggatgctgttctgccaggcggggaacttctcccggtagtaggggaagcggccgctgatgaactcacagatctcgctcagcgtcagccgcttcttggggctctgcaggatggccatagtgatgagcgcgatatacgagtagggcggcttcaccagcgggttcttggcgccgctacccgcgctcccgccgccgcccgcgccgccgccgccgccgcccccaccggctcctgcccccgccgccggggccgggcccgggggcgccggggagcccccagcaggcggggccagcaggatgtcatcgtcgtcctcctcctcctccagatcctccagctcgtcctccccggcgtacgagcgccgccgccgccgccgctgcgcggggacagccagccggggcccgccaccgccgccctcgtcgtcgtcctcctcttcctcgtcttcttcgtcctcgccctcccccaccacgtcgatgtctgtttcctcggcgaggccagaggcatcggacatctcagtgctcagggtcatagctgtggcgcggcggcggcggggcggcgcatgggggcgccgggctccgggctccctctgcgccccagcccgggtcccgggcggcaggcccggccggggggcgccacgctgggggcgctgcgactgcggctgccggagctgcgccggggctgccgggtggcggcggagtctcgcgcgccgactttataactcctgcgccgccgcggtagccgcgcggatgctgcgctccctgggctccgctcgcgcccggcccgggcggaggacttgaccttctcctctcggagcagcttttgc

SEQ ID NO: 94225 - DNA, 499 bp, Homo sapiens
  chr5:72744697-72745196
  hyper
gaaatcagcccttctcgggagagaaaattcacccgtaggagggaggcagcagctgagaagagtggggaggagaggggacctcactatttcttgccaaagaggctgatgcccgaattacgcggctgtctgcaccgagggccgctgcacgagttagacttcccagcctcctcaattagtcctccaccctaacctcagaagcacacccgcgacactctggtttgacccctcgacagcctgtaggagccttccagccgggggataaccaccccatcctctgaggtggcccctgggggacgctctggggtcggttgggggtgtccagcccctccagatcgggcgagcggccccccattggatctgatgcgaagccccccaatttaagcacgataataattgtttattgaccctttaacccattctcttcggttttactccaaagacgtttgttttccgccatctgttaataaaaacgctgtgagactggcgttttactcacttc

SEQ ID NO: 94226 - DNA, 6 bp, Homo sapiens
  chr5:72746678-72746684
  hyper
tcattc

SEQ ID NO: 94227 - DNA, 528 bp, Homo sapiens
  chr5:72746992-72747520
  hyper
agtcgcgaaattccccgagcgcggaaactcaagcgattcacgtcttgcgcgacccccttgtctcccccatcgtcccctaccccgggcctccttctctacagcgctcccagctttcggccccagctggtaactctcccccggctccccgcccccaagctggtacaagggaccaaaacctttcccagaggcgagccggggaagcgacgcgaagacccccgtccggcgcaacccgctcgcgtggacgcggaaagtggcgggcggcgggtcccggtggtgcctgcgtagggcagagttgccccctggcggcggtgcgacgacctgcgggccctcgcgcccgggccggcaactccctgggagctcggcccgcgcggggaactcgcccagcagcctgtgtttctcgagtgtgggcagccggctcccgggcgtccctcccaccggctgcgggggcccgggactgggcggtagtggaggcaggtccttggactgcaggctgaggctttttccccccacgagcggtttgggccctcc

SEQ ID NO: 94228 - DNA, 30 bp, Homo sapiens
  chr5:72747820-72747850
  hyper
tagaaggctgtattgcgatagtgtttgtac

SEQ ID NO: 94229 - DNA, 179 bp, Homo sapiens
  chr5:7394900-7395079
  hyper
gggggctctttgggccggaccacactcgaataggaggaaacttccagaagggtgggttcctttggtgataagcaatgaagccccttcggcccccagggcgaaggccagcggcctccgctcccacgcgtgtcgggaggggacactgtccctggtgacatccgcccccacaacgctcctgc

SEQ ID NO: 94230 - DNA, 234 bp, Homo sapiens
  chr5:7395160-7395394
  hyper
cgcccagccgctctccccggcgcccctttgccgccatccccgctcagcagaggggctcggcgaggaccacgaccagccacggggcagctctgtaaacctgtgatatgacaggcttatacggcacctccaaagtgtgactgaagctgagcgtgcagggcgcaacggacgctgcccccgcgaggccgtggcgggggctcccagtgcagtcactgccgcttcacttccacatggtgc

SEQ ID NO: 94231 - DNA, 831 bp, Homo sapiens
  chr5:7395433-7396264
  hyper
cgccctcgcagggagccccggccctctcaagagggtggagaggatgggggagccctcaaccctgctacgctgaggggaagaagggctggacggcaaaccggtgcccaccgcggggaggcgggaagggtgggaaatcctctccagctccccaaaagagtgaaaaggagggagaccccgctgtcctctgacccgcgtactaaaggagggaccccccgggtcctctgaccccggctgcgctctgtgactgtgggggagggtgggagcaggccccgcagcccactaaggggtggaggaaacaggagggtggcagcgtccctgcccgctgaccttgaggtagtggagaggagctgaggagccccgcagtgctccgagccaggtggggcggggggagtggtgggggtaggactccctccctccaccccttaggctgtgttctcacttcgtagcggggagggccgtccctcccaccccacccacgctgcactcgggatagggcagaggaggtggacgacctggtggctgagtgtgggaggccggcgggcgaggacgaccccgggccggggcgcagcgggagcccctcagttcgccactccccccaccgtacagcccccgccgtccccagcctgcagccgggccgtcgggtgggggccgacaccgcccctgcacggaggccggctgcgcgcggggcggggagcggcgggcggagggccccgtggaacccgccccctcccgcgcggtggcggtggcggcggcggcgccgggagctgcccccgaggccgccgcccggcccccgcccgcgcgtcagcgcgcccagcccggggcgccgagctc

SEQ ID NO: 94232 - DNA, 505 bp, Homo sapiens
  chr5:7396473-7396978
  hyper
gcggagacgggctgccgcggtcccgggactggctctacgagtcctactactgcatgagccagcagcacccgctcatcgtcttcctgctgctcatcgtcatgggctcctgcctcgccctgctcgccgtcttcttcgcgctcgggctggtgagtggcctccccgcgggtccagcgccgcgccttccccggccctgagaggagcccggccagccgagccgcgtcccgctccgggctgcccctcggcccgcggcagcccctcggcccgcggcagcccctcggcccgcggctccctgcttctcctgctggcccgcggcccggtggactctggcaagggctgcgggcgggagaaaagtttcctgggaaggctcttcccaaaataaagttcccgaggtgttcaccaggtggacgggcagggcgtgtgctttttgcatctttgcgcacccgctggcaaactctgcgctttccgccgggcaccgctgcccgcagcgctggaataggtcttcccc

SEQ ID NO: 94233 - DNA, 56 bp, Homo sapiens; identical to SEQ ID NO: 29459
  chr5:7396979-7397035
  hyper

SEQ ID NO: 94234 - DNA, 104 bp, Homo sapiens
  chr5:74061423-74061527
  hypo
aaagagattatataacgtactgtacctaaaatatacaaatgctagttactatttctggttttaaagagaatgatgagatcaccttagaaaatggagccttaaaa

SEQ ID NO: 94235 - DNA, 67 bp, Homo sapiens; identical to SEQ ID NO: 29677
  chr5:74161713-74161780
  hyper

SEQ ID NO: 94236 - DNA, 35 bp, Homo sapiens
  chr5:74162202-74162237
  hyper
gtgacgcactagcgccgcagcgcctccagccttcg

SEQ ID NO: 94237 - DNA, 110 bp, Homo sapiens
  chr5:74162506-74162616
  hyper
atataaaaatagatgcggttaagccgcgggggctgcaacgctgattttgcgtattcctttaatgccgaccttcgcaggattctgttcgcatagcccggtggagttctcca

SEQ ID NO: 94238 - DNA, 381 bp, Homo sapiens
  chr5:74348254-74348635
  hyper
tagcaccgtttcctacgtgaagactgcaaatggactcgagcgtcccgtttctcggctcggatcccagaagctcccgacccgctgtggtaggcaccgccacctcgcaggcagacgatcccggcccgctctgcggcacaaaaaacttgaccttaaaaagcccagaaactggtctctgggaagggcgcggcctgggaggcgcggcccgcagcttccgcccccaaagaacaactcggaggccccctccagccccggttgccctggcgcagaagccgcggtagcagtcctttcaggcgccccgcgtccctgtcccgaagcccaggggcgggggctcgggcagcatcgcttgtcccctctggtccagggctgcggagaagcggcaag

SEQ ID NO: 94239 - DNA, 511 bp, Homo sapiens
  chr5:74349496-74350007
  hyper
cccggggtgggagagcgctgagcggcccccgtgacgtgcggagaaagtaggagcgcctccgcgctcccgcagagggagctccctgccctgcgctcccagtccccgggccgcgcttcggacaaagttctcaggcgcgcgcggtgatctcggctctccgccgctgcccggagcgtcatccacgttcggttccctcccacattagacaagaaatctgaggtcaggagagctaagtaacttgcccaaagtcgctcacaaggcagtgacgaagcaaactcacatccgcggctccttttttctccttgaacgccgggctctgcggaggctcaggccctgcaggaatcgcccaaccagacagaaggcagctcgctctcatgggtgagacgaggagtgtcccacgcagccgcgagaaatattatcagcagcgtgggaaggtggagctttttgccgaataactagagtgcaaagttgtttttcaaacagtgcctacatgccaaatcggcttgctttttat

SEQ ID NO: 94240 - DNA, 25 bp, Homo sapiens
  chr5:74536034-74536059
  hypo
aatttttttttgagacggagtttcg

SEQ ID NO: 94241 - DNA, 125 bp, Homo sapiens
  chr5:74906134-74906259
  hypo
aataacaggcagcagcgggatttggcctggggatggagcaaagtgaccccctgctgtagagcaaggtgagtgagtcacgcccttgacaacacattcttagaagtcatgctcgttaggggcaagtt

SEQ ID NO: 94242 - DNA, 104 bp, Homo sapiens
  chr5:74907576-74907680
  hyper
tggaggagcctgtcccggatcccgaagcgggagggtcttggagaggaggacacagcagttgccggacacgagctccgtgagtcccgggacgaggtctcagaaaa

SEQ ID NO: 94243 - DNA, 42 bp, Homo sapiens
  chr5:75014106-75014148
  hypo
ttacaggcgtgagccaccacgcccggccgaaggtgttgattc

SEQ ID NO: 94244 - DNA, 116 bp, Homo sapiens
  chr5:75377684-75377800
  hyper
accgcctgtctccaccggctcctctgggcaggaggctccagcctgggggtgcctgacagctctccttccccggcgcctgtattatacatgtaacatttatatttctatccacacag

SEQ ID NO: 94245 - DNA, 438 bp, Homo sapiens
  chr5:75377859-75378297
  hyper
cggagagatgtgtgtgtttgagttccaatcactgcagcccgtattggcgcggcgctttgtctcgctttgggtcaccaccacaggagcaacgatttcggggacggcacacgcctgtgtgaccgcttcccactccacttgggttccgtgagcgcgcggagccggaggagtcagggacgtgaggatgccctacttcccgcagcatccggatggcagggtctgcgtcggaaggcccgggagggcgacgccctccactgctgccgcggggtgggtgcgccaggcctgggtgtggcctcacgggagcgagtttctctccagccgcctggcccaccgctttggaacagtgaagctcgagttggggtctcctgcacgccaaggggagaaatgtttgtttctgacaacacaagcaaaattctctctcctgcacgccaaggggagaaa

SEQ ID NO: 94246 - DNA, 155 bp, Homo sapiens
  chr5:75378559-75378714
  hyper
gtagacttaacccagcgaagttttcttctgtttgctcttgctgtgcccaagtttcctctggacttgtcttccagcgtcggggtgggggctgggggaagtaggcaacctagctctgcctggttgctccctggaagccaagtcgaagtgaacaagtc

SEQ ID NO: 94247 - DNA, 689 bp, Homo sapiens; identical to SEQ ID NO: 29683
  chr5:75379005-75379694
  hyper

SEQ ID NO: 94248 - DNA, 857 bp, Homo sapiens
  chr5:75380067-75380924
  hyper
caggcgaagcagacccgaggctgtgaagctcagaggggagagggaccaatcgcagtaaataagctaccgaggtaatcttagatggcgatgagggcagcaaaagccatcagccgaccctctgaccctttctcttagtgggcttttccccttccgcctgggttctagaactgggaagacttttctccagagcgtcgcggggagcgccccgggctgggcccacggggactgcggaatacggggatgaacttggcttggggcagccagcaccccacggcagatgaacaatcgggagcagatctgtgggcgtgcggggaccttaggcggcgcgcgggggcggggggaggggctgagccacgggggctagaggtgccgcctggacggcctgagctgggggcgctcgcgtcaccttctacgtgtgcgagtgatgcaaatgcagacccgcgaggggcgggcgggggtggcgggcgggggcaggcgacggagtctccgtctgggagcgcgcgtgtgtgcgtcaaaagctctgggttgatggatgccccgcggcgcgcctggcgcggagagcggcgacccggcggggcagaggggggcgggaggactgcggcggcgcggggcggcgaggaaagccccgcacggcctgggctggcgggcaggcggctccgcagtgcgccgcagtgccgggaaggagccgcagctaccgggcgctccccgggggaccgaggagatgaggcgtcttttaaggctcatgagagccttaaggagatgagaccgggatgccgtgatggtctcctctcccgctgaacctaatcccttcatacttagctgactgctagcgcggtagcttccgtttaattcttatc

SEQ ID NO: 94249 - DNA, 36 bp, Homo sapiens
  chr5:75587117-75587153
  hypo
aggaggtgttttgttcggatccgcaccgagctgtac

SEQ ID NO: 94250 - DNA, 21 bp, Homo sapiens
  chr5:75688128-75688149
  hypo
acagagcgagactccgtctca

SEQ ID NO: 94251 - DNA, 30 bp, Homo sapiens
  chr5:75698244-75698274
  hyper
tgtttttcctgttatcgggtcacccacaca

SEQ ID NO: 94252 - DNA, 714 bp, Homo sapiens
  chr5:75699459-75700173
  hyper
ctccctccccgaggacggcgttggagaagccgagggagccggttgcgcggcgcagaggaaattggaaggcagcaactgcgcggctggcaaagttgggagctggagttgcaaagggcagtgaatcgcgtccccccgctcctcccgccccccaattcctaatatccagctggcaacccagaccctccactccgcatacccaaacggggtgcgcgggcagtgcggggattgcgctctgggacagaccaggttgggattttaggggtatcaggtgaggagtccgcggagctccgggtcgccgccggcttgggccagggggtggcgtaaggcaccggattcttccaacccagaaggggaggaaagtttgtttgctgtggctacaggtgggcaccgcaagtagggcgccggcgcactctgctagtgcaaagccggcttgactggaagggcgggagtctcctcctgtcccgcgccctcgaacttcacctgacccgctagagccattggcctcacaggtgtaagtccctcccctctgaaaccccccaacccctttcccccccgctcccctcgcgcgggaggattgctgtgtggagaggacgcggcactaggctccggggaatccggcgggagcccgcgtgacttgaacgagatggtgtcgattacccagccaggggctgccctcggaaataggttgctttggccgatcgtgagtggatggag

SEQ ID NO: 94253 - DNA, 17 bp, Homo sapiens
  chr5:75719149-75719166
  hypo
aaaatggtgcttggtcg

SEQ ID NO: 94254 - DNA, 76 bp, Homo sapiens
  chr5:75743288-75743364
  hypo
aaatcttgtaactgcaaaaacaaacaaacaaacaaaaaacatggggcatagccacgtccgtcgagagctgccagaa

SEQ ID NO: 94255 - DNA, 30 bp, Homo sapiens; identical to SEQ ID NO: 40558
  chr5:75819580-75819610
  hypo

SEQ ID NO: 94256 - DNA, 30 bp, Homo sapiens
  chr5:75913911-75913941
  hypo
tgcttgggcaggccccggtaggtgaaagga

SEQ ID NO: 94257 - DNA, 89 bp, Homo sapiens; identical to SEQ ID NO: 40559
  chr5:75963986-75964075
  hypo

SEQ ID NO: 94258 - DNA, 40 bp, Homo sapiens
  chr5:75965679-75965719
  hypo
ttcttcttcctaggccggagtgcaatggcatgatctcagc

SEQ ID NO: 94259 - DNA, 30 bp, Homo sapiens; identical to SEQ ID NO: 40560
  chr5:75969716-75969746
  hypo

SEQ ID NO: 94260 - DNA, 30 bp, Homo sapiens
  chr5:75996136-75996166
  hypo
gcttggctgacgtggcgaaactccttctcc

SEQ ID NO: 94261 - DNA, 580 bp, Homo sapiens
  chr5:76011174-76011754
  hyper
atgcgcaggtgaccccggcgggcggcgcgggaaagggaagagctccgcgaggccgcgcgggggggaagcgggagaagccgctcttcctattccactcgcagtctgcgtgtgggggaaacgagtgcccggcgtatgaaacgcctaacttcgcgaaataaagagagacgtataaaagttcaagaattctgtccagactcaagggccctttctcatttaggggcaaccctgtcactacatcataaacttttaaatccgtgatccccacgttacaaaagcagaagtcccttttagacttttagcgaaaactgaactttgccggtgtcccacacggagggagggaggacgggaggccacgccagggctgcggggctgcagggcgtggacgcatcctggccggggcgtccactgtcgacgtctccacatcccaggagggtcgagacggccgcgggaagcagcctgcgagccgtgcggccccattccaaggaccccgccagtgtgagtcactgacagcttcgcgaatcaacggtgcccagaggaaaaaacttctcatttggacttctaggcccggcagtggccggcg

SEQ ID NO: 94262 - DNA, 35 bp, Homo sapiens
  chr5:76012164-76012199
  hyper
ctgcttcagtctgtgcggcccgctgttgtctgccc

SEQ ID NO: 94263 - DNA, 41 bp, Homo sapiens
  chr5:76012602-76012643
  hyper
taaaatataaagtggcgaaccgctgccgctgaagttttgct

SEQ ID NO: 94264 - DNA, 30 bp, Homo sapiens
  chr5:76114850-76114880
  hyper
ccctgaaacctaacccgccctggggaggcg

SEQ ID NO: 94265 - DNA, 63 bp, Homo sapiens
  chr5:76115162-76115225
  hyper
atccgggcaggtgtgcgaaggctgttctgctgccggcacccatctctacgaatcccttagcct

SEQ ID NO: 94266 - DNA, 166 bp, Homo sapiens
  chr5:76115443-76115609
  hyper
acctagtcccctccccgggcttggttgctttgtaaacactaagtcattaagagctttttgccaactccggagacttcctccgctggccccgcggggccggtggggttagcgagctgattgcgcagggcagggcggagtgggtgggaacccgcggcccgggagcctt

SEQ ID NO: 94267 - DNA, 392 bp, Homo sapiens
  chr5:76249279-76249671
  hyper
ccttcccgtcttctccggacacgggaaaacattacccctctctctttattcgctatgctgagtggcagggagggtgccccgctcctggtccccttttttatccccagcccttgaacttttccggactgacctatgtttcttgccagctgagggaagcggcggactacgatcctttcctgctcttcagcgccaacctgaagcgggagctggctggggagcagccgtaccgccgcgctctgcgtgagtcgaggctgcccggctcgcgggcgcccgggacgcggggaaggtgggactctgtgcggggggcagagggctcgcggacatctcggggaaggggctggccggaaccgccaggggcgcggtccccttagctaaggatcggtccgcggagg

SEQ ID NO: 94268 - DNA, 212 bp, Homo sapiens; identical to SEQ ID NO: 452
  chr5:76249695-76249907
  hyper

SEQ ID NO: 94269 - DNA, 206 bp, Homo sapiens; identical to SEQ ID NO: 29692
  chr5:76249944-76250150
  hyper

SEQ ID NO: 94270 - DNA, 236 bp, Homo sapiens
  chr5:76250409-76250645
  hyper
cttggttagaaggcccgccccacacgtctcacatctgagcccgcctcgctcctgctggtccacgctcggcagagccgttccgagagcacagaggctgtcttcagtgcgcgggtgacccgattttggagcagtaggggactggctgccgagggggcatctagattgagataggtgggagggcaggacaagacccctaagctcactgcctcctcgattccagtcgtcagactccataa

SEQ ID NO: 94271 - DNA, 30 bp, Homo sapiens; identical to SEQ ID NO: 40561
  chr5:76327167-76327197
  hypo

SEQ ID NO: 94272 - DNA, 26 bp, Homo sapiens
  chr5:76327430-76327456
  hypo
aaccttggctggacgcggtagctcac

SEQ ID NO: 94273 - DNA, 25 bp, Homo sapiens
  chr5:76327696-76327721
  hypo
ccagccagggcgacagagtgcaact

SEQ ID NO: 94274 - DNA, 30 bp, Homo sapiens
  chr5:76475962-76475992
  hyper
aggctggacttccctcgaggggccaggaag

SEQ ID NO: 94275 - DNA, 556 bp, Homo sapiens
  chr5:76476235-76476791
  hyper
cgggcaccaccagggcgcccaggagccgcccgccgccggcatggaccagctgtactgcccaccgagcgcgtgccaggtgagcccccagcgcgggggaccgcgcagccctcggccgccccctcacacctgggtacccggccgctggcacaagcccagagccggcttcagggccccctttcagacacccaggtgctagggtggctttttttcttttcttttcgcccttagtccctgcgtgtcctagtgccaactacctccttcctttccaggcgggaagcacctcgagcgtctagtgtaaccgtcaggtttattattcccaataataattgaccacagacagccgccgttcgcgtccacctggcgcttctcagcaggagctggacctgtttctccgtcgggccggctcctcgggctgctgttgcgcctggtgttttccacgcttccccggcgcgggacggtggggcccctgcattcctcctcgtgcttccagtggctgcaaagctgcctccccttctgagtagtgagtcgccggcagccccagcgtggggtgtgtaca

SEQ ID NO: 94276 - DNA, 614 bp, Homo sapiens
  chr5:76506145-76506759
  hyper
gccgagccgcgggcacgctctgccctgtcgggagagctccgggagcggcgggaggggcggaggggcgcagtggggcccgggcggctgcggccgcggagccggggcacctgaggaggaaggagggtgggagcgagggagggaggggacgggcgcagaccgaaagtggggaaagaaggtgcaggcaggcgggcaggcgggcgggcgccctggcccagggccgcgggtgcgggagcccggcgaggtcgagctgggcggcggcgggggccgcgccgagggaggaggggaaggcggaggcgcggggagcgtgtttggggcgccgcggcggggagggtggcggccgctggtgcgcgcggggcgctgtgtatgcgcgctcccccgctcggggaggaagatggcccaaaagggaaagttggggtgacgcgcgcggtccccggaggctcggcggggggcaccgcggccagcccgacggagcggcggacacacaggccggggggcgcgcagtccgggcgccgccgcggccgccccctcactgcaggtggcagcgggtgcgctgggtcccggcggccgcgggcgcgggcgggcgcgcgggggagcccggccgagggatgggctgc

SEQ ID NO: 94277 - DNA, 442 bp, Homo sapiens; identical to SEQ ID NO: 29697
  chr5:76506760-76507202
  hyper

SEQ ID NO: 94278 - DNA, 30 bp, Homo sapiens
  chr5:76507421-76507451
  hyper
accattgagagcattcggtggccagtcctg

SEQ ID NO: 94279 - DNA, 345 bp, Homo sapiens; identical to SEQ ID NO: 454
  chr5:76923679-76924024
  hyper

SEQ ID NO: 94280 - DNA, 214 bp, Homo sapiens; identical to SEQ ID NO: 455
  chr5:76924086-76924300
  hyper

SEQ ID NO: 94281 - DNA, 64 bp, Homo sapiens; identical to SEQ ID NO: 29700
  chr5:76924416-76924480
  hyper

SEQ ID NO: 94282 - DNA, 167 bp, Homo sapiens; identical to SEQ ID NO: 29701
  chr5:76924754-76924921
  hyper

SEQ ID NO: 94283 - DNA, 1402 bp, Homo sapiens
  chr5:76925454-76926856
  hyper
gtgacctaggtgcaccgtgtctgtgcgcgcgcgtgtgtagcgtctgagcgtgagcgagagtgcgagtgtgtgtgtttctgcccacaaaccagtccattggtgtctgatttcagatcctgagtcgactccctggtacgtaaaatggcgggaaggatactttttgccgggcgcgggaggagggtcgcgaagtgtggggaaagaggggaccggaggggaggcggcgggcgaggggggtcgtaggcgtcgcgtcgaaggtgtgggtgggaacgccgcccgtcagaaggccaggaggagggcgcgagcacggccagcgcaagcagggaggccagggtggcgggaagggtgggctgaggcgctggagaccgagccgagggcgcagctgggtgggaagggaagaggggcggccgggagacgggggaccgcgggcgatcgaaatcaggcggaggggaggcctcgcgggctggggcttggggtgagcccgagcgagtggaggagagaggcgaggacgaaacgagacggggcgaaggccggggcgggacggggcagggcgccggggtccgggtgcgcgccggaagggcctcggggcggcccccggggcggtgctgggggcggagcgggccggggcgcggctgcattaagtgaagctcatagagactgtgtgctctagcgccttgcggcggagggaggcgatgctggtgccccgccacacgtcgctgctgtccggggagctgcagagctggggcgaaccggagacgttgctggggccggggagggaggcgggcaccatgccggggaaggcgggctggtagaggtgcgactgcagccccgcgccgttggaacccgccaggctgttggacaggcccatggagttgggcggcggaccggccgccaggctgcactgggacagcgactgcgccatggcctgctgcctgcccagcgccggcggcagaggcagctgtgacacgccaggcatggcggccgccgcccagcgggtgtcgttggcgtggaaagagcacaggctgtcgcccatggcggcggcagcggcggcggcagccgacgggaactgaggcaggcctggcgtgggcagcagtgtgccgggcgcacggaacacgttggtcgtctttttgcgcttcttccacttggcgcgtcggttctggaaccagacctggagcgggcggggcgggagacagacagggagctattagccggcccggcggctggggagttggggcttgagccccagaaacccgcctcggatacagccgctctgccctgggaggaacaagtgccgtaggcccgacaagcccccatacccagccggagactgtggctccccaccaactcctggcaactggcgccccctgcacccaccaagcgcggagtcctgcgctcctaagagctc

SEQ ID NO: 94284 - DNA, 783 bp, Homo sapiens
  chr5:76928157-76928940
  hyper
aatctggtcatctggcgtttactgtgcctaaatataaatgatgtaggacaagcccaggtactgagtttcctcttagaatttggccaacgcaatttgaccacgatatccgtggaaaaaaacgttgtgcatccgttaatctaacctatttagtgtttactctgcaagctaaagtatcaggggtatggacatacctgccctcggtctcggtgagccagcaatgttcagcggtgtgttcatgcccaggcaagcgtagacgcactctacgcttaccagtgtgaacggtgttgcagtctagaatactcccccagcttggggccggccctcgcctttctaccgtgcctgcgccgtcgcctaccactttcttcctgtggtttctaccccattttgcagattgctgcgtatcccagtgtcggcgatggataaacaggtctcgtctcttcccagttgcagcccgtgagctggtggcacaacggattaatgaggcaacagggctctagatggtgagtgggatcaatgagacccaattgagctgttagcggtcttaggcggagagcatctctcaggaggaaaggaaggcacagcgagaagacctaaggccgaaagtcgctgtgcagcacccacccaaggctggactcgggggaggtagacgggacggtgtctgtgactaaacggttcccacaccttacacgccgcaccgggattatgttttgaaaggtgtcttataaaatcaagaccggttcctaacaacctgcaagtgccagtgaatcccgaaatgtttgtttg

SEQ ID NO: 94285 - DNA, 30 bp, Homo sapiens
  chr5:76929223-76929253
  hyper
ctccgttccaagctacgatgcatatgtttt

SEQ ID NO: 94286 - DNA, 984 bp, Homo sapiens; identical to SEQ ID NO: 2591
  chr5:76932282-76933266
  hyper

SEQ ID NO: 94287 - DNA, 55 bp, Homo sapiens; identical to SEQ ID NO: 29707
  chr5:76933464-76933519
  hyper

SEQ ID NO: 94288 - DNA, 30 bp, Homo sapiens
  chr5:76933770-76933800
  hyper
cacagccattggcaacgctgagtcccttgc

SEQ ID NO: 94289 - DNA, 614 bp, Homo sapiens; identical to SEQ ID NO: 29708
  chr5:76934040-76934654
  hyper

SEQ ID NO: 94290 - DNA, 622 bp, Homo sapiens
  chr5:76934676-76935298
  hyper
cgcctgaaggaggcggcggcggcagccctggcagctccagcccggagcaggagctaaagcagcctcagccgcctcggcctcgccctgagcttctgggcccggctccctctagttcttccctgcgattttctccaggctcccctttccttccccttggccggcgctgcgcgcttcgaaggcgtagctctgtgcctctgagctaacatcttcctagggcaggggcagagcaggggtcagagcgggccatgaccctggcgtgacctgagggtcgcccccacctgcgctctctgggcctgccgctcatattggcccgccagcccagggcgcgacgagggcacaccgcggccttcagacaacgcctggacttcgccgcggctcagtaggcctgcgcctagggtccaggcgccctggctgtgccctggggtctatacgagccccaaccccacagtgggcctagagcgcaaagaggagtcggcttccctggcaccgccagcgcccgctgtctgctttggggaccctcgcggagtgtgggttcgagcgctctgcactcttctcaccgggcttcttcccggctcctgctcttccgcttggcccacgcccgcatcctcgcccctaactcgct

SEQ ID NO: 94291 - DNA, 799 bp, Homo sapiens
  chr5:76936016-76936815
  hyper
ggctgagagcagatgcgagaggaattgtgtgtgtgtgtgtgtgtgtgtgtgtgtgtgtgtgtgtcctcagctgtatgtgtgacagggaccgagcaaggagacaaaggaggcggcaaagcgaactctcgggcagttttgtttcctccttccctcctgcagcccgttcgcctcctctcctgcacacacacgtgcgcgcgcacacatatgcacacacgtgtgaatgcagggtattggccacaccagtttcttctgagctgcggagaccgcttcccgggaagctccgggccggactgggtttcagcggctgctgcagctgctaccaacgcggcctatgtgggactgggcgccggggtcgtggactcaggctcgcggcgtgtctgggagccgctagggtttttggcaagcggccgcagcccttctgagaaacgctttgcctgggaggagaattccgagacctaaagcaaacaaagtctccccaataaaagctttctttgcccccaaacaaaacctcaaatctagaagctagagcgctgggagcgcacagcaaaaggaggccagacagcagcccagggaggggcggcgtgagctcaggacggtgactcgggagtacgcaccggcccgcgcacgtccagggactcgcaggaggtttctgcccacctgggtggggcttgcagggtgtccacaccggaacgcagggtcagaagtggggggaaagtggctaaggaagagacagggagacctggctccagaaccctgctcccagaaataggcaggtccgccaggccgcacagcctggctc

SEQ ID NO: 94292 - DNA, 26 bp, Homo sapiens
  chr5:76937397-76937423
  hyper
gctcccccctgctcccggttccctct

SEQ ID NO: 94293 - DNA, 30 bp, Homo sapiens
  chr5:76938430-76938460
  hyper
attaaatgtaactttcggctgcttgagttg

SEQ ID NO: 94294 - DNA, 378 bp, Homo sapiens
  chr5:76939435-76939813
  hyper
cggagccaaatgccaagcaacgttcaggatccacacttggggctttctttctgttttttaaacgccggtagcaggctgcgtgtgcatgacacgtgtacttgtgtgtgcttgtgcgagcagtgcgtgttccttgcctgttcactcacacggagggggcatgccaggcgctgcggaggggcagaaacctgccccaaagagtctcatttcctatcccacccagaagcctttcgcaatacacgagctcgacatatacacttttttcttttctgcagtaaacagtttcccacacattcgagtttgcaaacttcaaccagacagtccacccgcctgacttttcgtgggtgcaagggccggtcccttgctcgttttttctcccat

SEQ ID NO: 94295 - DNA, 151 bp, Homo sapiens
  chr5:76940344-76940495
  hyper
cgagccgcctgcgctcgcccactccccgctcgctccccgcccggctcctacgtcccaatccttttcttttcgggcgcaattagtgccaggtttgcaacagacgccgggactcggccgctccagcgactctacgcttcggggggtggggtgg

SEQ ID NO: 94296 - DNA, 641 bp, Homo sapiens; identical to SEQ ID NO: 29715
  chr5:76940857-76941498
  hyper

SEQ ID NO: 94297 - DNA, 389 bp, Homo sapiens; identical to SEQ ID NO: 7912
  chr5:76941512-76941901
  hyper

SEQ ID NO: 94298 - DNA, 23 bp, Homo sapiens
  chr5:77047288-77047311
  hypo
caccgcgccggccagcctgacca

SEQ ID NO: 94299 - DNA, 244 bp, Homo sapiens
  chr5:77140527-77140771
  hyper
gctgagccattttcccgcgaggcccccagcggcgcgggggctgtggggaggtggtgtgggagtacggtcgctgctgcgcggcgtggggagaactggagcggctgcccggacgcccccgccctggtcccgggtactttctcggcctggctgcagccgcgtggatgtctctcgaagcctccaccctattctccttattgttatttccactcaccccccaaccccctcccgccgtcctggttccaga

SEQ ID NO: 94300 - DNA, 134 bp, Homo sapiens
  chr5:77147516-77147650
  hyper
cggcgtgcatgtgtgcgtgtgtgcacgcgcgagaagtgcgtgtgtaggcgcgtgtgcaagtgcgcgcgcgtgtgtttacacttccagaagtcaaatcctttctaggactcccccttgcttcacccggaagtgtt

SEQ ID NO: 94301 - DNA, 260 bp, Homo sapiens; identical to SEQ ID NO: 461
  chr5:77147872-77148132
  hyper

SEQ ID NO: 94302 - DNA, 283 bp, Homo sapiens
  chr5:77148386-77148669
  hyper
tccctgaggagctgacgctgaacgcctgaatgggcagcgcgccaacttcgctgctccaggaggggggtggggagggagaggaggaggaggaggatgaggagagaggggaggtggaaggctgtggtaacggtgggcggaggcgggaccatggcgcatgctccgcgacgtcccgggccgcgggcggaatcccccggctaacctccttgggggtgagactgggtgggatgggggtcggtgggggaagttgcatggggtgttatacccgcccggttacaggccgctg

SEQ ID NO: 94303 - DNA, 32 bp, Homo sapiens
  chr5:77253986-77254018
  hyper
cggcgctggtgcccacccggcctccccgtggc

SEQ ID NO: 94304 - DNA, 367 bp, Homo sapiens; identical to SEQ ID NO: 463
  chr5:77268367-77268734
  hyper

SEQ ID NO: 94305 - DNA, 503 bp, Homo sapiens; identical to SEQ ID NO: 29722
  chr5:77268735-77269238
  hyper

SEQ ID NO: 94306 - DNA, 184 bp, Homo sapiens
  chr5:77269263-77269447
  hyper
cgccagcaccaggggcgggctggagggggaccggcgatcagggaaaccttactcctcgcaggcttcaacctgctggggcgtgtttacgtccgcaaagtccgataatatattttgtccccacttcttaggagctgattcttcttaaaatgcattgccacgttatctctaacgttggctttctgac

SEQ ID NO: 94307 - DNA, 30 bp, Homo sapiens
  chr5:7763815-7763845
  hypo
ctggcatcgtgccctcgggtgttccttttc

SEQ ID NO: 94308 - DNA, 90 bp, Homo sapiens
  chr5:77655493-77655583
  hypo
taagccaccgcgcccggccggtacaaattaatttaacacatcttttgataatctcatccttggtgttggaaaagacgggaaaatccaaaa

SEQ ID NO: 94309 - DNA, 19 bp, Homo sapiens
  chr5:77806301-77806320
  hyper
ggcccgtgcccgcagaacc

SEQ ID NO: 94310 - DNA, 30 bp, Homo sapiens
  chr5:77943372-77943402
  hyper
acgtaggtcacccaccgatggtaacctaca

SEQ ID NO: 94311 - DNA, 106 bp, Homo sapiens
  chr5:78105439-78105545
  hypo
ggtcaggctgagggccgccagagcctgcggccaggcctaacactaggcagagacgactctgcagctgtctgctcacactcactgccagtcacgcttcactccactt

SEQ ID NO: 94312 - DNA, 368 bp, Homo sapiens
  chr5:78407583-78407951
  hyper
ccccacgcccaactgcgggtataaagaggcaggctgcggactcggagcagctcggggctgcgcagcgggaaggctcgcctagtcggtccgcatccgtgtcgaccacctgtctggacaccacgaagatgccacccgttgggggcaaaaaggccaagaaggtgagtctccaggggacccgagggcgctctccttcccctcccacctgctctgtatcccagcctctgggagcgcagaggggccctcggaccctgcctggtacccatcatcctcctactccctcccctccctcagcctcagaccagaatgtgcttccagaacttctccagcaggaccccaaggcgcctctgagcctccccactcctgcccca

SEQ ID NO: 94313 - DNA, 259 bp, Homo sapiens
  chr5:78408016-78408275
  hyper
cgccccagatctatgtgatccttgcctctcagacccaaaggcaccctctgagccctccctgacggctgggtgtccccagaactccgagccttccaatatcttctgaatctggcaccccaagaccagaaaactccctagagatactgctcctagccccgcaggcgcgatatcccgtccccacggagcccctccgcatctgtgtccgaggccgccgcgagcgccctctgcacccggcgcgcccagaacagggaggagtgca

SEQ ID NO: 94314 - DNA, 164 bp, Homo sapiens
  chr5:78408297-78408461
  hyper
cgcctggatctgcaccgcgggtgtcggggccgcctccccgccgggttctcgctgcacccaaggcccaggcgctggttgggtgattgcagattttcacaggcaatttgatgtccgtgatgacagaaaaatgtcatccgaaatgtcagcctcgaaaacatggttta

SEQ ID NO: 94315 - DNA, 20 bp, Homo sapiens
  chr5:78469259-78469279
  hypo
agtatttttctatttcgaaa

SEQ ID NO: 94316 - DNA, 156 bp, Homo sapiens
  chr5:7850282-7850438
  hyper
gctgacactggtagtcgcctgagctgtactctttggggcccaggcgccttggcgggagctcaccctccctgtctccccagctgaccctgccgcgcccccttcatctccgcacgctcccacccggccccctccacaggctgtccagccccgcccctc

SEQ ID NO: 94317 - DNA, 179 bp, Homo sapiens
  chr5:7850439-7850618
  hyper
gaacccacccctggtagtgaagccctgcccccagggtccctgcccgaaggtgcgctcctcctctagggcccctctactctgtgagctctgtccccgatccctagcggtgcagcccctcccagggcccctcctcgttgtgagctcctctctccagtccccggcggcgcatccctgccccc

SEQ ID NO: 94318 - DNA, 377 bp, Homo sapiens; identical to SEQ ID NO: 29462
  chr5:7850922-7851299
  hyper

SEQ ID NO: 94319 - DNA, 30 bp, Homo sapiens
  chr5:78533526-78533556
  hyper
ctgggctctactggtcgcttttggtttact

SEQ ID NO: 94320 - DNA, 115 bp, Homo sapiens; identical to SEQ ID NO: 40564
  chr5:78552615-78552730
  hypo

SEQ ID NO: 94321 - DNA, 35 bp, Homo sapiens; identical to SEQ ID NO: 40565
  chr5:78881941-78881976
  hypo

SEQ ID NO: 94322 - DNA, 165 bp, Homo sapiens
  chr5:78985096-78985261
  hypo
cttttgagcagggcacgcctagctttgtttctcattgggtcattttactagcaatgacagcctgagctgctggagctcttcggagtctcagtttcctcatctgggaaaccagcactacagtaaaaccttctacaggtaccaccacagaatcgaggtaatgaaagc

SEQ ID NO: 94323 - DNA, 16 bp, Homo sapiens
  chr5:79330913-79330929
  hyper
ctttctctccagcccc

SEQ ID NO: 94324 - DNA, 205 bp, Homo sapiens; identical to SEQ ID NO: 29728
  chr5:79330930-79331135
  hyper

SEQ ID NO: 94325 - DNA, 108 bp, Homo sapiens; identical to SEQ ID NO: 7923
  chr5:79331229-79331337
  hyper

SEQ ID NO: 94326 - DNA, 3 bp, Homo sapiens
  chr5:79331476-79331479
  hyper
cgc

SEQ ID NO: 94327 - DNA, 209 bp, Homo sapiens
  chr5:7954008-7954217
  hypo
attctagaaaataaacgcatgagctgcaggaaaacaatgaacaaatattttaaaattaaaagggtatgtcagaagtttcgatgaattgtatagaatacaaaagcagaataactttctgtgggaaagtttaatagaatgcttcggggatttatcatgctctgattttttgccttactgagagaattgcagccattcgaataaaattcctt

SEQ ID NO: 94328 - DNA, 30 bp, Homo sapiens
  chr5:79550635-79550665
  hyper
accaagacagctccacgtggccactctaaa

SEQ ID NO: 94329 - DNA, 34 bp, Homo sapiens
  chr5:79554316-79554350
  hypo
acaggtgtgagccaccgcgcgcagccacaaggca

SEQ ID NO: 94330 - DNA, 16 bp, Homo sapiens
  chr5:79783240-79783256
  hypo
acagtctagctctatc

SEQ ID NO: 94331 - DNA, 30 bp, Homo sapiens
  chr5:79784399-79784429
  hyper
agctggcagagtgtgcggctcgcttgattc

SEQ ID NO: 94332 - DNA, 618 bp, Homo sapiens
  chr5:79864827-79865445
  hyper
tgaggatgctggcagcgtctccacggtccccgccgacccctggaaccaggcgcgtttcctcagtttttcctgagagcaggaggaagcgagctcaaggcgctgtcggagaagggcaaaggaaggtgactggggcgacagctccagggcaccgatgggggcggggtgcgcgtttcgtcgcctcatctctgagccagggcaggcagctggcgggctaaggcgatcaccatccatgaaaacgggttctgcccacagccgctgcggagcggtccctgcgccgctcgcccgccggccggacgcggccctcccttgggaaatggtgcgtctgaggggcgcagccactgcccccatcccggagcaggcgcacctctgcacccggctctctgctaagggggtccggtatcctggtgccaaggctgtgcgcacctgagaagggcgggaaccggctgcccgcccctgtgtggctcctggaagcaggagctcctggaagctgcaaagggctccgcagtccccagcccgcccccagcgcccagccggcacctcctgctgcccagctgccgaggcacctgcggagacgcgcccaagtcagcccctccggagacgcgcccaagtcagcccctc

SEQ ID NO: 94333 - DNA, 140 bp, Homo sapiens; identical to SEQ ID NO: 29732
  chr5:79865522-79865662
  hyper

SEQ ID NO: 94334 - DNA, 411 bp, Homo sapiens
  chr5:79866099-79866510
  hyper
gcagatctcggtagatgccgcccagtccccgccctgcttgcggaaagaggcgggcgactgccgcgaagcgctggagctgggacccggagcgcacacctcgccagacgcccgggcagcgaggcgcttccgctgggggtgacgcgtcggctccaggctctgcgcaggtgagggcggcaaggctcctctggacccaggggggccagcagctgctggaagctccgccttctgtccccgtaagtcccacccccgtcccccgcttcggccaccgcgcttcggccacggcgacttggccaacaacagcggcagcagggtctccccattgagggaagcacgcacccctacgtcacgggctttggctcctccagtccgtatccctcccctcagctcacatccacccgctggttcatgggt

SEQ ID NO: 94335 - DNA, 169 bp, Homo sapiens
  chr5:79911156-79911325
  hypo
ggaagacagcagccacgcctgcatatgggcttctgcactgctagcctcaaggctgccagagtgcaaagaatgccaggataatggctttatccacgtgtggccttttgacacataagctaatgactatattccaggtacaaatagttctttcccacgagctgtttctgca

SEQ ID NO: 94336 - DNA, 302 bp, Homo sapiens
  chr5:79947482-79947784
  hypo
ttgtgtgttcagatgcgttaaagccactttcgtagtttattttgtatcaactggagttttttacaactcaggtgaattttagctttattgaggggaattgatctaaaacactctttacgccggtttctattgacttgggttaatcgtgtgaccgcggtggctggcacgaacttgacgaaccctagggttagtatagcttagttaaactttcgtttattgctaaaggtttatcactgctgtctcccgtgggggtgtggctaggctaagcgttttgagctgcgttgctgcgtgcttgatacttg

SEQ ID NO: 94337 - DNA, 324 bp, Homo sapiens
  chr5:80255751-80256075
  hyper
tgtcatgagtgtgtgcgcgtgtgtttttgtgcatatgtgcgcgcattgtgtttgtgtgcatttgtgagtgtatttttgtgcgtctgagtgtgtgcattgtggatctgggtgaatgtactggtctgcgtgtgtgtgggtgtgcgtgtgtgtgtgcgcgcgttgtgcgcgagtgtgcgagcgcgtgtgagcgggtgtgtggtgcggccgggcgcctccacctccctgatccgccccatcccggcgggcgcccgagcagaggcagcggcccgggccggggcgggcgagggagggacgcgagccggggcaagcgggctgcgccaccgc

SEQ ID NO: 94338 - DNA, 58 bp, Homo sapiens; identical to SEQ ID NO: 7929
  chr5:80256312-80256370
  hyper

SEQ ID NO: 94339 - DNA, 138 bp, Homo sapiens; identical to SEQ ID NO: 29736
  chr5:80256428-80256566
  hyper

SEQ ID NO: 94340 - DNA, 18 bp, Homo sapiens
  chr5:80256790-80256808
  hyper
gccacccagggccggcgc

SEQ ID NO: 94341 - DNA, 110 bp, Homo sapiens
  chr5:80256887-80256997
  hyper
cgcactcccttgccgtcctaatccggggatcaggggtcgggggtcgtgaaagagtgcggggactatgctccgaaatccccccgcgtcaccagtggcgggacatctccacg

SEQ ID NO: 94342 - DNA, 203 bp, Homo sapiens
  chr5:80689592-80689795
  hyper
ggaatgaaggagtcccgagagccacacatttgggaaccaccggtctcggccatgcccagcgcgggcgcactgttgcaacacccctatccctggctgcgcagggttcagctctccgcaagtaccttcctcgccttcctaccccccccagcccccagccgccgccgctcccgcagccccggtcccgcgcctccccgcagccccgg

SEQ ID NO: 94343 - DNA, 304 bp, Homo sapiens
  chr5:80689879-80690183
  hyper
cgccggctggatggcttggctcatgaccacctcgccgggcgccggccgctccatggccagggcgagagcgctacgcctgcggcccccgacaccccaccatgcccgctccgcccgccccgccctccccgcccagctccagagggcactggcgccgcccgcccgggccgcgaacccctggccgccaggtggtgggagctgcgagtgagggggcccgcactgtcatcccaggactatcgcgagtgggggaaaaccagcgctctcgggtctcaggagaagtctgggaagtgcgcggggagggggctcc

SEQ ID NO: 94344 - DNA, 26 bp, Homo sapiens
  chr5:80887672-80887698
  hypo
aggagccaagatggccgaataggaac

SEQ ID NO: 94345 - DNA, 143 bp, Homo sapiens
  chr5:80895313-80895456
  hypo
acagtagtcacagtccgctgatcctagagagaaagagggagaaactgattgagattgattttccttggtaaagtctgagggtctcaggctcaggaaaggattttaccaaggacacgtgcctttgcacacgctgttccctctgt

SEQ ID NO: 94346 - DNA, 89 bp, Homo sapiens
  chr5:81075041-81075130
  hyper
cacagcacagacagccgccgtgccagcttccctgttttgcactgccaaaacagctccctcctgacctgcagctccgcagaattccaaac

SEQ ID NO: 94347 - DNA, 103 bp, Homo sapiens
  chr5:81266149-81266252
  hypo
tgtgagtagatttttcggtgaacctcagcgatcagagaggagagctacaggagccctgcttgaaccttgaaatgctatgatgacagaccgtagccttaaagca

SEQ ID NO: 94348 - DNA, 38 bp, Homo sapiens
  chr5:81266652-81266690
  hypo
ttcttgttttcatctgtgaaatacgtttttaaggtaaa

SEQ ID NO: 94349 - DNA, 21 bp, Homo sapiens
  chr5:81575044-81575065
  hypo
ccaccgcgcctggccatttaa

SEQ ID NO: 94350 - DNA, 30 bp, Homo sapiens
  chr5:8208408-8208438
  hypo
tcggtatatgtgttacgtgtatgtgtttgt

SEQ ID NO: 94351 - DNA, 784 bp, Homo sapiens
  chr5:82767026-82767810
  hyper
ggcaagctctgtgggcgcgtaaacacgctgtaaccaagttctttgctgattttacagttttgtgtgctcccgagaagaagtgatcgtactcaattgtctattgctggcctgccccctaagagcctgggggctcctttcccctaacccagaactagctgcacggggggcggggaaatgggggtggggaaggagtgggagggcagtggtttccgcgagcagagcgatgttactgagtgagtccctgaatggggagcgctgctgtccccaagccgattggtacttcttgtcaggaagaaacgccaagaggtgggagtgcctggggagggaggcaggcggtccctaccgcaggcgcggggagctgcctttccgcccctccgcctgctttccaagcctggactcttaggagtggctgaagctgcggagcgcttttggagcctgtgaatgaaccctcctcctctccctcctccttcttctcgctgagtctcctcctcggctctgacggtacagtgatataatgatgatgggtgtcacaacccgcatttgaacttgcaggcgagctgccccgagcctttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgcagcgctgcagtgaattt

SEQ ID NO: 94352 - DNA, 1152 bp, Homo sapiens; identical to SEQ ID NO: 29742
  chr5:82768217-82769369
  hyper

SEQ ID NO: 94353 - DNA, 408 bp, Homo sapiens
  chr5:82769910-82770318
  hyper
accacttgaacccaacgctagggccccgccccaggatattgcaaaagaagggctcctaatccaaaacttaaacttcctcaacttcagggcgggcgtcggacgggaaagtggagagaaggcgggcagtgggaggaaaaaagaaagggaaggaagggaagtggaaggaaagaggaccgtggaggggaggaaaaggagaaaggaacggagatggggcagatggcattcaaacagccaggaacggaccggaagggttcgtttcggggtttgggtctgaatttcgagactcgttttaggatactcttttccctttcccagcggcaacaaatgtgactgcagaggcgtgccgggatggaagggtgggaaagaactagacaagcggaggtggtccagccccgcccaaaggggctg

SEQ ID NO: 94354 - DNA, 49 bp, Homo sapiens
  chr5:82770563-82770612
  hyper
agagccgagtggcctcgcccccaggattcggggccggctgcttctggag

SEQ ID NO: 94355 - DNA, 172 bp, Homo sapiens
  chr5:83017828-83018000
  hyper
ggctgttggagcagccgggaggagggagcggggctggccctgggactgaggacaagcaaacaagctcgaggggcccgcggccagggtggaggcgagacgcaggccgtccccgagttgcagcgagcagggcccggtgtcgcggagcgctggggacgtgcggggattcgcggcc

SEQ ID NO: 94356 - DNA, 30 bp, Homo sapiens
  chr5:83527381-83527411
  hypo
ttaaggttacatctgcgcagagtacacatt

SEQ ID NO: 94357 - DNA, 94 bp, Homo sapiens
  chr5:83678217-83678311
  hyper
acccagccaggcaagcgcggccacataggcaagcgcggccacataggctagacgcactatcttctcctctaccccgcgccgccctccacctcgg

SEQ ID NO: 94358 - DNA, 265 bp, Homo sapiens
  chr5:83678989-83679254
  hyper
gaggattctattacccgcggatccctcacaaggggccgcccgcatctgtgagcgcaggagtggcacagctcccccaggcacagctcccactcgcctccccacacaccctgctgcccccgctgcccttttccggcgactacttcagccccggccagcggtgagacccaggtcagcacaagggtttgtatggacaagctgcacctcgcaggggacctggaagtcgcctaaactactccagcaggacactcgtcgaagtcctgcgttt

SEQ ID NO: 94359 - DNA, 74 bp, Homo sapiens
  chr5:83679569-83679643
  hyper
cctctccacctcacccgcggccaaaacgcccagcgccgggtctgggtttgcgaacggctcagcccaggccctgc

SEQ ID NO: 94360 - DNA, 725 bp, Homo sapiens; identical to SEQ ID NO: 29747
  chr5:83679644-83680369
  hyper

SEQ ID NO: 94361 - DNA, 58 bp, Homo sapiens
  chr5:83680693-83680751
  hyper
cgtgtgagtctgagcctggcaggcgcgctccccactcccccggcgcccgcccgccctc

SEQ ID NO: 94362 - DNA, 30 bp, Homo sapiens
  chr5:84126401-84126431
  hypo
gctgtgctggcctgccgcttgagccaacgc

SEQ ID NO: 94363 - DNA, 206 bp, Homo sapiens
  chr5:851688-851894
  hypo
tagttaacaattcttcgttcttgcagtcgtgaacgtccatgatacagtggctctgcgctgcctttggtggctcctccctggtcctctaaatgtgacaccaggcggatgcggggccacaggaccctggggcttgagtcacacaagaatgtctctgggagacccgagagactcacagttatgaaacaggaccatggttctttggccgg

SEQ ID NO: 94364 - DNA, 32 bp, Homo sapiens
  chr5:86308932-86308964
  hypo
gcgtgagccaccgcgcccggcctagtattcat

SEQ ID NO: 94365 - DNA, 30 bp, Homo sapiens
  chr5:86795866-86795896
  hypo
catggggttgagggccgtgggcagagtaaa

SEQ ID NO: 94366 - DNA, 225 bp, Homo sapiens
  chr5:86837505-86837730
  hypo
gtgtgaactggcatacgatgtaattttgaagaatagtataatgaaggtatgttgaattggcgagatgcaagtccagcagtatattataacatcgtcattttacttcagattctggtttcatatacacttccgcctttggtaatttacataaacatgcatagtctatgaataatgcataaaccttattttaaatgcagagctttcaactctcgcagtgcactagta

SEQ ID NO: 94367 - DNA, 175 bp, Homo sapiens
  chr5:87436594-87436769
  hyper
cttagtcggcttacccgtcctgttccaggagccgacagggaacagcccacctggagcaggtcttgggccaccactcgccccgccccccgtctctactcctcactcgctctccccgctcctattaagcagccaacgctgggtgatctcctctccagttcttcgtggtttcattgta

SEQ ID NO: 94368 - DNA, 30 bp, Homo sapiens; identical to SEQ ID NO: 29749
  chr5:87955350-87955380
  hyper

SEQ ID NO: 94369 - DNA, 63 bp, Homo sapiens; identical to SEQ ID NO: 466
  chr5:87955602-87955665
  hyper

SEQ ID NO: 94370 - DNA, 101 bp, Homo sapiens; identical to SEQ ID NO: 29751
  chr5:87955839-87955940
  hyper

SEQ ID NO: 94371 - DNA, 505 bp, Homo sapiens; identical to SEQ ID NO: 29752
  chr5:87956158-87956663
  hyper

SEQ ID NO: 94372 - DNA, 521 bp, Homo sapiens; identical to SEQ ID NO: 29753
  chr5:87956679-87957200
  hyper

SEQ ID NO: 94373 - DNA, 287 bp, Homo sapiens
  chr5:87961738-87962025
  hyper
acatctcctgcattccgtttagcggaatcaattaggcaagacagaccctcagattccccaccccctttccatttttgtcaggtctatatacgtcctaattatttcagtttgggatgccagagctgtttcctggatagacctgatcatccttaaacaaaaagagaggaggcgcacacgtgggttgtggcgtaaatgtcactttcatttccaatgctaggcgcagagtaagacagaacatttttttaacactttgacaagaggggaggcgatctcgtctccatcatgtc

SEQ ID NO: 94374 - DNA, 302 bp, Homo sapiens
  chr5:87962615-87962917
  hyper
gtttttactgtctctcggctgtagtctttcattctcacacgctccccggcgatcttgaaggagtttttactttcggttatctagctttatgaagaccaatacactcatacagctagataaccaaagataacaactcgcttcccacacaggcctctgtcttcctcttgccagactccaggtcctgatcctttctggcagtaccgaagagtggtcgtccaggatacttgccgcgcttaagattcctccttttatgtaaatatgacctggtttctgtttgtgtgtgtgcgcggctaaaacatcca

SEQ ID NO: 94375 - DNA, 55 bp, Homo sapiens; identical to SEQ ID NO: 29755
  chr5:87963456-87963511
  hyper

SEQ ID NO: 94376 - DNA, 446 bp, Homo sapiens
  chr5:87967773-87968219
  hyper
aagaaagggaggaaacggaacccgactctgcggtgctgggcccaaggcagccacagctccaaaggggcccccggccgtggccgtgacttgacagagcctccggtctaacttctgatcaattccactgctctcctgacccctcaagacagtcccccattcaagcaccgcgggtacatttgcaagataaaacgccgcagacactaatgcaaatacattgcccgagttcccatcaccctgggttcctgcagataattccaggccacagaaaggagttcttgccttcctcagccgggtctagactctaagcaaaccgcaaagacctagctccgtttggataccagaagcgtcttaagctgaaccgctccaagtaccaataactaaccatgatggttgcatcttgatgaatctgaacttgggataaccctgtaaagcggcctctcacctcc

SEQ ID NO: 94377 - DNA, 198 bp, Homo sapiens
  chr5:87968488-87968686
  hyper
ttcccttttccaacgcgaagatttcctggcatctctctgcgattgggggtcaagccgctggataattaacagtactggctaagaaaactcacgagatcaacaggtttaacatccgaggcacacaatcaattagctgaagcaaagccccggactggccctcggagcggcccgcagcgggactctgcgggcaccggctag

SEQ ID NO: 94378 - DNA, 219 bp, Homo sapiens
  chr5:87968772-87968991
  hyper
cgatactcacttgatctccctgcgccaggcaatgctgccccccaaatccagctgggcaggaaccgaggcgccggctgaaagacaagatccaaagtcacagcacggccgcagcacacaaacaggcttctttcggcgtctccaaaaaaaaaaaaaaaaatgtttttctcatcattcctctcccctgctcaacacatttaaaactgccgctcaattccacat

SEQ ID NO: 94379 - DNA, 73 bp, Homo sapiens; identical to SEQ ID NO: 472
  chr5:87970041-87970114
  hyper

SEQ ID NO: 94380 - DNA, 803 bp, Homo sapiens; identical to SEQ ID NO: 29760
  chr5:87970115-87970918
  hyper

SEQ ID NO: 94381 - DNA, 624 bp, Homo sapiens
  chr5:87971517-87972141
  hyper
agggaagcaaaagaacgtgtgtgtggtggggctggaagctcagggcaagagtctgcgtgtgcggccggaaggctggcgagtctgagagccgcgcggtgcagaaagaaggcggcggcttgtcctcccccggggccggcactggtcccttggcaccccggcctgggctcggctactgccgccgccgcccgcgctctcgggctccgccggctgccgctccgtgttttcccccatcccggcttcacgttcaaggtttagctgcgaggtcacgtccattgacgtcagctccctgtctccctctacgtccggctacatttacatacatcaaggaaattagggcattaaaaaaatatgcaaatcctgcgcgaagaggagcgggtgcattcctggcgcgatcgccttttattgaagcttttaattaaaggggccagttggcgagcccctgaaacaaccgccaaaaccccccaaaagagaaaaataaacgctgtagccttcgagaacggttgtttcggctcctgttctgtgggcggctgaggaccgccggctgcccggctcggagaagaacaggttagaggaggcagctccagcccatgcataatcagggctccgcggcgcctccattctttc

SEQ ID NO: 94382 - DNA, 30 bp, Homo sapiens
  chr5:87973581-87973611
  hyper
ggtcagatggctacacgtatgacattaaaa

SEQ ID NO: 94383 - DNA, 1076 bp, Homo sapiens
  chr5:87973988-87975064
  hyper
atgcgtgtgtatgtgcgcgcgcgcgctatgtgacaaggaacacagagaggtacacctcttatctctgatctctctgtaatctccttttctgtttctaatctcccttattggcgcatggtagtaacccaaagcgtgtgaaccgtcaccgtcgctgccgtgtgcgcgctgtggcttaccccgagggccggtggctcggtgactcgctggctaggtgggtgttggggaagagggtgggtagcgtcgctgccgctgccgccgcgggtccgggtgctctgtcccagcccggcagccgagcgcgcagtgtcggagccccctcccaccccgccctcacccccatcctcccctcccctcccttctgcgcctcccccaaccccccgccccgcattaccatatggaggccgagtccctgcgaatcacagcagcagcgggaggtatttgaataagccccgcaaccccgcgcagaccccaactcctccgagagcagcatgccctgcaccaagagccaccactctggccggtaacctggcagcgacagacaactccccaaagtgccctgcgcgcggtggagagagggtctgctgagggtactgggtctcccacttgctacttttatattaacttgacatagaatcagacaataaatgagaggagagagaagagaagaggaaagaagagacagaaaaagggagaggcgctgtaaaggggagagagaaaacagaagcgagaatgggagagaaaaaggagaaagagaacccaaagggttgagttaaagagagagtaaaatggggaccgggtggggaaacggtgggagggggagaaatacccaaatatctgaatttggacttctcaagctaaaaataccacctcactgaacttcacaacctccaatgagacacgtgtttctcccctcaccaccacgtcaccgaatgattaatttgccgtctcaatcagaaataattatttagaattgtataacagatataggacttagcagaaagaagctcattttatgaaacatagcgaaaaatatatgacatttaaagatgatgttggctacctcacggtaaaaattaagg

SEQ ID NO: 94384 - DNA, 461 bp, Homo sapiens
  chr5:87976202-87976663
  hyper
tctcctttctctccccgaaggtacttccttaggccggcagtgtcgctacggtggtagccaggtgagcacgggcacagtcccggggcgggggcgggtagagcggccctctctcgggagctccggtgggtctgcgaacctgccgggagcggaaggctgagtggcgctgggggcccgcgcggggctcctggctcccgccggcaggggaacagcgacacctactggccgcatgggtaccgcgcccgggccgtcagggctgccctgggacggggtgccgggctccgtggacttgggaggccgcgggaaacttcaccgaaggctctgcggactgctctaggactcgtccgccctggagaagacaaagccacgctttctggagacccctgggaggactgtaggatggaactgaacacacaggcacacacgcatgcccattttttctggggaaccggataaaccctcag

SEQ ID NO: 94385 - DNA, 87 bp, Homo sapiens
  chr5:87979692-87979779
  hyper
gtaacaaggaggacacgtacacagcctttacacacttaaaagcccttgcgactccctctgaattcttagttacttatgacggccttc

SEQ ID NO: 94386 - DNA, 86 bp, Homo sapiens
  chr5:87979899-87979985
  hyper
cttattggtaggtcatcagcagctgatcagacatggtaatccaataatttttttgaatacacacaatttttcgttgaagttaattt

SEQ ID NO: 94387 - DNA, 164 bp, Homo sapiens
  chr5:87980397-87980561
  hyper
agggtgcccatctctcggctatgggcgggggctggaccctgacaggtacggactccgcgggaccccagtgtgcttacctcgagcgaggccctggcaaatggtggcccagaagcatcaagtttcctctcccagccgttgtgccagatttcccctcctgccttctg

SEQ ID NO: 94388 - DNA, 704 bp, Homo sapiens
  chr5:87980621-87981325
  hyper
tcacacacgaggattacttgtgacttttagaggcaaaagcttgcttattcagaggagagagggagggggagagggagaaaggaggcgggagggaggagagacgggggagagagaagtaaaagggggatggaggatgaagaggaggtggagaatcagaaggtagtgcgggcgttgttagagaaggaggaggaagaggaggaggaggaggagggatgggaggggtagggtggagtaaccaaagatgggctgggatgggacggcgaggaataaattgctccccacccagctgcggtgcgacgcccccagcgtcccaggggagccggtgcgtcagctcacggctggccaaggcggggccgtacaaaagctagcgccgcgggacccccttcatgggcttctaccctagcagaccgagcgctggaggccgctccacgcgcgagctcgaaccacggagggctctcagctcggacaagcgtcgctgtctaagagctccaagctccacggaactttgattttatgcccgggagcccggtcatccacttctgcatctcagacaagcgccggaggctcgtgcagcttcctcgcgtcctcttcctggacgcggggcgcccaccttagtcatagcccctggtcccggcactgctcacgccgtcggtttccccactgcccaggctccctcagcccgaaccctgcgtctctgttcacat

SEQ ID NO: 94389 - DNA, 30 bp, Homo sapiens; identical to SEQ ID NO: 29769
  chr5:87983365-87983395
  hyper

SEQ ID NO: 94390 - DNA, 30 bp, Homo sapiens; identical to SEQ ID NO: 29770
  chr5:87984984-87985014
  hyper

SEQ ID NO: 94391 - DNA, 293 bp, Homo sapiens
  chr5:87985348-87985641
  hyper
aataatttgggactgcgataaaaaaaaaatagccgcagtttcgaagtcccagagctttatcaggaagcattggacgcccctttctcctccagactggggcgggcttccagggatgccccctccgaccccgtcaccagcggaggactcatctgccgcggggctgccggaagctctcactcccgccagccccctgggtgctattgatgcggaccttggaggtgcctgcggcgtggcctaacacgtggacgcggcccataacccgccccggctgctgctttcgcctgaaggcggac

SEQ ID NO: 94392 - DNA, 157 bp, Homo sapiens
  chr5:87985895-87986052
  hyper
taaggcaaaagaccccgagccttgtaaacccttttgtcagaacgcgaattaatgtttccaagattttttctcaaaagaattaagagctctagaggcgcctcttccactcactagggcaccatgtcaaagggactcgtcatggcgatttacaaatatc

SEQ ID NO: 94393 - DNA, 83 bp, Homo sapiens
  chr5:87986310-87986393
  hyper
cacccccctagctcccgcgttaaaatcaccagagtcaattcccggcgtcggtctccacagtcaacccccgccccttccccatt

SEQ ID NO: 94394 - DNA, 30 bp, Homo sapiens
  chr5:87987135-87987165
  hyper
tatctgaaatctaaacgcaatttaagcgcg

SEQ ID NO: 94395 - DNA, 499 bp, Homo sapiens
  chr5:87988152-87988651
  hyper
actgtgagcacagcccgcttggggttggtttcacatcgctcaggactggggttccacgcctggagcgcagttaccttgttgcgcccgcatgtgcctcgggaagtgcatctgcgaccctaggtcggggaccaccgcgttagtgagggacagccgagtcggggggcagtctcccctggtggacagtatgaagtttggacagcaggggaaggaagagaggaactggaggttgggggaggctagagagcaacgtttgctctctgaacttttccttctcccctttgcgccttctgaaatggcctgggagttagcagaggtcgggaagctgctgtaagagcgaaacgttgccccacttggcggtgtccaggtctcgcagtaggctcgggtcacaggagggagggggtaggggttcagctccgccgaaagagttagctaccgtcccctcctttctcggccggagacgttaagagttcccggtgaatgacaccgtccagggtcagaa

SEQ ID NO: 94396 - DNA, 144 bp, Homo sapiens
  chr5:87990308-87990452
  hyper
atataaaaaagaacccgaaaagcctcgcgttttttctcttgtgttttcctcacttttctttttctcaaactgcaaaattttagtgcctgaatggcgaatggggaaaaggactggccggagagtgaggcacggaagggaggtctg

SEQ ID NO: 94397 - DNA, 30 bp, Homo sapiens
  chr5:87991044-87991074
  hyper
aaaacccttgtgagccgcctaaaaaccgtc

SEQ ID NO: 94398 - DNA, 30 bp, Homo sapiens; identical to SEQ ID NO: 29777
  chr5:87991432-87991462
  hyper

SEQ ID NO: 94399 - DNA, 30 bp, Homo sapiens
  chr5:88015167-88015197
  hypo
aataaacagcctccacgcagcaatgcatac

SEQ ID NO: 94400 - DNA, 259 bp, Homo sapiens
  chr5:88178852-88179111
  hyper
caataatctttacttcgtccagcgttgaagtgcttctccacctgattcaaacatgcagccacggcgacccacacagaaccttcaaagtcaatccaatagcagcccgaagatgtctgggtgtacgcgtgtgctcaagtgtctgtgactgcgagcagagcgagcagagagctggagacgatgtgtgcgtgtgtgcgcgcgcgcgaggggagcgcgcgcgagggggggggcgcggggccgcgcattcgcgcgcgccgaggcc

SEQ ID NO: 94401 - DNA, 258 bp, Homo sapiens
  chr5:88179171-88179429
  hyper
gaggagaaagtggctctcagcggccggtcggattaaaagtaaccagactcgtccagaaaactgcgtccaggaaggaagtgacagaagacgaatgggaaaaggagaacagctcacagcgtttgaaacatcgcgtaaaaaagactgggggtggtgggggcgggggggattgaaggatactgggaggggaggcgggggtggtagggaagacggagcacgaatggttggggttctaagcagcacgtccgatgaaatgtcttt

SEQ ID NO: 94402 - DNA, 495 bp, Homo sapiens
  chr5:88179851-88180346
  hyper
caattctttattgcacgaaatgaagacaacacggcgagctgcggctccctgctcctctcgcggcgcctctgcggaggacgctcggagagaacctagtctcccgctgcggcgcgctcgcttgctctccggggacgctgcgagccagccagcaggaaagtccttctaaagtcgggatctttcctctgaccaataggagcgcgaccctaatagttgctcttgtgacttttcccccttttggacacgcgttagccacttctctcttccaccggtcggtgcgctcctccgttactcacgcgtaaaaaccacggtccaggatgtctgcagcactcgattccagcgtgcttttcctgcacgcccagaagtcgcggttttcaccctgagaggttggagcgctagaaagcgagccgaaaggtttctctaatgttagtaatgtacgaaataataaaataattaccagtatttgagatctcgacttcatcgcggggccatgaactt

SEQ ID NO: 94403 - DNA, 534 bp, Homo sapiens; identical to SEQ ID NO: 29780
  chr5:88184853-88185387
  hyper

SEQ ID NO: 94404 - DNA, 613 bp, Homo sapiens; identical to SEQ ID NO: 29781
  chr5:88185388-88186001
  hyper

SEQ ID NO: 94405 - DNA, 26 bp, Homo sapiens
  chr5:88371468-88371494
  hypo
aatcttgcttaggggcggatctcctg

SEQ ID NO: 94406 - DNA, 32 bp, Homo sapiens
  chr5:88391487-88391519
  hypo
aatggaaaataaggccgggtgcggtggcttac

SEQ ID NO: 94407 - DNA, 30 bp, Homo sapiens
  chr5:88427549-88427579
  hypo
aagaatcacctggggcgggtggggtggtgg

SEQ ID NO: 94408 - DNA, 30 bp, Homo sapiens
  chr5:89073758-89073788
  hypo
aggggcgacagccaacgctcggactgatag

SEQ ID NO: 94409 - DNA, 622 bp, Homo sapiens
  chr5:891065-891687
  hypo
agtggtaactggccacgccttgctctagacattcagagacaccggaggaaacctcaggccagaggacacctgggatgaggccctggaaataccagctctcctccctcccatgcttctccccaaagcaacaggacacggtgccgacccctcatttacaacgatgagctgtgaacaccaggagagtctctaaaagtgcacccttgcctggctgtgtccggcacgctcggactggccgatctgggggcggctccacctccaccttcttcccaggatcaaagtcgtcagcctctccctccgtgtcacagtgctccctctctcgcttccgcttcttctcttcctgggcggcagagtcaagggagtgagaaaggcaggagtaggcgggatccggacaggtctgcccaatcccctcgcagttctcaggggagggacagaactaagggaaaccccctccgagatcctcctcatgccaggctccctcctcacagagaccctggcagggtctgctgaggaacagcacacccaggatcctggaactgagtctgcgggcctcagcggttcgcgttttgctaccaacggaacaccccctcccctcctccagccacgcaggcgcactctgcctggg

SEQ ID NO: 94410 - DNA, 26 bp, Homo sapiens
  chr5:89504166-89504192
  hypo
tggcagaataggaaccgctccaatct

SEQ ID NO: 94411 - DNA, 30 bp, Homo sapiens
  chr5:89854111-89854141
  hyper
acattctcttaggaacgaaaaaagactcag

SEQ ID NO: 94412 - DNA, 446 bp, Homo sapiens; identical to SEQ ID NO: 29782
  chr5:89854523-89854969
  hyper

SEQ ID NO: 94413 - DNA, 248 bp, Homo sapiens
  chr5:91876-92124
  hyper
aatctggagctggtccgcctagaccaggggaaatcggggtcccgtccgggtacactggcagaactcaggggtcagatcctctgccctggagcattcagatttgtgcctctacgttatggaaaccaggggcccgtccgggtgcaacgtggcatccacaaaatggcaggtccccgagctccgggctccgagagaacaaaagcagaagccactgccgcccgcgctcggggaggagccgcccaggtgggcgc

SEQ ID NO: 94414 - DNA, 23 bp, Homo sapiens
  chr5:9227669-9227692
  hypo
tttttttttttgagacggagtct

SEQ ID NO: 94415 - DNA, 220 bp, Homo sapiens
  chr5:926707-926927
  hyper
cgcttcttccccgcccgcccctcctgggcccctcgcgtcccccttccctgtcacccgagcttcgtttgtgactgaaactctgctgcgtctgtcatcttggtgtcctctatgaaaaccttcccagagctcttcacactccacacgtggcttttatttagtgttttctacctactcggcagcgtttcctggggagggaaggcacccagagcctccggagcca

SEQ ID NO: 94416 - DNA, 52 bp, Homo sapiens
  chr5:927008-927060
  hyper
cgaatatttccccgggaacgcggacttgccggccctgcgaggcacccggcgg

SEQ ID NO: 94417 - DNA, 37 bp, Homo sapiens
  chr5:92906137-92906174
  hyper
ttgtaaaagcggcttcgttcgacggtggatctctgaa

SEQ ID NO: 94418 - DNA, 5 bp, Homo sapiens
  chr5:92915042-92915047
  hyper
ccttc

SEQ ID NO: 94419 - DNA, 29 bp, Homo sapiens
  chr5:92915099-92915128
  hyper
cgctagggtcacgccgggtcccaggggcc

SEQ ID NO: 94420 - DNA, 150 bp, Homo sapiens
  chr5:92915445-92915595
  hyper
cccacccctgggaggcgaccccctccccgcccccagccggctggcagcggcgcagggagtctggctcggctgctaggctgcgaatcccggtgctctctcgccgccgccgcaggttgtctgctcgggagagcggctcgatgtcccttttaa

SEQ ID NO: 94421 - DNA, 328 bp, Homo sapiens; identical to SEQ ID NO: 29785
  chr5:92915837-92916165
  hyper

SEQ ID NO: 94422 - DNA, 30 bp, Homo sapiens
  chr5:92921022-92921052
  hyper
cggccaattcacctgcgagggctgcaaaag

SEQ ID NO: 94423 - DNA, 57 bp, Homo sapiens
  chr5:92939780-92939837
  hyper
ggtgtttgggggctgcgtggtgagccgaggcaaagccagggtaccccgatcgtcttc

SEQ ID NO: 94424 - DNA, 30 bp, Homo sapiens
  chr5:92940177-92940207
  hyper
ggggtgggccggggccggctgcgaggctga

SEQ ID NO: 94425 - DNA, 43 bp, Homo sapiens
  chr5:92948358-92948401
  hyper
ggggggggggtggggcgcgcgcgctgggcgctgtccatggtgc

SEQ ID NO: 94426 - DNA, 173 bp, Homo sapiens
  chr5:931145-931318
  hypo
aacaggaggaaagcacggaagcttatttaaaggaagctctatatggtgggagagcctcccatggaaggaatgccctaaagccacagagttggacactcacacccatgtgagcaaacaggacttgcaagaagtggatgggtggatctctagtggctcaccggccctaaatcctc

SEQ ID NO: 94427 - DNA, 805 bp, Homo sapiens
  chr5:94620329-94621134
  hyper
cttctcctccctcttcggctgcacctcctcccgggtccccgcggcgctggcggtggcggcggcggcggcggcgggcgcagcagcagaaaccgggagtgcccagcgacttcaggccagctcgggggaaagaagcggccgccgccgccgaggctctctggcctcgggactccggcgctgcctcttcctcccgcacctgctggggtgggctggagccgtaaccgaatcccggccgcggcgcctgcaaagtttttccctcgaagctccgcggctccagtccactggcgtcccccaggccgcgccctggctccctcttctctctgaccgagctcgggaagctgcacgcaccggggcgtgcgcgtccagctgcgccagggaccgcacccggcgccctctgggcagcacctgtcagcggcgggggcggctgcctccaaattgggcgcgcacgcggctcacacaacaaggcgcgtctggctggagactccggggaccagcagtccccctggggcgccccgggaccatcctccagctcctaggtgggagggccggtaggagccgggtggagctaggtagggcccgaagccagcttgctccctaggatccggccacagttgcccaggcagctcgctgtgcgctggccgctggccgcgctggcgatcgtctgggtcggatgaagcgagctggagtggaaactatgtgccctcgatgggtctcgtgggggcgccgatcgtccacactgagcgatgaacccgacggagttctaaagctgaagacgtctgcccccgccccgttgcgctccctgggtcca

SEQ ID NO: 94428 - DNA, 215 bp, Homo sapiens
  chr5:9479707-9479922
  hypo
aatacaatccagaaacggaagtggttattattggcaacatgatgtgggtaagatttgtggtaaggaataaaatcttcttcgggtattaattctcccttcataccaggatttcagaacaagggaaatctttgctatttccccatcaagaatcatgtatacaacctgttcgctggagaggcaccttgggctggcaggtactccggagatggccactc

SEQ ID NO: 94429 - DNA, 1724 bp, Homo sapiens
  chr5:94955559-94957283
  hyper
aatggccaagcaaagcgacattctgtcctgctgtgctttacacgtaaatagagaatggatgaggttctcagcgcccaggggtccgcggcttccgcgagggtagcgtcgggggccgctgcagagattggaagagtacccgccgggaatgggagggaagacgcggggaaggtggagaataggaatcatgtgtgttcctcgagtgtacaacccacatttgagtgacaaatcacgaggacaatcgacaaaaacaactaagcgcaaagccgcccgaatccatctccctctctgtgcgtgtgccttttcaactaactttgggaactcgtatagacccagcgtcgctccccgcgccgcctcgcctccactttggtttcccgcgtcctgcccgccctcttcggtgcctcctcttcctccgggacaaggatggaggatctctttagcccctcaattctgccgccggcgcccaacatttccgtgcccatcttgctgggctggggtctcaacctgaccttggggcaaggagcccctgcctctgggccgcccagccgccgcgtccgcctggtgttcctgggggtcatcctggtggtggcggtggcaggcaacaccacagtgctgtgccgcctgtgcggcggcggcgggccctgggcgggccccaagcgtcgcaagatggacttcctgctggtgcagctggccctggcggacctgtacgcgtgcgggggcacggcgctgtcacagctggcctgggaactgctgggcgagccccgcgcggccacgggggacctggcgtgccgcttcctgcagctgctgcaggcatccgggcggggcgcctcggcccacctcgtggtgctcatcgccctcgagcgccggcgcgcggtgcgtcttccgcacggccggccgctgcccgcgcgtgccctcgccgccctgggctggctgctggcactgctgctggcgctgcccccggccttcgtggtgcgcggggactccccctcgccgctgccgccgccgccgccgccaacgtccctgcagccaggcgcgcccccggccgcccgcgcctggccgggggagcgtcgctgccacgggatcttcgcgcccctgccgcgctggcacctgcaggtctacgcgttctacgaggccgtcgcgggcttcgtcgcgcctgttacggtcctgggcgtcgcttgcggccacctactctccgtctggtggcggcaccggccgcaggcccccgcggctgcagcgccctggtcggcgagcccaggtcgagcccctgcgcccagcgcgctgccccgcgccaaggtgcagagcctgaagatgagcctgctgctggcgctgctgttcgtgggctgcgagctgccctactttgccgcccggctggcggccgcgtggtcgtccgggcccgcgggagactgggagggagagggcctgtcggcggcgctgcgcgtggtggcgatggccaacagcgctctcaatcccttcgtctacctcttcttccaggcgggcgactgccggctccggcgacagctgcggaagcggctgggctctctgtgctgcgcgccgcagggaggcgcggaggacgaggaggggccccggggccaccaggcgctctaccgccaacgctggccccaccctcattatcaccatgctcggcgggaaccgctggacgagggcggcttgcgcccaccccctccgcgccccagacccctgccttgctcctgcgaaagtgccttcta

SEQ ID NO: 94430 - DNA, 90 bp, Homo sapiens; identical to SEQ ID NO: 40573
  chr5:94982142-94982232
  hypo

SEQ ID NO: 94431 - DNA, 80 bp, Homo sapiens
  chr5:95067652-95067732
  hyper
aagccctctggtctccggggacgagagcagcttgttgctgaacgcggccagcacggtcgcgcgtccggtgttcaccgagt

SEQ ID NO: 94432 - DNA, 21 bp, Homo sapiens
  chr5:95117541-95117562
  hypo
agactccgtctcaaaaaaaga

SEQ ID NO: 94433 - DNA, 435 bp, Homo sapiens
  chr5:9544685-9545120
  hyper
ggactcccgcccactcgcccaggacccagcaactgcctgtggcgcctcgtcctccgagcgctcgctcgcagcgccccctgccgggaatcccgaggacgccgcaggcgcaggaaagttaaatcccaactccggccgcggcatcctggtacaaagcaagcaaagggcgaggaggtgaacgcgcttcccgccaaagccaggggaacagggatgtgaccgctccaagccaggcaccggccgccgcggggagcgagccgggggaatcactcctccacgaccgttcccacgcacatcttgggagaaaccattccctctggagcccgatctgcccgaaaccctggggtctgaaaccctgagccgcggtgtgcaaaatccgtggagcagcggagggatgcctggtgaaaggggctcgcctagctgcagcgcacctggctggtg

SEQ ID NO: 94434 - DNA, 355 bp, Homo sapiens
  chr5:9545496-9545851
  hyper
gcgcccccggactgacggtcgtcctaatcctgtacgcgcaacccccgcccaggtgcctgctgatggatcccacccgagatcggcaccacccaccagccgaccgctgcagtccccgggtcccggccagcggcgcggcgcggcgcggcgcggtcaggggctcctgccaaggccacgcaggaatcgggcgggggtcgctcaccaggtgcgaggagcgctggtgccagtcatccagcgcctgggggccagagcggctccgaggatcctcttcagcacctggctagggaagtggaggcagcagctgcagccgccccctgccacttccccagagccgccccctactcgctgagttccagaa

SEQ ID NO: 94435 - DNA, 124 bp, Homo sapiens; identical to SEQ ID NO: 29466
  chr5:9546564-9546688
  hyper

SEQ ID NO: 94436 - DNA, 98 bp, Homo sapiens
  chr5:95551329-95551427
  hypo
tacctccttattcaccgcctctacttcttctgcctcaaccactcatgagtcagcaagaccaaccgttcctcttcctccttcttctcaatctgctcagc

SEQ ID NO: 94437 - DNA, 30 bp, Homo sapiens
  chr5:95767930-95767960
  hyper
ggggatagatggtcccgtgtctttcaccca

SEQ ID NO: 94438 - DNA, 161 bp, Homo sapiens
  chr5:95768166-95768327
  hyper
agaccgcctcagtcccgggggatggagcgcactgcttctcccgggggcgcttggttggtaagagcttgagtgtatctcaagttccctgaacaagcgtggagggatttttcttccaaaccgcgcgggaacggatttcaattctagagcggccaacagtaagc

SEQ ID NO: 94439 - DNA, 200 bp, Homo sapiens
  chr5:95768893-95769093
  hyper
agaggagaggctgggcggcggcgagcgctcagtgaagcgcttcggtctccaggctgagtggagccccagcccttcccagccagaatggaaatgagtgtttacacgtcaaatcgacgaaagccatctcttgacgtcagatctacctggactaagatccgaatggtattcccggcggggcggagaagcggctaaaataagca

SEQ ID NO: 94440 - DNA, 116 bp, Homo sapiens
  chr5:95769953-95770069
  hyper
atggtggagcctattcgaaccctgagggattgaacctggcgggagataccagtgcctagtattcagcaccgaggtctggacagcgacacacgcaggactgccgcaggagctgctct

SEQ ID NO: 94441 - DNA, 43 bp, Homo sapiens
  chr5:96038372-96038415
  hyper
atgccaggcgcatgacgagtccacggagcgggacctccctccc

SEQ ID NO: 94442 - DNA, 45 bp, Homo sapiens
  chr5:98104846-98104891
  hyper
gatccaggacctggacgcgggggtctgcggcgcccctacgccccc

SEQ ID NO: 94443 - DNA, 110 bp, Homo sapiens
  chr5:98200994-98201104
  hypo
ggtgactagatgctacgaggctggtttcaggctaagaatcttttctcctaaatgagatggaaagccactggagtgttgtaggcacagaaatataacggtgtgactttatt

SEQ ID NO: 94444 - DNA, 30 bp, Homo sapiens
  chr5:99383200-99383230
  hypo
gtgagaagaattattcgagtgctgtaggca

SEQ ID NO: 94445 - DNA, 150 bp, Homo sapiens
  chr5:99389805-99389955
  hypo
cgacgtagtatgtatcgtgtagtatgatatctaatgatgagtttgctaatacaatgccggttaggccacctacagtgaagagaaaaatgaaccctagggctcagagtactgcagcagatcatttggtattgcttccgtggagtgtagcga

SEQ ID NO: 94446 - DNA, 70 bp, Homo sapiens
  chr6:100036662-100036732
  hyper
tcctgctgcgtgagccgatctgcagatccagcaaaagacccgagagcggcttgaacgccagatgattcct

SEQ ID NO: 94447 - DNA, 201 bp, Homo sapiens
  chr6:100036959-100037160
  hyper
acccagcccgctctgcggatgggtcgtagattccggctggaagccggaggaagtgcatagagggcagcttcaaaagccaaggctgcgctgctttgcgcggggcttcttccctcgcgtgcccgcgccgggtgccggagcagcctccgcaagctgctttcatctcggtctgccggggcagggtcgaaccgcagctgtggggct

SEQ ID NO: 94448 - DNA, 67 bp, Homo sapiens; identical to SEQ ID NO: 30684
  chr6:100038640-100038707
  hyper

SEQ ID NO: 94449 - DNA, 369 bp, Homo sapiens; identical to SEQ ID NO: 578
  chr6:100038785-100039154
  hyper

SEQ ID NO: 94450 - DNA, 200 bp, Homo sapiens
  chr6:100039274-100039474
  hyper
cggtggtccagcagagtcttctggctcccgggaaagcagcgtggcgccgccccagcccccagtccccagactagggattgggacgtcagtcattggctgcaggttactggtctgggctgggcccgcagagatcccaagcgctcctctgtcggtgcttcctcagcgtctgcgtttccgcagatgcccgaggtcagacagtt

SEQ ID NO: 94451 - DNA, 121 bp, Homo sapiens
  chr6:100050341-100050462
  hyper
agaacacctttatttcgccttttaactctccgcctttctgattaaagagttcagacctgctccccggcccgcgttcaattattccccagcatcttttctcagaagctgtcaccaccacttg

SEQ ID NO: 94452 - DNA, 20 bp, Homo sapiens
  chr6:100050505-100050525
  hyper
cgtttcgcttttctttcctc

SEQ ID NO: 94453 - DNA, 57 bp, Homo sapiens; identical to SEQ ID NO: 30688
  chr6:100050754-100050811
  hyper

SEQ ID NO: 94454 - DNA, 251 bp, Homo sapiens; identical to SEQ ID NO: 579
  chr6:100050858-100051109
  hyper

SEQ ID NO: 94455 - DNA, 149 bp, Homo sapiens; identical to SEQ ID NO: 580
  chr6:100051359-100051508
  hyper

SEQ ID NO: 94456 - DNA, 380 bp, Homo sapiens
  chr6:100051771-100052151
  hyper
cgtagcctgcctctcggagggccggcggctgctggtgagcattccagcctcgttagggcaacctgttaccggagagggagccttgcccgaacggttctactgtgggcagggagcaggaccgcccctaaaccgcctttccccgcacctcggtgtaggagagatttcgctttaacggagactctggacgcccatttcaagtcgataaaaaaaaaaaaaaagccgagtggaatgttttgattgagtctcaacattgtctttgaataaggctgagaccatgtaattaatgtgtctttttaataagggacaatacggccgttcaagctatttaatttcatttaattttccatcccatttgctgcacagcccgcttttacttttaa

SEQ ID NO: 94457 - DNA, 293 bp, Homo sapiens
  chr6:100052449-100052742
  hyper
ttcgcgtgtcgttcacgctttttcactcattaaggagggccagggaggcgccccgaacccaggcccagcgctcgccccttcccgcttgcagtgctggtaatttaaactgggtgtcatcccagagtcgccaggccagaggttagagggacatgttcatggcttaaatttattgccctgactcttcggagcggcttcctctcctcctccccaccccccggcttttgccattcatgggccgctggatcaaagcctccctctgctctgttgagggcagtcttcgcagccctcagaag

SEQ ID NO: 94458 - DNA, 222 bp, Homo sapiens; identical to SEQ ID NO: 30693
  chr6:100053289-100053511
  hyper

SEQ ID NO: 94459 - DNA, 393 bp, Homo sapiens; identical to SEQ ID NO: 30694
  chr6:100054839-100055232
  hyper

SEQ ID NO: 94460 - DNA, 516 bp, Homo sapiens
  chr6:100055269-100055785
  hyper
cgacagccctgggtggggtgcactgagcgctgtaggtgccgggaccattcgcagcttgtgttttcccctgcgctctcgggtctcctcagtcagaagccagaagcccacccccgcacgctgtccgcagctctctctgcaaaagcaccctctttctgggggctcagggcatcgagaccctttcttcccttctgcccttcaatatgttaatttgaggcctaatttcgccttaaagtaattttttttcctgaaaaaaaaaatctttgggaggctctcagttcctagaacctcctcagatatttttttttcccttgccgatgtcggcttgtgggtatgcggcatatggagagaggatgagcaaggtactggctctgacgcgggctccaagggcgaggcgcgcccattcgcgcggggcacagggtcagagcgtctgcagcggggctctgagagtccagaggcccaaccgggaggcgccagggccaaaccactagctttgactcccacactccacacaccgtc

SEQ ID NO: 94461 - DNA, 45 bp, Homo sapiens
  chr6:100055786-100055831
  hyper
cgacccctgaccagagagacttatagcactcgcccgctttggggg

SEQ ID NO: 94462 - DNA, 722 bp, Homo sapiens
  chr6:100060975-100061697
  hyper
cctgcgtttccactgcgtgttcagcggcggtggaggcggcgccttcctgcaccacgaacacgcggctcgccaaggcgccgtcccagcggctgatggcctcggtctctccccaaaacccccggcgcccgatttcgccgcgccttcccaggcaggaactttgcgaccccaccccctgggcccgccaccagttcaggcctgcggtgcgcgggagggcatcaagcgcgaggcctcttccgcgccctcggccacctcgccgaccccaggcaagtgggggcagcccaagaagggcaaggagcagctggaccgtgccctggacatgagcggagccgcccgaggacaagggcacttcctcggcatcgtgggcggctcctcggcgggggtcggcagcctggctttctaccccggcgtgcgctcagctttcaagcccgccggcctagcgagggcggcggcggccgctcacggcgacccctaccgggaggagagcagcagcaagcaaggagccggcctcgctttgggcaggctgctgggcgggggccgggcgtgcgggcgccccgggagcggggagaactcggcggcgggcggcgcgggtcaccaccatcaccaccacgcgcaccaccaccaccatcccaagtgcctgctcgctggggacccgccgccgccgccgccgcctggcctgccctgctctggggccctgcgcggcttccctctgctctccgtccccc

SEQ ID NO: 94463 - DNA, 1100 bp, Homo sapiens
  chr6:100061988-100063088
  hyper
cggagtccatctcctacttcagcgggcctgcagcggccgccctaagccccgccgagctggggtcgctggccagcatcgaccgagagatcgccatgcacaatcagcagctgtccgagatggctgccgggaagggtcgcggacgcctggactcggggacgttgccaccggccgtcgcggcggcgggaggcaccgggggcggcggcagcggaggcagcggcgcaggtaagcccaagaccggccacctgtgcctctactgtggcaagctgtactcgcgcaagtatgggctcaagatccacatgcggacgcacacgggctacaagccactcaagtgcaaagtctgtctgcggcccttcggcgaccccagcaatctcaacaagcacatccggctgcacgccgagggcaatacgccctaccgctgcgagttctgcggcaaggtacttgtgcgccgccgggacctggagcgacatgtcaagtcccgccaccctggccagagtctgctcgccaaagcgggcgacggcccgggtgccgagcccggctatcccccggagcctggggatcccaagagcgacgacagtgacgtggacgtctgcttcacagacgaccagagcgaccccgaggttgggggcggcggggagcgcgacttgtaacgagtcttcccgggaaggggcggggtgaggacagagaggagtcgagggtttattctcgcagtagaggaactcctggtggtgggaagagggacccaatggacaaaaccgtttttgtttttgagagggcgccagatttgaaacagtgagaggtcccacatctggtgctgaaactcagagcaacagttcagaggtggcgtaaatctggccacctggagagctcgagtgccaccagtacctccgcaccccgggcctctggacttcttggatgagctcaccctgaaccgcccaggcggtctgctcttggtgttcagaatcacatcaatgcgaacgtcacagcgccttcgagggcgcagattttaactgccacgtatttttaagttgtacttttctgtggaggaaattgtgccttttgaaacgacgttttgtgtgtgtatttcacgttagcatttcatt

SEQ ID NO: 94464 - DNA, 411 bp, Homo sapiens
  chr6:100066608-100067019
  hyper
tgagccgcgttactccgagcgctcccattggtgcattccttggagccagggttgctattggtggcgagctggccgcggcgaaagaaccccggccgcttgggctagtgcggcggcggccaggcggagccggaggtgagagtgcgagcagcgtcctgtggcgtggcgacccctgggctcacagcctcgcgctccctgggctcacagcctcgggctccctggactcacagcctcgccctccctgggctcacagcctcgcgctccctgggctcacagcctcgcgctccctgggaataggggtttctggggtcttgttggggcagaggtgcgggagtctcgccgcgtttaggtggacagtccaggagtcctgctggagaggaggacctgggaagacccgcgatgccggcaggagga

SEQ ID NO: 94465 - DNA, 283 bp, Homo sapiens; identical to SEQ ID NO: 30701
  chr6:100067144-100067427
  hyper

SEQ ID NO: 94466 - DNA, 237 bp, Homo sapiens
  chr6:1004078-1004315
  hypo
gctcctccctgaggacgacagaccccccggcgatcaggaccctggccacttctcagactttagcgcatccactcccagcaccccgcaagaccctcgctcgcccgcctgctcacccactaagtcctgcgggctcccagcaccccgcaagaccctcgctcgcccgcctgctcccggcaccccgcaagaccctcactcgcccgcctgctcacccactaagtcctgcggagctcctgctgc

SEQ ID NO: 94467 - DNA, 17 bp, Homo sapiens
  chr6:100441291-100441308
  hyper
aaggccgtccggaggcg

SEQ ID NO: 94468 - DNA, 241 bp, Homo sapiens; identical to SEQ ID NO: 583
  chr6:100441497-100441738
  hyper

SEQ ID NO: 94469 - DNA, 404 bp, Homo sapiens; identical to SEQ ID NO: 30704
  chr6:100441761-100442165
  hyper

SEQ ID NO: 94470 - DNA, 353 bp, Homo sapiens
  chr6:100729492-100729845
  hyper
ggcatgcctgctggacgacttaattgtggagcctgaagggccatcatgaaccggcgtgcggagaccgcctcgccactgctgcattacaaatgctctttattaacagcgatctgtaatcaatgggctcaggctttttgccagagcccccaaatcagacaggcgggcccctgcgtcagggtgggcggagccacggggcccagctatcgagctgggaagagaaagctgtgttgtccctgcctgactcttgggtgcgatggtaaatcagaaagggaccctagtaatcattccaggggcgccctcctctcactactggttgaatattcattagcccgggtgagcgcagctcactgtac

SEQ ID NO: 94471 - DNA, 152 bp, Homo sapiens
  chr6:100903253-100903405
  hyper
ggggtcctcctggaccgttctggaagggcccccgccacagccacctgtacacaccccttggccttatcacatttatcgctcttcccctttcagccaacctattctccttcgtttctgtcacgacctgctcttctctttctaaatcccggctc

SEQ ID NO: 94472 - DNA, 221 bp, Homo sapiens; identical to SEQ ID NO: 30707
  chr6:100903560-100903781
  hyper

SEQ ID NO: 94473 - DNA, 649 bp, Homo sapiens
  chr6:100903832-100904481
  hyper
cgcctacgagggaaaatgagacttccccacaggttaataaacaacctgtccggcacaggttaacaggagcctctctcgccctctcctgccccacccccgccaccttttaaggaagcttttgccttcccggaggtttgccttctctttctgttccccgtagaaatcttacgattgtgtctgggttaatgttttataagggactggctactctcgtctacctgccgggctttcccgatctaatatcgaaggaacctccccaagtcctagtaaggggtcccccctccctaaagtctcgaagtggggtagagaccttctccctggagcccctcgcctcctgccttcggtgacgcgctctagcacacccaatttcagttggcgagggggtaagctgagatttcgtttctgcacttgacctaccgcagaaaattcgcaaatcctttgattgtctgtttaaaatgaggaggaaaccagctccctttgcggcgggattacagtgggaacaagatctaaagattctcttgcaattcggcgaggccgagggaacggggttttgcaaaagagaaaaggagctctgtgagggaggcgataactaaatcgggttttagacaaaaggattttcctcagctaaagtggccgaagacaaaggaaa

SEQ ID NO: 94474 - DNA, 41 bp, Homo sapiens
  chr6:100905267-100905308
  hyper
aaagccctcctaggccgaggccactgcggttcctgaacagc

SEQ ID NO: 94475 - DNA, 92 bp, Homo sapiens
  chr6:100905783-100905875
  hyper
ccgggccagagacaccgcggccgcacccagggaatccactaatgttactgtaaatgtggggtggaggccgaaggtcacaccgctgtctgtct

SEQ ID NO: 94476 - DNA, 232 bp, Homo sapiens
  chr6:100905935-100906167
  hyper
ctctctctctctgccttcgcggagctccagccctcgagtttgggcttcccgtagggatagagcctgcgggccaacctggctgcccgagttggagccagccgcgaaaagacggcagaaacccaaggagggcggggttcggccagactaaaactgggggcgaaattcatgcagcgttcatgagacagtcctgcgtgacggccgaaaaacgtcaatcgatgtcgccctgggactc

SEQ ID NO: 94477 - DNA, 81 bp, Homo sapiens
  chr6:100906245-100906326
  hyper
cgggcgaatcccacttaggttctacttggcgcagggactcggacgatggcacctaacccgccttcccgggaactgcccaaa

SEQ ID NO: 94478 - DNA, 449 bp, Homo sapiens
  chr6:100911997-100912446
  hyper
ctcacccatgccagccgcatcctccagacccctgggaagttgcccaaacaacaaaatacatatttctgaagacccgcaagggatcttccgccgcggatccccgagtccgcgcccaggccgggcgcacgtcccaggaaagcaggtttccgcaaatcagaattcctccaaggcgaggcaggggcctttcagctccctaccttggcagatctggaccttggctacctctttaacttgggtctcaagtctgagggattcctcaaaaagtgacacttacacaccaagtctctcgggactcccaaggcgacccagcgctctggctgcccagcaggggctgcaacaagcggggcccagcagcgccaggttaacaggtggcgcgctcgcgacagcccctcgcaggctcccccgggggtgggaggcgccgcggcctctcccacaccaccgcggagctg

SEQ ID NO: 94479 - DNA, 586 bp, Homo sapiens
  chr6:100912465-100913051
  hyper
cggggcgtcttctgcttcacctaccttcagtccccacaagcggcagaggtttcgggggcgcccatctcttaactgttctcatgcctaccgtccaacccagcgacaccgccggcctctccgcttcccaccggcagagaggagcagagcattcccggctcccttttctggatcatgaattggaggaggggtgcgtggcagaaagaggaggatgcaagctttgggacgagtgaggtgattttagaatcctggtcctccgtagttgctacgaagccagttcactattattcctaattggaagccgaaaactgccccccgtaacttctttatagcttaagggtttagcttcaacttcactccggggccgcctctctcccgccctccctcaatgccactcacaagccccctcgcctcccattggcctggcgcggccaggggcgaggcgctcattggccaatagggctgagtgacacgagtcggccccgagccgccctccgcgcgcccaggctccgggctctgaatcttactacccgcgggaccgctggactcctaatgagctcagggtgccgggtcggcgctgtccggttgc

SEQ ID NO: 94480 - DNA, 30 bp, Homo sapiens
  chr6:100913748-100913778
  hyper
ccctctaatttgaaccgccttctctttctc

SEQ ID NO: 94481 - DNA, 118 bp, Homo sapiens
  chr6:100914823-100914941
  hyper
gtaaggaagtcttcacgcttaaggctgacgtcctggggggctgggcgggctgttccaatgtcccagtgaagctcagttgtcaatgagccaagtagatgtcgtttaataaacaaagtga

SEQ ID NO: 94482 - DNA, 340 bp, Homo sapiens
  chr6:100915441-100915781
  hyper
atcctgatgtgggagaaaacccatgcggggctgcaaaaaagtgtctccctccttcccccaccaagcagggcgaacagcctagtgtgatggcgacactgttcccccaagagtccctgccacttctggggcaacccaggatgctgccctcatggagcctgccccggaccccggaggccaggacatgcaggcgtccgtgactctaccccaggggagccaggccgggtagattctggaaccaacgcgcctttgtgagcaatgtctagcatgccgcgcgcacccagaaagaagggggagcgggcacctcaagggccttctgacccctccccgcaaaaggcaaaat

SEQ ID NO: 94483 - DNA, 115 bp, Homo sapiens
  chr6:100917195-100917310
  hyper
aatccctgtccgaatcgggaattggcattccgtaagggagcggagggcctcaggccactaggcagctccgaacgcggggaagcgggagcaaagatgagctcagagcgagggttgc

SEQ ID NO: 94484 - DNA, 32 bp, Homo sapiens
  chr6:10113557-10113589
  hyper
tgagccgctgataaccggccgactggggagcc

SEQ ID NO: 94485 - DNA, 133 bp, Homo sapiens
  chr6:10113619-10113752
  hyper
cgggtgcgcaggcctggcccagcgggggcgccgggagagccggcccaattatgatgttgggagggatgttgtgatcctcggaggcggctctcgctaacaggcaggggcctgggggtcccgaggcaaggccggt

SEQ ID NO: 94486 - DNA, 1433 bp, Homo sapiens
  chr6:101840541-101841974
  hyper
agggagagcctggtgcgctcaccgccgccagcccctccctggaagccaagctgcgggaagactctgggactcagttgcccctccccatctctggcctttaaaagagtcctcccgagaacttggaccagtggccgccaaaccagggctgcttcccagactcctgtctccaatcttggagtctgcgacctcaggttcggcgcccactagatctcgaatccaacttctttctgaaatgtgtttaggttgagagttccggggcctgggcgggagtttggtggggagaggggagtctgctatttaaggcgccatacatacacagagacagcccgcccgacctcctaacactcaggaaaagtcaatttccaagcatctgttctcaataatggtggcagggagcagggcactgtgactcccagcatctgagggaatacccgcagcagcgctaccagagcgcatttgctctatgcgctggaggtcggggtgggagggtgcgcagatcaagatctttttttgcgaacctcagggaaatgaccgtagttggactaagaggtccactttggagactaccagcagccctccaagccctggcagtggagaagtttcgttgctatggtttcggagaggcataaaagccatcacccagaagcaaatgtgtttgggctccttatatgtgttgtcaccacccaaggctaggcaaattcctcggcgctttgcatgcatcactcactccctgacagagcatcttggccttagtctccccatcccaggaggcgggtgtgcgctaagggagcgaagtccagccggaggcttcgtaacatccaagtctagggacaccaggaattctctcgctctagctcctgtggtccaggggtgggagatgcccccgagtggccgcggcggccaggagcgtgcaggggccacggggaaaggagcgcggcgcctttaaagcaagaggcgaggaacccccgccaggaggcgtgtctgtctctgccgccgccgccgccgctgctgctcctcggtcaccgtcttcgccgctgccgtcactcgcgctcggcgccggcggctgcgctggtcggtctggtagctggggacttttccgcccgacctcctccggctgctcctccccgaggaccaccccaccccctccccgcccacctcacccctagctccaggtaaggactccccggctgtgggctgcactccgggctccttcacgaggtgtttgttttcaagaggacgggagggactgcgggtgggcgaggggcattttccacctggagagaaggaagaaggcgaacagtagcgctgcggacgtccgtgcgctcggggcgcccgctggacggattcactgcgagtctttgtcgggcttatctcagccaattcccgtcaagcatgcaagtggctctgttggctgcagtcgcctatgttctcca

SEQ ID NO: 94487 - DNA, 272 bp, Homo sapiens
  chr6:101849938-101850210
  hyper
gctaggactgtgattcgacccagcgtcctcctgtcacctcctgcgaggtgaggggcagcccccgcttagagtgctgaacccttgccacgtccctcgcctcccccgcccgtcttcagcgtgcgcaaccctcttccccgcgcttccctctccctctctgtatggcacacacaataacacacacatacacacacacacattctctcacacacactcaaacatagacacgcgctcgcgcgcactaagacacatgcgccctccgggtgcatttggca

SEQ ID NO: 94488 - DNA, 64 bp, Homo sapiens
  chr6:101850475-101850539
  hyper
tcttggttgtcaccccgcctttgatcctgtgttgggacaacttgggttttcctgggtgcccacc

SEQ ID NO: 94489 - DNA, 31 bp, Homo sapiens
  chr6:103355599-103355630
  hypo
cccctggagtagggccgcccagcggctgcac

SEQ ID NO: 94490 - DNA, 91 bp, Homo sapiens
  chr6:103355690-103355781
  hypo
ctgctggtgtctgtcggtgtgctcttctgctcctctcagtgtccagccacttgtttgtgtgcctgctaaggcctgtcgggtctatgtgggc

SEQ ID NO: 94491 - DNA, 86 bp, Homo sapiens; identical to SEQ ID NO: 529
  chr6:10381507-10381593
  hyper

SEQ ID NO: 94492 - DNA, 275 bp, Homo sapiens; identical to SEQ ID NO: 30280
  chr6:10381694-10381969
  hyper

SEQ ID NO: 94493 - DNA, 46 bp, Homo sapiens; identical to SEQ ID NO: 30281
  chr6:10382321-10382367
  hyper

SEQ ID NO: 94494 - DNA, 389 bp, Homo sapiens
  chr6:10382722-10383111
  hyper
tattaagggagacttcgaaggcctgttagcaggtgactgcggcaggggcaggggcgcatcagctgtccggcttggaccggcgtgggcgtgggctgggggcttttccgatttgctgagtcagccgcgggcgccgcgggctttggtgtttccagcccaagcgactgtgcttcgctgactggtgtgtcaacttggtagtgtaattattgttttgttttctaatatgtaattactctttgtcgttgctattatgaatccaccgagcttgactcttgagcagcaagatggattcaagtttgaagttaggatttgatgcgtggggaaaactggcttctccccatgcgtaggacactataggggcccacgcgtgtcttccccgcagcccagcaaga

SEQ ID NO: 94495 - DNA, 347 bp, Homo sapiens
  chr6:10383727-10384074
  hyper
cagctcagctacccacgctcccagccacgtcgcgggtggatattcccgcctgggctgggcaccgcggaatcagcaccgcctgctgcgcaggccccgcccagaggctgcaccacccaggccctgcccgccgccctctgcagcctaggcggggtgtgtggcgtcgcggtcagccttaccgagggacacgccgccccgggccgggacggggtggggctgtgggggatcctgggccgaggaaagcgatccattttctctaaccgtttgctccagagctgtcaggttagcgtggcctcctcggccgcccagagaagaatgtgttaaaattctttgcacgggagcctttccca

SEQ ID NO: 94496 - DNA, 75 bp, Homo sapiens
  chr6:10384438-10384513
  hyper
tgcccctgcgggtcccgattacagatgaatttttattccgaggtggggcacgtaatggaacggaaaagatatgat

SEQ ID NO: 94497 - DNA, 154 bp, Homo sapiens
  chr6:10384821-10384975
  hyper
tgcttctgcatattgcgttggtcgtggttttgtttaaaaagacgtaagaagggaagagaaagactgagatgatggggagatggtatttgcttgtttcatcttttatttttaaaagtaaatagggaagggggaaggagggggagccgtggcgggc

SEQ ID NO: 94498 - DNA, 994 bp, Homo sapiens; identical to SEQ ID NO: 30286
  chr6:10385279-10386273
  hyper

SEQ ID NO: 94499 - DNA, 1307 bp, Homo sapiens; identical to SEQ ID NO: 30287
  chr6:10389909-10391216
  hyper

SEQ ID NO: 94500 - DNA, 132 bp, Homo sapiens; identical to SEQ ID NO: 30288
  chr6:10391324-10391456
  hyper

SEQ ID NO: 94501 - DNA, 44 bp, Homo sapiens
  chr6:10404465-10404509
  hyper
ggaggactccgcgagcgcgcggcagcgaacgaagcgcgcaccag

SEQ ID NO: 94502 - DNA, 111 bp, Homo sapiens
  chr6:10404879-10404990
  hyper
cgttggggttcaccacgccgccgaagaggttgtccttgttaatagggatggcggagacggcattgctgttggacttggacagggacacggggcctgcggagacagagggga

SEQ ID NO: 94503 - DNA, 504 bp, Homo sapiens
  chr6:10410444-10410948
  hyper
atgggggctggaagtcggcattgggggtgtgggacagcggcggggcgctcgtgtagggagattgacctacagtgcccagctggggcaaccgtgccgtcccgttgctggtgccgtcgtgacggtcctagaagagagcgagaggaaaggtaaagaacaaggaatcaggcgtcgagctacaactatccacacaaaatccacttgacaagtctgcgtgggaaatcgcccgttcccgttggctggccgccgggaaaaaatcagctctaagttcttttcaggaaataccctcaagtgaaacagaccgaacaacgcagagaaactgtatatggagggggcacaagagactatttaggggtttctttcaaagagaggaaaagatagaaaagggtctcctggaacacagcccattaaactgcagcgtgaaatctctcttaagcaaaattaaaattcctcctaaatactaaacagcagaagcggccttttcttttcccccgatttgaacctgtc

SEQ ID NO: 94504 - DNA, 783 bp, Homo sapiens
  chr6:10411253-10412036
  hyper
gagagaggtgcaccccggggctgtggccccccccccccgccccttccaccccagccccaaagggcagaagaaacgcctgactttaggtttctctattgcaattcccttgcaaaacaagcgaagagagttgattccagagaccgcgaaccctcggcggttcggccgcaggtcccgagggtagggggcacaccgcgctgcacttttcctgcagacagtttaagcatcaaatgttgagaacatctcggggacaagtgaagactcaaggaaatcaagatgaacgtggggagaaacacgccttgggaagccgcggcgaggtaggtctgcgtgctcggagaggtcgagcgggggctggggtagggggtaatgcactcgatttagggatggaaaagagcgagagaaaggcggaaggtggggtgggggatgcaaatggagagggtgtcctgaaggaaagctgggcgtgaaacccgaggtttcgggcagctccacggcaccaggtttccagaatccaattcctaaagaaacagcaacgggggtggggatgggactcaccatggctgaaaaactgtgaactaacatctgcgaagagtctggggtaacgagtcagggtggaaaaaaacaagcaagcctggagcgcccggctgccccgccgcccgagcgcgccccacacaaaaggcgccgagagccccgcgccacccaggactccagtcacggcgccgacgctccccggagcgcgggagcccggctcggatccatccgaacttgaaccaccgattcgcgcggcgc

SEQ ID NO: 94505 - DNA, 299 bp, Homo sapiens
  chr6:10413015-10413314
  hyper
acccggcgccctgcccgggaccggcccgctcgctgcactggtcctctcctcggcctcctcttgagctttcctcggacaggggcaccgtgcgctccccggccaccgtcgctctgccctcggctctctggggccggggattccggatcgggagccgggatgcgggccggggcgcgcacagacgctaggcggcccagcccgggcgccgctggcaccggctcgcggctcccggcaaaaacccgtccgactggctgggccactcccgcctgacgcccccccagatgacacgactagctctcccg

SEQ ID NO: 94506 - DNA, 348 bp, Homo sapiens
  chr6:10414201-10414549
  hyper
agtgttggttgtaaccgttcccagcgcctcctgcgggtggacaggtcgcgctagggtctcccttgctgcctcaagaaggcgagctcaggggactctgcgttttaaaatgggttccaaagcggcgcgctctgtcggcccagcgggcttgcggcaccagaggtggtctgcagccgcgcaaggattcccacggtcgttctgggctggtgcagaagctggtgctcccgcacccagcggccagcaggctcggcgcagcacatctccccaccccacccccacacacccccgtggggtgcgtcgatcctgtagctcagagggagaagctacttagaacttcgtgaagcacagagg

SEQ ID NO: 94507 - DNA, 508 bp, Homo sapiens
  chr6:10414821-10415329
  hyper
tcgatgaagataacacgaggagtgcacaggcaagtgcccagttgccagcaattgcttcaaaagcccatgttcttcttttcccccattcttaggcacagccaaaattggtcagaaaggggagtaaagtgggacacgagcttcaaagtagggaaaccaaagaagggagcatccacgtcctctctctgcagcttctcccccgcgttcttcgggcgaatccgagggacgggcgctgcgctggggaaagtttgtcccacccgcgtttcgcagctggttgcaaggagaggaggaggagagggagggtcaagctcggagcctgtgaccgcacggatgatcgagccggcgtcgcgcttacctcgcagtcctcgtacttgatattatccgtcaatttccaaagcattttcatggatcggcgtgaacggatatgcccctctcggtctcgcacccaagtggagctactctctgggtgagcgcaaagtgctggctgccggcggtgagcgcaggaggagga

SEQ ID NO: 94508 - DNA, 447 bp, Homo sapiens
  chr6:10415389-10415836
  hyper
ggaggaggaagaggagggcgaggaggaggaggagggcgaggagaagggcgaggaggaggagagaagggaaagagctcccgtgtgcgctcggagatctccctctaatggtagaaacttttcccttttccagctctttaccaacagcctaatcgcctcattagcatatcaacaatagtccaattgctcgccagtaccacaatctgccgccggccgctccgacacaggtataaaggcctctctacgccgcgaacttgcttctagagcgcactccagcctgcgaactgataaaaccttcctcgagctccgccgcgaggccctgccccaacaccccctctcttaccccaattccgccacattccccttcctttctttctccgcttccttttctccagagatgccttctgcaaagcccggcactgctcaaggtccaagcgccacgcctggggc

SEQ ID NO: 94509 - DNA, 260 bp, Homo sapiens
  chr6:10416118-10416378
  hyper
atcccttaattgcagcgtgtaaaataaaagttgtaccctgaagaggttacttgacagctccaggggttaaacaatttttctcctgtttgtgtgaagctagggccaactgacagttcaaattggtgttcaggctaaggtttcctgggtgcaacgtggacacgaatacagaactcctatggaactgcacacccgcttctgaagttgagcctaaaaacagacgtgtgtgtgcctgcaagtctagataccgtctcgtgcgtgca

SEQ ID NO: 94510 - DNA, 372 bp, Homo sapiens; identical to SEQ ID NO: 30296
  chr6:10417158-10417530
  hyper

SEQ ID NO: 94511 - DNA, 363 bp, Homo sapiens; identical to SEQ ID NO: 533
  chr6:10419077-10419440
  hyper

SEQ ID NO: 94512 - DNA, 526 bp, Homo sapiens
  chr6:10419476-10420002
  hyper
cgtttttcctgtcttcgctgtctcctgggagctctcctgggcgctgccaggcgcgcctcacctacgactcccctgccctgggccacggcgcttcctctcctcctccccgctccggccccctcccctactccacccctgcccacctcaaccccagccaaggcaaaccccccgtacctgccagtcccccattttggcaagtatggacatcgcggctctgcgctcctggcgactggtccccgccgggcatgggctggagggctcggtcgggccagctccctggaatcgcttaggcaaatcctccttttttacctgctcaccaacatctcacctggtcataaagagctgggttgctacctgccgacgcatgcgcgctggcccaggaattcactccgccagctgcagtcccagcgccgcacagagctgacctgggaagtgatggatttatagccgcggcaatcttgccatcagctccagcttttcccaacagccccaacccgctttcccggtcagtccctggcccgggaac

SEQ ID NO: 94513 - DNA, 150 bp, Homo sapiens; identical to SEQ ID NO: 30300
  chr6:10420118-10420268
  hyper

SEQ ID NO: 94514 - DNA, 37 bp, Homo sapiens; identical to SEQ ID NO: 30301
  chr6:10420718-10420755
  hyper

SEQ ID NO: 94515 - DNA, 207 bp, Homo sapiens; identical to SEQ ID NO: 30302
  chr6:10420876-10421083
  hyper

SEQ ID NO: 94516 - DNA, 96 bp, Homo sapiens; identical to SEQ ID NO: 535
  chr6:10421356-10421452
  hyper

SEQ ID NO: 94517 - DNA, 1159 bp, Homo sapiens
  chr6:10421548-10422707
  hyper
cgggcccagccggacgggccgggccgagcctaggaggggctggcagacgtgtcccagggccagggtggggcgtagggagcgccgtctccaccctcagtacttttggggtgggggacctgagcgtgcggagagcgggaggcagagctgagagcggggttaagcgcgaagctaaggcgccgcatagggttgggtgggaatggacagggtgagctggaagcgaagcaccccagccaggccttaggagagaggaccgtcggcatctgtgcacatcctagcgggcggatgatgtgggagagaggcggagggaggtgaaatgcgggagctagaatttagctttgcagtgaggtcacttggggtctgcattcagctccgatatatacatgtaggggctgtgtgatcctggggaagttaccgaccttgtctgaactcctgtttcctggtttgtaaagtggctaattggtgggaattcaataggagaatgtgcgcaaaacgcttagcacagcgcctggccaacaatgcgctctcaagaaaggctgctgagccttgtccaggacggtctacaccgccccacgtccaagatgagttcacagcgcccaagacctgttcaatttaagatgatgtaaactgcattgcccttcttagacacgcagcagccaggagctggtcatctgcacctcccgcgatttcctcctcagaaccccagtcctgccagatttgcgtccttccctggctcctcaaacacctgctgcaccgctcagagcctttccccaccccgacctcctccgcagctccgcaccagcgagactgcgccccgtggcacctcgggggtgccacgattggcgggggatgggggatgcctcccagcttcatccgctctccgggttccagacaaccattccggagagccagctgctctcagtgcgggcaggcccaaggccactaactgcacttggcgacccacctccgttcccaagaggcctcggaaagtgcggcctcgggtctcttttgaaacagagacccgcggcaccccgcttctccccctgggataggagagggagagccgcgggagttccgcagccactcctggcgctgccaccacgaagcaggttcactagctaacagggcctgggacactgagccgtgtcgcaaacttttctgt

SEQ ID NO: 94518 - DNA, 169 bp, Homo sapiens
  chr6:10423918-10424087
  hyper
taaatcgctggaacgcgtggtgtcccaaccggcctggaaagaccgagagtaccatgagctgtgaagctggggtgtgacagggatgcccgtccagggctggcaagagtgcagaatggctctcttggatctttggaataggcacatctgcagaccccgctccaatgtttac

SEQ ID NO: 94519 - DNA, 96 bp, Homo sapiens
  chr6:10425382-10425478
  hyper
agggaaagtctgcctcgatctgtagcagagttttgggattgactttctaaactgcagccactcctcatctttggccttgtgaaaaacttgagaccc

SEQ ID NO: 94520 - DNA, 161 bp, Homo sapiens; identical to SEQ ID NO: 2765
  chr6:10425629-10425790
  hyper

SEQ ID NO: 94521 - DNA, 1119 bp, Homo sapiens
  chr6:10425838-10426957
  hyper
cgctactttaacgtctcagtctcgttcgctaagcccatgcgcctgggacttgttctttgaatctcaagtccgaaaagccaggaatcctcgatcatggacttcctcctgctaaattagagggagtgaaatttcgctctcctctccatcctacttccccatcccaaactcgctagattaagttcgctgaccaggcgcgcacccaatggcagcaccctctccaacattttccccaccagagaggcaagtgtcctacatttgtacgtaaaggtccctgagtggctaggtggagaggctcggatgtcttttcctggagcgggcctcggggagctgcagcagccccagcctcaggcaccacagccaagcgagcgcgccttgggctcgctgctctgcacgcagctggaggtctgggccgctgaccctctggccacgtagtcaacccgaggatgtgtgccccggggctcggccttgcctcgggtgagaaggctagtcaccattcagggtgcaggtgtcatggcctggaaatggcaatatctgagcaaacaggtgggcgtcgcttcccggcggtgcggtggccgctggctcgcagcgcgctccagctttcggcgccgccgccgcccctttgctctgcggactcagccagttcccgggtggcccagctgggtggctccgaggcctgcccccttgggctgcggcgggaggcggggactgcagtgccgagtgtagggcgccccagccgggctggcggttcacgctgcgctcgggcctctgccgggagggcgccctggcgccaaacccgggcgggcaggggggtggagagccgattgagtttattcccattcagaatttagaggctggtggagacagagagtctcctaaatggatgcaagtctcctgaaagtctgggccggaagcctcgaaactttctgccacgcaaagccccagctagtctccagggctcggtcctggttccctttgtgcaggcccggaagtgtccgcccggttttcccactgcctggaggggcccagggtcgcggatagactcggacaaggctccgtttactttcagtttgtcttagttgactaatggcgggactggttgtaatgcgtgctctgagattt

SEQ ID NO: 94522 - DNA, 19 bp, Homo sapiens
  chr6:105143888-105143907
  hypo
ccaccgtgcctggccctcc

SEQ ID NO: 94523 - DNA, 40 bp, Homo sapiens
  chr6:105384637-105384677
  hypo
ggtctcctaatgtgccgggattacaggcatgagccactgc

SEQ ID NO: 94524 - DNA, 7 bp, Homo sapiens
  chr6:105388314-105388321
  hyper
gcggcag

SEQ ID NO: 94525 - DNA, 85 bp, Homo sapiens
  chr6:105388632-105388717
  hyper
ggcgacagcggattccgtgcccggtggccgcgcgccgcccggctgttccgcgtccccttgccggctcacaatgtgctgaccctcc

SEQ ID NO: 94526 - DNA, 201 bp, Homo sapiens
  chr6:105389509-105389710
  hyper
gggcaggcgtcggggatcgtttttgctttggtatcggtgatgtaaattcatgaattaaaattaaggattttgaaaagaacggggaagaacgcacttggatttaggttgtttttgaaaaggaaaaaccaaagaggaaatgatacgtttgcaggagcattaactgactactgactggaacattggatgcgggtgctttgtgaa

SEQ ID NO: 94527 - DNA, 30 bp, Homo sapiens
  chr6:105389920-105389950
  hyper
gggtttgttttcatccgtaggtttttaagg

SEQ ID NO: 94528 - DNA, 362 bp, Homo sapiens
  chr6:105400890-105401252
  hyper
catttgtctccatgtcgtaggaatgtcaagaaagttaccgccaagtggtttaccaaaacgcggcggaaggaatcaggacagtttgcccgacgggcgggtcggcggctttcaggcgggagagatcttgccaggggcagagagagatcccgaaaatcgcccccagccttgcgtccagccctttctcgccgacgttttttcttgatcctccgaaggcccagggcgacgtttgccatcgcggcttcccgaaaggacggcgccgggtttgctggaagacagctcagttttaggcatggcccggtgggggtgggggtgctcattttcttgggttcggattccctctctttgaccgcacttatcttagc

SEQ ID NO: 94529 - DNA, 234 bp, Homo sapiens; identical to SEQ ID NO: 30722
  chr6:105401581-105401815
  hyper

SEQ ID NO: 94530 - DNA, 35 bp, Homo sapiens
  chr6:105404005-105404040
  hyper
accccaccccctgcccgcgccggctttttttctct

SEQ ID NO: 94531 - DNA, 155 bp, Homo sapiens; identical to SEQ ID NO: 30723
  chr6:105404519-105404674
  hyper

SEQ ID NO: 94532 - DNA, 268 bp, Homo sapiens
  chr6:105404877-105405145
  hyper
agccccttaaggatacgaggtgaaattagtagcaagaaagcatgtaattgacaaagtcacgtgtgctcagggggccagaaactggagagaggagagaaaaaaatcaaaagaaggaaagcacattagaccatgcgagctaaatttgtgatcgcacaaaatcaagatgttagattgatgcagaagatcactccgttccaaagggaaagttttcatctcacgagtttggagctgagggcccgtggggcaacatggccgaaggttaattttc

SEQ ID NO: 94533 - DNA, 895 bp, Homo sapiens
  chr6:105405570-105406465
  hyper
tttctctttcctcctcgtgcccgccggagagaatagtttcgctgaaaatttctctttgtcaatgggatcagtattaaatcagcaatatacaagtaaagtatcgcatgctgtaatgtaaaatgtggctgaaaaatggagttaaatgaataagtacacgtatgtatagaaacgtggaagttggtgtgatcgatagaacagtgtggcttccccctcccccgctttccttttaacccttttcattttaagtattttctgtggagaaaagaaatcaaaccattaaaaaaaattttttttttctgttacccttcccccccaaccccaggcaggcaattttttttttttaatctttgaatgcacattgaatgggaatacagactgacttttttgtcctgttccttctcaggcggggctagcaaaggtggtggagaagagcccgggaagctgccggagccggcagaggaggaatcccaggttttgcgcggaactggccactgtaagtggttcaatgtgcgcatgggatttggattcatctccatgataaaccgagagggaagccccttggatattccagtcgatgtatttgtacaccaagtaagccaaacttttttgtccccctcttcatctttttccatgtggaggagctgatcggtagttatgccaatagacgtacgataagatgtccttcggtatattgaaagacaaaatcttccctgaaatcactaggtagtccaacgtttagggtacgtgtatgggccttttcctgggttttctgtctaaagagaaaagaaaatatttgaaatttcactatatatattaaggttgacgttattagcatttccccctgcttcattctacagcgaaatagtgttcttgttgtttccggtattacctatac

SEQ ID NO: 94534 - DNA, 42 bp, Homo sapiens
  chr6:10541735-10541777
  hypo
atttatattcctttggatctatgggatcgctgggtcaaattc

SEQ ID NO: 94535 - DNA, 139 bp, Homo sapiens; identical to SEQ ID NO: 30726
  chr6:105584077-105584216
  hyper

SEQ ID NO: 94536 - DNA, 103 bp, Homo sapiens; identical to SEQ ID NO: 588
  chr6:105584217-105584320
  hyper

SEQ ID NO: 94537 - DNA, 185 bp, Homo sapiens; identical to SEQ ID NO: 589
  chr6:105584366-105584551
  hyper

SEQ ID NO: 94538 - DNA, 1082 bp, Homo sapiens
  chr6:105584552-105585634
  hyper
gcggccgctgaccgttgagggtctctgtggccgcagcgcccagacccggggagaagggcggcctccaagggccgggagcccctcgagggcgcggccagcgaggagggacagagggcggcgcccccggctgcccgggcgcgtagaacaagcagctgccgccagggccgacaaagttgctccccgaggggctgagatccaactttcgcttcccgatttagccaggggagcgcgaggccgcacacaacccggcgcggggggaaagccggctgcagctgcgcctcccatccttacccggctggtccctggcggggagcctgggcagcgccgaccaaagttcggagcggcagcttcggggcgcgggacgcggggcacacgggctcagctgctcgacgggagcccgacgcgcgctcctcggcgggtcggcgggtccggaagctccgctgcccgggccgggtccccaagcccgcagccgctttgactaaaataggcatcgcgacggcggcggcaggcggcggcagccagggctggggccgcaccgcgcacgcgcatgcgcccgccgccccgcgccccccggcgggcggagcccggcgccgcggccaggatttcccacctcgctcccgcgactccgctgcgggtctgcacacccgaggactcggtttgaaacgcccgcttatttattttcttgtcgcctcgctacaagattctatccttgtttgggcatgagtggggggcggcagtctcgtgggaccggcggcattcgtcgttcctccttacggggataattcgagaagtgcggtccgggtagggagagaaatcaggagagaaaatgagaaagagaatcctcgtttcccctcaaagttggacgacccactcgtatatctcctttttgggagattcgcccataactcagcacaaacagggaatagcccggaaagcgcgcgagttcccgtccgattgtggcgggggaggctgaacgtttggtccacacgggtgcaggacgcgggggtcaggcctcctgctgcggaggaagagggggaagaggccgcgcgggagggacttctgacacgcgccactgtttttgt

SEQ ID NO: 94539 - DNA, 715 bp, Homo sapiens
  chr6:105627368-105628083
  hyper
tctgggaggaatattcgcccagaagcctctagggcatacgactcgcgttcttcaggggtcggcgcggataggaaccgcagcaaaggatcccctagacctccgagctgtgagcggcgacacagccgggaccccagaccccggaccccagggcgcggagttgaccggagccgggaagggagcggcgcgggcagcgcggggcagcgagacgcaagcgctcgcaggggtcggcggcccagcagaagccgcgcccgctaagttgcccgaagcggccgcgaggtgcgagggtgcggacagcaccggaaggcggcggacgcagcgcccccgggctcaccttcttacctttccttcccagccctgcccggagcttcagcccggcgcccgcagaagtttcccggcggagcgcgcttgacccgggtggcccgcgcggaagccctcagcgtccccctcgtgagtgcctcgccgcccaccctgcggcgccgggcgcagcgtgaccgcagcgggctccggagcggcgcggcggcgcgggcgggtgccgggcacgggcgcgcgccccggggcgcagccgggtgggcgggcgcggcggctgcgtctgggccggggcaggcggttcggccaccggggtgcggggctgcggagaatcctagcggccgctacggaccgaagtttccaaagatgcggttccccgagtgtacaccgctcccggttgtaacataca

SEQ ID NO: 94540 - DNA, 257 bp, Homo sapiens
  chr6:105750389-105750646
  hypo
tcttcaggttctcctcgtgcttgctgggccagtggcgcaggcgcatgttttctcaggccgcaggtccaggggcttgtacctcttgcccttgtagaatttcctgaggttttctttgtgtgagtctggttaattacggtgagaacacgggcaatggaattgtggatgacacggatcttagagagcttggagaccgcgccgcctgtcagtggcgatgcgcagctgggacagctccaccttcaggtcgtccagctgtttga

SEQ ID NO: 94541 - DNA, 30 bp, Homo sapiens
  chr6:10591675-10591705
  hypo
tcctgaaagaattagcgagccccactttat

SEQ ID NO: 94542 - DNA, 78 bp, Homo sapiens
  chr6:10595774-10595852
  hypo
gctgggattacaggcgtgccactctgcccggccggttggttgggttgctttcttttcttaagccgtaccatgttccag

SEQ ID NO: 94543 - DNA, 42 bp, Homo sapiens
  chr6:106114044-106114086
  hypo
taaaaattaaaactccggtcccgctcacgaggggtcggggcc

SEQ ID NO: 94544 - DNA, 473 bp, Homo sapiens; identical to SEQ ID NO: 30731
  chr6:106429003-106429476
  hyper

SEQ ID NO: 94545 - DNA, 35 bp, Homo sapiens; identical to SEQ ID NO: 592
  chr6:106429589-106429624
  hyper

SEQ ID NO: 94546 - DNA, 127 bp, Homo sapiens; identical to SEQ ID NO: 30733
  chr6:106434152-106434279
  hyper

SEQ ID NO: 94547 - DNA, 1307 bp, Homo sapiens; identical to SEQ ID NO: 30734
  chr6:106441813-106443120
  hyper

SEQ ID NO: 94548 - DNA, 30 bp, Homo sapiens
  chr6:106534045-106534075
  hyper
gttgaaatacacatgcgaagagaggaagct

SEQ ID NO: 94549 - DNA, 30 bp, Homo sapiens
  chr6:10659521-10659551
  hypo
aagggaaggaggggccgggcgaggtggcta

SEQ ID NO: 94550 - DNA, 329 bp, Homo sapiens
  chr6:106808855-106809184
  hyper
accttccacctctggcgctccaaaaagaagcagcagccggcgccgcctgactgtggggtgttcgttccgcacccgctcccggcgcctgccggagaggccaggtgagctcctcgcccgagccctccagtcccacctcctcctcctcctccttctcctgctgcgctagcccttggactcctgaccccacttggaggaggggaaagccccggggtctgtttcagtccgcaggagggtacccgggtccggaggggagcgatcgtagccgctggggttgacgaggttcctcgcggcttttggttcagaccaagcaccggcgagaggaacttgtg

SEQ ID NO: 94551 - DNA, 97 bp, Homo sapiens; identical to SEQ ID NO: 30736
  chr6:106958240-106958337
  hyper

SEQ ID NO: 94552 - DNA, 87 bp, Homo sapiens
  chr6:106959519-106959606
  hyper
gcaaacggacacaagcgaggagggctccccgcgggagaatccccgagaggcagagggcgagctccccgagagcggtggccccgcagc

SEQ ID NO: 94553 - DNA, 107 bp, Homo sapiens
  chr6:106959939-106960046
  hyper
ccccagtgtgtgtgccgaagaaggctccctggggccccgcaacgcccgcagccagccccccaagggcgcgtctgatttgccaggtgagcctccggccgagggcgcag

SEQ ID NO: 94554 - DNA, 715 bp, Homo sapiens
  chr6:106960308-106961023
  hyper
gagcgctgccagggacgacgcggtgttcgacgacgaggtggcgccaaacgcggccagcgataacgcctcggcggaaaagaaagtgaaatctccgcgggcagccctcgacgggggcgttgcctccgctgcgagcccagagtccaagcccagccccggtaccaaagggcagctccgaggggagtcggaccggagcaaacagccacccccggcttcgtcccccacgaagaggaagggcaggagccgtgccctcgaggccgtgcccgccccgcccgccagcggcccccgggctcccgccaaggagtccccacccaagagggtgcccgatcccagcccagtcaccaagggcactgcggccgagagcggggaggaggcggcgcgggccatcccccgcgagctcccggtcaagagcagctcgctgctgccggagatcaagcccgagcacaagaggggcccgctccccaaccacttcaacggccgggcagagggaggtcgaagcagagagctgggcagagcggccggagcgcctggagcttctgacgccgacggcttgaagcccaggaaccatttcggcgtgggcaggtcgacagtgaccactaaagtgaccctgtaagtagccgcgcaagtcccggccgagttgctgtccgcacacgtgctgggggtccgctctgagaggctcggggtatctgcattgtggaagaaacgtctggtcactgaa

SEQ ID NO: 94555 - DNA, 44 bp, Homo sapiens; identical to SEQ ID NO: 40866
  chr6:107075561-107075605
  hypo

SEQ ID NO: 94556 - DNA, 41 bp, Homo sapiens
  chr6:10776289-10776330
  hypo
agattacaggtgtaagccaccacacccgacccaacatgaca

SEQ ID NO: 94557 - DNA, 332 bp, Homo sapiens
  chr6:107809976-107810308
  hyper
ccaccactgtcataacgaacactccacagtaacatgcagtggaacaatggacacccccatatcgcattgtgtcaggtaattatgaagtgtcgaggcgcgggaaggagaagccgggaacgtcaatgtgtcctctgcaacgtgtgggagcgctcagagccgcgcgtatcacagaaacatcatccagtcgtcacccccaatgcctcaacccagggacagggacagactcaatcagacctcggccccaggcgtggcaggagagggccaaagaggggacttgtgagcgcagagggagcgagcaccgctccatggagggcaggcgctagctgggaagt

SEQ ID NO: 94558 - DNA, 43 bp, Homo sapiens
  chr6:107810622-107810665
  hyper
attgccattgcagtccgaggcagcgccgcgtggaggaccggcc

SEQ ID NO: 94559 - DNA, 126 bp, Homo sapiens
  chr6:107812382-107812508
  hyper
ccaaccaaccagctgcgacggcgtgaagagcccgtcagtgcccggcgagctgcggcccgagaggcgcgggtctgggcacggtcctgaccgctctcctcgcccgcccccgcccgcacctcaccactg

SEQ ID NO: 94560 - DNA, 165 bp, Homo sapiens
  chr6:107886594-107886759
  hypo
catggtagagttctacgttgctccacctcttcgtggaatccagtacaaggcaggtgcaaaggattggacccagattgcatgataggtggatggagtgggtgtgtggcggctggggagggacgggggtgggcggagagagaaagagagagacgtaaagctgaccca

SEQ ID NO: 94561 - DNA, 88 bp, Homo sapiens
  chr6:108274499-108274587
  hypo
cccaaaactgtactacgggggtcctcatcttttacttaaaatccttaagaacaaatgtgcttcagaatttttcagatttgccccgtcc

SEQ ID NO: 94562 - DNA, 80 bp, Homo sapiens
  chr6:108280340-108280420
  hypo
tctccactgggcgacagatttgaatctacgctgtgcccatcttgcagatgaagatttccccaagccgttacagatggttc

SEQ ID NO: 94563 - DNA, 179 bp, Homo sapiens
  chr6:108323266-108323445
  hypo
atggggggcagaaaacgctcaatttccaacatgggggaaattcaacaagacgccataggctagggcgtatctaagttaggtactggaagaatttcaaaggcaaagactggaaagaacagtgtgtggcaggacagattttgaatttcaacctctctaccatctctcgcagaactttcaat

SEQ ID NO: 94564 - DNA, 324 bp, Homo sapiens
  chr6:108434925-108435249
  hyper
aggtgtgggagatgccgtggtcagcccaagggcgagatgcgcctcggggtcggagtcgcccgagtggagactggacactccatgggggaggctggaaccccctgtgccacagataaatgctcgttctccaccacatgtgaggcatttgaataggagcaagtctcccgggttgggaatactaggaagtgctgggggacaggcaaggtcacggcatccaggctgcaatgcaaatgcctaggtagtgcgcacggcagcggtaatccagaatcctgcccaaagagggtcccgcaatcaccgcccacttccaggcgggcttggggagcc

SEQ ID NO: 94565 - DNA, 795 bp, Homo sapiens
  chr6:108436034-108436829
  hyper
cagcccttccccccacgtgtcattaaaaaaaaaaaaaaggcttagcctgcctgcgatttccaacttctctttccacggatcgaccgcggccttggcaaggacttgagtctgcgttccagccccttccgctcccagcgcgcacgcagcctctcgcctttgcgtcggcgggttgctggttgccggtacccgctcagcagctaggagccttggggaaccctagctcttagcttccccgtctggcgaggccagagggccaagttgctcactgggctgtgctgagggataaggggagaaaagaacggaaatcgcagctacgagggctagagggacggcgcggctgcttgaggacgggtcgcctagcggtgggcgagtagggctgtgcgtaaaaggatctagacagacagtcgtgcgcccgcagggttgcaggacaggggcaggccgagttgtggcgcgtgtgtgtttgtgtgtgctcgcctccgggttgcgcgctttcagggctttggatgccggggattttgaggacccattcaaagctccgagggggcggaggctcaagcaagccagggaaaaggtcccctaagcctcagagcctgggctgcgccccagacaaagtgcctaatgcagagtaggctcttaataggtttgcattggatctaaacgaaagctagtgaaattcgtacatgattctaatgagagatgacggccaggtgttctcagcagcccctggccctcacggggcgacctgaaagttcccactctacccgagacgaaactcagagccgaggtgggggcgaa

SEQ ID NO: 94566 - DNA, 50 bp, Homo sapiens
  chr6:108438107-108438157
  hyper
cactcccgccctctacgacgtcctccctggcccgggcagcccaactgggg

SEQ ID NO: 94567 - DNA, 317 bp, Homo sapiens; identical to SEQ ID NO: 30743
  chr6:108438260-108438577
  hyper

SEQ ID NO: 94568 - DNA, 98 bp, Homo sapiens; identical to SEQ ID NO: 30744
  chr6:108438779-108438877
  hyper

SEQ ID NO: 94569 - DNA, 1150 bp, Homo sapiens; identical to SEQ ID NO: 30745
  chr6:108439495-108440645
  hyper

SEQ ID NO: 94570 - DNA, 415 bp, Homo sapiens
  chr6:108440744-108441159
  hyper
cgagggaggtctaccgcagcaccaccagcactggggagattccgggcatctggagcgaggaaggtgtgctataggggttgagtccatcaccgtggaagtccggggaatgggaggtgcgactcggtcccccacctctaccccgggcacggtggtgtcttcttttaaagacgtctcacttcgcaattggaatcgaagcgtgggccggtgtcgggtcttcctggtgttacaggcaggaggagggaaaactgagtccttcctgggatggggcaggaccctcacacgcaagaccccactgagctggactggcgcgggggcggatcccttctcccaaatgcttctgaatggcgcgcgacctggtcccctctgccacacggaccctgcgcgcacgccctggccctggcggcctctggggaca

SEQ ID NO: 94571 - DNA, 21 bp, Homo sapiens
  chr6:108475755-108475776
  hypo
ttccatctggccaggcgcggt

SEQ ID NO: 94572 - DNA, 30 bp, Homo sapiens
  chr6:108478521-108478551
  hyper
tgcgcttcccccagccgggtgccccagcct

SEQ ID NO: 94573 - DNA, 890 bp, Homo sapiens; identical to SEQ ID NO: 30747
  chr6:108478806-108479696
  hyper

SEQ ID NO: 94574 - DNA, 324 bp, Homo sapiens
  chr6:108484872-108485196
  hyper
gagtagaaggcagcccgcactaaggctccaggcttatttgggacctggtgggcgacggggcctcagcccctcccgcctaccctggagcttgttgccgccgttaccactgaaccagtcatgccagaaagtcatcacgatgatttcagaactgtattgtgatttatgcaaagcgcgccgataattacagccgggcgcacagaacacaggatgcatatgctgcgggtgtgtgcgcgcagtgttgtgcctttcgccagggctgaatggggtgtgtgtgtattccgtaggcatcttcttgacaccatgcttgatcggggactggtgaca

SEQ ID NO: 94575 - DNA, 494 bp, Homo sapiens; identical to SEQ ID NO: 2891
  chr6:108485513-108486007
  hyper

SEQ ID NO: 94576 - DNA, 998 bp, Homo sapiens
  chr6:108486008-108487006
  hyper
tgctgtcggagcccactggagcgcacagcccgctccccctgggacgcccaggcggaggacctgctgcgccctcccagggctcgggggactccagcattcacttgcacgcacaggcgaactctgattgaaagcccgggatgacaccgagtctggagaaagagggaccggggggtgggctggcggaattgcagagcgccggccacagctcccctccccgcgaacgtcgagcggagggcgggaggtgtaacctctgacctctggccgggtccacgccctgaggagggactggcaagctcttgttcgacaagttcaagctgccgagagagcttaaatagaattaatctcttagagatcggggatcatcgctccctcggcatgcgctctcccagcgccgcgcacagagcaaggcgcgagagagctcaggaatcgcgggaaggcaagcggaatggggagggggtaggggatgagggcctctcttcactattcctccgcccggagagcgggagcccgcaacgcccgccgaggacgagcggcgggagggaacgctctgccctccagccgccccggtgcagataatggaggcgacaagagattcgctcagcgtcggatgggccagctctgcttggggaagctggcggcatcctcccctcggctggtgcccaaacccactgcgcgaaggccgaaggaacgcggaacctccagaagaccccatcctcagccctgactttccgtagatatgtgcaaaatgagtaaattactcacctcgggccagatccaagttttacccaacagaaggggcaccggaccaagaatgaaccaactcacatggccatgtccggcgcgcacaatcacacgccagcacacagccacccaatttcttccgcgaatctatctggcactctggagagagggggaaaagcgttttgagaaagccccgtcacccctccccttccttcttgccgtgaaatatacgaattcatttttattacgagccgcac

SEQ ID NO: 94577 - DNA, 405 bp, Homo sapiens
  chr6:108487077-108487482
  hyper
cgcctgcattttctttgggagccgcttggaggttcattaatatcattagcatttaaccccctccctcttcccatcccctccccgcacatggctgacgtcagaccccgccaggagttgggggaaaagctaagtgggccagggacgccctattcccctccccgcggctgcctgtcagagcgcttctggagatattacaggggacccagcccgcagcgacaggcacaaagtcacggggtaatgaacttcggggacccttcgccgctgcgtgcgcggctctccccggaaacccggacctggccgcctcttccctcggaagatttcccagcaatctagttttcccactctgcgcttgggttccggcagcgcggagcccgtctgcctctgagactgcggtagtgttttcct

SEQ ID NO: 94578 - DNA, 819 bp, Homo sapiens
  chr6:108487779-108488598
  hyper
atttccactgttggacgaattctgagcgcccagggagcagcgcagcgcgcgactgacacccacctgtcccgcccaggagccttgcaggctggagggcagctggagagcggcggcgcccggcggcgaggcgggcgctgccggccgggactcgggcagcgcccaccaaccgctccgccccgggacagccagcatgagcaagccagccggatcaacaagtgggtacctctcgggccgccgtggggcctaggcgcgcagcctggggcgagcgagcggggaggctgggggaggtcctgcctggagcgctgcgaatctgagcccctgagagggattccagcgggcgtgtgcgttcggcccagacctgtagaccgtgagttggagcatttcgtggagaggggagagccgtttcgttgcctctggattgcttgatcccccctgtctggtgcggtgagaaggttacgacccgcgcagcccaccagtcggatgagttgtctccatttagccgccaggtgctggatgggggggccatgggggcgggaactgggccgcagctccaggcggtagcacaataacacactcgctcaaaactccgagctccagcgcgcaaaagcaactctgtgcaaagcggattttgaatggaatgctttgcaccccgtttctagctatttcaaataatcctgcaaactgggaagcagaaacaatttaaaagtcacattttccttaatcctaaatccgcgtaggtcataactggggaatttaaagtatggcgaaccactctagcaaagagaggaccaaatccctaatcccaaggacttttcgagc

SEQ ID NO: 94579 - DNA, 180 bp, Homo sapiens
  chr6:108488821-108489001
  hyper
cggtcacggtgctcagatctcccgggggcatttcagttcccgccatccagtggcccacggctgcgggctccagggtctgaggctggggactaccgttgccgccgcagtccccatatcccgaagttgccttgctgcttgtgttgttttcgcagatagcatttttggcgctctgtgcgttcc

SEQ ID NO: 94580 - DNA, 148 bp, Homo sapiens; identical to SEQ ID NO: 30755
  chr6:108489661-108489809
  hyper

SEQ ID NO: 94581 - DNA, 180 bp, Homo sapiens; identical to SEQ ID NO: 600
  chr6:108490066-108490246
  hyper

SEQ ID NO: 94582 - DNA, 219 bp, Homo sapiens; identical to SEQ ID NO: 601
  chr6:108490296-108490515
  hyper

SEQ ID NO: 94583 - DNA, 464 bp, Homo sapiens; identical to SEQ ID NO: 30758
  chr6:108490537-108491001
  hyper

SEQ ID NO: 94584 - DNA, 339 bp, Homo sapiens
  chr6:108491107-108491446
  hyper
cgcggggttgtaattacccggccgagcctggtcgttaccgaacaccccctcacccccaagcacggtcccccgcgctctccttcccccaccccctccacctgagacgagtctgggacccacggtgcaagctcgcccggacgcctcgggttccaggagcaagtttacacctgcggtgcctcgaggccctccccgcgccacgccctcacctcccctactcccctcgcccagacgttccactgccgccccttcccacctcaatcccatcgtagtccccaacccaagcgctttcggcagcagctgtcgaatttcagggaggcctgaggccgctggggcccaaac

SEQ ID NO: 94585 - DNA, 346 bp, Homo sapiens
  chr6:108492203-108492549
  hyper
atccctggttccagccgtgtttgtttttcttcttttcccttttacatttcaagtttgtctcctcgcgcgctcactaacaactttctctgttaaatgcaaaagcgaaggagggaggcggccaaactttccgcggagcagaaaggcagtggagggccgcactgccgcccgggcctgctgtcatcttttattccaaaatgggtctcggcgattagaagagaaccaaatacatgtagcggtgcatgaataatgctcattgtaggaaactgacacttgctcaaggaaaaaaagtttgggtataaaatcacttcattatttgcttttaccgcagcttcggtgctaatccctt

SEQ ID NO: 94586 - DNA, 179 bp, Homo sapiens; identical to SEQ ID NO: 30761
  chr6:108495639-108495818
  hyper

SEQ ID NO: 94587 - DNA, 551 bp, Homo sapiens; identical to SEQ ID NO: 603
  chr6:108495915-108496466
  hyper

SEQ ID NO: 94588 - DNA, 342 bp, Homo sapiens
  chr6:108497125-108497467
  hyper
tttctccagcatactcggagacgggttctccctcgttccattccctagcaatcccggggctcgggtcctttcctcctgcggccctcggaggccaaaagctatttctgtgggggcggggcctgcgggtagggaggcttgttcttggacggagctggaaaagtctgcgcagaaacgaggtgtctggcgtgcgcgacgctccctctcttttggatgggggcgaggatacctggctactccagcccagagggtctctggtttccctgcgaacccccttccctggtggggaggagccctggaccgaaggagaacacacctggtcttacttgaggctctgccattatc

SEQ ID NO: 94589 - DNA, 386 bp, Homo sapiens; identical to SEQ ID NO: 30309
  chr6:10881854-10882240
  hyper

SEQ ID NO: 94590 - DNA, 172 bp, Homo sapiens
  chr6:10882241-10882413
  hyper
gtgctgaacgttctccacccgaacggcagcatcgacctctggcagctgccccctcctttataaagatatacctccggggggctccgccctgtctcgcctacctcgctagcgcccacgctccaggggccggtcgccccctccaccacagtcccaggaacggaggtggaggtta

SEQ ID NO: 94591 - DNA, 15 bp, Homo sapiens
  chr6:10883008-10883023
  hyper
ttgggcctccactgc

SEQ ID NO: 94592 - DNA, 279 bp, Homo sapiens
  chr6:10883114-10883393
  hyper
cgagcccaggcgccttcacgctcccggggacttcggagggacctggccctgcaggaacggagtcctacaaagtgaacctggaggaggtggggggcggaaatgagcccggggtaggtgggagcctggggtaggtgggagcctggggaaggagggaaaggggagaggggaaaagtcccaaagaactcgctttctccactgctttggctccctctgggtctcagcttccttatctgtttatctgttaaataagaggttgtggttcggcgagctctcagttgc

SEQ ID NO: 94593 - DNA, 268 bp, Homo sapiens; identical to SEQ ID NO: 30313
  chr6:10886917-10887185
  hyper

SEQ ID NO: 94594 - DNA, 530 bp, Homo sapiens; identical to SEQ ID NO: 30314
  chr6:10887186-10887716
  hyper

SEQ ID NO: 94595 - DNA, 131 bp, Homo sapiens
  chr6:109038572-109038703
  hypo
aaggctgccctgacccgaagagggtgcccgaggcttcggtgtgctgaggccggggcagctgctggacttcgggtcttcggtgcggaccctggacctgcctcagatccgttcctagccgcccctctgctctg

SEQ ID NO: 94596 - DNA, 24 bp, Homo sapiens
  chr6:109057736-109057760
  hypo
tgttaggaatattctcggcccggt

SEQ ID NO: 94597 - DNA, 82 bp, Homo sapiens; identical to SEQ ID NO: 14879
  chr6:109059835-109059917
  hypo

SEQ ID NO: 94598 - DNA, 39 bp, Homo sapiens
  chr6:109578459-109578498
  hypo
attacaagtgtgagccactgtgcccggcctgtatagtct

SEQ ID NO: 94599 - DNA, 139 bp, Homo sapiens
  chr6:110299095-110299234
  hyper
aacctcccccttctccggggtttcttttttgacctgatccctcagtgatctttgacgctgggctttgctgcccggcaggtgtcactcatccttcacccctcccctcccagctcaccctcttcgccgcctggtctcaggg

SEQ ID NO: 94600 - DNA, 193 bp, Homo sapiens
  chr6:110299501-110299694
  hyper
actgtatctctcactcgcggagccggcacagcgacaggcgccccgcgcttgcctcctccccggcccggccgcctcctgcaggcagctgctctgtttgcgcggggagctcagcccggcgccccgcctcggcgcccatgaccagcgacttccagaagtcctgacgccccaggtgagtggccgagttcccagggaa

SEQ ID NO: 94601 - DNA, 30 bp, Homo sapiens; identical to SEQ ID NO: 30765
  chr6:110299948-110299978
  hyper

SEQ ID NO: 94602 - DNA, 405 bp, Homo sapiens
  chr6:11043701-11044106
  hyper
cacacacacacacacacacagcttactgccgaggagaaagaagcgttactaatccagagtggaggactggcctgggaaatcgggcagagagaggagttgtcggaaagaacacaccagaagcccctccgagcccagacactgatagaaacccagccgcttcccaagccaatctgcaaacccaggaggcacccacgagtgcacagacacacccccggggtgcaggcgcggtgaagggaggagaggggcaagagcttgaccgttagggcccgaaccccagaactcccgaggcagggtgtgtgccgcgcgcgggaaacgccgttctccgctccaggcgtcggcgggcggtggcgagagcaggttcgggggtccggagggtcggagggtgggctgcgcgcgggaatggcc

SEQ ID NO: 94603 - DNA, 434 bp, Homo sapiens; identical to SEQ ID NO: 30316
  chr6:11044107-11044541
  hyper

SEQ ID NO: 94604 - DNA, 388 bp, Homo sapiens
  chr6:11044542-11044930
  hyper
ctatctcggcgcccgcgccggttacccccacccacacccacgcccggcgcgcgcacacccgcccgcgcctccccgccccctcgggctcgcgccgccgccgcgcggcgctccgagcctcggggccgtttcgtccccgccccctctcccacaggggcctcgccggccgccgcgccaggagggcgcgcgggggaggggcgcagggcaagtgaggcggcgccccccgcccctgcggcctcgcgcgccccctcctgggcgaccgacctcgccctcgcgtccgcggcgtcccctgccggccgggcggcgatttgcaggtccagccggcgccggtttcgcgcggcggctcaacgtccacggagccccaggaatacccacccgctgcccagatcgg

SEQ ID NO: 94605 - DNA, 526 bp, Homo sapiens
  chr6:110678874-110679400
  hyper
cttcttcacgggatgcgcggagcctagaagggcgcccggccacggcgacccccaagtactggctgaatagtgaatgaactccgcttggccgcacttcagtctatctgggcactgaaagatgcgacccgtggagccgcctaagagagcacagggggaagagaagaagcggaagcctccggaggtcccatcgaggcggcctgcgggacctgagcgccgggctccgtagcgcggtcgggagggggcttctggtcccaggcccaagaccgaccgctttgcaactgaccttccggcgggggcgcccgcgcggggcacagcagccaggctccggcgtcccgctcccgccgccccccggcggcgcccggcgaccgctgcgcacgtaggtcacctgcctcctgctggcgccgcgcggctggcccggcgcgggcggcaggtgcggcccaggtggccgccaggccgggcccggcggggcgctgcgggtgggggacccgggcccggcgcgccgcagctctgcgcagagccgcaggcc

SEQ ID NO: 94606 - DNA, 342 bp, Homo sapiens
  chr6:110679401-110679743
  hyper
aacaacagcacagccccgagtagacaccggcgcaggacgccgcagcccctcccgggcggcctctcccgggccatggcgctacactcggggtcccgcgggccgcgcctggccggcagcagggatgtagccccacaggccggagcggccaactgtgggaactcccccgcgggccggggtgcgggctcggacccgcctccctccctcccgaccgaggaagccccggcgtaaccttatcctgccctgccgagcgcgccccgccgctggaacggtggtgggccgaacgcggtcacagggggccctctccgcccctccggaggtgccagggcccggctgtacagggtc

SEQ ID NO: 94607 - DNA, 325 bp, Homo sapiens
  chr6:110797490-110797815
  hyper
tccgagcgagcccagcgcctctgctcaccatgccaggtcccgctgccagaggcctagaggagaagcccagctaggggccggcgtctggacgcccgtgtcccgactgcgcggggtgaggaggaagtggagatgttttcggatcgcgagcgccgcgcgagaaccccgccgcaacggaaagaaacagacccctcggcgccgcctcccgcgtggcgccgcggggcccctcccccatacctgccgaagtgccccacgtggtcataaatcccctcgaagtggcgggaccccatggtgcggccgtgcactgggcgccgagttagccgagctc

SEQ ID NO: 94608 - DNA, 52 bp, Homo sapiens
  chr6:111409316-111409368
  hyper
cgaggccagcctgggcgacccgcgtggggcccccgagcgcatcccgcgtgtg

SEQ ID NO: 94609 - DNA, 217 bp, Homo sapiens; identical to SEQ ID NO: 30769
  chr6:111409641-111409858
  hyper

SEQ ID NO: 94610 - DNA, 16 bp, Homo sapiens
  chr6:111581391-111581407
  hypo
gcgtgagccacggcgc

SEQ ID NO: 94611 - DNA, 30 bp, Homo sapiens
  chr6:111874444-111874474
  hypo
tatgctaaagtgcctcgtgcagcctccctc

SEQ ID NO: 94612 - DNA, 30 bp, Homo sapiens
  chr6:11288375-11288405
  hypo
gctcagtcaaaattacgcaggctggttcag

SEQ ID NO: 94613 - DNA, 53 bp, Homo sapiens
  chr6:114177562-114177615
  hyper
caaaaagagtccattcgattctggcagtaggctgaaaacgatccatattgacg

SEQ ID NO: 94614 - DNA, 872 bp, Homo sapiens
  chr6:114663003-114663875
  hyper
ggcgagcgcagtaaacgcgtgttccctttctccctcaaagagagcgctacccagcgctctgggagagactgagagagaaacagacaggcaggctgactgacaccttctgtctaattttaccccaggaattgcccccgccgtttctcatctcgcactagtttaacctctggtcctaagcaaacctctcaaaagtcttccccaggcagcgcccaggagaaccgaaccccacaaagtgcttttttgctggcatcacccggatgcttccctttggcgatttgccccttctcatttccccccaaatctagaggtctcaaagcccctcccccgcgcgaggcgggcagcgcgccttgctcaccgtggtccccggcggtggcggcgcgggcgggagcctcagggcgcgggggtcggcggcgggtcgcgtgggggtcacccggccgctgctgcggtccggacggcagttggtccagtagtttcggatgcccgggctaggctcggcggagagcgagtcggcgtgaatgagagcaaaccaacagggctgtgcgtggcgcgtgtgagtaagacgcgagcgggccccacacgcaggcggcggcggcggcggcggcggcggcgaggtctgaggcggggagccgggcgggggggcaggcgggcgagaagtagtggagtttagggcgcgtttcctgcacttccccgagaggctggaaccaggtgcggcagggcgcgctcccgtggcgcgggcacggcacgggcggccgcaggagccggagtccgcgcagtgccggagaccgcagccgctctgcggggggaggtgcgcatcctccttgccccacgagggcaccggcgcagccccggaccctgcgcgcagagggcgagac

SEQ ID NO: 94615 - DNA, 268 bp, Homo sapiens
  chr6:114664337-114664605
  hyper
gggtggggaaggaagcgcaggtgtcttcggcggagagacgggcgcacgcaccggagcggcttgctgcagggggagggcagggccttaggcggagaaaggggaggaggaggatttacccggaggcggaggtcccgcagctgagccactgcgcgtcccacccaggcgctggaaccgcgggcgagcagcgcagtggggctgccgggtgggcgcgcagggctcccagttggactgaggtcgcagcttggggaacctgcggaggtgaccaggg

SEQ ID NO: 94616 - DNA, 137 bp, Homo sapiens; identical to SEQ ID NO: 40872
  chr6:116574057-116574194
  hypo

SEQ ID NO: 94617 - DNA, 61 bp, Homo sapiens
  chr6:116783506-116783567
  hyper
tgcctcggccgcaaccgcagctgcgccgcggagctgccgctggtgccgtgcaaccaggcca

SEQ ID NO: 94618 - DNA, 158 bp, Homo sapiens
  chr6:116937904-116938062
  hyper
ctgagcccttggaggcgaagcaggggccagaaactggacgccagtcccgaagcagccgtccttggagcccgcagtctagagccaagacgcctctgggtggccccgcgggaccagaaacatcatcacctgctcctgtctctccgcgggagccctcttcc

SEQ ID NO: 94619 - DNA, 30 bp, Homo sapiens
  chr6:117001154-117001184
  hypo
actcatgattggcaacgctttctggtaaca

SEQ ID NO: 94620 - DNA, 283 bp, Homo sapiens
  chr6:117086196-117086479
  hyper
tgttggcactgcggccgctttcgctcctaggtggccgcggtcggaaggtgggtcaccccgcacccttgcggccggggaccgactctccttcgcgcggcggtcgccacacttacgggatccgaggcgggatctcctccatcgatttgaaacgccctgtccacagcaggattttcttgtcgaactgcgaaggcctgcgctgcgtggggactcggtgaatctcccctgcagcgaaagcaacccagatggacgcgggaactgacgcaccggcacagaggatcagcgc

SEQ ID NO: 94621 - DNA, 160 bp, Homo sapiens; identical to SEQ ID NO: 605
  chr6:117086480-117086640
  hyper

SEQ ID NO: 94622 - DNA, 21 bp, Homo sapiens
  chr6:117089618-117089639
  hypo
ccaccacgcctagccagcaca

SEQ ID NO: 94623 - DNA, 74 bp, Homo sapiens
  chr6:117197631-117197705
  hyper
acttaagcaaacgtccgttgccgtactgctaggtatgagatgagtaatcgtcagggacgcgtttaaattacaaa

SEQ ID NO: 94624 - DNA, 84 bp, Homo sapiens
  chr6:117198137-117198221
  hyper
tgtgggcgcccagggcgtgacaggcgcaggtgagaaagtgagtttcgcgggagcatctgccgggaccgcagacaggtggagaaa

SEQ ID NO: 94625 - DNA, 30 bp, Homo sapiens; identical to SEQ ID NO: 30778
  chr6:117198544-117198574
  hyper

SEQ ID NO: 94626 - DNA, 798 bp, Homo sapiens
  chr6:117585846-117586644
  hyper
aactttaaaggaccccggccaaggagaccccagcatgaaaagccagacatccgaggccgggtaaagcctcctggactcctcgaaagcagctcacaccgggagcagccggaagcgggcgcgatctatgcgaagctaacgggttccggtggagaacatcaaagagaaaggagcaggatcgaactttagaggggcagaagggcacggcccaagagagcagaattggggtgtgggacaggcggcgggaggaccaggttagagggagcgaaaggaagtggattagaggacagcggttacaggtttcagccactgccatttccccgcagaggtagctcttctgcgccctggaggggtacccggactcccacatcctgtctgccacgacccggactccctaggggattccaagggacagcaccgtcctccccatacatcatcaggaaccgaaagcagagaatttgccccacctcggcacttctggaagcacccactcaactacagtatgagacaagggctttcctaagagacctttctccaactttctttctctgcgtgtatgagcccggatcccttcgtccccgcctccttctctctctctctttctctctctctcctattttgtcctgggagattcctactcgcggtgcgaagcctcggatccgctgggaaccgcatagtctccggcacccttggccgcatgcttgtcagaggtgggccccgggaaacacactcgctgcccctccaacaagcgtccctcgctccccattggccccccggtccccgccccccaccgccccctcc

SEQ ID NO: 94627 - DNA, 167 bp, Homo sapiens
  chr6:117587123-117587290
  hyper
ggcgcagccgggatgcggggattgccggagccgcccccagttggtagtgcaattagctaacccctttagctcgcctgtttgctctcgggaagcagctaagccctgctaatgtgagcctaggtcttccctggaataatcagaggaagatggcacgggctggattttct

SEQ ID NO: 94628 - DNA, 101 bp, Homo sapiens
  chr6:117587547-117587648
  hyper
tttcaaagagcaccgcgcagttttataattttttcctttgcgaagttctgggagcattatccggagtgcgaatgacccggcagaggcgagcctgatagaca

SEQ ID NO: 94629 - DNA, 461 bp, Homo sapiens
  chr6:117591136-117591597
  hyper
gacttcaaaatatgtcgatggactttcagtctgtcagagacgttaggtggtggggggcacattttctggagcaagaaggctgaaacgcgagagggggtagtgagatcactaggcggccgaccaagagtgggaagaggtatcgttagcttggggagaggttaaggctaggaaagggaggccgtgctgcgctgagtcgcgggaagctccttgagcttcaaggacttgagtcggggagggagtctctccgctcttgctactctacccgccacttggtttccgcactgaggactcggctgcgaaatgggaggaagcaggcctccttttcgtgggttcccagaagcccccattttgcagttcccccacctcgctttcacaggttgcagcccccttagaaaaacgccgctgcagaggcgggggctgcccatcagccccggccatggctagccagccctgtgcccgcc

SEQ ID NO: 94630 - DNA, 524 bp, Homo sapiens
  chr6:117591683-117592207
  hyper
cgcctccccggccggcctacagactgctccttcccgatgagccagcgcagcttccccgcctccttctggaatagcgcgtaccaggcgccagtgcccccgccgctgggcagccctctggccaccgcgcactcggagctgcccttcgccgccgccgacccctactcgcccgccgcgctgcatggccacctgcaccagggcgccacggagccctggcaccacgcgcacccgcaccacgcgcacccgcatcacccctacgccctgggcggcgccctcggcgcccaggccgccccctacccgcgccccgccgccgtgcacgaagtctacgcgccgcacttcgacccgcgctatgggccgctgctgatgccagccgcctcggggcgcccggcccgcctcgcaaccgccccggcgcccgcgcccggcagtcctccctgcgagctctccggcaaaggcgagccggcgggcgccgcgtgggccgggcccgggggacccttcgcgagcccctcgggggacgtggcccagggtct

SEQ ID NO: 94631 - DNA, 20 bp, Homo sapiens
  chr6:117913241-117913261
  hypo
gcacaaggctgggcacggtg

SEQ ID NO: 94632 - DNA, 30 bp, Homo sapiens; identical to SEQ ID NO: 40873
  chr6:118113403-118113433
  hypo

SEQ ID NO: 94633 - DNA, 237 bp, Homo sapiens
  chr6:118227995-118228232
  hyper
ccaggccaattatggcgaatgtagtaggagcaacatctaggattctccgtttgggtttctaatccggggccggcacctgtctcggcgtcctgccgctgtcccaggccggtggtgctggattccgcggcgcttgggcagaaacgaggaatccccgccaactccacagggaggatctattcccagcccccttatccccctaaaaaacacccaaaccaaaacaatcaccacaacctagac

SEQ ID NO: 94634 - DNA, 546 bp, Homo sapiens; identical to SEQ ID NO: 30787
  chr6:118228323-118228869
  hyper

SEQ ID NO: 94635 - DNA, 520 bp, Homo sapiens; identical to SEQ ID NO: 30788
  chr6:118228870-118229390
  hyper

SEQ ID NO: 94636 - DNA, 157 bp, Homo sapiens
  chr6:118229416-118229573
  hyper
cggggggacgcggggacccggccagggctgaggagggaggcgcggggctgcagagatggcgtggaagtcctgggcctcgtgctgtcctccgccccgccccgcccgggggcttcgaccccttgccgggggaatggggtcgcagcgacagcctagcagg

SEQ ID NO: 94637 - DNA, 116 bp, Homo sapiens
  chr6:118229616-118229732
  hyper
cggactcttcctggctgggagcagcgaagagagggctagaggcctggaacagacccagcaaagtgcaaaacattgcgggcagggtgtgagccggcggcgcccagttattccgaagc

SEQ ID NO: 94638 - DNA, 117 bp, Homo sapiens; identical to SEQ ID NO: 30790
  chr6:118229733-118229850
  hyper

SEQ ID NO: 94639 - DNA, 304 bp, Homo sapiens; identical to SEQ ID NO: 30791
  chr6:118241005-118241309
  hyper

SEQ ID NO: 94640 - DNA, 132 bp, Homo sapiens
  chr6:118241394-118241526
  hyper
cggggcttgggtggtggctggaaaagggagaaccaggaggcgggggaggggcgctcggactacagaggaccggacgggggcgagtgttccgcggggtgtgtggagtaagagctgggacggacctttgtagct

SEQ ID NO: 94641 - DNA, 143 bp, Homo sapiens
  chr6:118971559-118971702
  hyper
tacacaacttctgagcgacgcaagcatgaaatggctgtccgatacaaacagaccccttcagatacggaatgcagcaaacccctaattttccttgaaggggccacggaaagccaaacggattcgtaacccggttgctcaatggt

SEQ ID NO: 94642 - DNA, 152 bp, Homo sapiens
  chr6:119030526-119030678
  hyper
ggagttgagtgtgtacgccagattgggaagtgacacatgctggcatttctcagcgcatgcggctccccactcggctttctggagctctgccttttggcgacagagcagctagagctcctctcccctcccccatttcctctcataaagataac

SEQ ID NO: 94643 - DNA, 30 bp, Homo sapiens; identical to SEQ ID NO: 40874
  chr6:119240714-119240744
  hypo

SEQ ID NO: 94644 - DNA, 30 bp, Homo sapiens; identical to SEQ ID NO: 40875
  chr6:119254223-119254253
  hypo

SEQ ID NO: 94645 - DNA, 149 bp, Homo sapiens
  chr6:119254660-119254809
  hypo
ctccgcctcaaaaaaaaaaaaaaagagagaaacacttatttcgtttggaaagagattgaggactggagaagaggtgtacttaaatttgacttacttcatttgtccaacatttattgtactggactctacaaatacgaatattaaaggag

SEQ ID NO: 94646 - DNA, 543 bp, Homo sapiens
  chr6:119399076-119399619
  hyper
ggtgcaagtcccttacgcgcaccgtgccgctgtgctgtctagcttaaattcatgttgccagcgttccaccaaagtttgcagggttttggaggtgtctccggctgttgcttcggcggaggagtagagttcccctcgctgcgggcgcagggcgcactgcctcccggggagacaggtgagtccggcgcggcccgcacggggtcgccacctgccccgtcgctgccccccttaccttggtgagctgggcgattttcttgctcattttcaggtgcatctcctggctgtagtccatgctgtgcccagccagctgtgcggtggccggcgagggcgcgaatttggccgccgagccgccgtaatagtgctgctgccagctcatgcccggggtcgccatcttcccaacagaccccagccggggcacctgtccccgcgggtggaggcaggcccgtggagcaacgacgcccgggaggcaagagtcgcggcggccgcttcccgacccgacacccggcgccccccagactcggccgcaggcgccgtcccacccgcgac

SEQ ID NO: 94647 - DNA, 36 bp, Homo sapiens
  chr6:119510906-119510942
  hypo
gagctgcatcagccccgagtgcgaacatgccccccg

SEQ ID NO: 94648 - DNA, 157 bp, Homo sapiens
  chr6:119527110-119527267
  hypo
acacatgatgaatgccgagataaatgtgtgaagagttctctgagcatctaaagctgggacacacaatccagcgtagtggggatggatcacagaagacttcttcaaggaagagactcctgagttgattcttgaagggcaagtacgagttggtgaggaa

SEQ ID NO: 94649 - DNA, 45 bp, Homo sapiens
  chr6:119538695-119538740
  hypo
cggcctcccaaaggcgtgagccactgcgctcggcagcaaatggaa

SEQ ID NO: 94650 - DNA, 20 bp, Homo sapiens
  chr6:119560062-119560082
  hypo
ttattatttttgagacggag

SEQ ID NO: 94651 - DNA, 32 bp, Homo sapiens
  chr6:119584473-119584505
  hypo
ctgtccctctaagagcgccctaactaatacaa

SEQ ID NO: 94652 - DNA, 147 bp, Homo sapiens
  chr6:119590025-119590172
  hypo
gtaagccaatgtgcccggccctcatttttctaaaacaactctctcatgaacgagtaggccatagacaaactacgcctgaacaattcttagagtcatttaaagtaacaatatagaaaggcagttgaataatgccgtttccttaccccc

SEQ ID NO: 94653 - DNA, 151 bp, Homo sapiens
  chr6:119604968-119605119
  hypo
taggccaaatcaaaacgactcaacttttaaggccacatggaccagtggtggtttgcaagaagactgtgtggagtgatgacaactttccttagtgccacagtggggaagagactgaagaggggagacgctggcagtacgaaggtcagttgga

SEQ ID NO: 94654 - DNA, 42 bp, Homo sapiens; identical to SEQ ID NO: 40878
  chr6:119689647-119689689
  hypo

SEQ ID NO: 94655 - DNA, 30 bp, Homo sapiens
  chr6:119714970-119715000
  hypo
aggatgtttccctgacgccttcccaggtgg

SEQ ID NO: 94656 - DNA, 30 bp, Homo sapiens; identical to SEQ ID NO: 40879
  chr6:119824210-119824240
  hypo

SEQ ID NO: 94657 - DNA, 30 bp, Homo sapiens
  chr6:119849249-119849279
  hypo
gaataaatgagataacgttatgtaagagag

SEQ ID NO: 94658 - DNA, 280 bp, Homo sapiens
  chr6:119888178-119888458
  hypo
tataaaatccggtgcactctgctgcaggccggaattcccagtccggcgtccctctctctcgcaagagagagagtcgttctcctttctctttcttttgactattatatatctgctctgaaactcactacctgcgtgtgctccttccctaattttcttggcgcgagataacgaacctcgggtatttaccccagacaaagatgcggctgcactactctctttcagtctggtcatgcacattaacgtattataactctgagaatttcttcgtaaaacacttatt

SEQ ID NO: 94659 - DNA, 45 bp, Homo sapiens
  chr6:119958265-119958310
  hypo
aaaattacatgatgccgggtgcggtggctcacgcctgtaatccca

SEQ ID NO: 94660 - DNA, 30 bp, Homo sapiens; identical to SEQ ID NO: 40882
  chr6:119989053-119989083
  hypo

SEQ ID NO: 94661 - DNA, 30 bp, Homo sapiens
  chr6:121193323-121193353
  hypo
cacccagggcagcaccgacacaccagtccc

SEQ ID NO: 94662 - DNA, 29 bp, Homo sapiens
  chr6:121370472-121370501
  hypo
tgctggccagatcccgcaataataaataa

SEQ ID NO: 94663 - DNA, 30 bp, Homo sapiens
  chr6:121654694-121654724
  hypo
agtgagtaattcgtgcggccacttaaaata

SEQ ID NO: 94664 - DNA, 57 bp, Homo sapiens
  chr6:121758249-121758306
  hyper
ctcctgccatcttagcgtctgccgggatccttcccgcgccttcgctgcccgaaccag

SEQ ID NO: 94665 - DNA, 417 bp, Homo sapiens
  chr6:121758539-121758956
  hyper
gaatcccactatctccgcgttggtaagaaaacctgaataccttgggaattgtgcttaaattgcacttgcaactcccctggaagttcctgaaacttcccgagaatgaggcggggcggctcaaggggaaagggcagggaggagagaccctcgggaagctgatgacgcgtccggggcaagtcagcctgtttccgagacgcgcgcctcacggtcgtagcagcgctgcgcccaccctgcccctttagtgacccagccagcctttgctgggggtttctgataacgctcatcgataagctctccttgctcccaaaaggcgtgcttctctttctctccaggtacaaagtaggggtgggaaggggagagctacacaatgttgtaaaaagaagcgtggctttatttggaagacggttgaatttcttt

SEQ ID NO: 94666 - DNA, 17 bp, Homo sapiens
  chr6:12194739-12194756
  hypo
aaaggacaaacaggccg

SEQ ID NO: 94667 - DNA, 30 bp, Homo sapiens
  chr6:122021822-122021852
  hypo
ggaaaatgaacagatcgtcaaagaaatatt

SEQ ID NO: 94668 - DNA, 48 bp, Homo sapiens
  chr6:12222846-12222894
  hypo
aagcctaaccctgcccgggcctgtgtctgatggcgaggcttggtatat

SEQ ID NO: 94669 - DNA, 142 bp, Homo sapiens
  chr6:12287999-12288141
  hypo
cgcgcgcaggcacacgtcttgcaaattcaggattcaaagagacaggggcaccattatatttggcacggtggggcccttccaggtctgaaatcctgcattcttccttactatttactttccccgagctcgagaagggccaggt

SEQ ID NO: 94670 - DNA, 349 bp, Homo sapiens; identical to SEQ ID NO: 40747
  chr6:12288379-12288728
  hypo

SEQ ID NO: 94671 - DNA, 36 bp, Homo sapiens
  chr6:122931170-122931206
  hyper
acagaaaacacgatgcgacgtcggaaagcaggaagg

SEQ ID NO: 94672 - DNA, 411 bp, Homo sapiens
  chr6:122932059-122932470
  hyper
gtgcttaccaagccccgggtagtcacgagcggccgcggggttagcagagacccgagtactaacccgctcggccagcgtccggctgtgtggctttagccaagtcacctcacctcactggcctccgtccattctttggataaaatatggaggtgggtagaccgagtaaactcaagggtcgcccgtagctattggattttccctgctcctaggaccccggcaggccgcagggagggacacgagtgccaggtggtcgcgggctgagggagcggagggcctgtgttccggttggtgctgatgctagccccttggggaaattcctgaaggtgcatttcggagccaaatgaccctgccttgcagcaggtcccttccaagggagctgagagggccaggtcagaccggtcttcgtagagc

SEQ ID NO: 94673 - DNA, 114 bp, Homo sapiens; identical to SEQ ID NO: 30795
  chr6:123316893-123317007
  hyper

SEQ ID NO: 94674 - DNA, 642 bp, Homo sapiens; identical to SEQ ID NO: 2911
  chr6:123317072-123317714
  hyper

SEQ ID NO: 94675 - DNA, 198 bp, Homo sapiens
  chr6:123317715-123317913
  hyper
gctgctcccgagcgcatcttcggcccgggtccccgccgccacccctcttctctgctccttccatcccgcccagaggagttgatgccgctgtcgccgccgccgccgctgctgaagccgcggctgatggatgccagggagtgccgcattgcttagcgaccccgcctctgggtttgctggtaggagcggctgctctttctt

SEQ ID NO: 94676 - DNA, 30 bp, Homo sapiens
  chr6:124012649-124012679
  hypo
tttttttttttgaaacggagtctcggctct

SEQ ID NO: 94677 - DNA, 793 bp, Homo sapiens
  chr6:124124293-124125086
  hyper
gccactcgggctttccggccgctctggatgcctcggttgcacccctgttccatgaccccagcttccttccctaaccctcctcttggtcccttctcccccgagcgcgcgcgcacacacacactcggttcgctcccgcggagtggctctgggagcacgaccgacttcagctcagcaaaccgcggtcatgccgcccagactcctcgccccgaggccccggtccccgccgccgccgctttcgcgccgctcctttccgcctagacaccgccgcctgcggccgcctgggcggcagcccctgcggtcctcaaagttggccccctgggagggggcggcagggagcaggatgaaggatttgttgtaggaggaggattcacacatctgggcgaagggaggggcagcgccgctgctgggacgcggcgcggacccgcatcattgcgcgcagcagccgctgcagcagccgccggggaccgcggagccgggacgcccccgctcggcccgcgccccgctccccgccccacccccgcccgccgggcccagcaacgcagggtgcctaggagccgcgggctgcgcagggaggcgggcagcggccctcgcgcgcttctgccgcccccggagccggcgcgcggcgagcgcagggcgagcgcgcgtcgggcggcggccgcgctggggggcgtgaggcgagcggcgcggagagcggcaggggcgaaacttcgcgggccagatgcccgagggcgcggcggcgctgccaggctgccgctgctgcccctgcgggccccgagcgcgcctccgcaggcgg

SEQ ID NO: 94678 - DNA, 79 bp, Homo sapiens
  chr6:124734409-124734488
  hypo
ctctttttgtttaagaattgacgttcattcttttaagtatgcagattttcaattgttgtggcaccgtttattgaaaagc

SEQ ID NO: 94679 - DNA, 30 bp, Homo sapiens
  chr6:125013668-125013698
  hypo
acgtaacatgagggccgggtgcggtggttc

SEQ ID NO: 94680 - DNA, 77 bp, Homo sapiens; identical to SEQ ID NO: 40885
  chr6:125081173-125081250
  hypo

SEQ ID NO: 94681 - DNA, 20 bp, Homo sapiens
  chr6:125088325-125088345
  hypo
caccgcgcccggccctattt

SEQ ID NO: 94682 - DNA, 61 bp, Homo sapiens; identical to SEQ ID NO: 30799
  chr6:125282732-125282793
  hyper

SEQ ID NO: 94683 - DNA, 357 bp, Homo sapiens
  chr6:125283133-125283490
  hyper
gggctgtaggtgaagcgcggggagagggaggtcgcccgctccggcctctcccccaggggccctgcggctggccagcgctccggctgcacctcctggtgcgcgccgcggcggcgccacaggcccctcgaccctttgaccaccgccctcgggccgcgcgtccggcagccgggaccggtgatggcgcgggactgacggccgtctcctcccagacccctctgtcccgcctggggctcgctggggctgcggcgccgccccgagctgcatgtggggcgggcgcgcccgagcccagagcgagcggccctcggcgcccccgaggcggtgccccgccgcgccagagtacgaggaggagcggcgggc

SEQ ID NO: 94684 - DNA, 705 bp, Homo sapiens
  chr6:125283600-125284305
  hyper
cgagccgagccactgcccccgctgcccgcgggcgccgggtgggggtcccggcggctggatgggcagcggcggcgcgggccgcgggcggcgatgggcgaggagcagagcacggtgagcggcggcggcgggccccaggagtcgcagaccctggccagtggcactgcgggccaccctgagcccccgaggcctcagggggacagcgcccgggcgcccccgctgcgcgccgcctccgcggagccgagcggcggtggctgcggaagcgactggggctgcgcggacaccagcgccccagagcccgcgaggagcctggggcccccgggctggagtaagagccgagcaccggcgcagcctgcgggactggcactcaccgggcctctcaatccccagaccttgccactgcagttggagctggaggaggaagaggaggaagctggggatcgaaaagagggaggggatgaacagcaggaggcgccccccggcgaagagctggagcccaggacccgcgtgggggccgccgacggactggtcctggacgtgctgggtcagcggcgcccgtccctcgccaagagacaagtcttctgctccgtgtactgcgtggagagcgacctgcccgaggcccccgcctcggagcagctctcgccgcccgcgtcgccacctggggctccgccagtgttgaaccctcccagcacccgctcttccttcccc

SEQ ID NO: 94685 - DNA, 39 bp, Homo sapiens
  chr6:125286425-125286464
  hypo
atacacattattggccgggtgcggtggctcacgcctgta

SEQ ID NO: 94686 - DNA, 162 bp, Homo sapiens
  chr6:125397724-125397886
  hypo
gtttcataaaatttgcgattttgctttttaaaaactcagctaactctttccttctccttccctctcttgctgatacagatccacatccagcgaactgaaggatgtgaccatatgacctgctcacaatgtaacactaatttttgttaccgatgtggtgagaga

SEQ ID NO: 94687 - DNA, 366 bp, Homo sapiens
  chr6:125420809-125421175
  hyper
gcgaaaaccttccttcgggaacgcggagctagtgcacgggggcatgttcttcccccgcagccctggcaagcagaggccggcggcctgtggcgcggggcagttgtgctggctgccgggcggggctgctctgggtctgggtgcacggagaggagcgcggagtgaagcgcacggtgcacactgcggggcgctgcttgtcacctccctgcccctccctctgccctcccccgctgtccggagcacagtcccgggagggcggatgtcccctgggaagatgcgcgaggagagcgactgggaggcagctagcagcacctgcgtgtgggcaacacgacccgaggctgtctccattgcctgcgtgctgaaagcata

SEQ ID NO: 94688 - DNA, 241 bp, Homo sapiens
  chr6:125474789-125475030
  hyper
gttatgcccttatagcgccgggagtgggtgccttccgccggctgtacagagcgccggcaggtggcgcccagcggcgagcttgttccagcttggtttgggccaggtggactggaaggggcggaggtaaccagaagcggctagtggcggctgcctgcgtccccaaccccctccgcgcagcgctcgcgacacgcgtgccaggagtgggagcgagcggcggggccagctgcgttctgagcctggg

SEQ ID NO: 94689 - DNA, 43 bp, Homo sapiens; identical to SEQ ID NO: 30803
  chr6:125475547-125475590
  hyper

SEQ ID NO: 94690 - DNA, 168 bp, Homo sapiens; identical to SEQ ID NO: 30804
  chr6:125684529-125684697
  hyper

SEQ ID NO: 94691 - DNA, 29 bp, Homo sapiens
  chr6:125737982-125738011
  hypo
atcctctcagccaggcgcagtggctcaca

SEQ ID NO: 94692 - DNA, 15 bp, Homo sapiens
  chr6:126068007-126068022
  hyper
ctaagccttcccttt

SEQ ID NO: 94693 - DNA, 184 bp, Homo sapiens
  chr6:126068068-126068252
  hyper
cgttccctcattctttctcttttctttctctccacataacgcctcccctacacctccccacctccaatccactaccgtatttaagtcggcgggggcgctttaaagggtttcctgtgtctgtttctgtctctctgacccgaaacgcactttcggttatagacagacaaggcgctcaaccaaggga

SEQ ID NO: 94694 - DNA, 1162 bp, Homo sapiens
  chr6:126068780-126069942
  hyper
ttgaattcagaaaaacgtgcagccctcacggaaagttgtgacggtcgagcttgagcctggcgggccgcggagcgttcacctgcggccgggaggtactggcccagggcgctcggggcgggaggtggcaggcgaccggcgcgcgtcaggctcgtcacccgctggattgcggggccggagcggggacggggtctgggtcctggcccgccctcgtgcagccgatcggaggccccgaaccccgcgccgacccagccatccgccctgaggccgacaggggagctggggttcaccgacccccgcggccccgccgtcgggcgcggaccccatccagccccacctggccccgccgagtgtgtgctttgcctggggttaagtttcagaagccaagatggaacgattcgggtttctattcacaaggttattgaaggcatggcggtggggaccgcgcaaaagagatgagagtgtggggggaaaggggtttctgttctaataagggcttagcacgctggccgcaggtcctccgcgccgaccgggctccttcccgctctcccccgggccaaaccccgccagggtcccgtctttcccagtcgcgtcctttcctcttctccccgccccgcgccgggcttgtgtggacagagaacggagtgtcaaagggacgccctgggccgatccccaggaagctatgaatccctccgtgacggaggggtctggggatcgatagacggccctttctcagaggctctctccactactgaccaagcggccctgccaacgtgtggtttccggctggaccccaacccagccgccgccagtctcccggcgcccctggctgggtctcgctcagtccctgccctcgcagacgcacagcggggtggccagttcaaaagtcctacataacttggagagaaccagcagctagaaaacctgttttaaacacacagcttgagttttatacaacccacgttgtccaaggcacgaactgttggacacgaattcatactttagaaaccaaatctaatttccaagcgccaatcttcacctcccggactctaactctgcggctgcgagtgcatacaccagggggactggaggagactggaggcaattatctggataatccaagcccgaaaaactcgaacttgaaaatatacgattatgtcctgaa

SEQ ID NO: 94695 - DNA, 30 bp, Homo sapiens
  chr6:126070219-126070249
  hyper
gcaaatgtgaccactcgggtcagccagtca

SEQ ID NO: 94696 - DNA, 148 bp, Homo sapiens
  chr6:126071185-126071333
  hyper
gatgtggattttcaccgtaggggtggagtagccaggatgggagacgccactgaaaggcagagcgcaggagttggcgagggagggtcctggctgtcacagttggacgcgcgaacggcagcgtctgggcgacaggcgatgtcccagccac

SEQ ID NO: 94697 - DNA, 193 bp, Homo sapiens
  chr6:126235500-126235693
  hypo
agaaagctgtataaacgatgtacacttgtggacaagaacagataggaatgtagaaaccttaaaaatggtttgatctgttaggatatcagaattgtcggtggtatttctgtttttgttttagtcctattaatattattgcaattttatgtaattataaattttaaaaatcataagttaacgttatcccaacagt

SEQ ID NO: 94698 - DNA, 30 bp, Homo sapiens
  chr6:12626382-12626412
  hypo
ctgcacatgtacccccgaatctaaaagttg

SEQ ID NO: 94699 - DNA, 30 bp, Homo sapiens
  chr6:126274515-126274545
  hypo
aacccctacttgctgcgctgcagtagatgt

SEQ ID NO: 94700 - DNA, 225 bp, Homo sapiens
  chr6:1271441-1271666
  hypo
taagacaaactttaacgacagtcaacttggcctcatttttctatgtgctctgtctgacacattcagaaaacttgcacctgggcacaaagttgttcgtccaaactcactgcccctgttattggctaactggaagggctaggatccagccgtgcttggaattaggcaattgccattgtaattcctttactaagaacaatgaccattttacatcgcacttagagtttt

SEQ ID NO: 94701 - DNA, 83 bp, Homo sapiens; identical to SEQ ID NO: 30810
  chr6:127439190-127439273
  hyper

SEQ ID NO: 94702 - DNA, 206 bp, Homo sapiens
  chr6:127439321-127439527
  hyper
cggccaccgacagccgggtgcgcctagcttgaggccgcggagaggagccgaactgggatgggtggggggtcttcggcctcaacactgcctgccagccccagtgcgcccaagtctccccgccagagctgcccttctggaggggctcttcgcacgcactgctttccccattcttctggctggaattctccggccgtcactgcagtgtc

SEQ ID NO: 94703 - DNA, 727 bp, Homo sapiens; identical to SEQ ID NO: 30812
  chr6:127439783-127440510
  hyper

SEQ ID NO: 94704 - DNA, 452 bp, Homo sapiens; identical to SEQ ID NO: 2915
  chr6:127440511-127440963
  hyper

SEQ ID NO: 94705 - DNA, 1041 bp, Homo sapiens; identical to SEQ ID NO: 30814
  chr6:127441030-127442071
  hyper

SEQ ID NO: 94706 - DNA, 249 bp, Homo sapiens
  chr6:127442089-127442338
  hyper
cggtccccgcctcctctcctcccagggtctggcctggggaattgagtctcagggtcagtgggcatagggagcccgggctggagcgcaacccactctgctttccatccgctcttccagcccgtgcccattgggcgtcccagagcacgctctctcctttacccccaccgaggacccccgggctgggagccacacacttgtcaaggagggacagggtactgagtgtcagaggcgtctcgctttgcagttttg

SEQ ID NO: 94707 - DNA, 50 bp, Homo sapiens; identical to SEQ ID NO: 30816
  chr6:127442649-127442699
  hyper

SEQ ID NO: 94708 - DNA, 164 bp, Homo sapiens
  chr6:12749336-12749500
  hyper
gcacggagctgggaccgcgggcgcggcacgctcacatagagcagcctgtgggtgaaggagaccgtagtgtgcacttgggcagcgtaagcgcgtttggcgggagagggcacagtgctgactgggcatctctgcgttggagtcgtccctttcgcaagagcctatct

SEQ ID NO: 94709 - DNA, 121 bp, Homo sapiens; identical to SEQ ID NO: 30318
  chr6:12749820-12749941
  hyper

SEQ ID NO: 94710 - DNA, 105 bp, Homo sapiens
  chr6:12750364-12750469
  hyper
gggcgaggttggctggcgcggctactacggggtggaacttgttggtgacattcagactctgttggctttgacgggttgacgccgccgctgcggtgttggagtggg

SEQ ID NO: 94711 - DNA, 30 bp, Homo sapiens
  chr6:12770884-12770914
  hypo
tgatctgcagtgcaccgaactggccgtggc

SEQ ID NO: 94712 - DNA, 213 bp, Homo sapiens
  chr6:127836013-127836226
  hyper
ccggtctgggcgtagcggagccttttgcgctcggctttgcggaggcggtactgcaggatccggcagtttttgttggctctctccaactcgtggcgcatttcctgcagttgacaggcatcctcctcgaagaaagtgtccctcatctcgtccatctcggttctcagctcatcgatctcgttctgaggcggtgacaggccgcgtgtcaaaatcaaa

SEQ ID NO: 94713 - DNA, 1084 bp, Homo sapiens
  chr6:127836665-127837749
  hyper
gtctcgttttcctctcgcagcttctccatctcctcttgcatttcttcctgctcttggagctgctgcgggtgcggctgcgacgaagggggcgctgccgcctgcatgcccccgccgctcgcgctgccctctgcgctctgctgggggccctccgccgccgccgccattggggaggcggaggcgacggccagggtctcgcaaacggcaggggggccagacaccggggagctgcggctactgctgccgccgccgttcttagcgtgcatctgagccgcggccgccgccgctgccgcccgctccttcttgagatggaactggatgagctcagactgcagacatccttctttccagtagctccctccaccaccgctgccgccccccgcaacgccgcttccggagtttctgctgccggttcctggggttttgcccgcagaagaggaggatggagaaggggaggccccctccccgccgctgccgcccctctgctgagcgcgtacgcctttccctcgccagcccctgggcggcggcggctgcggagcgcccccctccctttccccggagccgccgccggctcctcctccttccccgccccctcctcccccttctccgagcggagggggttccccgagtttcgagggcacggactctagctcccgaggcggctcctcgggcggtccgggcctcctgccgcccaaagcggccagggtcgcggcgggggccgcttcagcaccagccacaggctggacagctcccggagcggcccctttgggcgccaggggcgtcgccttctcggccccacctccgcctcctcggatgctggcgggcggccccgtgcggctcccggtcttgttaccctgctgttgctgctgctgcagctgctgctgccgaacagaattgagtttagtgccggcccccactggggaccgggtggccgcgattgtctgtcgcagcgaactgtccctcggtctagcgggtgactgagctcgctgctgctttctgctgctgccctccgggtgcagacgagcctcagtggctgcagcggcgggagaagctgctgctgtggcaggggcagcgcccccgattggtg

SEQ ID NO: 94714 - DNA, 100 bp, Homo sapiens
  chr6:127839721-127839821
  hyper
acttctcagcagaggcgaggtttccaagtagctgaacaaatcaacagcactttccttctgatattccggggatctcagggtttattattgtgcctttctg

SEQ ID NO: 94715 - DNA, 764 bp, Homo sapiens
  chr6:127839929-127840693
  hyper
cggtaacgtcaagattcagctgcccccagagcgggtgacttcccggcggtccgcggctgggctggagctgcagctctcagcaggctaacacgcgaggtaccaagctgggccagacgctccccaggaagtgcagagatgttcatgagctgacctcaccgaactgggcaggagagaaggcgggattgcaagggacgatagggtagaagtaaccaaagagaggttactttcaagaggaaagagaagaaggcggggagggggacgggggacgggggtggggagtggcgggataaagagacaaaaaggccagagccacgcccgagatggaagattggcagcagcgctcaaactccttgctctattctcttatcccgtacttggcagaggatcccaaaaccgctcgaacacggatgcactggtttcctgcaaagctttgtcctgggttcggtcattctccatcaattatttacttgagcttcttttccaaggaggcggactagaacagccttccgggcgtgactaacatctcctgatgcagctggctggcggctgctgggagttctctttgttcactcactttaattctcagtcgagctctacacgcggtgctccctccccacccccagcccgggcggagtcatcagatgtcgtttccacgaatagataatggttgccatgatgggacccaccgtcccacagacaaagggttcttgcgaagccacgactaatttagtgcaaaccgaaataaatatcggcccacagagatc

SEQ ID NO: 94716 - DNA, 48 bp, Homo sapiens
  chr6:128840325-128840373
  hyper
aggtagacaagtgctcgggagcccgctccccagcgtccacctggtgaa

SEQ ID NO: 94717 - DNA, 64 bp, Homo sapiens
  chr6:128841037-128841101
  hyper
agacagcaacaaacccgcaccacaagcaacagagtgccgtcacgggagtcgtaactactttttc

SEQ ID NO: 94718 - DNA, 142 bp, Homo sapiens
  chr6:128841577-128841719
  hyper
gagcgggccgggcctcgcggggtgaggacggtgagaggacagccgcccgcccgccctttttccttcttcgcggtcgccaaactacctcaggggcgaaagcgtcgccagcgtcgccggccggccgcggcggcagctctccatg

SEQ ID NO: 94719 - DNA, 390 bp, Homo sapiens
  chr6:128901705-128902095
  hypo
ggcgcatgggagacacgtgctgtgtctgcgggactgtggaccatggccaggcgagctcttctctcttctccggcatgttcagccaggcctccaggttggagaccgcctgctgcagctcctgcaccacgccgcgcaggctctggttctccacttccaggctggcgatctggaggacgagctcgctgtggtcttccctggggccgagctctggcgggaggcgctggccacaggcccattcatctgcttgtagaatttcctttctgtatcttcatatttgaatttgtcgagccagatcttctcatgtgctaggaattttgtagccatttttctgacgcctgccaagaatgcggctaccagaaatgaggaatcggtagacgcaggacgcctaag

SEQ ID NO: 94720 - DNA, 15 bp, Homo sapiens
  chr6:129204289-129204304
  hyper
ccagcagctgctgct

SEQ ID NO: 94721 - DNA, 328 bp, Homo sapiens
  chr6:129204360-129204688
  hyper
cgagaagtggatccggtcgcggccactacgatgccgggagccgccggggtcctcctccttctgctgctctccggaggcctcgggggcgtacaggcgcagcggccgcagcagcagcggcagtcacaggcacatcagcaaagaggtacagtcgaggcatgggcttgggttgcatcctttgccgggaccgagattcctcacttcttccactcttccgagagttgctgtctgtggactgccgtcttgcttcgccttcagagagtgcgctctggggcaagaggaacttgaagcaagttcaagttcaatgccatgagagcgtagtgtaggggga

SEQ ID NO: 94722 - DNA, 57 bp, Homo sapiens
  chr6:129480603-129480660
  hypo
gccgggaggatctgccggggagagcggctttcctcatcgattcgggagcacccacca

SEQ ID NO: 94723 - DNA, 30 bp, Homo sapiens
  chr6:129958014-129958044
  hypo
aacaccatctagatccgctgattttttacc

SEQ ID NO: 94724 - DNA, 248 bp, Homo sapiens
  chr6:130088218-130088466
  hyper
ttcaaagctgatatgcgttgcaaagagaaaagcatgcaaagatgctctccttaccggaggtgaaagcattgtgccagctctgtcactactataaccatcttccgcaagtggagagcagggaacgccagggtcccaagaagtgacgaaaagcgataattagatctcctgcaagaatcttccctaagcactttcttccgtgacacacctactttgtggcatctacgcgctcttcacggctaaccacaatc

SEQ ID NO: 94725 - DNA, 506 bp, Homo sapiens; identical to SEQ ID NO: 30320
  chr6:13013570-13014076
  hyper

SEQ ID NO: 94726 - DNA, 30 bp, Homo sapiens; identical to SEQ ID NO: 40889
  chr6:130182604-130182634
  hypo

SEQ ID NO: 94727 - DNA, 30 bp, Homo sapiens; identical to SEQ ID NO: 40890
  chr6:130241934-130241964
  hypo

SEQ ID NO: 94728 - DNA, 114 bp, Homo sapiens
  chr6:130339570-130339684
  hyper
gctgcatttgccacccggctttattgctgctttccagcggcgaaggcgcagcagcagtaacagggaagccagagcgagcctccccggcagcggcggcggcggcggcggcaccgg

SEQ ID NO: 94729 - DNA, 30 bp, Homo sapiens
  chr6:13044971-13045001
  hypo
tttttcccctatacacgatggttagcattt

SEQ ID NO: 94730 - DNA, 30 bp, Homo sapiens
  chr6:130465678-130465708
  hypo
gctgaaatcctacttcgttttccttttctt

SEQ ID NO: 94731 - DNA, 39 bp, Homo sapiens
  chr6:130499389-130499428
  hypo
ggattacaggcgtgagccaccacgcgcccggctggccca

SEQ ID NO: 94732 - DNA, 149 bp, Homo sapiens; identical to SEQ ID NO: 40891
  chr6:130530028-130530177
  hypo

SEQ ID NO: 94733 - DNA, 30 bp, Homo sapiens
  chr6:130608796-130608826
  hypo
agttacaggtgtggccgggcgcagtggctc

SEQ ID NO: 94734 - DNA, 816 bp, Homo sapiens
  chr6:130686377-130687193
  hyper
gtaacctgaacctctcgttggctttgatgtttggagtcgaacatccgcactgctcatcgaagacccccgtgcttcagttccctctgtcttccatttcccccgcccatggttctcgcccccccaagccgttctccggaaccccttgccgggccggcgggaagcgtggaccgagcgggccttggccgcgtcttttccggccaggtttggtttagctcgcgcagcgcccgcgcagcccgccagggggaccccggcccgccgggcggcatctgaggagaaagcgtccgaggggcgtggagccagggtcctgcggtgcctgctccgggaatactgcgagtcggctggagctccccagccgctccggagaactgggggagccgggtccctggctcggtaaccggtggtcccgcggtagctagaggcgggccccacgggtgggtgtgtccgtttccgcacgccagccttccagcccgggaagagcgcctgcaagcgggtactttgttcccaaagatgggttttgtctgcgggtgatttgggctctcgaagtgcaactttgtggccgggacgcggatcggccggcctgggctcctgcagagcagatcctgtctgcgtcctccaggaggagtgggtggcaggactggggtttcccacaggttttggggcggcggcgagattggcacggtccggggtcgcaggcgcgcagccacgcccctggaagtccgccccggcccccgcccccaacccgcctcttcggggctttatggcgtgaggtttggggctgggatccatctggagccgagcagaaaacttttcccctcc

SEQ ID NO: 94735 - DNA, 694 bp, Homo sapiens
  chr6:130687224-130687918
  hyper
cggtggcggcgccgcctgagcggcgactccctctcccctgcccggcttgctgcgcccggtgccctccgagggcaggcgcgcctggactctgcgcccggatggcggcggccctctgtgagcaccggcagcggcgcatcccctgccccgaggcctccggtgcccccccggcgcgggcataggggcgcccccaccctccgtccgcttgcaccccttgccacccgccccctcgcctgactcatccgcccgcggtggccgcccgagccctgggatggggagggagaccgcggctgcccgcggcggccgagattcccgctgacgcccccgaccctgccgccttcttcgtccgcctccagaggcgcccgacgtcccgacagctcctggagtgagaccaggactgagaacagggagaggcgacccgacccccagggcccggtgctcaggacaggtgaggggaaggaaagggtgctgacgggagtggggaggtgggtgggcggccaccgcagccgaaaccgggcacttcttcagccctctgccctcccctcccctccgctacagcctccagagttaggtaaacgctgtctctcctaaagtttgggaaataaaccaagtccgccatcaggtccagactccccagtcccgggagcgcgagagaagccgtgcggggcagcctccaagaacccggagtactggagcg

SEQ ID NO: 94736 - DNA, 30 bp, Homo sapiens; identical to SEQ ID NO: 40892
  chr6:130808098-130808128
  hypo

SEQ ID NO: 94737 - DNA, 92 bp, Homo sapiens
  chr6:1310870-1310962
  hyper
agtcagtctaatctccgaacgcgatccttccccaaatacaaaaataacagagctgtggctggggctgtcatgttgcccgccccattgtgaat

SEQ ID NO: 94738 - DNA, 227 bp, Homo sapiens
  chr6:1311771-1311998
  hyper
acaggggtttgctttcgtaagcagcatcgttttcactactacagaagcacatacgccgcgtgcagcttaggcccgagcaaagtccctgctcccctagacccagtcccttcaggtgtccccctaggggaactgtggcgtgtccccccaaccaggcgcactcgcctaaactgcgtccccgaactccagggcgcagggagccctcgcgggctgcccggggctggggccca

SEQ ID NO: 94739 - DNA, 178 bp, Homo sapiens
  chr6:13118018-13118196
  hypo
tccatcatcccctggcgattgtaatctccttccttagccatctcctttcctgtgcttttatcccacctaacgcagagctctgcaggtgctaagcatgcaacagacgtctcacataaatgagtgcaaccacaccctctccactcaacttttgctttttacaagccggagcataatttta

SEQ ID NO: 94740 - DNA, 30 bp, Homo sapiens
  chr6:131269546-131269576
  hypo
agatggggaaagaggcgagtaggcatagtg

SEQ ID NO: 94741 - DNA, 30 bp, Homo sapiens; identical to SEQ ID NO: 30223
  chr6:1312754-1312784
  hyper

SEQ ID NO: 94742 - DNA, 35 bp, Homo sapiens
  chr6:1313267-1313302
  hyper
gcagcaagccatatacgcggcggcccaagcccccc

SEQ ID NO: 94743 - DNA, 18 bp, Homo sapiens
  chr6:131389805-131389823
  hypo
cctcgggaggctgaggca

SEQ ID NO: 94744 - DNA, 62 bp, Homo sapiens; identical to SEQ ID NO: 30224
  chr6:1314000-1314062
  hyper

SEQ ID NO: 94745 - DNA, 69 bp, Homo sapiens
  chr6:131455780-131455849
  hypo
gcatcagaaactcaacgtgttagaattatttgaaaatcagagtaactagtttgccgacttctagtgtgc

SEQ ID NO: 94746 - DNA, 21 bp, Homo sapiens
  chr6:131532615-131532636
  hypo
tgtaatccagatgggcgcggt

SEQ ID NO: 94747 - DNA, 181 bp, Homo sapiens
  chr6:131602777-131602958
  hyper
agaataaaaacaagccgggggaggggagctctgtgaaaaccgaagcagctgatcagaatggcaatgacaatgagaacaacaggaaatgagcccggaacgcaggcccccatgtctctgtgcaaagcctccctgcttccctctgctgagtctagggactgacttgcagcgtgctgtttaagtt

SEQ ID NO: 94748 - DNA, 89 bp, Homo sapiens
  chr6:131616389-131616478
  hypo
tcacgccctttgcagcggggaggagcctggcatctctctcctgttccggggtgtggtacctgggattgcatctgcgaggtgggaagtgc

SEQ ID NO: 94749 - DNA, 40 bp, Homo sapiens
  chr6:1316770-1316810
  hyper
tcacacacccagccccggggagtttcggtttctcagtgct

SEQ ID NO: 94750 - DNA, 30 bp, Homo sapiens
  chr6:1317677-1317707
  hypo
gtttggtttgggactcgccctttgacacct

SEQ ID NO: 94751 - DNA, 145 bp, Homo sapiens
  chr6:13180876-13181021
  hypo
catcaagaatcaaagcggtttcctagagatgtgttaggctgaatgacagctgcatcattattccaccaactgggaaattgaaacagagttacttcccacggcatctgtttgaacatgctaaataaaggcacgttaagaagactgg

SEQ ID NO: 94752 - DNA, 41 bp, Homo sapiens
  chr6:131884134-131884175
  hypo
ttaaaatgagtaggccgggtgtggtggctcatgcctgtaca

SEQ ID NO: 94753 - DNA, 86 bp, Homo sapiens
  chr6:132017843-132017929
  hypo
tgaacactgccaggccgcgtccttcaaaggcacctttttttctctcaatgatctacccagagcaccttttttttttttttttttga

SEQ ID NO: 94754 - DNA, 158 bp, Homo sapiens
  chr6:132128512-132128670
  hyper
gaaaccacataaaaccgtgggaatcgaaatatcccttacgtgtgttcagtacatgtgaacccacgtattttaagtggacgatttctctctcagagtaccgtaggtagtgggggacggggcgcagagggggagaaacagaaagtcgccttcctccatgg

SEQ ID NO: 94755 - DNA, 30 bp, Homo sapiens; identical to SEQ ID NO: 30828
  chr6:132271740-132271770
  hyper

SEQ ID NO: 94756 - DNA, 113 bp, Homo sapiens
  chr6:132722029-132722142
  hyper
gtctattaagtggggcgctggggacaggaaagtgttcaaagaaggaaacctgcctggggtcatccgtgctcggcttccctaccgcgcgccttctggggctccgggagagcagg

SEQ ID NO: 94757 - DNA, 890 bp, Homo sapiens
  chr6:132722157-132723047
  hyper
cgagagtgagcgtggccgggggcgcggggctgcgccaggtgagagagagctgcgggccccggggacgacccgcacctgcgccctctctggggtccggacgggaccgggctcggccgggcgggctccgggaggagacgcgcttacctggaggtagggccgcccgtgggccaccccgcccacgacgatgtcggcggacgccatggccccggtgggcgagaagccgaagcccacgtagcctgcagtgcgcacctggaggcggaaggcgatctggctgccccgctggctccagcccagccagtacttgccctccgagtccaggagggtccggtgcggataggttcggcccgagccccccgccgccgtcccggggagcagcccccacagcaggagcagcggccagcagcacatcctcgggcgcctcctgcccgccggtaccggcctccagccgctggggagtgaggagcagaacgaggagcggcagcggcggcgagcgggagcccagggaccgcccctcgggccggccgcgcgcccgcccgggaggggcaggacccgctctccccgccccgggccgcctgcagggcgcgccgcgtcccgtccggtcccgtcccgttccgtcccgtcgggtcccagccccgccaactctcaccctgcccggcccttccagcggatccacttgcagcccccgacccctgacttggtccccgaggtcggggctcggtgggaaggaaagcgaggggcttcccggaaagaaagggaggaggaggcaggaggaggcagacgccgagagaggagaaaaggaggccagaggcagagggaaaaggaggagggcaagagaatcctagagcgggaagagcgtgggctctgcgggacgtgggcgagaggttaccagg

SEQ ID NO: 94758 - DNA, 159 bp, Homo sapiens; identical to SEQ ID NO: 40748
  chr6:13288514-13288673
  hypo

SEQ ID NO: 94759 - DNA, 51 bp, Homo sapiens
  chr6:13293172-13293223
  hypo
tgtcccctacagcatcgcaggtttgagggtgctctgcggatgtagctactt

SEQ ID NO: 94760 - DNA, 302 bp, Homo sapiens; identical to SEQ ID NO: 30831
  chr6:133561966-133562268
  hyper

SEQ ID NO: 94761 - DNA, 89 bp, Homo sapiens; identical to SEQ ID NO: 30832
  chr6:133562348-133562437
  hyper

SEQ ID NO: 94762 - DNA, 421 bp, Homo sapiens; identical to SEQ ID NO: 30833
  chr6:133562674-133563095
  hyper

SEQ ID NO: 94763 - DNA, 1084 bp, Homo sapiens
  chr6:133563157-133564241
  hyper
cgagcctgcctgtcccttccggggtcggcgcggagcctgcgcgtaacggagttcatccagcagtccagcgcgcggcttctacctgcaccccgcctccacctggcagaggcgcgagcatcggggtctcccccacatctttcttatgacgtgtattactttctgatgaccccctagatggtccaggcgcgaggatgctgacccagagtccttcggagggtcacaggcgcctgggctttcccggtgccgggtgcgtgtgtactttaaaggctcgcgttctaatctccaggcactgatcgggcttttcaactgcggcgatcccactttaatagtttttatgtggcgtggactgaatgtctcctgcagtttgccagggtcggtgaaattagaggcgccttgtcagagcagtcgcgttcattggctcgagtagcgggtgccatggaaggcttataacttctccaaaggaagggacctggctgggtagagcaggtttttctctccttccaagcctgctgggtctggggaggcagtggaacttgaaatggctcggatttttagcgtggtgaagcgaggtttggaagtagacgtgtgtgtgcttgttttattctgcgccgcacagcaacccgaactttcgtttggtagcacttgaaagagttttctccctttgtttgcgagattctgaacagctcggagcgattagggaatttgcggaccgagtccggtggcagagctggggcgaaagcagagagcgcaatttaatttttgtcatctcttccctgcttgggaggatagtgtttcccttcaccaccacccctctttctccttcctatgaagacaacggatttgcgcctggggtgagagtgtgtgcgggagagtggtgtggagactgtcctctctcaccgcgtctcctgcgcctctccccgccatcccgagcgggcctagagagtcattcatgaatcttaacctgagggcaggggaggaaggtgcaggtccctctgccctttctgccaaggtgcagaatagcgcccgggcgtgtgttttggttccagagcagttccacgtggagcaacttcgtgtgtgtgtgtgt

SEQ ID NO: 94764 - DNA, 30 bp, Homo sapiens
  chr6:133894955-133894985
  hypo
gaagaaagatcattccgaagtgtttaaaaa

SEQ ID NO: 94765 - DNA, 93 bp, Homo sapiens; identical to SEQ ID NO: 40896
  chr6:134067455-134067548
  hypo

SEQ ID NO: 94766 - DNA, 170 bp, Homo sapiens
  chr6:134175884-134176054
  hyper
gcaggggatgggctgcgaccgctcccagtgaccccacgaaacccagaggggaggctgaggctctgaggccagccaggggagctgacgatctcgcagaagccgcggcgagtctcccccggaggtctaggaggcagagccattaaagccaggctgcccgctgaaacgcacag

SEQ ID NO: 94767 - DNA, 462 bp, Homo sapiens; identical to SEQ ID NO: 30836
  chr6:134210557-134211019
  hyper

SEQ ID NO: 94768 - DNA, 256 bp, Homo sapiens
  chr6:134211111-134211367
  hyper
cgcgggcctagagcctccagggaccggaggcgggcggtctagacacggccctcgctctctgccctaccagcccccggagcgggagtgatttatgcgagggtttgacgtggcagcccaattaaaagtttgcaagtgtgttgagctggcacagaggagggatcccccgctcccgctccatcgccatcctccctggggtgcagtggctgctgcggaactgagaacactgacaagacgctgcgagcggacaggcattttg

SEQ ID NO: 94769 - DNA, 113 bp, Homo sapiens
  chr6:134212308-134212421
  hyper
caaagccggtgtttgcgatggaagaaacgaaagtcggactagggaaatagatggtgatgaaaggcgatgaaagcgacagggccctgaaacccgaccaccgcctcagaaggagg

SEQ ID NO: 94770 - DNA, 72 bp, Homo sapiens
  chr6:134213916-134213988
  hyper
ttctaacaataaacccgcatgcctgccttttggttgctgttagcgggtgcgtttagctcccgccacgacttc

SEQ ID NO: 94771 - DNA, 326 bp, Homo sapiens
  chr6:134214076-134214402
  hyper
cgaggagcctgcgacccgggtccctcactgccccagcgcagcccgcggcggccgatgcgccagatgccaccggggctgtttaatgttcggggttatgaccgcagtgtttacaagacgtcttcggttatttatactgttattcctcgcagagagccttgaaacttccgcttcatttgctctttcttttcgattttttacccttttttctcggcttagtttggtacctggagcgagagcttctccgcccttccaccaaccccacaggccgcttcgcgggtggagccctctgcctggccatggaggaaggatcccgctaggctggtccc

SEQ ID NO: 94772 - DNA, 97 bp, Homo sapiens; identical to SEQ ID NO: 8736
  chr6:134216904-134217001
  hyper

SEQ ID NO: 94773 - DNA, 91 bp, Homo sapiens; identical to SEQ ID NO: 30841
  chr6:134217370-134217461
  hyper

SEQ ID NO: 94774 - DNA, 299 bp, Homo sapiens; identical to SEQ ID NO: 30842
  chr6:134499553-134499852
  hyper

SEQ ID NO: 94775 - DNA, 86 bp, Homo sapiens; identical to SEQ ID NO: 40897
  chr6:134589500-134589586
  hypo

SEQ ID NO: 94776 - DNA, 86 bp, Homo sapiens; identical to SEQ ID NO: 40898
  chr6:134589886-134589972
  hypo

SEQ ID NO: 94777 - DNA, 296 bp, Homo sapiens
  chr6:134638707-134639003
  hyper
ggatggagaatctagcggggctcagttcttcactcgcgcattctgcagcaccagctactgcagcaacctctccccactttcagttgccaccgacagcggcttttctccttccatcattgctccgaaacatatgcatcaccgctgcaggaccctgggggccggacggtgggatacggccaatctccggggagatgctgtggctcttaccgagcgggagaagggtacgcctccccgcccccagctacctggctgctcttccgcggccggcgcggggagcgagtcgctcttctccaggt

SEQ ID NO: 94778 - DNA, 207 bp, Homo sapiens
  chr6:13488388-13488595
  hyper
aggctaagggacttgcgcaaggtgacatatataagcaacaggcctgcgattggaatccaggccccagagtctgggcacggaaccgcagacttctacggtctccttccaagctagcctgctccaatcgcgcgcccccgctccggccgcgcacgcacggttcagccgccttcttccaagacagtccagtcttggcgggctcccatctgc

SEQ ID NO: 94779 - DNA, 18 bp, Homo sapiens
  chr6:13510401-13510419
  hypo
tggagtacaatggtgcga

SEQ ID NO: 94780 - DNA, 17 bp, Homo sapiens
  chr6:13510479-13510496
  hypo
accgacttcaagaatga

SEQ ID NO: 94781 - DNA, 39 bp, Homo sapiens
  chr6:136443399-136443438
  hypo
tgggattacaggcgtgagccaccacgcccagctataatt

SEQ ID NO: 94782 - DNA, 20 bp, Homo sapiens
  chr6:136556311-136556331
  hypo
gccaccgcacctggcctgat

SEQ ID NO: 94783 - DNA, 137 bp, Homo sapiens; identical to SEQ ID NO: 40899
  chr6:137144480-137144617
  hypo

SEQ ID NO: 94784 - DNA, 244 bp, Homo sapiens; identical to SEQ ID NO: 30844
  chr6:137241818-137242062
  hyper

SEQ ID NO: 94785 - DNA, 1183 bp, Homo sapiens
  chr6:137242063-137243246
  hyper
cctgaaaaccaaactgtctggcgcttaacggttacctcggctgagcgaaacccttggctgctgctgatttaactacaggtccgcgcgagttactttccagggaactgaattcagaacaaagagttaccgaagccttactccctctccaaaattagaattccctttttctcttagtcatataggaaacacacagttcacaagtcctgtggtgcaaaggtgtgaaccctggcccagggaggtggtgactctccccgccctccgcctgccggttgtcctgcttccgaaagcaacccacgacggtcccgcagggtgagggttccctgggatcagttccctgggatccggagaacgccacgcggagtctccctgcagggtgaggggccccgggttcccgccccctccccctctactctcccattctgcgagcgcagccagcctcccctcccacgcttcgggaagcgtcgcccccgagctcctcggttcctggtggtggctactcgtgttagtgacttcgtttctgcgcgtttgcttattttcatctttgcctcagttcgaatgtgtccccgccaccaggccccgctgctgggcgagaccactgaaccccctgaaagcttccccggagccgcgcgcataatcccgggaccctctctggaaggcgtgcggagagcggtgcgcgtggcctggcaccggaaggagccagcttccgggctccgaggcaccccctggacagcgccccgggccgcgggttcctcctccgatgcccgggcgtcgtcgccgggatcgggagcttcgggggcccgccggcaccgacggttttcgcttccctggcgggcagctggacgaggtcccgccgctgcaccgggagggacagtgggtggaaaaagccgctgcagcgccggggcgagggggctgggggcgccgtcacttgttgcgaccaataaacggcgctcgatcctgatgcgctgtttctaaaatctttagctgtgtcccgatccctccaacccaagcccctcggccaggaggaaggggcaagcgagagccgctggctctgtggggggagaggggcgccgcgccccaagagcccccgtcccgccctgcggcagccgccccggggcgcccagccgcccgcttccctccgcagagcgtcttccctgacggtgaaaccgcgcgggacacaacccac

SEQ ID NO: 94786 - DNA, 691 bp, Homo sapiens
  chr6:137243458-137244149
  hyper
cgccgccgcgctgggcgggcgcccccgccgccctcactccgctgctcccggctcctcgcgcgcaggtcgcggagctccgccaccgctgggtgcggcgaggccggcgcgatgcggcagctgtgccggggccgcgtgctgggcatctcggtggccatcgcgcacggggtcttctcgggctccctcaacatcttgctcaagttcctcatcagccgctaccagttctccttcctgaccctggtgcagtgcctgaccagctccaccgcggcgctgagcctggagctgctgcggcgcctcgggctcatcgccgtgccccccttcggtctgagcctggcgcgctccttcgcgggggtcgcggtgctctccacgctgcagtccagcctcacgctctggtccctgcgcggcctcagcctgcccatgtacgtggtcttcaagcgctgcctgcccctggtcaccatgctcatcggcgtcctggtgctcaagaacggcgcgccctcgccaggggtgctggcggcggtgctcatcaccacctgcggcgccgccctggcaggtgagcgggcccccgcgccgacccccagccgaccccacccaccccgctccgtcgggcagagaccgcggggatcactgagttcaacgacctcacttccagatggggagactgaggcagagagagccggagagctttgagagtggt

SEQ ID NO: 94787 - DNA, 231 bp, Homo sapiens; identical to SEQ ID NO: 613
  chr6:137244235-137244466
  hyper

SEQ ID NO: 94788 - DNA, 89 bp, Homo sapiens
  chr6:137310853-137310942
  hyper
gtgactatgaagggacgcagtcagtccaaagccaccccgggaaagatgtggcccgcagcctggcaggctgaggacgtgtagggggctgc

SEQ ID NO: 94789 - DNA, 222 bp, Homo sapiens; identical to SEQ ID NO: 30851
  chr6:137311158-137311380
  hyper

SEQ ID NO: 94790 - DNA, 46 bp, Homo sapiens
  chr6:137365956-137366002
  hyper
gcgcctggggctctgcgtgccacgctccaggcgacctgagtcccag

SEQ ID NO: 94791 - DNA, 40 bp, Homo sapiens
  chr6:137366320-137366360
  hypo
acggatgaaatagagcgttatttctcgatatacagttagg

SEQ ID NO: 94792 - DNA, 105 bp, Homo sapiens
  chr6:13767864-13767969
  hyper
tcatctctcccaccacgtttcctgcctcctctggtgcccccctctgacagtcatgtggctaattttaaaccgtaatctgaagcccagaaccgggaaagtcccatg

SEQ ID NO: 94793 - DNA, 142 bp, Homo sapiens
  chr6:137808752-137808894
  hyper
ggaggagaaaggagtcgccataaaatgcacccgcgccaccctccatgtcccccagtggaattgaggatcttgcttgtggcaaaagtgcgttcttggcaccacagccccgcagctggggaggggggcctcagtacccggcttc

SEQ ID NO: 94794 - DNA, 366 bp, Homo sapiens; identical to SEQ ID NO: 30853
  chr6:137809000-137809366
  hyper

SEQ ID NO: 94795 - DNA, 472 bp, Homo sapiens; identical to SEQ ID NO: 615
  chr6:137809445-137809917
  hyper

SEQ ID NO: 94796 - DNA, 1262 bp, Homo sapiens
  chr6:137810032-137811294
  hyper
cggggatcgctcacaggggctccggggccaccgcgagcgcggactgcggctgctggcgggctccttcgtcgtccaacgcaccccatcctctcccgccccgcagtgtcccagggaaggcttcactgaaaacagacgctcgacggaaaactgactctgcaggcccgagctttcggagtttgatttctgtgggccccttaaacgggcactgggtacaggagaggccccaactctctgcagggacggggagggaagggcactcactctcccgcaagttttcctagaggcgagctgaagatgcaggccacctccctcccgcacggcccctcccttggcctagttctgtccaaagacacttcccagccctcgagcggcggctcctccactcgattcctgcctacacgtgaagagcttggacccagcggggctgcactcgggaggacaggcccagatcctgcacggccgggaggacacctggccccgctgtcttctcttcacagctcccctttctcggcttcggcctggagcggtgcagggaggggtggacctggggtggccttaagatatctagcctgggtgcggagacttgggagcccacccttagcagtcactcctcctccccagtggagggtgagaaaaggggaacagagggccccggagtctctggaagggacgtggaacgcgaagttaaatgttggtgtctgagcgatgtgctggtggggcagagggggttccagcgtcctcccagagtgaggaggcttttgcaatttctgctgaatgcgtcagtggaggcacaaaaccttgcttgacctagcagctgggaaaaaaagaagttcgaggggacacaaggccccctgctgctggagcgaggaaaccctgggcttggccagctcgggccgcttctccctgcccgtttgcgggctgtcggcctcagcggtcccagaaacaaagatctagtgagcccagccgacgccggcctcattttccctttctaagggtcactttcttccgccctctaaattaggtcatcgcctgggaaagcgccgagaggtttctagtgtgggcttctcaaggtgtctccgcccaggaggatttcgccatccatttaaacgtaaggcggggtttaatctggaatgaaaggatcgtcgtggtgtttccagattgaatgaaaaactaaacttgcaaaatttcgagaaagtgacaagtttacaacgaaaaaaaatcccggccgaaacccattttcacctttgcggtcatgaaatctt

SEQ ID NO: 94797 - DNA, 1083 bp, Homo sapiens
  chr6:137813536-137814619
  hyper
agagagagccaaccccgcatgcagaataactgagcgagggggggtggcgcaagctactagagggagcccaggcttttacaatagcggccccagaacagcaaaggaaggttccgaataaagtttgaagggggtgggggtgggagaagaagcgcgtgtgcgtgagtgtgggtctttgcactctgccccttttttcatttcatacaaccacagacagatatatggagtacttgggataattcactaataaatccttgttacaaggaaaacggcaccacagcctgcacgacatattcagacaagattcatttagaagcgtgcatgcattcttttgacctacactgcgtcgaaaggaaaacccacataggaggtgtcatgccctggacctcggttgagattcaaaacttgggtcttgatctctctcgcgctctctctctctttctctctccattgtctctagaaaaactgtggcaaggacagagacaatcataatcgcatccatctcaagaaaatatttacatttgttttgcacaaaagggatggccgtctttttccaaagcgagaacacagagtcagagaaagccaactcaaaagtcccttcgcaagtttttaactacaccgatcccatctttatacaacaaatgcagttttgacaagagcatatggcagtgaaaaatactggcgcggcatggggaaaagaagcatgcatgcaaaacacacgacatctggttcgagtccccctttgctaccacctagaaattgcggtttgattttggtcctttccctccgggggtcaagtggagtctgagatctctcagacagcgtgggaggctgcgggccccggagcctgccctcccgtgggccgagcgtgcagcctccctcttccctcccggcccggcaccgcggcccctcccgccgctctccctcctccttggcagccgggcccgcccgctgctcacttgagcaagtccttggactcggccgacagccgggccatgttggctgtggagagagcggacaggtgcggcggcggcggcatctggcagatggtgcaggggcagggcagaccagcccagtgctggaagc

SEQ ID NO: 94798 - DNA, 518 bp, Homo sapiens; identical to SEQ ID NO: 30858
  chr6:137814653-137815171
  hyper

SEQ ID NO: 94799 - DNA, 727 bp, Homo sapiens; identical to SEQ ID NO: 30859
  chr6:137815224-137815951
  hyper

SEQ ID NO: 94800 - DNA, 815 bp, Homo sapiens
  chr6:137816459-137817274
  hyper
cttcctggaccttggcgctggcgcaaaacggtgggacggtccgcgcccgaagctccgccgggcctcctctggccgctgtgctgacgtgccccgagctccgggaactcagcggcaccccggcctgcgcgggtgggtccaccaggctggggccgccgtacggcgtcggacagggaaatcagaagctcataataaactatctgatgtcggggtggtggggcgggggggtggggtgcgtgggcaaagaagcacgggggaagggaaacaacgaaaggacctagaaagccccttgtgcgtgcccgggcactgcggttcagcgcagagtcgtttctgggaataaagaggaggtcggagtttggagccttcggtgcgagtgcggaggtgggcgtagatctttcttcccccttgctgtgtttttgtgatcaagactttagctcagcagcacgaggggcgggaaggcagaaatcccgggaagggagagagccccaggagtggtctctagaagaacccggacaccgcccctctcccggcttggtggaacgggaaacaaacgctagctagtgactgagagtctcggtggaagtgtgaaatcgaatcaatcgcggaacctcgggcacttggggcctcttgcgccgctgagtcacttcgaagaacaggatgcccccctttcccttgactcaaaccgagcggtcagtgggagagggatgcgcgcccaggtccggagtttgcacgctctgaggctgtgccccactgacagtcacgctgcgaaggcagctctggccaataccagaaggatgggcaaacgcaacattggcatg

SEQ ID NO: 94801 - DNA, 981 bp, Homo sapiens
  chr6:137817618-137818599
  hyper
agtggctagtcctaacgacaaccctctgcgactcccctgctgatcaaatggggtgaggagagagaggcggacgggggagggcattgggagcgagcactggactggacgaagagcagcttccccgccctgcggacggtgcacaggtctggcccccgccgtcctcctgagccacctccctgaccctaggtcgtcggcggcgtctgtccttcccacacccagactgaaaacgctgcacctgagttttgatttggggaagtagaattgtctggtcagagcagaagggttgcaaatgaaggagtggaaaaatcatgttgctacaagatattttaccctttaaaaaaagtcttgattttcccagtggacaatgtaaaataaagttttaaaatctcccccaaattagtaacgaaggtggcaagccgtgggcggggggaggggagggaaggagggtagagcagccctcgaaatacaagcttgcggggctggaagtccggggccagggttctgggagtccaaaccagaagccactctccttcagcacagcctttcagccgagagggggctgacgcctgccgcagccggttccgagggggctgcgatgggccgggaaggggcgactgggcctttgcccgaacagaccaggacattcccttccttcttccctaagggttttcagctccagtaacagaggtgcctgaaatgggagatctgcggggaccaggccgggactccctggctccgaggccgggacgtggcgcgccctccgctcctcggtcaccctctgctttttcgaaggtccgtaatgcgtgagtgtgggtggtccaaggttcagggcctccttccagtaagtacttttagaagctagttcccccacttcccatccgttgcggggcttgacaactagacgaggggagtgagtaaaggtgccacaactttgcttaccgtaaaatgggttaatactcgccggggcccaaaaggctgagt

SEQ ID NO: 94802 - DNA, 649 bp, Homo sapiens; identical to SEQ ID NO: 621
  chr6:137818618-137819267
  hyper

SEQ ID NO: 94803 - DNA, 493 bp, Homo sapiens
  chr6:137819268-137819761
  hyper
ccgctcggtgcccgacgcccactgctccgcagccttagccaccgagttcctctccagcagctgccggctctgcctgaggccgcggcgattttggctcaggagcgaacccccacccccacccccgcaagagtccagtagcaaatgtcgctagctgacctgccgaagagctactgtgagaggcaggtcaatcagcaacgtccaggggctcctctcgctcatcaagcagcaaacttgaccagcagaaactttggccgagaccgaaaggcgggaggctgccctgtgggcttcacctttcaacccaaccaccctccaagacaaaacagaacaaaaaaaggaaacctaaacatttctaactatgtttcctcatgtgcaaacaaggaatagcctaaaaattagttgaccacgcggagaaacttctcaaaaagtgcattctttagcagagtagaacgataacttcacaacaatagcagtgggggtccggtcaccagggccg

SEQ ID NO: 94804 - DNA, 277 bp, Homo sapiens; identical to SEQ ID NO: 2742
  chr6:1378199-1378476
  hyper

SEQ ID NO: 94805 - DNA, 711 bp, Homo sapiens
  chr6:1379267-1379978
  hyper
cgaaaccaccccggggaaagccgtaggggcgcgccggcccacgcgggaccgagttcagaggactctgcaccgtcagtttcagggccgacgtttatagagcgcttcccacgtgccgcacgcggttctaagagcttggcttgtattaattcgtttaatcctcccagcaacactgttaggcattataatgatcccaatcgtagaagtcaaaaaaccgaggtgcagaaacaaagtaacttgttccagatcacgtaggtggtaagtgcagggtattctggagcaggagggagggtggaaagcacagaaaaaaaaaaatgaactgggaaaagcgttgacgtgcttagtatttcatactgcaggttccactttcagagccaggctgcgagcctacagggtagagtaggggtgccgggccccctggtgtcctggcgtactcggggggaagacagtcgccggccgccgggctcctgccacgctgtggcgcgcgtggaaggtgagggtcctccgctgtcccgccgcctcccacagggcggcccagagcctgcatcttttgcaaagggaacataggatggagagaaagaaagtcccgcctgaaataagcaaacgcggtggcggctttgcggtcggccacgtccgctaggaacccgcgaggcgcccttgcgagctgcgcagtcgagttttctttccactgcactttcacgttctgccggatgg

SEQ ID NO: 94806 - DNA, 785 bp, Homo sapiens
  chr6:1381866-1382651
  hyper
aagacacagagcccccgtcccttgcttcagagaaccaaataacggaactgaatgatcgtttcttcagcaaagcctaaagacgcttgcgtcccgcggagaggtgcccacgcgcgactcggctgccccctcttcttgcgggtccgggtagggtagggcgggaacgcgggacgtgccctaagcgggccagccgagcgcgagacaggcgatgctgcagaagcctgcccgcctgcgggtcacacaccggccggcctcggctgcaggggttgcggggccacgggtcgcggggcgccgggagccgcgagcaggtgacggccgcgccgggcagccccgcgggccgcgattcccgagagcctggcgccaccccgcggaagccggaggaactgcggcttcttcccgctcccgcgcggaggggagagggaggcgcagcgcggaggggagagggaggcgcagcgcggaggggagagggaggcgcagcgcggaggggagagggaggcgcagcccgcaccgcgcaatcccggggctctggcgggagggaaggtgacttgcgtgggacgactccaagaggccaggcccggccttcgcagttcacccacgaggataccgcgaccaagccaccaaagcactctctggccaggccgagaccccttttcccccgggccccaagagaaaaaagcactttctcctaaaacacgaactccccgcggaggggcccggggctgcctggcacggggcagggtgtgcggctgccgtgcgggcgcgggccagagtcacgtggaggcaggcgg

SEQ ID NO: 94807 - DNA, 22 bp, Homo sapiens
  chr6:13829036-13829058
  hypo
cctactgggggaactcgccccc

SEQ ID NO: 94808 - DNA, 457 bp, Homo sapiens
  chr6:1382993-1383450
  hyper
gtgtggggcacagggcgtgaggggaggatgagctccccctgagcagatggagatttctccttgcctgggccgtttgacccccaaagccttgcagactggccgcgtgggtgccatggggcgatttcttgggaaaggagggcagcagaaaggcccgtgggctctcagcgccttggagtcaggggagcaggaaggggagtggaggtgcggacacgcctccagccaccgtgctcccctaggaggatctcccttcagcccctgtagaaccctgcatctcaaccaccctcgtgcatgtggtttaccttggcatagatttccaagccgctacagaaaacctgtccacctcccccaaggtggaggcgggagttgggaggcaggggtgctggaaagggtcacctggctcaagccgaccccaggtctgacgggcggagagcctcgagggccacgccccaggccagtg

SEQ ID NO: 94809 - DNA, 32 bp, Homo sapiens; identical to SEQ ID NO: 30231
  chr6:1383677-1383709
  hyper

SEQ ID NO: 94810 - DNA, 123 bp, Homo sapiens
  chr6:1383859-1383982
  hyper
ggggcccggggcctttggccaggctgcggggaggggtggggttggggggctccccaaagcagcttctcggaggcggcgtcggggcgccctgaggtccctagtcggcctctgggcgccgagcac

SEQ ID NO: 94811 - DNA, 197 bp, Homo sapiens
  chr6:1383983-1384180
  hyper
ttttatttatccccacagaggatgctggaggacaaaagaaatatttggacgtcagagctgatttatatttttggaagagctacgtttccttttctgaagagaagcgagcgcgccccatatcctgagctcggcggggaggacgagaggggagttttgatgcgccaggaagttcatctatcgcccaggcgctcaggacc

SEQ ID NO: 94812 - DNA, 31 bp, Homo sapiens
  chr6:1384625-1384656
  hyper
cgagcgttgccacagccgggagggcggaggg

SEQ ID NO: 94813 - DNA, 715 bp, Homo sapiens
  chr6:1384971-1385686
  hyper
tctccactcactccccgcaaccccgcaactcgccacccctaaacgcagcgggctgtaggcgaagtcgaagaggtgctccgcctggtaccgcggcctgcgcactgggatcggggcctgcaggccgctgggctggctcctgggatcatcccaaggttttggtctcgcaaccgaggggacccgcgcccggcaatttgggaagtgcggaaatggggtgaggccggtcttcgcttgagggtctcgtagattggacccctttttcccccttcaagcaccctcagacctggccagtgggtcatcgagtcgtgcccaccgcccaggccaggagatctggggctactgggagatctctcatgaaggtggctataaaaagagccctgaccgggacacaagcctttggagagcggaagactctatccaaataaacactgggaactgggtggctggtgttcaggcccggaggtctgggggtttctggacctaggaaggagagcagactccaggagaggtgtgaaattcccactcccggccaccttgctctctccaacccccgcctccgcgcgtcctcctattgctgttcccgtccgcatcttctgctgttatgtgaagtttctaaagaggcctctgcagcgtgcaggctggtgctcttccagcatttcctcaatcacgctgacacccccaggccccagcactgagttctcgccgtccacatttagaa

SEQ ID NO: 94814 - DNA, 35 bp, Homo sapiens; identical to SEQ ID NO: 30237
  chr6:1386121-1386156
  hyper

SEQ ID NO: 94815 - DNA, 38 bp, Homo sapiens
  chr6:138753177-138753215
  hypo
gtcactctgcgatggcgtggccccgcacagggagtaga

SEQ ID NO: 94816 - DNA, 157 bp, Homo sapiens
  chr6:138790419-138790576
  hypo
caacctgaagacattcgcacatgagttacgtagagggacctgcaggaagcggtagagaaaacataaggcttatgcgtttaatttccacaccaatttcaggatctttgtcactgacagcagcactaagacttgttaactttatatagttaagaagaac

SEQ ID NO: 94817 - DNA, 269 bp, Homo sapiens; identical to SEQ ID NO: 30238
  chr6:1389006-1389275
  hyper

SEQ ID NO: 94818 - DNA, 989 bp, Homo sapiens
  chr6:1389372-1390361
  hyper
cgcagcagcaccactcggcccggcgggccaggaggaggaagggggcgcggaggggcggggctgggtcctgggatgggacgcggggcttgctgcggggggcaaacagaaagaatatttcatgaagtcagaggtggtcgagttttgcgaggggtgggggtcgtccccctggcagaaccggagtgagtctgtgatccctcaattggaaagagggtgagtgagggaaaggggaggaggccgcgagaggaatgaagagcgaggagaccctggagagcggggagcgagataagagagggaggcggccgccaggtcgggagggggaggagtgagcgcggcggcgcggagcgaggagggggcagggcggggtggggggggagggagggagggagggagcgaggagggcggccggggagggcgagggagggaggaagtccgagagacagagcgaggagcgctcctgaagggagacgtcgggctcgtccccggggtccaggccgcggtcccactcgcgggcgcagtcgcccggcgccggccgctcggccccgcggcctgggaggccgttgcgcaaggcagggcccgcggctcggggagggatgcgccgggcgttgcctcccgcccgccgccgccgccgccgccagaagccccagaggagctgagggaggcgacgccgaagcgctggcccggagtggccacggctgcagcccgggcggcgggctagggcgctcgcagggcttctgggccgaccccgctccggcgcctccgcttcccgcccggggcccgccctcgcggcccggcctcgctcccgggtcccagatgaccaccgagggcgggccgccgccggccccgctccgccgcgcgtgcagcccggtccccggcgcgctccaggccgccctgatgagcccgccgcccgccgccgccgccgccgccgccgccgccccggagaccacctcctcctcctcgtcgtcgtcctccgcctcctgcgcctcgtcctc

SEQ ID NO: 94819 - DNA, 44 bp, Homo sapiens; identical to SEQ ID NO: 30240
  chr6:1390362-1390406
  hyper

SEQ ID NO: 94820 - DNA, 336 bp, Homo sapiens
  chr6:1390423-1390759
  hyper
cgggcgccgggagcgggggcgccaagaaggcgagctcggggctgcggcggcccgagaagccgccctactcgtacatcgcgctcatcgtcatggccatccagagctcgcccagcaagcgcctgacgctcagcgagatctaccagttcctgcaggcgcgcttccccttcttccgcggcgcctaccagggctggaagaactcggtgcgccacaatctctcgctcaacgagtgcttcatcaagctgcctaagggcctcgggcggcccggcaagggccactactggaccatcgacccggccagcgagttcatgttcgaggagggctcgttccgccgccggc

SEQ ID NO: 94821 - DNA, 621 bp, Homo sapiens
  chr6:1390955-1391576
  hyper
cgcccccagccacgcgcaccctcaccaccaccaccaccaccacgtcccgcacatgtcgcccaacccgggttccacctacatggccagctgcccggtgcccgcgggacccgggggcgtcggtgcggccgggggcggcggcggcggcgactacgggccggacagcagcagcagcccggtaccctcgtccccggccatggcgagcgccatcgaatgccactcgccctacacgagccctgcggcgcactggagctcgcctggcgcctcgccttacctcaagcagccgcctgccctgacgcccagcagcaaccccgccgcctcggcaggcctgcactccagcatgtcctcctactcgctggagcagagctacttgcaccagaacgctcgcgaggacctctcaggtaacgcagcacgctccagcccagccagctgggcgcaccgcttctaggcctccagggctggcggccactgccactcccacaaacagggaccccgaagctaggaggtctgagggcactgggaaaagcagatgctggggaaagccggcatcttattcgtgggagcagggatcagggtcttactgtcctcccagtatccctggccagcagccgaagcttcagaatt

SEQ ID NO: 94822 - DNA, 699 bp, Homo sapiens; identical to SEQ ID NO: 30322
  chr6:13924890-13925589
  hyper

SEQ ID NO: 94823 - DNA, 205 bp, Homo sapiens
  chr6:1392844-1393049
  hyper
cagccttggagaaaccgtactctaggaagaaaaaaaagcacacaggaaagagactcctgacccttcctcaaggctgctctcgccccacctcataacactgggcgcaggcacaagctcccaaaacttcggaatctggatacattactgtcttggagggggtgaaaactgcccagcaaagcaagccggcctctgtgcccctacccag

SEQ ID NO: 94824 - DNA, 83 bp, Homo sapiens
  chr6:1393301-1393384
  hyper
gccgcccactgaggcctgggggcccggcgaggcgcgggggtggccaaggcagtctccccggcacacagatcagcacatgtcta

SEQ ID NO: 94825 - DNA, 15 bp, Homo sapiens
  chr6:1393442-1393457
  hyper
cgctcctgggcctgg

SEQ ID NO: 94826 - DNA, 30 bp, Homo sapiens
  chr6:139645132-139645162
  hyper
ggtagataggagtcacgcccctcccccatt

SEQ ID NO: 94827 - DNA, 33 bp, Homo sapiens
  chr6:139720812-139720845
  hypo
gggcacggtggtggtttacgtgtatagtctcaa

SEQ ID NO: 94828 - DNA, 30 bp, Homo sapiens
  chr6:14002445-14002475
  hypo
ggtcccatcactggacgtgttccacggaga

SEQ ID NO: 94829 - DNA, 30 bp, Homo sapiens
  chr6:14140908-14140938
  hypo
acttcacgtgtttcacgctagttttatcct

SEQ ID NO: 94830 - DNA, 156 bp, Homo sapiens; identical to SEQ ID NO: 40750
  chr6:14203256-14203412
  hypo

SEQ ID NO: 94831 - DNA, 408 bp, Homo sapiens
  chr6:142409841-142410249
  hyper
gccctgaggactgaacgcccacgatttaggtttaatcgatgtccctccctctcgcccctgcaagtttactgtccgcggggcaagcctcacagcaccacgtccctaagagttcaggacctggggaggggtctgtccacacactcgggcgctccgcttctagaggggggaaatggctccggctaactctgaatttaaattaaaaaaaaaaaaaaagcaaagcggttgcgtctttgttccgtattcagtggtttgttctcgcggttatctagcggaaaacagcctttcaggaacaaggagctgtcccttggggatcagtagaagcacctgccggactcttcgcccagagaagcagaagtcatcctggcgctgtccagcgggccgcagctgaaatcccgggaactaggcggg

SEQ ID NO: 94832 - DNA, 30 bp, Homo sapiens
  chr6:142444970-142445000
  hypo
ggcacacccataagccgtagtttgccgaac

SEQ ID NO: 94833 - DNA, 249 bp, Homo sapiens
  chr6:142622714-142622963
  hyper
cgtttcggcgacctccgggtccgccctgtcccctcccagctggggagctgagcccggctctgcgcccatcgccgaccccggccactctcccttcgctgctcgctccaaaagcgcctgtcccgccccgcggggcgacttctccctttcggccctggggttgaagatcctgtgtggggcagctgcgccttcgggacagccccagccgcggagcgcccagaccagggcagccggagtcgggtcatacgccgc

SEQ ID NO: 94834 - DNA, 76 bp, Homo sapiens
  chr6:14281293-14281369
  hypo
ggtggtggacctcatcggtcatcacagacgtgccctggggatgctggcgccactccagccgcgtggtgggcaggca

SEQ ID NO: 94835 - DNA, 334 bp, Homo sapiens
  chr6:143247641-143247975
  hyper
tgtgaaaagaaagagcgtatattctatccgggcaatgacaaacggactcaggcctcctgaggtcagcgctcctgggcaccatcaggccccacttcgggagcccccggtgctccgggcccacctgactgggcgtcctctgagtcagggaggtgccagtgctgtggtccccgcgagcccaactgtcccctgacccccgggcttttccgcaccgtggagtcccccgacacgctggggccagtgaacccgggccggggcgcgcgttctccctcccggaccagctcccggcgctgggcccgcggccgagaaactaggtctgggccggccctgcggcggc

SEQ ID NO: 94836 - DNA, 108 bp, Homo sapiens
  chr6:143248343-143248451
  hyper
cgcctggatttcccacggggaggaaaaggcgtgcgtttccaggtgtttggaggacgcactggccgggcgcactttcctcagcgtaattttgaacgcagtttccctaaa

SEQ ID NO: 94837 - DNA, 312 bp, Homo sapiens
  chr6:143557301-143557613
  hypo
ccttcttgggccttacgagttgtgccagttctcatgagttgagcgcatacggctggtgtccctcctggtgaccttcgcagccatctgggctggggcctgtgtctgtccggctcagcccagcggggcagggcctctgccgtgagtttgcagatgcctcattcggactccgagtctgtgactcacgccatctgttggtaatttgtcgttgttctggagtcaggagttttcaaaggattcagtctttggtgtcccttcacaggtgcactgcctgtgattttctgacaccctcttgccatccggcctatggccaga

SEQ ID NO: 94838 - DNA, 30 bp, Homo sapiens
  chr6:144277296-144277326
  hypo
cctgtcagtgactcacgtgttcaaccttga

SEQ ID NO: 94839 - DNA, 144 bp, Homo sapiens
  chr6:144521927-144522071
  hypo
cctagggtcattcagcggaggtattaccaccaatgagcgagtcatcaatgttaccttctatcctactgaccatcttcccctccacctccaggtacagcccgtccatgatctcccagatcttgtagatgtcggaaaacatctcat

SEQ ID NO: 94840 - DNA, 55 bp, Homo sapiens
  chr6:144607633-144607688
  hyper
attggtgtgtagtcccgcgcagtcgccggctctccttttccggactctggggatc

SEQ ID NO: 94841 - DNA, 152 bp, Homo sapiens
  chr6:144622994-144623146
  hypo
ccccaccctccccctcgccccaaaaaccaccatgaaggaggcagagggcaccaggtgaagactgcccatggtccttttcttacctctgtgacttcgcttgttttgtgttctgggcttgattgttctccttctccctgcgtccccagttttgc

SEQ ID NO: 94842 - DNA, 149 bp, Homo sapiens
  chr6:146349147-146349296
  hyper
tgtgctctcctcgcccgctcccatagcccccttttcgtcgactctcaccttgagaaaaggagcaggggaggaacgggagagggagccaacttcagccccgcaggcggctgagatttggcgcctctgtccccaagcgggtgggtttggat

SEQ ID NO: 94843 - DNA, 282 bp, Homo sapiens
  chr6:146349511-146349793
  hyper
aatgtctggctggaccgagcactgtccagggtcctgaaggcggcagggctcaggctgccgcggcgagagcaacccggaagctcccctccgttccctttctagcaactatgcaaaccccaaagcaagcgcaggaccccccctaacccgtccacccaccgcgggaaacaagttaccttatctgcaccccttcttcttgaacatacacagcaagcctgacttcttacgggggaaacataccaaactcctccatacggagactttaccaggcgttgccttagtaac

SEQ ID NO: 94844 - DNA, 454 bp, Homo sapiens
  chr6:146755460-146755914
  hyper
cagcaacttcagtaccgcgatcccggattttcacgcggtgctggcaggccccggtggtcccgggaacgggctgcggtccctgtacccgcccccgccacctccgcagcacctgcagatgctgccgctgcagctgagcacctttggggaggagctggtctccccgcccgcggacgacgacgacgacagcgagaggtttaagctcctccaggagtacgtgtatgagcacgagcgggaagggaacacggaagaagacgaactggaagaggaggaggaggacctgcaggcggccagcaaactgaccccggatgattcgcctgcgctgacgcctccgtcgcctttccgcgactcggtggcctcgggcagctcggtgcccagctcccccgtgtccgagtcggtgctctgcacccctcccaacgtatcctacgcctctgtcattctgcgggactacaagcaa

SEQ ID NO: 94845 - DNA, 117 bp, Homo sapiens
  chr6:146864391-146864508
  hyper
acccaagccaaggcccgcaagtgtggctctccctgcggggagagtagggcaggaggtggatttccaggccagaggcttccaggctgggcccggaccccacgccgaccccggccccgg

SEQ ID NO: 94846 - DNA, 116 bp, Homo sapiens; identical to SEQ ID NO: 30871
  chr6:146864762-146864878
  hyper

SEQ ID NO: 94847 - DNA, 113 bp, Homo sapiens
  chr6:147828093-147828206
  hyper
cacaagcagctccaccggctctccgcgttggtctctcccctccccctaagcagacagtcctttctgccagctgtccttaatttgagattcgtgagtcccggggtttgggaaac

SEQ ID NO: 94848 - DNA, 246 bp, Homo sapiens
  chr6:147829255-147829501
  hyper
gaagggggattcaaacgcggatccggaaggaagggacactgaaccccgcagcgtccccagcgccgtggggcggcgggacgtgtccttgggctgccagcgggcgcggaagctggagtccggcagggtcgggaagaagtgagcacagacttccacgggtagaagagtcagattaaacagaaatgtgaaaagcaacccagggcagccaacggagcccagcagcgtagaagccaccggcttcccgccggg

SEQ ID NO: 94849 - DNA, 39 bp, Homo sapiens
  chr6:147829759-147829798
  hyper
tccccgcggcggcagcgtcggcggcgcatccaggggcgg

SEQ ID NO: 94850 - DNA, 74 bp, Homo sapiens
  chr6:147830039-147830113
  hyper
cggcggcggggttcccggtcccaccatgtgcaccaacatagtttacgagtggctcaaagcgctgcagcttccgc

SEQ ID NO: 94851 - DNA, 113 bp, Homo sapiens
  chr6:147830462-147830575
  hyper
gatcagggataagctcgtccgtgacggcatccacctgagcaagcccccgtactcccgcaaggtaaggaggtgccgtccgggcggcccggggcgcgcggcgggaggggacacag

SEQ ID NO: 94852 - DNA, 30 bp, Homo sapiens
  chr6:147886875-147886905
  hypo
gtgagccatcacacccggcctggatgctgg

SEQ ID NO: 94853 - DNA, 30 bp, Homo sapiens; identical to SEQ ID NO: 40903
  chr6:147981884-147981914
  hypo

SEQ ID NO: 94854 - DNA, 457 bp, Homo sapiens
  chr6:148663337-148663794
  hyper
atccaaacaatggctcgtgcccaagctttcacacttgttttgcagagaagtcttggctggcagaggcaggatttgtaattccttgggtcgcttgacttcacgaggggcgaggtatgcattgtagcgacacggactacttgtgaagcctttgggcgggagtcgcttaaagattaactttctcgggtttccgttaccaaaagcgtttccgtgaatagcgtgattggaaacttgtgcgggccggagaccgcggcgcggctgctctttcaacaggcgatttgttctcctgtccgaggctcatttccatgcaaagagcctgacatcagagcaccttttgttgctaaacgctttctttagcctcgagggagagagtcatgtggagctggaagagctcattttgaagagaggggtcccggggagctccctccaagatctagaggctccgcggccacccctgccg

SEQ ID NO: 94855 - DNA, 156 bp, Homo sapiens
  chr6:148664007-148664163
  hyper
gtggccacctagacccgaggtgcgggcgcctgcgaagggcccccgcggggtggccggggccgccggggcatgcagcgcgggggcgcggctcggtgacgccgcgggcggggacccggcatccgggcaggctgcgcgcgggtgcggggcgagggcgcc

SEQ ID NO: 94856 - DNA, 163 bp, Homo sapiens
  chr6:149068767-149068930
  hyper
agcgggggaccccctcgcttcctgctcgacctgcggcagtacttgggtaaggaagctgggcaggcgctagggcggcgccgacagcgcaaagttgtgcggcggggagagggtcgcggcggggacttctcgcgctgccaccgcgcgccgccgccgccccgggtct

SEQ ID NO: 94857 - DNA, 320 bp, Homo sapiens
  chr6:149069188-149069508
  hyper
agggaaggtcctcttcgttgcattgttagtgaccgcagttcagtcccgtcccgcgccccggggagtgtgggtgggtttagccctttgccaccgtccgctctgagaattctgtcccgcagatcccccgcctgcccgccggccctagtggctccgcgctgtccccgggctggcttgtcccttggctgccgctgcccaccccgccgcccgcagctagcctggcgcggggaacgggttgcatccaggggtttggggatgcccgagggcgctggtcagcctggccagcagtgtcgcccccagtaacccgaggatcctcggcgctg

SEQ ID NO: 94858 - DNA, 38 bp, Homo sapiens
  chr6:149069731-149069769
  hyper
agcgcaagcccaggtcgcaaggacgatgctggcactcg

SEQ ID NO: 94859 - DNA, 99 bp, Homo sapiens; identical to SEQ ID NO: 40904
  chr6:149177471-149177570
  hypo

SEQ ID NO: 94860 - DNA, 71 bp, Homo sapiens
  chr6:149460105-149460176
  hypo
aggttaaatgctcagcgcatctggccagagagttattatattacagcagagcatcacgagagtcagcagcg

SEQ ID NO: 94861 - DNA, 23 bp, Homo sapiens
  chr6:149498669-149498692
  hypo
aattctccatccaatcgagtctt

SEQ ID NO: 94862 - DNA, 34 bp, Homo sapiens; identical to SEQ ID NO: 40907
  chr6:149772982-149773016
  hypo

SEQ ID NO: 94863 - DNA, 192 bp, Homo sapiens
  chr6:149785967-149786159
  hypo
agtggggctggagcacgaggaatgagcccgggcaacaggtgtaaagggaggggcaaggataagttcttagagagccaagggccactacgccactcgtgccttctcccgagaagcctggcagccaacccatatgcagacaaggatgacattttgaattcacactgctgtgctctctctcgtatgtgacctttc

SEQ ID NO: 94864 - DNA, 20 bp, Homo sapiens
  chr6:149868358-149868378
  hypo
gccaccgcacctggcggaaa

SEQ ID NO: 94865 - DNA, 30 bp, Homo sapiens; identical to SEQ ID NO: 40751
  chr6:14999193-14999223
  hypo

SEQ ID NO: 94866 - DNA, 23 bp, Homo sapiens
  chr6:150069440-150069463
  hypo
tgagactccgtctcaatcaaaag

SEQ ID NO: 94867 - DNA, 85 bp, Homo sapiens
  chr6:150204851-150204936
  hypo
caaagaattacttgcactgtgctcacataatttatacagtcagttctgctatatcaggttgtttgaaaaccgtactttattccaa

SEQ ID NO: 94868 - DNA, 425 bp, Homo sapiens
  chr6:150243820-150244245
  hyper
ggcccctccactctccgggggttcctttccagcctcctctctgaccagctcctcccctcggaggataagtagcctctgggaacggacccggcgggaaggagacgcggagggaaactgagcgggggcgcagtccggggtgatcgcacgggtccttccagaagcctcccctcctctgaagcccacagtccacagccccccacggttggcctccgccccgcttaggctccatccccgaactcaccggccagcccggtcctgcaccagctggacagcaggagcagaagcgggaggcgtagaaggaacgcggggctggcggccgctgccattggggagttggatcgcaggggacagcagaagcgaagcccagcccgtggatcacctggcggctcgcaggctgtctgaatgcagcccgtctgaatgcagcc

SEQ ID NO: 94869 - DNA, 125 bp, Homo sapiens
  chr6:150246750-150246875
  hyper
ggcgcccgctgtccccgagctccgggcctgagtgctggctggcggagacccacagtgggtgccccgctcccggacgatgcccctgggcttccagatccagagcctcgggacgaaactgtttcagg

SEQ ID NO: 94870 - DNA, 143 bp, Homo sapiens
  chr6:150262701-150262844
  hyper
cccggactgtaatcacgtccactgggaactggcgcagtagtggaggggacgcgatcaggcccgtggctgcgcccagagcatgataagccagggacctcgcggcgcaggcggagggagggagagcgtcgcggacccaggcgggg

SEQ ID NO: 94871 - DNA, 702 bp, Homo sapiens
  chr6:150284667-150285369
  hyper
gaggcaaaaaaggttcgctccggaatggggaagcggctgcgccctggacggagaggggcggggacttcgcgactgcaggcggagggagggcgggtgtcgctggcgcaggcggtgacagggagacaccgccgccactgagtattcctatgcaagtttcttcatcttcctgtgcatcagtgtttacactggggtaatgataaatgctgtgttgaaaaattatttgatggggccatggaaggaacggaaggaacggcgtcctggcccgctcggggcccgcgcacgccgccaccaagccgcgggggcgggtcggaggggagagttgcgtcagccaggccgctgtcagatgacgagcccggggcgtgacggggtggagcatccccaaaaaagtgcatgcctaggatcccgcccagtgtatccctgcgcgcggcgggccgggctgggcagctttataaacagccgtggtgtgagcctcgaagggaaccatcagcgcctcctgtccacggagctccaggtctacaatggcagcggccgccagccccgcgttccttctgtgcctcccgcttctgcacctgctgtctggctggtcccgggcaggatgggtcggtgagttcggggatgtagcctaagcagggcgggggccaaacctgggaggttgtggactgcagcgggtttcagaggaggggaggcttctggaaggaccgg

SEQ ID NO: 94872 - DNA, 342 bp, Homo sapiens; identical to SEQ ID NO: 624
  chr6:150285544-150285886
  hyper

SEQ ID NO: 94873 - DNA, 540 bp, Homo sapiens
  chr6:150286099-150286639
  hyper
cgaacatgcccggctgaaggcactcagttcccctccgcggctcctttcctccgggtccgcttcctgcggctgctgcttgccccataggccaggaggcttctgggtggaccagcgcgatctccccgaatatcgcggtctacccgaacatcgcggcctccccgaacatcgcggtctccccgaacatcgcgatcccccagaacatcgcggcctccccgaacatcgcggtctccccgaacatcgcgatcccccagaacatcgcggtctacccgaacatcgcggcctccccgaacatcgcggtctccccgaacatcgcgatcccccagaacatcgcggtctccccgaacatcgctgtctccccgaacgtgcctggctgaaggcactcagttcccctccggggctcctttccgccgagtccgcttcctgcagctgctgctagcaccgcagtccagggggagtgtcaaagaaggctgaaaaggaattgcaggagggtggagggaccaaaaggctacagagggcaaggtagggcggggatccctggtg

SEQ ID NO: 94874 - DNA, 109 bp, Homo sapiens
  chr6:150310096-150310205
  hyper
ctcaacacagagtcccgccgtgtcctctgccccctccaatcctctcgtccctcccatcctcctgctgttatagaagatagaaagaaatcatttacgtagatagggtaaa

SEQ ID NO: 94875 - DNA, 39 bp, Homo sapiens
  chr6:150310414-150310453
  hyper
tacagaagatggaaacggagcctcaatgagcacattcct

SEQ ID NO: 94876 - DNA, 373 bp, Homo sapiens
  chr6:150311072-150311445
  hyper
tacaacctggcaacccgttcgggacacctctctgtgacagagagctgttctttcctttctcccataaaactcctgctccaatctcactccgtggatttgcgtccccgtccttgatttccttggccgcgagaccaagcatttattccaggcgaccagctgtttcactgcccttagtttctggtctcgtttccgccactgtgttttctcgggccgggagaagcagtcccagggacgcgacaggggcagaaggagccctgcgtggggaattgagaagggtgcggcgcggtcagaaagatccgtcctccgcgacgccctctcctctttctccgacccattcctggaactcaccggctcgcgccgtccagggacagtc

SEQ ID NO: 94877 - DNA, 462 bp, Homo sapiens
  chr6:150311753-150312215
  hyper
gtttcacaaagagcacggattgggttttgtactttttctgtgtggttggtttttgtgtgtctgtgggtgatgaaatcgggtcggagtcgctctaaagtcatttttgtctcttgcgcgcctcagggaggatattaaaggcttttgtggatttcaaccgctaaagcctttcctcaaagttcattgcgaggggtttcagttccgcccggcagcatccctcagggttctgcgcgctcccgtggcaccgtctgcgcccgagctccggtcccgtcccgattgcctgatgccccgcagggagcgcccagcggccgccgatgtcccaccagcaggcaccgggcgcctagcgggacccgcgggcggaactgcctttggaagacgcgtgagaactccaccccatcgcggcaggggacagttattatctccgagcttgaggtgaggggaaatcagaggcggctgatggtttcc

SEQ ID NO: 94878 - DNA, 98 bp, Homo sapiens
  chr6:150312685-150312783
  hyper
atcaatgccttgagccggcgagtctctccccagtgctgagggctttgtgtgtgtggtgcactcctgcccctgccgcactcaggcgggcagctgatgtc

SEQ ID NO: 94879 - DNA, 461 bp, Homo sapiens
  chr6:150358524-150358985
  hyper
gccaatgagagtggacgcaggcaggggcgggggagcctttcacacatgacttttcatggtttcgatcctgatacacgtgaatatatggaggtgaagtagtaaggaagggtggggccgggagccccggcgacggtcaccagttgagctcgcctgatctgttgtgggctacgagagtccggggacgggcaatctgggcagagtcgcacgaggctgctgcagtgatgaggcactggttctagaaatttacccaacggtgttgtcataggggggacattacaggtgattgctgatttcaaccacagatgactttcggggaaagttctctcctgggggtttctgtttctaccccgccgcgtcctctccgagttctgcgcgctcctcccagggcgcccgctgtccccgagctctggacccgggtcctgcccagtggagaccgcggagttggtgccccgcttgcggcc

SEQ ID NO: 94880 - DNA, 207 bp, Homo sapiens; identical to SEQ ID NO: 30885
  chr6:150358986-150359193
  hyper

SEQ ID NO: 94881 - DNA, 15 bp, Homo sapiens
  chr6:150359438-150359453
  hyper
cgggagaaagggaga

SEQ ID NO: 94882 - DNA, 30 bp, Homo sapiens
  chr6:150393330-150393360
  hypo
taagcaaagaaagaacgagtctgaaagtgg

SEQ ID NO: 94883 - DNA, 20 bp, Homo sapiens
  chr6:150487217-150487237
  hypo
tttttttttttgagacggag

SEQ ID NO: 94884 - DNA, 75 bp, Homo sapiens; identical to SEQ ID NO: 40752
  chr6:15073578-15073653
  hypo

SEQ ID NO: 94885 - DNA, 30 bp, Homo sapiens; identical to SEQ ID NO: 40909
  chr6:150985942-150985972
  hypo

SEQ ID NO: 94886 - DNA, 21 bp, Homo sapiens
  chr6:15129502-15129523
  hypo
acagtttcggccgggcgcggt

SEQ ID NO: 94887 - DNA, 61 bp, Homo sapiens
  chr6:151346311-151346372
  hypo
ttccctacatgtaggcgtcttcagagtgaacctgttgctcagggcccgcgagcccacaggg

SEQ ID NO: 94888 - DNA, 376 bp, Homo sapiens
  chr6:151560965-151561341
  hyper
tccgtggcctgactgcgttaacctctcggttccctgctcttgccacgtgaggtgcccaaatatggtcggactcaggaggagccagggagcgcttgcctttctcctgctaatggggaggaggctggaacaaatgtttggagttaaacacaatctgcaggaaagcaaatggggactcggactcgctcctgggcgagctgaaagtcggctgcagcagaagctcctgccttgggtgatccatcatttaataaaccccagagaatccagtgtccccggcaggctttttgctcccctgctctcttgccttctgaggccctgggtcgtccccgcagctctagtcgccctgttagaaacgggaggcgcccgagggccgggtggg

SEQ ID NO: 94889 - DNA, 624 bp, Homo sapiens; identical to SEQ ID NO: 8773
  chr6:151561368-151561992
  hyper

SEQ ID NO: 94890 - DNA, 540 bp, Homo sapiens
  chr6:151562056-151562596
  hyper
cgcggcggggggcttgcatctttgtcgcgggtctccaggggaggcgactgcgccatgcgcaataataaaacccgcgccctgcccacggcggctgagcctttctgcgcactcttccggtgggagccatgcagcccgaggcggaggagctgcgcggagggggatccgtggagaatggaccccgggccgggcctccggagctccgagatgcggaaagtcagctgtgaggccaggactcgtggtggagcccgccggggagcccagccaccctcgggttccccgtcgcgtaccgccctggatgccagcggtgcctggagcgagcgggtttggtacccagtcctcctgcggcagcggcccgagcaggcaccgccttcccgaggcagagaaagcctggggtgtagctcgctcagagccaggaaaaacctgggcaggcgctgcgtttccagaaggaatgacaggtttcgcaaaccagccagcgccctcgcgttcgctcagcgctttgcctgcagactcagttggccaaacacacgctagagtggctag

SEQ ID NO: 94891 - DNA, 49 bp, Homo sapiens
  chr6:1515653-1515702
  hypo
ggaggaggtggaacccgcggccggagacacacgccgtggggtcggtcaa

SEQ ID NO: 94892 - DNA, 735 bp, Homo sapiens
  chr6:151814876-151815611
  hyper
ttcctatgcctcactcgcgccagcaccgttcacagtgcccactggctgtatttatcgctgacataaggatgaggcctggaattgcattcactgcagagtcccaccgggaggaccgaccgttatccccgccgactccccccaggtcgccctggcagtttcggccgctcagttgcaggccctcgccacggaggccacgctcgggggttcggggtccaccccggcctcctgcggccgggccaccctactcgcgcgcagccgcgcgccgccgcgtccccgcggtgtttacccgttgcccgaggagacacccgcgccacccgccggctcccggcgccgccgcttcctcagggccggttccgggtccgagcgcgcccccgggctcgggtcgtcatgagcctggactgcaccagccatatcgcgctgggtgccgcttcgccagcgcccgaggtacggtcccagccgccggccgcgcgcgggggtggccctggggatagacgacccaggaggggccgaggcgcccctgatttgcacccttttcctcccggaggcgtgggcagaatcagagcagctctgtgcccgcgagggctgtggcctgggactgccagggcgctgatttcaggaggggatgggcaggaccggagtttgcggagcgcgtctgaattttaggttgtgccactctgcttctctgaccatttaaaccggtgacattcgaaagactgtggccgggcagttcctccc

SEQ ID NO: 94893 - DNA, 34 bp, Homo sapiens
  chr6:151815845-151815879
  hyper
ttagatgtaccaatgcgcgcgcgcacacacacac

SEQ ID NO: 94894 - DNA, 30 bp, Homo sapiens
  chr6:15213893-15213923
  hypo
gtgagccaccgtgcccggccctgtatatac

SEQ ID NO: 94895 - DNA, 87 bp, Homo sapiens
  chr6:15223030-15223117
  hypo
aaaaagttaaaaaaaaaatctggaaaaactcagctgtttattgatccctcaggctctggggtaatttccagtcgtacaaatagatgc

SEQ ID NO: 94896 - DNA, 271 bp, Homo sapiens
  chr6:1524158-1524429
  hyper
caagtctcgcagaagcgtgtgaaaatccccacgctcagtcgccctctccctgcacacgccccgagtccgcgtctccctcctgtgtgaatgcagggaaagcgggagcgcggcgaggggtctggtgcggaccagcccccgagccacagagtgcggggcccgagctccggaagcccagcctgggccgcgacggccccaattccagcaacgctagagggcgcccgtgccaagcgcccgctcccggcaagccgcgtgctcccgggtggccgcaacc

SEQ ID NO: 94897 - DNA, 151 bp, Homo sapiens; identical to SEQ ID NO: 40910
  chr6:152520849-152521000
  hypo

SEQ ID NO: 94898 - DNA, 30 bp, Homo sapiens
  chr6:152539785-152539815
  hypo
catgatcaaacaacacgtctgaaaaatctt

SEQ ID NO: 94899 - DNA, 196 bp, Homo sapiens
  chr6:152562427-152562623
  hypo
gggaaaaaataggaacgacaatttgaaaaagacaaaaaaaacccacctttacaagccaccagagagctacacaatggtagaagattttaaacttctataacccaatgggatttttttagtttccctacaggaaattcccatagtctagaaggctgggtttctggactggcaaaattgctttcgtaatcattgccaa

SEQ ID NO: 94900 - DNA, 579 bp, Homo sapiens
  chr6:152622914-152623493
  hyper
ccctgaaatcagccacggagagggaacatggagccactcgccaggctccagtcaaagagcaaagccgcggggacccactggatccttaccatgaccacagaggggtgggccgaaggcgtggggaggagctccccatccaggtcctctgtcccttccgccagcccctcgacctcggtcaccgtcagcagcatggtggcgtgcttggctttcatcgtcagcatcttgcacttggaattcaaagaagcgatctgctcctggtagcccttaattttctgcgccagctcctgaggaaacatttcccccaccggggtgtcagagcagcatcaaaaggaaacagaagtagtagcgttcatcttcctgcagggcgagccaatgagcgcgcagagccgcgcgggcccgggaggcaggatgtgtaggcggcgagtcctcctgcatctcgctaccgagccagaccgcaggctgcgcggcgcggcgcaggcacagccaaagtgcccgagcccgcgtccccgcgtcggtacaaaaggagaaatgaggggatgaggccgaatgagtggtttctaatcgcgagaggccccatat

SEQ ID NO: 94901 - DNA, 363 bp, Homo sapiens
  chr6:152957418-152957781
  hyper
tagtagcaacagtaccgaccatcacaataagaggctggctgccttttgcttctgcaccattggagcccaggagatgtgccacaagcggaaatgacaactcagagagggggatattaatagggacatctacgtacgagatgcaaagaggctccccaacctcctagtctccttatctatgagtatcgcacacgtacacacatcactgccaccaccccctcccatcaagcacgcagagccccagcgtgcaggcacaaacttgctgacaatttgtctgcaatgtgttcgtcttgcacctctctctcctctccctgtctctgtctctccctgtctcccagtctctgtctttccttttaccttctctct

SEQ ID NO: 94902 - DNA, 184 bp, Homo sapiens; identical to SEQ ID NO: 30893
  chr6:152957815-152957999
  hyper

SEQ ID NO: 94903 - DNA, 503 bp, Homo sapiens
  chr6:152958000-152958503
  hyper
cgctcaccctggctggctcgcccacactcactcccgcgccgggctgctcagccgcgctccccgccctccgcgaccggttcctcctcccggctgctcgctggggggtgaggcctcccccttcgccctcccccacgcatctactgctcctgtcgggaaggaaggtcgcccaggccggttcagcctctgggcagggtccctgcaccgccctggcccgccacaccccctccccggctccgtgccccgcgccccgcgcccggctccgggatgcgccggtgcctggaagagctgggggcggggacccggaggctcgcaggcttccctacctcctggagatgcacggccttgggcgtttctccgcagctgcaaagctgtgctgtgacccacccgctcagcgagcctttataccgggaccacctcccgggggtcgaggtgggaaggaaatgtccctgagagccgggacgcgctgcctccgctgcctggaggagctgcgctgtcctgccagc

SEQ ID NO: 94904 - DNA, 37 bp, Homo sapiens
  chr6:15302352-15302389
  hypo
gagtaatgaagaggccgggtgcagtggctcatgcctg

SEQ ID NO: 94905 - DNA, 30 bp, Homo sapiens
  chr6:153272474-153272504
  hypo
gtgtaaataaaagttcggatatatctaata

SEQ ID NO: 94906 - DNA, 625 bp, Homo sapiens
  chr6:153450977-153451602
  hyper
ggagccagggtcaatcgtccccgggcgacaggggttctcccacgtgaaccgacgtcccgggctccgggcgaggcgcagggctcagggcgcagggcgggtcccgtacgcagggcgggcgcgcgggcatctttgtggccaggcgaccccggctcgctctcccggagcccagggactcccgaggctggcgcgggctgcccgcgacaaggtgccagcagcctcgggctcgcgaggagcagctcccacccgcggcttccgagtccagctctgtccctccgccatcccctagtcctccggcatttattcagggagacagggaggcagagagaagaggagaaagcggccgtgtctgcacccagcctctgccgcagcactcgatgagggacagcagggaggctggcggggaggcagagattaaactatgattccatcgatcacggaaagaccaccatcacctacagcaaaggaggctccgatgcgcccacccgggcagcgactcgcggttggtgggcgttcctcgtcctcgccccctcggtggctgtggaatccaccccgcgccgcacacgccaggactccctttcctttgactaaggggaggggaaggaacaaaagagaccccccaccccct

SEQ ID NO: 94907 - DNA, 468 bp, Homo sapiens
  chr6:153451662-153452130
  hyper
ctggtcaaaggattcattttcgcaacctcttcttcgaacaccttccccacctgagcagtgcattttcccaaaggtaaagagagataagggaggaaacacagcacccaaggtgatcagtcgattggacactgttgatggcacattctcctcgttcccaaccaaccgcacaaaacccgcaacacctcgcgtccccgcggggtctcccgcgcccctggcccggccctcccggccgcccccagcaggcgccccgctctccgcgggaactctgggacctggccgagcgttccccggcgggcaggacactcgcccggttccctgcagcagctgagggcggcgagcggaccgcgtccaggcagcgacgcgggattcaacttcccggacccgcggcgcggcccccgctcccgctcagggcgccgcggccacagctgagaccccagcgccgcgcagccgcccccgccggggcatggg

SEQ ID NO: 94908 - DNA, 612 bp, Homo sapiens
  chr6:153452143-153452755
  hyper
cgccccctccttccttcacctcccccctaccttgaaaaaaatccatccattggtgcaaagcagacattttgatgtcatttacttagcaccgcttgttttggaggcagcgtcttacccggtcgcctggaggtgtgggcagcgcgccgatgggtccgggggagcggggctgggcggctcggtcctctagcggagccggtttgctgccatccgcccaacttcagcacccagcgggcgaggagagagggagagcggcgaggatgcagaggagggggagggggaggagggagcggtgggcggggagggagcgagagccgctcggcagcgcgcatgcgcctcgcgggccggcgcagcccctcgcccggcgcggccggaggggcagcttcccagcccctgcgcgcggccgcgagagtcccggccccgccccctccccgggcggcccccggccccgcccgacctcgcgcgctcgcctgggcgcggcgcccaccgtgcggaggggctcggccgggactctcggcttcggtgacgcccgtccggagcttcgcgggaggcccggagtcccgagagcttccctgggtgacagcggctctccgcccgggcccctgcaactccact

SEQ ID NO: 94909 - DNA, 39 bp, Homo sapiens
  chr6:153452788-153452827
  hyper
cgcgggagccttgcacccaggagccggcctgccaggcac

SEQ ID NO: 94910 - DNA, 38 bp, Homo sapiens
  chr6:153472441-153472479
  hypo
gtgtgtcatgattttgttaatgacgttatgttaacttc

SEQ ID NO: 94911 - DNA, 377 bp, Homo sapiens
  chr6:154360574-154360951
  hyper
gagctgtggcagcggcgaaaggaagcggctgaggcgcttggaacccgaaaagtctcggtgctcctggctacctcgcacagcggtgcccgcccggccgtcagtaccatggacagcagcgctgcccccacgaacgccagcaattgcactgatgccttggcgtactcaagttgctccccagcacccagccccggttcctgggtcaacttgtcccacttagatggcaacctgtccgacccatgcggtccgaaccgcaccgacctgggcgggagagacagcctgtgccctccgaccggcagtccctccatgatcacggccatcacgatcatggccctctactccatcgtgtgcgtggtggggctcttcggaaacttcctggt

SEQ ID NO: 94912 - DNA, 40 bp, Homo sapiens; identical to SEQ ID NO: 40753
  chr6:15456031-15456071
  hypo

SEQ ID NO: 94913 - DNA, 99 bp, Homo sapiens
  chr6:154771265-154771364
  hypo
tcctggtgtccaatccgtgtgacccccagctcctccaggtcctgatgggaaatctgcagcagctgctcgccgttgatcttctctcgttcaaacttgtgg

SEQ ID NO: 94914 - DNA, 62 bp, Homo sapiens
  chr6:154796421-154796483
  hypo
ggcccttctccacctcgtccctcctggccaccatctctccccctgggcgcccttccctcccc

SEQ ID NO: 94915 - DNA, 173 bp, Homo sapiens
  chr6:154830592-154830765
  hyper
aaagtcactgcctcccggggagtcctggctcgaggtttctccctggcgcaaatgctatggtgttggcttttgcgcggccctctcgccttctccaacaaaaacagacaggctcggcggacccgccggagtctccctctacctgtccgacagccctgtcacgcctgcggacggct

SEQ ID NO: 94916 - DNA, 103 bp, Homo sapiens; identical to SEQ ID NO: 40911
  chr6:154970495-154970598
  hypo

SEQ ID NO: 94917 - DNA, 40 bp, Homo sapiens
  chr6:15512658-15512698
  hypo
catccctgtgagtgccgtgcgtgagcgcacacagaagcat

SEQ ID NO: 94918 - DNA, 38 bp, Homo sapiens
  chr6:155281592-155281630
  hypo
caccttccctgttcacgccatcacgttgctgtctcctt

SEQ ID NO: 94919 - DNA, 195 bp, Homo sapiens
  chr6:155316026-155316221
  hyper
tgggtcttggagtgccgactcgattgccatctccgctgcgaagccatctcctctcagaaggggaaggagatggaaagtctctgcggccgctgacctcagttttgcgtgcctttcctcggtgggacccgggaagagccgtctttaaattccttggggaagggacggggtcgcactggcgcatcgcatccccggtag

SEQ ID NO: 94920 - DNA, 1084 bp, Homo sapiens
  chr6:155316256-155317340
  hyper
cgatgtttcttgaattgttttatttgtgttgttccaaagaaagcgcgagggacatggtccgggaccagccgggagctggcgcgggggtcctgggcctgacgctgggcggggctggggcgtgtccggggcggggcggggcgggaggtgcggtcgcggctcgggcctggcaggcgctgcgcgcggggctggggcagcggtaaccgtaactgtggccgcggccgccgcaggcgcacagcgcgcgtccaagtggagaacaaagtgacccccagaacttctccaactcctcccggcgttcccgcgagggccacgcgccgagggtagcggagggcggcgcgcgaccggccccaccgagcccggcgcgcgacccgaggtaaggggcgcccgggtgagggcgcaggagggcgacgacccgcgctggttggcggcggctccaggtcccctgcgggcggggcggcgcgcggccggcggtcccctcccttcccctttgttggccgcccctctctgcccccgctttcctgggagtcccgcggaaggtcgcggctgcggggcgcggcctggcaccctctccccggagggcggcagcgtccgggcacagcctggcacgggggacgaagcactttccagaaggctctgaaactaggtcccctggtcccctcgcgctgcgcgacacgccaggacccactttcagccccggtcccatcccggatgggaggaggcggcgccccggcctcctgataccgaggttctcgcccaaagccgagccgtgggtgcccggaggggagcgcccgctgcgcccacgcccgcccggcgacctcggagcctcagaaaggcgctgcggcgaagcaggatcccaggcggtcggctcagcgagtgtagaccgtgcggtccctgctcagcccctccggcctttccgagcgcgggagccatcccggacgggcgcggctcctgggggggctgaggtgccaagtttctgtgaaagccgacacgttgtgcccctaatggatcctatttaccaaaaacagttcagaaagaaaagagtccattcttccagccattcgttgctgacagccgctggaaaggtctg

SEQ ID NO: 94921 - DNA, 30 bp, Homo sapiens
  chr6:155438513-155438543
  hypo
tatttgtgggattgccggtttcaccatctc

SEQ ID NO: 94922 - DNA, 140 bp, Homo sapiens
  chr6:155568772-155568912
  hypo
cttttaatgaattgtttgaaactcactttttaggccacctataacaatatttctcatgggtatgcatgaaatgtgtctttaaagtcagacattcctgcattttgagtcagtgttagtctttggggcgcagcctgcattcc

SEQ ID NO: 94923 - DNA, 74 bp, Homo sapiens
  chr6:155569275-155569349
  hypo
gacggaccaggagagcgaggagcactaccacctgacgggtgaggcggcggcggcacctccgggcgagggcctgc

SEQ ID NO: 94924 - DNA, 30 bp, Homo sapiens; identical to SEQ ID NO: 14887
  chr6:155988231-155988261
  hypo

SEQ ID NO: 94925 - DNA, 158 bp, Homo sapiens
  chr6:156817422-156817580
  hypo
gttgcctcgttcaggcgttcagtcttggtggcccggaattagtaccttgatgcccttctcaaacaactggaagtatttcctgcagaaagcccacgatctgcctaagaagggatcgtcaccagataaagccatgatgcatatctcgtcagtgaaaacag

SEQ ID NO: 94926 - DNA, 30 bp, Homo sapiens
  chr6:157040065-157040095
  hypo
aaggaaaacactcggcgcattccacatttt

SEQ ID NO: 94927 - DNA, 179 bp, Homo sapiens
  chr6:157103443-157103622
  hyper
ggtggcaaatgttttcgtaattgggacaaaacgtgtatatattataggagaagggtctttttaaaaagtgaaataagccatttgacgattcagtttattactagatttttgtaagatgagtattcagatggagcagtctcaaaaggaatattgaggtctactcacgcacataggtttta

SEQ ID NO: 94928 - DNA, 30 bp, Homo sapiens
  chr6:157255695-157255725
  hypo
ggagttctatatatgcgtgtttattggttt

SEQ ID NO: 94929 - DNA, 30 bp, Homo sapiens; identical to SEQ ID NO: 40915
  chr6:157283403-157283433
  hypo

SEQ ID NO: 94930 - DNA, 30 bp, Homo sapiens
  chr6:157301697-157301727
  hypo
acagagatgaaaccacgcagtgcttttccc

SEQ ID NO: 94931 - DNA, 30 bp, Homo sapiens
  chr6:157431645-157431675
  hypo
atccagttcccatcccgccttgagccagtc

SEQ ID NO: 94932 - DNA, 30 bp, Homo sapiens; identical to SEQ ID NO: 40916
  chr6:157455406-157455436
  hypo

SEQ ID NO: 94933 - DNA, 193 bp, Homo sapiens
  chr6:157478285-157478478
  hypo
gtggctgtgctcactcggagatggctcaccgtgactcgcgcaccactgtctatgccacctgtcttcacttccagcttcatggctctgttaacatcccgcccccatagatacacacttacaccagatgtcctgggatcgtcacagcgagaaccagcattaaagcgcacccatcactaggcgtcattagcagccc

SEQ ID NO: 94934 - DNA, 30 bp, Homo sapiens
  chr6:157502438-157502468
  hypo
ccttcttgcaacccacgtctgtgtgctgtc

SEQ ID NO: 94935 - DNA, 48 bp, Homo sapiens; identical to SEQ ID NO: 40918
  chr6:157505817-157505865
  hypo

SEQ ID NO: 94936 - DNA, 30 bp, Homo sapiens
  chr6:157506082-157506112
  hypo
aatttaacaagctgtcgtggtaaggatcca

SEQ ID NO: 94937 - DNA, 543 bp, Homo sapiens
  chr6:157556754-157557297
  hyper
aaccatttctaaaagcattcctcagcgcttggaacttgcgagctgatggcttttggtggagcccaggaggggcgctgtggggcacagacgtgtgcggggccggcagctgcggagagagcagcgcaccccagccttcaattccccgccgaagatgggactctgcccagagccgaggcccctggctgctgccccgctcccttgcggccgcagtgacactcagagccagattcctcagacaatcttcactcctccgtggtggctgccttgggaggcgttgcggggtgaaggaagtcgcagctggtcccaagcagtggggagggcaggacagggagtaagacaccgccttcctggggtgcacacggaggaggggcgctgcccaggagcggaggggaggggagcggagcgcggagaggagaccggtgccagacttcacccgcctagctctcggaacccccgggggccgcgctcggctccgcctgggggctaccggttctgggccaggagaagaagtggcatccgcggggcagggcgggcggtgacggc

SEQ ID NO: 94938 - DNA, 31 bp, Homo sapiens
  chr6:157637384-157637415
  hypo
cagcttcctgtagctcgtcccaaggtccatt

SEQ ID NO: 94939 - DNA, 84 bp, Homo sapiens; identical to SEQ ID NO: 40920
  chr6:157638362-157638446
  hypo

SEQ ID NO: 94940 - DNA, 256 bp, Homo sapiens
  chr6:157912932-157913188
  hypo
gaattacgtcttgtgcggatttgccattttcagaagcgcacagagctcacctgttgagtaaccgcgccacttcctggtccctaccacaggccggccagggaagccggggctccccgccagaacactgcctcgccttcatcacagcaccagttgccggtgttggttgcggcacctcaggtgctccatccagcagccctccaggcaggtgctgtcactgtcccctctcaccggggaggaaacccggccttttcccttg

SEQ ID NO: 94941 - DNA, 30 bp, Homo sapiens
  chr6:15802460-15802490
  hypo
gtatacaccaagggacgggacaatcttggg

SEQ ID NO: 94942 - DNA, 38 bp, Homo sapiens
  chr6:158072190-158072228
  hypo
ttgttctgttatagtcggaggctcgaagccttaaatca

SEQ ID NO: 94943 - DNA, 307 bp, Homo sapiens
  chr6:158093775-158094082
  hypo
tcagagcaccaaattcgttttgcaggctgcagccacgcccctgctgcagagcgagcccagcctcaccagcgacgagctgcacctgcccgggaagcctggcctgggcacgccctgcgccagcctcacactgggcccgcccacaccgcccgcctccatgcccaacctcgccgaggccacgctcgcggacgtgatgccccggaaagatgagcacatgggccaccagttcctgacgcccgatgaggcgccctcgccccccaggctactggcggcgggcagccccctggcgcacagccgcaccatgcacgtg

SEQ ID NO: 94944 - DNA, 30 bp, Homo sapiens; identical to SEQ ID NO: 14891
  chr6:158119028-158119058
  hypo

SEQ ID NO: 94945 - DNA, 30 bp, Homo sapiens
  chr6:158245801-158245831
  hypo
ttggttttattaatgcgatagaacttgcca

SEQ ID NO: 94946 - DNA, 154 bp, Homo sapiens
  chr6:158430536-158430690
  hyper
tctggcaagaggagtcgaggaagggggctgaggaggtagaagggagggctttcctcaaaaggccagaaattcgtggccagccaaaggggaagcaaagacattctcgtgtaggaaaacttacaggaaatgcaactaaaagcgtgggagacaggaa

SEQ ID NO: 94947 - DNA, 185 bp, Homo sapiens
  chr6:15843746-15843931
  hypo
taaaggcattgttaacgtccattgggcagaaaggacgttagagtttttctggtgacataggccacagagtcaagtgacttccctaaagccacacagctagttatgggcaaagccgggaagaccactcaggtattcttgttttcacgacaagtcaatatctacagataacgcgtgaatggctggaa

SEQ ID NO: 94948 - DNA, 184 bp, Homo sapiens; identical to SEQ ID NO: 40924
  chr6:158489608-158489792
  hypo

SEQ ID NO: 94949 - DNA, 30 bp, Homo sapiens
  chr6:158937301-158937331
  hyper
tcaggggagggaacacgaaaggaaactctc

SEQ ID NO: 94950 - DNA, 35 bp, Homo sapiens
  chr6:158957282-158957317
  hyper
gcaggaaagggccttcggtccgcccccaagcacca

SEQ ID NO: 94951 - DNA, 241 bp, Homo sapiens
  chr6:158957747-158957988
  hyper
acccgggaggctgcgcggcatggacgccgagtaccctgcctttgagcccccgctctgcagcgagctcaagcacctgtgccggcggctgcgggaagcgtaccgcgagctcaaggaggacctcacgcccttcaaggatgaccgctactacaggtgggcgcggcgcgggcagcggcggggcggccggaggcttccgggccgcagtcccctccgggaccccggcgcgccccggccttggcctggt

SEQ ID NO: 94952 - DNA, 489 bp, Homo sapiens
  chr6:158958194-158958683
  hyper
cccggaaaggagctgcgggttgtggctcctccctgcgccccgcgtcgttctccccccgcgcccgcctcgccgcccccgctcgggcctcacgcggcgcagtctggggaggcgaccgcgcgcgctgcggcgtcgggaggagggtcttggccgcagctctgagcgccctaggctttgcaggacgcctcggaggcgggggcgccgccaagggctgggggcggatgggcgcggcggggaagacgcggcggggcgccatgcggggacacggcgcctgggagcggctgtgtggaacttgtttgcgttcatctctgtctccctcttcagcggcctaggggagagcggtggggactgcagaccctggcgccggcccccgcccccttcctctctgcgctctgcagttcggaggggaaggaaagtctgttcaccgccaatggccgatttacccaaaggcttggcggtgtcgggacaggaccctatcgcgagtcggtagaa

SEQ ID NO: 94953 - DNA, 30 bp, Homo sapiens; identical to SEQ ID NO: 40925
  chr6:158978998-158979028
  hypo

SEQ ID NO: 94954 - DNA, 79 bp, Homo sapiens
  chr6:158982731-158982810
  hypo
ggaggacaagcaaaacgcagcttgaattttgtgcgagtttgaggcctccccctgcagctgtaagcgctttgtgcctcag

SEQ ID NO: 94955 - DNA, 138 bp, Homo sapiens
  chr6:159049745-159049883
  hypo
ccccaggtcaggtttcgggtggcagagcccggctccaaacccagagaggctggcgctctggagcgtgcccacgccacgctgctttccacccagaggggcaggtgctgtgaggtaaatgaggtgcggttgcctctccac

SEQ ID NO: 94956 - DNA, 21 bp, Homo sapiens
  chr6:159081339-159081360
  hypo
gaacagcgcctggggtgttca

SEQ ID NO: 94957 - DNA, 30 bp, Homo sapiens; identical to SEQ ID NO: 40928
  chr6:159113607-159113637
  hypo

SEQ ID NO: 94958 - DNA, 22 bp, Homo sapiens
  chr6:159151570-159151592
  hypo
ggcgccccactgcctcgttgcg

SEQ ID NO: 94959 - DNA, 21 bp, Homo sapiens
  chr6:159151652-159151673
  hypo
gcaacgcggaaagaaagcagc

SEQ ID NO: 94960 - DNA, 35 bp, Homo sapiens
  chr6:159151892-159151927
  hypo
aaagccgccagggggcgggtcggggtggggcggtg

SEQ ID NO: 94961 - DNA, 50 bp, Homo sapiens
  chr6:159194739-159194789
  hypo
gaggcaaaaaggcagcggggctcctgggaaggtcacgtgggggaagcgtc

SEQ ID NO: 94962 - DNA, 30 bp, Homo sapiens
  chr6:159195237-159195267
  hypo
ggtggggcagtgcctcgagcagccctgggg

SEQ ID NO: 94963 - DNA, 30 bp, Homo sapiens
  chr6:159228054-159228084
  hypo
acataacaggccaggcgcagtggctcacgc

SEQ ID NO: 94964 - DNA, 265 bp, Homo sapiens
  chr6:159252784-159253049
  hypo
gcaggtgctaactggcgggtgggcagggatgacgcccataggaatgttgacaaactgggttttgtgaatctcccgaagctcagaactctgatggcatcgattcttggtggctcttcctcccttctcttccctttatcccaaggtctggccatcggatcctagaacttgcaactgagaagggggagacctggcttccatgtagaggacacacgatttcctcccctctgagggggctcgtgagggtgactgtcgggcctctcctgga

SEQ ID NO: 94965 - DNA, 39 bp, Homo sapiens
  chr6:159270065-159270104
  hypo
catgctggccaggcacggtggctcacacctgtaatccta

SEQ ID NO: 94966 - DNA, 36 bp, Homo sapiens
  chr6:159343088-159343124
  hypo
aaaagctgaaggaagcgacatcgtcgtacctggctt

SEQ ID NO: 94967 - DNA, 46 bp, Homo sapiens
  chr6:159456944-159456990
  hypo
tcctctgcacggactcggagacggtcctcagcgggaggagctcagg

SEQ ID NO: 94968 - DNA, 18 bp, Homo sapiens
  chr6:159537157-159537175
  hypo
agtctggctgctgggcgg

SEQ ID NO: 94969 - DNA, 49 bp, Homo sapiens
  chr6:159551945-159551994
  hypo
agtcccgaggacactcgcttccctgcagcccgtccgccctccataagcc

SEQ ID NO: 94970 - DNA, 164 bp, Homo sapiens
  chr6:159569246-159569410
  hypo
gggccattttaaacagcgaaatcaccaacaatgaccacaaaaattgtgaaaaccatagcggtaaagaaatagtgaaaaggacacttgtttacactgtcagagctgggacaagaaggcagggtgtcaccttgttagacttcagccgagaacgtgccagttgggtg

SEQ ID NO: 94971 - DNA, 177 bp, Homo sapiens
  chr6:159589910-159590087
  hyper
aactgggttccttttcgacccgcatcgtgcgcgccctagaaatgacagccagacggagcagggtctaaggacgctgaaaacccctgacgtgggcgcgccgggtgcgggtagggacgtggaaggactgggctagccacaggaactacagcgctgcggaccgggtgaggggtcccggcc

SEQ ID NO: 94972 - DNA, 608 bp, Homo sapiens; identical to SEQ ID NO: 2944
  chr6:159590154-159590762
  hyper

SEQ ID NO: 94973 - DNA, 306 bp, Homo sapiens
  chr6:159590971-159591277
  hyper
cgggaggctccagccgtctaagtgtcccgggagattcaggcacagcggggaaaaaaggaaaagaaaggcgactttcagcgtgcggactggggtaatgcctttctttgcccagaatttctcgggagcgtaggtggtcatcctactttctccgcgttcacctctcgcgaggcaggatgacgggcgcactcgggagaccggagggaggcagagcagggctgttctagaaggtcgtgggggaaaggctgcgagctgccgcagggcgtcgggtgcctctgcgctccagaggagaagcgctccagtgccagc

SEQ ID NO: 94974 - DNA, 30 bp, Homo sapiens
  chr6:159653218-159653248
  hypo
acccaagaccagaaacggaccctgaggccg

SEQ ID NO: 94975 - DNA, 106 bp, Homo sapiens; identical to SEQ ID NO: 30908
  chr6:159654897-159655003
  hyper

SEQ ID NO: 94976 - DNA, 30 bp, Homo sapiens
  chr6:159660826-159660856
  hypo
ccaacaaccacagtccgaaccactacgcgg

SEQ ID NO: 94977 - DNA, 30 bp, Homo sapiens
  chr6:159925862-159925892
  hypo
gttcctggtgcccaccgcggaatggacggg

SEQ ID NO: 94978 - DNA, 58 bp, Homo sapiens
  chr6:160248421-160248479
  hypo
cacaggactgcagctcgtgcctcaggctcaggctcagccccggcgcctcctggcggag

SEQ ID NO: 94979 - DNA, 30 bp, Homo sapiens; identical to SEQ ID NO: 30909
  chr6:160402852-160402882
  hyper

SEQ ID NO: 94980 - DNA, 61 bp, Homo sapiens
  chr6:160450704-160450765
  hypo
tgatcactaatgtggcgcacagtagcctgggttgcccatgcgaacgcgtttctgggcttgg

SEQ ID NO: 94981 - DNA, 30 bp, Homo sapiens
  chr6:160476041-160476071
  hypo
tagagttgaagatctcggtgatcagggaat

SEQ ID NO: 94982 - DNA, 666 bp, Homo sapiens
  chr6:1604877-1605543
  hyper
cggccaaggggcctccgggcttccacatcgtccctttttctgctgacgctcgcggggaagcggcgggaagcctgtgaggggcggcctgggagcagacggaccaccaggtcaccggcgcgcgctgccaggcgccgacccactcgcgaggaccagcggttcccggaggcgtcggccctcaggtcctcgggggaggccggctgcaccgagccgggtgtcggccttgtccctgtcctgagaggtgcaaacaccggccccggcccaggcccccggggctcctgcccagaaggctcagagctgggggccgaccgcgccttacccgcaggaggcccggcggtgcgtccgcgttggtgccactccccggccggggtgagggacgtcggaaggaaggtcccagggcgcagggttccgcgaagggagcactcggaaggaaggctggctgcggccccggcgcctgggtccgctgcggcgccgggccggagacctgggaacagccagccacctgcaaggttgcagcccacctcaccccgccggcggctccggggctgtctgtgggtctgtctcacggggcaaagcctttcttcccacacccacagccaaggcgcgtccgtgcaggggcacacgccttctgctccagccccaggaaggcgctttcgccctgcagtcctc

SEQ ID NO: 94983 - DNA, 310 bp, Homo sapiens
  chr6:160511899-160512209
  hypo
aaggagcaggtgctccgtgccctggtgctgagctcatcgccgagaaggagcaggtgctccgtgccctggtgctgagcgcatcgccgagaaggagcgggtgctctgtgccctggtgctgagcgcatcgctgagaaggagcgggtgctctgtgccctggtgctgagcgcatcgctgagaaggagcgggtgctctgtgccctggtgcggctgagaaggagcgggtgctccgtgccctggtgctgagcacatcgccgagaaggagcaggtgctccgtgccctggtgctgagcacatcgccgagaaggagcaggt

SEQ ID NO: 94984 - DNA, 494 bp, Homo sapiens
  chr6:160769301-160769795
  hyper
ggggggcaggaggagcggctgcggccggcacagcgccagggcgagtgaggcgggtggcgcgggggaggcggcggagtaaagagaggccgccggctgggtccgcgggtcactccgaggcgcgggctgcgggcggcgggcggcgggcgcaccatgccctccttcgacgaggcgctgcagcgggtgggcgagttcgggcgcttccagaggcgcgtgtttttgctgctgtgcctgacgggcgtcaccttcgccttcctcttcgtcggcgtggtcttcctgggcacgcagcccgaccactactggtgccgcgggccaagtgccgcggcgctggccgagcgctgcggctggagcccggaggaggagtggaaccgcacggcgcccgcctcccgcggcccagagccccccgagcgccgcggccgctgccagcgctacctcctggaggcggccaacgacagcgcctccgccactagcgctctcagctgcgcggacccactcgc

SEQ ID NO: 94985 - DNA, 108 bp, Homo sapiens
  chr6:160769827-160769935
  hyper
cgtgccgcggcggctggcgctacgcccaggcccactccaccatcgtcagcgaggtaagggcgccccggccctttggaagccggcgggagaggacgatgctggctccca

SEQ ID NO: 94986 - DNA, 61 bp, Homo sapiens
  chr6:160770239-160770300
  hyper
aattatggttaggtgcgcgatagggaacttcagtctctggggtgagcgacgttggcagttc

SEQ ID NO: 94987 - DNA, 48 bp, Homo sapiens
  chr6:1610816-1610864
  hyper
tgtactcgcaccctgcgcacgccgagcagtacccgggcggcatggccc

SEQ ID NO: 94988 - DNA, 933 bp, Homo sapiens
  chr6:1611198-1612131
  hyper
cttcaagaagaaggacgcggtgaaggacaaggaggagaaggacaggctgcacctcaaggagccgcccccgcccggccgccagcccccgcccgcgccgccggagcaggccgacggcaacgcgcccggtccgcagccgccgcccgtgcgcatccaggacatcaagaccgagaacggtacgtgcccctcgccgccccagcccctgtccccggccgccgccctgggcagcggcagcgccgccgcggtgcccaagatcgagagccccgacagcagcagcagcagcctgtccagcgggagcagccccccgggcagcctgccgtcggcgcggccgctcagcctggacggtgcggattccgcgccgccgccgcccgcgccctccgccccgccgccgcaccatagccagggcttcagcgtggacaacatcatgacgtcgctgcgggggtcgccgcagagcgcggccgcggagctcagctccggccttctggcctcggcggccgcgtcctcgcgcgcggggatcgcacccccgctggcgctcggcgcctactcgcccggccagagctccctctacagctccccctgcagccagacctccagcgcgggcagctcgggcggcggcggcggcggcgcgggggccgcggggggcgcgggcggcgccgggacctaccactgcaacctgcaagccatgagcctgtacgcggccggcgagcgcgggggccacttgcagggcgcgcccgggggcgcgggcggctcggccgtggacgaccccctgcccgactactctctgcctccggtcaccagcagcagctcgtcgtccctgagtcacggcggcggcggcggcggcggcgggggaggccaggaggccggccaccaccctgcggcccaccaaggccgcctcacctcgtggtacctgaaccaggcgggcggagacctgggcca

SEQ ID NO: 94989 - DNA, 39 bp, Homo sapiens
  chr6:161188236-161188275
  hyper
gcctcgtccacccctcgtccacccctccgcctcccgccc

SEQ ID NO: 94990 - DNA, 202 bp, Homo sapiens
  chr6:161188410-161188612
  hyper
cgaccctggattgctctccccattctcagcctcaccccccactccttccaccccatattttgccgcctcgaaggacatgaaccatctgctggctgaaggcgcttggacctgaaaccagcgacaggttttggcagctgcacgctcactcccagggaggcgagggcgcccggcgaagtgtggggtctgccgccccctgccggct

SEQ ID NO: 94991 - DNA, 42 bp, Homo sapiens
  chr6:161259532-161259574
  hypo
ttcattttgggaggccgaggcgggcggatcaccaggtcagga

SEQ ID NO: 94992 - DNA, 287 bp, Homo sapiens
  chr6:161351859-161352146
  hyper
gcgtggaagcagaagcgaacgtcacccaggccggcagggggcggcacaccccacacttcgctgcgcgccctcgcctccttgggagggagtgtccagctcccaaaacctgtcgtgggttttgtcccaagtgacttcagccagcagatggttcaagtcctgaggctgcaaaattcggggtggaaggagtggggcgtaaggctgagagtggggagagcaatccaggggcgccagggtgggagccgcagcgggcccgcggccgcccggaggacactgatgcttctggagct

SEQ ID NO: 94993 - DNA, 110 bp, Homo sapiens
  chr6:161352198-161352308
  hyper
cgcaggcacggggctggggcccggggcgggggcgcgggtgggcggacccctcccgcaagcccatgatggccaggccaaggccgctgggaaaggcaggacgctcgcccatg

SEQ ID NO: 94994 - DNA, 5 bp, Homo sapiens
  chr6:161352366-161352371
  hyper
cggtc

SEQ ID NO: 94995 - DNA, 30 bp, Homo sapiens
  chr6:16140263-16140293
  hypo
tgcctcctccttagtcgattcttaccttgc

SEQ ID NO: 94996 - DNA, 38 bp, Homo sapiens
  chr6:1614162-1614200
  hyper
cccctcccccagggtcgtaacctaatcgccgggaagat

SEQ ID NO: 94997 - DNA, 120 bp, Homo sapiens
  chr6:1614286-1614406
  hyper
cggcgctaggtcccggggctgcctccagcttcctcgggttacagcctctttcggggcgggggaaggggagggggtgacggtagagactccaccgccagtctccaggagtttggtgtgatc

SEQ ID NO: 94998 - DNA, 182 bp, Homo sapiens
  chr6:16148438-16148620
  hypo
tctgtcttttatattcgggataataaagactttaaagcaaacatggatgtgtgtattgtcatttaagccagttttatttcatttcaaagaaataagcaaggggtaacatcacagttagtatctactttcctcctaccgggaatttaattttttttttttaataatttcggtgctctacaaat

SEQ ID NO: 94999 - DNA, 30 bp, Homo sapiens
  chr6:161560023-161560053
  hypo
aggagaagccacaggcgcccccagaggaag

SEQ ID NO: 95000 - DNA, 121 bp, Homo sapiens
  chr6:161561655-161561776
  hypo
gcaggcgtgctcaagcggctgggagctgagctgagccaggacctggggggaacaaggagctgtggcaccaggatgcccgctggcccgtctaagggcaggtcctggccgtgaggaggggcca

SEQ ID NO: 95001 - DNA, 30 bp, Homo sapiens
  chr6:161575883-161575913
  hypo
tgaatccgatttttccgagacagctcaact

SEQ ID NO: 95002 - DNA, 30 bp, Homo sapiens
  chr6:161585055-161585085
  hypo
aatcaaggggaggtgcggtccctatgctgc

SEQ ID NO: 95003 - DNA, 188 bp, Homo sapiens
  chr6:161602138-161602326
  hypo
gtgaaactactagcacggaataaacagaaaggtgcctcccagctctagcccaagagttcttgctgcaggtgttaagtgggccccagcaacgctgtgaaggggaacagtattcagcagcccaatgcgtctcttgtgtcctggtactcaacacagtctgggattgctgagggaggcgggctgcctgctgc

SEQ ID NO: 95004 - DNA, 167 bp, Homo sapiens
  chr6:161609747-161609914
  hypo
ccatggtaacaagcacggccgtgcctctgggagggcagcttggggaggaactgaacagggcacctctgggttgagcagccagcggccgtcgaatggggcttccgtaaacatcattccctagaatcccgagagccacctggtgagatcggcatcgctatctcatttca

SEQ ID NO: 95005 - DNA, 163 bp, Homo sapiens
  chr6:161619824-161619987
  hypo
gaaactgacctggaacgtatatgttgtttcgagtaaagacaaaattacatagcttattaaggggtaaatatcttgtttatatgatccacgattctatattttaaactccagaaactcctcaaatatatgtcagaattactgctgatatcgattccttttttga

SEQ ID NO: 95006 - DNA, 186 bp, Homo sapiens
  chr6:161643685-161643871
  hypo
aatcttgaagtaaaccgatggtcacaattattgaaatttctgagggatggatacttggagcccatctagtgagagggtcaatggctgcaagttgctgctaggcgctactgtatgcctgcctgctctcctgcaggtgtctgtggatgcttcctctggcctcattcatttgcacggtggcctcacgac

SEQ ID NO: 95007 - DNA, 30 bp, Homo sapiens
  chr6:161656491-161656521
  hypo
caaatgtgtgacatacgtcttaagttcatt

SEQ ID NO: 95008 - DNA, 63 bp, Homo sapiens; identical to SEQ ID NO: 40939
  chr6:161672733-161672796
  hypo

SEQ ID NO: 95009 - DNA, 175 bp, Homo sapiens
  chr6:161685567-161685742
  hypo
aggtggtccccctggcgtgcccgcgcatccctgccctgcaagtcttatccactgcgtgggaacccctcgctgaggcttccgtcttgccctctgggcagcaggctcctcaaaggcacttgcagggtcggctccctctttgtattcctgcgggctgaatgcacgggctccctaagaa

SEQ ID NO: 95010 - DNA, 101 bp, Homo sapiens
  chr6:161690505-161690606
  hypo
tattagaagtgataccgccagggcaggcgcggtggctcacgcctgcagtcccagctgctgggggaggggggctgaggcaggaggatgcttgagcttaggag

SEQ ID NO: 95011 - DNA, 23 bp, Homo sapiens
  chr6:161726250-161726273
  hypo
aaaaccagctgaggccgggcgcg

SEQ ID NO: 95012 - DNA, 63 bp, Homo sapiens
  chr6:161766949-161767012
  hypo
tcaagcaggtcttcccggacaatactccctgcttttttttttttttttcggcatgttatttaa

SEQ ID NO: 95013 - DNA, 79 bp, Homo sapiens; identical to SEQ ID NO: 40942
  chr6:161780140-161780219
  hypo

SEQ ID NO: 95014 - DNA, 25 bp, Homo sapiens
  chr6:161795264-161795289
  hypo
tgtgttgtgtatatgcgtatgctgt

SEQ ID NO: 95015 - DNA, 24 bp, Homo sapiens
  chr6:161795349-161795373
  hypo
tgtgtgtaacgcatggtgtgcatg

SEQ ID NO: 95016 - DNA, 266 bp, Homo sapiens
  chr6:16197009-16197275
  hypo
agtagaaaacaaaagcgggctgaaccaagccgaggccgctccacagagaaagcatttagaccacccctagccaaagggaaatcagaatcgcccatcccagcagttcagaattgagttctgatgtgtccggaattgatgggttgtctcactgacttcaaggaaaaagccgcagatctccgtggtgggtgctaaaattcttaaaggtggtgtgtctggagtatgttccttttcatgttcagacgtgtgcagtttacgggggtggggag

SEQ ID NO: 95017 - DNA, 25 bp, Homo sapiens
  chr6:16197335-16197360
  hypo
cctaaggtggcgcagctggagttgt

SEQ ID NO: 95018 - DNA, 83 bp, Homo sapiens
  chr6:1619887-1619970
  hyper
gccccggtgcagccccgcgttccccgcgcccggcgctgccggggaaaagtggcacaacaggaaagcctcgccagagggccctt

SEQ ID NO: 95019 - DNA, 36 bp, Homo sapiens; identical to SEQ ID NO: 40945
  chr6:161989335-161989371
  hypo

SEQ ID NO: 95020 - DNA, 39 bp, Homo sapiens
  chr6:162084991-162085030
  hypo
tcaaaacagtgctcccgggagctccgctaatgcagcttc

SEQ ID NO: 95021 - DNA, 30 bp, Homo sapiens
  chr6:162135996-162136026
  hypo
gatgccatatttgaacggtattcttaccat

SEQ ID NO: 95022 - DNA, 151 bp, Homo sapiens; identical to SEQ ID NO: 40755
  chr6:16218420-16218571
  hypo

SEQ ID NO: 95023 - DNA, 40 bp, Homo sapiens
  chr6:162222104-162222144
  hypo
ccatagagaaggacacgggaggaaacggaggcctagggcg

SEQ ID NO: 95024 - DNA, 30 bp, Homo sapiens
  chr6:162226297-162226327
  hypo
ttcttcatgtttactcgatgcttatttcca

SEQ ID NO: 95025 - DNA, 17 bp, Homo sapiens
  chr6:162253379-162253396
  hypo
gtggggtggctctcacg

SEQ ID NO: 95026 - DNA, 17 bp, Homo sapiens
  chr6:162253696-162253713
  hypo
cgcggaactgtaataca

SEQ ID NO: 95027 - DNA, 177 bp, Homo sapiens
  chr6:162257854-162258031
  hypo
ggccttcactgctcccgagcacaagccgtaaaatgacgggagctgtgtgaggtgccaaggtctcaaatgaatgcgggcagcagcacctgtgaagctgataaaacatcagtttgcatttggctcaccttgcaagagggggttttatgcctctcgttttcgctccgctcccacactcct

SEQ ID NO: 95028 - DNA, 30 bp, Homo sapiens; identical to SEQ ID NO: 40947
  chr6:162280335-162280365
  hypo

SEQ ID NO: 95029 - DNA, 145 bp, Homo sapiens; identical to SEQ ID NO: 40756
  chr6:16249815-16249960
  hypo

SEQ ID NO: 95030 - DNA, 33 bp, Homo sapiens
  chr6:1625026-1625059
  hyper
ctcttctccccaaggcgtcccttgggctcttaa

SEQ ID NO: 95031 - DNA, 572 bp, Homo sapiens
  chr6:1625119-1625691
  hyper
gagaactgtttggaattgctgcacttctctggctaggagggaagtgagtaaatcaccaggcgcccctcccagctgcccgtgtccctgcgccgctcagctcctgccgcagggctggccgcgccaagcgcgcgtcctacccaaagccaccagccccgcggggaagggactcgggctgtggggcgcgaggccccaggactcggggacccctctacctcggcggcagcgtgcgaccctctttctaacgcggccgtggatgtttcttcccgggccgcagccaagcgcggttcttcctgggcggtggctttgggcttttcgtacccacagtcaagtcagttcacgtcgcctcccgcacacacgcgttcataaaacgaaactggagtttcacgaagcaattcttaggcttagcgtccaggaacgctgtagacggtctattctattctacccctattctactcggttcgattctgttcctaagaaaatgccgatctcgacccacttgtacttccacgagcggagctgcagccagcagctctgcaggaccccgcactgcccgccaccgtcccctctggcag

SEQ ID NO: 95032 - DNA, 181 bp, Homo sapiens
  chr6:162863312-162863493
  hypo
ccaggagcccccctgcgcggagcagtgatacccacacagctgtaaacctgagtgcaattaattgatgctggttaagaaaaggggaacatacatctgcagggtccttcacagtcacagggaccattcccagaaagcgtttcgtctttcttgcattcacaaagaatagcgtcaacaaatgttg

SEQ ID NO: 95033 - DNA, 42 bp, Homo sapiens
  chr6:16288325-16288367
  hypo
agccctcacagccctcgcttgctgtccacgcctcctctgcct

SEQ ID NO: 95034 - DNA, 23 bp, Homo sapiens
  chr6:162921490-162921513
  hypo
actgcgcccggcccaaacagcca

SEQ ID NO: 95035 - DNA, 192 bp, Homo sapiens
  chr6:16293373-16293565
  hypo
attatttcattctcacgctgtgcccgggaggcaaagtaccttcattttacggatgagcagacttaagcatcagcaaaaaaggaatttgtaaaaggcgacaccaccacttagcagagaagcaacagtgagaatctagaaatttccaagaagccccaggaaggccatggaaatatcttacgaaaatgaaatgtc

SEQ ID NO: 95036 - DNA, 40 bp, Homo sapiens
  chr6:16295428-16295468
  hypo
aagcagcgtctggctcgagtggaagcgtccaaacctgctt

SEQ ID NO: 95037 - DNA, 30 bp, Homo sapiens
  chr6:163521407-163521437
  hypo
ctttccattctgcaccgcagggaaggccca

SEQ ID NO: 95038 - DNA, 154 bp, Homo sapiens
  chr6:16356093-16356247
  hypo
ccctcacccacccttttgatgggcaacttgagctgccctctcctgcttattcctgtaactgcaaacacgtcttgctccaaccaccacttcttaaaactgcagatgaagggctgactctgggcatgccattggttgggctcgttccttccccgcg

SEQ ID NO: 95039 - DNA, 180 bp, Homo sapiens
  chr6:16359260-16359440
  hypo
cgccccaggaaggaccctccccatctctgcatgctcagatgtgtctgcgcccactgcctggcctctctccgttccaggcacccactcagatctcagagctgggttggggccaagccccggggccatgaatggcagcaggaggaagacagggtccggggcagaaaagaggggagtccccaa

SEQ ID NO: 95040 - DNA, 38 bp, Homo sapiens
  chr6:163616660-163616698
  hypo
ccccagggctccctgcgcctcggcggctgaggaggtgg

SEQ ID NO: 95041 - DNA, 95 bp, Homo sapiens
  chr6:163661684-163661779
  hypo
ggatttgggcacatacgcggtggggcctcttcagctgtagagtcattaaccctaaactccttgttcatggaatcaacagccgactgtgccgtcct

SEQ ID NO: 95042 - DNA, 39 bp, Homo sapiens
  chr6:163673393-163673432
  hypo
tgagcagcaggggggcgacatcatcggggaaacaaatca

SEQ ID NO: 95043 - DNA, 30 bp, Homo sapiens; identical to SEQ ID NO: 40708
  chr6:1637278-1637308
  hypo

SEQ ID NO: 95044 - DNA, 118 bp, Homo sapiens
  chr6:163834265-163834383
  hyper
aagacctcttgcctccgtattctttcttcatctgtaaaaatgttgacttctgcttttcagactacgcgcacagcctctttatttcctactgcggcttcattccctcacggaacactga

SEQ ID NO: 95045 - DNA, 128 bp, Homo sapiens; identical to SEQ ID NO: 30916
  chr6:163834405-163834533
  hyper

SEQ ID NO: 95046 - DNA, 119 bp, Homo sapiens; identical to SEQ ID NO: 30917
  chr6:163834710-163834829
  hyper

SEQ ID NO: 95047 - DNA, 48 bp, Homo sapiens
  chr6:163835083-163835131
  hyper
cgctctggagccccacggctacgtgtcgggccacgtgatgcccacccc

SEQ ID NO: 95048 - DNA, 109 bp, Homo sapiens
  chr6:163835797-163835906
  hyper
cccagagagaccccccgagcccgcggcacaggcggcggcggcgctgagcgggctcgaccagccgagcgagcggcggccccggctcctcctcgtccggcgccagcagccc

SEQ ID NO: 95049 - DNA, 1034 bp, Homo sapiens
  chr6:163836197-163837231
  hyper
gggcggagtgagctgcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaaggtgagcgtctccagggccccggccccggcccgacccccgccggggcggcccctttccccgcttgggatggtggggagggcgggaaggtcacggccgggcgggaccgagcgccggggggactgggaggccaggagggcgcacaaaggaggtgccgggccgggcttgcggcgggcgggcgggccggggtggacccgccggtgccggacgccccctgcccggccgggaccccgcgccgctggcgtccaagttggcgcgttgcggagggctgcggggtgagccctgcggcccctctagcttcggcggtcacatttccgagaggtcggcgggggctgcgcggactcggtggtcctcgccgagccctcccgagagcaggcccacgccgcgccgccggcctggaggacgcgtgtgcccggcgcgggccccgctcctccgctcggcctcccgagcctgctctgcgcggacccccaccgccccgcgttcgggagctctcccctcccgtgaggactaaagcggggtttcgtggttggggagttggtgcagctgttcaatactaagtggaagtcagtgtggggctcgttagtttaaagaaattccgtaggagaccgaaattatgctggcgtagccgacaaggaggactaagtgacggcgaaaagcacttttttcccttttgtttggggaagcgagaactgttagggagttgaacttcacttttcgggggtggggggggggggggtggagtgcgaaataacgcgatgacagatcggagcgcagcctgagttagaagaacttgggcggagggtttgctcccggggacgcagccgcctgagtttgtaggacagggtttcgagacgtttggaaagggcg

SEQ ID NO: 95050 - DNA, 311 bp, Homo sapiens
  chr6:163837469-163837780
  hyper
gcttagaggcaccaccggaggactgtgtaaaggaaactgaaaactacaggttgaagagatgaacaatggagtttagatttttcgcaagaatttcgagattttaaaaatagagtcggggaacaggagtttgaagcttggggagttggaatgtcactagagaacaaaaggccggaaatgtttccatgataaaaaatggttaaagaaaaatcccaggagttctgttgtcttgaaagtcatagaaacaacttaaaagtagaaaatggttaggtgttacggctttctcgtcgttttgcttccgtatgttaaacata

SEQ ID NO: 95051 - DNA, 30 bp, Homo sapiens; identical to SEQ ID NO: 40949
  chr6:163915349-163915379
  hypo

SEQ ID NO: 95052 - DNA, 35 bp, Homo sapiens
  chr6:163923060-163923095
  hypo
attttatattcttgccgggcatggtgcctcacacc

SEQ ID NO: 95053 - DNA, 140 bp, Homo sapiens
  chr6:163945790-163945930
  hypo
gcccggccttctgtttattttctacgatcatctattctagattctagcctgtccataccatatttacattatggtaatattaatttcagagctcttaaatgacgggtactcgtccatgtgctatccgaacactaacattt

SEQ ID NO: 95054 - DNA, 158 bp, Homo sapiens
  chr6:163946670-163946828
  hypo
acaggcgtgagccaccacgcccggccatcttgtttctttttattgttttcaatgaaataattgtaatcttgattatgttgacttttaagtattgtatttagcctttcttcttaataggtagttgtcaggtcgtcaaaggcagacgagtgtcatctgaa

SEQ ID NO: 95055 - DNA, 30 bp, Homo sapiens
  chr6:163979710-163979740
  hypo
gtgagccaccacacccggccagtgaaccct

SEQ ID NO: 95056 - DNA, 23 bp, Homo sapiens
  chr6:164012441-164012464
  hypo
tttttgagttgcagccgaagtct

SEQ ID NO: 95057 - DNA, 150 bp, Homo sapiens
  chr6:164047494-164047644
  hypo
aggaataatcttgttcgtgtcttgatccatactgtcacaaaatggccttgtcggtaaatgtgtgatgtgacatcttgtgaaattgttcagcaagagaacaccaaagctcaccaggccagctcacagcggcaccagcgcctggaagacagg

SEQ ID NO: 95058 - DNA, 32 bp, Homo sapiens
  chr6:164057505-164057537
  hypo
acatttagtcttgaccgcggtcagtcctgcat

SEQ ID NO: 95059 - DNA, 138 bp, Homo sapiens
  chr6:164064007-164064145
  hypo
aatggtgagtgggctcgggaaaaactccgctggtctgtcaatttccaggtggagaatttgcaatgacttttctggctgactcagctgatcaaagtaggtccacgttgttttcctttttttttttttctgagacggagt

SEQ ID NO: 95060 - DNA, 22 bp, Homo sapiens
  chr6:164114295-164114317
  hypo
ttatttttttgagaccgagtct

SEQ ID NO: 95061 - DNA, 50 bp, Homo sapiens
  chr6:164118784-164118834
  hypo
ccctcatgaaattagcgattcagtatatacatagtcgtaagaggatgaaa

SEQ ID NO: 95062 - DNA, 30 bp, Homo sapiens; identical to SEQ ID NO: 40955
  chr6:164121841-164121871
  hypo

SEQ ID NO: 95063 - DNA, 30 bp, Homo sapiens
  chr6:164136197-164136227
  hypo
gtgctacaatattggcgtgagggacccttg

SEQ ID NO: 95064 - DNA, 71 bp, Homo sapiens
  chr6:164143599-164143670
  hypo
gccaggaagctataacgctgctctccaggcagaagctgctagcaatggtgctgacacggcccaactaccca

SEQ ID NO: 95065 - DNA, 160 bp, Homo sapiens
  chr6:164145352-164145512
  hypo
acggagtcaccccagcgtgggtgtgggcagcacgcataggaagaggagtggcaccgccccccggggcctggaaagggagtgcacatgctgagagtgcccctgcctggaggggatggggtcttcttccagagtttatgggcgcagtcggagctgcccaccc

SEQ ID NO: 95066 - DNA, 400 bp, Homo sapiens
  chr6:164149947-164150347
  hypo
ctcccactggcatctcgtgtgtagaagccagggaagccgctaacatcgtgcaatgcacagcacggcccctaccacagattccagccccaagcggcagtagcgctgctgctgagaaaccccgctctagacttttctttacaagaggcaggaaaagatctgtttgtgggttaaagaattccttggactcagaaaagtccccgatgcacccagggtttgtattgagatcaggtttgaccagacagaaatgagacctggcggcacggcgtgtgcagggcacgggagaagctggactgacttccatgagtaggaggtgaaagagcccgtcactgcacgagtagctggtcaccactagggccaacaccagctctcagggacagcacctgcacgcttgtaatgtgag

SEQ ID NO: 95067 - DNA, 30 bp, Homo sapiens
  chr6:164164781-164164811
  hypo
atctgaatctggctacgtcatcctcaggaa

SEQ ID NO: 95068 - DNA, 92 bp, Homo sapiens; identical to SEQ ID NO: 40959
  chr6:164165801-164165893
  hypo

SEQ ID NO: 95069 - DNA, 38 bp, Homo sapiens
  chr6:164170286-164170324
  hypo
tagaaccagagatctcgcaggtacgaggggaacagatg

SEQ ID NO: 95070 - DNA, 59 bp, Homo sapiens
  chr6:164173782-164173841
  hypo
tcagaggtagaggaacggggctgccagtgaagagagagagagaccgaaaacttaggcag

SEQ ID NO: 95071 - DNA, 155 bp, Homo sapiens
  chr6:164179641-164179796
  hypo
tcgttactgccgcgtgcatcttattgccttctagctccgctccccatatgcgtgcttttattttttatgctccacatagagcaatctctttaaaatatactctggattatcttgacccactgtttacaatcgtgtatgtacgggcttccctaggt

SEQ ID NO: 95072 - DNA, 83 bp, Homo sapiens
  chr6:164182839-164182922
  hypo
agatgctggaagaatcggtttcctttgcggatgctctcctaggtctttttttttttggaatcttgctattcgcctgcctcagg

SEQ ID NO: 95073 - DNA, 85 bp, Homo sapiens
  chr6:164183688-164183773
  hypo
tctcaaaaataaaataaaataaaataaaaaataaaaaagaagctcaatgtttttaatgcaacagaccctgcggaaggtcagtaac

SEQ ID NO: 95074 - DNA, 22 bp, Homo sapiens
  chr6:164196996-164197018
  hypo
ctaaaagcgtcttctgacaaac

SEQ ID NO: 95075 - DNA, 207 bp, Homo sapiens
  chr6:164209872-164210079
  hypo
ttctcgaggttggtgcggcctgaaaaagcaagagttcccttggagtagtcccgagtatgggtctggagttccttgtggaggtgatgcttgaattcagtttcttctgcttgctcccacaatgccccatccatacctatcccttactaaactcacacttggtggcccaggatctcaaagtgtacttccttcctgcgctcacctgccacc

SEQ ID NO: 95076 - DNA, 133 bp, Homo sapiens; identical to SEQ ID NO: 40964
  chr6:164228294-164228427
  hypo

SEQ ID NO: 95077 - DNA, 195 bp, Homo sapiens
  chr6:164228682-164228877
  hypo
tggcagagaagggtccgcccgaggctctggccccagggaacccctcggttcttctccaacattttgctgagggaaggctgctcttgtgttgaacctaccgagggagagttcctaggtttgcatggcaagaaatgtgaagatatttttaagacaaattcacccctgcacaccaccggctttcgagtcacagaccct

SEQ ID NO: 95078 - DNA, 176 bp, Homo sapiens
  chr6:164241293-164241469
  hypo
gactgccgtgctccacgatacctcccacggatgcgtttctggcctgatgcttggcgctctggcagtctgtgtcattcaccgctctgcctctgccgcctggagacgtgccgggcacgtaccgggtccttggtaactgcggaattcgctaatgaatgggtggacgaattcccctcata

SEQ ID NO: 95079 - DNA, 30 bp, Homo sapiens; identical to SEQ ID NO: 40967
  chr6:164243378-164243408
  hypo

SEQ ID NO: 95080 - DNA, 51 bp, Homo sapiens
  chr6:164245443-164245494
  hypo
cagccaccgggaaagcggtggttaacgttggctccacgcccttgttcctgc

SEQ ID NO: 95081 - DNA, 21 bp, Homo sapiens
  chr6:164246122-164246143
  hypo
ccgggccgatatggaatttct

SEQ ID NO: 95082 - DNA, 123 bp, Homo sapiens
  chr6:164255972-164256095
  hypo
ggaacagcacagaagcgcaaccttcctcctcgtcctggtaatactcggagtctggcggataagccgtcacagggctggaccacacgtccggggaatacctggtctgatcggaggcagtgcagc

SEQ ID NO: 95083 - DNA, 68 bp, Homo sapiens; identical to SEQ ID NO: 40969
  chr6:164283216-164283284
  hypo

SEQ ID NO: 95084 - DNA, 21 bp, Homo sapiens
  chr6:164284046-164284067
  hypo
gaagagaaccagaaccgatgc

SEQ ID NO: 95085 - DNA, 38 bp, Homo sapiens
  chr6:164284509-164284547
  hypo
ttacaggcatgagccactatgcccggctgaggatgtat

SEQ ID NO: 95086 - DNA, 171 bp, Homo sapiens
  chr6:164288079-164288250
  hypo
aacttatgaacaagccggggcagctgctgtgcctgtgcagccagaggatcacccagaacatgttcaccagccatgctgcttcccacctgcttatgaagaatcccggaggacccccgtgaagggagcctcccctgtttgctgtctcacctctcaatccgccgctccgactta

SEQ ID NO: 95087 - DNA, 76 bp, Homo sapiens
  chr6:164314367-164314443
  hypo
ggtcaggttgcggcccgactggcctgacagtcaacgaggtggaaaccgtgacaaattcagacgccagggctttatc

SEQ ID NO: 95088 - DNA, 461 bp, Homo sapiens
  chr6:164322314-164322775
  hypo
gcccaggctgggtcacgctacggaggagaagattttggaaagaagtagaagtcctcacgggcaactccctgccatccacaccaacctccccttcttgttctctccttctcatcttaaactttcgagaggaagaagggttggtcaagggtgaacgttcctgggcatggtgagaggctgctctgtggtgcccactcacactgagagggaccagctggggacgcctgatggtgccactgaggctttggggtcccctttcagaggggggcatcttaacgcgagtcttacggtctttcctgggttcccatgctcggcggcggctcctccacaggcctgtcttccctttgttctggagaatgttctgcctgggcggagcattcggtgcggttacgtgggtgcggttctccagggagagcgcgggggtctcttcagggtaatgccaacctcaccgccaaatgcagcta

SEQ ID NO: 95089 - DNA, 86 bp, Homo sapiens; identical to SEQ ID NO: 40973
  chr6:164323845-164323931
  hypo

SEQ ID NO: 95090 - DNA, 33 bp, Homo sapiens
  chr6:164329998-164330031
  hypo
ctgcgcccggccaatgctcgatatatcttataa

SEQ ID NO: 95091 - DNA, 108 bp, Homo sapiens; identical to SEQ ID NO: 40974
  chr6:164334224-164334332
  hypo

SEQ ID NO: 95092 - DNA, 30 bp, Homo sapiens
  chr6:164340153-164340183
  hypo
ttgcacctcactctccggggtaaagcctgg

SEQ ID NO: 95093 - DNA, 30 bp, Homo sapiens
  chr6:164344488-164344518
  hypo
gcctgccatggctggcgttaataagaacgc

SEQ ID NO: 95094 - DNA, 181 bp, Homo sapiens
  chr6:164384580-164384761
  hypo
tgtcagcatgtgaaccgtcttcccacccagctcgggctctgtctcttcattcaggggtggctttagtttaccgggagataagtgggggagcgatgtgagaggaattcaggagagaggacaattccagctaaaaacaaacctcaagtgacagttgtgtaaacgcgctcgcaaagtaacattc

SEQ ID NO: 95095 - DNA, 65 bp, Homo sapiens
  chr6:164410701-164410766
  hypo
aaagcgaaccttgcccggggttcatgggcccagaacaaaatccatgcactcggatgtgacaagtg

SEQ ID NO: 95096 - DNA, 30 bp, Homo sapiens
  chr6:164441343-164441373
  hypo
acctgaagtgtattgcgaatatgagggctc

SEQ ID NO: 95097 - DNA, 41 bp, Homo sapiens
  chr6:16444348-16444389
  hypo
aaaaaaaaaaaaaaagtacacacaatcgatctatatctata

SEQ ID NO: 95098 - DNA, 184 bp, Homo sapiens
  chr6:164500295-164500479
  hypo
gtcagaggagagagacggggtactgggtggaagagctcaggtggcagcaccacctaagaaagtcttagcggggcatgggcgcacccccgagccaaggtccagcagtagaggatacctgtgcttggcagaagtgacctggtcccagtgcccagctgtgctcattcagtgccggggacagcccagg

SEQ ID NO: 95099 - DNA, 60 bp, Homo sapiens
  chr6:164565819-164565879
  hypo
tcgaggtcacttcaacgctctgcctgttaccctcttctcccagcccgctcaggagggcag

SEQ ID NO: 95100 - DNA, 49 bp, Homo sapiens
  chr6:164637238-164637287
  hypo
gcaagtgtagtgagccgacaagggaagcaggtgccgtaagtaatagatg

SEQ ID NO: 95101 - DNA, 30 bp, Homo sapiens
  chr6:165416380-165416410
  hypo
ggtacatgctatccacgtgactcatcactg

SEQ ID NO: 95102 - DNA, 61 bp, Homo sapiens
  chr6:165731354-165731415
  hypo
gaaagagaacaccagcgtggacggtggacggggactcctgcctcagcgatggtgctgcgct

SEQ ID NO: 95103 - DNA, 30 bp, Homo sapiens
  chr6:165746822-165746852
  hypo
gcaccttggtccatccgctctggaccgcga

SEQ ID NO: 95104 - DNA, 46 bp, Homo sapiens
  chr6:1658547-1658593
  hypo
tgaagctgcaatttgcgaagtcgcattttcccgaaggctttcccac

SEQ ID NO: 95105 - DNA, 198 bp, Homo sapiens
  chr6:166050958-166051156
  hypo
acacacacaagactgcggaaaatttttcacatttggcatggaaaaagagaaagactacacatgcagtcaaaattcattccatacattctggagaacgtcctgtgtgtcgggcagcataacagggtcacaaaaacaaaaccccactttgtttccaggcatcatgttaagtggcaaaaggttctgcgtcaatagtgcaag

SEQ ID NO: 95106 - DNA, 1115 bp, Homo sapiens
  chr6:166074010-166075125
  hyper
cggggttgcaaggagcggccgatcccggcgcgaatacgctcgccagcccgggggctgcaccccaaaggtgcctgagcgggcggtgagcccggagcagcttcggccgcagggaggggctcaacctcgggtgccctggagacccgggtcggccaaagcctgggaatgagccgcagttgggagcgggaaaccgaaacagcaatcctggaagagcgtcggcccagagaaggcgccgcggaaacgcggctcctgagcgaggcgcagacaaaggctcgggtgcacacgcggtggacggtggctccggagccgcgctctgggccgcgggaagccgcacccgccccgactggcgccggagtcgggcgggggcccatgggcgcgacctcctgcacccggaggtgctcctacccggccccgccgcggtcttcccgtcctcaccctgctccccctccatccgcgaccgcgacgcccccctcctctgcgcaccgggcgcctcctctttcctcactgtctcccgcctgcctgcttccttctagcgaacccctgccttgacttttctgctcaatcttgtcccccacccccgtgacatgcctttctgccacctctgcctcagcgcgctctcggccccgcgcccgcgggtggcgaggaggagtggccacgccacagtgggcccgggggcgcatcctgcgagtcggaggcggcggcgcctttctcttccaccctagcgacctattgtccttcccttttctctaccaccccggaccccagagaagcccgggaccaacaggacgcggcccggggtgggggtgcgtcccctgggtggaggtgcaaccgtttccaccccgccagtccatgctctggatgccggtcactgcgcggggtgggaggccgggcgcccactccgagtcctggagaacggcggtgccatcacagttggaagcgcggggttctgaggccctggcctccctcaccccggctacagggacccggtgggctggacccccaagtggaaggaagcgcatctgctccagccaagtggccacaggctcaagagggaggaacctaagtggtcacaaagttgagtataaatacgcgccggacaagtgtggccagaaacggca

SEQ ID NO: 95107 - DNA, 266 bp, Homo sapiens
  chr6:166075258-166075524
  hyper
cgctccgccaggggcaccggctcctgcccctccagagaagccccctgggcgctccacgcccgggcacgggcacctcgctcgacacccgcttcccacccagcaggccaagccccccacctgcccccaggggatgaggagccgccccacctccggggaacggggagcaggccacttactggggctcaggaagcactcggtcagccttcggaagcagctcgcattattagaaggtccatcttccatgtcggagccgaagagcagcgcgg

SEQ ID NO: 95108 - DNA, 964 bp, Homo sapiens
  chr6:166076095-166077059
  hyper
gggcgggcgcgggggcgcggcgcgctccgcccggccacggccaggccactcgggggccgggcccgggcccgccgcgctccccccgccggccgcgctgagccggggttccgggcggagtttgccggggccgcagcccggctcgtccccggccgctggcaggggaccctgggggcggggagcaagaggctcctcgaggctggccatggttcctccccgggccgcggaggggcaggccgcgggcgggaggggcgcggcgggccggggctcggtgggctccgcccccgcaggacctgcccacccctgccggccgcccgaaccgctgcctggtcctcctctccggtcttcggcttccctcccagtctagtcttcacattgtgctcggcttgggttgcgggaggacccgggcctgggggccaggccccggcgacggcgcctggctaccctcaggcgcgcacaatcggcgtcctcccgggccggggctagggacggcggagaccctccctgcaggcgtggcgtggtgtgtgcgcgctccggcggctgagcctcggcggcttctcgaaagcagcggagaaaagcgccgcagtgccgctgcccgtggaggcggtggtggcggcggcggcagaagacgcccactggcggagcaggcgctccccacgccgccgccgccgccgccgccttccgcgcccacgtagcgcgccccgcgggactcggcccctgcgccaggctcccgcacccgagtgatcctctgtgcgccgcctgcacccggggccggggcgggcggacagagcaaccgctgcgtctctgccctgccttgtcacatctgggtccggtgtttcggattctaaatcctgagtcctgcagctgctccagctgtgcgctgctgggcgagccacgtcggcctgcccgttgcccgagccagggaatcctcctggtagcgggccagcagctccgacccagctgtgct

SEQ ID NO: 95109 - DNA, 298 bp, Homo sapiens; identical to SEQ ID NO: 30925
  chr6:166077335-166077633
  hyper

SEQ ID NO: 95110 - DNA, 768 bp, Homo sapiens
  chr6:166077668-166078436
  hyper
cgctacagtgcagcaactgggttgacccagggccctgggctcccggtgtgccccgggtcccggggccatttctcgccctccacgttttcttctttctatccagtttcacatgtttattttgaagcgtgctccagattcctcactagtcgatgctttccccgactcccatccaaactccccccaatggaaaataacacttttgtatttgcaccaagctgagcagttgggatgcaaaggacatgctggggctcccctcccccagtaaagtccacagacgtctccgcgattgccgggcagattctgagtgtcgcgtgtaacgggcatcagacttggcactcactaggtcagaatccctacatttgtggaagaagaaaatgattcctgtgactcttaccttaggggcgctgcccttgtttctgaattttttcggcaaagaaaaaaactgcaatggttgagccaggctgccggcagcctcccggcttgacgcttctccagccgtgcagagtccactccggttactttgctgcgagtccggagtttgtgctttcgcgactggaccaggcagcaagggtctgagggctgcccacacatttagggaagtcgagtttctcctcaagtgtttattgtttattcctttacacgcaaaattgtttctccttgtcatttaagtttctttatttgcattttggagttactaaatctatttttcagttccaagaaaatatacatttaacttgcccataagcccccttgcgggcgcaggagaca

SEQ ID NO: 95111 - DNA, 33 bp, Homo sapiens
  chr6:166122198-166122231
  hypo
tctacccccatgctgcggcgctctgcccccact

SEQ ID NO: 95112 - DNA, 47 bp, Homo sapiens
  chr6:166128567-166128614
  hypo
gcagggacggccgcccgagaacccccgagggacgctgcagtgcagca

SEQ ID NO: 95113 - DNA, 185 bp, Homo sapiens
  chr6:166217994-166218179
  hyper
atcaaatgtttggcgcgaaccacagaaacgaggccaggaagaagaggtcgtggtgaagtggctgcaggttagtttcctccgagcagccaaggagcgccggagtttggaaacctggggccctggaaacccgggggccttggcctgcaggcggggctggtgggatcagagcgcgtggtcgcgaaggg

SEQ ID NO: 95114 - DNA, 274 bp, Homo sapiens
  chr6:166218546-166218820
  hyper
tggagggacatggggcgtacggaggggcagcggggcctggggtcgagcagaggggcgcatggaggggagcatggagggacgtggggcgcgcggaggggcggcggggcgtgggacgcgcggttcttcctcgcgaagttggagaggcctcgggtcgcagggcacccactgtgcgccctggacgaagcctaccctggaggcagcggctccgagggacgccggaaggaacggccgctttcctcagggtccccgcctgcacctgcgggctggcagatcc

SEQ ID NO: 95115 - DNA, 398 bp, Homo sapiens
  chr6:166267494-166267892
  hyper
gtgggaagccaaggccgtgatgcggggcgtggtggtgagcaggctgcgctggacccagacagacgcgcggggtcctagggaagagcccaggcagggggaagcccgtgggcggtgagaccctcccgtgccacgggcgcagcgcagcgctggctggggccgacggggcgcaccggcggacggtgatgaacccggagacccggcagccaggctgggctgcagcagcctttgcctggacgtcagggtggagcccgggaatcgcccctgcgccgggtgacggaggagaaaggggcccgcaggaggcaggagggagcgcctggcacagggacccagggactcgagcaggtggtccctggggaacggggagtgaggccggaaggagagaaagccaagaccaggtg

SEQ ID NO: 95116 - DNA, 61 bp, Homo sapiens
  chr6:166298461-166298522
  hyper
ttaattactgaattccgcctagactgcggtgcggccttcatgtgcacgcccctgccgccgt

SEQ ID NO: 95117 - DNA, 156 bp, Homo sapiens
  chr6:166302038-166302194
  hypo
tgagattacaggcgtgagccaccgcacctggcctgctttttttcagttgcctattgccttctgcgggaatgtaacttctaccaaggctgggatttttatttgtttgtttgtggatgttttccaagtgccttgaacagtgtccggctcagagcaatc

SEQ ID NO: 95118 - DNA, 30 bp, Homo sapiens
  chr6:166314916-166314946
  hypo
tcctcatcagggctccgggtctcacgtggg

SEQ ID NO: 95119 - DNA, 111 bp, Homo sapiens
  chr6:166343020-166343131
  hypo
tgtggggctggatgccgcgacaccctatgtgtcccatgccccagctagcagccccatgtgtgcagggccttcagtgctgctggaaaatcatgaagtcgaaagcatattttc

SEQ ID NO: 95120 - DNA, 30 bp, Homo sapiens
  chr6:166344391-166344421
  hypo
aacatgggaagccaccgtggtgctgatgaa

SEQ ID NO: 95121 - DNA, 115 bp, Homo sapiens
  chr6:166399418-166399533
  hyper
tatcctgaagaaacacgtaaaatcccatctgtgggggaaaagtctactcaagttgtcttgctatagggagctctgatgaagcgtggcgagggcattcctgcggagggatctcaac

SEQ ID NO: 95122 - DNA, 945 bp, Homo sapiens
  chr6:166400555-166401500
  hyper
ggaggaaggaagttgcggtgcacacaccatcccttctccaggccgcctcgggaggcacctgcgggtctggcgcggcagccgctgcggtttgcagctggcgcgcagccctcgctgggaacttggagctctcaaactcctcggatcaagcgttagccccgaggctgtcagttggcgctggggcgggctgcagtctctctcccctcctctgcaaacccttgagtcttcggctttatatactcccttttcttctttctcgagtccactcatcaccctttcccccaaacagtcacctccacaagcacaacacaccacacacgcgcacacgttttcttattgccaaaaagggtggagggaaaggacaggaagtttttttaagtacacgcacacacacacaaagattgggactaagtttttctggactctcaagggttaaataataggtaaaagaactgtcaacttacccgccaaagtatgctgacgcgcatatctgctttccgcttcatttcgagttcataaatttaaaaagagacagtgagagaaagaaaaagaaaaaaaaaggcaaggcgccgggagcacagtgggtccagggttccatggagaactgcgcaaagcaagttgccaagaaagcccgctggccaagttcgggacctgtccaccacgctcgcgcgctccgctcagcaggcagattccaaaggcttggggcactctggggtgcgcgccgatcttctcgcaaaaggcgagtgtgtggggttcctccttccctcctttccatctgggggtctcggggaaagctgcacccagcgccttgggcgcccatgaagaccagtccatctcagctcaagctcccagcagcagcaacttcggactcagacctctctctttagaacatgagtgcttgtgtgtgcgtgcgtgtgtgtgtgtgtgtgtgtccgagtgcacttcaca

SEQ ID NO: 95123 - DNA, 717 bp, Homo sapiens
  chr6:166401934-166402651
  hyper
ccccaacccgacccccgccccttgtcactacgtgtcgggctcgctctgcctggagggaggctggggtgcggggaagcagggagtgcaaacagacattggttctctttcctcttcccattcatacatttctgttggagtcctagggccgccgcgccgggagtcgcaatgaatggatggatgcccgcgcgctgggaccaccaggtccgcagagatgtcgccggcgctaggggcgctcctcccgcgtggggacaggcgccctcgcctaggcgcagtgtggggggaccccaaaagacccttaagaggccaaaggcctgctctccccgttctccccaacacacaccaggggtcttttctgccccggagaagttgggacgcaaaacgtagggaactgcgctcagtctccgcaccacgaagagtcgagatggggaccgagaccagcacggacggtagcaacagagaggggagcgcccaagtggcgcaacgttgtggctgaagccaagcctgtcgcctccccctgagtaccgctggcggcccaggaccgtgcgctctcccttcctgagcacccagggatgcactgcgcagggaaggagggcacggcgggagggtgcttgcaggggactgctgcgcggattccccatccgcacccggctcgcggggaatccgtgggcttgcactcgccagaaagagctgctgcaggagcagccggatggtgaggcc

SEQ ID NO: 95124 - DNA, 158 bp, Homo sapiens
  chr6:166419898-166420056
  hyper
gtaatgcacagagctcggcttgctgtggctggtgcagctctacacggatgcagagctggtcctcccgttccctggaaatggttttgcaaagttgttggttttgcaaacaataaaagggtaaaaaatggggtttgcaggcaaatcggttggttagaggg

SEQ ID NO: 95125 - DNA, 73 bp, Homo sapiens
  chr6:166421919-166421992
  hyper
ggagatgcgcccaagcgggggcggaggagcgggtcgcgccgctgacattcgccaaggacaggatggggtgggc

SEQ ID NO: 95126 - DNA, 288 bp, Homo sapiens
  chr6:166421993-166422281
  hyper
cccgccggtggccgactccgccccgcctctcaggggtgcgagtcatcagcgcagcggcggatcctggcccagggagccaccggcccaccctcgcgcccaggagccggactcggagacgtccacctggtggagagacgcgagggagccatgcagacaggggctgctccgtggagagcccgggaagcctgcggggcgccggaggggtgggtcccgggacagaccagtgaccatccgcctcctgcgtagcgctgcccccaggagaggaaaacccatcggaggttgtgctgt

SEQ ID NO: 95127 - DNA, 42 bp, Homo sapiens
  chr6:166487228-166487270
  hypo
ttacaggcttgaggcaccgcgcccggccgaagtaaggcttct

SEQ ID NO: 95128 - DNA, 135 bp, Homo sapiens
  chr6:166571802-166571937
  hypo
tcacatggaaggtggcgacacaggtgtccatgaggctatgaggcggccttgggctgcggcgtcgtactggctgtccacgatgtctgtggccgcggccgccccttcgtacagtggggatcccgaggaagagggcgc

SEQ ID NO: 95129 - DNA, 2678 bp, Homo sapiens; identical to SEQ ID NO: 30937
  chr6:166579715-166582393
  hyper

SEQ ID NO: 95130 - DNA, 433 bp, Homo sapiens; identical to SEQ ID NO: 30938
  chr6:166582394-166582827
  hyper

SEQ ID NO: 95131 - DNA, 155 bp, Homo sapiens; identical to SEQ ID NO: 30939
  chr6:166582941-166583096
  hyper

SEQ ID NO: 95132 - DNA, 242 bp, Homo sapiens
  chr6:166583152-166583394
  hyper
cgtggtgcgtgttactctccttactccgggtattaaaatgtctaagaggtcatcgctttggcccaaggcctcccgaggataagataaaagggaaaagtggaggggaggtgaaggaggaacgagggtgggtcccaggcaattgagggcctcggaaccctaggcacgggagcgaaacctctcctgcggcttcagggcaaaggagtcccgaaggctggatccctcccctgcgctcggacggcgtc

SEQ ID NO: 95133 - DNA, 42 bp, Homo sapiens
  chr6:166635577-166635619
  hypo
ctgcagataaggtgccgtcggacaggcgtctcggtggacctg

SEQ ID NO: 95134 - DNA, 134 bp, Homo sapiens
  chr6:166666726-166666860
  hyper
tcgaaaaaaaaagaagaggaaagaaaaagaaaaccagaacgagaaagtgcggccagcccgggctcaggagctgggtgggaaacaaagccgccagaaaatgacaagtaaacacgcagccgcgggaagccactggg

SEQ ID NO: 95135 - DNA, 247 bp, Homo sapiens
  chr6:166666879-166667126
  hyper
cgcgcagcggggccgccacgcccgcgcggacacggagcagcggcgcctttccctgcgactggctgtgtcgcctggagcccggcggccgccaccccagggagaaagctccggtgaggggagcagacgctgggacccgtggtctcgccctctgctctttcctggctggggacgggggtagctcccaggcaaaggccctccggggtctccgcccggggggccccacctgccttgtgacggctgagatgtg

SEQ ID NO: 95136 - DNA, 135 bp, Homo sapiens
  chr6:166667161-166667296
  hyper
cgtttctcattaaaaaacaagctttttgaataaccaaatgttcctttggcgccctccaattttattttactgtaatctattgagttgtatttgtttttctgaatccgcttcctaggaaagcgccccctcccattt

SEQ ID NO: 95137 - DNA, 66 bp, Homo sapiens
  chr6:166667524-166667590
  hyper
cccccaagccagccccgcctacccagagagggccagtcctgttccgggtcccgagggccttgggaa

SEQ ID NO: 95138 - DNA, 188 bp, Homo sapiens
  chr6:166683768-166683956
  hypo
gtggcgatggggacccggacttgtccaggtgggaggggctgtggcccggaccaggggcttcggggacagggatgagaagcaggaggattctggacacagttctgaggaagagctgtattcctcttattgggattccatggccttcatccttgtctagagaggttggtgccggccgtgcctctgtggga

SEQ ID NO: 95139 - DNA, 137 bp, Homo sapiens
  chr6:166711365-166711502
  hypo
ggctgcaccaagggacgagatgtgacggtgacagacgatggccaaggccatcttaccgagtgccaggcacgggcctcggcacctgctgtgctctgtctggggaagcgggcacagagatgaagcggccccacggcggt

SEQ ID NO: 95140 - DNA, 278 bp, Homo sapiens
  chr6:166721166-166721444
  hyper
tgcttctccagatgacgcttctggatgaccaggacggcctcgggggtgagattcaggcagaagcgcgcagcggagtctggacaaggccccgcccccgaggaggtgcccgcggcggtggtccccgtccccgccgaggtcgccgcataggtggtcctcgctgggctgtggccggagcctgccggccggggcggggcgcacgtggctggggcccgcgcgcggctgggcaaggcctggggggagacgcccggaggggccggcggctgcgtcctgtccaggcc

SEQ ID NO: 95141 - DNA, 480 bp, Homo sapiens
  chr6:166721658-166722138
  hyper
ccctggaaagagaggcgggcgctcagccactgtgcgcggagcgggtccccgcagtccgggcggcccctccacacccacctgcgtccagccgcggcctctccggcttcctcacatcccagcgaccaaacccggggactcaaagagaggcgctcccaccctcccctcctcctgggggtgctcccgggactggaccctgcaggaaccgcctcccgccgtccgactgtgggcgagtcgcggcgcccccgggtccccacagctgagacgcgggccgggccggcaggaggaggagcccagcgcgctcgctaaggacgcggccctgccaggccccgggctgtgcccggctggtgtcacgaccgactgttgaatgggagcaaagtgccaggacagcggagggcggagcgcgcgccaggcatcccggggctcccccagctggcgctccggtggtccgaggttaatgtagtccgtcgaaagccaggagca

SEQ ID NO: 95142 - DNA, 30 bp, Homo sapiens
  chr6:166731737-166731767
  hypo
agaaatgaagctgaacggacatttctcagg

SEQ ID NO: 95143 - DNA, 30 bp, Homo sapiens
  chr6:166825908-166825938
  hypo
ggaaaacagatctctcggcagaaacagaag

SEQ ID NO: 95144 - DNA, 32 bp, Homo sapiens; identical to SEQ ID NO: 40979
  chr6:166888304-166888336
  hypo

SEQ ID NO: 95145 - DNA, 193 bp, Homo sapiens
  chr6:166891666-166891859
  hypo
tggcagaggtggggtcgcggtgcctgccacctgaggcggcacgtcccttgcacatatgctcacgtgcttatgttataataagtgtccagatgtcatttgggtgcttgggaatgacaaggcagagactacacagatttccatcataaaagcttggtcttgaaagaggagtttcagccaccggcaaggttcctgg

SEQ ID NO: 95146 - DNA, 238 bp, Homo sapiens
  chr6:166911041-166911279
  hypo
tcccggggctgaggccggagcctggagagtgctgcagtgacccaagtggcaaaggaccagcgaggccctgggcaccagccgggggttctccaggcgacaccgcaggactcagccctggggttccctagcaaggggacgaggagtagggtgtggtgggaggagaggcggtcaaaactctgaagggaactgggtttggcaggcacacagttctgccacacgccagcggagcaaccttcat

SEQ ID NO: 95147 - DNA, 30 bp, Homo sapiens
  chr6:166914926-166914956
  hypo
ggcatcgaggagcttcgggcttcagcaggt

SEQ ID NO: 95148 - DNA, 33 bp, Homo sapiens
  chr6:166939005-166939038
  hypo
gagatcaaatggagccgtcggaagccattatcc

SEQ ID NO: 95149 - DNA, 30 bp, Homo sapiens
  chr6:166943962-166943992
  hypo
acgccctgtgtggcacggggtgccctcctc

SEQ ID NO: 95150 - DNA, 166 bp, Homo sapiens
  chr6:166944346-166944512
  hypo
cgttgtatttaaaaccgagtgaggccgtcggcctgccggtatcgaggctggtttgtcaggccccatccagcccaacagcctgctcgcagcctgctgctctgctttcccaatgccgctccacggcagaacatatgtgggagaatggtatttacgcaatacagctctt

SEQ ID NO: 95151 - DNA, 30 bp, Homo sapiens
  chr6:166946950-166946980
  hypo
tgtttgtggcagggacgccacatttccccg

SEQ ID NO: 95152 - DNA, 30 bp, Homo sapiens; identical to SEQ ID NO: 40982
  chr6:166982961-166982991
  hypo

SEQ ID NO: 95153 - DNA, 83 bp, Homo sapiens
  chr6:167038238-167038321
  hypo
ttacatatgctaccccgattttcacaagtatcaaataatagaaagctggggaatgcatttgtaaaaaagagagcattgtatta

SEQ ID NO: 95154 - DNA, 30 bp, Homo sapiens
  chr6:167039728-167039758
  hyper
taagatgccaagatgcgggacaggtagaaa

SEQ ID NO: 95155 - DNA, 198 bp, Homo sapiens
  chr6:167040127-167040325
  hyper
gaccatcccacaccccgtgcagccagcggcggagaaaccagctggaaatgcagtgggggtggagttgcccccgcgaggacccacggaccgcccaattactacggagtcccagcgataacgtttggagccgtttggttcgattttcggaaccggaccagctttccagtaacttgaactccctgacgggtctcggggtcc

SEQ ID NO: 95156 - DNA, 94 bp, Homo sapiens
  chr6:167041860-167041954
  hyper
tgcaaagagcagaaacgagtgcggtggtgagttgacaagtcttgcttgctcttttgcagtgcgaactgcaaaatcctcgcgttgttttgctccc

SEQ ID NO: 95157 - DNA, 30 bp, Homo sapiens
  chr6:167045191-167045221
  hypo
atgactcccaaacagcgagaagggagggcc

SEQ ID NO: 95158 - DNA, 124 bp, Homo sapiens
  chr6:167128131-167128255
  hypo
aagccaaggagcacccgaaccgcctgaagcaccagaagcaaagagaagggcctggaacaggctgtccctccccgcctcagcaggagcccactctgccacacctccaactcggacttccagcctc

SEQ ID NO: 95159 - DNA, 87 bp, Homo sapiens
  chr6:167129163-167129250
  hypo
gagcctgcacacacacggctgcgctgaacactggaggcagctgcagcttcctggtcgtgtatccaaacatagaaaagctgggccagg

SEQ ID NO: 95160 - DNA, 30 bp, Homo sapiens
  chr6:167130073-167130103
  hypo
tccctctgcactgcacggctgcatatgtaa

SEQ ID NO: 95161 - DNA, 102 bp, Homo sapiens
  chr6:167136306-167136408
  hypo
tccatgagcttcaatcgctgcattttcagcccattcctctctgcatttctggagtaatttcggttactctttgcacagctccctctccgagtccacaggact

SEQ ID NO: 95162 - DNA, 308 bp, Homo sapiens
  chr6:167139142-167139450
  hypo
ggtggggtgggcccacggggagaccctcactccacctgccttctcttcagatgctggggacgagagtgaagctccgagtttctgcttgcacagcttcctcgggccagcgtggacgttcccgacctgccccacagcacagagactggctccaggtatgccgggcagggaggctcctggcggcgcaggcccagagggaaagcagtgtcagctgaggggtggggaggaggcagagggcgcatcacttgtgattccccagctttgagaggagctcacagaggcagcttttggggaaccgacagatttactaa

SEQ ID NO: 95163 - DNA, 159 bp, Homo sapiens; identical to SEQ ID NO: 40985
  chr6:167140362-167140521
  hypo

SEQ ID NO: 95164 - DNA, 42 bp, Homo sapiens
  chr6:167144433-167144475
  hypo
aaaatagatgtcatccgccgggtgcagtggctcttgcctgta

SEQ ID NO: 95165 - DNA, 30 bp, Homo sapiens
  chr6:167250605-167250635
  hypo
tcttgctgggaggtgcgtggtgaggccagg

SEQ ID NO: 95166 - DNA, 363 bp, Homo sapiens
  chr6:167275668-167276031
  hyper
tccttttctgctggtcgagtattgatagtaggaaaggaaataaacagaggctcggaccggcacagggggacggccagacgggatgtcggaagccaagggacgcagaggccggcgggtggcggcgatggagaggacagatccggctcccagaggaggtcgtgagcgcggggcctgcgccggccggaggagggacccggggggctgcaatatggctgctcgggcgccgtcccctccctgccaagccagggctctggggagctgctgccgcttcccgctcgggctggggcgaggaaaggaggggacggcgctgcggcttcggaatctgtactgcgactttggcagagtaaacgctgcacttgcagc

SEQ ID NO: 95167 - DNA, 272 bp, Homo sapiens
  chr6:167276309-167276581
  hyper
ggagggacaggaacacggacggagggaccgggacgaggggagggctccacgcagcacagctgctttcctgcggagcgttcaggagactcgggcacctctggaagcgctgcggactgagctgcccgcggctgcccccgccccgagggccgggacagcacctcaggagaagagggacgaagagggacgacagacaaatagctggggagaggcgggggggggcggcccgtggggtccgctgggccctacccagccctgcccggagctgcccgaaa

SEQ ID NO: 95168 - DNA, 30 bp, Homo sapiens
  chr6:167601185-167601215
  hypo
ggatgcctctgtaaacgccgtcagacctta

SEQ ID NO: 95169 - DNA, 30 bp, Homo sapiens
  chr6:167753495-167753525
  hypo
gacagctggcagcaccgggtgcacggtttc

SEQ ID NO: 95170 - DNA, 194 bp, Homo sapiens
  chr6:167764951-167765145
  hyper
aaaggtgaatctgaccgcgttgaccgcgttacttcagagatgcgctgtgagctgctttgtgccgcgaaatgacctgtttacccgacagcgccctctgcagcccagcgccggaacgggctttttcatgatgttcctgcgttgtgtttacagcctccctgcgaggggttcgcacgcacaggcggacctcgttttgt

SEQ ID NO: 95171 - DNA, 30 bp, Homo sapiens
  chr6:167833924-167833954
  hypo
ggacactgggtctgtcgccatgttttgtct

SEQ ID NO: 95172 - DNA, 324 bp, Homo sapiens
  chr6:167835015-167835339
  hypo
agggcaggagagaggcgcaagcgggagctgctcttgctatgccagggcggtgctagagatagactttgccctgggctgggctgttttccccccacgcggatcctcacctccgcttctccactggctttccgcctttacatacgtctattttaaatttgtgttaggcacccccacactgtgactcccctcaacactgccgctcccccacgcacacagcggctcccccaacacacggctgctccccccacagcctgcggctccccacacacggcggctcatccacatatgctggctccccactacgcaaggcgtctccaaccctcc

SEQ ID NO: 95173 - DNA, 71 bp, Homo sapiens
  chr6:167836558-167836629
  hypo
ctccaaccctccacacggcggctcctccacaaatacggcggctccccctcccacggcggctcccccacaca

SEQ ID NO: 95174 - DNA, 32 bp, Homo sapiens
  chr6:167837812-167837844
  hypo
tgccctggtcacctacgcgtcacctaagcccc

SEQ ID NO: 95175 - DNA, 30 bp, Homo sapiens
  chr6:168122238-168122268
  hypo
ggcagggcattgctgcgttggttttctcat

SEQ ID NO: 95176 - DNA, 152 bp, Homo sapiens
  chr6:168122617-168122769
  hypo
gtcaaatattgattccgccgcgtattaacatgaatgccgctttgagtacctcactgccctctgccagcctcggtttcctcatctgtacaatacagtcaataacattaccattgtcattttgtgtagctctgggatgtcgtgcctggcctgtg

SEQ ID NO: 95177 - DNA, 30 bp, Homo sapiens
  chr6:168375613-168375643
  hypo
cgaggccgtgctgcgcggggaggctgggta

SEQ ID NO: 95178 - DNA, 191 bp, Homo sapiens
  chr6:168376093-168376284
  hypo
gaactgatcagatgtcggacgcaggcgtgggggattctcacggcgatgcagacttgaggctgagttgaaaaagggcgtggagaagcccagggtctggtcagggagggcgtccttggcactggggccatgagaagctggtgtccatgttcctaaccaacgatgccacatggtcgccgcgatcacgtcgcaca

SEQ ID NO: 95179 - DNA, 207 bp, Homo sapiens
  chr6:168377401-168377608
  hypo
gctcctgggactcagcgctgcgcctctgggaagggccggtccaggagctccgcaagttgcgggagaacctggcgggtccgtggtccagcgaggcctgggattcagaagggatgaaacgttcctcgacgcttgaacaccggcctcctgcccctgggtcttcctgctatttcttcctgcccctcgctcccgcctcgagccaccccctcg

SEQ ID NO: 95180 - DNA, 33 bp, Homo sapiens; identical to SEQ ID NO: 40990
  chr6:168399961-168399994
  hypo

SEQ ID NO: 95181 - DNA, 204 bp, Homo sapiens
  chr6:168453289-168453493
  hypo
gtccagttcctgctgcgtgcactggtttgtgacagcagcagtggctgaatggagagaaccacacccctgccagcgggaggcctggctggtcacctgagcacagatgccagggcagagccaggaggggactcaggatgaacactgccaccctggggcggctggagaaccaggcatgggccggcggcgagccgggagggagcccca

SEQ ID NO: 95182 - DNA, 36 bp, Homo sapiens
  chr6:168462485-168462521
  hypo
ccttctgcctcctcccgctgccgcagctgttgcaga

SEQ ID NO: 95183 - DNA, 30 bp, Homo sapiens
  chr6:168479771-168479801
  hypo
catgctgtcgttactcggccctcccccgcc

SEQ ID NO: 95184 - DNA, 5 bp, Homo sapiens
  chr6:168719798-168719803
  hyper
gtagg

SEQ ID NO: 95185 - DNA, 183 bp, Homo sapiens
  chr6:168719889-168720072
  hyper
cgcgcggggcctccatgtccccctccttggagaccgaactgcattccattcaaatcccaaaggacgtcccctccatccatcagacacccccgtcccactaacacacagtcgctgccgaaggagcagcgcctgtggcccgcacacctcgcagccccgagtcccggcgcccggtccttaccagct

SEQ ID NO: 95186 - DNA, 58 bp, Homo sapiens
  chr6:168760650-168760708
  hypo
gtcctcccagggtcccgtaattactttaatatgtgtgcacaatcgcagcctgagagga

SEQ ID NO: 95187 - DNA, 180 bp, Homo sapiens
  chr6:168771518-168771698
  hypo
gggcgtggggtcaatcggctgacggcaggagcccggggggatctttccaaggcgtcttggcgagtccaggctgggccctggatgtcgtggccgcagggtcggggtgtggttccccgggagcggcagagcttgtgtccccgctttgtcccctcaggttggtgggcacgtggcaccccagga

SEQ ID NO: 95188 - DNA, 56 bp, Homo sapiens
  chr6:168841423-168841479
  hyper
gtggatgaaaagtcccgctgggctgatcctgcgcggaccgggcctggaccctgggg

SEQ ID NO: 95189 - DNA, 1016 bp, Homo sapiens
  chr6:168841502-168842518
  hyper
cgtggttgtgcttggaagccccccgagggtgcgcgcgcgtgggtatgagtgcgtgcgtgtgcctgggtgtgcgtgtgtgtaagtgtgcacgtgtgtgtgtgagagtgcgcgcggggaaggaggcacagagacagcccggacaggccactgcgcagccctggtggcccccgctccacctctcgctccgcagacccgcgccagggaggcctctgggccgcagcgggcaccggagcggagcgggcgcggcagcgggcgctgggaggtggggctgggggaggagagggggagggagagaggcgggcgggaggggaggatccgggaagctccggggtatttgacaggagcgagggcggacgcaaagaacgcggaggacctctgggtgcctgcaggggagctgctccagccgggccgccgggagcggtggggagagcatcgcggagccgcccctccacgcgcccgcccagccgcgctcgcccactgggctctcccggctgcagtgccagggcgcaggacgcggccgatctcccgctcccgccacctccgccaccatgctgctcccccagctctgctggctgccgctgctcgctgggctgctcccgccggtgcccgctcagaagttctcggcgctcacggtaagcccgggcccgcgggacctggagctcaagtggtgccgcctcttgcagccggccgggttcgggtccccgcgccccgctccaggcccaggcgcctgggcacggggagcaggtggccccgggggccgtggagccttcgcctgccggcgaggctggagcaggtaggacgcagcgtgcgcgcctgggacccggctgggatgggcttctggggaccctgcccgccggggtcctgctgcggctgcgacgggctcctcgggttccacccggctgggaccccacctgcctcgggggctctgacccggctgtgagaggatcctggggtcctgcagaccccggacaagtgggagctgcgggtgcgctcgggtgtcccgcactcactgctgg

SEQ ID NO: 95190 - DNA, 203 bp, Homo sapiens
  chr6:168842858-168843061
  hyper
caggcggcggctccccgctctgcggggcctctgggttcttcctcgtggcagggatgctgcgctcctgagcgcgagggtcaccgcggttgaccgctgtgtgtttttctttctgagctgtaacttctatgcgacagccttggcccggccaacgcacgcggtgtcaaacgaggagctatgtagagggggctgagccaagcccccgc

SEQ ID NO: 95191 - DNA, 179 bp, Homo sapiens
  chr6:168843080-168843259
  hyper
cggccgctgggccaaggccgggtgtctgcagcccccagctccagccgtcctcctgggcttgcagggtttgcaaacccatcattaatgcaatcgccagaaacgaaaacattccacttaaatgtgtttttgaacaagtgtttgagaaaacacgaaggtagtgagaacgcctctggtggaca

SEQ ID NO: 95192 - DNA, 248 bp, Homo sapiens
  chr6:168858091-168858339
  hypo
acaaacggcacccaccgaccctgcactggagctgcagtgacttcatcgccttgtgtttcccgtcgggtgcccagtaatcacaaagtggcctggagtcactgtttgtaaatacacaggagcctgcacccatcatatgtatgcggcagagtaatcctcccagaacatgagccccgcgtcacgtccttccagccgtgcttgtgatcactgccggggtgggagcctggcctcgcactcgctgcagccccggc

SEQ ID NO: 95193 - DNA, 177 bp, Homo sapiens
  chr6:168947622-168947799
  hypo
tatagtcattccagccgcagctgcaggcagcatcgcgttgggtctgtgtggggttgctgttgtggttgatctgtggggactgagtgcaagtcctcagcatccacccgtatgcacacttacttaacttactctcataattgtagtctccttgcaaatcttttccgttctgaattcaga

SEQ ID NO: 95194 - DNA, 66 bp, Homo sapiens
  chr6:168983395-168983461
  hypo
gaggagtgcgtcacgcggtgtttccacctgtttggagcatgtccgacctgccgggaactcagagct

SEQ ID NO: 95195 - DNA, 128 bp, Homo sapiens
  chr6:168999540-168999668
  hypo
caagcagcccaagaacgacaatgtggtgatccctgagtgtgcgcacggcggcctctacaagccagtgcagtgccacccctccacggggtactgctggtgcgtcctggtggacacggggcgccccattc

SEQ ID NO: 95196 - DNA, 32 bp, Homo sapiens
  chr6:169067893-169067925
  hypo
aaatgtaaatccagtcgcggtgtgaccgagct

SEQ ID NO: 95197 - DNA, 30 bp, Homo sapiens
  chr6:169102398-169102428
  hypo
tctccccagcatagccgatgtggcatggct

SEQ ID NO: 95198 - DNA, 51 bp, Homo sapiens
  chr6:169105616-169105667
  hypo
cagagtcctccagtacgcagagccccagggcgggcacggagtcctccagca

SEQ ID NO: 95199 - DNA, 41 bp, Homo sapiens
  chr6:169400235-169400276
  hypo
tttccagtgctgccccggtgcctctgcggtggaggagctag

SEQ ID NO: 95200 - DNA, 138 bp, Homo sapiens
  chr6:169462691-169462829
  hypo
agccacagcaccaaccgtcacactggctagggcagcaccaaccgtcacactggctagggcagctccaaccgtcacactggctagggcagcaccaaccgtcacactggctagggcagctccaaccgtcacactggctag

SEQ ID NO: 95201 - DNA, 165 bp, Homo sapiens
  chr6:169539538-169539703
  hypo
ccccacaagtgaggccgaggaggtcggcgccaggggaaccagggccggtgctgagcagctccggtggaggccgtcagtggacttgagttttaaaaaggctcctgcggcgtggtcctggccagcttctctgctgctccgtggaaaggcctccgggacagtggcctg

SEQ ID NO: 95202 - DNA, 169 bp, Homo sapiens
  chr6:169562391-169562560
  hypo
ccaggtcctccttcacgttctcgccaccccaaatgcgggcaccgcggcgccaaacctgctcttcccactgttgtcaataaccgcagcctggccgaatccagtgattcatttctgtcttaatctctcctggcctttcggcagcgtttaacgtgtgcgacccctcccttct

SEQ ID NO: 95203 - DNA, 177 bp, Homo sapiens
  chr6:169562792-169562969
  hypo
tcaattgatcaatgccgaggatggggagcaatgcgtgtaccagagggggctgggcacacgcaggcttgttgttggatggaggagaggcagcatcccctgcatgcctgggtggtccccatctccaggcctgcgacaagcacttctcatcttcccatcctctgacggagccagtcccac

SEQ ID NO: 95204 - DNA, 107 bp, Homo sapiens
  chr6:169567826-169567933
  hypo
gccagcaggccctgccgcatctccgggctggaggcttgactgtcagcagatgaggccacggggtcggggtgtctctcccaccagaacggcttcgtggggtgctcact

SEQ ID NO: 95205 - DNA, 30 bp, Homo sapiens
  chr6:169571409-169571439
  hypo
ggtctttacttttcacgcaggtgatggaac

SEQ ID NO: 95206 - DNA, 496 bp, Homo sapiens
  chr6:169632340-169632836
  hypo
ccggaggcgtcgaggcggggcgtcgggcaccgcaggccccagcaggtccggtcccaagcggacccaagtcctgaagtgggaagggctttctggacacgcacttgaggtgctgttcgttcctgaggctccgtttgtgactcagccatcgtttctgagcctcggctgcagctcaccaagggctgcgctaacagcggagaggtggcggcctgaccctcacaggcccggctgagcacgccccgcaccccgcgcggagagcagcggcccagccgagcaggtgctcagcttccccgggccagcccctcccatgcctctcccgggccacgccaccccttcctctccttcctcctgctgcttttctgagctcatctgatttttccaaagccgctcgcaacacacaaggaaggccggccttgcgtacttgcttttccgtcttggctgcttccaggccgaccccgacgggctggttccctctgtatcggggcgggcagggcaggca

SEQ ID NO: 95207 - DNA, 39 bp, Homo sapiens
  chr6:169633129-169633168
  hypo
gagcagagttcaccacgcgccctgcgcagcacagaagga

SEQ ID NO: 95208 - DNA, 30 bp, Homo sapiens
  chr6:169634777-169634807
  hypo
atcagaatggaagcccgggtttcagtgccc

SEQ ID NO: 95209 - DNA, 118 bp, Homo sapiens
  chr6:169637173-169637291
  hypo
tgacaccccggatcccggctccagctgtggctgctcactgtgagctgcctgcaagcccgcccacccagggccccgccttcaccgtacttacttgggcatggggcgccctggcaggctt

SEQ ID NO: 95210 - DNA, 35 bp, Homo sapiens; identical to SEQ ID NO: 40999
  chr6:169637816-169637851
  hypo

SEQ ID NO: 95211 - DNA, 42 bp, Homo sapiens
  chr6:169640567-169640609
  hypo
gctgtccaccacccacgtttcattttccgcaaagaaccggcc

SEQ ID NO: 95212 - DNA, 116 bp, Homo sapiens
  chr6:169641889-169642005
  hypo
gaggacgtggagccccgagagctcctggaccatgtttcccagctcctcgcacgagcgttcgcacacctcgggcctcctctccgagctggggcccacgtactcggtggtgacatgcg

SEQ ID NO: 95213 - DNA, 454 bp, Homo sapiens
  chr6:169653638-169654092
  hyper
gcagtagaaacaccacgtgaagaaacacttgccatttagtgttaatagatacaccacccaccttaagttaagaatcgaaattgctcctttttcttctccgcttcttagagttcgagaactctaatttcttaaaattagagcaccattaaataattgattgagtttaagaaataatcgtacctggtttgccaaaaagatgcagtgatgactggtttcagtgttccggaccgagtcagaaaggcgcaggctctgctggagcgagagaccggccctgcagtgcaggatgctccggtggacgtggccgagcggctcccgggcagcgcggctttatatgccgcttctcctgtgcagggctgtcaatcagacacacgaggaagcacgtttaattcattccttcgaaggaatgacatcatcccccttctgatctcaccatttgctccgagtacctgctgca

SEQ ID NO: 95214 - DNA, 42 bp, Homo sapiens
  chr6:169713648-169713690
  hypo
tcaggttgccacctccgcgcaccatgccgagggcattgtcct

SEQ ID NO: 95215 - DNA, 48 bp, Homo sapiens
  chr6:169740765-169740813
  hypo
cctctgtccatgggccgagccaacagcgagcttcgtgcagaggggaga

SEQ ID NO: 95216 - DNA, 36 bp, Homo sapiens
  chr6:169852398-169852434
  hypo
cttgcttgaaagaaacgtttgcgatttttagtggaa

SEQ ID NO: 95217 - DNA, 30 bp, Homo sapiens; identical to SEQ ID NO: 41002
  chr6:170065367-170065397
  hypo

SEQ ID NO: 95218 - DNA, 45 bp, Homo sapiens
  chr6:170091017-170091062
  hypo
tacttcaaaagaggccgggcacggtcgctcacgcctgtaatccca

SEQ ID NO: 95219 - DNA, 30 bp, Homo sapiens; identical to SEQ ID NO: 41003
  chr6:170201723-170201753
  hypo

SEQ ID NO: 95220 - DNA, 30 bp, Homo sapiens; identical to SEQ ID NO: 41004
  chr6:170240081-170240111
  hypo

SEQ ID NO: 95221 - DNA, 30 bp, Homo sapiens
  chr6:170240765-170240795
  hypo
tcccaggacaatggccgtctcagggcctgg

SEQ ID NO: 95222 - DNA, 30 bp, Homo sapiens
  chr6:170249406-170249436
  hypo
aggcacagctgagctcgttcaaagacgttt

SEQ ID NO: 95223 - DNA, 50 bp, Homo sapiens
  chr6:170263200-170263250
  hypo
ctgagctgggtggggcgctgagggtcccttccctccgtccctgccaccct

SEQ ID NO: 95224 - DNA, 42 bp, Homo sapiens
  chr6:170264728-170264770
  hypo
tcaatgacaaggctccggcgagttgtgcggcaggactcagat

SEQ ID NO: 95225 - DNA, 139 bp, Homo sapiens
  chr6:170339404-170339543
  hypo
gactacccgtgagcccggtgacgtcacggtggagaccacccgcgaggctggtgacgtcacagtgcaggagaccaccgcgaacctggtgacgtcacggtgggggagaccaccccgagccctgtgacgtcacggtggagga

SEQ ID NO: 95226 - DNA, 30 bp, Homo sapiens
  chr6:170343912-170343942
  hypo
gcgtacacatgggcacggcatcctgggccg

SEQ ID NO: 95227 - DNA, 30 bp, Homo sapiens; identical to SEQ ID NO: 41006
  chr6:170361487-170361517
  hypo

SEQ ID NO: 95228 - DNA, 30 bp, Homo sapiens
  chr6:170365462-170365492
  hypo
tagccgggtcctcgacgatccagctgcaga

SEQ ID NO: 95229 - DNA, 30 bp, Homo sapiens; identical to SEQ ID NO: 41007
  chr6:170368767-170368797
  hypo

SEQ ID NO: 95230 - DNA, 30 bp, Homo sapiens
  chr6:170371320-170371350
  hypo
aaaatgttcagggtacgaagggcttcacta

SEQ ID NO: 95231 - DNA, 30 bp, Homo sapiens
  chr6:170374015-170374045
  hypo
ctgccttctgcaggccgttctggggcaggg

SEQ ID NO: 95232 - DNA, 42 bp, Homo sapiens
  chr6:170392903-170392945
  hypo
ttctcggcgtccagacggccgccttctcgctgtgtcctctgg

SEQ ID NO: 95233 - DNA, 323 bp, Homo sapiens
  chr6:170402281-170402604
  hypo
gaggaaagggacctgcgtgggaaggaaggggcaggggaggcttcgagaaagagccaggaccgtgtagttggacccttggagggagctacacgtggccaagggtgcagggcggccccaggctggggaacagcaccggccaagctcggggaagggcgtggacaaggccggcccgtggaacggaagggagcatcgcactgttaaaaggtcatgaaacgtccgggagcctcagcaggggaggccgagtgtggaggtttagaggaaaggaatgaggctgaggctgccaaggaaaagcatggtgtggggggacccggaggccccgcggt

SEQ ID NO: 95234 - DNA, 38 bp, Homo sapiens
  chr6:170408290-170408328
  hypo
ccgcacagctcccaacggcaccgcgcagctcccaacgg

SEQ ID NO: 95235 - DNA, 32 bp, Homo sapiens
  chr6:170409702-170409734
  hypo
gcccatcagccaccacgcgctgggagccatgg

SEQ ID NO: 95236 - DNA, 114 bp, Homo sapiens
  chr6:170413679-170413793
  hypo
cactcacagagccaccggtgaccccggcagagtcaggacatgctcaccgtgagggtgcacacccagcgagggcatcactcacagagccatcggtgaccccggcagagtcaggac

SEQ ID NO: 95237 - DNA, 138 bp, Homo sapiens
  chr6:170454062-170454200
  hypo
gagaacggcagtgcccgtgagcacctggagaacggcggtgcccttgagcacgtggagaactgcagtgccctttagtacatggagaacggcggtgcccttgagcacctggagaacggcagtgcccgtgagcacctggag

SEQ ID NO: 95238 - DNA, 781 bp, Homo sapiens
  chr6:170474843-170475624
  hypo
tccgacgttgctcagcgtccagcaaggggctgcccagatcccgtcttccacagaccccctctgaggccctcgttccctcaaaccccaggagccagctctgcccccgcacagctccacggccccaggctgcttcccgctactgtaacagacgaccacaggtcgcataggccagagcccggcacggcttcttgggtgacaatcgaggggtcctgacccagcacccgtgggcacacccttatttggaaattgggcctagcccggagtgatcatgaggccacgtgacatgggcgtgccagtctcaccaacgtgtgttttcacgggcaccacagagtctgttttctatgggtggggcagcggtgaacatatccctcttaatagcggtacgggtacggccagggaggcggcagaacgtagacagaacccgggcactgagagaccggtgccgccccccgccgtccacacaacccgggcctcgggcagcaccagcaggacttttattcctcaccccgcacgccgccgtccatctcctaggccagcgtgattcttctgagtgcagctgggtctcctcctgggagatccggtggctctagcagcgtgggtgctgggaacaggaccagcctcgccggcggacagtgtggacgcctgagggcaaaccctggaccactctctccccgggggactccgttcccgcctccagggagctgcgaacgctccttctgggacacctgttggcaagaaaccagttcaatcgtctcacttccagaaacgattctgtgttttg

SEQ ID NO: 95239 - DNA, 48 bp, Homo sapiens
  chr6:170475958-170476006
  hypo
cagcccttccaagggcgcggccaggcagttgggcggctcttccaggga

SEQ ID NO: 95240 - DNA, 142 bp, Homo sapiens
  chr6:170493059-170493201
  hypo
cctggggcctttgcacggcggctgctgccatctgctcctccctggcgctgtggggccagctcctttcttcgagttctctcactggacgcattgccacctcacacgggacccctgaccctgagctggccgggtggggccaagt

SEQ ID NO: 95241 - DNA, 126 bp, Homo sapiens
  chr6:170526716-170526842
  hypo
ttgtgtacaagctcacgggaggaggaggttaaccctcgggagaagctgtgctggggaggctgcatgaaagtccttcttggaagccagagaccaggttggggatccagactgcgaagtcacatgact

SEQ ID NO: 95242 - DNA, 30 bp, Homo sapiens
  chr6:170538913-170538943
  hypo
tgcccttggcacacccgggctgcagacggc

SEQ ID NO: 95243 - DNA, 142 bp, Homo sapiens
  chr6:170569776-170569918
  hypo
catttcaaaaaaaaacaatactaggattgaagtttgcttcctaacttccagtgacacggttttttcaatctaggatttaaaacaaaaattatgctttacagcaaaggagagtttgggttttcactcccggaggtgttcggag

SEQ ID NO: 95244 - DNA, 76 bp, Homo sapiens
  chr6:170579513-170579589
  hypo
cagtgcccactgaagcgtcctgctcccttcttcgcacagatggcagtgtggggccaggggacgtgtggcatcattt

SEQ ID NO: 95245 - DNA, 30 bp, Homo sapiens
  chr6:170592975-170593005
  hypo
tcgttcacgccatcccggcaggtgcccccg

SEQ ID NO: 95246 - DNA, 148 bp, Homo sapiens
  chr6:170598204-170598352
  hyper
gggatgggcacgctccgggtggtagcggtcgcgctgcgcgggtaatcgcgccaccaacgcgtctaggagtcgggaaaccagaaccttcccacgtgaaggggcgcctctgactggagacctggcacagaggccggatacggaaatctcc

SEQ ID NO: 95247 - DNA, 382 bp, Homo sapiens
  chr6:170598458-170598840
  hyper
cgctaggcagatcgcagcgcccacctgcgcctcgcggggtccccgaggtcccgccaccgagcgcccaaggcgggatcccagcgcgtcctgcagcccgcccagcttcagggccggcccggcgcgcgcaggtgcggcactcaccggccaggtgaagccgaaggggaagcggatggggttgctgaacgcggagtcggcgcccccgccgtcgggcagactgaaggagtcgacgcccagcacgggggtgacggcgctgccgtaggtgcagggcggctcgggggacacgctggcctggtagtgcttgaggcacacgcggaagaaggtccggcaggcgcacggcggtggccccgcgcccccgcggcagcagttgcggttccccagcagc

SEQ ID NO: 95248 - DNA, 356 bp, Homo sapiens
  chr6:170605520-170605876
  hyper
gggccactgcgagggcggagggcggcgccagggccctcccggtggaccccagtcgccgtcgtgacggccccacgcagcctcgcgcccggccgccgcctcgtgcgggactcgtgcccgcattcccacctcaccgggtgcagccggcccggccccgggctgtgcgaggcgacggcgcacacctcggagccctgggggccggggtcggcgggcggggccggggcgcgccctttgtgcgctcttagcggaaaccgcgcgttcccagaggagcgcggcccgccgagaccccggatcccgacgccaggaggtgctgcaggagcccgcgcggggtgggggtctccggcccaggcccctcggta

SEQ ID NO: 95249 - DNA, 31 bp, Homo sapiens
  chr6:170605909-170605940
  hyper
cgcggcggctcctttccggctgcatccgggg

SEQ ID NO: 95250 - DNA, 45 bp, Homo sapiens
  chr6:170757555-170757600
  hypo
gggcagatcagcagacgcggaggcctgaagcgcctccatctgaga

SEQ ID NO: 95251 - DNA, 30 bp, Homo sapiens; identical to SEQ ID NO: 40709
  chr6:1708613-1708643
  hypo

SEQ ID NO: 95252 - DNA, 87 bp, Homo sapiens
  chr6:170921658-170921745
  hyper
cacaggagcctcacgcgcctcttacctaacaggaagttgggtggaagcagcgcggacccacggcacaccgaacgcactccaacagaa

SEQ ID NO: 95253 - DNA, 73 bp, Homo sapiens
  chr6:17102273-17102346
  hyper
ggcaaccattcctggcgactgcccagaaactcagtgcgtcctgcccggggtttaagcgcgggaagtgggagag

SEQ ID NO: 95254 - DNA, 30 bp, Homo sapiens
  chr6:17102637-17102667
  hyper
tcccacgcttgggggcgacaagagttggct

SEQ ID NO: 95255 - DNA, 175 bp, Homo sapiens; identical to SEQ ID NO: 40710
  chr6:1726684-1726859
  hypo

SEQ ID NO: 95256 - DNA, 144 bp, Homo sapiens
  chr6:17281118-17281262
  hyper
cggcgcccggcgccccaggtgctgccgcggccaatcgcaggcgtccggcccgcccccctccccagccgggcgtcgacccccggcccgcgggggaagggagcagagaggtggagagctgtcctcggcactcgtcttccagatccc

SEQ ID NO: 95257 - DNA, 119 bp, Homo sapiens
  chr6:17282098-17282217
  hyper
gctgccccttcgctccggggtgaactgaaactttgctaggggagagggtcggcgccagcctcgcggggttcggagaagacccagcgctgtgcgaggtcgggggccgggcagggcagagc

SEQ ID NO: 95258 - DNA, 19 bp, Homo sapiens
  chr6:17339508-17339527
  hypo
acttcgtctcaaaaaaaca

SEQ ID NO: 95259 - DNA, 190 bp, Homo sapiens
  chr6:18035825-18036015
  hypo
gccaccacccacagacgctgtccctgtcctcaccactctccgtggagaacactggtacgttctgtcgtctcttaagagcttttgtagttgactctgaatcctaaggccttagtgaatgtcgagtacataccaggtactcgataaatctcaagtaatatgtgaatgaacaaataaacgtttacttatttca

SEQ ID NO: 95260 - DNA, 405 bp, Homo sapiens
  chr6:18122677-18123082
  hyper
aggccaggcagaccacgtggccgcaggacaggttgcgcgggcgccgctgctgccggtggccaaacttctcaaagcacaccttgcactcgagcaggctgatctccgcctcgcgcatgagctcatgcagcgctggcccgctctccgaggcttcggccgccatggcgcgtcctgtgcactcccgccgcgccgcctggccgtgccccagcgacgctctcggtcacggtcacagtcatggtcacggggtgggacgtgcgccctgacgtcgagcgccgcgggcctctgcactgcgatctgctgccccttggtgggcacgcgcggcactgtttcctgagggcctgatggtggacgtttgcaagacaaatccacatgcgcgttgtgtagacctgtaatcgtcacagcagtcat

SEQ ID NO: 95261 - DNA, 528 bp, Homo sapiens
  chr6:18277433-18277961
  hyper
ttcctaaagagggtgcgtttgtggggaaggtgagtgcgcgcgcgcggagggagggccggccgcggagaggggccaaaactcttcggaatcagcagccagagaggctctgagggcgcccgcggggcggaggggagcggggcagagggccgccggggcgagggccgaggaggggtccgagacgcgccaaggggctggtagctaggcgacctgaatgtcttccatacctgaacccgcagcctgaagaagctgatagcggaccccgagcgcgcgcgcgccttggcgggagccctgcgcctcccggggtctccctgctccttacttggacctcgggcgcaaggtaaggaggggcacggggtgcagcgttcgccctcgagctgcctggagcctctgcgaggggccagttcggcctccccgaggctgtcaccgcctccccttctgctccttccctttctccgtccccaggtcccctccgcgcagagctgaagccgcggcgggcggcccacgggggatcagaccctcgggcatccg

SEQ ID NO: 95262 - DNA, 64 bp, Homo sapiens; identical to SEQ ID NO: 30327
  chr6:18277979-18278043
  hyper

SEQ ID NO: 95263 - DNA, 34 bp, Homo sapiens
  chr6:18507305-18507339
  hypo
aaaggacccagccagcggtaaatgtgccaggttt

SEQ ID NO: 95264 - DNA, 283 bp, Homo sapiens
  chr6:19691714-19691997
  hyper
tagttgctgaaaagccggggccttggagctttcggatcctgcccgcctttcatcatgtaaacaaacgcatcagatttaaagctttcccataattgttatgctaaccttggagcgcaacctctccatttgcatttgaaggagctaaatattaggcaggaaagaaagtgctctttttgaaagcctgagaaaatgtccccgctcggggctgctccgccatctgggccgcgggctgggcgcgcggctcccgcccccagctccttggcagaggcgccggaggaagggg

SEQ ID NO: 95265 - DNA, 104 bp, Homo sapiens
  chr6:19692142-19692246
  hyper
cgtcccgagggctctcccttttcccagagcgcataccaaaggcagactcctttgcaggctccacgagccccattcgcggtggaaaggggcgttccagactgcag

SEQ ID NO: 95266 - DNA, 30 bp, Homo sapiens
  chr6:20057944-20057974
  hypo
aattaaagaagtgcacggaaaggagaaaag

SEQ ID NO: 95267 - DNA, 30 bp, Homo sapiens
  chr6:20317888-20317918
  hypo
gctactagaccagcccgggcctgcctgtct

SEQ ID NO: 95268 - DNA, 30 bp, Homo sapiens; identical to SEQ ID NO: 40761
  chr6:20691518-20691548
  hypo

SEQ ID NO: 95269 - DNA, 95 bp, Homo sapiens
  chr6:20702857-20702952
  hypo
ctctggacgtcctctcgatatccagccacctgtgttttcttcgccgatgtgttcctcatgatgtccagccacttgtgtgttggcctgctagggtc

SEQ ID NO: 95270 - DNA, 173 bp, Homo sapiens
  chr6:21587469-21587642
  hyper
tggaagaaaggagatcggttgcctggcgagggggcccgtgcgtcctacagtcgctacccgccacgcacgcgtccctctcctcctgacccgcgtcacttagcagccaatgcggtctccgtgccttcccacttccccgcaatcaagcgcctttcttcctccgcctcccctctttc

SEQ ID NO: 95271 - DNA, 268 bp, Homo sapiens
  chr6:21664923-21665191
  hyper
gggcatctctggtcccgggatgcgattgtcccggtttctccttctggcccactcgccgcgcgcacgaactctaggggaagttggttgtaaagtttccgagagcggcgtgggctggtgcgagtgaagcgcggggcgggggaggcgaggacagaagctctcctcgcggcgtctttgttctgctctggaggagagaccttggcaaggagtcgccgggcgggtgcagggacctaccgccaccacattccggacccagcgggagccctcctct

SEQ ID NO: 95272 - DNA, 567 bp, Homo sapiens
  chr6:21665622-21666189
  hyper
gacctggggaagggtcgggagctgttcctggtccgagacacctgatttgtcccggacaaggcagtgggggaggggaaggaaagaggggatgctcggctgggacgtgtcgcggcagggggtggaggatgaggaggcggcctgggaccccgagtcagatctttggggtgagcacgaggacgtggtgtagggaagaggacgagtgagcagcgcctggctgtagggtcagagggcgcctggtcatcctgagagccttgccttcgcagtttgagattaggggaagttcggggcctgagaaggtgggcgcgatgctggagctgggaattcttcctcggagcccctggaccgagttgcgctgcgcctgcagcaacaggtagccccgagggatgggcggaggccccggccgaacccggagctggcctttgtcctgccaattagagggctctccagagggacagcgtgggtgggggtaggtggggaagggcgggagaggagtttcctaacacttggagcccctttgagttgttctgtgtattgggtggaggagggtgaatccgagaggagggagga

SEQ ID NO: 95273 - DNA, 131 bp, Homo sapiens
  chr6:21666457-21666588
  hyper
agggctggcatctcccggggaaagtttcgagcctggcagtgggaggagaccgtctgggcagagttgtgatgaactggggaccgagcagccccagctcgcctcggaggttcccgagccgggcgggagatgcg

SEQ ID NO: 95274 - DNA, 23 bp, Homo sapiens
  chr6:21687659-21687682
  hypo
tgagactccgcctcaaaacaaaa

SEQ ID NO: 95275 - DNA, 30 bp, Homo sapiens
  chr6:21782706-21782736
  hypo
aggcgtgagccacggcgcccggcccaaatg

SEQ ID NO: 95276 - DNA, 176 bp, Homo sapiens
  chr6:22149842-22150018
  hypo
gacattgtctgagcccgtttaatttacatcttcgatttagtcaagaagcggaacctgccagatcagaatagtgtattctgtgcacccaacagggtggaagacattattttgtttgtgttagttcaaacagctggtcattaatgcagtccccatttctagagcgaagtgctgctgga

SEQ ID NO: 95277 - DNA, 155 bp, Homo sapiens
  chr6:2244329-2244484
  hypo
ctcacctcgagcaatccttccacctctgcacaccgaagtgctgagatttcaagtatgagccgctgcctcctgcccacttagccctttctaacactagagaactttgagagtggtttcaataccaactggacacttcccagcggtttaacctcagg

SEQ ID NO: 95278 - DNA, 21 bp, Homo sapiens
  chr6:2247175-2247196
  hypo
actgagcaagccgggcgcagt

SEQ ID NO: 95279 - DNA, 30 bp, Homo sapiens
  chr6:2376070-2376100
  hypo
attcgaatatttggccgccaccactatagc

SEQ ID NO: 95280 - DNA, 180 bp, Homo sapiens
  chr6:24126308-24126488
  hyper
gcgcgccagacagctcggccccgcccactcgccgctctcggaaagctggaaccctgcccctttggagggggaggcggcggcggcggcggcggctgcgcgggcctcgggtgcgcgggcacgcgggactcccagctgtcaatcaggcgcgggctgagctctacgaggcggagcggcggcggt

SEQ ID NO: 95281 - DNA, 30 bp, Homo sapiens
  chr6:24438527-24438557
  hypo
tagttgttggaatttcgctgtaaactttat

SEQ ID NO: 95282 - DNA, 30 bp, Homo sapiens; identical to SEQ ID NO: 40764
  chr6:24465059-24465089
  hypo

SEQ ID NO: 95283 - DNA, 223 bp, Homo sapiens
  chr6:24494649-24494872
  hyper
agccaggcagcagaacgcggggtcacacttcgacccctcagagaacgatcgctcccaatcaatactacgtgctcaggagctacaactgaagaagcgtgatcacggccttggcatttagggcaggcaccagcgcatctatggaccgcgcacaaattccggggatgccgaatttgggggatgctaaggggagagagtgggtctctagcagcgattgggggctcag

SEQ ID NO: 95284 - DNA, 30 bp, Homo sapiens
  chr6:2450689-2450719
  hypo
ttttctgaaaggtgccgcatagacttcttc

SEQ ID NO: 95285 - DNA, 30 bp, Homo sapiens
  chr6:24546740-24546770
  hypo
tcagtccttagaatacgattcttccttagc

SEQ ID NO: 95286 - DNA, 30 bp, Homo sapiens
  chr6:24602615-24602645
  hypo
ggccacatgccaggccggaagtggatggca

SEQ ID NO: 95287 - DNA, 29 bp, Homo sapiens
  chr6:24647342-24647371
  hypo
aaaaccagctgggtgcggtggctcacgcc

SEQ ID NO: 95288 - DNA, 110 bp, Homo sapiens
  chr6:24761445-24761555
  hypo
agctctccaaaaccccgctaggagatcagagctggcaccaggagcagaaaggccgggcagcgagagcagacacccccgagcctgcagggatggggcggggccaagggggg

SEQ ID NO: 95289 - DNA, 30 bp, Homo sapiens
  chr6:2510157-2510187
  hypo
ccacctgcgctctgtcgttcgccgcctgag

SEQ ID NO: 95290 - DNA, 150 bp, Homo sapiens
  chr6:25218431-25218581
  hypo
ggaacatgcagggggcggcctgagaatccagaacatgtcctgctccccaccacccccaccccactccctcccagggaggtagcggacgctggagcttcttaggccagaagtccaggggcaggggcatggtgggggcgcctttctcacccc

SEQ ID NO: 95291 - DNA, 19 bp, Homo sapiens
  chr6:25311446-25311465
  hypo
tgaacgcataagtaccttt

SEQ ID NO: 95292 - DNA, 126 bp, Homo sapiens
  chr6:25652379-25652505
  hyper
gcgcgcagggcggggcggggacaggcgcgccaggagcggggcgggcttccagccgctggttttgctgagggctgagggacggctcagcgacgccacggccagcagcgctcgcgtcctccccagcaa

SEQ ID NO: 95293 - DNA, 103 bp, Homo sapiens
  chr6:25668982-25669085
  hypo
gctttcccatcatgtcgggtctcttagaagtcctttcactttcttgcgatctatgctatgtaattaaaagttattggccgggcgcagtggctcacgcctgtaa

SEQ ID NO: 95294 - DNA, 30 bp, Homo sapiens; identical to SEQ ID NO: 40768
  chr6:25710967-25710997
  hypo

SEQ ID NO: 95295 - DNA, 116 bp, Homo sapiens
  chr6:25727275-25727391
  hypo
taaagcaggtccatccggacactggcatctcttcgaaagctatgagcattatgaattccttcgtcactgatatctttgagcgtatagcgagcgaggcatcacgtttggctcactac

SEQ ID NO: 95296 - DNA, 146 bp, Homo sapiens
  chr6:25727916-25728062
  hypo
aaatcagctgtgggccgagggtagacgaactagttgcagcaagacaatccttgctaggcaccgtgactcgcctgtaatcccagcacttgcagaggtcgaggctggcggttcatgaggttaagagacggagaccatcttggccaaca

SEQ ID NO: 95297 - DNA, 30 bp, Homo sapiens
  chr6:26018763-26018793
  hypo
agcacacgcaatcagcgcaccatgacatgg

SEQ ID NO: 95298 - DNA, 384 bp, Homo sapiens
  chr6:26020891-26021275
  hyper
actgaactgcttattcgtaaactacctttccagcgcctggtgcgcgagattgcgcaggactttaaaacagacctgcgtttccagagctccgctgtgatggctctgcaggaggcgtgcgaggcctacttggtagggctatttgaggacactaacctgtgcgccatccacgccaagcgcgtcactatcatgcccaaggacatccagctcgcccgccgcatccgcggagagagggcgtgattactgtggtctctctgacggtccaagcaaaggctcttttcagagccaccaccttttcaagtaaagtagctgtaagaaaccaatttaagacaaaagggaatgcattgggagcacttttcgttttaatgctactgaaggcttcaaaac

SEQ ID NO: 95299 - DNA, 472 bp, Homo sapiens
  chr6:26021706-26022178
  hyper
ccaccctcccccaatcgctgctcccgccatttcctggggcttggaggaggggttaaaggagcggactgtaggcgtcacatttcccgcctgcgcgcttttcagtctcagtgtccgctggaggtgggggcaggggtaacgtagatatataaagatcggtttcctattctctcacttgctcttggttcacttcttgggaagtcatgtctggacgtggtaagggcgggaagggtttgggtaaggggggtgccaagcgccaccgcaaggtgttgcgtgacaacatccagggcatcaccaagccggccatccggcgtctggcccggcgtggcggtgtgaagcggatctctggtctgatctacgaggagactcgcggggtgctcaaggtgtttttggagaacgtgatccgtgacgctgtcacctatacggagcacgccaagcgcaagacagtcactgccatggacgtggtctacgcgct

SEQ ID NO: 95300 - DNA, 30 bp, Homo sapiens
  chr6:26028765-26028795
  hypo
tcaactctccatacacgcttctcactgttg

SEQ ID NO: 95301 - DNA, 464 bp, Homo sapiens
  chr6:26033744-26034208
  hyper
gagtcttagccttggcgcgagctttaccgccttgtttgccgcgaccagacataactacttctgataagggaaaatcgccacaagaaaatgtaatgaaactacattagaacgcaaggcagagaagtatttatactgactggaggtaggctgtgaggaattctcccattggctaatgtcaaatacccaatgggaaatcagaatctgcatccttcatttgcatgtaatccttccgtctggtgtaaggtttatgtttgacccaatccccagtctggcttgacgagccttcgacttgaatactaataataattggccgaattaggattttgtcaaaataccttttttaagcatgagtggaggttttgttctggttattttgactttcagccgctcgtgcttttcccggattgtgactcatgtttttggaaaggagtggactccgaccaatttctaaatagatatttaag

SEQ ID NO: 95302 - DNA, 30 bp, Homo sapiens
  chr6:26034546-26034576
  hyper
gggagggaagaaaagcgaataccccaaatc

SEQ ID NO: 95303 - DNA, 41 bp, Homo sapiens
  chr6:26047700-26047741
  hypo
gcccggcctccttgaagccattcttacgtcagattggctgg

SEQ ID NO: 95304 - DNA, 27 bp, Homo sapiens
  chr6:26053446-26053473
  hypo
cgtgagccaccgcgcccagcctttttt

SEQ ID NO: 95305 - DNA, 43 bp, Homo sapiens
  chr6:26067205-26067248
  hypo
tggcctctgaagagtcgctgaaaaccaccgacaagaggaagat

SEQ ID NO: 95306 - DNA, 161 bp, Homo sapiens
  chr6:26087615-26087776
  hyper
gccccccaaaagaagcggagatttaacggggacgtgcggccagagctggggaaatgggcccgcgagccaggccggcgcttctcctcctgatgcttttgcagaccgcggtcctgcaggggcgcttgctgcgtgagtccgagggctgcgggcgaactaggggc

SEQ ID NO: 95307 - DNA, 208 bp, Homo sapiens
  chr6:26087777-26087985
  hyper
cggcgggggtggaaaaatcgaaactagctttttctttgcgcttgggagtttgctaactttggaggacctgctcaaccctatccgcaagcccctctccctactttctgcgtccagaccccgtgagggagtgcctaccactgaactgcagataggggtccctcgccccaggacctgccccctcccccggctgtcccggctctgcggagtg

SEQ ID NO: 95308 - DNA, 88 bp, Homo sapiens; identical to SEQ ID NO: 30339
  chr6:26088186-26088274
  hyper

SEQ ID NO: 95309 - DNA, 152 bp, Homo sapiens; identical to SEQ ID NO: 30340
  chr6:26172018-26172170
  hyper

SEQ ID NO: 95310 - DNA, 103 bp, Homo sapiens
  chr6:26172268-26172371
  hyper
cgtcggcccggcgcgcgcgtccgggaggttgcccgtaggccgctaactggtggttcccagtccccgccgactcggcctctttcttctgcggccaccagatcgc

SEQ ID NO: 95311 - DNA, 95 bp, Homo sapiens
  chr6:26184021-26184116
  hyper
gcatgcctgagccagcgaaatccgctcccgccccgaagaagggctccaagaaggccgtgaccaaggcgcagaagaaggacggcaagaagcgcaag

SEQ ID NO: 95312 - DNA, 35 bp, Homo sapiens
  chr6:26184356-26184391
  hyper
gtgtcagagggcaccaaggccgttaccaagtacac

SEQ ID NO: 95313 - DNA, 481 bp, Homo sapiens
  chr6:26188753-26189234
  hyper
cgccattgattactccagcatgggcgacacagcaagagtgaaaataaactttaatacactatcctcaccggccagtaagatatgaagccaaggcgtaataagaccatttaacttgaaaaccggagctactaaacacgtgaaactacacttttagcagtgactactactctttctcctgagtggataggtggccctgaaaagggccgttggttttgcggtagtgtactgtagaggtaagctcagccgccgaagccataaagagtgcgtccctggcgcttgagcgcgtacaccacgtccatggctgtgactgtcttgcgtttggcgtgttccgtgtaggtgacagcatcgcggattacattttccaggaaaactttcagcactccgcgagtttcctcataaatgaggccagaaatacgcttgacgccgccgcggcgagccaggcggcggatagcgggcttggtgattccttggatattgtcac

SEQ ID NO: 95314 - DNA, 209 bp, Homo sapiens
  chr6:26189235-26189444
  hyper
caataccttacggtgacgcttggcgccacccttacctagaccctttccgcccttaccgcggccagacatcttgaaaccacagctgttaaatctgtaacgcaatacgtctggcagagccacgcagcacttttataatagcatgacggacctgtttgaaaacctcatgagaaggggcgggaaccacagtcagttcccgcccttctgtgcaa

SEQ ID NO: 95315 - DNA, 248 bp, Homo sapiens
  chr6:26197272-26197520
  hyper
tggaatggcagtttgcgaatcagcagctcggtcgacttctggtagcggcggatctcgcgcagagccaccgtgccgggccggtaacggtggggcttcttcacgccgccggtggctggagcgctctttcgagcagccttggtggccagctgcttgcgtggcgctttcccacccgtggacttgcgagcagtctgcttggtacgagccattgcgaacttctaaaccctgctaaatgacgaaaaaacgaaagt

SEQ ID NO: 95316 - DNA, 25 bp, Homo sapiens
  chr6:26198574-26198599
  hyper
gttttgagacagtctcgctctgtcg

SEQ ID NO: 95317 - DNA, 85 bp, Homo sapiens; identical to SEQ ID NO: 30346
  chr6:26198839-26198924
  hyper

SEQ ID NO: 95318 - DNA, 696 bp, Homo sapiens
  chr6:26199182-26199878
  hyper
acttgtttagctcctcgtcgttgcggatggccagctgcaggtgtcgggggatgatgcgggtcttcttgttgtcgcgggcggcgttgcccgccagctccaggatctcggcggtcaggtactccaacaccgccgccagatacactggcgcgccggccccgactcgctcggagtagttgcccttgcggagcaagcggtgtacgcggcccacagggaactggagtccggcccgcgaagagcgggtcttagccttagctcgggcctttccgccttgcttgccgcgtccggacattttgaattcttaaaaacgatgttaagcaatgaagacaaaaatgtaaaagtgaattttgttagcaagtgagaaactattatacttggaggtcgaattgtaaataacgctatttgattggctagaacaaccaaccaattgcaaagaaacgctagaatcacctaatttgcataccacagggcacacagagacaattcatccaatcaatgtgtaagcttttaaatgccagtttacgataggagctctacaaatattaccagctgcagagtgaggacacttgcatttctctttaggttgtggacgaagtgtttatttatcatgcctgaacctgctaagtccgctcctgctccaaaaaagggctccaaaaaggcggtgaccaaggcgcagaagaaggatggtaagaagcgcaa

SEQ ID NO: 95319 - DNA, 36 bp, Homo sapiens
  chr6:26200118-26200154
  hyper
cgtgtcagagggcaccaaggccgtcaccaagtacac

SEQ ID NO: 95320 - DNA, 613 bp, Homo sapiens; identical to SEQ ID NO: 30350
  chr6:26204685-26205298
  hyper

SEQ ID NO: 95321 - DNA, 210 bp, Homo sapiens; identical to SEQ ID NO: 30351
  chr6:26205502-26205712
  hyper

SEQ ID NO: 95322 - DNA, 36 bp, Homo sapiens; identical to SEQ ID NO: 40772
  chr6:26214612-26214648
  hypo

SEQ ID NO: 95323 - DNA, 223 bp, Homo sapiens
  chr6:26216047-26216270
  hyper
gaaagcctcatgcatcgacctcccaaagtgctaggattacaggatcttgccaacacagaacaggagtatctcctgatcaattttttttgagacgaagcctcgcctttgtcgcccaggctagaatgcaaaagcgccatgtcttttcactgcaacctttgcttgctgggtttaagtgattctcctgcggcagcctcccgagtctctgggatgacacgcgactgcc

SEQ ID NO: 95324 - DNA, 300 bp, Homo sapiens
  chr6:26216390-26216690
  hyper
attccctagaaaacggtgaaattcaatattaaagctctttatgtgagacttgagtggctctgaaaagagcctttgagttttaaagcacctaagcacacatttacttggagcttgtatacttggtgacagccttggtaccttcggacactgcgtgcttggccagctctccgggaagcagcagacgcacggcggtctggatctccctggaggtaatggtcgagcgcttgttgtagtgggccagacgggaagcctcgcctgcgatgcgttcgaagatgtcgttaacgaaggaattcatgatgc

SEQ ID NO: 95325 - DNA, 43 bp, Homo sapiens
  chr6:26216810-26216853
  hyper
tggtcacagccttcttggaacccttcttcggagcaggagctga

SEQ ID NO: 95326 - DNA, 80 bp, Homo sapiens
  chr6:26217076-26217156
  hyper
taaccaatcaaattgcgcctttcacaattctaccgatgactataactagcttcttattcctccatcgagcccattctttt

SEQ ID NO: 95327 - DNA, 213 bp, Homo sapiens
  chr6:26217365-26217578
  hyper
tgctggaatatctgacggccgagatcttagagctagctggcaacgcggctcgcgacaataagaagacccgcatcatcccgcgccacctgcagctagccatccgcaacgacgaggagctaaataagcttctaggtcgcgtgaccatcgcgcagggcggtgtcctgcccaacatccaggccgtattgctgcctaagaagacggagagccaccata

SEQ ID NO: 95328 - DNA, 39 bp, Homo sapiens
  chr6:26226763-26226802
  hypo
catgagccacctcgcccggccttccggctgatatcttaa

SEQ ID NO: 95329 - DNA, 1358 bp, Homo sapiens
  chr6:26233978-26235336
  hyper
gttggccattctcaacgaccagctgcacaagatcgtgggccggaagcaccttgggcatgccacgtactgctcacaaccaggacgggatgtgctcaggaagtcacctcaacgctaaagtaaactaaagcatttacaccacatccctgtgtcagaaataaaattttttcagggccacttttaagcgccgcgctttaacagaaatcggccggccaatcacacaccaccgcgggaatttgaagaaaaagtaggacctggtggctcaagtagccttagctatccggtgactgtggctgagactgagacggaaggatccttgcgcccaggctgctgggagctgttaataactgacccccaaccagcacgactaggatagaccgtggccgcacaacaccgcagcacccgcacccctctccaccccactcccccctccaaaaagcttcagctcttttgactgagacctgtgggtggctctgaaaagagccgtttaaaattttcaaaggggaacgtcccgccagtttcactttttcttcggagctgccttctttgcctttgtaaccttcggcttccccgacttaggcttggccgccttgggcttaggggctttggccttagctggactcttggcagctttttttggctgaggtgttttcacctttttcgcactcttggccactttcttggtcccagcagcggttgctggcttctttaccttcttaggagtctttttgatgcttttcttcggggtagcggcgccagccaccttcttgggcttcttggctgccccagcaggcttcctaggcttggctgcgccagcctttttggccttgggtttgccttccccggaagccgctttcttgttgagtttgaaggagccagaagcaccggtacctttggtctgcaccagagtacctttgctcaccaagctcttgaggccaagcttgatacggctgttgtttttttctacatcgtagccagcagccgcaagcgctttcttaagcgcggccagagaaacgccgctgcgctccttagaagctgccactgccttggtgataagctcagatactgggggtccggatgctttgcgtttcccagcagttgcgcctgccttcttcgcctttttcttcacaggtgttttttctgcgggtgcaggaatggtaggagcaagtggagcagtctccgacatgtttttgtcttcccagaaaagacaataagtaatctcaaactgtcagaacagcatgtcctctacgagggaggctgagggtttatatagagagacgctgagtgatgattggttccttgctccatgcgcggcgctgctggaaaaggactcctcgtatctaccgcgctgctgtgtttgt

SEQ ID NO: 95330 - DNA, 636 bp, Homo sapiens
  chr6:26240633-26241269
  hyper
gttgttgtttgtcttcgatcatgtctggtagaggcaaaggtggtaaaggtttaggaaagggaggcgccaagcgccatcgcaaagtgctgcgtgacaacatacagggcatcacgaagcccgccatccgtcgcttggcccgacgcggcggcgtgaaacgcatttcgggcctcatttatgaggagacccgcggtgttcttaaggtgttcctggagaatgtgatacgggacgccgtaacctacacggagcacgccaagcgtaagacagtcactgcaatggatgttgtctacgcgctcaagcgccagggacgcactctgtacggctttggtggctgagcctcaccccggctttttatttaacagctcacccataaaaggcccttttcagggccacctccttcgtcacacgaagggctgtaactgatgacgacttgggtttcgttttgtaaatttgggattctaactgagttaaaccgagccgtttttagcgatcttcctaagatggcggatgtgctaaggagaaagggaaggcgaaacattagaaacttgttcaggtatttcgatcgcaaacattcacaggaaaagatggtggaaatggtttgggaataccagcagccttttatgacgtatgtgatgtgtt

SEQ ID NO: 95331 - DNA, 41 bp, Homo sapiens; identical to SEQ ID NO: 30359
  chr6:26249960-26250001
  hyper

SEQ ID NO: 95332 - DNA, 504 bp, Homo sapiens; identical to SEQ ID NO: 30360
  chr6:26250181-26250685
  hyper

SEQ ID NO: 95333 - DNA, 496 bp, Homo sapiens; identical to SEQ ID NO: 30361
  chr6:26250686-26251182
  hyper

SEQ ID NO: 95334 - DNA, 400 bp, Homo sapiens; identical to SEQ ID NO: 30362
  chr6:26251540-26251940
  hyper

SEQ ID NO: 95335 - DNA, 39 bp, Homo sapiens; identical to SEQ ID NO: 30363
  chr6:26252060-26252099
  hyper

SEQ ID NO: 95336 - DNA, 40 bp, Homo sapiens; identical to SEQ ID NO: 30364
  chr6:26252140-26252180
  hyper

SEQ ID NO: 95337 - DNA, 39 bp, Homo sapiens; identical to SEQ ID NO: 30365
  chr6:26252240-26252279
  hyper

SEQ ID NO: 95338 - DNA, 470 bp, Homo sapiens
  chr6:26271346-26271816
  hyper
gcggaactctgaaagcgcagatctgtcttgaagtcctgagcgatttctcgcaccaggcgttggaaaggcaacttgcggatcagcagctcagtcgacttctgatagcggcgaatctcgcgcagagccacggtgccgggacggtagcgatgaggtttcttcacgccgccggtggccggcgcgcttttccgagccgccttagtggccagctgcttgcgcggcgctttgccaccggtggacttgcgtgcagtctgcttggtgcgggccatctcagactacctgaaagaaaaactcagccacttggcagagtggaaactgcccttatatatactcagaaacattctaattggccttgttgattttcaaaagacccgcgcaacaaaaccattggctgaagagtccaacgatgtgattggtgaattactggaaaatctgattggatgaatcacttcatttttgaatcctctcttctc

SEQ ID NO: 95339 - DNA, 288 bp, Homo sapiens
  chr6:26271817-26272105
  hyper
gttagtctgcgatccaagaacgttaacttcttaaagttctaattctgcgcttctcaagctgtagtccgtaaacgactactttaagacttggaagacgctaattctcattcagtagatgtgttgtggggccagattcggaggaccacgttttgagaagtttatcttgtgccgttttcttgagtcacctggactgctgctagctggaaacctttgaccattataaggcaggattcctgggtgatgtacctgggaaatcacgagccaagaagtcaccgacatacaacagtg

SEQ ID NO: 95340 - DNA, 422 bp, Homo sapiens; identical to SEQ ID NO: 30369
  chr6:26272431-26272853
  hyper

SEQ ID NO: 95341 - DNA, 205 bp, Homo sapiens
  chr6:26273080-26273285
  hyper
gaaccaatgagaaaccgaaactcagccagcctcatttgcatatacacgaggtaaataatgagggcgtttgggctcaccagcattttcctgtggtcatttgacggtatcacttcggctgcgaacatgcctgaaccagctaagtcagctcccgccccgaagaagggctccaagaaggcggtgaccaaggcacagaagaaggatggca

SEQ ID NO: 95342 - DNA, 74 bp, Homo sapiens
  chr6:26273345-26273419
  hyper
aggtccaccccgacaccggcatctcgtccaaggctatggggattatgaactccttcgtcaacgacattttcgag

SEQ ID NO: 95343 - DNA, 251 bp, Homo sapiens
  chr6:26273514-26273765
  hyper
cggggagctggccaaacacgcggtgtcggagggcaccaaggcggtcaccaagtacaccagctccaagtaaactagttacctgggtaaaagcgctaacgacccaaaggctcttctaagagccacccatgttgtcatttaaagatctgtaattttccagacttggcattggcaaggtaaaatggctaagcaacacatgggatagtaagggtttactgaaacatccaagttcggccgggcgcagtggctcacgc

SEQ ID NO: 95344 - DNA, 89 bp, Homo sapiens
  chr6:26283423-26283512
  hypo
cctcctccctccacacgtctttagcctgtttcagtgatagcacttagcaccatctgatagtttcacttactttgcgtgtgaaagcacac

SEQ ID NO: 95345 - DNA, 49 bp, Homo sapiens
  chr6:26284880-26284929
  hyper
ctgcgatcctactcacgcagatgtgttgcgctcacggattcgccttggt

SEQ ID NO: 95346 - DNA, 30 bp, Homo sapiens
  chr6:26313515-26313545
  hyper
taaatgatttgttgtcgtttgccaaattat

SEQ ID NO: 95347 - DNA, 120 bp, Homo sapiens; identical to SEQ ID NO: 30372
  chr6:26322568-26322688
  hyper

SEQ ID NO: 95348 - DNA, 157 bp, Homo sapiens; identical to SEQ ID NO: 537
  chr6:26327825-26327982
  hyper

SEQ ID NO: 95349 - DNA, 122 bp, Homo sapiens
  chr6:26328294-26328416
  hyper
tcatgtataggaggacgcggtaatcccaaaacgtttttttctataggtataacgcctgtcttcgttcgtcagagggccagtggcgcaatggataacgcgtctgactacggatcagaagattc

SEQ ID NO: 95350 - DNA, 108 bp, Homo sapiens; identical to SEQ ID NO: 30375
  chr6:26331703-26331811
  hyper

SEQ ID NO: 95351 - DNA, 149 bp, Homo sapiens
  chr6:26332134-26332283
  hyper
ggtgagttttaaattcgtttccaaagttcactgcaggtcacaaccagtgtttccgttaacgaattcacgcgggggctggcaggttgtttgtgctgcatcttttctgagagataacggcgcctccctgtagcctccgttctcagctgatg

SEQ ID NO: 95352 - DNA, 119 bp, Homo sapiens
  chr6:26501722-26501841
  hyper
gagcgcggggcactgcgctttggcgggaatctggtcggtgtctgtccgtagttcccatctccacatcccgtctgatcccgctcgtttttcggcagctccctttgacgtgattggacccc

SEQ ID NO: 95353 - DNA, 260 bp, Homo sapiens
  chr6:26501949-26502209
  hyper
cgccggccgtgctggtgcatagggacgggcgcgagcaggaagccgagcagatgcccgagtaccgcgggcgggcgacgctggtccaggacggcatcgccaaggggcgcgtggccttgaggatccgtggcgtcagagtctctgacgacggggagtacacgtgctttttcagggaggatggaagctacgaagaagccctggtgcatctgaaggtggctggtgagtagacgggttttgactttctccgacgactcccctgctgt

SEQ ID NO: 95354 - DNA, 77 bp, Homo sapiens
  chr6:26534344-26534421
  hypo
ctttgcctatgtatgcgatggggggaacagtaaaaggtcacgccgactagagttttcatttttataaaaagatgcaa

SEQ ID NO: 95355 - DNA, 292 bp, Homo sapiens; identical to SEQ ID NO: 30378
  chr6:26550767-26551059
  hyper

SEQ ID NO: 95356 - DNA, 46 bp, Homo sapiens; identical to SEQ ID NO: 30379
  chr6:26551083-26551129
  hyper

SEQ ID NO: 95357 - DNA, 91 bp, Homo sapiens
  chr6:26555188-26555279
  hyper
aaacttactgggcctcgcctccagagacttttactcagatttgagaaggaacccagatttctgcgttttaaacaaacgccacagctgtttc

SEQ ID NO: 95358 - DNA, 344 bp, Homo sapiens
  chr6:26577131-26577475
  hyper
tacacagaatacttccggtgtatgagaatactgctttaaagccgatcgtagtttaaaaaatgagcattaatataattaattaaaaccaaatctcctaaatggaacaagacttaaaaacccagaaacttccaggacgcacattattttggggattctagagaacgcagaactacgtgtctaaaaaggacagcgttccgtgtccttcgatagctcagttggtagagcggaggactgtaggctcattaagcaaggtatccttaggtcgctggttcgaatccggctcggaggacggtagttttgacctaccaagctaataattccagacaatacggtctttacaaaaa

SEQ ID NO: 95359 - DNA, 168 bp, Homo sapiens
  chr6:26577722-26577890
  hyper
tggctcttggtttctcgatgccattcttatttccggctactgatcgtcaaatgcagtttttattcccacttcccctctccatccccgacccgagctgacgttcgaccagcaaaccacagccaacgcccgcaacacagttcagttaagaaggcgcgtgggaggtgtggg

SEQ ID NO: 95360 - DNA, 81 bp, Homo sapiens
  chr6:2684354-2684435
  hypo
ctgcactactcttgtgtcttggggccattatgaagtcaaatgatagttccgtgaacacaagcatggcgatgcctccacagt

SEQ ID NO: 95361 - DNA, 41 bp, Homo sapiens
  chr6:26988028-26988069
  hyper
gcgcgcccgaggaaccggtgctgtgacgaccagagcaaaca

SEQ ID NO: 95362 - DNA, 213 bp, Homo sapiens; identical to SEQ ID NO: 30382
  chr6:27059686-27059899
  hyper

SEQ ID NO: 95363 - DNA, 141 bp, Homo sapiens; identical to SEQ ID NO: 30383
  chr6:27064628-27064769
  hyper

SEQ ID NO: 95364 - DNA, 233 bp, Homo sapiens; identical to SEQ ID NO: 2787
  chr6:27064770-27065003
  hyper

SEQ ID NO: 95365 - DNA, 312 bp, Homo sapiens
  chr6:27065004-27065316
  hyper
tttcctaagtcttgtaaggccgcctgtgggttcctattacaaactctgaaataaaatactcgggaaacgtgggttatcaagacgaggtggccgagtggttaaggcgatggactgctaatccattgtgctctgcacgcgtgggttcgaatcccaccctcgtcgggggaggtcttttaatacgaagaggaggaaacaacacccaagtccagccaacttccctttcaactctcctggaattcaggtccctggcgttggagaggaaaaaggagctcttgtaattttgtatcatcagtataacgatggtgttgctgg

SEQ ID NO: 95366 - DNA, 138 bp, Homo sapiens
  chr6:27094912-27095050
  hyper
ctacattagcctatccgttattgccataagatggcgacagcccttctcaactcataaaactaaacaaagttttagctacattatcccatccattatcgccacaagatggcgatagcgcttctcaactcgcctgcggga

SEQ ID NO: 95367 - DNA, 104 bp, Homo sapiens
  chr6:27095107-27095211
  hyper
cgcagcgcttcctgacgttccgttagttcagtctcctgaacttctctgcatgtagattcctctcagggtagccctttgttgaccaaaaacgaaatatgttcact

SEQ ID NO: 95368 - DNA, 68 bp, Homo sapiens
  chr6:2709559-2709627
  hypo
attagcttgccttcccgttgtttcagtttctgtcagtggtgccatgagacttgcgtcttacttgtgga

SEQ ID NO: 95369 - DNA, 110 bp, Homo sapiens
  chr6:27099764-27099874
  hyper
gatgcagaggaagggcgggcgttgcccgggcaaattcaaactgacaaccgctgcaacttggcactgttccaaatcactaaccgacgggggaccgacgagtattttaattg

SEQ ID NO: 95370 - DNA, 98 bp, Homo sapiens
  chr6:27100291-27100389
  hyper
gggaagcctcacctgcgatgcgctcgaaaatgtcgttcacaaacgaattcatgatgcccatggccttggacgaaatgccggtgtcagggtggacctgc

SEQ ID NO: 95371 - DNA, 600 bp, Homo sapiens
  chr6:27100449-27101049
  hyper
ccgtctttcttctgcgccttagtcaccgccttcttggagccctttttcggggcgggagcagacttcgctggctctggcatagcactgtgtagctataaagcgccaacgaaaaggaaaaacagcgtgagcagggtatgacaaggcgcttttatatagaatcgcttatgcaaataaggtgaagagttgaagtcttgtgtctgattggtagttattcagggtaacgtcagaggtcaggtctgcccaatcaggattcgcaaatccagaagacgcactactattggttgaaattaaactgcagccctaaccaacaacacgtcttctttttcgcgcccaatagtgtttataaaaagcgccgcctttcccgttcactttgtggttgctcgtagtgagttgcgctcgctatgtctggacgtggcaagcagggaggcaaagcccgcgctaaggccaagactcgctcttctagggccggtctccagttccccgtgggccgagtgcaccgcctgctccgcaaaggcaactatgccgagcgggtcggggccggcgcgccggtgtatctggcagcggtgctggagtacctgaccgccgagatcctggaactgg

SEQ ID NO: 95372 - DNA, 97 bp, Homo sapiens
  chr6:27101109-27101206
  hyper
ccatccgcaacgacgaggagctcaacaagctgctgggcaaagtcaccatcgcacagggcggtgtcctgcccaacattcaggccgtgctactgcccaa

SEQ ID NO: 95373 - DNA, 24 bp, Homo sapiens
  chr6:27102706-27102730
  hypo
ttaagaagacgttaactcattttt

SEQ ID NO: 95374 - DNA, 181 bp, Homo sapiens
  chr6:27173366-27173547
  hyper
ttcttgttacctgcccgaggtccttgtcagttcttaaggacaggtgctttgcattatcctccagcactctcccacccactgcaacattcccctctcaccatgcaggtggtaagtaaattttggttgaaaatatttatccagcaagagatgaattgcccggctaatgtcactgccggacgcc

SEQ ID NO: 95375 - DNA, 232 bp, Homo sapiens
  chr6:27173632-27173864
  hyper
cgtggcccggttcctttctcttacactcttccaaggaccccttttagacctagaggaaaccccgcagaagtgacagggagagggggaaagctcttttacagtggcgaaaccacgtggctgcgagagcttctcagggagagctcctgttttcaaagtctggcaaatttatcagtttgatttttcttaaacatttatatttttatggagtagaaaatctaccaaacgagtaaag

SEQ ID NO: 95376 - DNA, 257 bp, Homo sapiens
  chr6:27173924-27174181
  hyper
ctccactacggaaacaactgtgggaaagggttacccacatcccccccgcccccatccccaccccgccgcttaactaagagggctttgcctgaagggcctggactgccttatacgtctgtttagaaaatgatcgttgtggtgcagttctctccttttactgttttcgaaaagaaaagcaattcataaccaagcttccccagggctccaattcccgcacaaatttcaaacatggaaagctagaacggaatgctacagaa

SEQ ID NO: 95377 - DNA, 145 bp, Homo sapiens
  chr6:27182855-27183000
  hyper
cattaaaaaacaaaaacaaaaacaaaaagcgggtacatcaatgatagataatcgacagacgcagactgagtggccagtagtcaaaagcgcaaccgagggccagtggcgcaatggataacgcgtctgactacggatcagaagattc

SEQ ID NO: 95378 - DNA, 86 bp, Homo sapiens
  chr6:27203207-27203293
  hyper
aaagatataccctgacggaacggataaatttaaagttcattttaactaattcaaaactgaaaaacactctcactaagcgagtttcc

SEQ ID NO: 95379 - DNA, 27 bp, Homo sapiens
  chr6:27205332-27205359
  hyper
gaaggtgagaaccctcgtggcccgtac

SEQ ID NO: 95380 - DNA, 418 bp, Homo sapiens
  chr6:27205419-27205837
  hyper
ggccacccggaaaacagttgttctttcaattttaaaaaagcaaaatgtttgttgtttttgtgtttctttaacactaaaggaaattcttttcctctcctcaaagggatgtcttttaaaataattttaattgcgactacgtaatattgtttcttcaaacttctgttggtgttttgcattttcccttcctgcactcccgcagggaagaaggaaaacaaaaacaaaaacaaggacaaggccaaaaactctacctccagcagaaaggaacttcgcctctcccgtgggaaatgagattttctcaaactcacctattccgcccggagaaaatactacagagaaccattcacgagaggggcttccttccttttgaccttgggaggggtccagagacccgggggacgatctgggagcagaagctggt

SEQ ID NO: 95381 - DNA, 373 bp, Homo sapiens
  chr6:27205913-27206286
  hyper
cggcatgaggaatccgctccataatggaaggaagaaaatctccggcagctatgcctcgcgggttcataaggactggagagttactccttctctctggccccctcaaaacgcccggtggtatgtctgttgctccactacgcgttattataattaactgcttgtgttactctttgtgctgtcttgctcttcattctcctggtacctcgggtgcccgcacagcatggtaagctgctcaatagttcaatgaatggggaaaaggtgtgcagaggtcatttctgctgattatcaagacttcaattcttcgaagtggagcacgaggatcctctaggcggcaggcaaatgtcatcaggagtctcaacgtcttccccccaaa

SEQ ID NO: 95382 - DNA, 10 bp, Homo sapiens
  chr6:27206493-27206503
  hyper
gtccgggcgc

SEQ ID NO: 95383 - DNA, 47 bp, Homo sapiens
  chr6:27206504-27206551
  hyper
gctacggttcctggtacacattcgctgcgcctcgggcagcctaaggg

SEQ ID NO: 95384 - DNA, 61 bp, Homo sapiens
  chr6:27219595-27219656
  hyper
aagcagcattgcggacggagctgagcgcttgcgggcccctgggccgcgctgaaaaccaggc

SEQ ID NO: 95385 - DNA, 15 bp, Homo sapiens
  chr6:27228172-27228187
  hyper
gaagagcccacctgc

SEQ ID NO: 95386 - DNA, 170 bp, Homo sapiens; identical to SEQ ID NO: 540
  chr6:27228289-27228459
  hyper

SEQ ID NO: 95387 - DNA, 280 bp, Homo sapiens
  chr6:27228667-27228947
  hyper
atcctttgcatatagcgaaggggccacaattctcgtcccgccggccggttagctcggttgcttagagtgttgtgttaattacgctaaaggtcgtgggtttgatcctcttaccggccacatgaggagaattagttctttaccacttttgttgatcacatctcctgtgaattctgcttccagtttctccgaaagtaagctctatatcgccactactgaactggaaacacagtctttcaaaagaagaaatgtgggcgagggcggtggctcacgcccgtaatcc

SEQ ID NO: 95388 - DNA, 245 bp, Homo sapiens
  chr6:27242878-27243123
  hyper
tcactggctgaaaaccgacgatttgcatcgttaattatccgtagcccttcgctggctgaaaaccgacgagtttctgcagaactgccataaaaaactactggggaaaatacgtggccagtacggggatcgaacccgcgaccttggcgttattagcaccacgctctaaccaactgagctaaccagccgacgctgggtgcagctcttccccccccaccccccgcccttaatctcgacactcatccttt

SEQ ID NO: 95389 - DNA, 522 bp, Homo sapiens
  chr6:27247546-27248068
  hyper
gatgatcccatggagcgaggcttacgagcagcgagtgagcgactggagcccagcctgcacctggaggggcggttctggcccagtgctcccggaaagggtggctttcggcaaagtctcggcctcgccttgaccctccaggaaaaatgttcctgagcggaaagatcgttcaagttgcctgcgaaccaagtccttgaggtctttgtggggatcaggcgatgagagcatcaattataataataataatttgttcggcaaaaaattgctcgggtctgttcatgtccacccgagtagccacggacacttggctttgaagagggctttttccttgtcgaaaacaggaagggctctggtgggagaaaggcggcaggtgtacttcggtttatatgcacaccacaggtgacaaggagaaccttctctcctaaacggctaaagatggtgcgggggtgcaattctaaaaacgtgcactgagaaattcagctaaggattcctcaaaaatacaggttgcttctgcccggtttcgaa

SEQ ID NO: 95390 - DNA, 24 bp, Homo sapiens
  chr6:27249182-27249206
  hyper
gattgcaggcgtgagcaacggcgc

SEQ ID NO: 95391 - DNA, 510 bp, Homo sapiens
  chr6:27255937-27256447
  hyper
cactctgctttccttcgccgcggttgcggccgcgaccctgttcttaccaccagcaattcctccagggacttggtcagcagcccaacttgatctgcgtctctctgctaaggtgtttccgcaacagggtcaactccaagtctcacctttctaggaatcccgggcgcagcgcgggggtcgggactccgacctgtatttccaggcggaggtttccctgggtcaggcggccactctctgccagagattgtcagttatccaactgtcaatagagccgccgctccagcgagtttaatttaggcacagaaaagtcctgcctgggttgaggtgggcttaggatgagtttacttgagtgtgtgatttagaaatagatctatgggacagacagacacgaaatcgggcattggggccctcgcaggcagggtatctagactggcagctgccggtgcaggatattgccaaggactcggcatccggctcagctcaaggtggggacgaagacgtcctggttgcaag

SEQ ID NO: 95392 - DNA, 329 bp, Homo sapiens
  chr6:27258095-27258424
  hyper
tttatccataaacatcgacaacaacgaaatcacactcttctgaattcctgcctctgccccgtgaaaacaaaaaaaaaagaaaaaaaaatcaacgtccacagtaacaagcctcgcatctgaggggaaattttcttaaattctccagtcacgtctgaaaaaaaaaagttttaatggaggactttgtagtaaagaaaagcatggtaaccttgataatttactgaaaggaaaggccaatcaactcgatgttaccaaagctgaaacagaaaaatttaattctcccttaacgaaggaagccaacgcagcacacaggtttccgtggtgtagtggtt

SEQ ID NO: 95393 - DNA, 30 bp, Homo sapiens
  chr6:27264021-27264051
  hyper
ctttcttggcatttccgtctgggcatggac

SEQ ID NO: 95394 - DNA, 30 bp, Homo sapiens
  chr6:27264418-27264448
  hyper
tagataatatcttaccgtgacagaacaact

SEQ ID NO: 95395 - DNA, 1007 bp, Homo sapiens
  chr6:27279779-27280786
  hyper
ctcacaggtctataccgtggggcagggtgggcgcggtggacgaactgaacccgatgaacttggtgaaggggctgaggtggccggcgtttcgtgggcctctcgggcaagtcggtgcgcacctgggctggggacgagggcgaaagttccagtttgctcaggaaactgcccatgaggagagatgaggcgcgggcagtgagttcaagcacggttttggcttccgaggtttcggacgtctgcagaatcggacagagtcgaagagcgcagtgttcggttgacggttgggattcacgcgctaggaaagcgcgagtctcagggtgcttagcactctccaggcccggcacccgcgggaacgggggacacgcgggacttcggcagtcccagtaacttgctttgctgttctgagacctcagcggggcggtcagacctctgctgtctccgcagcgagttgcagtacttggcgcggggagaggaactcgagaggaagctcactgcgcctcgcccctggcgtcggcagcggctgtctgggaccctgtggtccggattcaccaagtggcgcagagctggaatcgagtgggtgcacagtttccaggctccgactattactggcctcgaaggtacaggctcaggcggctcagggccccggcgcagatctgtcggcccgcgggatccccggagtctgagtggggagcactatccgcaccccgtagagtgagtgcgggcggctttcgcaggtgctcaggactggagatctggaccggtggctgtgccgcccggatggcatttgtggcactagcagtcgggaaagcagctgattgaggatttccgcgtttctctttttttgcagatcgtgacgccgccagtaggtgtcagtcatttgccgcacagccacctttgagatccacctgtgtctcccagcggccgaatccaggtttccttcctattcgcacttggagaactcatgcagattgccgtcaggagtggcctcagagatccggagtgggcgaatg

SEQ ID NO: 95396 - DNA, 166 bp, Homo sapiens
  chr6:27301031-27301197
  hyper
caacctgccaaagatcgtctgagcctcttagcaagcactcgtttatcatagcgagcctaggaggagggcgccaagcaaaacactaggtgtagtcttctcgagtagaatccaggcagtcgtggagcgaacgcagctgccaccggagaggaatcgtgttaacagtctt

SEQ ID NO: 95397 - DNA, 578 bp, Homo sapiens
  chr6:27342451-27343029
  hyper
ccagtttgtggctctcggagagttcgcctcgtccctccctctcagataaccacctatttctgacctctggaggccgggctgagcccggaattttatgaccagcgcccgctggccgtcgtcaccctctaatttctcgcaaaactcccggggacccttcttaatgtcagtagccacagtcgccgccgctcctgcgcctagaagccttccacgaccctcaaccccacagagccccgagcaggctcgggttcccgcaggatacactgcccgcccagtggcctggagggcgcgtcccgggctcccctacgccttttggaatcagcgacagacgcaggtataaaagagagcctccactcccacctctccagggctccccacccgctccttctggccgctttctcctgaaagagcaaggcacccctagaagcttcaggctcctccacaggcgagtgcctacccacctatcaggtaagacgtgcaactgacactcagcgcgcggaggagcccgctgagaaagggtttacctgtccgaagagaactgcgcttgcatggctctggctgtgggccggctggctcttgtc

SEQ ID NO: 95398 - DNA, 30 bp, Homo sapiens
  chr6:27356433-27356463
  hyper
ttgcaaaaccttccacgaaagtgaatccca

SEQ ID NO: 95399 - DNA, 395 bp, Homo sapiens
  chr6:27356685-27357080
  hyper
tgggcgttggagcagcggttcgacgcatgggtttctctttaatccttccgacttccccaagcccagcgcactcaggttccgctccaagtgcgggacccgcccggggtgtgtcgggggtactcggccggaggcggccggtgagtgaggcttacagggccccgggaccaaggtgggtgctcttagaggttctggaaagcggaaacacgggttcttcgaaggaaacgggcgaaagggtcgcgtgtggtttggctgcaggtcgggtcaggaggcacctccacggttgggacgccgcgtggcgtggggtcatgaagcccccagcgctcgtctcactggcgggccagcctagtccctctgcggcagtgacagccagtggttttccccgggtgtatccctgg

SEQ ID NO: 95400 - DNA, 72 bp, Homo sapiens; identical to SEQ ID NO: 40713
  chr6:2737187-2737259
  hypo

SEQ ID NO: 95401 - DNA, 21 bp, Homo sapiens
  chr6:27441925-27441946
  hypo
ccactgcgcccggccccaaca

SEQ ID NO: 95402 - DNA, 658 bp, Homo sapiens
  chr6:27463029-27463687
  hyper
ctaaatttagagcaacgcgggaagcccttgtgtcggccaaaactcaaaccagattctgagcctaaaagacttaatgtcacaacgaagggacacagaggagacttttccacataatttttcgctccctccacctaagacacaaatcagcggaagcgattccgtgcctggaatcccctacgaacaccgtcgttcaccgaggagctttgggctcctggaagtccgaacaccccggatcagaggagagttggccatgactccccgtcggtaccggctgggtttggtgccagctatggcgagtacagaagcctggccggtcccggggcaggcaggcgctcgctggatgttattcgactgactggatatttgctggaaacgttaatgcttgtgcgatgaggactctctctaattgcagggcgctcaattaccaaggatagcctgacttcctttcctagaattctcatttcaccttagcatttccaaaaaaactcaccaaagacagaagtttgcacacgtcacctgacacgtcatttcaccaatctatcaaagggtgaagttccacagctgtagtcgtggccgagtggttaaggcgatggactagaaatccattggggtctccccgcgcaggttcgaatcctgccgactacggggtggtttttgc

SEQ ID NO: 95403 - DNA, 240 bp, Homo sapiens
  chr6:27471362-27471602
  hyper
tgtcctgacagaccccgtcgttttggcttaggcggcagattaaagtgtaaattcgccaagtataatcaatttagtagaatacaaacttacagacttaaaaaagtgggcaagaatacttaagtttattagaggtagtcaaaactcgctgacgcagagttcttcctcgttagtatagtggtgagtatccccgcctgtcacgcgggagaccggggttcgattccccgacggggagaaaagttg

SEQ ID NO: 95404 - DNA, 30 bp, Homo sapiens
  chr6:27494670-27494700
  hypo
gtgagccaccctgcccggcctgccttttct

SEQ ID NO: 95405 - DNA, 492 bp, Homo sapiens
  chr6:27512392-27512884
  hyper
tcaaaggttacaaaccgtttctaacctaaattgaagatatagcaaatgccccagtaataagaccaaataatatttgcaagagtccaacgaagggaacacatttcttactattttagagggaaaaacaaatgtgggcgcgctttcactatcagagacattgccggcctcggtcatggaggtcactttccctttgtatctgcggggccgactcacttccattcccagaattccgagactttccccctaacttttgtctaaaaaggaatctgattcaagtctaccccttatttttccactctgacaatactgtagtatctgaagcaagaatcaaccttattaatttagctagatttatcctgacatttacttgtttccatctttttgcgtttttctgtgctggactctccctaagatatttggaaacctgtgttctgagttcttccttttccccgggctcgggtggctgaaggccttggctcttgggaatggtct

SEQ ID NO: 95406 - DNA, 712 bp, Homo sapiens
  chr6:27512994-27513706
  hyper
cgcccgctccagtccggttttagccgttccttcggaagagtaagtcagttgaatgtcatcgaagaagctcctgatttagattttaactgtacgtaaacgcagatgaccccccactctcgtgccttcatttaattcccgttgcttctcccatgggtattcagaggcttgaggttgcttggactctcaattcaatactccctttctgcgggttcgtgagaattaggtgtgaacgtggtgtccgcggatttcagcagctagcgggcaagctccagcgcccagaaactttgagtcgcttgtctaggagtcctgtgttgaattgcaacactatgcactatgttctggttattgatgtgctctgaatgagctctttcgttcgtgagcagaggccctgacgagactgaagaccaactatttccgagcgctccactcaaccattataagttcaccccagccgtcagcgatggcgtaggtaggtagtcgtggccgagtggttaaggcgatggacttgaaatccattggggtttccccgcgcaggttcgaatcctgccgactacggttttaccaggtgcagttcccgcctttcctcaaaacttacccaaattcttgtactccatttgctgctctcctacacaatcctcccactgcatattcagataatatcctctttactcagtgaatggagactaccttatgttgccgttacttcaaaact

SEQ ID NO: 95407 - DNA, 34 bp, Homo sapiens
  chr6:27526047-27526081
  hyper
ccaaccctccagtgacggtcgtatttgtttctgt

SEQ ID NO: 95408 - DNA, 30 bp, Homo sapiens
  chr6:27526284-27526314
  hyper
taacggagcaagtaccgctgggccacaccg

SEQ ID NO: 95409 - DNA, 604 bp, Homo sapiens
  chr6:27533773-27534377
  hyper
catcacattgattggcgtcaagaggggacatcagtcatatgggcctgttggcgctgtgaggcaacggtctcaagagtcctcgagagaaagagaggtgttgcccctccctggggacaacctgacactaggtgtggagccagtcgcggggatgggcgaccgccatggggccaggggcggaagtggggatagagcacagggtataaaagactcctgctacagctccccctctgctgtcgggtgcagacacgaggtagcctccaggtgacaacacgggtggtgagagccgccgcatgaatccacactgcggctgaaggtcaagaattggcggtagcccatcggtagcccagagacccaaactgtgtccgatgtgagtgaaggtcaccccagatcagtgcgtcagttccgttttggcggccaaatttctgacgatcccatgtaagaaatgccacacctgtcaataggagcgactcacgcgctgggtctctttctcggatcgggtcgccaccccagtgccgggactatgctaaagactagagtctcagacttggaatttcgaggaaggtgttccaaaacgctgcgctccctccggcgagggacaagagca

SEQ ID NO: 95410 - DNA, 58 bp, Homo sapiens
  chr6:27551225-27551283
  hyper
actgcttcgtctccccgtcggggaatcgaaccccggtctcccgcgtgacagacgggga

SEQ ID NO: 95411 - DNA, 138 bp, Homo sapiens
  chr6:27559855-27559993
  hyper
ttacaggggaaatgacgaagaaaatcgggctcagaatagagtgggaccccttcggtagtgaataatcccgcagctcattattgcgaacagcagcccttagagatcgtagctggctggtaaaggcggctttagagcgga

SEQ ID NO: 95412 - DNA, 34 bp, Homo sapiens
  chr6:27560276-27560310
  hyper
ataatatctttttcccggtcgcccaacctagtct

SEQ ID NO: 95413 - DNA, 175 bp, Homo sapiens
  chr6:27560710-27560885
  hyper
aacatctcctaacaccgctgtccagctgcgtcaatatttttttcttccttatccatttatcttctctagtctctgtctttcatcctcgagttgtctcacgtttccttctcaacatagtcacctacaacttgttgtttgctcctttgcaacttaagaaaaccgattgaaatccttt

SEQ ID NO: 95414 - DNA, 789 bp, Homo sapiens
  chr6:27572826-27573615
  hyper
taacagattattttacgtgtgcagaaaagcagtgaagattttagtcactgatcagttgactgatcagttgaacggctaaggaaaagaactgggtgttaccgtcgttgctagagcggtgtgagtttacgacagttgctggtcagatcaatgtccgactcccctttcagagagacagacgatatacaggaatctggaacattcctacagggctctctgagaacggagacctttttctcgtgccttttttcttttcttttctttttttgtttgtttaatttttatgttagcggattcacagaccaatagatggaaatccgctgcttactttctcgcaggagaaaatgatctccaacagtgctgcgggactgcgtccaaatggcactgaaaatatcccaggattctgtaaatgtggggttttcctttgtcgattggtttgatgtaagagagatgcctctctctttgcgagaccctgtttggcgaacatcggttggggagggaaatcttggaggtagaaacggctgaactattgtggcattccttggcgaaactttcggtacaaatctggtagggaaaaacaaaagatcaggctgtgtcagaagtgggattcgaacccacgcctccatacggagaccagaagacccgaacacaggaagcagtaagcttgagtctggcgccttagaccactcggccatcctgacactgtgacaaaaatccttgaaactatacatgatgagtaatcacggcttacggctcgccttctggctgaatcccagccgcaaaagttctctc

SEQ ID NO: 95415 - DNA, 379 bp, Homo sapiens
  chr6:27585093-27585472
  hyper
ttttcctattgtttgcgtttataccacttccggtcacacgggcattgttttgccggtatgactttgggggatgaaggtggggatgcggaatatgtgattgttttaccctttaagacctttgggacagctggctggattgctcttaaacagcagatttcacagcctgtcttctggaagggagagctgcgtcctcgggataagacaggcgcatagagcctggattccccgcttcccaaccagtggctcgcatttttttctgagttgttttaatgttacttgtatttgtcagtagtcgaggactttttaagtttttatttattttatttttttaagggatattgtttctttatgagcacagggcccccgacttgggacagga

SEQ ID NO: 95416 - DNA, 669 bp, Homo sapiens
  chr6:27598672-27599341
  hyper
agagatgctggactgcgaatgcaggcgcgctgcaggcgaggctgggagggccgccaggagcgctgcgggtatcgggagacacgcagagggaggggcaggcggcgggctccgcttcttcgcgtcctggctctgaaagcaaccacaggccagcggggcggtgctaggtgaagctacgaagaagccaaatagctcgcgtcttctacaaaaaccgtgttcttgctagaacgttggcaaggagaagccggagtctctcctttttctcctcggcttttctcgggctttctgaaaagagcacctgcatattcccaggaaattttggctcctgatggcatgggggaggatcacattcatcttccaggagagatggagatatcttgatcaaattgtgttttatgcaagaggcgaggggctgcgaagggaggatctcgggcagctcagcgcgctgccgctccggcgcgaggccggggtcgagcgcttcagtagctcatggctctgtagagtgcgcatggccaagcaaaggaaagcatgctccagtggcgcaatcggttagcgcgcggtacttatacaacagtatatgtgcgggtgatgccgaggttgtgagttcgagcctcacctggagcatgttttcttccaattgcgatttcagacatttcacgataatgcattttt

SEQ ID NO: 95417 - DNA, 25 bp, Homo sapiens
  chr6:27631920-27631945
  hypo
aaaactcaatacttccggccaggcg

SEQ ID NO: 95418 - DNA, 30 bp, Homo sapiens
  chr6:27633696-27633726
  hypo
tttactgtgcagagacgcaagagaggacat

SEQ ID NO: 95419 - DNA, 258 bp, Homo sapiens
  chr6:27635245-27635503
  hyper
aagaatgaaaaacatcgaagctcctggtggtacttcggtctttaaccgttgaatacattaagagtaacactggaattccaacacttcctcgcgccagcgtcagttttagaatcaacaaaatcgttacttgctgattcatttaactgctaatatattcgttaaaagtttattaggcgtcagtgatcttgaaagttccaaaaacacgaaggaaaccccaggcacatgtagagagatagttcctgacgctgcaggaggttt

SEQ ID NO: 95420 - DNA, 211 bp, Homo sapiens; identical to SEQ ID NO: 30418
  chr6:27635858-27636069
  hyper

SEQ ID NO: 95421 - DNA, 196 bp, Homo sapiens
  chr6:27636335-27636531
  hyper
cctttaaaacagcagcgcattcgtgtggccggttagctcagtcggctagagcgtggtgctaataacgccaaggtcgcgggttcgatccccgtacgggccactggatgccatagtggggcccttcacttacctgaagggaggccttttaatttaagcctgtcgaatcacaggtgctccgaatcgaatcccaggtgct

SEQ ID NO: 95422 - DNA, 262 bp, Homo sapiens
  chr6:27640050-27640312
  hyper
gcagaagtgagccaccgcgcccggccttcaaatgtacatatttcttgatgtacatttccacaagtgtgcgcgcgctgtaaaagccacagcgatagcactcacaactttctatcctagtgaactaatgaaagctaactgatgaaagtagcaaattggaaatctaaccagaaaatggcgacgctgtgagcaggatttgaacctgcgcggggaacccccattggatttcgagtccaacaccttaaccactcggccatcacagctc

SEQ ID NO: 95423 - DNA, 223 bp, Homo sapiens
  chr6:27647513-27647736
  hyper
gggggtaggggttggcgatcgaccatcaggagagcccagtctttgccacttgcggggagtcacttattgcaggcagggtgttaactgagtttaacactaggagacaaaatgaggaaataatctctcagaatgtaggttaggaaagtagaaacgccctccgagtgtatgtctatcccagaagaaaacctgtcttaaagttcgcgatttttaccaaaataggcca

SEQ ID NO: 95424 - DNA, 357 bp, Homo sapiens; identical to SEQ ID NO: 30421
  chr6:27647890-27648247
  hyper

SEQ ID NO: 95425 - DNA, 258 bp, Homo sapiens
  chr6:27648814-27649072
  hyper
aaccgcaaactggttcgtgcgtaagaaggaatagaaactaagcagcaaccaagaatatcataagcctacctgtttccgcccggtttcgaaccgcggacctttcgcgtgttaggcgaacgtgataaccactacactacggaaacaccctctttctgctcccttaccttgaaacatggaagtatatattccctgatccccaagtttagaaattttggaattgttctttccttgtagaaaattttccgattgtagtattgt

SEQ ID NO: 95426 - DNA, 441 bp, Homo sapiens
  chr6:27661684-27662125
  hyper
tgaacctttcttccccgtgtgtttagaagggaaggtgaggagagtcaaaggcacatggagcattaacagttggaataaacgacagagacacggaaacctccgaggtttccagagcggacccggaaatgacgccaggggatgcaaacccttctgcccctttttgctacccctgaagcttactgttagtggtcgagtttttctggaagtgggcttccgcgatcgcggggaccaacgccctgagctcttgtgcccaaaggggatcgccaggttttttgatgcggatcgaaagggactggccccggagcctacaacctgacgcaggtgggacttggggaaatgtcgagaaacctaggtctgggacttgagttggcttccagggcacacattcttgttcagaagaaacacattgcaaaaatcgggaggtgacgggcagatgaagtg

SEQ ID NO: 95427 - DNA, 34 bp, Homo sapiens
  chr6:27719759-27719793
  hypo
gaaatgtgtcaccttcgcgcggtggctcatgcct

SEQ ID NO: 95428 - DNA, 153 bp, Homo sapiens
  chr6:27719853-27720006
  hypo
ccaggctggcccatataagaagcagctaacacccctagggctgagggctgagatggagcacgcaagtattctcttccccaccagggctgagatccagacctgcatccaggttgggagggtagaaaaaaagtgctccagcggaaggtgcaggtc

SEQ ID NO: 95429 - DNA, 32 bp, Homo sapiens
  chr6:27755529-27755561
  hypo
tactttgattgagctcggtgataatttttttt

SEQ ID NO: 95430 - DNA, 51 bp, Homo sapiens
  chr6:27759373-27759424
  hyper
aaaaagtgaagtcgtcgaacaaaaccgagcccttatcgtgtgccaggtttt

SEQ ID NO: 95431 - DNA, 620 bp, Homo sapiens
  chr6:27774739-27775359
  hyper
cggaaagattaaaaacgccagccttgttttcctagtgctgtttttggtttttacctcgggtcttttgtcgtgccttaaaatcatgtctggttgcgcaagtgagggaaaggattgggtaaagggggcgccaccgcaagttgctgtgcaacatccagacatcaccagacccaccacctggagcctggcctggcggtgtcaaacgcattctggtctcatctttttagaaacccgtggatgctcaaggaatttccggataacgtgatcccggatgcgcttgactgacttacacggaacgagcaaagcgcaaagcagtccctgctaaggacttagtttatgccctcaagcgcaaaggtcggaccctctatggtgttggtagctatatgcacgtacctcatgtacatttcaccttaaatggctttcaaagagctagattaatttagtggatagatcaaaatgatttatgacccctcgccccccagtgataggaagagcgaaccagctcttctttagataatagtgagtggctctgaaaagagcctttgggttggacaagagcttgagaatttacttggagctggtgtacttggtgacggccttggtgccctccgacaccgcgtgct

SEQ ID NO: 95432 - DNA, 307 bp, Homo sapiens
  chr6:27775704-27776011
  hyper
accaaaacaagaagtcggtctcctctttttatataatagtttatgcggccgaggtagtgggaaggtctctgctgattggtaattatccgtggatgacgacagatgccagttttgcccaatcaaaataggtatcctgcataatcgagtcctattggtctaaataaaaataaaacgtaagccaatcgcacagcttccttttcgcgcccagtagaggctataaaatgtacgtttttctagtttcacttcagtctttcttgaccgtatagataataggccttttgccatgtctgggcgtggcaagcaggga

SEQ ID NO: 95433 - DNA, 441 bp, Homo sapiens; identical to SEQ ID NO: 30426
  chr6:27777715-27778156
  hyper

SEQ ID NO: 95434 - DNA, 221 bp, Homo sapiens
  chr6:27782421-27782642
  hyper
gatgcactcggcctacgggaaactgaagcccggcccgagaagagcgggtcttggccttggcgcgagctttgcctccctgcttaccacgcccagacatggcaaaaggtctattacctttacggtcaagaaagactgaaatgaaattggaaaaacgtacattttatagcctctactgggcgcgaaaaggaagctgtgcgattggcttacgttttatttttatt

SEQ ID NO: 95435 - DNA, 428 bp, Homo sapiens
  chr6:27832864-27833292
  hyper
gtaacgtcctgttcacgaattcttatgcaaatgaggtgattaataaaatagtgtgtaggactggtggcgattctagatgacgtcatatacacgtttgtccaatccaaagaagcatgtttcataacagcgattccattggttgaaataaaactgtaatttgagccaatggcacagctttattttcgcgcccagtattgactataagtagtggagctctggtgaacttctctcggctgttctcagttcctccatttatcgtttcttcgtcatgtcgggacgcggcaagcagggaggcaaagctcgcgccaaagccaagacccgctcttctcgtgccggtctccagttccccgtgggccgagtgcaccgactgctccgcaagggcaactatgctgagcgggtcggggccggcgcgccggtgtacctggcgg

SEQ ID NO: 95436 - DNA, 19 bp, Homo sapiens
  chr6:27833815-27833834
  hyper
aggctcagtggctcacgcc

SEQ ID NO: 95437 - DNA, 789 bp, Homo sapiens
  chr6:27834074-27834863
  hyper
aggaaaaaaaaataatccagtacagaatgacacggtcatatcaaattggcatgtaatagagaccccatcttgaaacttgctactatattgtcttgtgcgttgatagcatattatattaatgccgaacacattagtgacgccgaagtagctggtgcctaaatggcttaaacgcggaaaaaccacatacagatgatggaacaaaaactggccaatcagattatagagcgggctttttaaaatataagaagcttctttgtagctaggcgtctgacaaaaagcttgacaccaacttaacaaaaaccaacggctggaattcatactctaataacagactgcatgggtaaactacgtggggagtccaaccaacaccctggactcttgcttgccttgcgttactcgattagggttgagggagaactgcccgagatttttcgaatgcaaggaatcttgctgcctgatctaacatgttgtgcacagccattttttagaggtctctgggtggctctgaaaagagcctttggggctttgttgcggttttcacacgccagcttcctacttctttttggcagccgccttcttggcctttgcagctttaggttttgctgctttgggcttagcggctttgggctttgccgccttcggcttaactgccttgggcttggcaggactcttggttgcctttttcggtttggcagcggccttggccttcttagggctcttcgccacctttttgacgccagccgccgcgggcttcttcgccttcttcggagtcttcttcactgccttttt

SEQ ID NO: 95438 - DNA, 193 bp, Homo sapiens; identical to SEQ ID NO: 30431
  chr6:27834904-27835097
  hyper

SEQ ID NO: 95439 - DNA, 95 bp, Homo sapiens
  chr6:27835377-27835472
  hyper
cgggccccgggcttatataagccggcgctgccctgtgattggtggagcgtccaatccaccgccctctggccgccgccgctcgcggttggactccc

SEQ ID NO: 95440 - DNA, 890 bp, Homo sapiens; identical to SEQ ID NO: 30433
  chr6:27839683-27840573
  hyper

SEQ ID NO: 95441 - DNA, 153 bp, Homo sapiens
  chr6:27841104-27841257
  hyper
acactttaagaactccgcgtgtctcctcgtatataaggcctgagatgcgcttaacgcctccacgccgtgccaggcgtcggatggcgggcttggtgatgccctgaatgttgtcgcgcagaactttgcggtggcgcttagcgcctcctttgccca

SEQ ID NO: 95442 - DNA, 461 bp, Homo sapiens
  chr6:27858279-27858740
  hyper
gcacgcctcttgcagcgccatcaccgccgagctctggaaacgaaggtcggttttgaaatcctgcgcgatttctcgcaccaggcgctgaaatggcagtttgcggatgagcagctcagtcgacttctgataacggcggatctcacgcaaggccacggtgcctggcctgtagcggtggggcttcttcacaccgccagtcgctggagcgcttttgcgcgctgccttggtggccagctgcttccgcggtgccttgccgccggtagacttgcgagctgtctgcttcgtccgggccatagttgagaaagctatgctctgaaagcaagcagctgaatgagcagtggcttctaccagaatttataacgatgatctgatcctgattggtcagaactgttgtaggaaaaacctggttggttgttaatactatcttcatttggttcctgccactttttttttttttttttttt

SEQ ID NO: 95443 - DNA, 127 bp, Homo sapiens
  chr6:27934883-27935010
  hypo
ggcaccgggcctggacgaggggaatgcggtggcgcctgaaaacttgacgatgccacaatgtcagagccccaaggggtgttgggcggagcacgtgctacatctctctctttcccgccacctgcagctt

SEQ ID NO: 95444 - DNA, 254 bp, Homo sapiens
  chr6:28129376-28129630
  hyper
aagtctgagcattgccgacgggccggagcaaatcgctcccgggctagaccctgcctacaccgcggcggggacaggtggaggtttcaacccctgtttggcaacctcgggcgcagccaggccccgcccagaaatttccgggacacgccccggaagtactgagagggacttccgccccgaggcgaggcctcggagctggttgctgctcacaggcagagaaacgctggtatgcatttgggtgtcgcttgggtggatgt

SEQ ID NO: 95445 - DNA, 40 bp, Homo sapiens
  chr6:28149166-28149206
  hypo
gtttaacaaaatgctggtgggggaacgggggaacgtggtt

SEQ ID NO: 95446 - DNA, 1150 bp, Homo sapiens
  chr6:28175189-28176339
  hyper
acccacagaatgaatcgaagggtactcaacaaatgggaggactcgggcagctttcctgggatatcacaccatatagactgagaatttcagaaacgcaaagtgcgcgtcccagcagggcgagaatggcgttaactatgtcaccaccgcccaaattccctataatttaccacttatcgttcctggctttattctccgtgcgtgcagggacatgtaattctctaggagacggtggtccggacttggttcccgactccctcgtggctgcaaacaggggcagctgatttgggtggatgcagaggttgtggccaggggaagggccgcggggcagcgcgtagaactgattgtaaacccaacttcccgcctcggagcgagccgcggctcggagtagcgtcattcgaaagccaccggagatatcgagagagctccttaactgctcactgagcaaacttcgttttacagctttggggttgatatttgggaaactgggtcctaaaagtggcttctggtcttcagaaggctttgttctccgcttttgattttttgacaccacgggtttcacaccccaccccaccccccagtctcacacaaaccactcaaactcgattgcgtctccattgcgctttggggaaaaataatttaagattctcgcttctgaaatacagcgtgatggttaagagcatgggccgtggaaacagacccggggaaagcctcagctcggccactctttgccgcgtgaccctgggtggcaccttctaagggtgattctgggattctatgaattaatgcatggaaagcgcttgcgagagcgctagccggagtccgcgctatttaggtgtttgccaatattattgttgttgttaaggtgtgagggatcttggaagacagaagccaggaataaagtaaacctacagagacgtccctccccaaaccccggccgctacccctgcaagaccttgtggagcatgttaggtttcgtggcgtcgccaagttgtacctcctgcgcttcgccgcagataaagccccagcttagagcatggggtcgcaaccacccagagccttcagaccagtgagcactttccgcacaggtttgaatcccatgaacagtgatttttcttcaattctctagtctcgtctacgttttttgtttttt

SEQ ID NO: 95447 - DNA, 170 bp, Homo sapiens; identical to SEQ ID NO: 30438
  chr6:28249409-28249579
  hyper

SEQ ID NO: 95448 - DNA, 38 bp, Homo sapiens; identical to SEQ ID NO: 30439
  chr6:28303451-28303489
  hyper

SEQ ID NO: 95449 - DNA, 370 bp, Homo sapiens
  chr6:28303931-28304301
  hyper
cggaaatgcgtcagccgttctgagcccactggctgaagccaggcaactctttcctttctaggaattccagaggtggctgctgcttggtgactcccttattgcaaaccccggggccaaaaatcccagtcccactgggtgcgaggcggagaaatccggcgaggcatttctatggggagcggcccccagcatttaggagttagatggtcatcgagacccaaaacattagagccggaaggtgttaggaagatataaacgtagagagcgagtaacaggaggcaattccacggccaaacaggtttatttacaggaaaagcctgcgaagagttccagttaggaatctggctgagatcctgatcgcttacaagctgag

SEQ ID NO: 95450 - DNA, 225 bp, Homo sapiens; identical to SEQ ID NO: 544
  chr6:28367054-28367279
  hyper

SEQ ID NO: 95451 - DNA, 67 bp, Homo sapiens; identical to SEQ ID NO: 545
  chr6:28367280-28367347
  hyper

SEQ ID NO: 95452 - DNA, 81 bp, Homo sapiens; identical to SEQ ID NO: 546
  chr6:28367490-28367571
  hyper

SEQ ID NO: 95453 - DNA, 306 bp, Homo sapiens; identical to SEQ ID NO: 30445
  chr6:28367572-28367878
  hyper

SEQ ID NO: 95454 - DNA, 30 bp, Homo sapiens; identical to SEQ ID NO: 40776
  chr6:28395568-28395598
  hypo

SEQ ID NO: 95455 - DNA, 141 bp, Homo sapiens; identical to SEQ ID NO: 30446
  chr6:28410889-28411030
  hyper

SEQ ID NO: 95456 - DNA, 57 bp, Homo sapiens; identical to SEQ ID NO: 549
  chr6:28411031-28411088
  hyper

SEQ ID NO: 95457 - DNA, 342 bp, Homo sapiens; identical to SEQ ID NO: 30448
  chr6:28411151-28411493
  hyper

SEQ ID NO: 95458 - DNA, 126 bp, Homo sapiens
  chr6:28414613-28414739
  hyper
tacagctacaaaccacgttgataaatttcacaaacataatagtaaaaggagccagaatagtgagtaaaagaagacaaaaaacacgacatttgacctctcgtccctgagaggcgggtggttgttagt

SEQ ID NO: 95459 - DNA, 50 bp, Homo sapiens; identical to SEQ ID NO: 30449
  chr6:28414942-28414992
  hyper

SEQ ID NO: 95460 - DNA, 118 bp, Homo sapiens; identical to SEQ ID NO: 30450
  chr6:28415091-28415209
  hyper

SEQ ID NO: 95461 - DNA, 53 bp, Homo sapiens
  chr6:28457292-28457345
  hyper
taaagttctgtgtcacgtggggcctctcaggaggggtgcggaggtgggggagg

SEQ ID NO: 95462 - DNA, 639 bp, Homo sapiens
  chr6:28457553-28458192
  hyper
tcccagaggagataacgcgttctcctctgtaacccgtccttccacgtcccggtggtgggggggggggtcccggttctcattctttcggggacctgcaaggagccccgcccgcaggctttgaaccgatttcggctccgcgtccaggagcaggccctacgtagggccgggggaattcaggtgcgtctgcggggcccagggcacccagggcaggcggggactgagacgactgagggttgagggacaaggaggttgggactggggaggggagacccgggacccgcccagaacgctttcgtggggttggagagggcaggacacagcctctctgggcccggtagtatgcgaagacacgcataacgcaaaaggattcccgtcctggactttgggaattaaggccctgaacacattgagcaaaaagtagatctgtctgtacagacgtttctttccacgtctttcatagtaaggactttattaaaaagcaggcactcgaatcctaggtgggtagatgggaggctggggctggggatggggacgtcctctgttttctggttgtgcacattaaaaataactctctgctgcctactcctaaacgcagccggcaaaaatgagacgtcaactaagcgccgtttcagtcccaga

SEQ ID NO: 95463 - DNA, 510 bp, Homo sapiens
  chr6:2903047-2903557
  hyper
ggccgagactggtgactgtaaaggacagtgaagaagcaggacagacgtcatcctgcggatcccagagcagagaagagcagtgagaacacagggccggcaggtggggaggaggctgcaggggagggcttcggccagggaagggcagcgaggagacatccgggagggaggcgtccgcggtggctgtgggccgccaaggcggagaccggctgccgctcccaggcaccccccagagaccgttgctgaccccaccgagaaggcaccgcctccccggggctcttggctgagcgacctctcctgtcctccggtcccatcactcggtggcagccggtggacctgaagctcgccactcccgtcccctaccccagccgtgcgcggggacgccctcacctgccacctagtccagcgctgccgccgtctccgtgccgcgctccgagcctggacgccgacccccgaggcgcaggacccggccctgctgctgcgctcgccgcggactcccgctagggcctctgc

SEQ ID NO: 95464 - DNA, 180 bp, Homo sapiens
  chr6:2920758-2920938
  hypo
taatgaggcacgtcccgctcccccaaaccatcctggcgcaaactagtctttcaggtaaactttggaatgtccttggcaagaggggacgtccattcagatggttgggaagcttagaattttacttttggtttacaaacgtgagacggttgctgtagatgcgggcggcgagcatgtcaggac

SEQ ID NO: 95465 - DNA, 30 bp, Homo sapiens; identical to SEQ ID NO: 40715
  chr6:2939086-2939116
  hypo

SEQ ID NO: 95466 - DNA, 30 bp, Homo sapiens
  chr6:2964245-2964275
  hypo
ctcctgcccctgtgccgctgccctcctgct

SEQ ID NO: 95467 - DNA, 68 bp, Homo sapiens
  chr6:2985307-2985375
  hypo
aaaactgaaaaagcacgaaaacaaaaatggttgtgaacagggctcagcgatgacgaggctacattcag

SEQ ID NO: 95468 - DNA, 47 bp, Homo sapiens
  chr6:304250-304297
  hypo
gcctgcagtgggcaccgtgtgtgcagtggcctcgtgcagcagagtgc

SEQ ID NO: 95469 - DNA, 30 bp, Homo sapiens
  chr6:3053039-3053069
  hypo
acttgcttctccccacggcttggccccctt

SEQ ID NO: 95470 - DNA, 104 bp, Homo sapiens
  chr6:3053334-3053438
  hypo
gctccaggctcttcacgagttctttgaaagccgctggcgttgactccattactagcaatgagtgggacacatttcctaacccatacacacgtttgttcagctgg

SEQ ID NO: 95471 - DNA, 84 bp, Homo sapiens
  chr6:3065550-3065634
  hypo
ggctgtggcgggggtggctgggggtgcgggttgtgttcattgtccaaggctctccagtgctttgcgtggcgttttggggagcac

SEQ ID NO: 95472 - DNA, 94 bp, Homo sapiens; identical to SEQ ID NO: 40718
  chr6:3104457-3104551
  hypo

SEQ ID NO: 95473 - DNA, 35 bp, Homo sapiens; identical to SEQ ID NO: 40719
  chr6:3225962-3225997
  hypo

SEQ ID NO: 95474 - DNA, 50 bp, Homo sapiens
  chr6:3227693-3227743
  hyper
ggaccccctccgctgcggcgcgcccaccttggcgccgatctggttgccgc

SEQ ID NO: 95475 - DNA, 494 bp, Homo sapiens
  chr6:3228186-3228680
  hyper
aggagggtgagagggcggcgaggcgagggccaccagcgcgtcctgaccggggtgggggcagagctggcaccggatgggaacgatggaggactggagcatgtggagaagccgtcaggtgctccagtgccggcaggtgggagggctgaggtggcacaggctgctccgccacctcggactgcggctcctactcggccactggccagagtccctccagccaactgcccctggtgagaccaccgtctttttcctcaaccctggaggccagcgactgcccaggcggcgctccgtctcacagaggcctgggggaggacaggtggccccagaaggaagtcgtgcttgatggcaaccgggacacctgcggcccatgaacaccagcgcggcctccgcccccgccccagcgtgggcctgctttctcctttgtctgtcttgggctggtagctcctctcactgcgccgcagcatctaggggtgaagcgacctcggagcccctcagcc

SEQ ID NO: 95476 - DNA, 326 bp, Homo sapiens
  chr6:3228921-3229247
  hyper
cccacccccccaccccgccctcggattcagttcatctattgtcaagtaagagggtgggttccaagggtggcccaagcccgagtaacaaactttcttatcttccatcgcggcgacctggaggtccgaggcttcgtgctgcggttgaagggtggggaatacgactaaaaactgcagcccagcgcgcgcgagacgacccaagacccacgcgcactcgcacgagcgcgtgcacagacttggagcacagaccctcccttcagatccgcagtctctaggtactgaggcaggaactggtctctttgttacttttcgcgcgcgcgtgtgtgtgt

SEQ ID NO: 95477 - DNA, 325 bp, Homo sapiens
  chr6:3229307-3229632
  hyper
gggcgggaggggaaagggtgtcagaaacgttcactgcacaacctgttccctgcaattcgatgactgaagcgcgccgccccacacttcggaagggccgttggcgaggtgacgtgacctctttcatcccctggcgagaaaggccgaatgacccgggcgcacgcggcggagctcagcctgcagctgttgagcgagaccctcccagaactatcagcaagctgtcatcgcctccctttcccgctgtggggtggagggtggggggttcaagtcgattccaatgtacaaagagaagtagcgagaacaaaagcccaggcgcccccaaacatcc

SEQ ID NO: 95478 - DNA, 358 bp, Homo sapiens; identical to SEQ ID NO: 30253
  chr6:3231580-3231938
  hyper

SEQ ID NO: 95479 - DNA, 186 bp, Homo sapiens
  chr6:32632511-32632697
  hyper
cccggcacagaaactcggggtctcggccaagggtgggcctcacggaggggcgacgacgctcacctctcctctgcaagatcccgcggaacgccacctcgtagttgtgtctgcacaccgtgtccaactccgcccgggtcccctccaggacttccttctggctgttccagtactcggcatcaggccgcc

SEQ ID NO: 95480 - DNA, 396 bp, Homo sapiens
  chr6:3285139-3285535
  hypo
gaatacaaatgtatccgtatagtgtccaacctacggccaacttcagctgcagttcttggagggcaacggggagaaagagaaaatggaaaccacaggtccgtgagtcttcgagaaaacacccatttagatgtaatatgagacgaggaagcacagcccacgcgcttgggactcacctgagtctgggtgctggctgtactttccaatcactggacccgcagacatgatcgcacccacacggacaagggccaagcaagcgagaagagagaagagagcacattaggtgtggagttagcctagcgtgttcccatgcgacttggttcaagcaaactcccttccgtgtctgggatggcgctggccgccggggcagtggaattcatactgcgctaaacaaagatc

SEQ ID NO: 95481 - DNA, 48 bp, Homo sapiens
  chr6:3286048-3286096
  hypo
ggtggacagccctggcgtctagttctgagagcccgggttcattttcct

SEQ ID NO: 95482 - DNA, 30 bp, Homo sapiens; identical to SEQ ID NO: 40721
  chr6:3298330-3298360
  hypo

SEQ ID NO: 95483 - DNA, 297 bp, Homo sapiens
  chr6:3307198-3307495
  hypo
ccaagcaggcgtcagcgtctgcagcgcggtatggatacagcaatggaggggcacaaggattcctcctctagggtaagtaggatgcttgccaacttggaggattttagagcagatgtttgctgatgggccatgaacatgctgagcagacggcatacggcagcgctacgacatgcacaggtggcacttggttactgacaagctgagggtaggcacaaaacctgcactctcagtggcatgtccaggcaggtgtcctcactggctccgggtctcagttcatctcgacgctctgacccccca

SEQ ID NO: 95484 - DNA, 149 bp, Homo sapiens
  chr6:3328274-3328423
  hypo
ctcattggtctcattcgacatggtgagatcctgtctctaaaaaacaaccaaccaaacaaacaaccgttacttttcccctaacaccttaatgaagaatgcttacaagctactcttggcaactagatatactttgtcgataagcagagaga

SEQ ID NO: 95485 - DNA, 52 bp, Homo sapiens
  chr6:3333103-3333155
  hypo
ggaacttgaagaaaccgctggttttatgtgactgtcccgtgatgtcgttcac

SEQ ID NO: 95486 - DNA, 30 bp, Homo sapiens
  chr6:33579234-33579264
  hypo
actcacagagacctgcgccgcttccctcct

SEQ ID NO: 95487 - DNA, 30 bp, Homo sapiens
  chr6:33609197-33609227
  hypo
ggatttaagacaatccggcggcatccttgg

SEQ ID NO: 95488 - DNA, 128 bp, Homo sapiens
  chr6:3361088-3361216
  hypo
gacgaagccttccctcgggcaaagatgctggggtggggaacaggtgcagcaggaacagaaggtcagagcgtggtactggggtgacgagaggcgctagcgaacatcagcagctgcggggagctcgaggc

SEQ ID NO: 95489 - DNA, 197 bp, Homo sapiens; identical to SEQ ID NO: 40724
  chr6:3363773-3363970
  hypo

SEQ ID NO: 95490 - DNA, 30 bp, Homo sapiens
  chr6:33678306-33678336
  hypo
ctggaatgtccttcccgccaagtgtacatg

SEQ ID NO: 95491 - DNA, 30 bp, Homo sapiens
  chr6:33678538-33678568
  hypo
ctgtttccctagcaccgttccaggcatatg

SEQ ID NO: 95492 - DNA, 30 bp, Homo sapiens
  chr6:33684793-33684823
  hypo
ttcaactggaggaaacgattggctgcaata

SEQ ID NO: 95493 - DNA, 30 bp, Homo sapiens
  chr6:33748632-33748662
  hypo
ccccactgcacatggcggcctggctctggg

SEQ ID NO: 95494 - DNA, 30 bp, Homo sapiens
  chr6:33761619-33761649
  hypo
cgtgtgaatgttcagcgtggcgggggtggg

SEQ ID NO: 95495 - DNA, 468 bp, Homo sapiens
  chr6:33955284-33955752
  hypo
caaatagcatcttagcgttattaagaaacagttctgacctcaaggcctccccctgagagggtcttaggaaccgccagaggtcctctgattacaccttgagaactgagcccctgaaggcagggaccatataaacttgtcctgtgtcctggggcagaggcgatgcccgatacacatgcatagaatatgagtcaacactgctgtgcgcatgtcaccctcacggccactctggaggcaggcgcttttgtcatcaaacccatttcacatgtgagggcgctgaagcccaaagaaagcagcgcctcactctgctgcctcatactctgttaaaaggagaatcatgccaacctccagaaatgaggcgggaaaatgactgcgctccgtgacctgtcaattaccccctggagacagccagcagctgtcctcatccctaggctgcggtcagagaaacatggaccccgagaggttaagggc

SEQ ID NO: 95496 - DNA, 195 bp, Homo sapiens
  chr6:33995948-33996143
  hypo
gaagttgcccttctgcgtgaacttgttggacatggtggccgccgtaacgacggctttgaggctgcgcttgcgcttgggcacgttctgctccgggtggaagaggatgatgtagactttgggcatgtagagcattcccagggacaccgaggcgctcagactcaccgagaccgtcagcgtcgtcgtctggatgtacag

SEQ ID NO: 95497 - DNA, 30 bp, Homo sapiens
  chr6:34021237-34021267
  hypo
cagagaggctcacagcgcctggcctggggc

SEQ ID NO: 95498 - DNA, 41 bp, Homo sapiens
  chr6:34034613-34034654
  hypo
tgacagcaagggtgccgcggtcctcacgtggtgccgcctga

SEQ ID NO: 95499 - DNA, 44 bp, Homo sapiens
  chr6:34037899-34037943
  hypo
tcgcacctgctcacacgctcccatcccctcggtgacctcccctc

SEQ ID NO: 95500 - DNA, 30 bp, Homo sapiens
  chr6:34038143-34038173
  hypo
gagtgctcaggaaatcggcctgcaaaggat

SEQ ID NO: 95501 - DNA, 30 bp, Homo sapiens
  chr6:3405673-3405703
  hypo
agagacgaccgagcacgtattcatgcgaaa

SEQ ID NO: 95502 - DNA, 30 bp, Homo sapiens
  chr6:34100465-34100495
  hyper
tcaccgagcctccagcggcaggtgctgttt

SEQ ID NO: 95503 - DNA, 136 bp, Homo sapiens
  chr6:34110456-34110592
  hyper
agttccagtttcactcgatcgctcacccgctcgctctctcacctacctcgggctgcctgccgctgtgcaaggcgctccctctcagagaagtcacgcctccaacggaatgaagccgcccagacgcaggttgggggag

SEQ ID NO: 95504 - DNA, 1919 bp, Homo sapiens
  chr6:34111638-34113557
  hyper
ccagaacggacaaggcgagggactatgatgggaacatacatgcccctccctccctgtcacttcgggctttctgccagattgacacaggggcagccaccgctctgagagacacgtggcttcgggcacccagctaggcaagcccagctcagtcggtgtccggaaaggccgcgttctcccgcgccaggggccggcaatggtgcggagaggggagaaagaagcaaggcgcctcctccgacagggactgaaagtctgagggcgggatgtcactcaaggcctaggggcagggggcgctcgtacgttcgggcctcaggactccctgccgccgccgatgctgctgccccatctcagcacaaacagcctcagaccgccctggtgcgggggcgcctctcgcagtcgaggcctccacctcccggccccgcccccgcgcggggaggagacgcctcccacctgcgagcgccggggaagaccgaccccggagcggggacccccagcacacacgcgcgtacacacatgcacacacagagaccactgccggtccgctcgcccggcggccgcgtagacgcgcaggttcatcacggtcccggggagggacggtcccgagtgtccggagagagcctgaccctgaagtcctggggctgcagggagaccccagaccctagagacccccacaacctgccgaggccacgggcaagcggttgccgggctccggccgctggcgaaggcggcgctggggcgggcacgggagctggacgcggtgcctgggaaaggagccgaggcgcgcgaggctgggtgccctcccgccgggagactgccgggaagaggtgcaaataatgccccgcgcccccgcctgtcccgcctctccgcagaccgggatgcgctaatgccgccgcccccacctgaaagctggcacgaccctccatccggtggaagcccctgtatacagagacagtactttccaccgggcccgcaaaaaagcctctgccccattccctccctcaggggcacccggaaagcctgccttagccccgaggggagaccctctagttcagatcccgcgccctccggcccctagggctccgggggcgccagctctcctcggagcactccaagcgcgggagctcgccggaggccacctccccgagccccgatgtccccgccgcagccctcgccccaggaggccggagggcacggtcccctctgtcggtccccctcgggccacaactcaccgcgcgccagcaaggtttaagccgcggcgaggggtcggctgcgtgccggcctgccccgggggcgcaggcagtcgacggccggaggcacggttctcgcggtgcccagagcccgggccgcggcgggcagcgctgacgctgcggacccagcgcgccgcggagccgcccggagtccgggacgcagcagggatgagctggcggccgcccggccggagccgccgccaagcgcgcggcgttcggctgctgctccggcaagcgagcaagcgagagggagatcggcggcaacccctgctcctgctgcggcggagcccggcgtccgagccggaaggagcgggagaggcggcaagaggagctgggtctggccgagagctccgggctgggaagggagcggagcgggagcgaccagcgagcgcagccggccgaggtacgggcgcctggcggcgccgcaacagcggcaacagcagcaggaaaaaaaatgagagcgagctagagagcgcgctggagagcgagcgagagagggagcgagagacgagagagcgaggaaggcgctgagaggggaggctgcgggagagggcgggagagccgggaagcgcaagggggcgagggggccgcagccgcttgccccggcgcccacagccgctgctgcacccgaggaggcacgagaccaatccggcaagtttgcgctgaaagtgcggg

SEQ ID NO: 95505 - DNA, 174 bp, Homo sapiens
  chr6:34119143-34119317
  hyper
ccagcctctttgcctcgctgcaatttaaaacaacttatcatctctctctccacatgtccgggggctgtcagccgtgagccaaatgtcattagcatggatgtcacaagccgggatgtcaaaatacaattaacatttaaaagccccttccgcccaagacctcgtggccgcctgctc

SEQ ID NO: 95506 - DNA, 120 bp, Homo sapiens; identical to SEQ ID NO: 5043
  chr6:34170868-34170988
  hypo

SEQ ID NO: 95507 - DNA, 31 bp, Homo sapiens; identical to SEQ ID NO: 5044
  chr6:34171048-34171079
  hypo

SEQ ID NO: 95508 - DNA, 30 bp, Homo sapiens
  chr6:3438520-3438550
  hypo
tacccaagggggccccggccagcagtccag

SEQ ID NO: 95509 - DNA, 46 bp, Homo sapiens
  chr6:34392006-34392052
  hypo
catatcctttcacatcgtggtatacaccatccgttctccactccag

SEQ ID NO: 95510 - DNA, 31 bp, Homo sapiens
  chr6:34396511-34396542
  hypo
cgacagagcgagactccgtctcaaaaacaaa

SEQ ID NO: 95511 - DNA, 611 bp, Homo sapiens
  chr6:34433479-34434090
  hyper
gaggaaaggccaaggcgatggggagatggggagagaggcagggagcaacatcccgggctccgagcgcgccagctgggagggctggggaggagggcgcaccggagggctcccggcacgcgcggggccgcgggcagcccccagaagagggagccaggcaagactgctggggcaggggtcggctgaagcagcggggagccggaccccacccgccacccgccacccgccacccccggcgcctgccaaactggttgctgcctccccggcagccgcggcgcgtccacctgcgcagccaccgcgccgccctgcccgcgctaccattggctcgctaaaaatgcctctctaatctgctctgctcggtgcacgcctcctcctcatccttcccccctctccgcctcagctctgaccttcctccttcccgcagccccggcgagatcccagagcgacgcggtggcggcggcagcgccagccccctcctcccccgggaagtcggccgggcttgaggccgggccccagacgtcccgcttcgccccgagtcgccgccgatggtccccggagctcctgcccccaggtaggaggtctggcccttgaatagagggcgggggggttgtgtg

SEQ ID NO: 95512 - DNA, 30 bp, Homo sapiens
  chr6:34490562-34490592
  hypo
ctcatgcaaagtccccgagtccaaaggcca

SEQ ID NO: 95513 - DNA, 30 bp, Homo sapiens
  chr6:34498821-34498851
  hypo
cagggttggggaccccggtccagatcacag

SEQ ID NO: 95514 - DNA, 30 bp, Homo sapiens; identical to SEQ ID NO: 14846
  chr6:34514348-34514378
  hypo

SEQ ID NO: 95515 - DNA, 30 bp, Homo sapiens
  chr6:34518840-34518870
  hypo
cgctgtgacctgctacggggcacctgtcca

SEQ ID NO: 95516 - DNA, 29 bp, Homo sapiens
  chr6:34535577-34535606
  hypo
gccctgccatcatagcgctgacagcggct

SEQ ID NO: 95517 - DNA, 29 bp, Homo sapiens
  chr6:34535906-34535935
  hypo
ggcgtgagtcactgcgcccagccatatcc

SEQ ID NO: 95518 - DNA, 70 bp, Homo sapiens
  chr6:34618507-34618577
  hypo
ttgagctatctaccacgcctggccaggaatttaattttaaacagtgcgcaacgttcgccttcttcgggaa

SEQ ID NO: 95519 - DNA, 70 bp, Homo sapiens; identical to SEQ ID NO: 40786
  chr6:34671603-34671673
  hypo

SEQ ID NO: 95520 - DNA, 30 bp, Homo sapiens
  chr6:3471840-3471870
  hypo
cccctctccttcctccgatgaccgaacccc

SEQ ID NO: 95521 - DNA, 19 bp, Homo sapiens
  chr6:34723890-34723909
  hypo
gggcgcggtgggtcacgcc

SEQ ID NO: 95522 - DNA, 19 bp, Homo sapiens
  chr6:34724209-34724228
  hypo
aagacgagataacctttct

SEQ ID NO: 95523 - DNA, 45 bp, Homo sapiens
  chr6:34854786-34854831
  hypo
tgggtccctgatcaccgggtgcggtggctcacgcctgtaatccta

SEQ ID NO: 95524 - DNA, 336 bp, Homo sapiens
  chr6:348707-349043
  hypo
ccacgtggatgcagacgtgcacatgtgtgtgacgtttcgggtttgtttccatcctctccagtatcggcagtggctgaaggaagaatatggagagagccctttgcaggatgcagaagaagccaaaaacattctgggtaaatataaggagcaagggcgcacagagccccagcccggcgccaggcggtggagcagttttccggcactggctccgctgacctacgataattatacgacggagacctaacgcaagcgacctgctgccttccttcccactgcttgtcttcagtgtgcccggctgggcaggggtgcggtggtggtggccgatgaggacaggaa

SEQ ID NO: 95525 - DNA, 50 bp, Homo sapiens
  chr6:35026986-35027036
  hypo
aggcaacacttcagacggcgtgctggcccaggagacgccctgcttgccag

SEQ ID NO: 95526 - DNA, 56 bp, Homo sapiens
  chr6:35109367-35109423
  hypo
agggttgtttcacagcgtgtgccgcaggggcgcaggggccgcgctctttcctcaca

SEQ ID NO: 95527 - DNA, 297 bp, Homo sapiens; identical to SEQ ID NO: 40791
  chr6:35149810-35150107
  hypo

SEQ ID NO: 95528 - DNA, 191 bp, Homo sapiens
  chr6:35181252-35181443
  hyper
aaacctggcgccgcacggccgtcctcgcgagcgagcgcggggacgcaccctcgctccccgactctttcctaggggagcgaggacgagtcggagcccggtgctgtttggtctggagccgagcggagcttgcattgatccattgattgcgcgcggtctgcgcctgacctccctgctcccggggaagccgtctc

SEQ ID NO: 95529 - DNA, 122 bp, Homo sapiens
  chr6:35181861-35181983
  hyper
ttgggtgggattacacggagcagccccgccgccgccgctggcagaggccggcttggagagggcgggggttcccctccgtcagtcgcccctggcgcccctcgcctcgtcgcactctccgcctc

SEQ ID NO: 95530 - DNA, 64 bp, Homo sapiens
  chr6:35182200-35182264
  hyper
ctcggggcgcgtacccgggctctgcctgcttgtcctgctggtccacgcccgcgccgcccagtac

SEQ ID NO: 95531 - DNA, 266 bp, Homo sapiens
  chr6:35309463-35309729
  hypo
tgaaactgtgtctcaaaaaaaaaaaaaaaaaaaaaaatcactcatccagatagctaggtgtggcctaaggagcttgcggcctacggaaggtgtggccgaaggagaggggaggggtcatctttaatgatgatggaggggaggcattggtcatatacctgagagtcaagctttgttcatcgtcagatgaaagccaacttcttccaccagattgcctcccagctgctaggtagtttcctgtggtacatcttaagcggtaggttgggata

SEQ ID NO: 95532 - DNA, 234 bp, Homo sapiens
  chr6:35359757-35359991
  hypo
ctcagatgttgtgctcggaaccaagcagaagagcaccaagccttataggccctgacaggtgagagggaagagagaggtgccttccttcatccatctggactgcccttggaattcctgggccaatttggggaaccctggcaccaaccctaacatgggccagtgccagcaccaggtatatgcagcctgtacttcccagtctgggcaggcaaaggctggaaccgcaccagcagctct

SEQ ID NO: 95533 - DNA, 47 bp, Homo sapiens
  chr6:35454542-35454589
  hypo
ctcctatcccacagccgctggctctggagctccgcccccagccccaa

SEQ ID NO: 95534 - DNA, 65 bp, Homo sapiens
  chr6:35466126-35466191
  hyper
cgaaactggagagggcgatggcgaaggcctgcagggcgcacagcgggtaccggtagtctagggtg

SEQ ID NO: 95535 - DNA, 30 bp, Homo sapiens
  chr6:3569703-3569733
  hypo
ccttaaggcctcaagcgtcaaaggagaaag

SEQ ID NO: 95536 - DNA, 30 bp, Homo sapiens
  chr6:35744172-35744202
  hyper
tacttggaagtaacacgtatggaggctccc

SEQ ID NO: 95537 - DNA, 103 bp, Homo sapiens
  chr6:35773143-35773246
  hyper
ccgggaagagggagacgggcagggcggcgccagcaggccctggtgggcttgggaggaggcaggagactggagacagcctcggctagagcggacacaggcacct

SEQ ID NO: 95538 - DNA, 25 bp, Homo sapiens
  chr6:35895210-35895235
  hypo
ccacggtgcccggcccccaggtatt

SEQ ID NO: 95539 - DNA, 79 bp, Homo sapiens
  chr6:3593615-3593694
  hypo
gtaggtaaatacatccgtagatttatttaaagcatgtgtaaaagctaaggcatattacctgtagcggttggtattcttg

SEQ ID NO: 95540 - DNA, 125 bp, Homo sapiens
  chr6:35992409-35992534
  hyper
gggcgggctgaggagatgagagtgggggaggggacgaggaagaggagcatgagcagctgggctagggagccaggaaagtggtacctgggtcgccctcctcatacctgagtcgtgggatccccttg

SEQ ID NO: 95541 - DNA, 57 bp, Homo sapiens; identical to SEQ ID NO: 30462
  chr6:36088966-36089023
  hyper

SEQ ID NO: 95542 - DNA, 104 bp, Homo sapiens
  chr6:36165588-36165692
  hypo
tctagagtttctccccggtgtctggaggcgtgggtgggacaaaacacgtctgtgtagagtcttgcatggtcgagagatgcttgagcagccgaggaggtggcagg

SEQ ID NO: 95543 - DNA, 171 bp, Homo sapiens
  chr6:36214623-36214794
  hypo
aaggttcttcccacacgtaaaattacatagtactcttaaatatgtcttcttgaacgccatcgccccatcccagactcaggaccagcctccccgcgctcactgctgtcactgctttccgcactccctgcggattttaggattttagctcccatctcgcgtcctctctccagc

SEQ ID NO: 95544 - DNA, 200 bp, Homo sapiens
  chr6:36238319-36238519
  hypo
ggcgggggctgtggacgccctgcgggacctggccccccggatgctggaaacagcccaccgctttgcggggacatcggcaggtgctgtgatcgccgccctggccatctgcgggattgaaatgggtgaggcctgtgttctgggtcccctgggaagtctcttgggggattccacagagacagaaggagcgtgagggaggctgg

SEQ ID NO: 95545 - DNA, 29 bp, Homo sapiens
  chr6:36240231-36240260
  hypo
acaggccacagacccggggccatggcctg

SEQ ID NO: 95546 - DNA, 369 bp, Homo sapiens
  chr6:36252866-36253235
  hyper
taacaattattattacgttggggtagggtattcaagatatacccacaggaaaatgcagattacaattcagtctgcaattagggaccagatagcagccaactctcaggtgatccatgcagggattctgagcattcgtcggcgcctccccaggggctgctgcgccccctgcttcccgcgcgcccaccacgcacgctgctctgggagcagggccggcggcgccgccgcctcgcagcgattggttgaaccggaggttgttgctaggctaccagtgcgccctgagcctggggccccgcagtcccatcctctgtggcagatccatccctcactgcagacctaattccggtaccctgtgaacggcatcctcagcag

SEQ ID NO: 95547 - DNA, 164 bp, Homo sapiens
  chr6:36287117-36287281
  hypo
cccgccctctctcaccggctggtcctccctgtatgggaactgggtgcaattgtagtggtctcttaggcccatgaggatgcacatggcatggctgttgctgccagcaaatttgttagctaagctaacgtcaaactggtagagtctcctggcgcggttcctgtcca

SEQ ID NO: 95548 - DNA, 30 bp, Homo sapiens
  chr6:36313961-36313991
  hypo
gctttccataagacacgctaagacacgccc

SEQ ID NO: 95549 - DNA, 56 bp, Homo sapiens
  chr6:36344624-36344680
  hypo
agtgactagcccacacgcatacaggcagcatggggcacagccgggctgtctggcta

SEQ ID NO: 95550 - DNA, 30 bp, Homo sapiens
  chr6:36355327-36355357
  hyper
aggtgaggaagccaccggctttctgtcttg

SEQ ID NO: 95551 - DNA, 18 bp, Homo sapiens
  chr6:36392123-36392141
  hypo
aaatgaagattcaggcgg

SEQ ID NO: 95552 - DNA, 91 bp, Homo sapiens
  chr6:36535507-36535598
  hypo
gtatttttgattgtgagtcaccatcaaaaagtttgaacacctctgaatgaatacagttaaagcaattagaagtgtgcgggacaccttgtaa

SEQ ID NO: 95553 - DNA, 367 bp, Homo sapiens
  chr6:36806909-36807276
  hyper
gggctcttggcagatcggcaggggcgcagtcctggagaccaggacactctgggaagggggcgcgcggaggtttaggatcgaagcggcaggggccgcggggctctgcgtccagggccggggcaaggggacccggccagcgggaggctcacctgcaggacacggtgatctccaccttggtggccgggatgctgcccgccaaggagtcgaactcgctcagcgacgccatgtcctcaggctgctccatcgcccaccgcaccccccaccccaaattagtcaatccctgcgcgattcacgcctcctccggagcgactggagccctgggctctcccccaactccagagcctgggctgggcggcaaggggaggag

SEQ ID NO: 95554 - DNA, 495 bp, Homo sapiens
  chr6:36808059-36808554
  hyper
ggttatgggaaccaacgggcgcctttttgagaaaggtctatgcagggttgagagggggcataagtgggagggaggtgtgcaaaaaagatcccctcccaggggcttgggtgtggagggtctctgctgagtgtgcgccctactcgggggcgggtctcagttcagaaacagaccctacatctccttctggggaggtgtgtgggggcgaccccagtgccaggagggactacctcggtttcccagtggcccaggtggggtcggtgcatgggcgcctcccccatccgtggttcccgccagccgcggcctcgccaagtcggctgccgaaaccacgcgccagcgcccttccactcccccgcccgtcgtgaccacacgactgagccagcctccaggtctagaagctcctgccacccagtctggtggcaaccagactgggagatcggcccgagctccctgggcttctatgcagccagcaccgagtaggcgcgtgctgtgtgcctg

SEQ ID NO: 95555 - DNA, 30 bp, Homo sapiens; identical to SEQ ID NO: 14852
  chr6:36831576-36831606
  hypo

SEQ ID NO: 95556 - DNA, 30 bp, Homo sapiens; identical to SEQ ID NO: 40799
  chr6:36881595-36881625
  hypo

SEQ ID NO: 95557 - DNA, 30 bp, Homo sapiens
  chr6:36932229-36932259
  hypo
ttggttaaggccctccggaagggaaaggct

SEQ ID NO: 95558 - DNA, 56 bp, Homo sapiens
  chr6:36949243-36949299
  hypo
atgccagctcgactgcgtgccatgctgcgcagtgagttccccggggccagctggtc

SEQ ID NO: 95559 - DNA, 46 bp, Homo sapiens; identical to SEQ ID NO: 40801
  chr6:37004177-37004223
  hypo

SEQ ID NO: 95560 - DNA, 510 bp, Homo sapiens
  chr6:37024139-37024649
  hypo
tatgggctgctggggcgggggaggtcccagggttttccagattcagctgtcctccctctgcagtctcagggacccagacagggctggctgacaaacaggtcctgcccgggatgggcgtggggctgagcgagcgaaactccttttaggaaggaaatctcggccaggttgagaaaccagcatcttgccaaggcctagggggtgggggagcccaggtgagccgactcagtcctcaggaatgggtggggtctccaggagaggcgggcacttcctccgccccagcccagggtcctgttcaatccttattgaggagtttcctggcgacaggcagtgacctgtcggctgcctgtgtgggaagccgcttggcgtggccctccccatctcattagtggtgattcacctggactcacctggctgtcagggacctgtcccactgcccgctggaaccagctcagcaggcaccctctgaggggcagagacctcgttccctcagctccccgtcctccatggtgt

SEQ ID NO: 95561 - DNA, 68 bp, Homo sapiens
  chr6:37027628-37027696
  hypo
cttggcccaggaaggcgcccccaggcccagctactgggggaagcaacacttcccggctcctgtgctcc

SEQ ID NO: 95562 - DNA, 79 bp, Homo sapiens
  chr6:37053276-37053355
  hypo
tgataaaacccctaccgatggctgatgactaaaccaatccgcattaatttaaccagctaccttgggctgggcgcggtgg

SEQ ID NO: 95563 - DNA, 30 bp, Homo sapiens
  chr6:37139199-37139229
  hyper
cgagctcaagctcatcgacttcgggtcggg

SEQ ID NO: 95564 - DNA, 45 bp, Homo sapiens
  chr6:37275438-37275483
  hypo
aaaatattacgcaaggtattcttatgagtccggttcaacaacaac

SEQ ID NO: 95565 - DNA, 30 bp, Homo sapiens; identical to SEQ ID NO: 40805
  chr6:37358523-37358553
  hypo

SEQ ID NO: 95566 - DNA, 180 bp, Homo sapiens; identical to SEQ ID NO: 40806
  chr6:37391410-37391590
  hypo

SEQ ID NO: 95567 - DNA, 42 bp, Homo sapiens
  chr6:37392290-37392332
  hypo
gggattacaggtgtgagccaccgcgcccggcctagtaccttt

SEQ ID NO: 95568 - DNA, 132 bp, Homo sapiens
  chr6:3751602-3751734
  hyper
ggtgcaggtagagcacgctgcggtccgaccactccgtgcggatctcgaagaactcctcttcgtcgccgcgccggctgacgatgagcctgcggatgccgttcacccagcagccgcgcacgaacatgttcacga

SEQ ID NO: 95569 - DNA, 137 bp, Homo sapiens
  chr6:37526552-37526689
  hypo
ctcgggccggcacaccgtaggtgcccagcatgagtgcgtggacaccactcgtgtctctcaccattgtccctaaaatcaagcccacagtccatggaggcttgccctgccagctcctgaacagccggctgacccactcc

SEQ ID NO: 95570 - DNA, 32 bp, Homo sapiens
  chr6:3752663-3752695
  hyper
ccctgggaagctggacgcggtgggtgctcttg

SEQ ID NO: 95571 - DNA, 30 bp, Homo sapiens; identical to SEQ ID NO: 40807
  chr6:37557743-37557773
  hypo

SEQ ID NO: 95572 - DNA, 474 bp, Homo sapiens; identical to SEQ ID NO: 30466
  chr6:37663985-37664459
  hyper

SEQ ID NO: 95573 - DNA, 760 bp, Homo sapiens
  chr6:37664481-37665241
  hyper
cgaggttaagccaaggtggagcgggacgcgggctcttaccgtagactccttgtccccggcagtggaaggggatcagcgccagaagtagaaggcaggtcacctccatcttcacggccggtgcttcatccccgcgaggcggcgcagcccgagaggcggcggggggcgcattcgccggggccccgcgacgcccctatgtccccccctttccctgagaggtgagagagagagcggcgacgaagaccaggagactgaagaggcggaggtggcggcgacccgtgtttctcctccggcggggccgctgcccgcgtggggacgcagggggcgctggcccagccccgggtgcctcggcgcgcccggcacagcagccagcgccccgacccgaggagcccggccgccgagccgccccgggtacccagggccgtccgcgcgggatgctaggcgccggggacctctcggcggcggaggcggcgcttcgatccaacaggccacggacgactgacaaacttgtcgtttccccgcactggggccgcccctcagcggagcggagtcggggaggccggggctccgctcgagttaatcaatctgctgtttccagtcctgcggccgctgccgtgggctcagcggcccgactccagggggccgggctgaaagcactcgcggcggcgaagcagccccgggcccggccctcctgatccggggagcagcgcgggctgggttcggccgagggacgagcgccgcgggtccccgggtccgtgaagtt

SEQ ID NO: 95574 - DNA, 470 bp, Homo sapiens
  chr6:37673008-37673478
  hyper
gcagccccagtggaacgcatcaagtttcgctgagctggtctttctaactttctccccggcagctccgcgggaagcaggatcaaatgttctccagcctgaaaagcccggctggggtgtgaggagaaaggagaaggggaggaggggcggccaatctgcggtattggaaggggaggggccggggccgggccccagggacaggcctcgtgactctccttgctccctttctgtttaaccctcccagccaattctttttcctttagccattagctctttttgatccacgtaaaagggggtggggggcgggaaatctggcgtggacttggaggcgttcagcacacccgcgaccgctgcgtggcataaactacagggggcgccattcacataggatacgacagacatggcgcccgccccctccgcccccccagtacaacgtgggggccctgctgccacgccctcgggtctgacctgac

SEQ ID NO: 95575 - DNA, 30 bp, Homo sapiens
  chr6:37751633-37751663
  hyper
aggaggaaagctggtcgaaataattattct

SEQ ID NO: 95576 - DNA, 30 bp, Homo sapiens; identical to SEQ ID NO: 40808
  chr6:37776410-37776440
  hypo

SEQ ID NO: 95577 - DNA, 32 bp, Homo sapiens
  chr6:37776736-37776768
  hypo
caccagtcttaacctttcgacttcatcctgta

SEQ ID NO: 95578 - DNA, 21 bp, Homo sapiens
  chr6:37791857-37791878
  hypo
tattaacgtcatatttttagg

SEQ ID NO: 95579 - DNA, 34 bp, Homo sapiens; identical to SEQ ID NO: 40810
  chr6:38018000-38018034
  hypo

SEQ ID NO: 95580 - DNA, 98 bp, Homo sapiens
  chr6:38101874-38101972
  hypo
tgttttgttgtgtcccgaatgccacatctagataagatgcttctggaaaaccgggtccacagcatggtcaccttttggtctcccgctgtacctgggta

SEQ ID NO: 95581 - DNA, 30 bp, Homo sapiens; identical to SEQ ID NO: 40811
  chr6:38137726-38137756
  hypo

SEQ ID NO: 95582 - DNA, 43 bp, Homo sapiens
  chr6:38183138-38183181
  hypo
ggcaagcttcaatgtcggcctccgggctcgctaagcaaatagt

SEQ ID NO: 95583 - DNA, 30 bp, Homo sapiens
  chr6:382294-382324
  hypo
cagaatgccggcacgcgctgtgcaatgccc

SEQ ID NO: 95584 - DNA, 30 bp, Homo sapiens; identical to SEQ ID NO: 40813
  chr6:38684078-38684108
  hypo

SEQ ID NO: 95585 - DNA, 153 bp, Homo sapiens
  chr6:3881645-3881798
  hypo
tccaggagaaggactcgcagggtcatcttagagtttgcctaattgagttacagattcccactaccttactttttaagtttttaaaacatcatgttaaaatacacaggacataaaatttgccacctttaaccatttggaagtggacggttcagt

SEQ ID NO: 95586 - DNA, 30 bp, Homo sapiens
  chr6:38848809-38848839
  hypo
acaaaaacaaaaccccgcacaatggatatc

SEQ ID NO: 95587 - DNA, 114 bp, Homo sapiens
  chr6:39016211-39016325
  hyper
gggaccctgaatgggcgggggttgctgtagctttcctcagctgggagacccgggaggaggtccggggtgccagggtgggaggagggcctggcttgtcgctgaaagccggccagg

SEQ ID NO: 95588 - DNA, 240 bp, Homo sapiens; identical to SEQ ID NO: 30470
  chr6:39016390-39016630
  hyper

SEQ ID NO: 95589 - DNA, 256 bp, Homo sapiens
  chr6:39016678-39016934
  hyper
cggcccccgcccccaggtgagatccagggaccccgacgacaccgggggaggcgggtggctctgcgggctgcaggcgcagtgtcctggtggagggccccgggacttgaacgaaactccgagaccgctggcgggggcatccgaaagcctcggggggagtagggactggagacttggtgcccctgggctggaaggcccaggtgagggcttggactacagaggattccccccaaccccagcgaggcgccctcttcctcgc

SEQ ID NO: 95590 - DNA, 570 bp, Homo sapiens
  chr6:391173-391743
  hyper
tctttttagtgagtgcgatgttctctaaacaccgcggagaggcagggttcccggtgatggccttgccgagggtgctcccgcaacctccacctccagttctctttggaccattcctccgtcttccgttacacgctctgcaaagcgaagtccccttcgcaccagattcccgctactacacgccccccatttcccgccctggccacatcgctgcagtttagtgattgactggcctcctgaggtcctggcgcaaaggcgagattcgcatttcgcacctcgcccttcgcgggaaacggccccagtgacagtccccgaagcggcgcgcgcccggctggaggtgcgctctccgggcgcggcgcgcggagggtcgccaagggcgcgggaaccccaccccggccgcggcagcccccagccttcacgccggccctgaggctcgcccgcccggccggccccggctctcggcttgcaaagtccctctccccagtccaacccccggcccccacaggcctcggcgccccgccccgccccaggccccgccccagagagttctataaagttcctctttcccacctc

SEQ ID NO: 95591 - DNA, 20 bp, Homo sapiens
  chr6:391744-391764
  hyper
cactctcagtttcaccgctc

SEQ ID NO: 95592 - DNA, 135 bp, Homo sapiens; identical to SEQ ID NO: 517
  chr6:391765-391900
  hyper

SEQ ID NO: 95593 - DNA, 307 bp, Homo sapiens
  chr6:39197084-39197391
  hyper
gtggggccccactcacgcggcccggggtgggcgaacaccagcggggctgaaagggcgccctggaccgcggatgcgtaaggagcgggaagaacacaggacttgactctgggcagacacgtgggccgcttctccacgcgtcgctcctccgcgcgccactagcagtatgcgccgcgcccgcctccgcacgcctctttaaccagcgcccggcgcgctctgcccccttgctccgggctccgaccggggaggagcccaggcgggccccgccccttccccgcacaagcagcccggcgagcgcaggagtgagcgc

SEQ ID NO: 95594 - DNA, 25 bp, Homo sapiens
  chr6:392409-392434
  hyper
gctctcccgggcctgctccggggtc

SEQ ID NO: 95595 - DNA, 372 bp, Homo sapiens; identical to SEQ ID NO: 519
  chr6:392587-392959
  hyper

SEQ ID NO: 95596 - DNA, 911 bp, Homo sapiens
  chr6:39281088-39281999
  hyper
gcctttctgggcagccgcgcggcggcggcgcgcccagtccttgtgtccgaagactcggagtaaagcgggttcagccagagagcggccctgcgtccgccctcctctcgaacccgggtctgcgcacgtcgagccccctctctgcgttgagggtggccccgaccagcacgcctcgggcccaatccacccaccctccgggacaaacgcgccttcccccaggctcctacggccgcgccctcgctcctgcgcatccttagacccggcgcccctgccgtcccagctcccagttcgcaaacgtgcgcccgggttccccctctggaagcggccaggtgtggcgtttagctctttgccacgggtgcgggtgcgaccaacccccaagcaggctcaaacgcgccctttcccgggtcaggccgggcggggccggttacgcgcgcgccccctgccgtagtcgtcctcgcccccaaatttggatgtgtccccaggcatctgcctcctcaccgggccagcatgccctctcgcccccaagtaggactcagcccggcttctcgcagtcctctcgctagggcgagggtcttttcctccgaggtcccccaaccctctggtccccgcgcaggaacgcccacccccgttgtgcccgcgtctgcgttcccgacgtttccctgaacaggaaacacctgaccagggcctgaataggccccctcgccctcggcccgtacaccccgcggcccgctaccccatcccgccgcgcccaggccgacgccgctcgcccctgacccggatcagcgagtccagcgccgggcggtccagacacgtgaagttctgcaacagctcccacttgtcgcgctggaagctgcggctggagtcctgcgccgcgcggccctccagcgtccagaacacgccggtgcccagcgcca

SEQ ID NO: 95597 - DNA, 115 bp, Homo sapiens; identical to SEQ ID NO: 520
  chr6:393124-393239
  hyper

SEQ ID NO: 95598 - DNA, 233 bp, Homo sapiens; identical to SEQ ID NO: 521
  chr6:393240-393473
  hyper

SEQ ID NO: 95599 - DNA, 766 bp, Homo sapiens
  chr6:39759800-39760566
  hyper
gcccagaggaggagccggggagaaacccgctgcccaggtggccacttttgcctctttgacccttccatgtttccaaaacagaaggggccctgagaacgctccctgccaaagtggggaacagctaccctcattgtacgcctcgccctgccggtggcgctctccccccgcctgcgttcggtctgaaagtgtgaaaattacaaatcccaagaaactgcaatcagaagtctacctagggaaaattcagagtaaccttgccataaatatcccgctccaagacgcctgacgtcagagcggggcgggcggacgggcgcgaggccgggcctggaggggcggcagccgcggcttcccggggatagcgcggagcacgcagcagcgagcggagcgcgggcggcggcgccgtacctcgggctgcgggagcgcgggcgccctggggtcctcggagtaagtgcggccggccctggcgctccccgtcttggggcccgggccgcggggagccctctccgctgggctcccacacttctctccctctgctttctttagcatgccccgcggggcttggggaggcagcagctccgcaggctggcggttttgtttctccaaagtgtttgcaggagccgccgaccccggagtgggctcccagggcctgtgtgtgtgtgagttgtgtgtgtgtatgagtgtgattgcgtgtgtctgtactggcacatctggacataggaaatgtctttggaaaactttttaaaaatgttttttgcggctttgaaacctg

SEQ ID NO: 95600 - DNA, 125 bp, Homo sapiens
  chr6:398564-398689
  hypo
cagttacagagagagcgctccaagtttccttccaaagctgtgcactggctcgtttctccatcagctttggttttccagttggtctccagctcatctttgcctcacaagagcgtgccctgctagtt

SEQ ID NO: 95601 - DNA, 443 bp, Homo sapiens
  chr6:39901919-39902362
  hyper
ggtccctcccagaagcggtcaagcagataggccgggagctactgggggaaaagggcagtgtgccggggccactcctgccccgggaagctgtggacgcaggcggggtgggctcacctccgaggcagctcgcgcggactccccggggcagggctgggtcaccggagcccctgagctgcagctccgggcgctggacctcagaagccgccgcagcatccgggacagtggccgcgccgccatgaagcctgatacgagcggaaccgcagcccgcttcgggagcacactggccgggcactcgcccccggggtcatcccagcaagggcggggaggggcagggggagggcgggacccgcgcagccaataggcgaggacgcagtcccgcgtggccttgtgggagctgtagtacgctccctgtgcccactttcctgggccggggtagcgctcta

SEQ ID NO: 95602 - DNA, 33 bp, Homo sapiens
  chr6:4020063-4020096
  hypo
tttatttatttgagacggcgtttttgcttttgt

SEQ ID NO: 95603 - DNA, 33 bp, Homo sapiens
  chr6:4020336-4020369
  hypo
ggccctaacatttcaaaacgtttggaattcagg

SEQ ID NO: 95604 - DNA, 43 bp, Homo sapiens; identical to SEQ ID NO: 40814
  chr6:40244038-40244081
  hypo

SEQ ID NO: 95605 - DNA, 195 bp, Homo sapiens
  chr6:40317758-40317953
  hypo
agggctgaaccacaccgggtcagccctgtgcttggacagtgtctcactccagcagcatatcacagcaaggccgggagaggagaaaagcatcgtgcattcataaaccctttcatgtgccagagtgaatgcaaatgcacacactctcacattcacatgtacacactgacacacacccactctcgtacccacactgac

SEQ ID NO: 95606 - DNA, 35 bp, Homo sapiens
  chr6:40360217-40360252
  hypo
tgaagtccaggagctcgttgcgcaccaccaccttc

SEQ ID NO: 95607 - DNA, 340 bp, Homo sapiens
  chr6:40554520-40554860
  hyper
agagaagggggtgtccgcatgagcacctaggatgcggggagtcttcaagagaaaaagaaagggatgcaaagttcccggttccctcgggtgcgttcagccccgcgccgagctcccgcggacacccgggatcgcaaagacgcagcgccggcgaccactcacctgggcgaggcagcatctacccccggctgggtggcaccgaggccggctccgcggggcgcccgggctccccggctcggccacgcatccttccccgcccgagacagactcgagctaaaccctccggcggctccggcgaatgcaggcagatggtggcctcggacgtccacgcggggaaagccct

SEQ ID NO: 95608 - DNA, 40 bp, Homo sapiens
  chr6:40555175-40555215
  hyper
gcacactgccccccacgcgcgcgcgcatacgcgcgtaccc

SEQ ID NO: 95609 - DNA, 579 bp, Homo sapiens
  chr6:40555275-40555854
  hyper
atcacacgctccaatctgggagggagtcgggcgggctgcggagacagcgcagggccagcagtggagaaaacccagcggccagaggcgcccaggaacccggcggccgtgcgcaccgtccccgccgagctctccggcgcggcagcccccagtggcgaaccgcggagctgcaggagccgaaggcagcctctgcgcccgctgccctgcccgctgccgagcgcacccgcttccgagacgaccaacaccgccgcggaaaccagagggattcacggtcctggcaggggtggcgcggggacgcacggtggggcgggagtgggctggggccgcagtcgcggagggaggtgggcaggccgcgagccccggaaccgggagggcggtctccgcggtccagcggcacgggcagcccctgcggaaggcgagccgggcggccagggctgcacctctgcagctggcgacggcgctgccacctcacgtgcctagcgcgccctgcagccgtcagcccgccgcctgctggaggaaaacccgaccgcgccggccctaggctgggagtgggggctggggcgatcgcgcccacccagtcct

SEQ ID NO: 95610 - DNA, 30 bp, Homo sapiens
  chr6:41160377-41160407
  hypo
tggtctccgcctggccgccctcctccccag

SEQ ID NO: 95611 - DNA, 228 bp, Homo sapiens
  chr6:41337024-41337252
  hyper
aggcaacaggtgggacggggagccagggagtggaaacgccggaggtcctcaggctggggatcccggagtcctcgctcagattccgattccggagaaggccaattccgggaccctatccatgtcccattccgggcaccttcctcaaaagtaggggtgggaggggcataagccggtcaagtatttcccgggccttccggagcaatcttgcctaagcgttcatatttaacg

SEQ ID NO: 95612 - DNA, 338 bp, Homo sapiens
  chr6:41339221-41339559
  hyper
tgcttccccagagagcgatcgccccggacttgtgcctgtgttccggcctagggcagccggaacctcccgatatccccagaggagtctcaggacagcgcacagggaagtactggcttggagctgcgtgttccttgggcggccggcggagggcgaagagcaggaagagcccgggggacgacggtagcagagtgttggggaggccacagacgcggactgcgtggagaaagcacgcacccgggccgcagtagccgggcagggggacggcggaaagcagccctctctggaacattttattctgatccccgcaggactcccccgcgagccccggcttgagcagt

SEQ ID NO: 95613 - DNA, 426 bp, Homo sapiens
  chr6:41339601-41340027
  hyper
cgtgggcacttacacgttcccggggaggctgggggcaggagcttcactgttcacacaaagagcgcttagaggaggaacatttaagtttgggggcaaagaaagaaaaaagagttaaaggtttaggagatgggggaggaggatggggcttaaggacgcggtgttgccgcggctcagccatcggggcgggaagctcggggagggagagcgcctgggcccgcttctcgcctattctacgcagaacttttctctcctccttcttccctcgctctgcctctctcggggcggtctccggggactgtctctcacatccattctcctctcctccttgatttatgctgcagagtggaacgaccttccctgacctcattttcatgtcggcgcgagcacacccggagccggctacgcacattccggaggaggcgcgcg

SEQ ID NO: 95614 - DNA, 897 bp, Homo sapiens
  chr6:41340707-41341604
  hyper
ggcacattcccagtgcgggcgctcgcagcaccacctcgcctggccgcccccagtcctgacccctttctagcgctggatcggccgggtccggcctccgtgctcgcggggtcgtccgtcggcgctggctagttaagaaaaataaacaacgttccaaatgaaggcgattcctttcaacccaagctccgccgcctgccagagaaatgcaaacagcggggtacggccggagtccgccccagcccccgcgccggagctgcgggtggcagggtcgggccgcggtaacccgagccgccgcgccggctccccgcgcgctgccctccgcctgccccttcgcccctgaccccgcagtcggcgcgctgggcctgcgcccgccatccccagcgccccccaccgggccgggacctccgccagcggtcctcggcgcccttcctgccccctccccccagcggtctcggccccatcccgaaccgccaccctgggatccccagccctcctgcgccctcgaggccaccgggctcctgcgagcaacgcttccctgcggcgaccgcgcgctgggatcactcaacaccaagaaaaaaaaaatgcactgggaacgacagaaacctgccttagcgaactatcctctagtggatcgggcgtggggggctgcttccagataggacccctgctcaccctgcagggtgcggccgggacaactacgggcgccactgcggaaggcctgacctgatccggcacggtgtggccaccgtgggcccacagagggtgaaggggtagcttatgctgagtgggggtgtccacctggacagaccaggcgagcctcgctcctggtgcgggagctagttttccctggatcttccgcggcagagaagcctgcgtccgggaccagcagagtgagccgac

SEQ ID NO: 95615 - DNA, 532 bp, Homo sapiens
  chr6:41341760-41342292
  hyper
cgggaaggagtcagaaacagtcccgggcgcagagcgaagaaatcctgggacctcggcaagagggcctcaccactggagatggggtagctacgccgtgtggctgggggaggggtggtagggggcgcctagccagttgcaggggcctcgggactttccatggcctcacccctcttctaggacacgtggccagcgtcctccaggccaccactggggatgagggtgctcgagcctcggtgcccagagtgttgggaggagcggcggcgcacccgcttcctccgaattcctgcatcgcaacgctgggccgcaccgaaggcggtaggatgtgccaggcgtaaagctccgattggcttcgagagagtcgggggcaggcgaagacgcggaccacgcgggcttcctgtcctctttattcccagctctttttcgcgggataagcgtgtctgacggcttaagtgcagtctccctgcgtccctgcctgagctttccagctcccaattacttcgcgggattgggagccgagcgctctccctggagc

SEQ ID NO: 95616 - DNA, 923 bp, Homo sapiens
  chr6:41342779-41343702
  hyper
gggtccttcaaaaagcgccactttggagacggtgataaatctgcgctgcctgagtcgttcccctactcccaacccctcgctcctcatcactgcccctcctagaccctgctgtgtagacgggacctcaaggagttcccgagggaacagatttgaaagcccagctccgggttccatggacagtgtttgacaggtcagcccctcgctgtcctcctatccccctcctccaagtccggtccccctctttcaccccaacccccactctcgcgtgggactcagacactgatcccggagcgagaatgcggctgacagttaaattgcagtgtaggccgagggggggaaaagggaccatgtctctttaacgggccctgcagacaaagcgtctccccttggagcgagcggagccaggcgcagccgcgcgcagacctgtcagcgcgtctcacgcgcttgggagagagtttgcaaagtcataattatatctcttaacctgtcttgctctctgcagaagaaggtcccattatattgaaatgagattattagccatcaaatactttctttctcgggagttttttttttttttaattcaaataccttaacgacttggcaattgcattttgatcagatttagttggcgccccagcccggagcgggagccggggcgggaaggcagctggttggggagcgacgagggggaggtcgggggggaagccagaagagtttgcaaagaaatgcaacccctcttttatctcgctcctaggtctcatttacctggcgagggcctccaggcctggggagggggtgtgagatgagggaagttggggcagagtggtgagatgtcttttatccccttgggacctggtcggcttaaaccgcttctttgaaaatggaacgcgactttcagacaaggcgaacgtggacgccgaggc

SEQ ID NO: 95617 - DNA, 145 bp, Homo sapiens
  chr6:4135160-4135305
  hyper
cttcaaggccaccaccgtgtttcggttttgttccctatgcacagattcgtgcgggttcccgggaccccagggaggtgcagcgtgcttcttagccgttactctgtacccggccatttcactttatagcatacgtgttctccaagaa

SEQ ID NO: 95618 - DNA, 30 bp, Homo sapiens
  chr6:41395227-41395257
  hyper
agcgcaaagcgggggcgcctacccccaggc

SEQ ID NO: 95619 - DNA, 557 bp, Homo sapiens
  chr6:41438018-41438575
  hyper
actgagctgagaaggcggtgagggccaggcattgcattggtcctcgccttctcggggcgccgctccccacgcagtctccctgctcgagctcgggaagaggagacaccttcctttcccaccctggagagtctggtggtccccgagcgccccgccccacccgcgccctcagggacggccagggccgggccgcgcgtcctaggcacccggagcgagctgctaagccggactggacggcgggagccatctgggccagcgcgggggccggggaagttcaaggcccgggcactgcgcagcgccgagggggatgacccgccgtctccggggcgccagcgccggctagttgctcaacctgctggattagtcactcggcgggacccgcgggaccgtcggaaaaacgcgaagggagcgctaacgcgcagtgggagggaaggagaggactgaagagagacgggggaggggagaggaggggtcggctgccaggcctaggtggggtgaatccgcagctgggctgactcaagcggaggagccggaaggacaccccgcgaggcttcggggcg

SEQ ID NO: 95620 - DNA, 235 bp, Homo sapiens
  chr6:41472913-41473148
  hyper
gcgcggcgcgagggacgcggcatctggaattgcgctgcgctcacggccaaggccgattgtttagtctgcgcggcggggcgggcggcccgcgcggtggccccacatctggagcctcggccagacggccctgctggcggctggccggggtgcgtgtgcatttttaactctgggatttgctgacaagttaagaagtcagaaagtcagtgacggcgggaactggcgaggcgctcaagga

SEQ ID NO: 95621 - DNA, 186 bp, Homo sapiens
  chr6:41605766-41605952
  hyper
actgagaaacttgatcgcgcccatctttggggcaaagagatttggaggccgcaattattcagacagttccacgaagtggttgaggtttctctctttctcctgattttccagaaacttttgcagagtttggacaggcaaaggaaaacgtgcagcccgcggatctccgggcctcagagagcagggagt

SEQ ID NO: 95622 - DNA, 320 bp, Homo sapiens; identical to SEQ ID NO: 2812
  chr6:41606037-41606357
  hyper

SEQ ID NO: 95623 - DNA, 95 bp, Homo sapiens; identical to SEQ ID NO: 30490
  chr6:41606527-41606622
  hyper

SEQ ID NO: 95624 - DNA, 153 bp, Homo sapiens
  chr6:41709830-41709983
  hypo
gggatggggtgtggtcgggtggctgggagaggattcgagaggaagcccaggaaggaaggccctggagcaagactgactggagccagatgcccgctgggatgcctccaaaccccaaagcattgagcactgagcctcagtcgtccagggcggccg

SEQ ID NO: 95625 - DNA, 35 bp, Homo sapiens; identical to SEQ ID NO: 40816
  chr6:41715572-41715607
  hypo

SEQ ID NO: 95626 - DNA, 192 bp, Homo sapiens
  chr6:41773568-41773760
  hypo
ctgagtggagcatggcgaagggcgacactagggcccacttcccggaccacatgactcggaagagggtgtgcagttcacggcagagggaaatgtgctttgaactcggctccttgttctggatgagctccagactccgactaatggaggccctgccgttccagcagaagccctcccgctcgcatgcctcggccc

SEQ ID NO: 95627 - DNA, 37 bp, Homo sapiens
  chr6:41919768-41919805
  hypo
ggattacaggcatgagccaccacgcccagcctagatc

SEQ ID NO: 95628 - DNA, 20 bp, Homo sapiens
  chr6:42062066-42062086
  hypo
gcctgagcaacacagcgaca

SEQ ID NO: 95629 - DNA, 23 bp, Homo sapiens
  chr6:42066001-42066024
  hypo
agccaccgcgcccagccaaggaa

SEQ ID NO: 95630 - DNA, 20 bp, Homo sapiens
  chr6:42076874-42076894
  hypo
ttaaatagggcagtccggcc

SEQ ID NO: 95631 - DNA, 155 bp, Homo sapiens
  chr6:42090718-42090873
  hypo
tatgcatcaccctggcgatggcttgattcagactggggagggcaagagagaaccccagaaaacacaaccttgctgccacccactgttctatggacccagctctcagacgcagagggacaggccgggcgcggtggctcacgcccgtaatcccagaa

SEQ ID NO: 95632 - DNA, 61 bp, Homo sapiens
  chr6:42110212-42110273
  hyper
ggaccttccctccctcgccctgccctgccccggactgaactcagcacggtttccccagggg

SEQ ID NO: 95633 - DNA, 77 bp, Homo sapiens
  chr6:42110870-42110947
  hypo
gagaatgtgggatgacgaaatcttggcattctgtgtctgtacatcacattgtttttctttttcttttcttttctttt

SEQ ID NO: 95634 - DNA, 90 bp, Homo sapiens
  chr6:42184556-42184646
  hypo
aaacaaaaacaaaaacggtggtctcaaagtgtagtctgaggacgtctgtggggtctgagacactttcaggggatccgggaaatcaaaact

SEQ ID NO: 95635 - DNA, 176 bp, Homo sapiens; identical to SEQ ID NO: 40822
  chr6:42190336-42190512
  hypo

SEQ ID NO: 95636 - DNA, 38 bp, Homo sapiens
  chr6:42419139-42419177
  hyper
gggaacctggcccctcgtccccccgacaagagtgtgct

SEQ ID NO: 95637 - DNA, 41 bp, Homo sapiens
  chr6:42441227-42441268
  hypo
gatggcgtcttcctccgggcgaatcacgaggtcaggagttt

SEQ ID NO: 95638 - DNA, 30 bp, Homo sapiens
  chr6:42626581-42626611
  hypo
aaattaatgtcttgacgagtttttcccaac

SEQ ID NO: 95639 - DNA, 30 bp, Homo sapiens
  chr6:42762875-42762905
  hypo
aacgtgacaaaaagtcgggtgcggtggctc

SEQ ID NO: 95640 - DNA, 35 bp, Homo sapiens
  chr6:4276412-4276447
  hypo
accaatctggttaatcaacacggttgcacctgctg

SEQ ID NO: 95641 - DNA, 43 bp, Homo sapiens
  chr6:42773440-42773483
  hypo
aaagaggacaaggaacgggccaggtgcggtggctcacacctgt

SEQ ID NO: 95642 - DNA, 43 bp, Homo sapiens
  chr6:42773723-42773766
  hypo
agtgagactccatctcaaaaaaaaaaaacgaaggaagaagtag

SEQ ID NO: 95643 - DNA, 224 bp, Homo sapiens; identical to SEQ ID NO: 40824
  chr6:42813314-42813538
  hypo

SEQ ID NO: 95644 - DNA, 37 bp, Homo sapiens; identical to SEQ ID NO: 40825
  chr6:42846392-42846429
  hypo

SEQ ID NO: 95645 - DNA, 96 bp, Homo sapiens; identical to SEQ ID NO: 40826
  chr6:42846609-42846705
  hypo

SEQ ID NO: 95646 - DNA, 28 bp, Homo sapiens
  chr6:42868404-42868432
  hypo
gagccaccgtgcccggccagcttgattt

SEQ ID NO: 95647 - DNA, 176 bp, Homo sapiens; identical to SEQ ID NO: 30491
  chr6:42879393-42879569
  hyper

SEQ ID NO: 95648 - DNA, 139 bp, Homo sapiens; identical to SEQ ID NO: 30492
  chr6:42879621-42879760
  hyper

SEQ ID NO: 95649 - DNA, 38 bp, Homo sapiens
  chr6:42928321-42928359
  hyper
cctagcccaggattgcgaggcagcgccctccctgcagc

SEQ ID NO: 95650 - DNA, 26 bp, Homo sapiens
  chr6:42951450-42951476
  hypo
gggattacaggcgtgagacaccgtgc

SEQ ID NO: 95651 - DNA, 37 bp, Homo sapiens
  chr6:43119834-43119871
  hypo
tcggcctcccaaagtgagccaccgctcaaagacgtga

SEQ ID NO: 95652 - DNA, 30 bp, Homo sapiens
  chr6:43149410-43149440
  hypo
aaagttttgcggggccgaggaccttctccc

SEQ ID NO: 95653 - DNA, 38 bp, Homo sapiens
  chr6:43193505-43193543
  hypo
ctggaggatcagcctcgaagtatcgatccagcagggcc

SEQ ID NO: 95654 - DNA, 265 bp, Homo sapiens
  chr6:43211197-43211462
  hyper
ctgatgctggcggcgcggtgcattgtgggcagctccccgctctgccgctgccgccgccgtcgcccaaggaggatcggggccgggccgggccgggatgatccgggtcggaaggccgccgccgccggagggagcgggtcacccaacgccgcactgagccgcccccgccccgccccggccccgggggatgcgccgccccgagctgctgcctccgccgccgccgcagccgcagccgcagcgggcacagagcaggtgaggcggggcgggg

SEQ ID NO: 95655 - DNA, 89 bp, Homo sapiens
  chr6:43211478-43211567
  hyper
cgggggctccttcgtgggctcagggggctccgcctggctcgcctcccagcgcagccttcttgggctcccctccgcgctgctgtcgccgc

SEQ ID NO: 95656 - DNA, 106 bp, Homo sapiens
  chr6:43215365-43215471
  hyper
tcctgacctctgagtcgtgtgtgtgtgcgtgtgtgcttggcgcgtgtgcgcacccgcgtgctttagtggggaggctcagttcacgggagtgcggggttggagagga

SEQ ID NO: 95657 - DNA, 438 bp, Homo sapiens; identical to SEQ ID NO: 30494
  chr6:43237245-43237683
  hyper

SEQ ID NO: 95658 - DNA, 164 bp, Homo sapiens
  chr6:43242769-43242933
  hyper
tggccactcactaaccggccctcacgcactcacactcacacccacactcacacactctccctccgtagctgcgcgcacttcgcccactctccggaccctgcactagcggccccggccgggagggcacgaggactgcgcagccggacccccgcaggtccccaagc

SEQ ID NO: 95659 - DNA, 42 bp, Homo sapiens; identical to SEQ ID NO: 30496
  chr6:43243433-43243475
  hyper

SEQ ID NO: 95660 - DNA, 178 bp, Homo sapiens
  chr6:43244096-43244274
  hyper
cggcgtcggggggtggccccaggcccgggtagaaaagcatgcactgagccccctgcccctagactgcgagtactgtacaaatccaacacttgaaaccgacacgcacacgcgcggcgccgccacgggggtgggacacggacacgcacccacgcgcacacggccgcgcacgggcggggag

SEQ ID NO: 95661 - DNA, 217 bp, Homo sapiens
  chr6:43251405-43251622
  hypo
agcgcccctggagaacggcctcgccctgtcagggctgaatggggctgagatagagggctctgccctgtctggggccccccgggaaaccccctcagagatggccacaaactcactgcccaatggcccggcccttgcagacgggccagccccggtgtccccgctggagccaagccctgagaaagtggccaccatctcccccagacgccatgctatgcca

SEQ ID NO: 95662 - DNA, 92 bp, Homo sapiens
  chr6:43276520-43276612
  hyper
tccagctcatagctccgctccaggcagcgcacgcggcacacagtaggtacgccgctgcggctcagttccgccccctccgcaggctccaccca

SEQ ID NO: 95663 - DNA, 22 bp, Homo sapiens
  chr6:4334950-4334972
  hypo
gtagacccgagctgttcctatt

SEQ ID NO: 95664 - DNA, 169 bp, Homo sapiens
  chr6:434224-434393
  hypo
tgtgagccgcaaagtcgggcctgggcttcagccctgctactgcgactctgccgggacaaagggaggcactgatccccacaggccatcccagacactgatacatttttgacttgccagcatcttcgctaccttctctttcattttcctataatcccgtttcctttcacag

SEQ ID NO: 95665 - DNA, 67 bp, Homo sapiens
  chr6:43423602-43423669
  hyper
ctgccttcgcttgtccgccgctcatcacgcttctcatatagatctatgcacacgcaggcaatcgctc

SEQ ID NO: 95666 - DNA, 206 bp, Homo sapiens
  chr6:43424414-43424620
  hypo
actgcactccagcttgggggacagagcaaaactccgacccccgcccccccccaaaaaaagacaaggacccagaacataatttctagtttgtgcaggacaacagggcagaggtcaggaacgctagcgcccatctctagtccttcagattgagatttcaccatctttaaattcaaaacatcggaaggagcagtcgctagtcggggcag

SEQ ID NO: 95667 - DNA, 103 bp, Homo sapiens
  chr6:43425406-43425509
  hypo
cccctttttttttttttttaaacaatgaacatctataacttgttttttgttgttgtttgtttgtttttccttgagattatcactctgtcgcccaggctggagt

SEQ ID NO: 95668 - DNA, 71 bp, Homo sapiens
  chr6:43476085-43476156
  hypo
acggcaatggcaaggcggctccagcccttaggggtgatgccagggttggcactcagcgttagctccttcaa

SEQ ID NO: 95669 - DNA, 209 bp, Homo sapiens
  chr6:43478536-43478745
  hypo
tcctcgccaagatggcggcctcatcagggaggccccaggggccacggctgggcagagccagcttgagctgctggggagaagggtaccccatagggtccctagggcaggggagcctcagatagatgcaaggtcctggtgccacaccttctcaggtacgcagggcactgttgacatctgagggtgtgtccgtgccgcgagactggggcagc

SEQ ID NO: 95670 - DNA, 30 bp, Homo sapiens; identical to SEQ ID NO: 14862
  chr6:43486338-43486368
  hypo

SEQ ID NO: 95671 - DNA, 74 bp, Homo sapiens
  chr6:43612825-43612899
  hyper
cgctgacctgatggacgccgacagcctcctgctgtctctggagctggcgtccggcagtgggcagggcctcagcc

SEQ ID NO: 95672 - DNA, 312 bp, Homo sapiens
  chr6:43613052-43613364
  hyper
cgctctataggtgaggaggcccccgggacgggctccccagagggtggctacctggaggcagggcggggtgggcgggtcgcagcaattgaaaggggcggggcccatggggccaagggaggtgtgggcgggatctgagatgagtggaatgggggagaccctggggggcgggcctggggacggtcaagaggtggttgagggaaagggcggggatggggatgtctcggaatctgaggctagggcggagcctgagagggcggggcaatggacgggcgatgtcccccggagggcggggccttgcgagagcttgttctc

SEQ ID NO: 95673 - DNA, 149 bp, Homo sapiens
  chr6:43639599-43639748
  hypo
tgtagatgggcttgacggagccaggagcccagcgcgtcaggtacctgtggagggagaacaaagaggtgcctgtgagggctgggggcccaagctggacgtgggagagtggagcactacctcctcaggccaggccacggttgggcaagcaa

SEQ ID NO: 95674 - DNA, 30 bp, Homo sapiens
  chr6:43706822-43706852
  hypo
caccttttctgaggacgctgtgcaggccaa

SEQ ID NO: 95675 - DNA, 72 bp, Homo sapiens; identical to SEQ ID NO: 40831
  chr6:43748463-43748535
  hypo

SEQ ID NO: 95676 - DNA, 30 bp, Homo sapiens
  chr6:43749564-43749594
  hypo
ggcctgggggctgaccggctgggtgggggt

SEQ ID NO: 95677 - DNA, 30 bp, Homo sapiens
  chr6:43750186-43750216
  hypo
tgagaagctgaaagccgattccaggtgtgg

SEQ ID NO: 95678 - DNA, 37 bp, Homo sapiens
  chr6:43893966-43894003
  hypo
tacaggcgtgagccaccgtgcccggcctgaccagctc

SEQ ID NO: 95679 - DNA, 23 bp, Homo sapiens
  chr6:43970452-43970475
  hyper
gtgcagacgctggcccggatgtc

SEQ ID NO: 95680 - DNA, 73 bp, Homo sapiens
  chr6:44044377-44044450
  hyper
ccggagcagctgacccgctggcggtgggccaggtcgcggcggggcctggaggcagcaacgtgcggcgcggcat

SEQ ID NO: 95681 - DNA, 100 bp, Homo sapiens
  chr6:44241060-44241160
  hypo
tggcactgccaagcccgccatgagctgcagcaccgtgttgatgtgagcagtgtgcgggaacgtgtgggccgcatgcagcaagccacgccctgcatctggt

SEQ ID NO: 95682 - DNA, 30 bp, Homo sapiens
  chr6:44250199-44250229
  hypo
acaagtccagctcctcgaggactgggtggt

SEQ ID NO: 95683 - DNA, 350 bp, Homo sapiens
  chr6:44264917-44265267
  hyper
gtaacccagggaaaccggcagtgcagtgggaggtagggagatgaggaagcttccgcacccgcgggagggattacagccctcgggtgatgggaacggacggcctttcggagaagcctagggccccagggcttgggaccgctctcctccacgccctacggatgccccactttccccctcttcttcccagtccctcccctcgcctcactcggatccccagccccgggccagacggtttgcagacagtgactgtggtggggaggaggcgcggggcgtcctcgcgtggagggcgtggggtctcccgtgggtacggaccggcgcttccccgccacggaaaacgcaacccaggcaat

SEQ ID NO: 95684 - DNA, 279 bp, Homo sapiens
  chr6:44265528-44265807
  hyper
gccgctgccgctgcgcgccaggcacgcggcttactcgcgcgcagggtggccaggcccggcctcgggacggttccgtggaagcggccgctttgcgggtagtgggactgtggccttgcgctatgccctgtgcttccgtgggacgtgtctaggaacgggtgggctttctgcgggaggcgggggtcgggcagggctgctggtctggagtgcttgtgctctcttggtagcttttgtgtggcaatggatagggagctggtccaggaaaagcgtctgtggaagaag

SEQ ID NO: 95685 - DNA, 41 bp, Homo sapiens; identical to SEQ ID NO: 14865
  chr6:44437145-44437186
  hypo

SEQ ID NO: 95686 - DNA, 53 bp, Homo sapiens
  chr6:44443969-44444022
  hypo
gtaggtgttacaaagcgaggcccagcctgggtctggcacggtgaatcctcctt

SEQ ID NO: 95687 - DNA, 51 bp, Homo sapiens
  chr6:44695868-44695919
  hypo
ctggggcaatgatggcgtcaggcctgtggaaataagcgccaggtttgaata

SEQ ID NO: 95688 - DNA, 244 bp, Homo sapiens
  chr6:448910-449154
  hypo
ctgtgagagaacaaacgtgtgttgctgaagcccggagtgcacgcccagcgcgtggtgctcgttaaggcaatcagagcaaagtgacccagcacccttctagagaaatggtttcatatcgaagcttggaagtcaccgagccccctgattttataactgaggaaatggaggcaccccgtgttgggtcccacagctcaccagctcagccagtgttccctgagcctggcgctggcgggccctgggcacc

SEQ ID NO: 95689 - DNA, 30 bp, Homo sapiens
  chr6:45346268-45346298
  hyper
tccctaccctgacctcgcacagaatctgtt

SEQ ID NO: 95690 - DNA, 520 bp, Homo sapiens
  chr6:45387578-45388098
  hyper
accaggtgtcatagccggtggcgcagaatcgcttctcggagtcaccgagggtggcagtggcaggcggcggctgtggggcgggaggggcgcggcttggggctagtgtctgtggagggatttggggaagaggcaggaacgtggagagaaacgtgggaaagggaaagaccgacgagggaggcgtggagcagtgcatggaggaagggcaggtaaaaataaagccccaattaggaaggacagagtagtatcccctgaactccatccttacccctcgagagcgcacacctggctaccccgcacccccacctctgctcccgcggtctggcagaccctcagtcccccgcgcatctcttcagcggggcgatcccgagtcacgcaaccacagccccccaagctcatcttgtactcgaaagggctccagagtccgcgactggcaccaggcccccatcttccgtgcccctcatgctctcagagcccttccaggccccttctagggcgcagacccgggcgtgggctcagcgag

SEQ ID NO: 95691 - DNA, 38 bp, Homo sapiens; identical to SEQ ID NO: 30505
  chr6:45388359-45388397
  hyper

SEQ ID NO: 95692 - DNA, 55 bp, Homo sapiens
  chr6:45388792-45388847
  hyper
ataaataaacagccacggaagcattttgaattttttagttcgtatttttaatttt

SEQ ID NO: 95693 - DNA, 683 bp, Homo sapiens
  chr6:45390864-45391547
  hyper
ggggctcagtccctccgcgcaaatccctccctctcccacctgtgcccgctgccaccccgacttcagccctagtccccctgacccgttcagcactcctcatgcctcctgcctggccttgattctcactcactccttcgcgccgtctccctttcccccaggatccccaaagtacccactcttgcactgcgagcggacttgctccaccccgcccctttcccgggggcgaggatccccggcattgtcccctggggctcccgcgtccttccgggacatcccggcctggccgcattgcgggctgcccgcgcagcctctctttggggctccgcgcgctctcacccgcttccctcacagccaaacgcctctcctcaggtctcggcgtccccttccccgacccgcagagttcagcggtcctggtccctcccgggctcccgtgccgggattcgtggggtgccggtgccgggcattagtgcccggggctgggcgtggggtgctgactgaggcgcgcgggctgcgctaccagtgcccgggagggtcctggacaaacctagggtctccagaggagggggtgtcagggcgggggcgtttgctctgttcgctgacccgcgccagatcccgttaccgggaggaaggcggggccgctggggcgtccgcaagccccgaagcgggggcgttcagggggcctg

SEQ ID NO: 95694 - DNA, 16 bp, Homo sapiens
  chr6:45492559-45492575
  hypo
atggtagaggctgggc

SEQ ID NO: 95695 - DNA, 119 bp, Homo sapiens; identical to SEQ ID NO: 40835
  chr6:45609047-45609166
  hypo

SEQ ID NO: 95696 - DNA, 265 bp, Homo sapiens
  chr6:45982726-45982991
  hyper
tttaggatctctgagcgaaagagagaaagagaattttaagaaatgtcattttcgctttgccaaagatcattgtgtcaataacgtttctctcccattcctccccctcctcccgttttaaaggaaaggttcacgggtccagccaggtttctgccgcatcccgacacctggagacgtctttcaggaccagcctgaatcgcgtccgggctgggctctggactcggactcgcagcggtgacagcggaggcggggacgggggtggacaaac

SEQ ID NO: 95697 - DNA, 468 bp, Homo sapiens
  chr6:45983215-45983683
  hyper
ccttcacaaagagctcgatctcggggtccctgtcgtccccgttagctgtcgccgagtctgtcatgccgttggcgcccggggctaccgtcccgggccggggaggcgccacctctgcagcacctgggccagcactctgcgctcctgccgctgcccagcggggctcctcttcagggcggtgtttaatttttcacaaaaccatctattctccagcccgagcagcggggtctgagagatcagtgtcccagatgctcacatgaaaaggagcgaagccgggaggaggcggggggccacggggaaagccgggttaagggaatgacaacaggtcgtgggagcaacaagtgccgggctgcccggaggtgtcacaggatccgcgactgtcagcgatcccgccgccgccaacgcgcccaaaatagccggcggctgcagggcggggtcagccgggcggggacgcggcggggacaccccggc

SEQ ID NO: 95698 - DNA, 203 bp, Homo sapiens
  chr6:46138598-46138801
  hyper
tggaggagactccctcgggcgcgccgcgggtaacggcgggagggtgactggaggaacgcccccggaacgcgcaggagctcacctgcgctcaactctggagcggagcacctgaccgcgccgcttccccgccccgcctcctggcttctattggctgctgcagagatagtcacttctgcctgggttgcccccgaaagccaggctcc

SEQ ID NO: 95699 - DNA, 207 bp, Homo sapiens
  chr6:46161493-46161700
  hypo
acaacaacaaaaaaacgatgggttgttcaacacaaaggactgactgagaattggacaaattttatgtcatcatataatttggattggtaggtgcaacaaagcgtgagttttgaagtgagtcttggtagtaaactgctgtttggttaacgagctggttcctaggtgagcagtctattgtctcggtaagagaaccgcttctccatttca

SEQ ID NO: 95700 - DNA, 36 bp, Homo sapiens
  chr6:4647938-4647974
  hyper
aggcacccttggaaccgaagccgcctggggaggcag

SEQ ID NO: 95701 - DNA, 922 bp, Homo sapiens
  chr6:46702603-46703525
  hyper
aaaagaaaagaaaactccatgtgttccctgcctgtcctgattctccccccagctctgagctcttagggttgcttcctttcgggaaaaggtttggaagaactggtgtctaataccgtcatcctctccctctccccgcaaggatcctagcgctgtttccgagggctgcagggactgtgagcccaggaccggccagcagagcgggtgcgactcagcgagcccaccccggccggtcgccgctccggggtcccgacctccagcgcggcgaccgtgcccttcctcccactcccgcctcgcccccggggcccctcctcactcaggcgcggcgcggagctgctcgcgggaactggggtccctgggcgcgttccaccgcgcaccaacgcgacccaagcgctccaaacccgactgcttctcgccgacagcactgcgagcctccgaccagccgctgtccccctggctgcgggccgagcagctctggcaggcggcgggcgggtgggctgcgcgcgggctgtgtcctgggtccgcctagcgcggccttgtggccccgaccctctcctcccctggtgatgctggaggaggtaccggggaggagcgtgtgtggccccggcctctcactagcagcggcggctcccgacgctagcctgctcgagcgcacccagcaccctccccaagaccatggcccgcacctggacccgcggttaacttagcccgccgcggagagagccaggcaatgcctgggtggtgtcgtgctcaccagctcctttccgcagacctgatgccgatcagatttactccctgctgaattcaccccccagtcaggccggttttccttgtttcaccgtgttctctgaatacactgaattactccgagcatctatagttggcaatgccctgcgcattttccgcactccgatacactttacac

SEQ ID NO: 95702 - DNA, 16 bp, Homo sapiens
  chr6:46951843-46951859
  hypo
ggagtcttgctctgtc

SEQ ID NO: 95703 - DNA, 93 bp, Homo sapiens
  chr6:47202360-47202453
  hypo
tggggggtttaagtgcgtgtgtgaggtctgctgcgatgcccgtacctttggtaataaaggaaccgttcctgctcagcgcggaggagccgctgg

SEQ ID NO: 95704 - DNA, 127 bp, Homo sapiens
  chr6:47539998-47540125
  hypo
cgcccggatccactgcgatggtgtacaagtgctgggtgacgaattgttctgtatcttgttgtatttacatggtgcgacatttgtcaaacattactgaaatgcatatttaaaacgggttcattttatt

SEQ ID NO: 95705 - DNA, 389 bp, Homo sapiens
  chr6:4775154-4775543
  hyper
accgcttaaggggaacggcgattcgactcgcagtgacttaagggttggcgtggtgcttgttcctgggcgtggggaggacaggaaaccgcggggtctgtgagacgccccgtggttgttgaaacgctgttggggggcacaaacgaatagggctttaggaagaaaactggtgggaggagccttgtggctccaaggtaggttaggaactggagcgagatggagcacggaggagtgaggcggcccgaaggatgcccggggagacatggaggaactggcgagggcttcccgatgcagggcctgggggagagggtgaactaatgcctctgcagtgccccgtggggaagttccgcatactcggccagagtgatcggagttggcggctgtctggggga

SEQ ID NO: 95706 - DNA, 32 bp, Homo sapiens
  chr6:47924450-47924482
  hypo
gagccactgctcctggccgagagtatggtttt

SEQ ID NO: 95707 - DNA, 186 bp, Homo sapiens
  chr6:4804538-4804724
  hypo
agtcatgttgaagtgcggggcgctgcctaagaacctagctcctaggctccccacatcactgcagggcaggcattagtcaccacttttagagctgaagagaatgagtctttggttaagtgttgaaatagaagtacagttcagatctcaaaataaagacctttgtcttacgaccgcatctccaggcca

SEQ ID NO: 95708 - DNA, 33 bp, Homo sapiens
  chr6:4836425-4836458
  hypo
accggagctgttcctattcggccatcttggctc

SEQ ID NO: 95709 - DNA, 273 bp, Homo sapiens
  chr6:4853849-4854122
  hypo
tttagattactgcatcgagtccctgtctcctgcctttcttctcccaatatccacattcctgtcaggaatatcttttaaaaaggaaacaaaacaaaacaccaggcagctgtcacctttgcgtacaggatagagcccatcaccgtttgtgtggcacactggctcctcacacctgtccccacacctgccccagcttctcctgccatgccacagcacacctgcgtgtgcagaacagcatggcaggcacctcttagctggcctcgtgtgctcccgtgc

SEQ ID NO: 95710 - DNA, 30 bp, Homo sapiens
  chr6:4858773-4858803
  hypo
agccacgggatcgagcgccaccctggccag

SEQ ID NO: 95711 - DNA, 65 bp, Homo sapiens
  chr6:4874127-4874192
  hypo
gctcattctggttcccgccttctgcctgtctgtacctgggtacacatgtgcgtgtcttttgagcc

SEQ ID NO: 95712 - DNA, 43 bp, Homo sapiens
  chr6:48951303-48951346
  hypo
gctggtgggccactccgagtgcggggcccgcaattgcggccag

SEQ ID NO: 95713 - DNA, 89 bp, Homo sapiens
  chr6:49002323-49002412
  hypo
caaaaaggtgttgcctcagaagtggggaataataagccttataattaatacttctctattgccatttaacaaagcgagacccaaatggc

SEQ ID NO: 95714 - DNA, 83 bp, Homo sapiens
  chr6:4910864-4910947
  hypo
caaaggctcaaggagcgagcatgtctggttgaggtctgcagaaactatgaagagggaaaaggtgtctccgtgggcctggaagg

SEQ ID NO: 95715 - DNA, 33 bp, Homo sapiens; identical to SEQ ID NO: 40728
  chr6:4920708-4920741
  hypo

SEQ ID NO: 95716 - DNA, 101 bp, Homo sapiens
  chr6:4931677-4931778
  hypo
attccaggtcataggcgttctaggcagagggaagaacacatgcaaaggtcctgagatgggcacaaccctgggtgacatgagaaccccgggtgatgtgagaa

SEQ ID NO: 95717 - DNA, 172 bp, Homo sapiens; identical to SEQ ID NO: 40837
  chr6:49464924-49465096
  hypo

SEQ ID NO: 95718 - DNA, 275 bp, Homo sapiens
  chr6:4951177-4951452
  hypo
aaaaacttgcaaaccctcatgaggagcctgtccccagccctgttttccagcctctgcctgcatgggaggggcagtgagtcagccacgtgtttgctttgccgcctctgcctgtgtgctctccaagctgcgggtttcacatgcagtaaacggcatcaagacattgacagaaggtgtatgggcagtcttacactgtctcagcgacttcagggccaaaactgtcttttgtgattttgcctcttttggaagtggaagccacctaccgaaattgtgtttta

SEQ ID NO: 95719 - DNA, 424 bp, Homo sapiens
  chr6:49518576-49519000
  hyper
cagcctgggggacctcgggccttttccgcgggaggtagggcgcggggctccgctagctccgggcgcccggaatcccgcgacggcaggggcgagccgaagccagggcggcggccacgaggacagaacggcagatcgggccctcggacctcgggccggggaggaattggaccgtgagtcctgggtcagagagaaagtgctctttctcctgcacccagagaggtggttagggactcgaggggaccctgcacgggaagaggtggccggtgcagaggaccttcctcatgcgggtggagaggaccacggcgaggagcccaactacccttctgtctttcaacgacaaaagcgaatttctggcaggcgtgtagccccgccgcgggacgcagcagacccacccaaatacgtgcttgtgcgggtggaggattat

SEQ ID NO: 95720 - DNA, 20 bp, Homo sapiens
  chr6:49576100-49576120
  hypo
ctcttttttttgagacggag

SEQ ID NO: 95721 - DNA, 164 bp, Homo sapiens; identical to SEQ ID NO: 40838
  chr6:49590413-49590577
  hypo

SEQ ID NO: 95722 - DNA, 43 bp, Homo sapiens; identical to SEQ ID NO: 40839
  chr6:49590817-49590860
  hypo

SEQ ID NO: 95723 - DNA, 26 bp, Homo sapiens
  chr6:50207704-50207730
  hypo
ggcgagcgaggcgtggagcagtgacg

SEQ ID NO: 95724 - DNA, 197 bp, Homo sapiens
  chr6:5026576-5026773
  hyper
tgcggagggagggagcgaggagggagggggacagcttagcctcccgcctcccagagcctctcctgaggctcccacccagcgcctttctttccttcctcccttcgtttatttctgggacccctccccacaaactttctttaaagcctggtcacgtgaggtctcctctgaggttttgctctctgcgggtctggacggag

SEQ ID NO: 95725 - DNA, 30 bp, Homo sapiens
  chr6:50352067-50352097
  hypo
tgcaaattaataccacgatcatataccact

SEQ ID NO: 95726 - DNA, 424 bp, Homo sapiens
  chr6:50674326-50674750
  hyper
taggccctatggttgcggctcaattcgtgcaacctcagttaccagggggtcccggggccagcgcggaattcgcggaattcaccaagccgcagctgcctgccgctgaatgcgaagagggcgcaggagactggcaggtacagctggtggtcccttcggcctgatttccctgctgagtgccacagcgtccgagatccacgactggccaggtggagccaccgactctgaagagaaccagaggcggaccagccaggggagagggcaaccctgggagcactgcacccttgtcggtcccctggaaagctagcggtaagatccgggaggctgaatttgaggccgcggtagtccaggcgacttcccctggaaggtgtgacgatgacttgtactgcaaaagaagcctagaccaggcctccgtctgggtgttttc

SEQ ID NO: 95727 - DNA, 735 bp, Homo sapiens
  chr6:50681604-50682339
  hyper
aggagctatctgatccgggcaaaaccattacaatttagatatctacctatagaacattttttttttcctttaaaaattggaaaatacaagaagtttggatttttttttcccgattctttttttggagggggaaattgcatcgtaagctttcggagaaacccaacatgtcaactacctttccgggactagtccacgatgccgaggtattattacttttttttttttttttttttgagcgcgcgtgtgtgtggcggcggcggcggtggcggcggtggcggcggcggtggcagcctcccctgtctctaatctatattggaccgttacgtttaattataatctgtctttcgggggaagttaaggaaggaaaggggagaaagttcgttatgacatctgtcgccagggagggcaactctctgccacgttaagaaacatttgccataatgagcgggaaaacataatcttaataataaaaggggggagtgaagagaaagagatagagacggaaagaaagattctcagaaaagcaaagaaaagggactggtggggaagcagtagatgcacaagggggatggggaaaacgcaccccttttggaatgggcttattcaaggaaagggaagcagaaaagagggagtcggattccctccctcgaatgactaaggaagggagcaagttgaacgatttgcacagactggattttttaaaatatatggacaatgattttgagcagcccgggc

SEQ ID NO: 95728 - DNA, 236 bp, Homo sapiens; identical to SEQ ID NO: 2816
  chr6:50682448-50682684
  hyper

SEQ ID NO: 95729 - DNA, 230 bp, Homo sapiens; identical to SEQ ID NO: 2817
  chr6:50682711-50682941
  hyper

SEQ ID NO: 95730 - DNA, 366 bp, Homo sapiens
  chr6:50682991-50683357
  hyper
cgctccaccaccagtccttccattacgagtttcagcacagccacccggccgtcacccccgacgcctactctctgaactctctccaccactcgcaacagtactaccagcagatccaccacggggagcccaccgactttattaacctgcacaatgcgcgggcgctcaagtcgtcctgcctggacgagcagaggcgggagctgggctgcctcgatgcctaccgccgccatgacctgtccctcatgagccatggctctcagtatggaatgcacccagatcaaagactcctgccagggcccagcctggggctggccgccgcgggagcagacgacttgcaggtaaataagcatgcagcgaatttgtctgctc

SEQ ID NO: 95731 - DNA, 88 bp, Homo sapiens
  chr6:50684010-50684098
  hyper
acgtgcactcaaaaccgcagcccagttaggtaatttacaagtttatttttgctcttccagccattacattttacgtaaaatgcacctc

SEQ ID NO: 95732 - DNA, 64 bp, Homo sapiens
  chr6:50684905-50684969
  hyper
catttttcaaaagagcggattagaacatttgcaagcactagacaaagagcgaatcccgtgcaaa

SEQ ID NO: 95733 - DNA, 161 bp, Homo sapiens
  chr6:50689869-50690030
  hyper
tatttgccactgcctcggaggcgcagctccctgcgtgctgactctcggttaatggtgtacgcgattttgcccgcagctccggctctccaaccatcagaaccaataatctttactttaccctgtgctcgcgtatcgatagcttctttcgcctcgggcgtagg

SEQ ID NO: 95734 - DNA, 178 bp, Homo sapiens
  chr6:50690519-50690697
  hyper
ctaaaaaggggggggcgggggatgggagaggaaaaaatgaaaaaagtgaagaggggaagcgcccttgtttcgctttgtgatcattctgccttgcagccccaggctaatttcagaagcttaaacactgcggtagcctctgggccacgcgaagagggagcggacccggccatgggcaggc

SEQ ID NO: 95735 - DNA, 30 bp, Homo sapiens
  chr6:50691065-50691095
  hyper
cagagccttggaatccgggatggagaaagc

SEQ ID NO: 95736 - DNA, 424 bp, Homo sapiens; identical to SEQ ID NO: 30521
  chr6:50691789-50692213
  hyper

SEQ ID NO: 95737 - DNA, 257 bp, Homo sapiens
  chr6:50692299-50692556
  hyper
cgcggaggccgtgagtatggctcagaggcagatttagaggctccagggacccgcggctccttggagacagccgccgctgtttcctctgccccagtagcctgggatgagaagagaaaaagctcacccaggctccggcgcttgtctttcccatccagttgcagcacagacggtggcggggtgtgtgtgtgtgtgtgtcggcggggggacctgtcttgtcctaccccgcagttcacaccctgcaacggggtagttgtttt

SEQ ID NO: 95738 - DNA, 30 bp, Homo sapiens
  chr6:50786551-50786581
  hyper
gatcattacagacagcggagtcctgagaag

SEQ ID NO: 95739 - DNA, 713 bp, Homo sapiens
  chr6:50787164-50787877
  hyper
aggacagagaattagcgggaaagaagtagatggctggagatatggatggatagagcaaaatagaagtcgtagcagtttattagtttctgttttcttgtgttttgcttccttgagggtcactgcgtccgaacagaaatcgcagccgcctcctgtgtgggcatctttcacggaaatttctgcccacgttcaatgcgtacgggtctctagcactgaggctagctcaactcttcggggcaggagaagttgcgcccagccaggaggacgccagccgcctccggggcccggaccgcgctcgccaaagcccttttccggctcgggcgagggctgacgcggccagacggctccgctactcgcgggcgaggcggactaggcggacgaggcggccgaggcgggcgaggtgggagaggcgggcgaggtgggagaggcggccgaggcgggcgaggcgcggggcgcgcggcgggccaggctggggaccgggaagcccgcggagcctcgcttttaagcggaatggtctgggacagccccaggtggttgccaggggaagggaggaagggaaggttctgctgagacgtcgaggttggaaataaaaacttcggaaaggcgaagcggatttagaaaaggagggaagtcgaggcgggcgaagcgggccatggagattgctaagaggaaaagttggagagaaaaggaaggaagagaagcagactcccgggtgg

SEQ ID NO: 95740 - DNA, 452 bp, Homo sapiens; identical to SEQ ID NO: 30524
  chr6:50787949-50788401
  hyper

SEQ ID NO: 95741 - DNA, 205 bp, Homo sapiens
  chr6:50789374-50789579
  hyper
tctccactgaatgaacgtcatttacaatagtaggggagctctgcgctcgctgctgcttcacgctccatttgtcctctattctccctttaaagtactcgtgtaatattaatagtcatgaatatcaattattatgaggcggtgtaggcaagcggagggaggaaggggcggccgagcagtctgagcccagcttcgggtgaaagaggac

SEQ ID NO: 95742 - DNA, 372 bp, Homo sapiens
  chr6:50791123-50791495
  hyper
ggcacgatggtgtcccgagccacagctcgcggctctcccagctgggctcggtgtcccaaggaccctactcgagcgccccgccgctgtcccacaccccgtcgtcggacttccagccgccctacttcccacccccctaccagccgctcccctaccaccagagccaggacccctactcccacgtcaacgacccctactccctgaacccactgcaccagccccagcaacatccctgggggcaacggcagcggcaagaagtgggttcggaagccggctctctcctgccccagcctcgggccgccttgccccagctctcgggccttgacccccggagggactaccactcggtccgccggccggacgtgctgctgcatt

SEQ ID NO: 95743 - DNA, 82 bp, Homo sapiens
  chr6:50791550-50791632
  hyper
cggccatcccggaatggaagacgtccaggtaaccacaaacaaacaaacaaacaaacaaaaaagaccacgaataaggaatgct

SEQ ID NO: 95744 - DNA, 429 bp, Homo sapiens
  chr6:50793335-50793764
  hyper
atagtcttgtcaaagcgtcggaaaggatttagtgtttatgtgaacggagcacctcggggccaagttgttgctgtcgggaatacagaccacagaggtagagagctgaaaggagaaaagcagcaggcagcacaccggagccacttgcaggctctccactcacccaacccccaccctgttcctcccctgctttatctcatttcgtcacctgccgggaggcccacgggaccttcttgggacgacccctatagtgcaagggacacaccctgctcctgtccctagagggaaacagcaaagacagggacggtctctgcctccgcggtgatgacagacctcccaaggccagggtgaagttgactgatgcagggcaggtgacaaagaccaggggttatgtttccaggaccacagcctcgaatccgaaggcttccaatc

SEQ ID NO: 95745 - DNA, 192 bp, Homo sapiens
  chr6:50794608-50794800
  hyper
tgagttgtttttctgcgcttccgcatgcagtcctaattaaatctttacgatcctccctgtgacgattaagcgccagcatgctgcgtgaatatcctgtacaaaaacccagcaggcggccgtaattagatagaaaatcagacaagagccttctcattaactaccacaactaccccacgtcgctgatgaggcgtt

SEQ ID NO: 95746 - DNA, 228 bp, Homo sapiens
  chr6:50798960-50799188
  hyper
agtagagagagcaaacgagtggagtgaaggtagccagcgtgataaatggctctttcatttgaagatctccagagctcgtttacggctaattttctgtattggccccctttgagctattaatgcaatctgcagggaccgtggcccctctcctcttagctgccccattagagctcccattaagctgcctagtctcaactccatggcgggagtgggcggggggagtaatga

SEQ ID NO: 95747 - DNA, 564 bp, Homo sapiens; identical to SEQ ID NO: 30531
  chr6:50803804-50804368
  hyper

SEQ ID NO: 95748 - DNA, 108 bp, Homo sapiens
  chr6:50805738-50805846
  hyper
cggtttgaatttacccgcgggcaggcgcaaagcagcaaatgtcacgttactcacctccctggtggaaggtaagcaagacgtgtggccatttcacgaagtggctgagct

SEQ ID NO: 95749 - DNA, 128 bp, Homo sapiens
  chr6:50808631-50808759
  hyper
caggcctgcagtgggcggcgctgcgtgcgcccgcacgtttctcttgcaggcgcggcccaaacagccgcgctcatttatttagtgttggaggacgcggtttgtcccgttgacagcgtaatttaaagaaa

SEQ ID NO: 95750 - DNA, 163 bp, Homo sapiens; identical to SEQ ID NO: 30534
  chr6:50810551-50810714
  hyper

SEQ ID NO: 95751 - DNA, 669 bp, Homo sapiens
  chr6:50810936-50811605
  hyper
cggcgccccggccatttgcgccgcgctcacggccctgcagaactatctcaccgaggcgctcaaaggcatggacaagatgttcttgaacaacaccaccactaacaggcacacgtctggggaaggcccaggtagtaaaactggcgacaaggaggagaaacacaggaaatgaaaaatttttaaaaaaagaaggaaaaatgttttaaatacaaaaggaaaaacagacaaaaatttaattttagctttaaaatattggattggctttggaagaattatattaggtagaatacacatacaatcaaaattttaaaaaaaaaagctaaataacttaaaaaaaaactgaggcgtacaacggagcaacaatatcggttctcagtgtctatttcaagatacatttggagacaaccgtccggattttccacttcggttctttcgagtttagtaatactgataataaaagaaaaccatgatttccccttccctttggaaaataaacataagactaaacatgagaaaaacgctaacttattggaagaaaatcggagaaacgttggtgtcaatgctttgagagctggttgactgagacgcacgaactttttaattttaaatatatttttaggaaactctcgcagtccccgccctccatctcacctcacccgtctcccaaccacc

SEQ ID NO: 95752 - DNA, 385 bp, Homo sapiens
  chr6:50811816-50812201
  hyper
tgcaatttttggtgccggccggcagagcaggttctggcggctgaggaaaatccggaccaataagttgattcaaacatcatcagttcctttcagaaatgttactagctcccagccttgccagcatctgcatagagagaatctcacatttattatatttgtgtcatctactaattttatgaactatagtaaaaaaaaaaaaacacacacacacacaatatgaatacgttgattagtatgtaattccttcggaggggtatgtaccatttcattctcttctgttttccaaagctttgcccgcatggtttatgagcttcttcaaagaggacttgggcttcctacacaatctataaggtacagagaaaaaaaaatccgatccctttttaat

SEQ ID NO: 95753 - DNA, 640 bp, Homo sapiens
  chr6:50813299-50813939
  hyper
cagctcagaggcctgcgccttcgtccgagagctcggccgatcgcattagatgtgttctgattgcacaaggccaggagagaccacactgaaaacgatcgtctcctttccttgcagggcaacgcgccccacgcgtgtgacgtgcgagagacgcgatggacgcgccttgctcttactgtgcaggtcctgagagcgtgtgggccacaggcgcccagtcgtgttgaggacatagaatcagccgctggaggggctgccgactgcgcgggcccttcccgctctcggtctcaccctaagggctaaggcgaccgagaaagccccattctccagtaggtaatggggcggcgcccggtgggctgcaggtggggagggctcccagcgccgccagcggccacccggggcgccggctcctggagggagagtggcctagaaatatccaaggaatccgaagcttcccctcctccacctctgccagtacggaaacaccccaccgtcacaatcctaaagcggggagatgggatgggaattgtcttacttggcaaggcagggtaccttcattgccagacgccctcatttgtgtgttcctccttgctccagcgagatagaaccttttgcgcccccaaccccgtttcgtggagtgagccca

SEQ ID NO: 95754 - DNA, 30 bp, Homo sapiens; identical to SEQ ID NO: 30538
  chr6:50814569-50814599
  hyper

SEQ ID NO: 95755 - DNA, 397 bp, Homo sapiens
  chr6:50817023-50817420
  hyper
gacagccctgggctgcgtgtcacagctccccggcccctttgttacagtgttagcaggctgtagagggagtaaggaaagagcagtagctagaacctctaggtcgttgaccggcccagcgcagggaccctgagaccgccagatccggtgggcggcttacagtggcccagaacgcacccgccggctcgtgttagcgggttaagggcttgattaaaaatagtgctggaaggaagacccgattatttttttatgaagccacattccttttcttcatttgcaaataacagttccgtagggtcccttcccagggaccctgggcgccgaagttaggggccacctgagagttgttggcccggtgggaagtgtcccttcctgagggcgctctcggcttctcagggca

SEQ ID NO: 95756 - DNA, 72 bp, Homo sapiens
  chr6:50817685-50817757
  hyper
gggtggggtgtggggcgggggggcgcgctctcctcccgttcctctccgccgggatcgcggtatcctagggga

SEQ ID NO: 95757 - DNA, 648 bp, Homo sapiens
  chr6:50818360-50819008
  hyper
gggcgtaaccccagctgctgtgacgggccagggctcgcagctcgcctgctagagtttgtggcgcgccctcgggatcagggcactggggtttgaaggggctgcagcgtgggaagccttcaattttttttttttgtaagctgcgtgtgctcagattgaggaagcagttttgtcacacatgttcaacacgttccacgctggtcacaagctagcaaggtcaggtagtttttcgcccacttgttcgaaaacctattagttcctgcccaccctgctcttcgcttttcctcctctctcctaagggctgcagccttctggagctgactcaggcgagaggcgtccagagcccaaataggggtcacacctgctgtcgagagagtcctctgcataaaaatgctctttaaaatttttaaaatcagcataatggccaatggacttaacaaagcgtgacttgcccaggctgcacggagggcaactctggcagtcatctgtaactcgaccagttaacgtcccgaacgtgcctgttcgcggagatattagcaaacgtttcaaggatgtggctgtcagatgtcattagccaacgcttgctcacccaaccatttgcctaactgggaggagggcatggccacggcgtataggcgtagaatttggggg

SEQ ID NO: 95758 - DNA, 153 bp, Homo sapiens
  chr6:50819287-50819440
  hyper
acactggaaattcagcgtccggactctcgatcagatgccctagagctcagaagcacctgattgcgcggaaggctggtggtggttacttgggcaaagagagtgcgactcgaaactcgagtttctcggatttaggaaatccgatctttagacagt

SEQ ID NO: 95759 - DNA, 30 bp, Homo sapiens
  chr6:508264-508294
  hypo
tgcatttgttacagtcgaaagacctacact

SEQ ID NO: 95760 - DNA, 30 bp, Homo sapiens
  chr6:5084912-5084942
  hyper
ctgggcagatgggggcggcggctcctgcct

SEQ ID NO: 95761 - DNA, 692 bp, Homo sapiens
  chr6:5085637-5086329
  hyper
gctccttccacggcccgaggagttagttaagtctccagaggggcccggttcggcccgagcaagtccaggggcgaacggcgtcatggagcccataggggcgcggctaagtttggaggcgccgggaccagcgcccttccgagaggccccgccggccgaggagctgcccgccccggtggtcccctgtgtgcagggtggcggcgacggcggtggcgcttcggagaccccgagtcctgacgctcagctaggggataggcccctgtccccgaaggaagaggccgccccccaggagcaggaggagctgctggaatgccgccgccgctgccgcgcgcgctccttttccttgcccgccgaccccatcttgcaggcggccaagttcctgcagcagcagcagcaacaggcggtggcactgggcggcgagggggcggaggacgcacagctcggcccgggcggctgctgcgccaagtgcaagaagcgggtgcagttcgcggacacgctggggctaagcctggccagcgtgaagcacttcagcgaggcggaggagccgcaggtgccgcccgccgtgctctcgcgcctgcgaagcttccctatgcgtgccgaggacctggagcagctcggggggctgctggccgcggcggcagtggccgcgcccctttcagcgccgccttcccggctccggccgctcttccagctcc

SEQ ID NO: 95762 - DNA, 48 bp, Homo sapiens
  chr6:52102871-52102919
  hypo
catatcttcccagttcgaggcagggggcactaccgtcccaaggttttc

SEQ ID NO: 95763 - DNA, 88 bp, Homo sapiens; identical to SEQ ID NO: 40842
  chr6:52156845-52156933
  hypo

SEQ ID NO: 95764 - DNA, 106 bp, Homo sapiens
  chr6:52226691-52226797
  hyper
tgagggcggttaaggcgtctctgtctcaaactctccggattttttgcagctaccagggactgcgagggtctgcgtcctgggtggaaggaagcggcgtcagtcaact

SEQ ID NO: 95765 - DNA, 125 bp, Homo sapiens
  chr6:52227751-52227876
  hyper
ttggctggatgggaacgccgcggtggggtgtcggaggtggctggtggggctggaacgctgggaacgtctgtctaggctatgagaacgcagcgccctcggtggaacagggtcgtagataactcgag

SEQ ID NO: 95766 - DNA, 114 bp, Homo sapiens
  chr6:52268175-52268289
  hypo
ccgccccacggggcacgagtggcgctactacttcttcagcctctttcagaaacacaacgaggtggtcaacgtctggacccatttactggcagccctggccgtcctcttgcgatt

SEQ ID NO: 95767 - DNA, 30 bp, Homo sapiens
  chr6:52344375-52344405
  hypo
ttttactcctgattgcgtgagagaacatca

SEQ ID NO: 95768 - DNA, 180 bp, Homo sapiens
  chr6:52928858-52929038
  hypo
agcctgggctacagcgagactctgtctcagcaaaacaaaacacggcatttggacttccttattgtagctcgttctctctccccttcactctctcgctctctcccctccctcagcactttcacctccatttctgtgccaaagatgtactacaattttttttttttttgagacggagtctca

SEQ ID NO: 95769 - DNA, 32 bp, Homo sapiens
  chr6:52929278-52929310
  hypo
tgggccaccgcgcccagcggatatactgcatt

SEQ ID NO: 95770 - DNA, 102 bp, Homo sapiens
  chr6:53052001-53052103
  hypo
catttttaaatcacacgctgcagataactgattaagtgctgtcattgctctaacaatgcaatgtacaaaaggatagccaggacacttcgcagggcctcaaga

SEQ ID NO: 95771 - DNA, 30 bp, Homo sapiens
  chr6:53212219-53212249
  hyper
catctaatgcaaaaccgcctgtttctatct

SEQ ID NO: 95772 - DNA, 1193 bp, Homo sapiens
  chr6:53212645-53213838
  hyper
ggaacggttgcaagacgcagttcagcaagaacaactcttgctctaggcattgctccgtcgacccgaggtggtggggtgggagagtcttaccggcgtggaaacagtaaaaaggcacttttccttacaactcgcaagacaacacacactctagctcccccggcgcagagcacaaccgcccccccgccgcgcgcctccctcgcagccaaccgctcccgcctctccagggatcaggctcccagaaagggccgccccggtcgcccccgagtccccgccctctcgctttcccaccagcctcatccctccctgagtaccaagggctgccgttgtctggtttcaataaaaactgaagcggtcccgagctagcaggcttccctccgaggggcggacggaaggtccgcagggttaacggaagcggagagaacaggacaaaaaggaaaggccggagagtccccccagcggcgcccggtgcccgcagaccctcgcacaggctcttcgaactcacccgggtttcgccgactccaaagaaagcgcgctccctccgagagcgctcccccggctctcccgccgcgcgctccggcccgcagggcgggaggacccaggcggacagatccatccctccgcgtctggtgtgggcacggtgtcgtgccccgcggcgcctgtcagcgcgcacaggtgggaccgcagcacagagaacgctcccgagcgccctgcctcagcctcggcgtggggcgagccgcccgcgcccgcacccgcacccctttccccgcgcccgaggagccgggctgtaccccggagccggcggagctggaggccgcgggcggagcgcgggttgccccggcagctctttctcggcaccaggtccgagacctaacggcagttctctctgaccgcttcccggccgcgcgctcgcgcgggtgtcatggccgagcggcggcccccgacgaagtttcccggagctgacggctttaccttttagcccaaggggcggcagcagctttgagcagcagcaaggcggcggcggcggagggagcgcgggtggcagccggcgcagaggcggatgtagaaggagacaccggtggctaggacccgcgcgatgggaagaggaaggcgccggctatctacaatcagaacgtgggctgaccgtgacgtcacaatggcgcggccagccaatcgggacccgaaggatgaatcaa

SEQ ID NO: 95773 - DNA, 30 bp, Homo sapiens
  chr6:53214185-53214215
  hyper
agggttaaatgcccacggagaccgccggag

SEQ ID NO: 95774 - DNA, 30 bp, Homo sapiens
  chr6:53438260-53438290
  hypo
tgctgctagctctcccgctctgttcctggc

SEQ ID NO: 95775 - DNA, 72 bp, Homo sapiens
  chr6:53517059-53517131
  hyper
aggctgaagtgcgtgcgcttctggttcatgctggccaggtgtatccaggtgttgaagcggggatcgtatctg

SEQ ID NO: 95776 - DNA, 514 bp, Homo sapiens
  chr6:55443691-55444205
  hyper
ctggctgtcagtgtgcgcatgagggtggggacaccctgggccgcgaggtggtacctgcgcggggtcgagcgcccctgccactgaatccccgatccagagatgctcccggagaagctgctggtagctgaggcagtgcttcaccgcggatggcacattccccatggcggagcctggggcggcagtcggcgaggggagggagactggaggaggatgaggggcgggcaccgcgctgggaaactgcgccagctcgggagcgcgcccctccggtgcactggctgtgaggaccagagctgttctgcgcactgcggcggcgccgagagggcggggagtggggcgtggcaggtggccgcgcctggggcagcgggtgcacggggcacctgcgggaatcgacagaaatgccgagcacctgaacaggagagaaaggagctgagccagaggatgtccaggggtgtctcattttccgcactacactgagcgcccagggctgactgtatcttaacgtgcccacctactt

SEQ ID NO: 95777 - DNA, 19 bp, Homo sapiens
  chr6:55678574-55678593
  hypo
acaccgtctcaaaaaaaaa

SEQ ID NO: 95778 - DNA, 433 bp, Homo sapiens
  chr6:56112173-56112606
  hyper
tgtctccttacctggcgcagtgtccaggctcggggttgccgtcgcagccagctgagtgttgcgccagggggacaggtatgttccaggcagtggcaagcccaacccgagcaagacctgcgctgaaacggattggctgccctccgcccggagtccgttctccctgcagcggccagtgcagagctcagaggctcagaaactcgctctcagccccctggaggcggagcccgggagataaggttcgcgctccccacccgccccctttccttggccgaagaccagagggtggattttggatctggatcttgaagggcgaactgctagtgtcgccctggtggaaacactcagttcaaatcctgctagcatcagaaaatgcacgattgaggattgaaaacgagggtgaaggaggaccagggaagcgcgaggagagaggcaa

SEQ ID NO: 95779 - DNA, 41 bp, Homo sapiens
  chr6:56407898-56407939
  hyper
ggcagaacctggcaccgggagatccgcgaagaaattatttt

SEQ ID NO: 95780 - DNA, 49 bp, Homo sapiens
  chr6:56707974-56708023
  hyper
ttcccctctccccctcgtaacccccggacagtatcgcagtcagcaagac

SEQ ID NO: 95781 - DNA, 279 bp, Homo sapiens
  chr6:56708790-56709069
  hyper
cctgagaaacaaagccgcagatcgctccaccgctgtgcgcagccccctgctgaggggccagcggctctccctgggtaagggatgatcggggggagggttggaaatactttcttccacccatctttttggcgtgggaggattcaggtcactctgtgacagcacagggcaaggagggcacgggggtccgcgtctaggggacatcccggggacagggtgaggaggcctctgcaggtggccccgcgcatcagcgcctgacagccgggccgcgcctgcgcctga

SEQ ID NO: 95782 - DNA, 113 bp, Homo sapiens; identical to SEQ ID NO: 30548
  chr6:56716187-56716300
  hyper

SEQ ID NO: 95783 - DNA, 306 bp, Homo sapiens; identical to SEQ ID NO: 30549
  chr6:56716389-56716695
  hyper

SEQ ID NO: 95784 - DNA, 1567 bp, Homo sapiens
  chr6:56818703-56820270
  hyper
gttgggaaagcacatcgcagactcctggaattcggtgggacatcctgggggagggaggaggagtcctggggccatcggtctctacgtgatttctccgcgagaagtttgcatgaaagttctgggggagttggggagccccgaagtttccatgccttactttcttacccctacgctccagcgaaggatgcgtgaaggcgaggctggcgcagccccggactacgctcaaattacccttaaggctttagcaaactgactaaaaatttgagttctttcctcccctccctgccctcggcatcgccgtggttattcaaacctgggagactggagggcggaggtgacggcaaaaagggcaaggggcgttaaagaaacgcactcagcctggggagtgggcaatgatggggctaggggcagccgaggagaagggagcgagccgcgcttcactctccaaatcggcttaattgttcctggtagcccgcagaaacccgtcgcggcgtgtcttacctcggcttcttgaacgacccgagaagaccgatttcatcggatgcctccctttctggagcttgcggtgccagcagcagaagaagacgatggtggcgatggtgcccagcagaagcaacaagaggaagagggcacattggatgctgtagggtctcagcaagacgaggaaagccgcggcgatcatggtgcgggcgaggcgagggcgactcgacggcggggctggagggcggcggcacaggcacccgcgctgggcgcacgccgggacggcgggcacgggtgagcgcggctcagcgcgtcatgcctggcgctcgcggccccgcgcccagcccaatggctgcgcaccccgcgccagccgcgctacgcgagtgatccagggctgcggggagcgcttgccatgactcagcagacagcgacgaggctgcgactcggcggctgggatcctctcccctccctccccaggcgcccccgcccccgtccgtgcgcagcccccgggcgcagccccgccggggacgcggcgagtggggaggagcagcgccgccgccgcggccgcccgggccccgcgcatcgtcctgcggccgccgccgacctcagcatcccagaagccgggcgcacgtgggtcggggcggggacgcggcgctcaggctgcagccgcggcagcctgcggggggcgggaatggggcgccgcggcgggggctcggctgatgacatcacggccaggctgcggcagcgcgggcgcgcggacatggctgcggcggtttcggcggcgtccgcgggctgcacccgggcctgagagcccagcgccctcccgcggggccgcccgccagtccgcgccgtccgcgggtgcattggccgggtgcctctagcttcccggacacccggagcttccgcctatccagcctccctcggccaaattgctgcggagcccgtcgtcagggggcgccaaggagccagggggaaaaccgagaggcgctgacaggagcctcccggcggtgctaccctccacctcccacctccctgcgccccgccccgaggttggggctttgaagaatgcagccgggtgagctattgc

SEQ ID NO: 95785 - DNA, 144 bp, Homo sapiens
  chr6:56820756-56820900
  hyper
gcacggaaggtatagcgagagcgctgcagtgtgcctttctgcggacggccacggccacctggccaggaagcggctgctgcagcagtcattctgcggcatcttgcggccttggcgggcggtgctgtgccgcgttctgctgccccc

SEQ ID NO: 95786 - DNA, 81 bp, Homo sapiens
  chr6:57694608-57694689
  hypo
ctaaggacaaagaaccgccagtaacaacatgcaggcacacacacatacgcacatactcatatatatcgatatagatataga

SEQ ID NO: 95787 - DNA, 85 bp, Homo sapiens
  chr6:5783294-5783379
  hypo
agcctccctgcctcacgcctcggggctgactggctctgacgtggttcggctgtgctgttccagcctgggacggagcaccccgctg

SEQ ID NO: 95788 - DNA, 30 bp, Homo sapiens; identical to SEQ ID NO: 40846
  chr6:57979515-57979545
  hypo

SEQ ID NO: 95789 - DNA, 91 bp, Homo sapiens
  chr6:57985540-57985631
  hypo
ggtctacactttctgcgatattgaaagcaatatcatactcttcccgcagaatattaggactaatatcacggggtgggtgtacagcttctgc

SEQ ID NO: 95790 - DNA, 98 bp, Homo sapiens
  chr6:58002802-58002900
  hypo
cactctttgataatgcgagtaatatcatcctatttccccctgaatattaggaacatcacagcgagcgtgtacaccccctgtgatattgggtgtagtat

SEQ ID NO: 95791 - DNA, 92 bp, Homo sapiens
  chr6:58147419-58147511
  hyper
tggcgtgcagaaaaccgcatctcccgaaatcccagaacgtaaacgtcgcccaggtactcgctctcttgtcattctccgggatgtaaaagact

SEQ ID NO: 95792 - DNA, 218 bp, Homo sapiens
  chr6:58147758-58147976
  hyper
gggcacaggcccggcggcggagccctgctcccctcccttatcagtaccgcggttagtgctctgctttatggccgcagcaatctcagacactttcggagcgtgttttttttttcttgtcctttcgctccccttttcgggcgccagctttcaaaccagaccaaaggtgtgctttcccccattatctcccagccttctttccttttcgcctctactcaagg

SEQ ID NO: 95793 - DNA, 39 bp, Homo sapiens
  chr6:58148912-58148951
  hyper
tcttcacgggttgctcggaagctacggaagcaaagtaga

SEQ ID NO: 95794 - DNA, 22 bp, Homo sapiens
  chr6:58149309-58149331
  hyper
cgatccccgtacgggccacagg

SEQ ID NO: 95795 - DNA, 26 bp, Homo sapiens
  chr6:58180231-58180257
  hyper
ccgcagccctggagccgggcagtgag

SEQ ID NO: 95796 - DNA, 35 bp, Homo sapiens; identical to SEQ ID NO: 40847
  chr6:58504069-58504104
  hypo

SEQ ID NO: 95797 - DNA, 185 bp, Homo sapiens
  chr6:5851459-5851644
  hyper
cgctgcacctcggggcgtgttctcccacccatctgtgctcaggcatcccttccctctcctctggattttgtttaggcctatttgcaatttcttaaaaaaaaaaaaaaatctaataaatagttggagcctgaaagagagctggccaatgaaacgccgcgttggggcattaccgcatcggtgaggcc

SEQ ID NO: 95798 - DNA, 191 bp, Homo sapiens
  chr6:5851645-5851836
  hyper
cccattggctggcgtgccctgaggcgatggctgcgtttccccggcaccgccccgcgccggtgcccacgcgtcccgggcttcaggggagcacctgggaagcgctgggggtcgcgtgcccttggccggaggcctggtcacccgcaggccctgccatcctcggcttggccgctgctgcccgcgcgcctgtggcg

SEQ ID NO: 95799 - DNA, 148 bp, Homo sapiens
  chr6:58588027-58588175
  hypo
ggtgtacaccccctgcgatatcgggagtaatatcatcctcttttctcctgaatattaggaataacatcaaagggtggttgtacaccacctacgatattaatagcatcttctctttctgtagacattaggaacaatatcacagtggggg

SEQ ID NO: 95800 - DNA, 181 bp, Homo sapiens; identical to SEQ ID NO: 40731
  chr6:5892797-5892978
  hypo

SEQ ID NO: 95801 - DNA, 1253 bp, Homo sapiens
  chr6:5996021-5997274
  hyper
gcctgaagcccactccgtcccactcccaatactcccaccatctcatcagtggggcatgctcgccctggttaatgtcatctccctgaactgccaacgaggctagcagctttgctgcttaaaaccggtaacatcaaccaacatatggagatgtcatcatgattaaacggcaaattatagccgaagacggcgcgataataatctaaacaatcaccacaagaagaaacgttctctaacgctccagttgcggaagcctgcgtttccaagactcgcggccctgcgttcccagggatatctccgtgctcacgtgagcgtggtcctcggcttgggacagacaagggagccccagacaggacgataaggtttggagattcccagggcgatctgggactccgtggcgtgggggcttggaagcgcgtggaggggctgagagaggggagagggcgcccttcctctagggcggccccgtctgggaagcagttggaacagcagtaggagccaggggttcctagagaagaaccctgttaggagagcagaccagcccgcgctcccagtccccgccccctcgccccttctgccccgcccttagcctgcctcttcctagatcttccaggacattgatttccgagtaggaagcccgcgctgctaggggaggggcgtcctctgtgggtcgtgggggggtttcccttctctccacagtcggagcagaagggcgcctgccttttattttgacaagcaatgggcttagttgtgagcacttgtttgcccccaatatgtagaggaaaagatactgataggaggcggcgtgctacgatggcaaaaatggagaagaccctccctctttatcctggttctcctccttgttaaatagattcgtatttaagataggcacagacattctaatttgaattccaggggttgaactccagttagaatcatcctatttatacgcagaccgaaaataaccattgaaacgaaaccaacaaaatgcaactattttccaaaaccccgagcgtttgctggtgggtgaccaccccgcgcaggtagcgcggatctgctttggttttgactgagaacccgggttttgactgagacctccgtcgggaggaggggactgggtgggagttagcgggcgaaacgattccccggagtggccccgagcggcgcgtgcgtgaacgcgcggccgtaatatatgctgccattaagaatccgtgcagcttccagcgctccgggcgcagggacgcatgtgttgctgg

SEQ ID NO: 95802 - DNA, 386 bp, Homo sapiens
  chr6:5997513-5997899
  hyper
caagaaatcagatttcgatttctctgaacccagagacctgcatgcagttctttctcccccgcctactccaggcctgcagtccccggacccgggtcgcctctgcccatttactccggaatgtttacttctctttaaggccatgcggggcctataaataggagaggtggaatcagccccactgccagatcaatagggcccgtctcctcgccatttcagctgagctgtcttattaattatgaaaggattcacctgatccctgccagggaacacagcctctcggcccctctgctggagcccttaatggcggttccttcgcaagctgcctctggccaccgcacaggaagaggcgaatcgtggttaggccgagcctgcgaggatcgtggtta

SEQ ID NO: 95803 - DNA, 260 bp, Homo sapiens; identical to SEQ ID NO: 525
  chr6:6003269-6003529
  hyper

SEQ ID NO: 95804 - DNA, 395 bp, Homo sapiens; identical to SEQ ID NO: 526
  chr6:6004349-6004744
  hyper

SEQ ID NO: 95805 - DNA, 514 bp, Homo sapiens
  chr6:6004836-6005350
  hyper
cgtgaacatttctgtcttttaaaactgtgactccttggactctagccttctctgggaggccgggaggctgcgcgcgggacggattttgcaggcgcacgcgtcccagcaggtcgcagcccgtgggtccctcgctgtccttcctgaaccccgcttaggcgagactctagcgggtgaccctggctccttccctgtcctctctgccgtccccttcttgtgcggtttccatccgttcattcattcgttcgacctctcattcattccgaacttcctcctgctgcgtcttctttcgtgttcaccacactcttctacctccccgcccctcccaacccccacttttcttgccaaatgtcaatgatttgggacagctcccagccgtgaattaataaagaccgaggttctgttgcaggaaagggcagacattagggaacaaatacgttcaatttcaattccacagtcaacaaatagtcatttttggaccgaggttaatgtgttcaaaacgcgtccctcaggcacg

SEQ ID NO: 95806 - DNA, 129 bp, Homo sapiens
  chr6:6006283-6006412
  hyper
agaaaagtatatctacgtaaatttggctgaattcatcctcttcaatggtaagcatgttaaaatatgtggtctgaagttccctatcactctcgatttgcccaccagccgggtctgcggtgcccgtgcaaa

SEQ ID NO: 95807 - DNA, 996 bp, Homo sapiens
  chr6:6006674-6007670
  hyper
aagggggaaaaaaaccgtgtccagaaaatgtccggccgcacacatttcctggcgaacatttggaatctatagctttaggaaaaaccgatctgggacgcgctagtccccaggaactgatgcccccaccctcgggggattgccggcttctccgcaccctggggcggccgcggacccgctagtccccctccgcgcctcgggccggggcaggctgcctcccgcctccagcctccagccgggctgagcggccacttacctatttgcaccgcgaggatcagtgaaatatatctgccgttcaacttaagtcccatcctacgtttagtcaaaccatttgcgaccgcagacctttaaatagttagtttagagaacgcgggggaaagccaaaaaataggcattgccaacaagttccgggagcgacagagactttatgcactgggaaggcagagggaggagagaaagagagggagcgaggaagagacagaaagagagagagagagagaaagagagagagagagagaggctgaggggggggggagagctgggaatggttcactccattagaagggggcggaggaagtacagcctcacgcccacgagcaggcctgacgtgggggatgacacggaatgattttttttttaatatagacaccttggtagagaatcgccatttatagtcatcagaagctggaattaatcagatatctccaattaatgtgcgatctgaacgaaattttgcctcccgggggtgagcactttcctattctagcggtcacccctgcctcttcctcgttccgggggccccccagccccgccgcctccctgcgcagaacaggggctccccctcccttccccgccaggagctggggagtcctggcgcgcccactcgattgtttcaacctgctccccctcctccatcagcaccacagagaatccagcccgctctctacgatgcaggggggtttaaaggagcgggagagggaaaaacagctaagctagctc

SEQ ID NO: 95808 - DNA, 101 bp, Homo sapiens
  chr6:6007671-6007772
  hyper
attaattcgaaagcgctcctcggccgcccgccccctgcgcttgcctaccctctttttctccaacccagcagctgagctctgggcgcagcctggagcgcgtg

SEQ ID NO: 95809 - DNA, 617 bp, Homo sapiens
  chr6:6007832-6008449
  hyper
acgcgcgcgcgcacgcccgccagccgcgccgagcgcccccatgcccgcccgcacacaaggcacgcgagcgcgcgcacacgcccaggccccgggggtttggtttgcacacgtggggccccagaaataaacaccgaatgtcctctgaattttacccacctgcgatgccccagcgggccaaaggccgcttcaagggacacagcgacacctgttttagggggcgagtagggcaccggggaaggagcctctgataagacagttttcggatactagtgatttaccaaccaactctcagcgctttaggaaatttccaaggcaagcgctggtgtgcggacttctttctaatcttgatgcgcctcttgggcttatttgttgggctacacacacacgtacccacacgcacacacgtacatcacgtacgcacacgcacacccggacccacacacacctgcactgtcttttgatgctcaggcacagaccctgtgtaggtgtagcctaccctgcaacaaaatacttctgcagctggctttgtgctaggtgcaagctgctatcgacgacagcttgagtcaaaaccgaaaaactaacagggctatttcctttctaaacgcctttaagctctg

SEQ ID NO: 95810 - DNA, 863 bp, Homo sapiens
  chr6:6008689-6009552
  hyper
tagggccaatcttgccgtccccatactcagatatttggagatgcatagacaaagggggagaaaggtgcaaaataacgggggtaggacaggctgtggagggtagggggccgaggggaagctgcgggggtcctactgcagcacttggtgacgtgaggtgtctgcaatgtgcggcccctaactcacgtcccgcgggagcctcagactcccatgcagccttcctggccctgggggcggagtcatgtctccccgcccctggttatgtcaccggcctgcgggcggggcggttgggggctcgccttccggtgtccaggggcacggtggcggccccgggtgtttcctttccccgagctcggaggctccgggaagaaccgaaaacgtgggcggacaaggggtggggcgggggctggtggcgagaggggggcgtttctcggaccctcccccgacgtcttccaatggcagggcgggaggctttccgaggggcggggcctcaggggggttgccacgcggcccggcccacggctccgcccctcgctcggggttccgcgtggggccggcccagctttcccggaccaggccaccagctgcgggcccccaacctcgctcagactcgtgcagagcccaggcttgggagtggcttaaggttttttgccctcaacgtccttgccttcctcctgcttatccacctgggatcttcacagcatcattttctgggatcctctccaacccctcccctgtaactctgagcgtggggcgctggggatgtggagtaggcagggctgagggcctcaatgaagcgggtgaacccacgcgcgtgcgcacagccgcccgcgccgcgccccgggccgatccggttcttgcccttg

SEQ ID NO: 95811 - DNA, 30 bp, Homo sapiens; identical to SEQ ID NO: 14827
  chr6:6045657-6045687
  hypo

SEQ ID NO: 95812 - DNA, 30 bp, Homo sapiens; identical to SEQ ID NO: 40733
  chr6:6055082-6055112
  hypo

SEQ ID NO: 95813 - DNA, 40 bp, Homo sapiens
  chr6:6058547-6058587
  hypo
gggaaaaccccttcccgccctggctcgggctcctggcctc

SEQ ID NO: 95814 - DNA, 216 bp, Homo sapiens
  chr6:6180497-6180713
  hypo
gtcttccccaactgccgattcttggctgagagcctttctctgtgcccggcagcacccgtccaccctgtgccagagcaattctcacccagcacagtgagggctgccttctgcttttctccccagctgcatgggaaggcagggctgtacatgtatccagctctacacagcactggaagatggcagatggtaagagccagctgtcgtgtggatgtatgt

SEQ ID NO: 95815 - DNA, 30 bp, Homo sapiens
  chr6:6199350-6199380
  hypo
aacacttccttagtgcgaagtggtgttcta

SEQ ID NO: 95816 - DNA, 30 bp, Homo sapiens
  chr6:62692207-62692237
  hypo
tccctctgagacccacggaaatgactataa

SEQ ID NO: 95817 - DNA, 27 bp, Homo sapiens
  chr6:62849167-62849194
  hypo
ttcatatgggccaggcgcagtggctca

SEQ ID NO: 95818 - DNA, 519 bp, Homo sapiens
  chr6:62995356-62995875
  hyper
taaaaataaaaataccgatctgtagctacgaagctcttagaacactacattgatcaccatttacttccaaactgctttcccttccctctgcgaagtgaaaatgtccctgtagaccgcgttacatacactttatggtttctctatcaatgatcctaacaggtcacatcgccactgccattagatctccgtagctttggtcttctccaaattaagacgtggagaaggagcactgctgtccgccccaagaacggggtctgtccgcccgagctctaaggcgagcatcttcagggggacagtttctgcgaaggcggggagaggagtccctccccaacttcactcccctaatcaagccgcgggtgagataggcagccggcggtttgtgcccatctgtgggggcaagtcctaccttctgccaaaaggcgcgacgcatgcacaaaagatggatccaggctatctttctctgccatcagctcaggcaaatatttctcctcttccatagcgcggacttcggattgtccc

SEQ ID NO: 95819 - DNA, 53 bp, Homo sapiens; identical to SEQ ID NO: 561
  chr6:62996077-62996130
  hyper

SEQ ID NO: 95820 - DNA, 83 bp, Homo sapiens; identical to SEQ ID NO: 562
  chr6:62996131-62996214
  hyper

SEQ ID NO: 95821 - DNA, 496 bp, Homo sapiens
  chr6:62996215-62996711
  hyper
gtagcgcaagtcgggtggcctgactggcaggaggcagctgcagaggggaagggagctcggaagatgcaaacgctttcttcttgcgcccaagccttccctggctattaggcatgcccagttttgtggagttctctgtgtcttcagctaaggcgcagaggagagagagcgcgggaaaagcgcaggttaaagagagaggtctgagtacaagtggacaggggagatggagatgagaagtgagccacccgagagggtggaaaagcgccagggaaagtctcaggaaggtagatgggacttcacctgcgtccctaaggcacaggtgtctcctttccctcacacagctcaggcgcactccagttgtgcaggaatcagcagcgcactgggtctggaaatacaatgaagactgcatgtgatcggcagctggtatttccgatgacctacatctcagggacgcagtaggatgttcattgataaacaaataaagcggctcgaagaaata

SEQ ID NO: 95822 - DNA, 30 bp, Homo sapiens
  chr6:63080264-63080294
  hypo
ccggacacattttggcgacccagaggggac

SEQ ID NO: 95823 - DNA, 37 bp, Homo sapiens; identical to SEQ ID NO: 14828
  chr6:6367079-6367116
  hypo

SEQ ID NO: 95824 - DNA, 83 bp, Homo sapiens
  chr6:63983649-63983732
  hypo
tatttaatagaatctcggagggccagaaaatcaggttcagaagaacaggcttgactgttccagagacccgacagccactggca

SEQ ID NO: 95825 - DNA, 155 bp, Homo sapiens
  chr6:64150663-64150818
  hypo
cgtcaccatgaccaacgcagatagcgagggcggaaacctccgccaccagctggacagcaacaaacaggacctgagcctcagcaacctggatgaagacccggtcaaggagctggctgcccttccaaagactaccacactggatctgtcttgtaata

SEQ ID NO: 95826 - DNA, 68 bp, Homo sapiens
  chr6:64734852-64734920
  hypo
gggactttcgcctatcgcccagtggtatgacaatcaccatgtggtgagaccatcgcctattgccgagc

SEQ ID NO: 95827 - DNA, 34 bp, Homo sapiens
  chr6:64921720-64921754
  hypo
tagtttggccaggtacggtggctcacacctgtaa

SEQ ID NO: 95828 - DNA, 180 bp, Homo sapiens
  chr6:6534755-6534935
  hypo
ggagaggccctggagcgcctgcaaaccccgtgggacccaggcgtccaggcaccgcgcccaggagagccagctctgagcatccccggggggccactccttctgccaggagcctgaaacccaaacgcgagagatcaggacccccgagtgcagcctcttcccaccacccgaaccatcatggct

SEQ ID NO: 95829 - DNA, 702 bp, Homo sapiens
  chr6:6546520-6547222
  hyper
ctggcaggaaccagccgcagtgaagccaccgcaaccgcagccgcagccgcggaggggaggccgtgcacccgcccgccgggagagccgcgcgcctgagccgggcgcacgtgggaagtgggccacgagactggagtccaccgagatggaggccccggcactcgggctcaggcctttgtgcttagcacgtactgttggaatccagcacgccctgctccggcgggcgcctccgatcctgaagcgcgcacctgggaactcacgcaccgcccagccgcgaggggcttggcctggctgaaagccacattattctcgaaaacaaccgtgggaagcacacgctgagctcccggggcccctagagtatgcaaagaggccggccctgcgagactaaataagtctctccccctaggacctagtcccttgccaccggctcccgcggccaccgcgcagccagagtgcaccgtccctagggctttggcggtggccagagccagcaagtgcggcggcctggagctggggtggtgagggcggatggcaggttggagaaatgcagccgagccgcaggtttctagaggcctctacagcccctgccatctgggcactgcacagacagacgctgcgtgagacctggagctcgccacctccatgcggcgctgccagccactccgctgcgggtgcaggagcgttccatgtcggggactgagggac

SEQ ID NO: 95830 - DNA, 71 bp, Homo sapiens
  chr6:6720969-6721040
  hypo
catccgtgtgcaaaacggcattatgtacaatagctgaaggatggaggcaactcaagcgtccatcaacaaca

SEQ ID NO: 95831 - DNA, 30 bp, Homo sapiens
  chr6:6745438-6745468
  hypo
caaaagaacagaactcgcacaatataaaca

SEQ ID NO: 95832 - DNA, 198 bp, Homo sapiens; identical to SEQ ID NO: 40736
  chr6:6891420-6891618
  hypo

SEQ ID NO: 95833 - DNA, 30 bp, Homo sapiens
  chr6:6921408-6921438
  hypo
acaggtgagccagtccgtgccaacgtttac

SEQ ID NO: 95834 - DNA, 326 bp, Homo sapiens; identical to SEQ ID NO: 30560
  chr6:69344323-69344649
  hyper

SEQ ID NO: 95835 - DNA, 1099 bp, Homo sapiens
  chr6:69344943-69346042
  hyper
tctctctcacacacccgcccgcgcccccggcaggcagaactccaggaagtcgcagcggccgcgccgcgcgagccgagcctctggcgggcggcggggcgcaccgcagctgtgcataagaagggcgcgcggcacccgggacgcgcgcgcacacgagcacgcgggaggccgccgcgcggacgcgctcccgggacacgcgcaccccccgcgcgcgcgcccaagggagagcgagcactgcgcgccggcgcgcacacccgagacagagctttactatctcgctccctctcgcgcctccctcctcgctgggcattcaaacagctttccgacatcaccagccaaggatttttttccccgctctccttagtcgccgtccgtccatcagtacctgcaggggggaggaggaggagggaggaaagcggaaagaggaaaaagcataagcttgagccttccgatccgaccacgaatactcctgtaataaacccaccgccccaacaaatctgccatagcagccgccgccgccgccggtcacttctcgtctcagcgctttctttgcttcttggtttgttgggggtagcttttatgaaacaaatctttgctattaagccacttacattttggggggttccttagagtctcccttgggggggcttctccctccctttagcccccctcggtttggaggttggattcagttggatacggcgcaaggttctgggctcctgctggcttttttttcctctctctcatcgacccccctttggttcccaccccccaccttttgcttttcgtatgtatgcatttttaaaaataaatcctgattttggaagctgagccggggaaaatgggcaacggtgattgggaccgaaggggagtctctccgtcactgttgctgggacgcgtgcctgtgctggtgtcttagagcaagagcctccctgagctttcggagtggaaggtaaggaagggggtccaggggtcaccttttctctgccgggggtcgccaccgtggagctttgggcttaatgtttgagaagggaggaaaatgaaaggaaaggctgttgctggcggatggggaggctgtgagcagatccgactgtctgcattt

SEQ ID NO: 95836 - DNA, 370 bp, Homo sapiens; identical to SEQ ID NO: 30563
  chr6:69942843-69943213
  hyper

SEQ ID NO: 95837 - DNA, 38 bp, Homo sapiens
  chr6:70310230-70310268
  hypo
gcaaggcaagctgggcgtggtggctcatgcctgtaatc

SEQ ID NO: 95838 - DNA, 73 bp, Homo sapiens
  chr6:7051765-7051838
  hyper
gggcgctgcatccgccttccgagatgctggcagcccgggacggcctagcgcggccctctccttatttatccac

SEQ ID NO: 95839 - DNA, 48 bp, Homo sapiens
  chr6:7051873-7051921
  hyper
cgcccccttcctcgcgcggagcccagcggcagtcgagggcctggctgg

SEQ ID NO: 95840 - DNA, 38 bp, Homo sapiens; identical to SEQ ID NO: 30564
  chr6:70576959-70576997
  hyper

SEQ ID NO: 95841 - DNA, 344 bp, Homo sapiens
  chr6:70577295-70577639
  hyper
ccggaacgtcccagtcgcggcgcgaggaagacgcggccccagcctctgccgcctccgctgtcagagtcccgaggccaccgccgagagcgcgccggcgccgcagccacagcggccgagaaccaggaggcggcgccgggcggcccagctagggcgctgcagggtcgcgaggaagtttgttggcccggaaccaagcacgccgtcgggcacgctagctccccgagagcaggcgggcgcgtaagcgaacccccttagaggttacggagggagcgggaagccggcaagagggtgggcagaggagctgggggacaggcgggtgccacaggagcccccgaggagcttcattt

SEQ ID NO: 95842 - DNA, 86 bp, Homo sapiens; identical to SEQ ID NO: 30566
  chr6:70991963-70992049
  hyper

SEQ ID NO: 95843 - DNA, 985 bp, Homo sapiens
  chr6:70992136-70993121
  hyper
cgtcccggagccgccagcaccgctagctggactcggggttagtgcagctacggcgggctggaggagcgggagagggagcgtgcctggattcccgccttttccagcaaggcctgctgttgacagtgaccaggaggtggggcgggggagggggtgaggtgcgggaagtaagaagcaataacaggctaagaattaaacctcggtctccagtcacctattaccttcagcgccagagcctgcagtagggaggacccagattggggaggagccccccttcctagaccaaggggtcatctacggctctggacttcgataggactcgcggcaggtgctcgaggctggaggaagcgcgggtctgagagccctggggatgctccgcgcctttctcacagctccctcgaccgctgcgccccgacctgtcctcgtgtgcgcttgaaaaatgcaaacactccctgcccccaacttacctcgtcggtggtctggctgggctggagaagaaaagatggggagaaagtgagaaaagcacccctcaaactcgatcgcaacttacttgagccgcgcacaagcagagccccaacagcagcagccccagggccccgcggtcccgcgcagtccaggccatgcccgccgcccgccgctaatcccttggcccggctctgcagcctggttcccctctaggcttccagacccgccactagcataggtggcacttcgtccctgcagaaaaagcacccccgggagtagcggttgccaaagcgtccaggcccgggaggcgcgcgttccccctgtttatgaatggccccggagagggtcctgggattggaggagagctagggggcaggggaggacggatagaatgacaacagtcgcccttaaccccttccctgccgccgcacaggcgaggactgagcacgcagctctgcctccatcccatccaccccagtgcagcttctggctgtcctcggagacttcccgggtggcctgtgcc

SEQ ID NO: 95844 - DNA, 30 bp, Homo sapiens
  chr6:710606-710636
  hyper
ataaaggcaggactgcgagtcaaacccggg

SEQ ID NO: 95845 - DNA, 257 bp, Homo sapiens
  chr6:711053-711310
  hyper
tccagtggcatttcccgtcttacacgatgagcttcatccacgttctccataaccccctccccgccacgggaagcgtcagccacctggaacagccctattctgctcggttgtaaaaagcgtcaggcgcttttgatttgaaaagcgttaggcctgggaatcgctgttgctccctcggtgggcacgccctgctgacacgccctagcccaccggggaagccactggccacgagggagcgaggcgcacgggtgtcttccctc

SEQ ID NO: 95846 - DNA, 84 bp, Homo sapiens
  chr6:7120320-7120404
  hypo
cccacccccaccccccgcccgccttttttagctatttctttacttgcactgtgttttagttgattaaaaattatgtacctaggc

SEQ ID NO: 95847 - DNA, 30 bp, Homo sapiens
  chr6:71277663-71277693
  hypo
aggcgtgagccaccgcgcccggtccgcaaa

SEQ ID NO: 95848 - DNA, 30 bp, Homo sapiens; identical to SEQ ID NO: 40737
  chr6:7132823-7132853
  hypo

SEQ ID NO: 95849 - DNA, 107 bp, Homo sapiens
  chr6:71589506-71589613
  hypo
aagtacacgtgatggcgggattgtgagatgggacagcaagccactgaagctgagtgcacagagaacacaaggaaaataacttgagcgaggctcgggggtggggatgc

SEQ ID NO: 95850 - DNA, 217 bp, Homo sapiens
  chr6:71665506-71665723
  hyper
ccctcgcccacccagcggggcaggctggcctttacctcctggaagagctccagactataggtgttgtcgtcgtcagcgaagaagagcacgccgggctgcgcgcgctggtgctggtgcctctggcgcagccaggcgaggcccgcgttgcgctgctcagtggcgcgcggcagcccgggccgcttgtagcgccgcggcgtgggcacgtgcaggtgagtgc

SEQ ID NO: 95851 - DNA, 736 bp, Homo sapiens
  chr6:71665945-71666681
  hyper
tcccgtgagccgggccgcccctgcggagcgggagtcgggcgcccccgcggcccaccgcgtagggagagaagtaggggcgcggggtgagcgggggcactggcctgcgcgtgtccacgtcgagcatgatgatgacaattaggatccagggcaggaggataaagaagcgggtgaaaagcgcggacttcatggtgcacgctccctggcctctcggacaccccagagaggggcgagccgagggaccccagtgcgcagcttggacagcggcggcgccagcacttagggagtggtgatgggtgcgctgtccatggggccgagggcgctgcagagacctggagccgcggggctcactacctgggcgtggaggagcggcaggttcgcgcaagctagagcgacaaggggtgcaggcgggcgggcaggggctgcccccgactccaggtgagctggcgggaagcgggactcggtccagccgcgcgccgccggtcccggagttgtgccgagtgcgggaaaggcgctgatccccaccgcgctctttctgaagagtggaagccgagaagcggcacccggtgcgcctcgccgctccagtccggcggtgctgcgggcacaagggctccagccgcgggcccccaggacgctctctgggacgccttcgagggcgggcggcggcgctgggggctttccttcctcacattcccgccggggtggcgaggagcgggtggagacgctgggggttgtgtcc

SEQ ID NO: 95852 - DNA, 288 bp, Homo sapiens
  chr6:71666698-71666986
  hyper
cgcagcggaagcctgctctcagtcccttgctcttgtcttctcagaacctctccggatccagcagcaagatcccaaagcaaggaaagaaagaaaaagcgagggggcgggggcgctgcagaatccagcgtcctcccaagtcctcctgtgggaagacagcagcgctgctactggtggagaggggctgcgagagggaggcgcggagggaccccttggctctccgccgggtctggcgctaacggccccgcgagcaagctcgggaggcggccgctgcaccgcgggtggaggagc

SEQ ID NO: 95853 - DNA, 30 bp, Homo sapiens
  chr6:71868836-71868866
  hypo
acgcatgtgctaccacgcccgacctcatct

SEQ ID NO: 95854 - DNA, 22 bp, Homo sapiens
  chr6:71955640-71955662
  hypo
atttgtgtctgtgcccgctacg

SEQ ID NO: 95855 - DNA, 184 bp, Homo sapiens
  chr6:7204204-7204388
  hypo
ggtggctgcagtgtccggtgcatttcaccaggagcatcctgcgagccctgggagctgcctggctgacggcattcccacagcgagcctacagactgtgggtttacacttcatgccaggctgactttagatttttctaagggctggctttggaggtcagcacaggtgcttacgcattgtctaacct

SEQ ID NO: 95856 - DNA, 30 bp, Homo sapiens
  chr6:7204910-7204940
  hypo
gagtgactttccttacggtaccattcactc

SEQ ID NO: 95857 - DNA, 118 bp, Homo sapiens; identical to SEQ ID NO: 30572
  chr6:72129732-72129850
  hyper

SEQ ID NO: 95858 - DNA, 119 bp, Homo sapiens; identical to SEQ ID NO: 30573
  chr6:72129926-72130045
  hyper

SEQ ID NO: 95859 - DNA, 309 bp, Homo sapiens
  chr6:72130190-72130499
  hyper
cgccgccgccgcccaccgcgttctttgtgtgtctctcgccgccctccagccgcttcgccgctcgcctgacagctgatgggctcaccgcgccgggtcccgcgtcctctcggccgcagccggcggagcccggcccggcaggaggaggaggggagaagaggagcgttgacagatgctgtcttggagcgggcaccgccgggggaaaagtctggactgcctcggcgagaagcggccggtaggcaaccggccccagcctcgcattcgcctcaaagaccccaattggctaggagcccttccctccgcagcggctcg

SEQ ID NO: 95860 - DNA, 27 bp, Homo sapiens
  chr6:7237769-7237796
  hypo
tttaagcgctcgcgttggggcttgcag

SEQ ID NO: 95861 - DNA, 100 bp, Homo sapiens
  chr6:72596035-72596135
  hyper
gcgaggtgctgtgcacgttggcgactgtaggggtagcggccggggcacgcgtggctcggacccggggagtgggcgggtgggtgcccgtgggcggagcggc

SEQ ID NO: 95862 - DNA, 179 bp, Homo sapiens
  chr6:72596136-72596315
  hyper
ccgggactgagtggctggcagctatgtctgcgagagcagcggcatcaccctggatggaagcctctgagactccgcctaactgacacccaaactctccctctccctcccgcagccccaaattggaggcagcagagcctgggagcagcctccacggcggcagcggccgccccagtcccagc

SEQ ID NO: 95863 - DNA, 543 bp, Homo sapiens
  chr6:72596541-72597084
  hyper
gaaagactgggttctcgctctccccggctctgctgctgctgctgctgccgccgccgccgctgctcctcctcctgccgccgccgctagggctccgctgtgagggggaagcaggggcgcagctgctgggcgtgcatccgaaaggtgagagccagagagcgagcagagggggcgggcaggccacgaaaatgtcctcggccgtggggccccgcggtcctcgcccacccacggtgcctccccccatgcaagagctgcccgacctgagccacctgaccgaagaggagaggaacattatcatggcagtgatggaccggcagaaggaagaggaggaaaaagaagaagccatgctcaagtaagccagccccagccgcgccatccatgcctccgtgcctccatccgtccattcaccactcactcccctagtcctcgcggctgagtgtggggaaggggctgccagggtgctgggtgcggacggaggcgcccgccttgggccaggggcgcggggcttgagcagggaagaggtcaggggaccggaggagggagggg

SEQ ID NO: 95864 - DNA, 38 bp, Homo sapiens
  chr6:7279451-7279489
  hypo
aatctatcttggggccgggtgcggtggctcacgcctgt

SEQ ID NO: 95865 - DNA, 30 bp, Homo sapiens
  chr6:72806875-72806905
  hypo
catgaacataaggggcgttgtgaatgtgga

SEQ ID NO: 95866 - DNA, 30 bp, Homo sapiens
  chr6:73063627-73063657
  hypo
aacccaggctttggccgggcacggtggctc

SEQ ID NO: 95867 - DNA, 342 bp, Homo sapiens; identical to SEQ ID NO: 30579
  chr6:73329784-73330126
  hyper

SEQ ID NO: 95868 - DNA, 494 bp, Homo sapiens; identical to SEQ ID NO: 30580
  chr6:73330620-73331114
  hyper

SEQ ID NO: 95869 - DNA, 123 bp, Homo sapiens; identical to SEQ ID NO: 566
  chr6:73331115-73331238
  hyper

SEQ ID NO: 95870 - DNA, 612 bp, Homo sapiens; identical to SEQ ID NO: 30582
  chr6:73331239-73331851
  hyper

SEQ ID NO: 95871 - DNA, 1216 bp, Homo sapiens; identical to SEQ ID NO: 30583
  chr6:73331875-73333091
  hyper

SEQ ID NO: 95872 - DNA, 28 bp, Homo sapiens
  chr6:736009-736037
  hypo
aacgtattagctggccgggcgtgatggc

SEQ ID NO: 95873 - DNA, 126 bp, Homo sapiens
  chr6:736749-736875
  hypo
gtcatggaaagagtacgccccgtgtacccaccacgcaactgaacagtaacacggcacggggagcgtgggaggctccggcttgtttctccgcccctgtgtttccgcctaactcgaaggagccactgc

SEQ ID NO: 95874 - DNA, 179 bp, Homo sapiens; identical to SEQ ID NO: 40850
  chr6:73764839-73765018
  hypo

SEQ ID NO: 95875 - DNA, 489 bp, Homo sapiens
  chr6:73972632-73973121
  hyper
tctctgtcccttcaccggactaaccgagttcgagaccacaggggggtcaggtagccaaggctgggctttgacggtaggaatgaaggaggtgagggtggcgcgccgcaggcctgggccactccctgagtagggcggcggcggcggcggcggcggcggcggcagcggcggcagcggctgcaggcctggccgattgtgaggagacagcggtacctcctgggccgcgcacccgacccttccaggggtcccggctcgcgccgcggccgcgcgaggcgcgctcgagcggaagtggcggcgaccccgccggaagcgcgcggctgcggcgcgggaagcaacccagagccctcctcccgcctgctctgtgtaggagacagcctgcggagcccactgccggcgcgcagagagcccagcagctcttgagtccaggaagcaagggtgggaggagggacgagccagtggcaatgacccagacccggacgacccccattgctg

SEQ ID NO: 95876 - DNA, 681 bp, Homo sapiens; identical to SEQ ID NO: 8540
  chr6:74019413-74020094
  hyper

SEQ ID NO: 95877 - DNA, 15 bp, Homo sapiens
  chr6:74161177-74161192
  hyper
ggaaggtagggactg

SEQ ID NO: 95878 - DNA, 89 bp, Homo sapiens
  chr6:74161232-74161321
  hyper
cgccaagcagctcaccttcacgtgctcatagtagctcccggtgttcagcagcccgacgcctctgaacgcggagtcgcacttcagtctga

SEQ ID NO: 95879 - DNA, 114 bp, Homo sapiens; identical to SEQ ID NO: 30587
  chr6:74161684-74161798
  hyper

SEQ ID NO: 95880 - DNA, 235 bp, Homo sapiens
  chr6:74161830-74162065
  hyper
cgtgcggaagccttgggggcagtggctccggcctcggaagctctctgcatggcctttccgtgccaaggctgcatggctggcgctttctgttccccgaaagaagaatccgtttcaggaaaaggccgcaagaggaagagccagcagcagctgttggaaaccaagcactactggcgggcacacaagagtctgcgacccgaaggggaaccccaggctgggaagtcgctgggagccacgc

SEQ ID NO: 95881 - DNA, 100 bp, Homo sapiens
  chr6:74234126-74234226
  hypo
taccatggcttgccacgtgaaaatgatttttaaatcttttcatctgctgtagctacctctgaagaaaagatgatggcccggtgcggtggctcacgcctgt

SEQ ID NO: 95882 - DNA, 38 bp, Homo sapiens; identical to SEQ ID NO: 30589
  chr6:74405585-74405623
  hyper

SEQ ID NO: 95883 - DNA, 102 bp, Homo sapiens
  chr6:74405913-74406015
  hyper
tgtagcccaggcagacgccgtcgagatgcagggcccaccgctcctgaccgccgcccacctcctctgcgtgtgcaccgccgcgctggccgtggctcccgggta

SEQ ID NO: 95884 - DNA, 38 bp, Homo sapiens
  chr6:74406224-74406262
  hyper
atgaagttgtttaagcgtctccccggccataacaactt

SEQ ID NO: 95885 - DNA, 93 bp, Homo sapiens
  chr6:74698077-74698170
  hypo
cctttaccttaaaagcgggaaacaaaagattagcattatctctttttggtactaaagagaaaagataacttgtttcaaaaacatttctgacaa

SEQ ID NO: 95886 - DNA, 30 bp, Homo sapiens
  chr6:75167870-75167900
  hypo
aagatttaacatagacgtaattacgtgaaa

SEQ ID NO: 95887 - DNA, 87 bp, Homo sapiens
  chr6:7543263-7543350
  hyper
ccagcggaaacagaccgagggcgtcatttgggtgggtggggaagagatcctgtccctgctttgaccgggtctcgggagctggactct

SEQ ID NO: 95888 - DNA, 30 bp, Homo sapiens
  chr6:7562793-7562823
  hypo
tatctgaagtaaagccgtgatggtgtgcgt

SEQ ID NO: 95889 - DNA, 52 bp, Homo sapiens; identical to SEQ ID NO: 30591
  chr6:75914106-75914158
  hyper

SEQ ID NO: 95890 - DNA, 138 bp, Homo sapiens; identical to SEQ ID NO: 30592
  chr6:75914461-75914599
  hyper

SEQ ID NO: 95891 - DNA, 240 bp, Homo sapiens
  chr6:75914881-75915121
  hyper
gagctgggaaaagtccgccaagaatgagtaccctagtgctgcctaacccaccatctcggatgctctgaaaggtaggggaggaaggagccagaacactccactaggaatctgttacgagatgccacacacacccgtgcagcctcgacgagctgcagagcactcagcgggccctccaaagaattccgcaccgtgcgtcaccaaaataccttcccagcgcccccgccgcacgcctgccctccc

SEQ ID NO: 95892 - DNA, 214 bp, Homo sapiens
  chr6:75915170-75915384
  hyper
cggcgcgccctccattgaaatcgacagcatctacagatgaaactcctctagaaacggaaacactgaacgggatgctttgcgtgcacaaaaccttgctcagctcttaagaaaagcaacattcccctctccctcaaaaaccccaaagaatcaccaaatcccagtatacaaggcaacgctctagcccacctacactattacaagtccaaactgtcct

SEQ ID NO: 95893 - DNA, 563 bp, Homo sapiens
  chr6:75915426-75915989
  hyper
cgccgtttcccgagttgtctctgggaatgatgggggtaggggaaaggggacagaaaccaggctgacctgaggcggcggcaacagggagaggtagcggcggcgacagcggcttcccggcgtcggagaagctggtgctcggtgtggcccccacacgccccggcgataggcgctgcactccaggagcacctggcggccgccgaggcgtgggcagctgcggggaagtccaggaggaggaggagaatcccaggaggagaggcgggcgcggcaggaagactggagatggcctgagcctgcagctgccggcgcgcggacgcgtctggggcggttcgccttagccaagtggaaagagactccgcgccgcgggctacttaatagagggctgttcccagctctcagtttactcggttacgaaacgcctgagaaggtggacggctgccacggggtgatgtatgctcctccggcggtgaaggaggtctacttttgggaacgtgtgcatacttcgagcattccttcggcgtgaggtggcgatcgccgtagtagcagtgccccgctggggggcgggg

SEQ ID NO: 95894 - DNA, 190 bp, Homo sapiens
  chr6:75916269-75916459
  hyper
gggtgcacttaaaaccgatttacaggatttccattaactaactgtctgtacacgcggcgcgccttctgtctttttcaatctccaagcgcgattggaaacccggacagccgcccgcgcggggctcagtgatgggatggctttcccagtcctttctcactcccctggtgcttcaggacggaactgggaggct

SEQ ID NO: 95895 - DNA, 40 bp, Homo sapiens
  chr6:75918553-75918593
  hyper
tcctagtgtgataaacggtaaagaacgggtaaccctcttc

SEQ ID NO: 95896 - DNA, 17 bp, Homo sapiens
  chr6:76006457-76006474
  hypo
cccgcctcagcctccct

SEQ ID NO: 95897 - DNA, 1514 bp, Homo sapiens
  chr6:7726255-7727769
  hyper
tggctgccagcctgtcggttaccgcggggcggggagtcccggggctggagtgaggtacctgagccgggcgcgcagcagaaagcccacgttggccgctgcggggagcgcggcgtggagaggcgggagaccgaattccggcgccgccgccgcggccgctgctcggtgcactagcccccttccttcccatcctttctgcgagcgggtttgctgggcagccgggcgaccgccgaacggaaagcaagatcctcgccgcctccgcttgaggaggcgtgcggcgcgcggagattttgagtgggagcgacggtgcccgagagctcaggggcgcggagttcgtgagcgagaaggaagttaaacctcgcggaatagactggcatttcgggacgccttgtcgccgcagcctgggccctgcaacggggtaaacttcatggtggccctgcgatctggggaggggcgtgcgccacggtgatgccgggcatctcccgcagctcgtgagcggccccgctccccgctgccccgggtcccactcagtcgccagggagagcgcggggcagcgcacgtgtgcggccagcgaggcccagagtgaccgcgccgcgactcgcaggagccagggcgcaggctgcagtgcagcccggactcagacgcacctggcctggaccgcgcgcctctagagacctgcgcgaggctgtgaggctccccttcctcccctccaagcggttctcctggtgatcgccccttcgccacctctctagcctgggcaactgggggcgccccggacgaccatgagagataaggactgagggccaggaaggggaagcgagcccgccgagaggtggcggggactgctcacgccaagggccacagcggccgcgctccggcctcgctccgccgctccacgcctcgcgggatccgcgggggcagcccggccgggcggggatgccggggctggggcggagggcgcagtggctgtgctggtggtgggggctgctgtgcagctgctgcgggcccccgccgctgcggccgcccttgcccgctgccgcggccgccgccgccggggggcagctgctgggggacggcgggagccccggccgcacggagcagccgccgccgtcgccgcagtcctcctcgggcttcctgtaccggcggctcaagacgcaggagaagcgggagatgcagaaggagatcttgtcggtgctggggctcccgcaccggccccggcccctgcacggcctccaacagccgcagcccccggcgctccggcagcaggaggagcagcagcagcagcagcagctgcctcgcggagagccccctcccgggcgactgaagtccgcgcccctcttcatgctggatctgtacaacgccctgtccgccgacaacgacgaggacggggcgtcggagggggagaggcagcagtcctggccccacgaagcagccagctcgtcccagcgtcggcagccgcccccgggcgccgcgcacccgctcaaccgcaagagccttctggcccccggatctggcag

SEQ ID NO: 95898 - DNA, 1035 bp, Homo sapiens; identical to SEQ ID NO: 30276
  chr6:7728086-7729121
  hyper

SEQ ID NO: 95899 - DNA, 183 bp, Homo sapiens
  chr6:7764169-7764352
  hypo
ctccgttggatcaagcgtatgtgtcctgcgttcatttctaggtctgtaaacaaacacagctgttgagtgaaggatccgtcttcagaaatggtgaaaaaacagccatgccctgccagtgagagcgcagcaggggagagttgttccagggcttgggaggagcaggcgaggcgcagcagggccggg

SEQ ID NO: 95900 - DNA, 27 bp, Homo sapiens
  chr6:78061285-78061312
  hypo
agaaatactgctgggcgcagtggctca

SEQ ID NO: 95901 - DNA, 100 bp, Homo sapiens; identical to SEQ ID NO: 30597
  chr6:78172176-78172276
  hyper

SEQ ID NO: 95902 - DNA, 892 bp, Homo sapiens
  chr6:78172322-78173214
  hyper
cgaggacgtggacccgggggagtcggttatcagctgggctcgggtcaagcgcttgccggtcctgttgggcgtctgtttcaaaatccgggagcgggcttctacgtagatgcggccatagagggcgatgaggagcagggtggggaagtagaaagcacccaccgtggagtagaccgtgtagaggatgtggtcggtgttcaccacgcattccgacacctcctcttcggccttagcctgacgccagaagaagggcggcagcgagatagagatggagaagacccacaccagcgcgatcatgaccgccgccctcttgggagtccttttagctgagtactccacggcgtccgtgatggcccagtagcggtccagggcgatgacacagaggtgcaggatggaggcagtgcaacaagtgatgtccgacgacagccagaagtcacagaccacctggcccagtgtccagcggccggtgacagtgtacatggtgctgatgggcatcaccaggatggacacaagcaggtcggtgaccgccagagaggcgatcaggtagttagccggggtgtgcagtttccgggtccggtacactgtggcaatcacaaaggcattggagagcgtggtggccaaggtgatgagcgccaatagcataaccagcagtactttccagggtagggagatggagtcctggtaaatgtagtccttggcgctgcagttttgggagggagcagaggataagttggcttgaggaacccaggtctcggagcccgcgggcggcggtggagcgcactgagcacccggttcctccatggctctcctcgccccagctccggagcgcagctcttgggcatggagcggacgaaggagagggcggaaggaccgtggcgatcgcaggtttgtcccc

SEQ ID NO: 95903 - DNA, 25 bp, Homo sapiens
  chr6:78173701-78173726
  hyper
ctaggagcagcgctgcgccgcgcct

SEQ ID NO: 95904 - DNA, 285 bp, Homo sapiens
  chr6:78173771-78174056
  hyper
cggacgagctgccccgcggagacggagccataaaaggggggacacgggggctggagttgcggctgctcgggccgcgccgccgccaccgccaccctggtcccacgggagccactcggagccatgccactgggtgcgcgggtctggaggacctggcgcggcacactgggaaggggcaggtgtctgggggagctggagggacgcggcgtgcaccagcccgggagaagcgtgcgagctacggagcagatgggctctttatatagagtccaggtccggtccgccagagca

SEQ ID NO: 95905 - DNA, 234 bp, Homo sapiens; identical to SEQ ID NO: 30600
  chr6:78175915-78176149
  hyper

SEQ ID NO: 95906 - DNA, 84 bp, Homo sapiens; identical to SEQ ID NO: 30601
  chr6:78176445-78176529
  hyper

SEQ ID NO: 95907 - DNA, 44 bp, Homo sapiens; identical to SEQ ID NO: 30602
  chr6:78176790-78176834
  hyper

SEQ ID NO: 95908 - DNA, 30 bp, Homo sapiens
  chr6:7844836-7844866
  hypo
ccccccttccccacccgcagccatccccac

SEQ ID NO: 95909 - DNA, 362 bp, Homo sapiens
  chr6:7911626-7911988
  hypo
gaaagaaagtcaaagcggcctcttctagacaagaaggcacctagcaggactgactggggtcctactgtgccctcatttatgccggttactaaaatgaatgacagcacgcctgctatggctgaactcagcctgtggaatggcccgaaggcatccctgcccagcgactcataactcgcacctgcacacacaccttacagcagatggtaatcgaaagctccagccctaccccggggatctgaagctaaattagaatcaccgggttgctctccgggatcctgcctgctctttgattatcctcaatccaggaagccccaggtagttaactcctggcttggcaacaggggacgcgcccactgtctcac

SEQ ID NO: 95910 - DNA, 39 bp, Homo sapiens
  chr6:7920126-7920165
  hypo
ctctgagagctgtagcgaggaatgcgaagggggcaagga

SEQ ID NO: 95911 - DNA, 54 bp, Homo sapiens
  chr6:79620288-79620342
  hyper
ggaaatggactaggtcgtaacaagaaaaagtgatatcaagcccgggcagaaggg

SEQ ID NO: 95912 - DNA, 211 bp, Homo sapiens; identical to SEQ ID NO: 30604
  chr6:79620474-79620685
  hyper

SEQ ID NO: 95913 - DNA, 191 bp, Homo sapiens; identical to SEQ ID NO: 30605
  chr6:79620686-79620877
  hyper

SEQ ID NO: 95914 - DNA, 30 bp, Homo sapiens; identical to SEQ ID NO: 40853
  chr6:79699310-79699340
  hypo

SEQ ID NO: 95915 - DNA, 52 bp, Homo sapiens
  chr6:80341274-80341326
  hyper
gcgggaggcgcgcggcgctcgtcactgcgcgtccttgcgctcagccggtccg

SEQ ID NO: 95916 - DNA, 1078 bp, Homo sapiens
  chr6:80656522-80657600
  hyper
aaggaatcctgtgcacggggaagagggaggcgagctcgggagatgtgggagcacagggtggggcggctcctgcgaggagctcctggctgcacaggctccatctgatatgtcagctcccgcatccgagagctgatgagagatggagggagctcagaagaaaaccctgcgagtgtcgggggaggggaggccttaacattcggatcagattaaccagtgctcaaccgcagtgcccgcgccggcccctccgctgatccgcagcatccgaaagccgcagggcgcgggggcctgtggggccgggcccgggagctgcgagaccaggggccggtgaccccccgcgggggaccgagcgaggatggggaagtcagcggctttacctgcgatggaccaggtccagcggtagaactctaccgtgtcgttgagtgccgtggacactacgtttaggacactacccggctccgagtccaggagccccatcgcggcgatgagcgggcgctggcggcaggagaaagcggagacccagagagagggctgaccccggaggcggtggcggccgacggggcgagcggcggccgggaacccctctaacggcggcggcccggctgcgtcttctcctgctcctcaaggcgccgcggcggcggggatgcggcagaaggcagggccaagcggaaggcgtcgtcaaggttcccgggagaaagacgaggaggtggaggaggcccagccgccagcacagtgcgctgcaccagtctgcagcctcgcgcagccgcccctccaatctcctcagccggcgtcacgtggccgcgcgcgggggcggggggccggccgcccctcctccctccctccctccctagtattgggactcgctggcgtagggatgctgcgctcaagggtgcgacgccaactgggctcgcgcaggcgcgcgccgtcgagcgggagcgggacacctgggctcctccttggcccctccccgcacaagtcgcctcattagccttccccgcccctgtcccgggcatcggcccctgcggaggagttcaccgcctccccacgggtgatttcttatccgccccggatacgtcctggg

SEQ ID NO: 95917 - DNA, 265 bp, Homo sapiens
  chr6:82461332-82461597
  hyper
ctttgttcaccccctcgggtaagaagtccaacaggcagtccagcacgacgtccttcacagtctgaaactccccttccccgcgcaggtcggcgcagaagatgaggtccaggtccttgtagcccaggccgctgtcctggtgcaggacatggctggctgccgagccgttgaggcgcacgtcgcggacgccaatgcgcttctcggccaggcgccgccgcaccaccttcacgatcaggctcggctgcagctcgagcgtggggaagttgcc

SEQ ID NO: 95918 - DNA, 30 bp, Homo sapiens
  chr6:82462799-82462829
  hyper
gtctttagatcatcacggttgggctccgga

SEQ ID NO: 95919 - DNA, 31 bp, Homo sapiens
  chr6:82958615-82958646
  hypo
taagcttaagttggccgggcgcggtggctca

SEQ ID NO: 95920 - DNA, 43 bp, Homo sapiens
  chr6:83073208-83073251
  hyper
tcagggtgaattccacgagattcaccagcggttttgctccagt

SEQ ID NO: 95921 - DNA, 71 bp, Homo sapiens
  chr6:83073519-83073590
  hyper
ccaggggctggggtgcgaagagagtcggcgcccgcaacgcggagccgggaagtcgtcgctactctggtgga

SEQ ID NO: 95922 - DNA, 32 bp, Homo sapiens
  chr6:83073803-83073835
  hyper
gaggggctggcggggcgcgggctggggggcga

SEQ ID NO: 95923 - DNA, 312 bp, Homo sapiens
  chr6:83074517-83074829
  hyper
gggttagccaagttccggctgcggcgccactccctcggttccacgagaggaaagttttttttttccagacgcttccgccggctcgcgccctccgggcccagcctcccgagccttcggagcgggcgccgtcccagcccagctccggggaaacgcgagccgcgatgcctggggggtgctcccggggccccgccgccggggacgggcgtctgcggctggcgcgactagcgctggtactcctgggctgggtctcctcgtcttctcccacctcctcggcatcctccttctcctcctcggcgccgttcctggcttccg

SEQ ID NO: 95924 - DNA, 88 bp, Homo sapiens
  chr6:83458754-83458842
  hypo
ttgtaaggagtgaaatcctcattaaactgagttttatgttgaagcataatctctataaaatcagtaaacactgcgcatatgcagtggt

SEQ ID NO: 95925 - DNA, 272 bp, Homo sapiens; identical to SEQ ID NO: 568
  chr6:84417429-84417701
  hyper

SEQ ID NO: 95926 - DNA, 156 bp, Homo sapiens
  chr6:84417908-84418064
  hyper
cgtgacaccgtccccattctcccccggcccccacatagggccagactcaccccctggggacccccctgtcaatcagcactttccccgcaacctgacccgcgggtgctggactagccacaacgtgcgttggggttattccctgggcgccgcacccac

SEQ ID NO: 95927 - DNA, 464 bp, Homo sapiens; identical to SEQ ID NO: 30610
  chr6:84418260-84418724
  hyper

SEQ ID NO: 95928 - DNA, 64 bp, Homo sapiens; identical to SEQ ID NO: 30611
  chr6:84418725-84418789
  hyper

SEQ ID NO: 95929 - DNA, 131 bp, Homo sapiens; identical to SEQ ID NO: 30612
  chr6:84419071-84419202
  hyper

SEQ ID NO: 95930 - DNA, 126 bp, Homo sapiens; identical to SEQ ID NO: 2842
  chr6:84419203-84419329
  hyper

SEQ ID NO: 95931 - DNA, 85 bp, Homo sapiens
  chr6:84419330-84419415
  hyper
attttaaatgtcagatcctgccggccatccgcgaccgtcacctgtgcgtcttcagctcctcaggctcctccgcttgtctcagtta

SEQ ID NO: 95932 - DNA, 79 bp, Homo sapiens; identical to SEQ ID NO: 40855
  chr6:84513478-84513557
  hypo

SEQ ID NO: 95933 - DNA, 219 bp, Homo sapiens
  chr6:84562711-84562930
  hyper
gtcctgagtctccagcgaatcaagcaattaaccagtcacttggcctttttgcagaaatccacaaaacgtgtagactcgcttaattccatctcctcctggcctcttcacacggaaattggctgctcgggcgaatgttgtttttctccgcagccatgtgtcgaagggcgattaacattcgctcgacaaaaccctgtcccgggccatttgggagttgcacgc

SEQ ID NO: 95934 - DNA, 354 bp, Homo sapiens; identical to SEQ ID NO: 2845
  chr6:84562931-84563285
  hyper

SEQ ID NO: 95935 - DNA, 437 bp, Homo sapiens; identical to SEQ ID NO: 2846
  chr6:84563416-84563853
  hyper

SEQ ID NO: 95936 - DNA, 66 bp, Homo sapiens
  chr6:84743425-84743491
  hyper
gccccgcgccgcctccgctgcgggtcgggagcgcgcgtctccgccgcacctcggatctaggagcta

SEQ ID NO: 95937 - DNA, 30 bp, Homo sapiens
  chr6:84847017-84847047
  hypo
acttgaacatgctagcgagccttacaacgg

SEQ ID NO: 95938 - DNA, 39 bp, Homo sapiens; identical to SEQ ID NO: 30618
  chr6:85471957-85471996
  hyper

SEQ ID NO: 95939 - DNA, 2365 bp, Homo sapiens
  chr6:85472324-85474689
  hyper
ccctgcagatccacccgcggggcctgcggcgagggcagaggggtcccgggccgggccagggagcgcgccggagaccccttgggggagcctcccggtgacgccagaggggaagctccctgctggaagccgtcctcacagccgcctggacagcaaaggacagagaaagggaactggtgagggaaacagaggggaagccagccgcggagacgggcccacctggtggctgagaagaggaaaatgaccgggagaaaaggggaagctttggtgccatcaggtcctcctaaagaacaagccagtcgatagacacccacattctgcctgtcgaaggggcgcattcagagctccagtgtggcctgcttggtccccaagtcccaagcccgggagaggcgcgcgggcagcgtccaccccacccgctgggcctccgcagggccaaggccccagcagaaaaggcttcacgccgccgccggggtctgggacgcttgcccgacggagtcagaggagctcccgggtccagagtccccagtgcaaactccgacgcaacctgcgcctcgaagcgcaagcagcaaaagcgcccggactctggtcccaagagcctgggcctccttaagccataagcgtctgcggcgcctcgctttgggccttcttttgggccgggccggaggcatcttctagaaggctcttcagaccccgctttcgccaaactcccggcgccctgcgcttccagcccagcagagaaaagtgtgaaaagcaagcccgcggtcgccgtcggccttggcagagaaatcaagaggagaagggaagggaaccgctcaactacccttcgggaaaccaagtttccaaatatgccgccctcttcctggtttgcacaaacggtttagggcattcgttccggtttcagggtggggtatgccgtcgctcccctcctccccgccctgtgcttttaaaagttaggaaacaaaaaagagcacccattggctggaaccccaagggaggcagatgcaggaagcacagagctgcaccgctaggcgcagcaaacagccgcggccgaaggcgcgggtcgccgagtgggcggcggccgcccgcgaggcgagcctggaagcagtatctgaaccgtctggagggtgaccaggttgcgcggcgagctttgcgactgacacggccaatgcgctagtggctgagtggccttggccatgtagggacgcggcgcgcacgcacacccacagactcgcagaagttcaggttcgcgccggagagaagttataggcaggaaggggcccactcacccgcggctccgcgctccaggtctgcgccactccgagccggcccagacgtcgccccagccggcggcgggagcgcagcgccttcgtctccctcagaagaacccttttcgcccgcgccgccgccgcggctgcagcctccgtcgtccacggcccccgccgcctcttcggcgcccagttttcgccgcttcttctgaagctgttgctgcttctcggcgccgatcagcgcctccaccgagaaagcgtgcgccttgaggcttagcatgctgcacggcgagccccttcgcttctcggccatcccccccgccccgcgcccgcccgcccctctctcatatacactcacgcgggcacacgcgcgctctcgctcttcccccaccaaaaactaaaaggctctcggggcctcccgagatctgcccccttccccaccgcgggcaaaaaacagatttggcgtttccgctttctcgcttgtgttgggatccaggaaccggcgacgcgccggccaagtctcctttcctgggtctctctcgcgcgctctctcactgatgcactcctttgctcccaccccttccacctcctcctgctgctccgaggtctgcctcaactgatgcgccagagaggactaacatgggtaaaaaacactctgtggacacaaattagggattgtaattgaaatttgttgccttgatctgtcagcacttccaggcaggagagcggtgggaagaacttgctcattagtgtcaataaagcggcgggggcggagcccgggtccctgtccatcacccagacggccggccaatcaggaggcgccgactccgcgcagcccgcgcccacttccttacaaggtagcgaaaaaccaggagtgaaaagcgccgctgtctggcttggatgtgccagccacacggacgctgaactctgtctctctgacgtccgtagctgagtccagccccgtagtctccagctttcctcaccaggacctggaaaggcggaagttcccggctttaaactagacgttcaacaagttagaaaatcaggaatctttcaaggttccgtaaattgccgtcccacttccgtatcgcttaatgttgcta

SEQ ID NO: 95940 - DNA, 39 bp, Homo sapiens
  chr6:85474894-85474933
  hyper
atgtcagaaaaagcacgccctttccgcagcccacctttt

SEQ ID NO: 95941 - DNA, 60 bp, Homo sapiens
  chr6:85475862-85475922
  hyper
tattgtagaagagaacgcgcggttcctggaggccggacaccacagcgggagtaggaacct

SEQ ID NO: 95942 - DNA, 211 bp, Homo sapiens
  chr6:85476191-85476402
  hyper
ttagccgaaggcaggcgccggcagggagagctaagaggccgcctagagagtttgggccgggagtgggagtgggacaaggcgggagctaacttagctggagtagacgccagaagaagttccgttcagctgaggtgccccgccccaatcccaggctctcggggaccccaagaagggagctacccggtgcttctccgagcggtccttacagctt

SEQ ID NO: 95943 - DNA, 267 bp, Homo sapiens
  chr6:85476998-85477265
  hyper
agcccactccaacctcggctcctggagaaggggcgtcgaatctctcttgggcatgggagggaaagacattccgagttggctgggcggagtggcagccttgagagtgacgagtgacagcaaagcctcgtcctagcaaggccttttaccaacagcgcggcatgccctttcgaggagagcgccaggccctcgcactttgcaagtcaagagagcaaagaaagcggggacagggcgcgtaatcgcaatgtccggtcgcgcgtgtgcacgtgt

SEQ ID NO: 95944 - DNA, 38 bp, Homo sapiens
  chr6:85478418-85478456
  hyper
ttctcgcctctccttcggatctgcgttaatgaaaatat

SEQ ID NO: 95945 - DNA, 200 bp, Homo sapiens
  chr6:85478694-85478894
  hyper
cgtccttctcaattccgattagctgagactgaagccctctacaaaggacctgtgcagcccacggaacaactccgcagttctcaggtagaagaatcagaatcaggtctgagcccgcggagtatctctttaagcgctgattttttaaaatcaatgatcgtttctcattggggctccagggaggtgctcggtttctggagtgt

SEQ ID NO: 95946 - DNA, 30 bp, Homo sapiens
  chr6:85481458-85481488
  hyper
tctttagatttccatcgtggaggcataggg

SEQ ID NO: 95947 - DNA, 396 bp, Homo sapiens
  chr6:85482401-85482797
  hyper
agccaaattattccccgacggctccaatattgtgccagagtcccagagtcagttatttttatgtctgactgtatttcacatgtgcagggtgataaataaaatccgtctcaagctacaaactatctgagtgtgatgaggaacaatcgacaaaaattaacccagccaaagcgttggggttcaagcgagcgactggaccataaatcagcgtcgcggtggcgtcgggaagctgagcgctcggaggtgcactcagctgcctctgggttcgcccagtccgagagcggggctccgccgcgggagcccgggcaggaatcggactccgccaggggttcggagtcttctggggaaagggcgtgttgggagagaaaggcaagcccacgcaggagcgacctcctaatt

SEQ ID NO: 95948 - DNA, 310 bp, Homo sapiens
  chr6:85482857-85483167
  hyper
gtgtaaaatcaaaaaagacttgggaggcaaacttgggtgggaagcactgaggaaggcgaaacaattcccaacttatctggatcccagacgagtccctctgattgcttaagtcactagaaaaggagattcgtctcagcgattaacaatgataccctttttaagagagatcaaagaaggcgcctagggaagctctacaacgcggcttcttggagttctgaggccgcctgcgcattcactttccagtgtaagcccccgctccggaatcccggctccagcccagcccgcgcccccttccctggaaagacctggc

SEQ ID NO: 95949 - DNA, 314 bp, Homo sapiens
  chr6:85483210-85483524
  hyper
cggggctggtccgaccggtcgcttccagctctctccacctgttggaaagcccaggcccaagaaccgcgccagcggcggcagcacgtcactcggcggccacggggagtcagggagcgcggaacgcgggtttctgttgataagtgcaaagtacggccctctcggtgctaagtgcacagtaagtgcgaagaataaatacatcatctcccggggcggctgtctcgaaaacgcctctcagctgcctgcgtttcagagcccgtcaagggttatagcttagtgtgggcgtccgcgccgcgcctgcgcctccgagcgccggc

SEQ ID NO: 95950 - DNA, 173 bp, Homo sapiens; identical to SEQ ID NO: 8572
  chr6:85483759-85483932
  hyper

SEQ ID NO: 95951 - DNA, 69 bp, Homo sapiens; identical to SEQ ID NO: 2850
  chr6:85484557-85484626
  hyper

SEQ ID NO: 95952 - DNA, 217 bp, Homo sapiens; identical to SEQ ID NO: 2851
  chr6:85484716-85484933
  hyper

SEQ ID NO: 95953 - DNA, 61 bp, Homo sapiens
  chr6:86159448-86159509
  hyper
cagagaggacccaggcgcggggcggacccctccaattccttcctcgcgcccccgaaagagc

SEQ ID NO: 95954 - DNA, 125 bp, Homo sapiens; identical to SEQ ID NO: 30627
  chr6:86159778-86159903
  hyper

SEQ ID NO: 95955 - DNA, 262 bp, Homo sapiens
  chr6:86160146-86160408
  hyper
agggcgccgaggtggcgcacttcatgaacgccctgcgctacgatgccatggtaagacccgagcccgcgcccgggatagtagtcccggactgagagaggagccgggctggaaaagcagcggatggcagagtgtggcaagcctaggtccagggcgcggagagatgtggggataaagtgagactccggccagtgtgccagctggatgcatagaagtcccttggacgattcgtcttaaacggacgttattgcgcccccactatgag

SEQ ID NO: 95956 - DNA, 77 bp, Homo sapiens; identical to SEQ ID NO: 40856
  chr6:86302345-86302422
  hypo

SEQ ID NO: 95957 - DNA, 30 bp, Homo sapiens; identical to SEQ ID NO: 40857
  chr6:86415082-86415112
  hypo

SEQ ID NO: 95958 - DNA, 84 bp, Homo sapiens
  chr6:87646860-87646944
  hyper
cgccagggctgtggccggcaaggggctcaggaggtgagtcccttgcccacacctccaaccccgctggcccggtttataacatgg

SEQ ID NO: 95959 - DNA, 92 bp, Homo sapiens; identical to SEQ ID NO: 30629
  chr6:87647217-87647309
  hyper

SEQ ID NO: 95960 - DNA, 54 bp, Homo sapiens; identical to SEQ ID NO: 30630
  chr6:87647316-87647370
  hyper

SEQ ID NO: 95961 - DNA, 209 bp, Homo sapiens
  chr6:87647371-87647580
  hyper
ctggcggggagaacgccctgggctcaacgtactccagaatcgaatgttgagagaagcagtgctctgatccagctcaggagaaaaaggagcgggttccgagtgagacttctggagccagctggacgtgccggtttgcccagtgcggcgcggctgcacgcaccgtccacaaggtgaggggcgcacaccttccgggacgaccttggcttccc

SEQ ID NO: 95962 - DNA, 27 bp, Homo sapiens
  chr6:87770042-87770069
  hypo
cgcaagaggctacgttttccattccaa

SEQ ID NO: 95963 - DNA, 761 bp, Homo sapiens
  chr6:87861548-87862309
  hyper
agactccagcatccccggggtgggtttccggaggccccgctccccgccgcgccctggaaaggctccagaatctctcggcctggaggcccctggcggcctctgctcccaagcggggagtcgcagccaggctacagcgggcttgatcctcagtgctgggtggaaaaaccgcggcggcaaacgccgggcctgcaactgctgggtgtcggcgttgctggttcgcgggcggcggcggcggcggctccgcgacaacagaggacgcgagcaaccggcgcagcgcccagcagggccttggcggggtggaggggcgcaggctgggttagcggagcagagcggaccgatctggtgccctccgtggcccgaggcctgcggaccttctccgttctccggcccagggcgagagcggggcaagagacagcgccccgatagtggcgcacgctctccgccatccccgggcctcgcgctttcacctcgcgtgctggggcgagggcggggctgcggggtgtactgggtcgggggtaggaaggacctgccaggccttagccctgagctatccgtcatccgctaacgccgcgctccctgcatccctggcttggcccccaggctctgcgccgcttgtctgtagcagacacaactcagctcccttactgtcctcaggcccggctatttcaagaattccagaaaaagagtgcaccggcgtgtgcgggccggtgctgcccggaaaacccgtgaagcaggcacgcacggcccggatgcaagcacat

SEQ ID NO: 95964 - DNA, 186 bp, Homo sapiens
  chr6:88875382-88875568
  hyper
cagctaagtaaacaccgacgcacgattcgctcacacggaataagaactccacgaaggacacttggggaccacactggtcgtacccgagggggcgggaggcggaaaaagtatttccaaacgcaactctgccaggtcttacccttcgcatcccctggtcctcgggacagaagctcccttggcacctct

SEQ ID NO: 95965 - DNA, 617 bp, Homo sapiens
  chr6:88875621-88876238
  hyper
cggagagctctgcagggagccgaggcccccgcccgggccaagggaaggcgctggcgccgcgggagacaagaagaggcggaggcggaaaagaagtggagaaggaaggggtggcagagggagtagcgtgcgggaggcggcgccggcgccgggctgctggcgaggcggggtggggtggagtggggtgtgcctccggcgggcggtcagcaagtcagtccgtccgagcgccggcgtcccggtctccagcgcccgcccgcgacagcgaccgggactggcgccccgctgctccgaccgccggcgagcctcgccccttcccaggctcttcactgggtcctcccgcgagccccgcctggcccggcgtggggccgcccgtctccgccagcccgggcgcccgtcgcctcgtcccgctcgcgcagtccctgccgctccctccgctcgcgctgtctctggctccctctcgctccagtcccatttatgaagcgcggtcccatcacgtgttaatgagcctttgtcctgccctggcagcggcggcggcacagaccccgccgagggaactgcgcggggagggacctgagcgcagcgcccgtagccccaaactttgcttggggcgggggacccgc

SEQ ID NO: 95966 - DNA, 193 bp, Homo sapiens; identical to SEQ ID NO: 30635
  chr6:88876284-88876477
  hyper

SEQ ID NO: 95967 - DNA, 111 bp, Homo sapiens; identical to SEQ ID NO: 2853
  chr6:88876630-88876741
  hyper

SEQ ID NO: 95968 - DNA, 322 bp, Homo sapiens; identical to SEQ ID NO: 2854
  chr6:88876742-88877064
  hyper

SEQ ID NO: 95969 - DNA, 357 bp, Homo sapiens; identical to SEQ ID NO: 30638
  chr6:88877065-88877422
  hyper

SEQ ID NO: 95970 - DNA, 67 bp, Homo sapiens
  chr6:88877474-88877541
  hyper
cgtactatatctggaccctatatttgaactacgtggtgagaatctgtgaaagcgagcctctcaggga

SEQ ID NO: 95971 - DNA, 37 bp, Homo sapiens
  chr6:88982725-88982762
  hypo
taaaagattctcagccgggctcggtgtctcacgcctg

SEQ ID NO: 95972 - DNA, 49 bp, Homo sapiens
  chr6:89792319-89792368
  hyper
ggtcctctttcgtgtcgtgtcttgcttactaccgcgttacaagtgttgg

SEQ ID NO: 95973 - DNA, 48 bp, Homo sapiens
  chr6:89827453-89827501
  hyper
gcctccgccgggcctcggccgtgctccgcggcgcggctgttaccccgc

SEQ ID NO: 95974 - DNA, 48 bp, Homo sapiens
  chr6:89827745-89827793
  hyper
agccgcagaggccggcgcagagggggcgcagcgcggcgccagcctgga

SEQ ID NO: 95975 - DNA, 120 bp, Homo sapiens
  chr6:89849217-89849337
  hypo
ccacccttatgaccttatttcactttaattacctccctaaagtcctgctcccaaatacagtcacactggaggttagcacttggacctgtagttccagctactctggatgctgaggtggag

SEQ ID NO: 95976 - DNA, 20 bp, Homo sapiens
  chr6:89849397-89849417
  hypo
gcccgcgtggcagagcaaga

SEQ ID NO: 95977 - DNA, 85 bp, Homo sapiens
  chr6:89857318-89857403
  hypo
cagcgagagacatatcgtatttaatgagttaagggtcaagaatgaagagcggtgggcagatcagttgaggtctggagttcgagac

SEQ ID NO: 95978 - DNA, 120 bp, Homo sapiens
  chr6:89857583-89857703
  hypo
cctgggcaacagagcgaggcctcctcttaaaaaaaaaaagagcggcggcttcatgtcagagtttgagcactgtagaaccgccaaaaaaaagctaaactttgagaaatgtacactcttttt

SEQ ID NO: 95979 - DNA, 417 bp, Homo sapiens
  chr6:90120876-90121293
  hyper
ccgcgcgctcactcccgggcaggcactgccatgtccaggtggtgataccgagagcagataaggtgtcctgacaacggtgtttgcgtggatcccgggaaatctgcggcctctcggagactcccacaacagcttggcgagcatccccccgccgccccgcgggtctccccagccactacctgggtgggcccctcccgcggcgacgcggggcgagactgacacccgcagctgccgacgaccctgccagtcacgccgccgccggctgcctttttttagccacgacatctgaccctggcttcaacagcaccgttctgggagagaggtcccagggcgcgcccgcggtcccctcccctccccaaccgccagacgctgcggagagcttggggtgaggggcgcgggaggcaccggctctgaaagggg

SEQ ID NO: 95980 - DNA, 87 bp, Homo sapiens
  chr6:90121597-90121684
  hyper
cggaggagtcgggcccgtctccgtagtccgctagccccaccagctcatcctcctcctcctcctcctccgcgtcgtcctcgtcctgcg

SEQ ID NO: 95981 - DNA, 30 bp, Homo sapiens
  chr6:90122393-90122423
  hyper
agctagggtcccaagcgggtggcctcccaa

SEQ ID NO: 95982 - DNA, 826 bp, Homo sapiens
  chr6:90142902-90143728
  hyper
cggccacaggtaacccgcaggagccgagagcgctgcctggcgcgcgggcggctggaggcacggcgctgggcggcgccgaggccctggggccgccggagccagcgggagccagtccccgtcttcgcccctcgccccccaccgtgtcgccggccttggtccctgcggcgcggacgtccggcgcgggagagaaaggtaccaggcgacctcgccggctccctgggacccccgcttacaccggggtgggcgcctcaggtcggggaggacgctgtcgggggaagggggcgctgctccctcggcaccccaggatcgccgactgcccgcggaggagacccggacaccgcgcctcgccccctggcctgcggcctccgaaaacgcccggcgcgagggggtccccccggggcgcctccctcttcgcctggcatcagttgcctccctggaatatggaacttcgggcgagggaggtggagaactttcttctggggctcgtccctcgttctcctgctcgcttgcagtttgaaggaagggcggtgggggcgggggtccgagtaccccgcggtctgcggcgcgtaggagggtaggtccctggcctgcggccgcctccgaatgaccccgtccctccccgccctggacgacagcactagggtgcagtcgcaggagaggggccgatacccctcaggagccccatcggcgaagcctcagcaagtggcatctcccggggtccagagagtcggcgtgctgtctggtttgggtccagacatcagctcacccaagcttatcttgggcttttaagtgtgttgcttccggtagatctcggggactggagggg

SEQ ID NO: 95983 - DNA, 30 bp, Homo sapiens
  chr6:90349357-90349387
  hypo
gggacttgcttgcctcgcctgttagcatcc

SEQ ID NO: 95984 - DNA, 239 bp, Homo sapiens
  chr6:90367251-90367490
  hypo
ggaaaagcaaaacaccgttaaaggtatacattgcctgaagtctaaattccatgtttccttcctggagagctttctgaaaaacaacacgaacctgattctcccatctagagctaccagtctaacaactttttcttattatgcacaccacttaaatacagccgatattccggggtttgtcctgggaggcatataaaaataagtagcagtcatgtaccacacaacaacgtttcagtcaagga

SEQ ID NO: 95985 - DNA, 30 bp, Homo sapiens
  chr6:90596072-90596102
  hypo
gcagagaatctttaacgtggacctgtacga

SEQ ID NO: 95986 - DNA, 94 bp, Homo sapiens
  chr6:90644578-90644672
  hypo
caaggaacaggtctccgacacgggagctgcatgtgccgtaacatgaatgcaatctggcaggcggcgtgggcatgtgtgtcggaaagagagattt

SEQ ID NO: 95987 - DNA, 185 bp, Homo sapiens; identical to SEQ ID NO: 40861
  chr6:90661223-90661408
  hypo

SEQ ID NO: 95988 - DNA, 30 bp, Homo sapiens
  chr6:90995490-90995520
  hyper
gggcagtttacagtgcggccagctgagtgc

SEQ ID NO: 95989 - DNA, 418 bp, Homo sapiens
  chr6:91004761-91005179
  hyper
tgcagcactagacagcgaaggtgaaaaccaggaacgccgcgtctcgccgcccgcgggcccgccgggagactgcgggtccgtctcgcgggtggggcgccccggtccctctcgtttcctggaggccacaggtcacggcgacggcggtgaccgggagagcaggctgcgaggcgcgcctcatcgggccacagacaaaccaccccggcagcggccgcgccggaacttccctcaagttaccaaactcgcctacgcgcgggagagtgctggggatgccccatgcgcccgcgaccccagaagccaggagtgtgccaccccttcacacactcactcccggccctgcacgcttcccctcacggtccgagttcctgcaaatgcttggccagaccgaggtcgccgagatgctcgctccagtctctcccct

SEQ ID NO: 95990 - DNA, 423 bp, Homo sapiens
  chr6:91005208-91005631
  hyper
cgcccgccgccgtctccagcggcgccgggctcccgaacacccgccgggtgagcgaagcacagcggggccacggagcgcctcgacgcggggacggggagggcagtgtccccttcataaaccagtctcctgggtgaagcttctggggcttggagactggagtgtagggtgtgtgtgtgtgtgtgtgtgtgtgtgtgttgcaccttgacttcatggaggatctgtgggagaggaggtgcaaggtttccctctcagaagcctggcgcccttaggtcttagctacgcgggacgctttccgacaacccgatctttcgctaggagagattcgatccaggtctgcgccgcgaggcccccagctcgcctcttcctgcgaccctaaacttgggctttgattccccgccggtcgcggtggtccgggccacccgg

SEQ ID NO: 95991 - DNA, 42 bp, Homo sapiens
  chr6:91005660-91005702
  hyper
cgcggccaaggtcctcgcggagcagcccgggatgcgcacgcc

SEQ ID NO: 95992 - DNA, 1010 bp, Homo sapiens; identical to SEQ ID NO: 30644
  chr6:91320285-91321295
  hyper

SEQ ID NO: 95993 - DNA, 166 bp, Homo sapiens
  chr6:94126125-94126291
  hyper
gtgaaataaacattgcgagattactgtttattgccattctgctacccctcagctcagcctgggggtggaagcaagggacctaagcagacagcagtgatggccaagttaagagagaaacaaactaacaaattaaaacaaaacagaacccggcccgagaacgtttaat

SEQ ID NO: 95994 - DNA, 247 bp, Homo sapiens; identical to SEQ ID NO: 30645
  chr6:94126366-94126613
  hyper

SEQ ID NO: 95995 - DNA, 424 bp, Homo sapiens; identical to SEQ ID NO: 30646
  chr6:94126642-94127066
  hyper

SEQ ID NO: 95996 - DNA, 46 bp, Homo sapiens; identical to SEQ ID NO: 30647
  chr6:94127085-94127131
  hyper

SEQ ID NO: 95997 - DNA, 580 bp, Homo sapiens
  chr6:94127417-94127997
  hyper
gtttctgatcgctaacgtcaggggagtagaaatgtggttttggaggggatgagcgtgcgtttctagcagatgtccgtccttctgcaaacgcgtaaccgccagcttggaggcacggggttctctgaatgggttcagcatctatacaggttgcagatgtggaaagtggggtcagaaggtcaggctgaaagaaggactagaatttggcgccgggtttgaggggggcttgagcgaactaagaggagtgcacgatgagaataaagaaaaggtgcactaagttttcagaaatagatgaatcaaggacctatatgtaagtcccctcaacaccccgcccgataaccaccatgacctaaatttcataacagattcctctccctctacacatcaggaataagtaattatttctcttctgcttttaacagatcgaaaaatgaaacttagatacacagcctgaaagaccaggggggcgacgggatgaggggggttggggatgggattgtgacactgctcaaaagcaagagacttccattgacagggtttatttttccccagctccaactacaggcaccgaaaggtattttac

SEQ ID NO: 95998 - DNA, 477 bp, Homo sapiens
  chr6:94128430-94128907
  hyper
acttcattagtaacccgagctttccgagctcatcgaagtctcggtccctctgggaaggctccgggctcccgccactcgccggcgggctggcggagacggtaggggctgcatttcccagtctccaacccaactctggccgcagctcccacagaaggcgaataaggagacaaggaagaccgagctagagagagatgtgacccgcctgaggtactaagaaataagctcgccggcagttcctccaaccccaccccacccccgttgctgctcacgccctccagactgcccgcgccagaaatcccgcacccgtcggatggacggctccgggcacagggctgtaggcggctcggaacagccctggttcgcgctcgctggtccgccaggagcggcctcagcggtgagggggcggggagccggcgggggagggtcgcccggcgccggaggcgcggccggcagcgccgcggacgagctggcttgtgc

SEQ ID NO: 95999 - DNA, 460 bp, Homo sapiens
  chr6:94129167-94129627
  hyper
ccccttctcggtccccgatcggctgctccacgtttagctttttttaatttcccccccactcctgttcgctcgcaccgtgtttgctgcctgcaagtctccgactgcagaccggccgcttgctccacactccaataatatcaattagggggggagggggcggggctccgagctgagagcctccgccactcgggctgagtggcaggcacagccggcctgccaggaggcgattcccagggccaaggggcgggtcccggcgaaatggccgccccggccacgggggcggggtccgaggcaggagccaatcggtgccgagcggagtcaggttgctggtccaggattccctccaggttctgagctcgcgctggatgttcagaggagaacgaggatggtagccgaggtgtgtgctgctttggacgctctgcttttagcaaccgcagctttcgcgtagcagaataaatcc

SEQ ID NO: 96000 - DNA, 256 bp, Homo sapiens
  chr6:94129628-94129884
  hyper
agaataacgctcccaacttacactcttttctatagctgtactccgcgcgatcttttagaaaccagaggcgaagcaagccttctctcagctaccaagcacggagcccggacagtgaaatgagctgtgcctttaagtaaagtgtgttttacttttttgttgttagaacctccgcgggctgggtaactttgttttttgcctttttgaaaagtttctacttctctttttctgttactccaagagccgtcagttttaggta

SEQ ID NO: 96001 - DNA, 691 bp, Homo sapiens
  chr6:96463169-96463860
  hyper
gctggtcaaccccggcggtaaacaaccaaggccacccctgcccaggcaacagctccaaggggcaggcgatggttgccggcattgagctccctgctggcgccttctggcgggacagccagtgccaaagagcgcccagggaaacaaacaccaatgggggactatacagatgtcatggatgcacatgtaggatcataatctgcccagaaagaggagagaaggagggcgacaggctgcggatcctggtccaggagccgccgcaatggagcgggcggcagtgtgcgcgcacaggtgccacaggccggtggcggggagagctgtagaggctgcctcccggactcagcactcgcaccagcgcgctgaagccgcggctgctgccaagcttgggtaacccccagcctgagccacgagaggaagagcccaaggaaagggcgcgaagggggaaggagggtagggtagaaggagggcgggggagagacccatcgcctcatcttacatttcccctcccaagctcatttagtgggaacctctgctgggctcctgcgcgcctccctccccaccccctcaactctgggcgaccatctccccctcttcccttgctcaccccccacccttcctgctcttccgtccctccctaccgcgtgcctcctcccctccccctcgcctccctcccctccagcggcagtagctgtag

SEQ ID NO: 96002 - DNA, 122 bp, Homo sapiens; identical to SEQ ID NO: 30653
  chr6:96464082-96464204
  hyper

SEQ ID NO: 96003 - DNA, 38 bp, Homo sapiens
  chr6:96464457-96464495
  hyper
ctgccacccttcacccgatctcgcgctgacaaagcctt

SEQ ID NO: 96004 - DNA, 38 bp, Homo sapiens
  chr6:97285806-97285844
  hyper
agggtcctggtttcccgctcccacgggcccccagagtg

SEQ ID NO: 96005 - DNA, 24 bp, Homo sapiens
  chr6:97299307-97299331
  hypo
gtgagactccgtctcaaaaaaaaa

SEQ ID NO: 96006 - DNA, 30 bp, Homo sapiens
  chr6:99164434-99164464
  hyper
tgagtgcatcaaggccgtgtcaaccccttg

SEQ ID NO: 96007 - DNA, 1176 bp, Homo sapiens
  chr6:99271691-99272867
  hyper
ggaaaccatccaagacgcggtttaagaaaacaggaagaataaacacccacggtgcaaacttctgatcaatcattttaccaaacttcaaccacgactagagaatatgtaagaagtgtgtcctggggcttataataatgccactagccacagtatgttttcaggagcgcccaagaacattattcattgtaaatttctatgtaaattatccaggggcaggggcattgctttggtccgcccaagagtcagatggcgcgggttccctccctgtgagtttcgacagtgcatcatcttacggaagaggctaaactagtattgattttccactttctaaaaggagtaaccatttggagcaaaggcaagctctcagggacgcgggggttgatagggggcaggtctgcgaaaaagagaaacacttcaaacagcgctgcggagagtgggggatggagctgtggggagcgagcggaggcttctctctgcccaagtagtggggctgcaaagttcctgccacaacggctgagacgttctgattctgtggacctgccaggagaggcgtttcccttgccaaaatagagccttcttaggagaggtttatgtattgttcgggaaggcaggagtatcttctagtcgttttcactctcctccacctttattaccctgaatccttaggccctcccctcggaaccccttcaaagtggagagggagcgtgggagggagagagcgcgcgccaagtttcaaatgtcgccagtctttccagaagcccctggctctcgcaggactgggtgcaggcgcctctccgggcctcggagccccgccccgcctccccatccccacaatcccaaggctccaggctctgcagggaaccgcggcgggaattttccagcctcaaatacggggcggactaattttcaggtccactccaacccagagatcggattccacttgatcttggagttcgcgaagtaactgccaagtcagagcgtgcgttccgcagtgcgcggtggctgcgcggcgctggctcttgctgtggggcagacagcagaggaccaggggcgagtcggcagcgggaggagccgcctggccaggagcctcggacagtgtctccccgtcccgaaccccttcccgccacctcctccaccccccgccccgcattccccccggggcgaccctccctccac

SEQ ID NO: 96008 - DNA, 30 bp, Homo sapiens
  chr6:99273084-99273114
  hyper
tgacttagaatctcccgctttgaggtttta

SEQ ID NO: 96009 - DNA, 280 bp, Homo sapiens
  chr6:99273322-99273602
  hyper
tttagcagctttcttcggagcccgggtaccccaagtggcaacttaggaactgggagaaggaacgtgccaccaccgaccacctatcctggtgggaggaggtactgctcccccctactcctcccttttccctgctccctctccatcagcaacaggttgtcaagttgaggagacatcccctccaaactctctcactccccacttgtggccgaggcctgccctgtgttcatcccagacagtcaggcagacgctgagctgtccgcgtcggcgtgggcgcctgtgg

SEQ ID NO: 96010 - DNA, 53 bp, Homo sapiens; identical to SEQ ID NO: 30658
  chr6:99273848-99273901
  hyper

SEQ ID NO: 96011 - DNA, 93 bp, Homo sapiens
  chr6:99275537-99275630
  hyper
tgcttggccattccccgcggggccggccccccttcccttgctcagtgcccaggtcctccgggcccttctcctcgagcccgcagtcggctctca

SEQ ID NO: 96012 - DNA, 167 bp, Homo sapiens
  chr6:99275841-99276008
  hyper
caggacctgcctaggcgctcttcgaccacggaacatccctccccgccacccccacctccatcctttccatagcagtctctccccgggtcagtccagggcgctgggaagccttagctctcgctttctacccccactgatccccccacgcgggccgaggctaggacaca

SEQ ID NO: 96013 - DNA, 50 bp, Homo sapiens
  chr6:99276380-99276430
  hyper
tttaatgctgggacccggctgccctagattaccatcgaaaactctcagaa

SEQ ID NO: 96014 - DNA, 77 bp, Homo sapiens
  chr6:99276704-99276781
  hyper
acctgctcccctccccgcccacccccccatccccccccaaccgccgtcctcccggacactaacgacacaattgttaa

SEQ ID NO: 96015 - DNA, 21 bp, Homo sapiens
  chr6:99277180-99277201
  hyper
tagggggagaaaatgcgagcg

SEQ ID NO: 96016 - DNA, 141 bp, Homo sapiens; identical to SEQ ID NO: 30662
  chr6:99277261-99277402
  hyper

SEQ ID NO: 96017 - DNA, 201 bp, Homo sapiens; identical to SEQ ID NO: 30663
  chr6:99278897-99279098
  hyper

SEQ ID NO: 96018 - DNA, 445 bp, Homo sapiens; identical to SEQ ID NO: 30664
  chr6:99279350-99279795
  hyper

SEQ ID NO: 96019 - DNA, 1241 bp, Homo sapiens
  chr6:99279796-99281037
  hyper
gggatggaagttggagttgagacctgggaagtcaacgtgggaaggatctcagcattaatcgccggtgatgtcctatcgcagacaggaagttttgatgtacacgtgcagcctattcttgtcccctcacactagcgccctatgccgggaggagggcgggggtgtggggtggggtgtggagagaaagataagaggaggaggaacttttaaattgattcagagccaggccgcctcagttccttcgaagatgtgtttgaaaacttcattcttctttcgagtgtatcatcctatgggctgcagaaggccttgtgcctcgagaaatgtgaaattaaatccagagaaaagcagacacctgccccagaaaggtgggggagaagtatgagctgcttagcacttggacgcggcccttccccagggctggattcttctgtccgtgggagctctgagctccaggtccgcgaaaagaaaggcacgacatgtcaggagaagatgcggctggcgggctgtctgtgcgctccccaaggcccagggaaagtcacgcgcctagcacaggggacgcagggccgaagccgggagaaggcggttctgcccgccacccagccccttggctcgcggttgcggagccgcgggcaccagtcgctgagtctgcgcgctgaggctcggacttgttcattttttcctagctagacaaagttatgggattcctagcagcccccaggcgcgcggccagagtggccccgcgcttgcgctgggacggagcgacacgctgtgtgtgtcctcgcctcgcctcgccgcgcgggtgcgcgcgtggtgggggtgcaggtccgtcctgctggcggcctgtgggctcgcccctcccctatccatttctctcccccacacacgctcataaacacaggacacgtggaaattctcagccaaagcgtcttgcccgggcgggtgctcaacgtggtgatttataaacagctcagccactctccaaagagcatgactccttgttagtcatgatgaattttctggcccgctccagtctgctgtctggattcagatgctcagaggccccaaaatgctccctctgagcgttgatttggctgccctctcaagcctacgaccgccggcaaaaccagcgatagagcgaggggtgagaggtggggacgcgatccaggttccctggggtctgtcattcccttcccggcagtaactgttgattcgctttacagcgcccatgtacacacccggccctg

SEQ ID NO: 96020 - DNA, 425 bp, Homo sapiens
  chr6:99281067-99281492
  hyper
cgcgcccaagttctagctaccgggcttgcaggctcggaaactcgcaggcggcacctgctctgggcggctaaagaactgatggcgcgacgcgcccgcgctccgtagagcggcgctgcgggtgcatggtcccatagtcttgctctggagttcactgctgaaagctgagctgggagcttggccagggagcgccaaagacatagactaaccccacccgctagcgcccaccgaagttactgattaggaaggttcccctggcatcagcccatttgcttcacacactcttcctccttcccaaggggctaacggaaaagttgcacctaccagcggtaggagcacggggaatcgcgcacgcaggccctccgcgcggcttcccggagcggcctttggcgactgcgccgcccctacaaggccgcacacccctcgcc

SEQ ID NO: 96021 - DNA, 207 bp, Homo sapiens
  chr6:99281846-99282053
  hyper
cactgaaattctaaccgtgggatgcaaggagagttgaacaggggaacaggtctggctcttggctctaggtttaagagatacacactgtgtgtgtgtccctaggtgaataaaaatccgactcccgctggctcggtgcgacccagcttttcccttaccccctccgtttccccatcttaaagccctattgggaaacgaaagtggacacca

SEQ ID NO: 96022 - DNA, 41 bp, Homo sapiens
  chr6:99282531-99282572
  hyper
gaaagagagcgagggcgggcgggaggcggcggcggcggcag

SEQ ID NO: 96023 - DNA, 302 bp, Homo sapiens
  chr6:99282778-99283080
  hyper
cctgctcacctccagcgcctccatcgtgcacgccgagccgcccggcggcatgcagcagggcgcggggggctaccgcgaagcgcagagcctggtgcagggcgactacggcgctctgcagagcaacggacacccgctcagccacgctcaccagtggatcaccgcgctgtcccacggcggcggcggcgggggcggtggcggcggcggggggggcgggggcggcggcgggggcggcggcgacggctccccgtggtccaccagccccctgggccagccggacatcaagccctcggtggtggtgcagc

SEQ ID NO: 96024 - DNA, 702 bp, Homo sapiens
  chr6:99283339-99284041
  hyper
gaacggcatgctgggcgccggcgggcagccggccggtctgcaccaccacggcctgcgggacgcgcacgacgagccacaccatgccgaccaccacccgcacccgcactcgcacccacaccagcagccgccgcccccgccgcccccgcagggtccgcctggccacccaggcgcgcaccacgacccgcactcggacgaggacacgccgacctcggacgacctggagcagttcgccaagcagttcaagcagcggcggatcaaactgggatttacccaagcggacgtggggctggctctgggcaccctgtatggcaacgtgttctcgcagaccaccatctgcaggtttgaggccctgcagctgagcttcaagaacatgtgcaagctgaagcctttgttgaacaagtggttggaggaggcggactcgtcctcgggcagccccacgagcatagacaagatcgcagcgcaagggcgcaagcggaaaaagcggacctccatcgaggtgagcgtcaagggggctctggagagccatttcctcaaatgccccaagccctcggcccaggagatcacctccctcgcggacagcttacagctggagaaggaggtggtgagagtttggttttgtaacaggagacagaaagagaaaaggatgacccctcccggagggactctgccgggcgccgaggatgtgtacggggggagtaggga

SEQ ID NO: 96025 - DNA, 30 bp, Homo sapiens; identical to SEQ ID NO: 30673
  chr6:99284652-99284682
  hyper

SEQ ID NO: 96026 - DNA, 193 bp, Homo sapiens
  chr6:99290280-99290473
  hyper
gggcgagtgtgctgccggccaacatctgctccttgcccagtcgcaaaagaggtaccttggccttgccgcgcaccccccacctcggggaccctggccgctgtcgcgaaggcccagacagcctagctcggccgcgcggggaggagagagacagggaaaggagcggggcactccctgcactcccagccccggcctt

SEQ ID NO: 96027 - DNA, 57 bp, Homo sapiens
  chr6:99291285-99291342
  hyper
accctctgggcaccccggcatctcaagccagagctgagggcccggaaagtgaggggc

SEQ ID NO: 96028 - DNA, 111 bp, Homo sapiens
  chr6:99291586-99291697
  hyper
cgcagaggcgggaagctggccggagaggagtgggaaggcgaccaagggcagcagcaggggctcctgcggggcgcaggtctgtgctggcgccgggcctggcctctgcaggct

SEQ ID NO: 96029 - DNA, 206 bp, Homo sapiens
  chr6:99291729-99291935
  hyper
cgcccgcggccactcacccggccccgcggccagcccgggcggggtcgcacgcaaacaaggatgcttctatttactcgcctctgcctgtagatttctaagacattcagcaggcacaatcattaaactaatttgtgtttgattgtttgggcggacggagggtagttttattgcgctaagcattcaagcaggcacgcatcgctgattac

SEQ ID NO: 96030 - DNA, 318 bp, Homo sapiens
  chr6:99292203-99292521
  hyper
tcggcttggaagaggcgtctgttatttattatttccctcccaccagcgtagcctggtctcccagcgccgtgcccgccgcccccgccccatcctgcgccccagatgcgcgccccgcttggaccagtccgagcagaggggggttccgaaatctgctcggacgcagcatcgctggccgcctgccccgctagttccccgagtgcgattactttttaaaggctcctttaagcatatttccgtgaatctgtttcttgtgctttaatgttactattaattgataagatcagctcatcaaacatactatttcgatagggaattgta

SEQ ID NO: 96031 - DNA, 30 bp, Homo sapiens
  chr6:99293257-99293287
  hyper
cggctgaggagtcctcgggggctgcagatg

SEQ ID NO: 96032 - DNA, 215 bp, Homo sapiens
  chr6:99295649-99295864
  hyper
tccacacacgcctcccgtctagagagccccagtggcccagggccacctccagtccctggacttggaaatcaggacgctgtggatcccacaggcgccccgcgacatcctggagtcgccgggagtggcgctgcggtgaaagccggtgcctagagtgggcttaggggtcccattccactcggaaagtcctctcacctccccaagggccattctgccgg

SEQ ID NO: 96033 - DNA, 304 bp, Homo sapiens; identical to SEQ ID NO: 575
  chr6:99296061-99296365
  hyper

SEQ ID NO: 96034 - DNA, 117 bp, Homo sapiens
  chr6:99296407-99296524
  hyper
cgcctggagggccctgacccttccggtgttccaccgcaatggggtcggggggagaggggggctgtggctgcctgagacctccagggcagcgcacattacgggcgggaaagggaagtc

SEQ ID NO: 96035 - DNA, 149 bp, Homo sapiens; identical to SEQ ID NO: 40863
  chr6:99396329-99396478
  hypo

SEQ ID NO: 96036 - DNA, 29 bp, Homo sapiens
  chr6:99396718-99396747
  hypo
tgagccaccgcgcccgcccttggcacttt

SEQ ID NO: 96037 - DNA, 30 bp, Homo sapiens
  chr6:99797154-99797184
  hyper
acccggcccaccagccgaagaaggagatgc

SEQ ID NO: 96038 - DNA, 30 bp, Homo sapiens
  chr6:99961087-99961117
  hypo
ccattttctccatgtcgggagaaagtctct

SEQ ID NO: 96039 - DNA, 30 bp, Homo sapiens
  chr7:100035094-100035124
  hypo
gcatgggcaacataccgagactccacacca

SEQ ID NO: 96040 - DNA, 19 bp, Homo sapiens
  chr7:100047876-100047895
  hypo
ctcccgaaatgtcaggatt

SEQ ID NO: 96041 - DNA, 191 bp, Homo sapiens
  chr7:100088128-100088319
  hypo
catcccagcagaggtcgaggacggtgcccgggcctggaatggcagtgccgagggtccaggcaaggtggagcgtgaggacaggggccctgggacatcggggatcccagtgagaagccagggggcagagggactgctggccaggatccaccatggagaccgaggagggagccgcaccgcgctgcccattccct

SEQ ID NO: 96042 - DNA, 54 bp, Homo sapiens; identical to SEQ ID NO: 31426
  chr7:100091127-100091181
  hyper

SEQ ID NO: 96043 - DNA, 95 bp, Homo sapiens
  chr7:100104078-100104173
  hypo
ggattataggtttgagcactcgtgtccagccagtgttacaacttttattgaagcttcagtgcacagccgcagcaaaggtacggctccttgcagag

SEQ ID NO: 96044 - DNA, 30 bp, Homo sapiens; identical to SEQ ID NO: 41394
  chr7:100118785-100118815
  hypo

SEQ ID NO: 96045 - DNA, 242 bp, Homo sapiens
  chr7:100167379-100167621
  hyper
actccagttcctgggcgacgtgaggattagtctcgtggggtgggggttccggagcggtcggcggagggagggaggtagtggggagcccaggccaggggcaacagtcaccgggacactcgctgtgcgcagagtccttgccccaaacttccagtcgggagcccgggagagacgctgggcatcaagacgggtggcagcctgcccggccgctgctcccggcccgccgagttcgccacctcaccccc

SEQ ID NO: 96046 - DNA, 194 bp, Homo sapiens
  chr7:100167860-100168054
  hyper
aagtttcgcgcgtgccgagcgcggctccagcgcagcctgagcctggcgggtgcgtgcaccaccagcaagtgcgcagatgcgcgccagcaccacctgatcgtcctctacacccgcgacagcagcctgcgcgtggcggcggcaggcgaggcggagcagcaggcgtgatacaacaccctgctcgaggagcgcggtga

SEQ ID NO: 96047 - DNA, 39 bp, Homo sapiens
  chr7:100170295-100170334
  hypo
aggtacaggggaacacgctgcccccggggcagcagaggg

SEQ ID NO: 96048 - DNA, 30 bp, Homo sapiens
  chr7:100173832-100173862
  hypo
tgcccacgcagctcccgcctctgctcacct

SEQ ID NO: 96049 - DNA, 266 bp, Homo sapiens
  chr7:100179674-100179940
  hypo
ggcttcccagggtgccgatgtcagggggcagggctcccagcttgttgttgctgacgatgaggaccctcaggggcagctggcagatgtagggtggcagcagcgacagctggtttcggctgtggaagggagaaaggcagcggactggctccccaggcatggcatcccagcactgccatcctctcggggtcactgggtgggtcactcagtagtacttgagactgagaagcacacgctcccacgtggccctggctcggcctccctacctg

SEQ ID NO: 96050 - DNA, 39 bp, Homo sapiens
  chr7:100207977-100208016
  hypo
atacagggcagggagcggtggctcacgcctgtaatccca

SEQ ID NO: 96051 - DNA, 132 bp, Homo sapiens
  chr7:100253710-100253842
  hyper
agggcaccctcccgacgggaaaggaaggggcccggggccaggtggaggtgggttgcaaggtagggccctgtgcgcgcggggcgtctggggaggaccgagcgcaggggtggcgggagacccgagcctgagact

SEQ ID NO: 96052 - DNA, 135 bp, Homo sapiens
  chr7:100253997-100254132
  hyper
cggcccgtgggcggtggcgggatcagcaccgaggcggccggacagctcccgggatccctggcggggcgggactctcagcggccaattgggaggccggatcccccgctccaacggcgccgccgattggctgccagg

SEQ ID NO: 96053 - DNA, 91 bp, Homo sapiens
  chr7:100254614-100254705
  hypo
cttactttttaaagcaggattggggagagaggtccagttcccagaagggttatctatcttcaggctgctctgagcccggttctgccacacc

SEQ ID NO: 96054 - DNA, 23 bp, Homo sapiens
  chr7:100269563-100269586
  hypo
ccccatctcgttctttcttatgg

SEQ ID NO: 96055 - DNA, 119 bp, Homo sapiens
  chr7:100279900-100280019
  hypo
tggagacccaggtcccgcccacctcctgggagccgctcgcccaccgtccaggctgcccgtggcgctcagcgtgtgcagcatctgctcgcaccactgggtgaagccgtcctggggcctgg

SEQ ID NO: 96056 - DNA, 120 bp, Homo sapiens
  chr7:100296125-100296245
  hypo
atgagccaccacgcccgccccgcccccacttttttttttttaatggcagattcctcttcagtgttttcctttgatgaaatgtaaggagagggctggatgcggtggctcacgcctgtaatc

SEQ ID NO: 96057 - DNA, 20 bp, Homo sapiens
  chr7:100318091-100318111
  hyper
ctttcccagatagcacgctc

SEQ ID NO: 96058 - DNA, 269 bp, Homo sapiens; identical to SEQ ID NO: 31430
  chr7:100318466-100318735
  hyper

SEQ ID NO: 96059 - DNA, 39 bp, Homo sapiens; identical to SEQ ID NO: 41397
  chr7:100391505-100391544
  hypo

SEQ ID NO: 96060 - DNA, 51 bp, Homo sapiens
  chr7:100425811-100425862
  hyper
gcgcgcactaagctgcgctagggagtagagaaaaatcgaggaaacaacggt

SEQ ID NO: 96061 - DNA, 112 bp, Homo sapiens
  chr7:100459369-100459481
  hypo
tctgcttcggctggacgtccggaaggatcacgtgaagttctggcggccccagctgctgctcctggtggggaacccccggggcgccctgcctctgctgcggttggccaaccag

SEQ ID NO: 96062 - DNA, 30 bp, Homo sapiens
  chr7:100485916-100485946
  hypo
catacccccatgccccgtatggtgctggtc

SEQ ID NO: 96063 - DNA, 456 bp, Homo sapiens
  chr7:100489889-100490345
  hypo
ctttgtgtgtcctcccgcccccgactcctgtcctccccagccttctctccctctgcactgctgaccctgtgcgggcaaagttggcccagtatcgcatcagtcgctgggcgaagattttctcctctgccgtgtagtttcgagaggggtccagggggatcccaaagatgaactcgatctcgtagccgtggggcacccccatccacaggggccaggagagcgtggaagcacggtgttcaaagacgtaggcgtagacccgggcaccctgggcagccagtcgcccagccagctgggccacggggcacacgacattgtggtcgcccaccacatcgctcagggcctccctcaggcgtgccgggtcctcgggatgcagccagtctgtgtaatgcaggaccacagcctcggctgccaggtcacttacctggggaaccccgacccgcaccccggccaggaactcgg

SEQ ID NO: 96064 - DNA, 353 bp, Homo sapiens
  chr7:100494408-100494761
  hyper
ccgaggggcctgacccgcgcagattgccccccgccccgccctccaggagttcacccgtgtggacagggctgctgcagcggggtccccacgaccgaggtgcatgcggcaataccgcgcggcgcctgcttcctggaggcggccggctcaggagcccccgagaccccgcgtgggagagcggccggcgcaggccagcgtcgggcgtgcgtgcgcgcgcgcggcggtgcggggcgcggcgtggggtgggcgcgtgcgcacacgctcgctctaaccgccgcgcgccccgcagcgccccgcagcgcctcgggcacgcgggcgccgccgccagggaccgcgggcaccgggttgcggggcct

SEQ ID NO: 96065 - DNA, 37 bp, Homo sapiens
  chr7:100495406-100495443
  hypo
aatgatggaaacaaactgtgaacgagtgctctgaggc

SEQ ID NO: 96066 - DNA, 19 bp, Homo sapiens
  chr7:100606618-100606637
  hypo
gccacggcacccggccggg

SEQ ID NO: 96067 - DNA, 72 bp, Homo sapiens
  chr7:100608819-100608891
  hyper
gtcgggcgtggacaacgccatcgactgtcaccagggccagtgcgttctagagacgagcggtcccgcgtgtcg

SEQ ID NO: 96068 - DNA, 59 bp, Homo sapiens
  chr7:100660623-100660682
  hyper
ggggggcttctgctccgctccctcctgttccggggtccagcgggcggctccccaggcag

SEQ ID NO: 96069 - DNA, 30 bp, Homo sapiens
  chr7:1006918-1006948
  hypo
ctggccaggtgagggcgatcactccgtttc

SEQ ID NO: 96070 - DNA, 77 bp, Homo sapiens
  chr7:100715916-100715993
  hypo
aaaggggctcaccaccgtaagcccagagctttccgtggccaaggcaggagaatcgttcaagcacaggagtttgagac

SEQ ID NO: 96071 - DNA, 17 bp, Homo sapiens
  chr7:100723832-100723849
  hypo
gtttgttttttgagacg

SEQ ID NO: 96072 - DNA, 124 bp, Homo sapiens
  chr7:100770176-100770300
  hyper
gaatgctcttacacacgtacacacacagagcagcacacacacacacacacacatgcctcagcaagtcccagagagggaggtgtcgagggggacccgctggctgttcagacggactcccagagcc

SEQ ID NO: 96073 - DNA, 145 bp, Homo sapiens; identical to SEQ ID NO: 41401
  chr7:100799106-100799251
  hypo

SEQ ID NO: 96074 - DNA, 30 bp, Homo sapiens
  chr7:100806035-100806065
  hyper
ctcgcacaaaccacccgccctcctgggctg

SEQ ID NO: 96075 - DNA, 665 bp, Homo sapiens
  chr7:100807394-100808059
  hyper
tttcgggaaggggcccgctgtcgggcatacgcgcctggaattgagagggggccgggggcggcaggggcgcgcgctccgggacacgcgcctggaactctccccaggaagcgcgccatacgcgctctggccccgggctctccagattcactcgggtcagcgtgtgcgtgcgggtttccgtctctgctgccgccgtctcctgctggcgcttggcgctacttggactgaaatctcgcagttcctggagcagggacgctagcgcctcgagctcctcggagggatcgctcgcctcgggcccattctccggagtctgagggcgaggcggagccgcgggctccgggctctccggcgccgggaggctgtgggtctggctgcgcacggtctcggtcagcagagcttcagctgcttcttcctccggcccctgctgggagccgcttggtgccgggggtgaggcgggacggtcgagtgcctgcagcagcaccgcggccagcgcccggggatccacgccctggaaaagctctccctcgtcctgcggctcggaattccgagcgcctcggacctctggggcgctgccatcctttggcccgggcactgcgtccccggctaccggctctttatgctcagagctgagaggaggaggctgcgcctcagggcgaccagggggtgct

SEQ ID NO: 96076 - DNA, 113 bp, Homo sapiens
  chr7:100808389-100808502
  hyper
ccatctcactgccatcgcccacgtactaagcagcagcaatatgggggaaaaaaaaatctctgctccctccccgtaggactccccggatggtgcgtgggcgacttcagcagcaa

SEQ ID NO: 96077 - DNA, 218 bp, Homo sapiens
  chr7:100809337-100809555
  hyper
taaagattcaagagccgaccagggggccgggttccccaccccgagaccacgcgcccaaggacggcgtgaacctgagtgcagagggacagatctgcacgcctgcgggcgctgtccgcgaatcggcagtgcgggtggcagccccctgacaggggcagatgggtggatcttgcggttttggtaatcccatcgggaagggtccgagtcggaagagaaaaggg

SEQ ID NO: 96078 - DNA, 30 bp, Homo sapiens
  chr7:100809815-100809845
  hyper
tccagctctctccaccgcttaaagggaagg

SEQ ID NO: 96079 - DNA, 48 bp, Homo sapiens
  chr7:100813879-100813927
  hyper
gcaaaaccagagctgcggaaagtggcgaagcggcggctgcccctaccc

SEQ ID NO: 96080 - DNA, 30 bp, Homo sapiens
  chr7:100814949-100814979
  hyper
gagttcttccacccacgagggggcagaagg

SEQ ID NO: 96081 - DNA, 278 bp, Homo sapiens
  chr7:100815652-100815930
  hyper
gcgcgcggctgtccacgcgccactccaggcccttggccgccagcaggcgcaggttgctttcgctaggccggtagggctgccagtcctggatgatggtcccgcctggaagcacgtcgcgctgcacggagggtgacagcaggaggcgtgccacgtcgccgcctgcctcggacacggcctcggtgggcagcggcgagaaggtgccagaggtccgcagcgccgccagccgcgcgcccagcccggccagcagcgcggacgcgttgaatcggaccaaaaggatg

SEQ ID NO: 96082 - DNA, 44 bp, Homo sapiens
  chr7:100816611-100816655
  hyper
gggggcccagctggtcgtcccgggtgagccgtgccaccttgacc

SEQ ID NO: 96083 - DNA, 87 bp, Homo sapiens
  chr7:100817650-100817737
  hyper
agcaggctctatttccgcagcctccagaggaaggctggggagaagctctcatcctcctcttcctaagatccacgcacccgcaggtgg

SEQ ID NO: 96084 - DNA, 69 bp, Homo sapiens
  chr7:100822573-100822642
  hyper
gacaggcagggaagccggaggaggcttcgacaccgaatcacagacatgacacctcgtgactctgggccc

SEQ ID NO: 96085 - DNA, 301 bp, Homo sapiens
  chr7:100823050-100823351
  hyper
gagcgatctgcttggcgggggttcccctgggcgccggaccctggggacaggtgggagcgacatggcaacagaggggggcgggggagcgcttctggacacctgaagcgcagcctctgactcagttttctgggtcttcggactgggaggggctgggcagaagggggcgcagccgcttggtccccctgaggggcggtggccttctgctgccccattctgcggtggaggagcacgctagccccctccccagtccccaggcccggccgcccccctacctcgccggagccggagctggagccagggc

SEQ ID NO: 96086 - DNA, 390 bp, Homo sapiens
  chr7:100823380-100823770
  hyper
cggcgggcgcagacacccccggtgccaagagagaggtccctttggagcccccaagagtcaaaggaggatgacgcgcggggactcggccgcgctgtcggagcccgactctaacgtcggtcagcgctggggcagcgccgcagctccgttggcgacgcgggccggggcgcccatcggttcaggggttcgggtggcacgcgtggctcccccggcgacgctccggcggcagcttcgaggggcggagaccccggcgacgcggaagaaacccgggacggatccggagcggactcgtgccctgctggcggggccgggggtcggggtgcgccctgggcagctgggtggcctcaagccctactggcgagactccgccctgtgtcccggctggggagtggg

SEQ ID NO: 96087 - DNA, 134 bp, Homo sapiens
  chr7:100845293-100845427
  hyper
ctccttggggataggcgggaacagagttcagggctggcgcggtggccaaaggccagtctgggtggccccaacccgggacggggagggagcgggccctgggccaggatcgcggggcggaggccggggctcaccta

SEQ ID NO: 96088 - DNA, 122 bp, Homo sapiens
  chr7:100845444-100845566
  hyper
cggaagggcagcgggaggccccggcggcccaggaacagctgcagggccacgcttagcagcggacgcagagcctcctgcgtcctctgcacccacgagctctgcgggttcgggaactgctggaa

SEQ ID NO: 96089 - DNA, 30 bp, Homo sapiens; identical to SEQ ID NO: 41402
  chr7:100858230-100858260
  hypo

SEQ ID NO: 96090 - DNA, 39 bp, Homo sapiens; identical to SEQ ID NO: 41403
  chr7:100894771-100894810
  hypo

SEQ ID NO: 96091 - DNA, 34 bp, Homo sapiens; identical to SEQ ID NO: 41404
  chr7:100897086-100897120
  hypo

SEQ ID NO: 96092 - DNA, 161 bp, Homo sapiens
  chr7:100912996-100913157
  hypo
agttttgtatttttatttttatttattgttttatgggggctacagcggcaggtggcaaggcgccacgcctgagtggggatggcgagattgttctccaatcgccaacctcaatggtgcaacgggagacggacatgggaaggctatgacgtcacgggccctgt

SEQ ID NO: 96093 - DNA, 358 bp, Homo sapiens
  chr7:100943169-100943527
  hyper
ccgcagtcccgctaccgacttccacagccccccgaccctcgcgggcctccagaatgggcagcggccgagagattccccagcggcgttgcaggagcccacgtggagcccacgggcttccctgccctgagcagctgcagctgcagcccccgccaccccgagagtccagccccgagggcagctcctgccttgcctgcggttaccgccgccgccagctgagggccaaggagggagaggggaggccaggcgctctcaggagtcccaaaggacaaataaccccgccgctgccgcgggacccagacgcgagccagctgctcgcccgccctgccccgcctgagctttccgccggcagcctggggcc

SEQ ID NO: 96094 - DNA, 122 bp, Homo sapiens
  chr7:100946544-100946666
  hyper
gactaataaccccaccgccaccgcgggactcagacgcgaaccaaccgcttgcctgctctaccccgcctgagctttcctggggaccagcccttccctgtccgtcctagccagcgaccgaaccc

SEQ ID NO: 96095 - DNA, 160 bp, Homo sapiens
  chr7:100951829-100951989
  hyper
gtgagtgagagaccccggggctatgcagttcccccagggacttccacagccccccgaccctcgcggacctccagaatagggggcagcgggcgagagattccccagcggcgttgcaggagcccacgtggagcccacgtggagcccacgggcttccttgccc

SEQ ID NO: 96096 - DNA, 30 bp, Homo sapiens; identical to SEQ ID NO: 41405
  chr7:100967105-100967135
  hypo

SEQ ID NO: 96097 - DNA, 647 bp, Homo sapiens
  chr7:101005996-101006643
  hyper
tccagggacctcctgcggagctcgcaccctagctctgccgccactgccgcctcctcggccccggaccgccgagggttaacaaaaaagccccacgccccctttgacggcttagagcccacctcgccgaatttgaaaaggcggccccggagaggcgtgggcgccccccacacatttccagctcgcacccgggctccgaccgctcgccccgctcctctcgctgtgctcccggccggtgccgcgggttcggtccgggcgccggtgcgctcctgccggtcctcgtgcccgggactccgggtccccgcgggctgctgcgcacgatgaagctggccctgctcctgccctgggcgtgttgctgcctctgcgggtcggcgctggccaccggcttcctctatcccttctcggccgcagctctgcagcagcacggctaccccgagcccggcgccggctcccctggcagcggctacgcgagccgccggtgagtagctcggggccgaggggccggggggtggggggagggagcggacagcgggggccctggccactgggtggctggagcgaggcttgggggctggagagcggggcgatccgggacttgggggcgcagggcagcggggactgggggctgcagacaccgggcagctggaacg

SEQ ID NO: 96098 - DNA, 18 bp, Homo sapiens
  chr7:101056505-101056523
  hypo
aaagagacttgtggccgg

SEQ ID NO: 96099 - DNA, 24 bp, Homo sapiens
  chr7:101090772-101090796
  hypo
aacttcctccgttatgatttttgc

SEQ ID NO: 96100 - DNA, 41 bp, Homo sapiens
  chr7:101116625-101116666
  hypo
ggattacaggcgtgagccactgcgcccggcctgggttgcat

SEQ ID NO: 96101 - DNA, 87 bp, Homo sapiens; identical to SEQ ID NO: 41407
  chr7:101131936-101132023
  hypo

SEQ ID NO: 96102 - DNA, 38 bp, Homo sapiens
  chr7:101137675-101137713
  hypo
gggattacagatgtgagccactgcgcctggctgtctat

SEQ ID NO: 96103 - DNA, 30 bp, Homo sapiens
  chr7:101151473-101151503
  hypo
acagaatcccagctccgtcatgtaactgtt

SEQ ID NO: 96104 - DNA, 30 bp, Homo sapiens
  chr7:101178233-101178263
  hypo
tagtgctgtcacccacgccagccacgtcac

SEQ ID NO: 96105 - DNA, 230 bp, Homo sapiens
  chr7:101191125-101191355
  hypo
attcatttctctgtgcgtctcacaaacattcattgaacatctgccactacatgtgccagacagtgatctaggttcccggaactcctgaataatcaaaacaaacatcatcgagaaactctcattctggtggaggacaggaatatcatcataaattgtgacttcgacaggatctgagggagctacaagggagaagctggggcgtggcggggaggcgccgtcaaaacgtgaca

SEQ ID NO: 96106 - DNA, 30 bp, Homo sapiens
  chr7:101206277-101206307
  hypo
cacacaggcggttggcggtgaagctgagtt

SEQ ID NO: 96107 - DNA, 30 bp, Homo sapiens
  chr7:101207916-101207946
  hypo
gggcaactgtcctaccggaatggcagaaac

SEQ ID NO: 96108 - DNA, 333 bp, Homo sapiens
  chr7:101241831-101242164
  hypo
tatgatctcacctctcggaaactggcaagccgccggagggcctcgtcaaggctttgatgaccctgtgctgaggacgcaaatcctaggcctggccgacaccctgctccaaggaccaatgactgaggccagagagggtcccagatggagcctgggtaggggtgaaactgcacaggcggacgggcagagcgtccaccctggagaagagacccaggcccaaccaggccccagagcctgcacgagcacctggagtggcagggacagcccagccccctcctgccccacttcctgggaagcagcagcttgtgtgttctggtcggtcggctttggcaaagc

SEQ ID NO: 96109 - DNA, 30 bp, Homo sapiens
  chr7:101262039-101262069
  hypo
catgacaggctcagccggagccccagtccc

SEQ ID NO: 96110 - DNA, 30 bp, Homo sapiens
  chr7:101392564-101392594
  hypo
accgagacagcagttcgatttgaaacttga

SEQ ID NO: 96111 - DNA, 68 bp, Homo sapiens
  chr7:101475790-101475858
  hypo
caaacacaagtggggcgacaggacccacacttcggcgttggacgtgactcacgcggggagttggcttg

SEQ ID NO: 96112 - DNA, 30 bp, Homo sapiens
  chr7:101480043-101480073
  hypo
gaaaccgggagtgcccgttgtctgcctgga

SEQ ID NO: 96113 - DNA, 38 bp, Homo sapiens
  chr7:101521914-101521952
  hypo
aagagaaaaaaaagacgcaccagcggcttacaagatct

SEQ ID NO: 96114 - DNA, 149 bp, Homo sapiens
  chr7:101586167-101586316
  hypo
agatcttggttccatcggctgctgggagatcagttcccttctctgcacctccattcagcttggacgggaatctgtccttcctagaacagctgtgattaataactgagaccacacccatgttcgttgtggcttagcgccatgcacacagg

SEQ ID NO: 96115 - DNA, 30 bp, Homo sapiens
  chr7:101596278-101596308
  hypo
gcagagggaccccttcggagcatctcagag

SEQ ID NO: 96116 - DNA, 39 bp, Homo sapiens
  chr7:101603269-101603308
  hypo
acattggcacggttgcgtaagaatcgcacggtcccatga

SEQ ID NO: 96117 - DNA, 89 bp, Homo sapiens
  chr7:101627757-101627846
  hypo
gctcagattgttctccggcaaaaaaaaaaaaaaaaaaaagtgcttgcagtgagaacctgccctgcactctcaggcgagctgttgggtgc

SEQ ID NO: 96118 - DNA, 30 bp, Homo sapiens
  chr7:101628185-101628215
  hypo
ttcgttgttttaaaacgtctgagaattata

SEQ ID NO: 96119 - DNA, 120 bp, Homo sapiens
  chr7:101630456-101630576
  hypo
ttcactcccgcatcccgacacagtgcccagcacatcatcgatgaatgagtgtggggcaaatgcttgcacagaagtccgtgcgtgagccacgacggtaaacagaggcgctcctcttgtcct

SEQ ID NO: 96120 - DNA, 115 bp, Homo sapiens; identical to SEQ ID NO: 41412
  chr7:101652590-101652705
  hypo

SEQ ID NO: 96121 - DNA, 78 bp, Homo sapiens; identical to SEQ ID NO: 15018
  chr7:101656381-101656459
  hypo

SEQ ID NO: 96122 - DNA, 30 bp, Homo sapiens; identical to SEQ ID NO: 41414
  chr7:101707051-101707081
  hypo

SEQ ID NO: 96123 - DNA, 102 bp, Homo sapiens
  chr7:101707433-101707535
  hypo
aggccagtgtctaaccgtctctagatccgtcctggtttagcttcttccaaatagttttgtgtctgtgtgagagtgtgtgtgaaacggagttttgctgtgttg

SEQ ID NO: 96124 - DNA, 101 bp, Homo sapiens
  chr7:101707595-101707696
  hypo
ctgggattacaggcatgagcaacggtgccggctctaaatggttttaagggcacggtacctacctcaagctaacgtgcaggcaggcacgaggtagctggaat

SEQ ID NO: 96125 - DNA, 30 bp, Homo sapiens
  chr7:1019055-1019085
  hypo
gacaagggctaggatcgttgaccttatctt

SEQ ID NO: 96126 - DNA, 30 bp, Homo sapiens
  chr7:102091922-102091952
  hypo
agcccttacctgcctcgtgctgatgatcta

SEQ ID NO: 96127 - DNA, 97 bp, Homo sapiens; identical to SEQ ID NO: 41417
  chr7:102097002-102097099
  hypo

SEQ ID NO: 96128 - DNA, 29 bp, Homo sapiens
  chr7:102133076-102133105
  hypo
acaacctggtaaggtcggatcaacttcct

SEQ ID NO: 96129 - DNA, 212 bp, Homo sapiens
  chr7:1022042-1022254
  hypo
tgtgcaaagcaggcccggccgcttctgctgccagcagccctcccacccctcacagcggtttaggagacagatggacagggctcgtaaaccccgccacctgccacccggcagcccttccatgttcctgtcctagctcagagggttgcatcccctgcccgggcggcagccctcgaaaaggagcaggctgctacctggggcgagaacaccctcag

SEQ ID NO: 96130 - DNA, 29 bp, Homo sapiens
  chr7:102232246-102232275
  hypo
acaacctggtaaggtcggatcaacttcct

SEQ ID NO: 96131 - DNA, 79 bp, Homo sapiens
  chr7:1022888-1022967
  hypo
ctgggggctgctctgcgcctgcgcccaagacccctccccagctgcccggtggcccccggggcctcgcccgctgccgctc

SEQ ID NO: 96132 - DNA, 52 bp, Homo sapiens
  chr7:1023349-1023401
  hypo
agggcctgggcctgtcggctgcctgctcagcccccctcggccctcaggtgtt

SEQ ID NO: 96133 - DNA, 624 bp, Homo sapiens
  chr7:1026795-1027419
  hypo
ggacatggtcatggccgggacggagacgacctcggccacgctgcagtgggccgcacttctgatgggccggcacccggacgtgcagggtgagaccccggcgcctggcgagacggctccttctgcccccgggggacccccagggacgagggatggcgctgccacccaagcggcccaccctttgccccaggccgggtgcaggaggagctagaccgcgtgctgggccctgggcggactccccggctggaggaccagcaggctctgccctacacaagcgccgtgctccacgaggtgcagcggttcatcacgctcctgccgcacgtgccccgctgcaccgcggccgacacacagctgggcggcttcctgctccccaaggtggggctgggcctcccttgccccttccatctcctctggggtaggcctcggcgggggtccaggggcactgggacggctgagcgtctggtgggtgcctgatggcccagcgctccccgaccggaggcaataaagggcgtccagccaggagcaggagggaggcagccctctcaccccacagcccagcacttggcctggccagcagacctggcgcctccctgcatgtcctggggtcccctccgtgtgtcctgtggg

SEQ ID NO: 96134 - DNA, 41 bp, Homo sapiens
  chr7:102782018-102782059
  hypo
aggctgtgatacatgcggcgatcaatcttcttagattcacg

SEQ ID NO: 96135 - DNA, 40 bp, Homo sapiens
  chr7:102782119-102782159
  hypo
cattcgggcattggctgtacccttccgcttacctatgccc

SEQ ID NO: 96136 - DNA, 145 bp, Homo sapiens
  chr7:102921382-102921527
  hyper
ccgccggtggtgctccgggcattaggaacgtctctgctctcctacgatcgctgaggtatcggacagtcagtgcccgttgccaacacggagggaacgggccgagactgcgggcaacacgtggcagagccggcgtgagtctggtggg

SEQ ID NO: 96137 - DNA, 328 bp, Homo sapiens
  chr7:1030000-1030328
  hypo
gacagtggcgcgtgtgctgggggcggtgtgatgggacacctgctgtctgagacggccctggcccccgtcccagcgctgaccatgcacgtgagcggcaggcggcccctcaccgagaagagaggataagccgtggcacattcccacctgcgccacgtgaagcggcgccccaaggccaggacgtggtggccgggacacacgggtgcacggcaggcctcacactcccaggtggggccgcagggtccctaagtcatgggtggggctgctgctacggaggctgctgcaaggacgagaaggggacggagggatggaggctcggctgcgtccgctc

SEQ ID NO: 96138 - DNA, 903 bp, Homo sapiens
  chr7:103085831-103086734
  hyper
cactgccgcgagcttcgagagttcagcgtgtcagagcctctatgatggcagagcacctgccgcgatgcctgattggtagggagaaggatttcccgggagggggccaataccaaattttagggctgttaggctctgagcagtcccttcgtgaccggataagtcagagacccggggtttgagccttgcccggcgctgagcggagggcccagtttcgggaccacagccttgctccctgggagctccgggcggccaatgccgggcaagcccagcccggcacaggaggaggcagggcccgtctccggaaagagggccagaggcagaactgagggcctggttttgtgtaattcgatttggatacaaacaggccagacccaaactggaaacggcgaagggctggattagcaccgaagggattcgaggaggcaaacgggaagtaaaaatgctgtgtggagctgcagagggcaaggggacaggggttgcaaaggaaagagcttcgtgagactttctccttcccggcgtagggaccagcagagtgcgggcaggtcagccctgtcaccggttcgtttagggaaaaagcgcgacatggggcctgggagacaggggcagaggcggtgacagcgagggcccctgctcgggtgggcccgcgggcctcagctcagtcccctcccgagggaccgcgacccccggccccgcggccgcccgcgcgcactcaccagcccgggctgccctgggcggagccgccccgccgcgctccacagccgctgcctcttcgacgcgcgcgctgcctccaggtgcggctctaggaggaggcgccgcgggcagtgccggccgcgccccgcgactcccggtaacccgagcccgccccgccccgctagggccaggccccgccgccaccctccgcgc

SEQ ID NO: 96139 - DNA, 182 bp, Homo sapiens
  chr7:1031815-1031997
  hypo
gcccctgtacccccccgcctctaggtctccagggaaggaccctcctggggtgggcaggctgctcttggccccagatctgcttctgggtctgaggctggccctcagccgtgctgcacgtgcctcccattaccatcctaagtcaaggcaaaacaaaaccacacagtccccgagccatctgcaaa

SEQ ID NO: 96140 - DNA, 86 bp, Homo sapiens
  chr7:103395555-103395641
  hypo
tatggagatgaggaccgaagggatttttttgttgtttgttttgtttcttaagatattatgatagtggccgggcccggtggctcatg

SEQ ID NO: 96141 - DNA, 736 bp, Homo sapiens; identical to SEQ ID NO: 31445
  chr7:103629059-103629795
  hyper

SEQ ID NO: 96142 - DNA, 30 bp, Homo sapiens; identical to SEQ ID NO: 31446
  chr7:103630053-103630083
  hyper

SEQ ID NO: 96143 - DNA, 186 bp, Homo sapiens
  chr7:103630363-103630549
  hyper
cgctgagcccgcgactcttctgcgagggacgtcaaagccccgcagagggcacctcccgtccagctgtctgaaggggaaggccagcccctttggccgtcagtgtgccctgtttttcctgggaggatgcgtgagggaaggagaggggcggcagggacggccgctggcgccggtttctttgtctgagcc

SEQ ID NO: 96144 - DNA, 468 bp, Homo sapiens
  chr7:103630550-103631018
  hyper
gctgcgtcccgcgcccctcggggctcgcagtctgccagtccgggcggcccgcactcgttctgggaatccgcccgaggccgcgaaccgctaggggccctcgcgctcccttcccacccaggccccctgtccctcccgccgcggccgcccggcccctcgcggcagcgacagagcctcatctgtagaggattttaaaatgagattaagcgaaagtggaattggcagactcgagtggtgcctggaaatggtgatttgtgctgctcggttgtggggaattgtaaggcaggaagggctggcggagctaagatccgacaggctctcttcgccggactgttctgttattcattgcttctgggctcttcaggcagagatgggtgttgtaattttttaaatcagtgtttatttcctttaaatgtcggttatgaccaatggccctgaaatcgggggagggaaaaacgttcaggggagatg

SEQ ID NO: 96145 - DNA, 85 bp, Homo sapiens
  chr7:1037221-1037306
  hypo
ccctgcactgggcagcggccccgccccgcgctgaacccactaggagagcagctgcagcacctgtcggatgcgctgggccctcccc

SEQ ID NO: 96146 - DNA, 149 bp, Homo sapiens
  chr7:103968582-103968731
  hyper
caaagatgcagaggtcgaagcacgtttctgtgcggtgatgaaatgctcgctgaatcagcctctcgagcccggcctctcacacccaccaggatcctggggttgtctctaggatccctgtgggtgctcctgccaccttcttagactaccct

SEQ ID NO: 96147 - DNA, 251 bp, Homo sapiens; identical to SEQ ID NO: 3084
  chr7:103968915-103969166
  hyper

SEQ ID NO: 96148 - DNA, 355 bp, Homo sapiens; identical to SEQ ID NO: 3085
  chr7:103969167-103969522
  hyper

SEQ ID NO: 96149 - DNA, 117 bp, Homo sapiens
  chr7:103969562-103969679
  hyper
cggcctctccatgatgctcatcattgcctgcatcatttgctttaccctcttcttcttctgcaacacggccactgtgtacaagatatgtgcctggatgcagctcacctccggtgagtg

SEQ ID NO: 96150 - DNA, 434 bp, Homo sapiens
  chr7:103969693-103970127
  hyper
cggaggcggaggaccccggggcgcccgagccggggaggggccagagtgggagggacgggggctgtgcgcgccgctgcgagccaagccgcctaatccgctcaggcgtcgaggtgtggggggcgggagcccagcgaggccggaacccccggggttccccagccccggcgctggcgcctcgtcccggggctttcgtgagcctcccaagtgtgggggacgcccactcagagggacgccccggaggcagggcggttgtggggccgagtccgctcagaactaaggatggtgggtggagaagtggccgcttagagagatggggccggggttccgtgctgagggactaaggagggactgacagggcgaagtgaaaagcggatttggagaggtcatagtggaaggagcagccagcctgccctgcccctcgctgctgggactat

SEQ ID NO: 96151 - DNA, 42 bp, Homo sapiens
  chr7:104628051-104628093
  hypo
acaggcatgagccaccacgcctggccacggcctttattttaa

SEQ ID NO: 96152 - DNA, 30 bp, Homo sapiens
  chr7:105086390-105086420
  hypo
gtgagccaccgcgcccggcccaaagataaa

SEQ ID NO: 96153 - DNA, 79 bp, Homo sapiens
  chr7:105171453-105171532
  hypo
aacgccattgcaccccagcctgagcaaaaaaaaaacaaacacacatgtacactataaatatatacgattatgttcccat

SEQ ID NO: 96154 - DNA, 30 bp, Homo sapiens
  chr7:105220974-105221004
  hypo
gcagtggcgccatctcgtgcccggcctttt

SEQ ID NO: 96155 - DNA, 296 bp, Homo sapiens
  chr7:105279375-105279671
  hypo
gtgggaggctcgattcggcccagacaaacagagccaccaagcagagagggccatcgccttgatcccaagaagcactagcagttcagcatgaaatacagggctttgggcgacccaatggcggccgccttgggtcagctgttcccctggccaccccggtgtggctggatcaggggcgcggcatatcatcctcccctccagggctgcctttcagggcgctgccgccgccgccgccgccgctgccgctgctcctgcatacattaaaacgtagcaggctttagaaccgcctgtgagtgcct

SEQ ID NO: 96156 - DNA, 30 bp, Homo sapiens; identical to SEQ ID NO: 41420
  chr7:105280417-105280447
  hypo

SEQ ID NO: 96157 - DNA, 66 bp, Homo sapiens
  chr7:105288157-105288223
  hypo
ctcctctaaagtcaacgtcaggctctgaatgtgctccttaaggcagccccacgagcacaggtgcac

SEQ ID NO: 96158 - DNA, 30 bp, Homo sapiens
  chr7:105331896-105331926
  hyper
actcttatgcatccccgtttcttcaaaaaa

SEQ ID NO: 96159 - DNA, 30 bp, Homo sapiens
  chr7:105432522-105432552
  hypo
ctgcagagcccatcccgtctcccccacccc

SEQ ID NO: 96160 - DNA, 252 bp, Homo sapiens; identical to SEQ ID NO: 41054
  chr7:1054444-1054696
  hypo

SEQ ID NO: 96161 - DNA, 115 bp, Homo sapiens
  chr7:105649670-105649785
  hypo
cagccaccctatgaacgccaagatgtgaggaagggcaacgaaagggacccctcctctgcagttccaggggcggaggtcttcagcctaaagcccagcctcgcgtcccaaggctgca

SEQ ID NO: 96162 - DNA, 30 bp, Homo sapiens
  chr7:105753818-105753848
  hypo
cgtccttgtagtaagcgaaccctttctctt

SEQ ID NO: 96163 - DNA, 35 bp, Homo sapiens
  chr7:106123211-106123246
  hypo
gtctgctggagctgccgtagtaaaatgctacaggc

SEQ ID NO: 96164 - DNA, 95 bp, Homo sapiens
  chr7:106123306-106123401
  hypo
tcaaggtgctggtgaggcaggttttattctgagttctcttctcttagccagtaggcagctgcgacctcaccgtgtgctcacgtgaccttttcttt

SEQ ID NO: 96165 - DNA, 126 bp, Homo sapiens
  chr7:106507970-106508096
  hypo
atccctgtgtccctccgctcccaggtcgcatagggcatggagctggagaactataaacagcccgtggtgctgagagaggacaactgccgaaggcgccggaggatgaagccgcgcagtgctgcggcc

SEQ ID NO: 96166 - DNA, 290 bp, Homo sapiens; identical to SEQ ID NO: 41424
  chr7:106508656-106508946
  hypo

SEQ ID NO: 96167 - DNA, 405 bp, Homo sapiens
  chr7:1065987-1066392
  hypo
cgggaggcaagggttcgcacggcagtgcttctgtgtcgacagaggctgtgctgcagctccctgccaggcccgtgtccttcctagctgtgagaacactaacctgcctgggcttcacctgtggaagccaccgctaactagcagtcggaggcggcgttgtttctaagacaggcaggcagctccggcaggagcagccgctaagcacaaggacggccaaccacacaaagcctgcttctcaaccactcgcaggaaatcggctcacagttgctccccattcttcaatgctgatcctgccactttactgaaaatcacattattaacgtttaaaaaacgtatgggaaccatgcaaagacatccacgcccctcagttgctgccgctccagcacctggctccgaagtctgtgcaga

SEQ ID NO: 96168 - DNA, 39 bp, Homo sapiens
  chr7:106609350-106609389
  hypo
agttgaattgagggtcgggtgcatggctcacgcctgtaa

SEQ ID NO: 96169 - DNA, 22 bp, Homo sapiens
  chr7:106636238-106636260
  hypo
aaaaacccgtgtattttacttt

SEQ ID NO: 96170 - DNA, 30 bp, Homo sapiens
  chr7:106637063-106637093
  hypo
tgagggttagtacaacgctagtttgaatta

SEQ ID NO: 96171 - DNA, 30 bp, Homo sapiens
  chr7:106644946-106644976
  hypo
acagtagaaagaacacggattttgatatta

SEQ ID NO: 96172 - DNA, 79 bp, Homo sapiens
  chr7:106651422-106651501
  hypo
atagtggatcagttgcggtacacagacttcattatgaggtctaccatgagaaactttatattctgacttaaaaatgtcc

SEQ ID NO: 96173 - DNA, 18 bp, Homo sapiens
  chr7:106653764-106653782
  hypo
aaaggctggtcatggcgg

SEQ ID NO: 96174 - DNA, 88 bp, Homo sapiens
  chr7:106684832-106684920
  hyper
atgacgcctgggaagcggggcgagtggccagcccgctcctggacgcgcggacaggtggacacgaaggcggcctcgctgggcctccctc

SEQ ID NO: 96175 - DNA, 749 bp, Homo sapiens
  chr7:106685171-106685920
  hyper
ggagcagacgcgcgccgggagccgcgggccgggccagccgggccgccggggcccagtgcgccgcgctcgcagccggtagcgcgccagcgccgtaggcgctcgctcggcagccgcggggccctaggccgtgccggggagggggcgagggcggcgcccaggcgcctgccgccccggaggcaggatgagcatcgagatcccggcgggactgacggagctgctgcagggcttcacggtggaggtgctgaggcaccagcccgcggacctgctggagttcgcgctgcagcacttcacccgcctgcagcaggagaacgagcgcaaaggcaccgcgcgcttcggccatgagggcaggacctggggggacctgggcgccgctgccgggggcggcacccccagcaagggggtcaacttcgccgaggagcccatgcagtccgactccgaggacggggaggaggaggaggcggcgcccgcggacgcaggggcgttcaatggtgaggaccagaccccccacttcgcgcccccggatcccctcgctgccccccaccgctccccgctgtgctctcggatcttgccgctttgcgcacccacctctccccgcattctccacctttccctaccttcccatctcgcccaccccctcagcatccatttctgtctctcccactcgcccaccttcctactccgctctctgtcataccctcttcccttcctctagaggtgggagagctgggatgttacgcttccctcttacc

SEQ ID NO: 96176 - DNA, 103 bp, Homo sapiens
  chr7:106712145-106712248
  hypo
atttctacctcaaaccgtatgacatgtgacatttatttctgggcacgttccattagtatttgttgtacattatacgtatcattggctgggcgaggtggctcac

SEQ ID NO: 96177 - DNA, 16 bp, Homo sapiens
  chr7:106748394-106748410
  hypo
ccggccaagagatgtt

SEQ ID NO: 96178 - DNA, 20 bp, Homo sapiens
  chr7:106796956-106796976
  hypo
ctcttcatttagggccgggc

SEQ ID NO: 96179 - DNA, 20 bp, Homo sapiens
  chr7:106797276-106797296
  hypo
gaaaccgagacagcttgttc

SEQ ID NO: 96180 - DNA, 105 bp, Homo sapiens
  chr7:106797653-106797758
  hypo
tggtgcagtagaaatcgctcgatgctcgcggggacagtactttggagagcttgccctggtaactaacaaacctcgagcagcttctgcccacgccattgggactgt

SEQ ID NO: 96181 - DNA, 90 bp, Homo sapiens
  chr7:106802877-106802967
  hypo
acagagcgagactccgtccataaaacaaacaagcttaaaaattcttcaagtgaaacggcatgaagcaagagacttcggattttattgaaa

SEQ ID NO: 96182 - DNA, 178 bp, Homo sapiens
  chr7:106837489-106837667
  hypo
ccagagttgtcaaaacggtgaacttaagagctgtcctcagtagaagctggaaataaaaatcaactcaagtccttcctactctgttgcctgtacccttactcatctccgagtcctctactgctgaatccctctcaaaccagtcaagttctccatatattaataacgctgtcttcttcca

SEQ ID NO: 96183 - DNA, 30 bp, Homo sapiens
  chr7:107060805-107060835
  hypo
tattattcttttgatcgggatagggagaag

SEQ ID NO: 96184 - DNA, 100 bp, Homo sapiens
  chr7:107148303-107148403
  hypo
ataatgcttctatgacgtatttggttttaagaatattctctcatggggtgggtggagctaagatggctgaacaggaacagctcccagcgtgagcgacgca

SEQ ID NO: 96185 - DNA, 30 bp, Homo sapiens
  chr7:1071811-1071841
  hypo
ccagagaactgctcccggcccacggggctg

SEQ ID NO: 96186 - DNA, 1363 bp, Homo sapiens
  chr7:107300982-107302345
  hyper
ccacagggcctggcccgcccctgacctcgcaacccttgagattagtaacgggatgagtgaggatccgggtggcccctgcgtggcagccagtaagagtctcagccttcccggttcgggaaaggggaagaatgcaggaggggtaggatttctttcctgataggatcggttgggaaagaccgcagcctgtgtgtgtctttcccttcgaccaaggtgtctgttgctccgtaaataaaacgtcccactgccttctgagagcgctataaaggcagcggaagggtagtccgcggggcattccgggcggggcgcgagcagagacaggtgagttcgccctgaagatgcccacaccgcccggcccgggctccactcccggggaggcctcgagggttgcggatgggactcttaagtggtcacggatcaggtgggcagggggcagtacagctttctttctgagacgccgagagcgaacaggctgctcggaaaacaggacgaggggagagacttgctcaataagctgaaagttctgcccccgagagggctgcgacagctgctggaatgtgcctgcagcgtccgcctcttggggacccgcggagcgcgccctgacggttccacgcctggcccgggggtctgcacctctcctccagtgcgcacctggagctgcgtcccgggtcaggtgcggggagggagggaatctcagtgtccccttccagccttgcaagcgcctttggcccctgccccagcccctcggtttgggggagatttcagaacgcggacagcgccctggctgcgggccataggggactgggtggaactcgggaagcccccagagcaggggcttactcgcttcaagtttggggaaccccgggcagcgggtgcaggccacgagacccgaaggttctcaggtgcccccctgcaggctggccgtgcgcgccgtggggcgcttgtcgcgagcgccgagggctgcaggacgcggaccagactcgcggtgcaggggggcctggctgcagctaacaggtgatcccgttctttctgttcctcgctcttcccctccgatcgtcctcgcttaccgcgtgtcctccctcctcgctgtcctctggctcgcaggtcatggcagcgccaggcggcaggtcggagccgccgcagctccccgagtacagctgcagctacatggtgtcgcggccggtctacagcgagctcgctttccagcaacagcacgagcggcgcctgcaggagcgcaagacgctgcgggagagcctggccaagtgctgcaggtagcggccgcgcgggcctgcgtagagagaagcggagcggggcgtccacgccttggggagggaagggcgtccccagcgggcgagagtggggtgcg

SEQ ID NO: 96187 - DNA, 149 bp, Homo sapiens
  chr7:10730732-10730881
  hypo
tgaactgaaactctacgatgaaacattgtatttccatttaagtaagagcgttctgaagatctcatgatttcaatggaaagaaatggcttctgtgatgattacttcaaatatacataatacgattgtgtgcaaaacatttgggaggccgg

SEQ ID NO: 96188 - DNA, 224 bp, Homo sapiens
  chr7:107483694-107483918
  hypo
atttcagcagagacccgcaggtacaaggacaccacccaggcgaggagccagaaagagcagccgcagcaggtggagcgcatgggcagaggggcggtggtgggacacgcgactgtttgggattgagcgaggccacctaagcagattgcggtgagtgagcgcggaatgacgtcactgacctccaatcaactgtcacatgaaaataccaaaagcggcagtgttccttt

SEQ ID NO: 96189 - DNA, 89 bp, Homo sapiens
  chr7:107642639-107642728
  hyper
tgtgagcttgggaagcgagagtgcgtgtgcgtgcacgcgcgagggtcaccggcgcttcgctggggacgaggcgccggggctcgcggtgg

SEQ ID NO: 96190 - DNA, 113 bp, Homo sapiens
  chr7:107643070-107643183
  hyper
cttgggcgcagagcccgggggatgagggtccgcggcgctccgcgtgcgctgtctccagccaccaccgaagcaagggcggtggcgtttaatcccaggggcgtcatttccatcca

SEQ ID NO: 96191 - DNA, 273 bp, Homo sapiens
  chr7:107643722-107643995
  hyper
cccggtcccaccccccggggcgcctcttttgtttgaaagccgaatctgcgatcgctgcggggctggggcgcttccaggtcccagggcgggtccgccccggggtgcgcgtcccagaacggcgcgcggcggggccgtccagcgaggggggcggatgcgtgggggcgtctccgaggtgggttttcaggttgcccagccagggggccggcgggacctaccgcggactcgcgcatttacgttcgcaagaagtgaatcaccaaacgtgcccacggctaa

SEQ ID NO: 96192 - DNA, 306 bp, Homo sapiens
  chr7:108095272-108095578
  hyper
acccgcacttctgagcgttaaccatctgggactcggaaaggaaaagaaagctttcttctcaggacagttctgcgccggtggtagccaagggctggagcccctgatgcgaagaaaagggaaggagagaggcggggtgcgaaagaaacgccaccgctcggcgccctccctcggtgcccgcggcgcaggggccacccgccagcgtacgggggacgaagatgtggccgcgggcgcgggcgggaggggaggcgatccggggaaggaagcggcctgttcgccagccccggggcccggggagccctccagcag

SEQ ID NO: 96193 - DNA, 1931 bp, Homo sapiens
  chr7:108095780-108097711
  hyper
cgctgcgagatggatgctccagggcgggtaatcactcctggctcaacacagcatcccgggcggagcggatgccagatcccaccgctaagagcctgggctgggaaagcaatctttccaggcagcccccagcccggtgcgccggccccgacaagtcccagccctcggaggcagggcggggcgcagggactcccgggacccgcacctgtaaggccgacaaagcccccgcaagcgccccacccctctgtcctccgtgtctctctcgttccgcctcgattccccgagccctctccaggcagcgactggagaagcgaagtcggcctcgcccccgaactccgtggtcagcacaggtgtacgcacttccgaacaaagcccacgcccagacgtgtccgcaggggcccgaacaggcacacgcccgtgcgctcccggcccggcccccgcgctcctcgccccgccggcactgtggcgtgacgccccgcgcctccgtgtccaagcccgggaagccgccgtgccgggcccgcaggctctccatgcccaactgcccacgagcaagagctctgggcagggcttcccggaaagcgtggggtgcgggcgcggagcagaagttggccacaggctggagggggtggtgggtgccggcgctgctggatttcagctgtgccttcacccaagcgcaggtccccctgctccctctcggcgcccgcgggagtgtcgggggcctgcaggggagaagggagttggagatctgctttgcccctcctgcagcgctgccagcccggtgagcgctcggctgaaccccgcggcggtgtccaagtgacaacgcagcagcctcgcgcgtcctcctccgctccagccgtcacccccgagcaggacccagtgtcaccgccagacgcgcaaggagctacttacgttctcgcgccgcgccctccgctcagctctggcgcgactgcccaggaccctggaccgccggtgtcctccgttctcgacgaagctatcccctctggctgctccagccaggcggcccctgcgccgtcccccgcgcccgcgcgtctgaggctcggactgcggcgcgcgtccgccagcgaccctggcgaagcgaggctggccccgcgccggcgcgcgcccccgccgctcccgccctctccgctccccctccccgcgccgtgcttttgcccctcccggctctccttagcgtcctcccgtccccctcccccgcactccctgcgggcgtcctccgcctcctcccctcctggccaaccccctcttgccctgctgctgcgacggcagcgaatgggctccagccgccggcgcctcgagggactgggtggcccctcacctgagcggccgccccaccgccaacctccgtcagcctgcgagcgcgtgtggcggcgggggtgggggtgcggggacggagggcgggagtgttccggggctaggatggctgggatttagctacaaaagatgttccagaaaatgggtagtttttgaatgccactctcatgggtttagctttctgtgggaggtctgtggtcttctagttttttcttttttaaaaagcactttcttcgaaattcatcagttggggtggttgagattgggtgagtggttttgggggttttgttttgtttttgcaaccgttctttccaaacactccccgccgccccccaccaccgcagaaaaaagagcttttagcataaggcggatgctatctatccgcggtagaaactgggtcttctggtcccaaggaatagggttagttcggatttgcttatttacaaatgggggagtattatggagattttttttttttttttttggcaatgtaaatcgagaattaagattttccaactgtatagtatttgagtaaacacactgcttgctgcatagttcaggctccgaagcgcacgtctccactctatcgtggatggtgttca

SEQ ID NO: 96194 - DNA, 42 bp, Homo sapiens
  chr7:108164980-108165022
  hypo
atgactggccaggtgcggtggctcaggcctgaaatcccagca

SEQ ID NO: 96195 - DNA, 41 bp, Homo sapiens
  chr7:108165202-108165243
  hypo
atcgcaccaaggcactccagcctgggcgacagagagagact

SEQ ID NO: 96196 - DNA, 30 bp, Homo sapiens
  chr7:108168666-108168696
  hypo
tcttctgtgcaaccacggtaatcttttgaa

SEQ ID NO: 96197 - DNA, 37 bp, Homo sapiens; identical to SEQ ID NO: 41202
  chr7:10819400-10819437
  hypo

SEQ ID NO: 96198 - DNA, 187 bp, Homo sapiens
  chr7:108503958-108504145
  hypo
gaatccttatgttcccgtcatctggacactggagttcactgtgtcagtggcttgcgacatgccttgtccagctgcaagccctgcatggagcctgttcttgtgctggcgcatggaatggacagccagacctggcactcacttgctcacacacccactcccactgggggctgagcgtgcagttgcagtg

SEQ ID NO: 96199 - DNA, 150 bp, Homo sapiens; identical to SEQ ID NO: 41434
  chr7:108515007-108515157
  hypo

SEQ ID NO: 96200 - DNA, 120 bp, Homo sapiens
  chr7:1086199-1086319
  hypo
tggagagtagaataacgtttcgctccaatttgagatcccaaaatgagatgctgcccgggaccagaagtcagtttcttaggagcgtgctgtctacccaggagcctccgtgtgcaaacaaaa

SEQ ID NO: 96201 - DNA, 30 bp, Homo sapiens; identical to SEQ ID NO: 41203
  chr7:10929379-10929409
  hypo

SEQ ID NO: 96202 - DNA, 279 bp, Homo sapiens
  chr7:1105515-1105794
  hyper
agctccagggccagccgcggtttccggcctcaagggcaggctcggttctggagctccctccagtggccgtcggggtgccgtcactttcagggccccaccaggagagcaggggccccgccgaggaccagagcgcctggaccagagggagccctgcgcggccggcacggatgcctctcaataggcggcatggggccgacacgactcggtgagttcccgccacggctttcgccggcagccggcggctggaggacaaggagaatgcgccggttctgttcctgg

SEQ ID NO: 96203 - DNA, 39 bp, Homo sapiens
  chr7:111560077-111560116
  hypo
actataaaggaaagacgtagcaaatatttacacattcct

SEQ ID NO: 96204 - DNA, 98 bp, Homo sapiens
  chr7:111560176-111560274
  hypo
gggtgggggatatgggggttagggagagtaaaccgggagattttggtcacaggagacgaagtttcagttggacaagatgaagacgttctagagagcta

SEQ ID NO: 96205 - DNA, 30 bp, Homo sapiens; identical to SEQ ID NO: 41057
  chr7:1115722-1115752
  hypo

SEQ ID NO: 96206 - DNA, 30 bp, Homo sapiens; identical to SEQ ID NO: 41435
  chr7:111662581-111662611
  hypo

SEQ ID NO: 96207 - DNA, 80 bp, Homo sapiens
  chr7:111844185-111844265
  hyper
ttgactgataatatccggtttgccattccaggaaatcccagagtggtttttaagcctctgcccaccgcttgtaaagaaag

SEQ ID NO: 96208 - DNA, 30 bp, Homo sapiens
  chr7:112220127-112220157
  hypo
ccctgacccaccccacgacgggtgaataaa

SEQ ID NO: 96209 - DNA, 30 bp, Homo sapiens
  chr7:112429052-112429082
  hypo
ccttataaggcactccgtgttgggcctgaa

SEQ ID NO: 96210 - DNA, 156 bp, Homo sapiens
  chr7:112431236-112431392
  hypo
gctctctggggaacacgagtgccacatttccaactacctgctagatgtttctactcaaatatattgtcatcacttccaactcaacttgcctttaatggacatttatatacatttattatgccccccatttgaatccccttccgtatttggagaatt

SEQ ID NO: 96211 - DNA, 331 bp, Homo sapiens
  chr7:1126502-1126833
  hyper
attacagagggaaaacgacacctagaagtaggagtgagattcgctgaagttcccttctgaggaagacccacccctccgcctggagagccggggctggcggtgcctgaggaccccttcggcctggacagcccacgcgggcttggggggcctcgctctgccctcatggggcggccatcggttcccgaagcggcgagtgaaaattcaaatggccagtagggggcgcactcggaagtggccgccccgcatgaggcagttcagcggccccgagagtccggggagggaggtttattctccgcctgcacgagactgtgaaatccgcaaccatgagcag

SEQ ID NO: 96212 - DNA, 56 bp, Homo sapiens
  chr7:112726558-112726614
  hyper
tccttgagctccagccgcgtcctcccctgtcgcagcggcaccgtctcccccagtaa

SEQ ID NO: 96213 - DNA, 141 bp, Homo sapiens
  chr7:112726853-112726994
  hyper
tcttcccaaaggcagcgcacgaggaagtcacagtgcccgtgacgcccgccccctccctcagcttcccggaaccctaaccttccccagacactttcttcccttttcttttagggtggtccaaaccaccggaggcttctttta

SEQ ID NO: 96214 - DNA, 588 bp, Homo sapiens; identical to SEQ ID NO: 31462
  chr7:113722696-113723284
  hyper

SEQ ID NO: 96215 - DNA, 445 bp, Homo sapiens
  chr7:113723338-113723783
  hyper
cgagttcaaggaattgcaaataaatatattttatgaccacccatcaacaaactacgtgccaccgtggcggcccctggtagccgggccgtgtctgcagtgtggccaggggcgggggctgaaaaggaggcggccggagaggcgaagcgagctgcgagccccgggcctgaactttcacctctcgaacccgggcccagcccattggctgcagccgaggggtccaccgagggcagcggctcctgacaggacctgttttcccaactccctggacagcttccctgcgggatgggttggtggcccggggcatggcagcaggcgaggaggagataatgggggcgaagttgagcgggggcacttgggagctgcgggctcagtttcactgagaaaaaggccccggaagggtacgcgtccactctataaatatatactcctccgactgagatgtcct

SEQ ID NO: 96216 - DNA, 726 bp, Homo sapiens
  chr7:113724746-113725472
  hyper
aggcacaagttagtgcggttcgcccgtctccccaaccaccaccacccctccctcttctgccaccggaggggttcaagttggccgttctttccccagggaggagggccgggaagcagccgggggccaggctctgttcaccacggcctattggccgcagctatttggaggaaagtttcagcgcctctcggaacgccacgctttgcgactgacttgcgagcaaagcagcgggctcagtctgcggcgcgcggaaaaggcggccggcgaagagtcgcccggcccgcgggcaggggagggaccggagggagacggcggggagggagcgctggcccccctctgggctggggctccggaggaagcccctcgccaagattccggtcgtgcgtcccctccggggcccgctctctcctccctcggcctttcccctgtcaccgccctgggtcccaagcaggccgcccagccgggtcacacccggtggatagaagccgggacccagggctggcggctgggcccgtgcatcccccacgcgggcgcctcggctttgaagtgcgcgcggagcaggctctgaccgtttcttctttcctttctttccggttacttttgctcccctcagtcactgataggacccttcccgaaaacctcagactctctaagtcccagcttggcggccccttccttccaagccgcgccccggtgacctgggctgcgcgaccacgaggaagcccgaga

SEQ ID NO: 96217 - DNA, 157 bp, Homo sapiens
  chr7:113725701-113725858
  hyper
atttgccagcagctccgtctgctgagaggacgtactttggggactgccaagaagcagcagacacaactcggctttgccaatacagcatacggttttgttctcgcctccctccccacccccttccctgactcgccgtctggggcgagctggagaaggc

SEQ ID NO: 96218 - DNA, 800 bp, Homo sapiens
  chr7:113726087-113726887
  hyper
tatcaacaacaacaacgacaataacaacgcaaagtaaaacaaaacaaacaagtggtccggcggtacttcagaatcctctgcggcgtcctgtcccccaccccgcccctccgaggagaggcagccccgcgagcagtgtgtgtacagttcgcattgccaacaacacgcgcgcgcggccgggtgcgcgcgcctgccagcgcacattcacacacacagacacacagacacacacacacacacacacacacacacagatccgggtggggggagcggctgcgcgagacagcgcgagcctccgagaaagcgcgagacacgccggcgcgtgcagctccgcggccgccgcttcgccctagctctagccccgcgccacccgcagcccgcccgcgaacgcccgccccggttatttatgcggcggccgcgtccgctggctgcggcttcctcggccccccccctccccgggcgcgccccccactcgcggcagcagctgcccggactcgcgcgtgggtgtgttgtttgggggcttctgcctcgccgccgcgggtgccacctcccgggacgctgcccacggcgtccccggtcgcggtaagtttcttggccctcactctggcgcgctacacctccgcaccccaccctgtcccagccacctccacgctgggccgagctgcgactttactctgctccgcgctcctcccgcggtggcgacaaagtttcgccccaaaggcagcgccctgcttgccggggcgagtgtgacatgtgtcaaatttgggctcggcgttggggtcgcattccggacccagcatcac

SEQ ID NO: 96219 - DNA, 257 bp, Homo sapiens
  chr7:113727369-113727626
  hyper
gactgctgccttgatcgcgttcctttccctgtccacgcgttagcacgaccggcttcccccggtgtctggcctggttttacttttattccgctttagagaggtcgcctggctgtttgtgggtgggtttggggtgaaatcgcacctcgcggcacttggtgaggggacgtgggaggagcgcagacacctttcggtgatagggagggcttctcacttggctgttacctggaagtccacagtggccccggcgggcaggcggg

SEQ ID NO: 96220 - DNA, 54 bp, Homo sapiens; identical to SEQ ID NO: 9172
  chr7:113727754-113727808
  hyper

SEQ ID NO: 96221 - DNA, 30 bp, Homo sapiens
  chr7:1139445-1139475
  hypo
acacgtctcactaggcggtttgctcagaac

SEQ ID NO: 96222 - DNA, 155 bp, Homo sapiens
  chr7:1140555-1140710
  hypo
gcaggcacagagccccgtgcacccctgctcctggcctaggcggggtctgcaaaggcccttccaccgcaggcacagcccgtcagggaggctcacgctccactcagaaggacacagcccgtttcagggaacacaggcccaggcggccctgccacagg

SEQ ID NO: 96223 - DNA, 122 bp, Homo sapiens
  chr7:114562155-114562277
  hyper
cccctttcccagccccgggagggcgcagcgcccgggtggggagcccgagccagcccaggccggctctggcctcctgacccagacagcgcagggcgcgagggatcgcgcggccgagcccgggt

SEQ ID NO: 96224 - DNA, 1188 bp, Homo sapiens
  chr7:114562326-114563514
  hyper
cgatccggatgtgatgaaaaagagcaacagagggagaagtgtttcaggattgtaggagtggaagaggggaaagagaggcagagagggggaaggccccctcgcaggggagccggctggagtgagctggctggaaagagggggcggagtgcgcggagtcagagccgccaccgctgccgcagttgccgccactgcggcgtctgggctgagccggagggaggcgggaggacgcgcaggggcggccgccgccgtcgtcaggccaccggggcgaaaatgcggccgctgccggaggctcgctaactttccggggcggaagaggaggaggaggaggaggaaggggcttggagcgactacggggggatgcggaggtaggtagtggtctccgggcggggaagaggaggggtttgatccccatccccggggttctcccaaacccgatctctctttccagcccctccccgctgggtccacctcggacccctgggaccccgccgctgtcaacttgcgctgtaacagttttcttcgcaagtttcaaatcaaaacttccccggggtggagtttgagggagggaagtggagggggagggaacgtcccgcaggggtggtgtgctcttctctaaaaacatttttttttttaattttgtatatttttccgccagaagcagtcagttccctgcacccagcacctcacagcccttcctccgtgcgccctgccgggcggcgagctaggcggcagcggcgcggcgcgggctcggcggagcggcccatgtccggcgcgggcgaagccctcgctcccgggcccgtggggccgcagcgcgtggccgaggcgggcggcggccagctgggctccacagcccagggtgagtgcgcgcttgcaagtggcaagcttctttgtcattgttgcatttttcagtttgctcacaagtgcacagataggggtggggggagtgctgtgaggaggggctcccactcgtagttgagaacttttgcacagttcgcgttactcaggcaagttcttcaggatccttgccctagatcaacaaccgggtaagagggcgggaaccgttggtccctccactcccccttcctttggttgcgaagaaacaggatgacaggattgcttctttcttaagcatatgcatgtttgggcctaagactcaatgtgtaggttctgaagcgcttctcctctagg

SEQ ID NO: 96225 - DNA, 475 bp, Homo sapiens
  chr7:115117435-115117910
  hyper
ttattccaagtgccccgtcccaggcttgcactccccaaaaaggagccgagacgggagggttgaggcgtctcggctgcctccgtggagatcccgagaaaagctcctgcgctccaagttaacttctctctgggccgcgcggcgcagtggagtctcggtgcagcccgcgtccctggaggcgcgcagcgaagcccagcgggcgtggacagggaaggggcgggaaggcaggggacaaggcggggtcctaagggttggtggggttgagctgggggggggggggcggaaaaagagatctgcggagaagccttcggagaggctaaggagggctagcctggggctgacgaaggcaatgctctttagaagggcactgggggcaaagagggtcccccaaagcagctcatctgggcgcccttgactaacagtgctctgagctttttgccttgagactctaaagatcaaaattcgatgtcctcggaat

SEQ ID NO: 96226 - DNA, 43 bp, Homo sapiens
  chr7:115738426-115738469
  hypo
ggtctcggcgtgaaccactgcgcccagccgcaaccaagaataa

SEQ ID NO: 96227 - DNA, 264 bp, Homo sapiens
  chr7:116139864-116140128
  hyper
acagctcttcatggacgacgactcctacagccaccacagcggcctcgagtacgccgaccccgagaagttcgcggactcggaccaggaccgggatccccaccggctcaactcgcatctcaaggtgaagcccggggcgggcgggcccaagtccccgctgaggccgggaggtgcgggcgcccctcagccccgccctaacccgtcccaccattgctaccgggtcggccccgcagggtctgagacccgcacccttccccggtcccaccc

SEQ ID NO: 96228 - DNA, 62 bp, Homo sapiens
  chr7:116140129-116140191
  hyper
tcaccaggccgcccgcgtagccaggaattcttagccaggttcctgtgcgcccaccgtgaccc

SEQ ID NO: 96229 - DNA, 30 bp, Homo sapiens
  chr7:116166712-116166742
  hyper
ccctaaacacctcaacgatgacgtggtcaa

SEQ ID NO: 96230 - DNA, 92 bp, Homo sapiens
  chr7:116339527-116339619
  hypo
cattagctgtggcagcgtcaacagagggacctgccagcgacatgtctttccccacaatcatactgctgacatacagtcggaggttcactgca

SEQ ID NO: 96231 - DNA, 44 bp, Homo sapiens
  chr7:116492603-116492647
  hypo
ctctccgagtagctggaactacaggcgcccgcaaccactccttg

SEQ ID NO: 96232 - DNA, 30 bp, Homo sapiens
  chr7:116620287-116620317
  hypo
agccatgagccaccacgcccagcattcata

SEQ ID NO: 96233 - DNA, 30 bp, Homo sapiens
  chr7:116921667-116921697
  hypo
ctgaaaactaggtcgcgaaggtaagtctgg

SEQ ID NO: 96234 - DNA, 745 bp, Homo sapiens
  chr7:116962402-116963147
  hyper
agcaaaatgttcttccgccccactggggtgaacctggaatgtggaaggacgggaaataatacaaagtcacacgctttaggttctacaactcctgactggctgaattggcccgtcgatttaccttgaggcagttttggcggggtgggggctgggatgggggaggcggttgtagttttcaaggtgaatttacacacacacacacacacacacacacacacacacacgtctgtgctagagctggagaccaggctagcacgtctctcaacaggataagaaattggctgattttgctgtcgctcagctggatccaaataaaccaaacatcggagctctcatttgagggggaatgtggttttatggagttgtcaaagctgaaatgatcttctgggaaaagagaaggggctcaccatggggcgataagagggcagtagccagggttcgggccagaatccgagactgctgcggccgcgggggaacgcagccaggaagggtctatgtggccaatgcggtccccattccgatctccaaaatcccccgcgcccgtgcgcgtggacttaccaccatgaagagttgacctcgggggtgagccaggtcaagagcagagggagccagagccagattccaccgagaggggcgttcatattaacccccttgcgtctgcatcaggtcagactccgtgtgcgggcgccatgcgtgcccagagcagaagcgctcagctccgggagcgcctcgtcacggccgccgg

SEQ ID NO: 96235 - DNA, 1391 bp, Homo sapiens
  chr7:116963330-116964721
  hyper
cgtccgctctgctcccctccgggcgcagccgagggagggggtgctgcgcctggcgggggtggggagaaacgcggggttttagacacgggtgcatgaaatgatggcaagagatgtctggggatgaggtgaggcggggaagggggaacatcgctgcatggttacgagcacacgcgaatacaggaacctttagggaagctccaggccaaagagcatccgtgggctctcggagcgtgcgttccggattgccgaggccatccgctggcaaacaagtccctgagcgtgcaatgtgaggaaacgaggaagggggccaggggataaggagattactatgcatgggatacaagaatccagagatgattctcaactcattgcttcgcttctctccctgaagctgggatgaagagctagcacttgtaaatttggagctgccgcgtctatgcagggcaaggttagggaggggccaggcctctgcgaaatgacctgttggctttgattccttggtgctgggcttaaatacagagcccatagggaggggaacttggagggtccatgaccctcgggacctaacccagcagtatctgccaaagcacccaggaaagatgcagtttttacgcacacccagctcctctccggagctgcggagcgcaaaagatcacatagagaggaaccgaggcagccaggcgttcgccgggggtgtgcgcccttgcacctcctgccgcctgggcgctcagcctgtgcgccttgtggaggttaagggaccctcggtcctggacctgggcccccgcccagccaagagagaggggcttgggcccgcgggtggagcattttgagcagtagctggcttgtagccgcgccgtttatcaccggaaaggaaggaagaccaggaactcgtggcggccgtgaactgttccattgctcttttcctggggcggagggactcactgcccgcccgaggagcgtgctctggggaatagagtatgcgcctgtgtgtatgtgtgggaggcgaattgttcgcagggcgtgggggagggggtgccgcccagatcggaaggacgggctctccctctctccagcccaccctcgggcctggactggccagagcgtcagccctcgccggcagcgagcgcggtgagaggctggacgaggcgaagctcagagacgccaaaaacctgaaagatgctgtcatcgccacccccttcccccacgctggtccctggcaggtccggcccctcccaggctgacccagatacatccccgtttgggtccggaaagggaggggagggaaacaagcaccgcgccacccacgactcgggaagagcagggctcctcgccagggccgctccgtatcgctgggccgcgacccagggaagttctgcttggtctgcgtcggt

SEQ ID NO: 96236 - DNA, 876 bp, Homo sapiens
  chr7:117119448-117120324
  hyper
ctgtattttgatatacgaaaggcacattttccttcccttttcaaaatgcaccttgcaaacgtaacaggaacccgactaggatcatcgggaaaaggaggaggaggaggaaggcaggctccggggaagctggtggcagcgggtcctgggtctggcggaccctgacgcgaaggagggtctaggaagctctccggggagccggttctcccgccggtggcttcttctgtcctccagcgttgccaactggacctaaagagaggccgcgactgtcgcccacctgcgggatgggcctggtgctgggcggtaaggacacggacctggaaggagcgcgcgcgagggagggaggctgggagtcagaatcgggaaagggaggtgcggggcggcgagggagcgaaggaggagaggaggaaggagcgggaggggtgctggcgggggtgcgtagtgggtggagaaagccgctagagcaaatttggggccggaccaggcagcactcggcttttaacctgggcagtgaaggcgggggaaagagcaaaaggaaggggtggtgtgcggagtaggggtgggtggggggaattggaagcaaatgacatcacagcaggtcagagaaaaagggttgagcggcaggcacccagagtagtaggtctttggcattaggagcttgagcccagacggccctagcagggaccccagcgcccgagagaccatgcagaggtcgcctctggaaaaggccagcgttgtctccaaactttttttcaggtgagaaggtggccaaccgagcttcggaaagacacgtgcccacgaaagaggagggcgtgtgtatgggttgggtttggggtaaaggaataagcagtttttaaaaagatgcgctatcattcattg

SEQ ID NO: 96237 - DNA, 30 bp, Homo sapiens
  chr7:117433609-117433639
  hypo
gcagtaagccatgtgcgcatggcacaagag

SEQ ID NO: 96238 - DNA, 104 bp, Homo sapiens
  chr7:117512306-117512410
  hyper
ggcccccgctgtttacgcccggccctgccctctcctgcactgattctgctcaggtcttgataggaagaggggggcgtccacgccccgctcgctccatcccaccc

SEQ ID NO: 96239 - DNA, 391 bp, Homo sapiens
  chr7:117512787-117513178
  hyper
tgctaggacctaaagcgctggcctcagcggcagcagcgcccacatctggacacggccctctcccagtgggcctcccgaaggcacaggaccagatgcacacaatgggcatccccacacctgctgggcgatggcccacctcccccaagctgctctcccgggtccgctgagcggtaccaggcacccccgagacacgcgctggcaaccacgcgcgcagcgagaggtgaacaatggggggtcaaattcgccaggaaacacgtcccagccttctcccccggccagaagcgaccgcagcggagggagtgggcataggggtcgcactggacgcagacagggagctgggagaaccgggcgacccggggccgcttcccgtggggcgcggaagggacaggag

SEQ ID NO: 96240 - DNA, 35 bp, Homo sapiens; identical to SEQ ID NO: 31483
  chr7:117513436-117513471
  hyper

SEQ ID NO: 96241 - DNA, 30 bp, Homo sapiens
  chr7:117805645-117805675
  hypo
acaggagtgagccaccgcacccagctgtat

SEQ ID NO: 96242 - DNA, 465 bp, Homo sapiens; identical to SEQ ID NO: 31055
  chr7:11871392-11871857
  hyper

SEQ ID NO: 96243 - DNA, 417 bp, Homo sapiens
  chr7:119912968-119913385
  hyper
ccttgaaccgggactcgagaggcagaagcaaggcacgggtcccctttctcctctcctccaccaaaccaccgcagcccagcacgtgaagcttccctttgttcatccgaggctcgcttttctccccagcagatccacctggatgctctccctcggtgacattttgcgccggggttggtgggtggctggggtggagcgagaggagcccgagggggcgggggcggagaaaggtcaagccgagggaaaggcaggagacgcctttcctaacctgcgtggcggggcgtgcgcgcggttatttatttattttctccttatttattgatcgcactagcagagcagcgcggggagcccggggagatgcaggaccacccactggcggggaagcagctagcagccctcccgcgcccccgcgctgccgag

SEQ ID NO: 96244 - DNA, 330 bp, Homo sapiens
  chr7:119913416-119913746
  hyper
cgtgccggccccggccccggccccaccgcgccaacgccgcccgcccggccgccccgcagccccgccgccccgcagccccgcaccgcgctggccaggctcccgcgacagtggccccgcagtaagttggcaggagcgagtcccctccgttctcgcctcccccgcaccttttgaacttgttgctgctgctctgctcgcctgcgcctggcttttggaaggtgaaaaggaggagggaggcacggagggatgggggaagggaaagaagagctcgcttgagctttatttatgctctctcggcgcatcggattcggctgctcgcgagctgctttctct

SEQ ID NO: 96245 - DNA, 106 bp, Homo sapiens
  chr7:119913981-119914087
  hyper
gagggtgtttgtagacgtgggggaggagaatctctattaacgccccccaccgtaaccactgcacatcacctccatctctgcaaatacagcccgaggagtagaggca

SEQ ID NO: 96246 - DNA, 33 bp, Homo sapiens
  chr7:120368239-120368272
  hypo
aagtttcctttcaattaacgatgttcaagttgc

SEQ ID NO: 96247 - DNA, 93 bp, Homo sapiens
  chr7:120969260-120969353
  hyper
tggacaactgacctgcggcccgaagggcctctggggagggggtgcaaaagaggagcggctgggctgggggactccatgcgggggcgatggaca

SEQ ID NO: 96248 - DNA, 1077 bp, Homo sapiens
  chr7:120969626-120970703
  hyper
gggcattgcctccttcggggttccagagaagctgggctgcgccaatttgccgctgaacagccgccagaaggagctgtgcaagaggaaaccgtacctgctgccgagcatccgagagggcgcccggctgggcattcaggagtgcgggagccagttcagacacgagagatggaactgcatgatcaccgccgccgccactaccgccccgatgggcgccagccccctctttggctacgagctgagcagcggtgagtcctgggtccttaggggttggtgggggacggaaggcgacaactcctccaccggttcctgcaaataaagtaaatagtgctacgtggtcctgtagctctctaagttccagaagaagccctttagtgcacggggattgagagctacaaaggccagacctggggagcaggtgcgagcctggagggaggtgactccccagttccagagcggagctctaggggctggagctcttcctctttcctgcggtgccccgccagagttggaaaaaaaactctaattctcctaccccgccgaccccctcggaccccgtagcgcccccctacgtgggtgaccagctggagaaacatgatgtcggcagcggggaatgcggctgccgcatctgctttgatttaaccaactccgctgcgcaccaaaccccggacaagtggctaattgcagcgaagccccacctttattggctcctaggagcaccgagttgacagaataatggtgacttttaaagcgactgtccgcgaccacccaacgtgcggctaacctgagcaggaccacttgtgcgcttctcgtttctttggcttttctatctttccctcctcggcgcactcccgcggcgcgggaagctgcaggaaaacaaagttccacttccacgtgcgtagtgacttggtaaggataaaggtacagggagccaggattgttcctggaatatcaacagatccaaagaatgttaggactggggcgctgaaggatgcgctgtcgtttttcatgttcatttccgttccccctccgcctttgacccttgtccacgcagtccctgcgcgcacccccgccgagccg

SEQ ID NO: 96249 - DNA, 30 bp, Homo sapiens
  chr7:121074-121104
  hypo
ttaaagtttcctgttcggtctgggactcct

SEQ ID NO: 96250 - DNA, 33 bp, Homo sapiens
  chr7:1212360-1212393
  hypo
acaaagcccaggtaccgacggcctttccgtcct

SEQ ID NO: 96251 - DNA, 347 bp, Homo sapiens
  chr7:12151126-12151473
  hyper
gacaagacttacaagcgacgatgctgacggtggactcttgcccagggatctgggcagagcgtgggagggcctgtggggcctggggttctctctgcgcacgaaatccggggcgggcactatgtgattcgagcccgctgcgccctgggctcctcgtgtcgcccgcggggaaaggaggagggagactgctcacatggcccacttcgcggcctgagatggagtgcgcgcagggcgtcagggcagagggaggcggggattcaggataaagagcggcctgatgcccagagccgggtgcccggacctcctgcctcctgcttctgatccctgcaagccgcccaccctgcgatcgc

SEQ ID NO: 96252 - DNA, 149 bp, Homo sapiens
  chr7:121512756-121512905
  hyper
aacaatgtacccaggcgcccccaccgcattctgattggacccacttaagcatctgcagaaaacaataaaatgaaaaaaactcttagaggtgaaactcaaaggtcaacctctggctgtgcgggacaatgggtgtccggccttcccttccc

SEQ ID NO: 96253 - DNA, 405 bp, Homo sapiens
  chr7:121513553-121513958
  hyper
atgcgaatcctaaagcgtttcctcgcttgcattcagctcctctgtgtttgccgcctgggtgagtgagaagagctcggtggggtttcagctccgggatcggtgggatgagggtgggagcatttcagcgtgtccgcgacttgccgccgccgccgccatctagccaggaggaaaaagggacagccaactgggctcccacggagcgggcggccgcgcggtgcaggcagctgcgtgggatttgcgcgccccctccccgccccgcgccctcgccccttccatcggcccgcgggcattcgtgccccgggccccaggagacggagctactggagacggagggctactcggatccctgccgccaccgttcttctctcctcttttgcaaagtgtagaaatcgccttttagatata

SEQ ID NO: 96254 - DNA, 216 bp, Homo sapiens
  chr7:12151523-12151739
  hyper
cgtcgccggtcctgtgcgcctctggtggcgcgtgcgccctgtccttccctgcccaagagggagaaccctcagtgccccagcctcagctctgcgcacagcggtcccctgcatgtccgcactcctgttctgtactgcacgctcgccagagcacagagccccatgtcccattgcgagggtcccacagagggcagtagccaccctcggaatccataccct

SEQ ID NO: 96255 - DNA, 774 bp, Homo sapiens
  chr7:121783508-121784282
  hyper
taaactgcttctccccgcgccccgtcccgcgcgagcgctcacaatgggctgcatagtcccgcaggggctgaagagttcaggaaacccagacttgcaaggcgcccaacttccacccatctccgatccttgctggagaatgggtctgtgtctcggagagtgggcagcccaagatggacaaggagagaagtttgtgatcagtttggctaagctgggcgtggggagggaagggggaaagaaccaccccgaaatctccatccaccgccccctcagccagccgtcccctctaagcacgccgtccacaaattaacaagccgttgtttcctcagcttcatcagttctttattccccagccacagcaccaccactgtccgccaaaaaagaaagaaaagaaatccgaattgcaatccctcgcctttctacttagaaatgctggagctgcgctgaccgctctccctcccttcctcgcagtgaaactctctgcgtttccgctctccctccattcctcgcagggaggcccgaatgctcgccgccttctccctctctcggcccggccggggtcgcctcgcggcgccgggacccgaaggccaggctcgcgggcccctcccagcgacagcccgagcccggcccgctatctccaccgcatctcacaggctgagcccacccgcgcgtctgctcagctctccgcggggacctctcctctcctcacctcgtccgctctggggcgccgacttgtcccccgccgcctcgaatcttccgagtcgctgcaggggaggc

SEQ ID NO: 96256 - DNA, 138 bp, Homo sapiens
  chr7:121784548-121784686
  hyper
aggtttgtaactgtccgtggcagaaggcgggcggggacggaaagcaacgaaaatagtctgggcattacgctctaaatagaggtgcacatctcctggggaaaagttgcgagcgccggtacctcacgtttgtttagctat

SEQ ID NO: 96257 - DNA, 568 bp, Homo sapiens; identical to SEQ ID NO: 31492
  chr7:121939677-121940245
  hyper

SEQ ID NO: 96258 - DNA, 657 bp, Homo sapiens
  chr7:121940433-121941090
  hyper
cggtgtggaccgatggtggattctccgcgacaacagccctggagggagagagtgggccgggggaggggccacggggcccctgaggcctgcggggctggccgcactggccccgggcctggcggggtggtggagtccgaagcggcgaggcgaggaccccggggcccgctccccccagtcgccctcccgggatgtggccccgctgcagtagcactacggtgctgggctgtttgtctggcagcttctactgagcagctaatagtataacaacccggctttgataaatctgaactaattacccctcttaattaaagtctttagcagttgtttcattgttttggcaagaaaacaggagagacgtgcagttagaaacaccagagcccgagctcacagcggagccgctgattaacacttgaagcatttcaaggacctggcacccgccacagtttggttttcatccatgtttcctccttgaatggaagtatattcgtctataaacatacatacacatgtaaaaacacggaggctccgtttgccagctgtgtacaagtcagtatgtgccgtcaggatgcaaacaatagatacctgtctatctatgattgtaatgcgtttgaggagatgtacattgcatacagctactggatacgttgttcccattta

SEQ ID NO: 96259 - DNA, 510 bp, Homo sapiens
  chr7:121941881-121942391
  hyper
ggtgcatgcaagaggcgaaaggccaggggatgcagaggcttctggtcggccctgaagtgtggggcccaacatgccctggggtctgcagacgaactcggaccaggagctctagtctgccgctgcctcagcgtgggggcacggctgaggctgggaggacccttagcctcgatcactggtggccctggtggagcccgggctgcaggggccccggggttggcagcggcggctgcagaggaggcagcgtcatcggcggctgctgcggtagcgggggcggcggttcagtgcctggttcgccagctggcgtgcgggccagccccaggctgctgtcgtgcagcttgcggacatgcttcttgaggtcaaagttcctgcagaaacccttgccgcacgtggggcaggtgaaaggcttcttgtcgttgtgggtgtgcatgtggaaggtgaggttgtaaacctggtggaaagccttgttgcagatattgcacttgaactgcttctccccgctgtgggtcaact

SEQ ID NO: 96260 - DNA, 333 bp, Homo sapiens
  chr7:121943656-121943989
  hyper
gaaggaaaggatctccgttttgcattgtacttgcctttccacacacttcgcaagtgaaaactttgggcttggcattaggagagcctcggctgaaatccgaggttttgaacgcgattttttccgacagaagctgggcgctttctttcatgtaatgctgcagctgagcctgggacaggtctttgaaagctactccagaagggtatttctccaccgccgggaccaccagtttattcctttcggctaaatacgtttttggctgcgggtgcaaaggggaactgaggaagtaggaggccaccgggtggatgttcacgccggctgccgggtggcatgggc

SEQ ID NO: 96261 - DNA, 216 bp, Homo sapiens
  chr7:121944176-121944392
  hyper
cgccgccggggcctccagactggccttccgcggctcggagcccgtcactcctgccttggggctcgtgtcgtaggccacaggcacgaaggggatcatgcaggggatcgacgagttgagatgcagagagtgcttgggttcccccttgggtaaggctccctgcaggaagtgggggactggcagggccttgggctctggggtgcgcgccatgattcgttc

SEQ ID NO: 96262 - DNA, 30 bp, Homo sapiens; identical to SEQ ID NO: 31498
  chr7:121944621-121944651
  hyper

SEQ ID NO: 96263 - DNA, 535 bp, Homo sapiens
  chr7:121945611-121946146
  hyper
caggatacacacagacgcgcgcgcgcgcacgcttccgagtttccattgagagtctggaaagagcatttctttcttaagtacctgcgctcagctagagctctcccggagcattttaaatactgaatgccgagcggagaagggaaacagagtgtattaatccccactccggttgccggtgtctgcaagcctcctctaagcagcgcaggcggcagcctggatgtctgtgcgcatcaaggagacttgccggcgccagagttgtgtccacaggtgcacttgtgcctcccaaagagcgcgcgtagagaccatttcccctgcaacgccccccagccgaacacccgccgggtgtggcacctcggccgaaactcctggggcggcgcggtggagcgtgtggaggtttccgggaagacgcctacggctgcggctccgactgtgcgggctcccgccgcccaggcaagagcgtccaggagcgcgctggaagctgcggcgcgcaccttccccggcgcagtctcttgccagccggcgatcacgcagagct

SEQ ID NO: 96264 - DNA, 611 bp, Homo sapiens
  chr7:121946372-121946983
  hyper
caagtgtagtgggggcgtccttctgctagagctctgaaaagggttggccccggaaggctggataacggcggactagaaaccctggcattattaagtccctgagcaatttcactcaaagatgcgaaactggaccttaaacgaaggaaattgacgtcaaagtattccctcctctctaccccattctcaacacatgccaggcaagctacccgggtccctccgccccactctaactttccgcgaaaatcagttccgcctctgccccaagagccaagaggggtggaaaggaagagagcttgggctgggaacgcgcctgatgtctaacagaaaggcagtggcagctgggtgagtggtgggaaagctcacaggctgaagaaatgggggagggggagtgagtcttattggaagttgaggacagccaaggggcaagatggggggagaggtctggctgaatacgacgggcttcagcagctaggcctgggagtgcctcgtttcaggcctcgaggtggcttcaggctgggacaactgatgcagcagagaagggcagagcgcccggggggagaaagcaaagaggcgctacactccaaggcggccctttggaaccgtccttggcc

SEQ ID NO: 96265 - DNA, 352 bp, Homo sapiens
  chr7:121947097-121947449
  hyper
cgcttcgtagttgtccttggaccgggcgcagacactcagtattggtcagcgctggaaattttctttccttttgctgttggggccgcagaaccagtctcctcctttcccctgctcagacaaagggcacgggaagggctttgctggggcaaaggggggtggggggttctctgtcccacgacagatgggtcgcggttaagactttaattgctgacttttgggccggatcagattccttttcctacctgccacttcccagcagcgaaaaatccccctcctgctgcactcctccgccaccgggctaggttgaaaggaaaaagccaagaagcgcgaagcagcccggctctggaaggct

SEQ ID NO: 96266 - DNA, 227 bp, Homo sapiens
  chr7:121950038-121950265
  hyper
ccttgacactacccacgaagtttaaagcattttttatgttattttcaaactttcttaagtgatcccatgaaataaaagtcgataatagaaattaaaacaacacagagcaaagaacgagcttagtgaaatggagaagcagtagaggtaaataaaaatcctcgagctagaaagctctaagaaccgcttataaattcagttacctcctgaactccggccgatggccactc

SEQ ID NO: 96267 - DNA, 125 bp, Homo sapiens; identical to SEQ ID NO: 710
  chr7:121950428-121950553
  hyper

SEQ ID NO: 96268 - DNA, 148 bp, Homo sapiens; identical to SEQ ID NO: 711
  chr7:121951863-121952011
  hyper

SEQ ID NO: 96269 - DNA, 126 bp, Homo sapiens
  chr7:121952043-121952169
  hyper
cgagggtgggaagggaagttgaggtctggggtaaaaagccggaaaaagaaaggaacaaggctgagaatcattcaaagattaaatggggtcggctcccgttgcttgcgaagacggatgaggagggag

SEQ ID NO: 96270 - DNA, 45 bp, Homo sapiens
  chr7:121955270-121955315
  hyper
gcagtccagcaactccgggcaggagtcggtgctggcagtcgccct

SEQ ID NO: 96271 - DNA, 465 bp, Homo sapiens
  chr7:121955375-121955840
  hyper
gcttggtttccgcagctggggccaccttgaagggtgtggacccctctgcctttctctctctgttccgcttgcagtttgcaagtgtatccttctgttgcatccctgaattgggacgcaggacatcgttctaggctcccataagccttggaaaatattaatgaacaccatttgcacctgaaattcccttgaactcaacgcactgaccacaacagccgaggcctgagattcctcgcttgtgatctggcacctcctggatcatccccgtcccatttcagagcccttgaccaacataatctgcaagtggactcaataacacatctccagctacctcccttcccaaccgcagccacaggggctgctgttagcgatgctggccctttctgagaccagagttcccttgcccctccccgtctcctcctctcctcccatcgggctggccatatatataaccggagaactggacaa

SEQ ID NO: 96272 - DNA, 78 bp, Homo sapiens
  chr7:121956177-121956255
  hyper
aagcttggggctctgcggttgtccaagctgctgtcaggtacacccaaatctgggtagtaaaatcggaggtcttcttca

SEQ ID NO: 96273 - DNA, 124 bp, Homo sapiens; identical to SEQ ID NO: 713
  chr7:121956458-121956582
  hyper

SEQ ID NO: 96274 - DNA, 123 bp, Homo sapiens; identical to SEQ ID NO: 714
  chr7:121956954-121957077
  hyper

SEQ ID NO: 96275 - DNA, 1 bp, Homo sapiens
  chr7:121957253-121957254
  hyper
c

SEQ ID NO: 96276 - DNA, 76 bp, Homo sapiens
  chr7:121957255-121957331
  hyper
gctgagtgacctctttccctctcaagcacaccttcaaggagccggtggaccctctcaccgccggtagctgcaggct

SEQ ID NO: 96277 - DNA, 30 bp, Homo sapiens
  chr7:1220695-1220725
  hypo
agaatttgctaataccggacttagagattt

SEQ ID NO: 96278 - DNA, 93 bp, Homo sapiens
  chr7:1225133-1225226
  hypo
gatggcgcctctcagcgtggcgacgcggaccgagctgtctccatggtcatgctgtggccccgacacccacggcccctccgtggactttccctg

SEQ ID NO: 96279 - DNA, 314 bp, Homo sapiens
  chr7:123172930-123173244
  hyper
ggcccccaagcttggcgcggaaggcgccgccagtgaccggctgcggctgggggcggaggccggcagttgctcggagctccggcgggtcaggaggtgacgggaggaggaggaggcaggaggaagaaaggggggttgggaggtagcgtccggtaggtctgcgcagacagcgctgccagacctctgactcccccagtcctgccgccgccgatagccccacaaggcgacatgggaagtccgccggagcagaggggagaaaattcaaaacgagtctactcaacctcgtcttggctccgaggccccgccatgcagacccc

SEQ ID NO: 96280 - DNA, 16 bp, Homo sapiens
  chr7:123175665-123175681
  hypo
agagtcttgctctgtc

SEQ ID NO: 96281 - DNA, 30 bp, Homo sapiens
  chr7:123259499-123259529
  hypo
gcaggtgttctgccccgatacagtttgctc

SEQ ID NO: 96282 - DNA, 1007 bp, Homo sapiens
  chr7:123672016-123673023
  hyper
gcccataaaattgagcgggtagtgagaatagtcccaggaacaagccccgcacgtgcggagtcccagaccccaggacagctcccacacgtagatgaagatcacgtagatgggcacccgcttccaagtgccccaaccgcggctgtagtggaggtggaagtagagcttttccaccacgaaactgcagctgccgtacataaagaaggaccagagcgacgtgtggccgctggttgtcccgtccccctgccccagtacgttgaagaagaaggtgaagaagatctcatccagaaagccgtgcattccgaagaaaagaaagcggggtaggtcgggcagcccctggctgggggctcccccggcgcccctggggccacggggtcgtcgccgccgggctccggccgcagtagggacccgggcgccgggagggacggggagcgcgcccctccgctgctgctgctgctgctgctgctgctgttgctgctgccgccgcctctgtcgcccgtaccgcaagcgcaggaagcgcttcaggaacacttggcagtggtagagcgccagcacgtactgcagcgccaggtccagcgcccctggcgccaccgcgacccccgccccgccgcccaggctgagtagtagcgcctggcccgctagggtctgcagccccacgtgggccgaggggtagaggaggaaattgaagacgaaggcgttgggacagcgccgctgctgcaggtacaccttctccagggcgaaatgggtgagcgagtgcagcaggcagcggtagggcgaggagaagcctagcatccgcaggtccgggctgcgggcgaagcgccgggccgaggacaccagcacgtccagggtgatcccgtgcatcccgtagaagtagaggcgcatccaggcgggcagcgtggcgctctcagccggcgcttcagcagtggacagcggctccgggcagccggctgccgcctcgcttcctggcccgccaggggcccccggacgccgcgccgcgccgcccctccgtg

SEQ ID NO: 96283 - DNA, 157 bp, Homo sapiens; identical to SEQ ID NO: 31517
  chr7:123673226-123673383
  hyper

SEQ ID NO: 96284 - DNA, 137 bp, Homo sapiens; identical to SEQ ID NO: 31518
  chr7:124404361-124404498
  hyper

SEQ ID NO: 96285 - DNA, 674 bp, Homo sapiens
  chr7:124404543-124405217
  hyper
cggaaatgccagcgcctctgggacccttctcttcctcctctgagatctgaaggaagagctggagggccgtggggttccctctccccaaagtttcagaaggctcctgaccccgagcacctttccacctccaggggccaggtggcctggttggaggtcccgggggtccggctgccgacgcctccgcccctctgcctgcagccgggtcacggcccggggccgccggcaggtcccaggagggtcccgcaagaaacgctgccccctgctcctccctgggtgctcgggctcgcagaacgtctcttgcagaatttcccggtccccaggcgtccctgccgcggcgctggatcactgtaggtgcacagctctcccccagacaagtttcgtttctggacgcaggggcgaccccgagggcagaagaggcagacaccttgagcagtagcagaagcagtagccgcgacatgcgggcgagaagcgcgcccggggctcgcatggcttggtgagggcacacccggcagccgcagctcctgcttagttaggatcgacacctgctgccgaagttgctgctgagagttaggcacatgtcacatactcacccccgcccgggtagcggggaaccggagattagggtgatagcggaagatcggtcttgggggtcacacacacgccccctataatcc

SEQ ID NO: 96286 - DNA, 671 bp, Homo sapiens; identical to SEQ ID NO: 31521
  chr7:124405556-124406227
  hyper

SEQ ID NO: 96287 - DNA, 30 bp, Homo sapiens
  chr7:12442920-12442950
  hyper
attcaggtccacttgcggctagcatacctt

SEQ ID NO: 96288 - DNA, 424 bp, Homo sapiens; identical to SEQ ID NO: 31058
  chr7:12443294-12443718
  hyper

SEQ ID NO: 96289 - DNA, 30 bp, Homo sapiens
  chr7:1252449-1252479
  hypo
tgcgtttggagatcacgcttgctctttctc

SEQ ID NO: 96290 - DNA, 30 bp, Homo sapiens; identical to SEQ ID NO: 31059
  chr7:12610212-12610242
  hyper

SEQ ID NO: 96291 - DNA, 29 bp, Homo sapiens
  chr7:12610636-12610665
  hyper
ccgacgcaccaaggccggcgaggggaggg

SEQ ID NO: 96292 - DNA, 35 bp, Homo sapiens
  chr7:126325948-126325983
  hypo
accagaaggtgaactcgtagcgcttttccctgggc

SEQ ID NO: 96293 - DNA, 615 bp, Homo sapiens
  chr7:1263658-1264273
  hyper
cgctgcgtggccttctccgggaggtggggggaatccgaagaggtcccaccccaggttcggttcccggcttcctggtctttgtttaccaggctccgaggaggacctgcctctctcctcccgcagccctgggccccccactcgacagtttcacatccagggagggacaaagggggacgcggccggattagctttcgcagcgcgcggtgcgttcccggggtgcagctgcttcggggcccctgccaaggctccggcttctgcaggcgggactcgggctcgggccaccaccgcgagcactttcctggccagctccgttcccgccccatcgggccgggccgggccgagctgagcggggcgcggagaccgcggcggacggtggggagagcgcgcgcgcgtccatccgatttcaggcctttgttgccggagcctcgtgccgatgggttaatggggcagaagagatcggtgaagggcgacagaagcggcctttgaaagagggtgtcagcgcggggcagcgagacaaaggccaaaacacacacgggcggagagggacagatggggacgggcgagggaaaacaattaggccgcaagtgcgggggcggggcgcggctccatcgtttt

SEQ ID NO: 96294 - DNA, 490 bp, Homo sapiens
  chr7:1265078-1265568
  hyper
atgaatccccctgcccgtaaataacaagagctgcgtcctggcggctgaccgtagccaccccgtgtctccctgcgggatgacctgagagcgtttcctggaagccgcgcagcccctctcccggcctccaccatcggggccgctcaccctctggggactctggccccgggaccccgggatccaggcccggtgcgcgcggctccggccccgagcgcgctgtccaggctggatccccaccaggcggcgctgcgcccctccgagcccgcccggccgcgctctgcaaaccgatgctgtttaattaacgtgcaaattgagtagattaaatgactctaaataattagccacagatcctacaaacaggataacagatttaattaagcagcgatatagattttggaaactgttaatgtatttttagaatggcagctcagatccttcacttttcccccctaacttcaaacatgtaactacggccctccgaacgtggataaat

SEQ ID NO: 96295 - DNA, 2032 bp, Homo sapiens
  chr7:126891206-126893238
  hyper
gtctgttttcacccccgctatcttgggtgcgcagacactctctgacaccaggcttcacagtttgggccacgggggaagtaattccccagggaaccgcgggggtgcggttttgcgcaactgggtgactcgcgtgtccctccgcatttcatttgcaccaagggagcgcgtgtcagacgaagggaatttttttttcttttttggtgattctgttattttttcaccaactgtacgaagctcaagggatatccgagctttctggctgggcggatgggcttcgcgcttggcatggctgagcggtccatctctacctctccgtttctatctctaccataacagcgaccactcagcccgccaggagcccctgtttcccagcgcaggttcctttttcttctcagttccttgggctgttgaagccgggttctgggtagatagagactggggccgtggggagagcgccaggctgcttttgcctttcccgcgccccggggcattccggcgcgctggggatgcagcctccgcccccgccgcacctggccgcccgagcgcccgcgcccacgccccgcgcggggccgcccgaaactggggccgcgccagccgcgggagctaccgaggagctgttggggtgcgtttgcctttgctttttaaacaagatccccgagaccttttctccatccccccaacccccagcaggacacggaactccggcgtttctcgaaagccacaaaagaggggcacggaaatcccaagctcgccgtgctaactcggagaacgcaaactcgaggcagagcgtgcgccgtgcggggatgtgggtgtcgaggaccccgaagcgcccggcttcccccgcgacccccatcctccctagatcctggttagacatccatccagcccacgctcagagggcgggggttaccccgactcatcccggaagccgctaacttcagaaatccctcctgttaggttcgcgaaacgaaggtacctcgtcatctcggcggggcaagtccggattccaccagggcaggtccgggaggtcacccagggcagacgatccgaggcagagcgctttaaaatcctgccgccgcacgcccagtcagagcgccgagcgcgcctgcccccttcccgtcacccttcagtctcccattcgccgactaaacttttgggggatcacatctccaagccttgggagttccgggtaaagtctccctcttttctgaacctctttactgtaatgtaatcatgggcagacaagaggggtggctgccttgttctttgcaacgtaaaatcaacagacacccaatcaagctccaatgcccggccagcccctcgccccctggtgcccactctccttctccccccattcccgtcacctccgcccgctatttctctcacagactacggacatgcagggccatctacttgtgctcaggaaaaacaaatcactagagtgatatgagaaggaatggtgcacctggctgtccgctgaaaggttttagagaagaaaacggaaaggggaataaaacggggggattctccttttccaacaagcagggcgttttggggaagtttgggggccaggggctttttgtcccgtggttcggcacttgctttcctcggagccgctttctgctgccgggcggcgagtcttaccctgctccccgcagagggcgcggtgaggaagcccgccgggggcccgcagctccatgtcagcgccgccgccgccgccgccgccgccgcgtgaggcgagcacagcggccgcacttgtggctgatctctgggctgagggggctgagctggcctagcaggcgccaagtctcttccatgtgaataacaaatactcccaccggcggccgcgattggtctgcgcccggcgcctcccgatcctccgcccgcggccattcacccggcgcggcgcggggagccgcggccaggatcgcgcccgggatcgccaatcgcttcgcgccaaccagtcacctcgggaagcgggaggaggaacccccgaggggcgggagcctctggatttcggtgtcacccagcg

SEQ ID NO: 96296 - DNA, 47 bp, Homo sapiens
  chr7:126893442-126893489
  hyper
tgtggaggagcccagcggctccggctgcctggcgagcccgggaccgg

SEQ ID NO: 96297 - DNA, 267 bp, Homo sapiens; identical to SEQ ID NO: 30973
  chr7:1269197-1269464
  hyper

SEQ ID NO: 96298 - DNA, 256 bp, Homo sapiens
  chr7:1269552-1269808
  hyper
cgggctggaccgggccggggcgcgtccggcagcgctgagaccccccaccccgaatcaaagtagcggcggctgcgggggcggcgggtgggtgggggggagccgaggaacacggcgaggcgagcggcgtcctgaatgcgagtcgtgtgcgtcttattatcaagttaattaaagctagcatctgacaatgtcactcggctgtagaaaaagggatttaaatgcagcgtctcccaggaccgcgtgtcgagggctgcttccc

SEQ ID NO: 96299 - DNA, 101 bp, Homo sapiens
  chr7:126987739-126987840
  hyper
ggctcaaaccagggacggcgagggcaaggggtgaaaggggtttgaggcgaggcagaggactcaggggtctgcggacggctggtcggcccgtggagacggcc

SEQ ID NO: 96300 - DNA, 49 bp, Homo sapiens
  chr7:126988157-126988206
  hyper
aaaccaaggaaagagcgccgacgcctctcagccccgcaagagctgcaga

SEQ ID NO: 96301 - DNA, 674 bp, Homo sapiens
  chr7:1270100-1270774
  hyper
gagccgggcgggggtcgtcccggccgcccccaccgtcattaaaggcccctctcaaacactcgaggaggttttcggagcgcgagccggcccgacagcatgaaaaacacagggcgattgaaatgcgagcattgggacgcacggagccgccgcggcgcggactcgctcttgaggtcaagtgacggacggattgtatgcttcttcataataatattaattaaacaatttgcatgctaataaggtaacaattatcagggcctctgttgaaagattcgggttattacaacacgccaatctgaaggccaggggtcagagagtgagaggcgagcgaaatttcaactcaaattaacattctgtcagctccagaaaatgggataaataaagtcgaattaattcattataataaagagagatgggcgagggagctcggccggcgcgcgcccctcctctgccctccccccgggccgaatagattacagctctgtattcagaaacacgcgccgcgcgcattcctcctcgcgaacccaacagaagaccaggcgcttgtggctgctggcgaaatcgagtcggatggacggagtttacatttagtatttatagagacagaaattaaattatggcgaaaagtagtgctcttggcctctgacctcggaatgaatactcgcagcgttttccta

SEQ ID NO: 96302 - DNA, 206 bp, Homo sapiens
  chr7:127061193-127061399
  hypo
tgtggtgtgaagtatcgcaaatgaaaaatgaaactaggtttccggagaaattgcctcctctaagctgcattcacgtctcagtggtcctcaaaatgtagttcccaggccagcagcatcagttatcagtcaggtggaaacttagaaacacaaaggttcaagctcctctcctgggcatattgaatgagaaactccgcaatctgtgcttt

SEQ ID NO: 96303 - DNA, 123 bp, Homo sapiens
  chr7:1271038-1271161
  hyper
cctcctgagcgtttccggcaccccccaccctccccggcccaggcacgggcacctgacccggagggacgcagagatgcgcacggtcccggcctgcccttccctctcacgcgggctagggcttgg

SEQ ID NO: 96304 - DNA, 214 bp, Homo sapiens
  chr7:1272298-1272512
  hyper
ccctccggctccccccgcccccagcccgtcttgttgtgacagttcctgatactgtttattgaggtgcatgtcaggtataattagcaatcgatatggaaaacgtttccctgcacccagcacgcctctgacgtcagagccgattagcgcttcttattggtcccaaattccccgggccgcggctaattatcgggagcttgatgttgataagtaaagc

SEQ ID NO: 96305 - DNA, 875 bp, Homo sapiens
  chr7:1272513-1273388
  hyper
ccggagtgcgggcgaagcatgtgtggggctccgggtccctgtctccgccgccgccgcccgcgcctcccgccgctggcccgccccggccccggcccgcgcccccgcgccccgccaccggccccgccggccccccgcgcgagatgatggacggccgcctcctggaacacccgcatgcccagttcgggggctcgctgggcggcgtggtgggcttcccctacccgctgggccaccaccacgtgtacgagctggccgggcaccagctgcagtcggccgccgccgccgcctcggtgcccttctccatcgacggcctgctcgggggctcgtgcgccgccgccgcctcggtggtcaaccccacgccgctgctgccagccgcctgcggggtcggcggggacggccagcccttcaagctgtcaggtaggcgcggcgggcgggagggcggggaggagtgcggctgggggcgggggccctggtccggccgaggcgctggggggcccggggctggcgaaggagagccggctcctaggcggccgtctctgcgcccccccccccggatccaggcggccagcgggtagcgggagggaggggtgggggtcgggcctgggccggtggctgagccgcgctgcgtcctgtgactgcccgcagactcgggggacccggacaaggagagcccgggctgcaagcggcggcgcacccgcaccaacttcaccggctggcagctggaggagctggagaaggcgttcaacgagagccactatcccgacgtgttcatgcgcgaggcgctggcgctgcgcctagacctggtcgagtcccgagttcaggtaaagacccggcgtcgctcccggatctgccatccggaccccaggctctgggcgcgc

SEQ ID NO: 96306 - DNA, 100 bp, Homo sapiens
  chr7:127253534-127253634
  hypo
gtagccagctttccacgggccactgaatcaggatactgcccacgctggaactctgcggagatcgagtctcacaaagtaagggcaccgggagaggagcaag

SEQ ID NO: 96307 - DNA, 181 bp, Homo sapiens
  chr7:127260532-127260713
  hyper
ctcagctttccagagcgcacgcgccacctgtccaaaaccgttctctggcggcctgtgcctcccactttaaagtcaaagtgatttccttgctacaaaaacacggaggctattcgagttccctgaaaattctgaacttgagaccctcacgccaaagttgcgctacccccgcaaagctttatgc

SEQ ID NO: 96308 - DNA, 366 bp, Homo sapiens; identical to SEQ ID NO: 30980
  chr7:1273589-1273955
  hyper

SEQ ID NO: 96309 - DNA, 30 bp, Homo sapiens; identical to SEQ ID NO: 41439
  chr7:127371129-127371159
  hypo

SEQ ID NO: 96310 - DNA, 493 bp, Homo sapiens
  chr7:1274432-1274925
  hyper
cgttgggggagggctcggcttcatgctggagacctccccatggacaaggctccctgcgacaaggctgggcctgctattgtgcaagtctctgtgtggccgcgacaaagaatccgtattaacgcgccctcctggggagggcaggactgcccgagcttccgcggggctcagacggatttgactgtgtgtgtttggtggctggcggttgagtgagggtgtagcgctgccgtccccggatgtcctgtgtggctccccaggacaaggactgcagagaggatggaagagacgcgatgggcccagcctctccttccggcctggtggtcgcctcttgcctccccacctgccttggccggtggcccaggccaaggaccgcaggtttgggaaggctccgttggcgccctggcccagggtttgcggaaagaaggctgtgttagctgtgccctgggagggaggctgcagaggcccacccaagtacggctccccaggcccttccgga

SEQ ID NO: 96311 - DNA, 147 bp, Homo sapiens
  chr7:1275045-1275192
  hyper
cggcaggatggtcagcgccaggccgggcgggctgcttagaacacgagccgtgagcggccaggaagggtgaacaggggccttgctctctagcctccggaccaggaacccgacgctctccgtccggggccagaccggccccccaagtaa

SEQ ID NO: 96312 - DNA, 44 bp, Homo sapiens
  chr7:12750788-12750832
  hypo
cagtgctgggattacagacgtcagtcacccggcccggccgacac

SEQ ID NO: 96313 - DNA, 30 bp, Homo sapiens
  chr7:12751560-12751590
  hypo
gtgagccaccgcacccggcctgttcattct

SEQ ID NO: 96314 - DNA, 139 bp, Homo sapiens
  chr7:1275543-1275682
  hyper
actcgcacccgaccacgtgcagcggcgagcccatggacccggaggagatcgcgcgcaaggagctggagaagatggagaagaagaagcgcaagcacgagaagaagctgctgaagagccagggccgccacttgcactcgcc

SEQ ID NO: 96315 - DNA, 184 bp, Homo sapiens
  chr7:1275733-1275917
  hyper
cggcggcctgtctccggagccgcccgagccgccgccgcccgccgccaagggccccggagcgcacgcctcgggcgccgcggggaccgcgcccgcccctcccggcgagccgcctgcacccggcacctgcgaccccgccttctacccgagccaaagaagcggcgccggcccacagccgcgcccaggt

SEQ ID NO: 96316 - DNA, 30 bp, Homo sapiens
  chr7:127615921-127615951
  hypo
gttagtaggcaggtccggctccattcagca

SEQ ID NO: 96317 - DNA, 131 bp, Homo sapiens
  chr7:1276436-1276567
  hyper
ggggactgcgcggacgcggggaccgccggccccgcgcccccgccgcccgcgccgtcgcccaggcccggccctcggcctcccagccccgccgaggagccggccacctgcggggttcccgagcctggcgcggc

SEQ ID NO: 96318 - DNA, 567 bp, Homo sapiens
  chr7:1276989-1277556
  hyper
ccaagcgcccagccccgccgcccttcccacctttccacgcctctctccgcgggtggggcccggagggggccccgcacttcccgggggtctgcgcttaatgcgtccttttgtgtgcgtgtgtgtctgtgttttctgattcaacacatttatgcatctgcggctcccggtccccgcccgccccggcgctccccctcctaccccgcgccgcacacgcacgctcacatccgccgcgcgcccccgcgcgcactggcacacgccggggcgcgcggcgcggggtgacggagccgggggctgcgagggccgggccgctgggctcctgcagagttttgatatgaaagtaattattttccggtggctgctgcggggactgggtttcttgcccaaagggttattatacattaccgatttctagtgatatggaatcacataaacttcctacaataatagaattagcatgaaaggctggggtgtcaaattgaaattggagaataatagcgccggcagctgggggagtgcgtgcgcatattggagcggagatggggaatcgtggggcggaattttcatgag

SEQ ID NO: 96319 - DNA, 153 bp, Homo sapiens; identical to SEQ ID NO: 715
  chr7:127744057-127744210
  hyper

SEQ ID NO: 96320 - DNA, 499 bp, Homo sapiens
  chr7:127744211-127744710
  hyper
cagctgcagaggggcccccctcgacgcatacactcaagagcccgaccgcgcggctgaaatcgcggagctcggagccgcggctggctgagcgatcgcggttcctgggctgcgtgcgcgccccttggagctgaaaggagcgccaggatcgggggcgctgcaccgggctgggcccctcaacgctcgcagaccgggccgggctgcagctggagatggcagcaatcccgggaggtctccgggcctcttcagggtgcgtccaggaggcgggttccgtgcgacgcggcgcagcccacccccacgagaccgcttaacttcgcgggggcagcctcgggcgctcggagacgcggaggcccagactgcagcctccggatgctggaagcccagactccctggggtcaccggctctcccgccaccccagctgcaaagagtcccattgcttcaccgtccggagcttagtctccttgttcctctaccagtccctccctccgcaggtctctgggg

SEQ ID NO: 96321 - DNA, 23 bp, Homo sapiens
  chr7:12776931-12776954
  hypo
agtcactgcgcctggccagtgtt

SEQ ID NO: 96322 - DNA, 141 bp, Homo sapiens
  chr7:127776269-127776410
  hyper
gaggaagcgggtccccgcgccctgggttccgattctggcccgaggctcagctaggatggccccagatcccagagaacgtcctacctagtgcccgtttctacacctccccctcccgccccagagttacgggttaaggagaaa

SEQ ID NO: 96323 - DNA, 151 bp, Homo sapiens
  chr7:1277825-1277976
  hyper
ccagccccgcgcccccgcccctgcccgcagccgccccatcccaaagtgaaccgccacccgtcctccatctccccccacccccccaaaaaccccaacccactggcctcaattttcctgggccctgggtcctcgttgccgcaaaagccaccaa

SEQ ID NO: 96324 - DNA, 897 bp, Homo sapiens
  chr7:127806266-127807163
  hyper
ccacgaaggtcagtgcgtggttgcctgctcatcatctctgtggtcagcaaggaacaaaggccaataggagaatacctggggtcagggggctgggggaacggcgtgctgtgcaagacatcagtaggctctgtgcatgcacagagaccttgggggacgtttccctaaatctcaggcacactcttacaccctctaaccccccgccaccccccgccagaaaaaatctcaccctgggcgagacaagcccagggtgaaatgaaccaacagggacctctctgcgcccttcacccggttcctctgggaggaaggggaacgccaatgcccgggagcggcctttgggaggaaggggaaggctaatgccctctcaaatgctcttccctgcttcccgcatctactcaggtgtgtgagggagcccgcggaacccgctctgcccagccggcgcgccctcgaccgccctcggagttccgcggctccgcgcgccgcctccccgcctccgccgacattccgaggctccgcgtttgccatttcgatctggaggcgcattctcctcaccctcggagagagactgggtcaagggcccaggctgggaagaagggacagctagtaaaggaactctgcccgcctggccggcggagagccgcagagagaggacgctcacaaaagtcggtcgctacccggcccaaacgattgtggagccggcgagagcaactggtcccccagtcctcctccctggaggaggtgcgggggcgcggcaggcgggcttggcccaccccagccgaggagcttgtgggggacggcgggcggccggctggacccctgcagggcttcccccactttcgggagcccgagcggccgagggagaaagggcaggggctctccgccgtccgtctgggagagcag

SEQ ID NO: 96325 - DNA, 1247 bp, Homo sapiens
  chr7:127807478-127808725
  hyper
tctcaaaatagtaggcgagcgcggccggcgctgccctggcgaggggtgggggctccgcgctcgctcgcgcgagccgagttagctgcagggttacaaacagtatctccctgctcccccggcctgaattaatgtgttactatttcgggcgagccagtgtttccaggggaaacctaatgacgcaatgacgtcaatgcaggtcagcagcagactctccgggagggcgggcgggctcccggctttcgggctcggcgcagtctgcgggcgggagggcgccggcgaggtggcgagggcggctggcgcgggggcgcgggagccccggctaagcccggggacgggagggcgccccctcccagcgcccgaacccaggcaacttcccgccgcccgggcaggagtttctccgtagcccacggacatccgggaggcttgtggagggcaggcgggtaacccccactcccaccccacctttatccaggggcagccagaggagccagcaggtcgggactcgctgagggggctccacgcggggcctcccacgcacaggtacgcgctggtcctcggggtgtccccagtttgggagggagacacgcacagtcgctcccgtccacactcctctcgtgtcctggctccatgactgggagtctggggaaagaagaatgggtgtctgagacctacccctccgccggtgtcgccccgctctttctgggcgtaggagcgggctgcctgcccctctcccgcaccttcctggtctcgggctagaactggggcttcccatcggccgcgcttcccttaggggcgccatctgaggtcggaagcaaagctggaggggcgtccaggccagaggacgcgggctggggcgggagcctcggcagcctggtgggagctggtgcccactgcagggtgcgtgtacggggctgcctgcgtgtgcttggtgtgtgtcacttctgggagcgtaccccgtgtgtccacggggtgtgtatgcgcccacggaagtcctctgtgcatgcgtgtctgtgccataggcgtgggaacacctcgtgcacccatggtacttgcccggagagtaggaagccagcgagggagcggccctgctccagggtctcttccctgctcatccctccagctggcccagattacaccctactcacacccgggtcgcggcccactttccccatagccgcagcttccggcggctgcacacttcttagtgctcatcctgccttctcgccccaactcgttgtgcccttccc

SEQ ID NO: 96326 - DNA, 234 bp, Homo sapiens
  chr7:1278288-1278522
  hyper
gagcaggggagggggcgggatccacgggaaggagacctctgcgctggttgcccaactctgggacaggccgcccccagtggaagccaggagttgtcggggaggggacgcggggttcccatggaggtcgcaggagctcggccgcagagcctggccctctgcccctacccctgcttcctggggtcctgcagcctgggcctccccacaggccggccagggccgcgtcccagcagcgcg

SEQ ID NO: 96327 - DNA, 71 bp, Homo sapiens
  chr7:127841202-127841273
  hyper
tttacagttaaaaggcgttagcgctggcctttgagacagactcactgagccacccaaggtcacccgggcag

SEQ ID NO: 96328 - DNA, 159 bp, Homo sapiens; identical to SEQ ID NO: 3109
  chr7:127841338-127841497
  hyper

SEQ ID NO: 96329 - DNA, 225 bp, Homo sapiens
  chr7:127841625-127841850
  hyper
cgcctccttcctccgccggcttctctgtctgcctcccactgtccctattctgcccttcacagatcgttgtcattatcaagtcctacactttgagagcagaaaacgaccccgtacgtggtgggtctccgacatctgtttattacgttggaccgcatgctgcatatgatccagccacctcgctctactcctgtggctgcccttcgtcctcgtcgccgggacccctct

SEQ ID NO: 96330 - DNA, 30 bp, Homo sapiens
  chr7:1279210-1279240
  hyper
tagaatattaagagccgagctgcagaaagg

SEQ ID NO: 96331 - DNA, 30 bp, Homo sapiens
  chr7:127982386-127982416
  hypo
gagaatctttcaaaacgaatgccagatcac

SEQ ID NO: 96332 - DNA, 200 bp, Homo sapiens
  chr7:1279875-1280075
  hyper
ggcggccttccactgcggctccctccgcgtccgatgccaggagagggtgggagtggaggacgcggccccctgcttcgctaggtaggggttcctggctgttctaggcggctgctcttctctgctaggtggtgcctctgggcggggagcaggggcctcctccacaacgcggccagggtctaggagtgcggggcaggaggtcc

SEQ ID NO: 96333 - DNA, 82 bp, Homo sapiens
  chr7:127991661-127991743
  hyper
gcagcagcggagccgcgtggcccggggacaagcggaagagcttggcccagcagcgcggcggcacgcgaggactgcagagcgc

SEQ ID NO: 96334 - DNA, 136 bp, Homo sapiens; identical to SEQ ID NO: 31537
  chr7:127991787-127991923
  hyper

SEQ ID NO: 96335 - DNA, 275 bp, Homo sapiens; identical to SEQ ID NO: 31538
  chr7:127992044-127992319
  hyper

SEQ ID NO: 96336 - DNA, 180 bp, Homo sapiens
  chr7:127992371-127992551
  hyper
cgcgtggtcccggccgacagcagcagcaggtccagcagcgccaggcagggggcgccgggcgggcaccgccagggcaagagggccagagccagcagcgccagcaaggcaaccaggccgaagagcgcgcctaccccgtacacgtgggcctcccaggccagcccccagcgagccctggcctct

SEQ ID NO: 96337 - DNA, 15 bp, Homo sapiens
  chr7:128001006-128001021
  hyper
cgtcacatacccccc

SEQ ID NO: 96338 - DNA, 157 bp, Homo sapiens
  chr7:128002255-128002412
  hyper
agcttggtagaaactcgaaccgtctccctgccggccctctccaccacctggtggttttcaacagttgcactgctacacagcagtgcctccaacacttcaccggtgaactgccaaatgccaatccctgtgtgacatgtcttttcgctaaaactgatct

SEQ ID NO: 96339 - DNA, 1250 bp, Homo sapiens
  chr7:1280349-1281599
  hyper
gatttatttttaacccgaggttgtacaagcccctgacagtttggataaattagccaggcctcgcagtctcctaatgagagggtattatttcggcacctcggaaggagcgtgaaaaatgagagagactccatccggaggtgtcggatcgattcaggatcagggtgtaaattatatacaactaaatatccagccgcccataccgctgcttaatacggagcttagaaatgcaacattaaacaaagattatgagagatcgacgcctctggaccgagcccaattcactgctcagccgggtcagcccctgccccgcgggccgaggatggggagggggcgcgcaaggagtgaaaacggcgagtttgggatgagagccagggccaggaggggagcctcgccctcgctactccttccctttcttctaaagccagggagctccccgcccagcattgcccgttccttcctccccgccagggcccagagaaatccgggctccagcaccgggcctcagtttcccggaagcggacttgggccccgatcccgggccctctccgcccttcccaggtctcaggcgtcgctgcgtggaggaggcgcgcgtggctcccggcgccgatgtcccggcccggaaccctgcccgccgctgcgactccggggcgggggtgggtcagcctcgggggcggccggggtgggcgtggaggtggacgcggggccgcatattgggcgcttggttctgtttatctcacttagcggtggagggactggagggaaggggcggcccgaagggaggccttggtggggcccagcggctccctggcgcaccccggacacggtggccacgaggagccggggctgtggccgagggctgcccgcaccccgagacccttcctcgtgggcccctctgcccggggcgccgcccagagggggcccggacggaaccccccgcgcggggaaccaccgggccgggcagagctggcgtgagtatggagggggcgcgtggggacagaaaccccgagctgggaggagcggggcgcggggctggccagtctgcggctctctgggccccgctgggcgtcctcccttcctcccggccgctctctccttgcctttccggggtctccccgcgcccggcgcccctcgcccagccgtgactccctttcctctcggccgcccgactccgcgcgcccctctcggcttttccgagctgggatcaccctccccgagagaggagcgggccattgccgcgtgtgggtgttgca

SEQ ID NO: 96340 - DNA, 102 bp, Homo sapiens; identical to SEQ ID NO: 41440
  chr7:128096987-128097089
  hypo

SEQ ID NO: 96341 - DNA, 101 bp, Homo sapiens
  chr7:128097589-128097690
  hypo
agacaagctgagcaccgttgtaaccagagaactattactaggccttgaagaacctgtctaactggatgctcattgcctgggcaaggcctgtttaggccggt

SEQ ID NO: 96342 - DNA, 23 bp, Homo sapiens
  chr7:128126053-128126076
  hypo
aagaaaagcacaggccgggcgtg

SEQ ID NO: 96343 - DNA, 331 bp, Homo sapiens
  chr7:1281819-1282150
  hyper
actttcaataactatcgataatctcatctgcacagaaccccccgcctctccgcgttatcggaaagtttgcagcgtttcccgagcagcgcgggcaaggccggacctgcggtggagccggcacctgccgctccgcccgggattagggagctcccggcttgtggggggtgcgggcggccggtggtccagctcgcccgccccggccgagacgctgggcccggcccccacaggctgcgcctgacgggaccggcgggaggcctttgttcgcagcccggaggccccaggctccaaaccacactcgggctgcggggagcgagcgcgggcgttgccgcta

SEQ ID NO: 96344 - DNA, 175 bp, Homo sapiens
  chr7:1282506-1282681
  hyper
gtttctgcttgcaggcgttcctgcagtaggagggcgcgcagaggcccagagaggggaagggacttgcctaagatcacacagcgtcccagaggccttactgggcaggggagggggtggcccggccgggccctcgcgcgccggcttctgctgattctttctgcggcctgataataag

SEQ ID NO: 96345 - DNA, 103 bp, Homo sapiens; identical to SEQ ID NO: 41442
  chr7:128315917-128316020
  hypo

SEQ ID NO: 96346 - DNA, 138 bp, Homo sapiens; identical to SEQ ID NO: 31541
  chr7:128337405-128337543
  hyper

SEQ ID NO: 96347 - DNA, 134 bp, Homo sapiens; identical to SEQ ID NO: 719
  chr7:128337787-128337921
  hyper

SEQ ID NO: 96348 - DNA, 315 bp, Homo sapiens
  chr7:1283626-1283941
  hyper
gacacaggggctttccgggatcgaaaggtgtttcttccctttctaagtcacgtcaggccacctccgaccccagccgacacgctaccaggcctgcaccatagaagtgggctctgagagtgttcccaagccctgggggagggggactccccagagatcgtgtccccgacccctccttccgggcccactgctgccatcccaaacccagccccccagcgtaactcgcaccctcatcccctttcccgaggaatccaaactccggtttaatgagtcgtgaagtgtgagaacttccggagcccgcagcgcccctgatgccaa

SEQ ID NO: 96349 - DNA, 47 bp, Homo sapiens
  chr7:1284177-1284224
  hyper
tcctcggagctatttcgggggaattcaattttcgctgaatggtgaga

SEQ ID NO: 96350 - DNA, 173 bp, Homo sapiens
  chr7:128430709-128430882
  hyper
agagtgaacatcagtcgtgcccactctgagcgggctactgtgggggcgtggctcgcagcccaccgggtgtgggaccggaagggaagacagggcggaggagagggggtcttccggccctgaggcttgatggggccaccggagggctcctcctaagagggtccttggccctggct

SEQ ID NO: 96351 - DNA, 34 bp, Homo sapiens
  chr7:128430922-128430956
  hyper
cgttcgcccatccgggcctcgacttccctcctcc

SEQ ID NO: 96352 - DNA, 624 bp, Homo sapiens
  chr7:128470433-128471057
  hyper
ttaaaccccccgccccggcccagcccgcccttcccgagcaccgctccggccctggagggagagagagccagagagcggccgagcgcctaggaggcccgccgagcctcgccgagccccgccagccccggcgcgagagaagttggagaggagagcagcgcagcgcagcgagtcccgtggtcgcgccccaacagcgcccgacagcccccgatagcccaaaccgcggccctagccccggccgcacccccagcccgcgccagcatgatgaacaacagcggctactcagacgccggcctcggcctgggcgatgagacagacgagatgccgtccacggagaaggacctggcggaggacgcgccgtggaagaagatccagcagaacacattcacgcgctggtgcaatgagcacctcaagtgcgtgggcaagcgcctgaccgacctgcagcgcgacctcagcgacgggctccggctcatcgcgctgctcgaggtgctcagccagaagcgcatgtaccgcaagttccatccgcgccccaacttccgccaaatgaagctggagaacgtgtccgtggccctcgagttcctcgagcgcgagcacatcaagctcgtgtccataggtcagtgccggggg

SEQ ID NO: 96353 - DNA, 154 bp, Homo sapiens
  chr7:128471125-128471279
  hyper
cggggagctgagagacagggcggagggcaccccccggtatagagagaagaccctggccccggccctcccacccatcgacaagggccatgggcactgcctgcacacccctctggggacagcgagcactccctgggtgccccggggagtccaggcc

SEQ ID NO: 96354 - DNA, 30 bp, Homo sapiens
  chr7:128481374-128481404
  hypo
tgcccacatcctgcccgccccacctgactg

SEQ ID NO: 96355 - DNA, 30 bp, Homo sapiens
  chr7:128482220-128482250
  hyper
gcggccagcagagggcgctctgcagaggcc

SEQ ID NO: 96356 - DNA, 106 bp, Homo sapiens
  chr7:128482943-128483049
  hypo
tcaccgtcaagtacacgccaccaggggcgggccgctacaccatcatggtgctgtttgccaaccaggtacctaagctcctgggtactcacagcgacatgcacctgcc

SEQ ID NO: 96357 - DNA, 50 bp, Homo sapiens
  chr7:128484931-128484981
  hypo
cccacatccctggctcgcccttcaaagccaccattcggcctgtgtttgac

SEQ ID NO: 96358 - DNA, 142 bp, Homo sapiens
  chr7:128486098-128486240
  hypo
cacaggcggcaaccacgtgacggctcgtgtgctcaacccctcgggggccaagacagacacctatgtgacagacaatggggacggcacctaccgagtgcagtacaccgcctacgaggagggtgagggccggtgggccaggcta

SEQ ID NO: 96359 - DNA, 128 bp, Homo sapiens
  chr7:128493102-128493230
  hypo
gagcccccattccagcgggtgcctcccacaggcacttgtcctcgtcctgcccagcacccccttggccgcactctctcctccctgaaacttcctgaccagtctgcgtcaggattcgcattctggggccc

SEQ ID NO: 96360 - DNA, 30 bp, Homo sapiens
  chr7:128494242-128494272
  hypo
ttcggcagcatcacccggcagcaggagggt

SEQ ID NO: 96361 - DNA, 30 bp, Homo sapiens
  chr7:128507583-128507613
  hypo
ctgaagatgcaaattcggaggtcattggaa

SEQ ID NO: 96362 - DNA, 120 bp, Homo sapiens
  chr7:128510078-128510198
  hyper
cttcgggcgggtaagcgcagcccacgccccctcccgggcggcccccagctttgccaccgccggtgccgacctttgtggctcgcctttgatcatgctctgcgtcagcgtggtagtccttct

SEQ ID NO: 96363 - DNA, 40 bp, Homo sapiens
  chr7:128525170-128525210
  hypo
tcatggggcccttggcggggctgggcgcaagagctgatgc

SEQ ID NO: 96364 - DNA, 389 bp, Homo sapiens
  chr7:128528743-128529132
  hypo
atacaaacacacagccgtgcccgggacctctatcaaaggtgagggagtcggagagtgagagaaaagtatggtggagcggcaggcagtgggagggctgggaggaaagtggaatcggtgagaaaggcaccccgggagccccagcagggggaatggaagggcaggtgtggctctaccctggcaggtcgggcagcagtgcccagaggggatgagtgggtggctgcagcccggaggctcacagggccggcggccgcaggtcacgaagcctccaagacaggtacacaggttgcagggttctcgggggtctgggaactcctggttactcaggtaggactcccccaggtactcacagcctttcagagaagagacagagaggccgaggggagggacag

SEQ ID NO: 96365 - DNA, 156 bp, Homo sapiens
  chr7:128531803-128531959
  hypo
tcctggcaggggtctcgggggtgggagaagctctcgccgtccacaaacacctcttcctccaggatgcagtctgggcagtggatggtgggggcaggtatgagggcaaagcctgacagtccctccagccctggagtccagagccgccacacaagtgcc

SEQ ID NO: 96366 - DNA, 41 bp, Homo sapiens
  chr7:128532991-128533032
  hypo
cttgacagacgcaggcggtgcagggccgaccatcaggctcc

SEQ ID NO: 96367 - DNA, 30 bp, Homo sapiens; identical to SEQ ID NO: 41449
  chr7:128533290-128533320
  hypo

SEQ ID NO: 96368 - DNA, 30 bp, Homo sapiens
  chr7:128555645-128555675
  hyper
gcccaggaactattgcgccccatccttctc

SEQ ID NO: 96369 - DNA, 104 bp, Homo sapiens; identical to SEQ ID NO: 30994
  chr7:1286007-1286111
  hyper

SEQ ID NO: 96370 - DNA, 84 bp, Homo sapiens
  chr7:1286670-1286754
  hyper
acaaaagagtaactccggagaattagagaaaaaacccacgcaacaacaacacgagtcgggggcggggtgagcgctccggagagg

SEQ ID NO: 96371 - DNA, 485 bp, Homo sapiens
  chr7:1286886-1287371
  hyper
cgaagggagtcgccgggtacccggctcaggccgtgtctgagcgccagggatgcgcagaaatgggagcctggccgcgcctctgcagcggccttggaggagcctctggagcgggccccgcgggcgcgtggggtgggacctgctggagacccgcaggcggcggcggccaagcagggtcaggcggttggcaccacaggtcgcgccctcggctgcagtcggggcagctccagggggccgcgtacctcccgcttcacggctacgcgtgggggcggctccgtcctggcctcaccagcctccccggagcccctgccggtccccagcctgggggctcaggggtcccgttgggcgtgtgtcccgcccgggccccggtgtggggggcgcgcagtcctcagggccgcctccctcccgcccccagcacagcgccccccagctctcagccggtccttgcggccgcgggatcccagccccagcagcgggaaactgaggcc

SEQ ID NO: 96372 - DNA, 18 bp, Homo sapiens
  chr7:128718421-128718439
  hypo
acccggccaagaaacttt

SEQ ID NO: 96373 - DNA, 35 bp, Homo sapiens
  chr7:1287623-1287658
  hyper
ggttgcttggcaacccgaggcggctcattaccgcg

SEQ ID NO: 96374 - DNA, 37 bp, Homo sapiens
  chr7:128767772-128767809
  hypo
agtggccaggctccccgcgtcccgctggtgacctgcc

SEQ ID NO: 96375 - DNA, 196 bp, Homo sapiens
  chr7:1288109-1288305
  hyper
ttcggtgctgaggtgcgtgtaggcagggcagtttgggtccccgcctttgtggaactggtgttctgtgcagaaggcgggcgggcagttgtcccctggaaaacaggaaaggagaggatagtgtttgggcctcggcgccagctgtgagcacagcgggtgggcattcctcacgcaggcagccttgcggagcagggaggtc

SEQ ID NO: 96376 - DNA, 536 bp, Homo sapiens
  chr7:128828104-128828640
  hyper
ggcgggcctggagaacggggcagagatggaacagaagtccccgttgacttcaggcatcccctgtctttcccatcctgagccaggagaaaagtccgcttcctgcagacgacctcagaccaagcaaggtgcccgccgagtctctccttgcaggtccggcccacgatttccactcatctctttcccccgggcgcggggcggcggcaggcggggtcaccagatccccctagcccgggcccctccaggcgccagggacgctgacgctcgcgctcttcctctctcgcctcccctccccacctctccgctccttcgtccagtccctcccccagcctcggcgcaggggggccgggcttggctccgcgaggcccgtgcattccagagagcccagcgagctagagcaacaaaggagccgggtcgccggcggggagagttcggggggctgcggcgcgctggggcgaaggtggctgctgggccgcgggctggcgcgggggcggagccggagctgcactcgcacccccggcccgcgtctggcctccctc

SEQ ID NO: 96377 - DNA, 475 bp, Homo sapiens; identical to SEQ ID NO: 31549
  chr7:128828904-128829379
  hyper

SEQ ID NO: 96378 - DNA, 301 bp, Homo sapiens
  chr7:1288552-1288853
  hyper
tctgagggagctttccgtgggatggctgggcctctgttgcagttgcgaccaatgctgcggtttaaattctccctgggtccaatcctgcttccctcccctaagcctctcgcacacacacctcggctcaggctattcaccgggaaagccacgcggaggcagggcaggcagcgccccgccagagacccccggatggtggagatggtgcggtggagtcgggactgctgggggcacctgctgatgaggtgggagggtaaagccacgggggatgcgggtttctggacttgttcgggtgggcggggcg

SEQ ID NO: 96379 - DNA, 242 bp, Homo sapiens
  chr7:1289320-1289562
  hyper
ccctgcacccaggcacggagacactgcagaccctggcagggtccgggacaggcccagggctggagggaggggttcgagacaggccacccttcctggggcagcccccctccgcttcctcccacagctctatttagggcagacaggccaaagagagccacggaggcgtgttggacagcctagcagcggccatgaaccctggcacgtttatctgctggagcagtggagcccggcctcccagggag

SEQ ID NO: 96380 - DNA, 99 bp, Homo sapiens
  chr7:129142801-129142900
  hyper
gggacaaggggtgcccggcggtccgcgcctgctgggggcgcagcagccgcggagtcaggccagccgtctttccaggttttaggtcgtggtcctgttgag

SEQ ID NO: 96381 - DNA, 27 bp, Homo sapiens
  chr7:129229604-129229631
  hypo
agtcaccgcgcccggccagtcttttct

SEQ ID NO: 96382 - DNA, 30 bp, Homo sapiens; identical to SEQ ID NO: 41451
  chr7:129297274-129297304
  hypo

SEQ ID NO: 96383 - DNA, 57 bp, Homo sapiens
  chr7:129330294-129330351
  hypo
cagaacacgcccctgcgccacaggaggttaactcagaactgccgcctctcaccatcg

SEQ ID NO: 96384 - DNA, 258 bp, Homo sapiens; identical to SEQ ID NO: 41453
  chr7:129381062-129381320
  hypo

SEQ ID NO: 96385 - DNA, 30 bp, Homo sapiens
  chr7:129407651-129407681
  hypo
cctggctgtgtggcacggggcctgcagcct

SEQ ID NO: 96386 - DNA, 345 bp, Homo sapiens
  chr7:129418271-129418616
  hyper
attttctcttctttgcgtaaggccgactccagaggtcccgctaactcccccgcaggagcatgaaggggcggccttgagcggtaaagaaacgagcagtggtggaggctgccgctccgagcccaggtccgaaccgagagccgcgcggggaatgtgggggtcgaggctgagagctgggcttggggcaggttcctttgcgttcgctcaggccacgatgaggccactaggacagatttctccgaaggctcggcctcggatcagagatccgccgactcggtgcccatcggtcgggctcactgggtgacaggtagagggtgatgcgcacccgtagagctgagtgacccggcc

SEQ ID NO: 96387 - DNA, 65 bp, Homo sapiens
  chr7:129421284-129421349
  hyper
acccccagctcctgccgagccgggaggggccaagggtgacggcaaggatacgaacccttcaatat

SEQ ID NO: 96388 - DNA, 79 bp, Homo sapiens; identical to SEQ ID NO: 31552
  chr7:129421630-129421709
  hyper

SEQ ID NO: 96389 - DNA, 854 bp, Homo sapiens; identical to SEQ ID NO: 721
  chr7:129422115-129422969
  hyper

SEQ ID NO: 96390 - DNA, 357 bp, Homo sapiens
  chr7:129423125-129423482
  hyper
cgatcttggcccagcccttagccctcggtcctttgctctagcatctagattctcgtgggtcaacaaagtcactggaaacccaacgaacttcccgacatttttcgaaaaccgtatgcgtgtgcttctgtgcgtttttcctctgatcgaggtagggccctgtagggttctgtttggacgggaggctggagtggttccttcccggctgcggggtcggaggatgcagagattcgaaagaaggagaaacacagagactgtcaaatgaaaggagattctgtcttcggaatcgacccagctctttaaaagaatgaggaaaacatggggtctttatatatcctggaaagtcgcctaggcgttcag

SEQ ID NO: 96391 - DNA, 1399 bp, Homo sapiens
  chr7:129424547-129425946
  hyper
ctgctttttaccaggcgacaccccggtcgactttgacccccgagcaggtgaaacataagcgtccaccccagaggggtcccctacccaagtcagaggagaaggtggcctgccaggttaaaggatcgagtccagcctcggtttcctcatctgtaaaataagccgagaacatccgcgcctctttctggagaaggctgggaggatgccagagagaaactgcgcgcaggccctggcgaggagcccctccggcccatgcggaactctgcacaggctgggtccctccagggttagaaacccagcttccccacccctacccagcagggacccgcgctgcatcccctaacgccccccaaccctctgcacccagacccaagagccggccttcgacgcaccacatgcgtggagcccgggtcccagccctgaggaccaggtttcagggctcagaagactccagcgaggttccctcgcagattgtgtctgcggtcgttgggggaggggccccgcagccttcagcagattatccaaaggtcagtgacccagatatggttttggccacgggccatgtttcacttcctgtgccccaagcagaatttagctgaataattcggaccccaaaccaaacaaaacgctcttatttccgtttggggattcttcggagttgggatttttctgtctcaaattagaataatctgcattattaaccacttaacagttatttgttggttggctgcctgacctttctgagcctcagtttcttcgtctgtaaattgggagcttacccaggtcggaggactgttggaattggaaatattcgaataaggaagtgtttttgcaagtgctttgtaagcagcaaagcgcttcttcaggggtcaatttttttttagctctgcagtcaccacccaaattcggaagatcgttgtgcctttcttggatgagaatgcccggctccagcccggggatgggacggtcttttccttgctaggagtccgctgtggagggggcgatgcgctctgtccaggacctaggagtccctttctccctccaccctcggctcacagcgggcagctcccccgacgcgtaccgcctctttgcccccagcctgaggtgcgctcttccccaggacgcctcctctgtcctctgcacgccgccggccctgctggggttgctttctgccgcggcgtcttcgcgaatatcccctcttgctgtctgcctgggcgtccctccgggttaccgcacaccgcctccgaccctcccagggcgcgggaggaggggcagggcatccgcgttcgtgtctgggccctggcggggagtcgcgtggtccaacccctcgtttttaagaggagggatctgaagcccagctaggcttctaattccagacagagccctacggagcccagttctc

SEQ ID NO: 96392 - DNA, 30 bp, Homo sapiens
  chr7:129426289-129426319
  hyper
gagaaagaccacaggcggtttgggttgttg

SEQ ID NO: 96393 - DNA, 30 bp, Homo sapiens; identical to SEQ ID NO: 41454
  chr7:129782524-129782554
  hypo

SEQ ID NO: 96394 - DNA, 348 bp, Homo sapiens
  chr7:129794391-129794739
  hypo
ctcctcgggaggccccgcaggagccctggcacctttccaagtgccagctgcgcagcctggcccagagtccgggcccaggagggcccgcagtgcctgcagctgcctggggaccacatgcgtgactggctggccccctgctcatcccgcctctctcctccgcctggcttcgcgccgcctgcctgccctcggggacaagcgtgcccatctgacacctcagcgcctgcccattccccgggaccaggccatctggcctcgctgctgcctctgctctgtgcaacccccatgccgcagcccgtcgcctcctgctccagcctccgccaggactgtcctgtgcgcccatcagggtgt

SEQ ID NO: 96395 - DNA, 41 bp, Homo sapiens
  chr7:129800321-129800362
  hypo
aacaccttctcaaaccgccaggtttgcggcctggcagctta

SEQ ID NO: 96396 - DNA, 19 bp, Homo sapiens
  chr7:129844190-129844209
  hypo
ttatttgttttgagacgga

SEQ ID NO: 96397 - DNA, 30 bp, Homo sapiens; identical to SEQ ID NO: 41456
  chr7:129846079-129846109
  hypo

SEQ ID NO: 96398 - DNA, 30 bp, Homo sapiens
  chr7:129913242-129913272
  hyper
gtgaattaatgctcacgtcctgagagatga

SEQ ID NO: 96399 - DNA, 143 bp, Homo sapiens
  chr7:1303425-1303568
  hypo
cctccgcaggcagcgcgtcccccgcacacccgctgcccgcccggctttcactccagaatggcgctgcccgtgcctgtacagacagctggcaaagcgtcagatggcattacaatatttttacttataatcgagaaagcaataaa

SEQ ID NO: 96400 - DNA, 248 bp, Homo sapiens
  chr7:1308287-1308535
  hypo
gctcgcccctgtccccgaagccccaggacacccagtggccctctttgggctggacccaccctggccaccctggcccttccggctgccggctggggacgcgggcgtggtgcggcaggcctgccttgattgtgtcgatgggagatgattttcaaggtgaaatttctagttcactagagtcactttcgttcaaggcgacgcacaaaatgtcatcccggcctgttccgcgtgcaacgcgctgttctcccatc

SEQ ID NO: 96401 - DNA, 185 bp, Homo sapiens
  chr7:1309947-1310132
  hypo
ccctctcccccaacccgccagggcagtgccaaactgcgggactcagccccaagccccactactgccgccatggtgtccccactccaggacaaccagggccctgcctcactgccctctgaacagcctcatcctgcggggctagttctggtcccttcttttgctgaagtccccgccgcccactccag

SEQ ID NO: 96402 - DNA, 31 bp, Homo sapiens
  chr7:131011381-131011412
  hypo
gtgtgagccaccgtgccgggcctggcctttc

SEQ ID NO: 96403 - DNA, 81 bp, Homo sapiens
  chr7:131041515-131041596
  hypo
ggaatgtatccaaatcgtgtgcgccaaatatgttgccggtggcagatacccaagttaccccgattccgtatgggtctgcca

SEQ ID NO: 96404 - DNA, 167 bp, Homo sapiens; identical to SEQ ID NO: 41015
  chr7:131076-131243
  hypo

SEQ ID NO: 96405 - DNA, 147 bp, Homo sapiens
  chr7:131231034-131231181
  hypo
ggagtgtacagtgggcgtgtccaggagctgattacccaatcacaagcgccatttatccaggtagaaagagagccaagaggtggaagactgcatttaaccacgttatgggctaaccacctagggggctgccaggatcggggtgcaggt

SEQ ID NO: 96406 - DNA, 42 bp, Homo sapiens
  chr7:131240674-131240716
  hyper
agagtcccgcagaagcgtggagcctcgcggtgcggtctccct

SEQ ID NO: 96407 - DNA, 379 bp, Homo sapiens
  chr7:131242722-131243101
  hyper
gcacatcggcggagccgggaagcggagggggcgaggggtgattaaccttggaacccgggtacggcgtaaatttggctcacgtgactccggggttgctaatctggagtctatctgccagatggggctgggtggaggggttttctccaggatctagccgcgtcccgggcacaggggactccgtgagcccctcaagtcggctgcaagcaggcgatgcctgcagggcactgcgtccctggagccgcgaaggaagcgctggagccctggctggggttccgtggcagccggcctcaagcttgggaagggctgacggggttgttttcatcaggaagtttctgcaggatcgttctggccccgttttccacaccgcatatgggaaaga

SEQ ID NO: 96408 - DNA, 65 bp, Homo sapiens
  chr7:131377139-131377204
  hyper
gcagagggcctgatgcggcagggccaccgtgggggccaggcctggaaacacgtgctgatttcctt

SEQ ID NO: 96409 - DNA, 30 bp, Homo sapiens; identical to SEQ ID NO: 41060
  chr7:1313980-1314010
  hypo

SEQ ID NO: 96410 - DNA, 30 bp, Homo sapiens
  chr7:131422856-131422886
  hypo
aattactgtgtcctccgcggcttgattaac

SEQ ID NO: 96411 - DNA, 271 bp, Homo sapiens
  chr7:131514720-131514991
  hyper
aagcccccactttggcgctcctgggcttggatcccgctgtgaggccgggggcaggtgatcatggcaggcggtaggactcctctcactctctgccccagaccccgcctgggagcctctgccgccctctcctgctccagcaggcaaggccaggaagccgggagtgcttgctgtcaatatcacatgtggagctgcttgtggccggccaggactctcaaagcccagcctcccaggtcaggcgtgggctcctcctactcctcgtcactttctagct

SEQ ID NO: 96412 - DNA, 143 bp, Homo sapiens
  chr7:1315844-1315987
  hypo
aacccttcctctgcccgctcccgcgcctcacctcgctggcaaaacagcccctggcatgatcatcgcaccggcctgcggggtcagcagccccactggctcgccggggcctgggcctgggcctggggggccgggactccaggtgg

SEQ ID NO: 96413 - DNA, 30 bp, Homo sapiens; identical to SEQ ID NO: 41062
  chr7:1318952-1318982
  hypo

SEQ ID NO: 96414 - DNA, 30 bp, Homo sapiens
  chr7:132086857-132086887
  hypo
gcctacataccaaagcgaatgcacttgact

SEQ ID NO: 96415 - DNA, 187 bp, Homo sapiens
  chr7:132099502-132099689
  hypo
gacactggcaagaggcgtacgtatcatgagaggcataggatgtgctatgagttccatggaaacatggcacccacacgaaaacctcccacacacctcatggaacccgcaatccctatattgataagaatgccaaaggatccatttcctagttgtaactacaaattctttccaacgccaaggacaacaa

SEQ ID NO: 96416 - DNA, 37 bp, Homo sapiens
  chr7:132155928-132155965
  hypo
tgacgtgcctgctctcgattcgccttctgccatgact

SEQ ID NO: 96417 - DNA, 37 bp, Homo sapiens
  chr7:132156085-132156122
  hypo
gaacggtgtaatacaaatagaccgttgtgtgtgttgt

SEQ ID NO: 96418 - DNA, 998 bp, Homo sapiens
  chr7:132260210-132261208
  hyper
gaggactatatccctcgtgcttcccccttctagttctctttctcagacacacaccacgaaaggcatgtgacaggtgttcgccagccggaggcaccggggaaggcagccccatgtgcccagggagggtagggaggtgagaggggacccaagtcctgtgtctccaagtcctgtctgcttgctgctaagcaggcactgaggctgtgaataaggtcttaccttttaaggaggatctgacccccgtaccttccctagacaagcaacatacgcggcgatgctttaagccgctttctgcctgaaatctcggcgcattcccggggaagcagtgccacgcttcagaaaggcgtttgtgctgcctcttactggggaaacgcagtgtctgtttcatatgcgccgccctacagaactgcagccccaaccgcctatctggcctcctccccgggcgctgggccaccactctctccaaatatgcgtccgaatatctgtgggtctgtctcccgttgaaatcccagggtgtccaaaggccacggggccgcgatgacactgggtaggtctccggaaacctctcaggacttctcccattttaaagcccagctagggacgaaaggggctgggagctgaaaaattgctccctcaacctccccgggtgggaggcagagccgggaatacacagaatcccaccccgaaagtcccgggaaagagaagtctgagtccaggagcgtgagaggagaacacacccgggaaatccctgctccggccgctgcacctccgcgggcgtccaggtgggacgtgggcaggtgcgcgagcgccgtgtgtgccggtgtggatctgtgtgtgtgcctgcgtgtgtgcgtgtgcgtgtgccgcgggctggctccgggacactgaggactcccgggtcggcccaggtctgtccgaccttgctgccctcgccgcccgcccggccccactccccggcgggccggctccttacctggacgcgccgcgtttccctccttcag

SEQ ID NO: 96419 - DNA, 249 bp, Homo sapiens; identical to SEQ ID NO: 31561
  chr7:132261256-132261505
  hyper

SEQ ID NO: 96420 - DNA, 908 bp, Homo sapiens
  chr7:132261534-132262442
  hyper
cggtggcgacgccgggctgccccccttcgtccccacccccgcgggctgaatgtccttgatgccaagcgggcacagcggcgtcactccgcgccgcccatgctcgcccggtcgggccgctgcccgggcgcggcgagtgcgcgggggacccgccggggagcgctctcggcgcctctgcgcgcctctctgggtagcggcggccgccccccggcagcccgcggccggccgcgccgcggcagcccccacccttgccgagacactcgccgggcagtgccctggggccggggctggggggccgcgggagccgccggctgctccccggggaggcgcggggctgcggcggtggtggctgcggcggctggcgctgcggcggcggagagctcggccgcgggccgagccgggcctcccgggcgcgcccccggccccccgggcgggctgctcgcaaagtttgcagggggcagggagcggggccgccgctggctcggccgccgccggagctcccgggctgcctgctgccgccgcggctcgctgctgctgtgcattgaagcccggccaagcgctgcaaaaactccagctgcctggcgctctctgggtcctcctctcctccctcccgccctccctgcttcccttcctccctccctcgcctcgcctcctctcctccctgccgcccgccgcccgccgccgctccctctctggctcgctctcgctggctcggagctcgcggctgacatctagagcgagggagagcggccggcagagggggcagggggcgcctccctacatgctcccacccgccgccgcccggcttgccggctctcctccgcaccaacgtttgccgacacccccctgggtcccctcggcccgcacggagctaccctggcggtggcgatgtggggcggagagaggggcat

SEQ ID NO: 96421 - DNA, 236 bp, Homo sapiens
  chr7:132299552-132299788
  hyper
ggagacacctcccaccgcggaactgagccgcggagaaaagcaagctgcagagaaagaggaagcagatgtgcagagaggcggagatggaggagtggctgggaaggtcgcctgtgtcccgccggcttccaagttccagagccttccggagcctcttctgaaatcctgccccctggcttcccaagatgtcccttgcccttaaactgtaataaatctctctcccccgagccctcgccctc

SEQ ID NO: 96422 - DNA, 332 bp, Homo sapiens
  chr7:132340002-132340334
  hyper
cttgcccagcaccctcggtgggctcctgacactcctagtgccgaaatggatggctactcaccctttggggctgaccctttctcctccatcccctcccactccattaccacagcgattcattgaaagagatcaataattatgaaaaacaattgattttctactcccctccacccccttctttctctgagtaagtctgtctgacatgcataacgggaatcaaaccagagaggaagtgctgcggcttccctggtgggacattgtgctctctctccctctcggagggcccctccctctgcactttcagcgatttcaagatccgcacattactcttt

SEQ ID NO: 96423 - DNA, 117 bp, Homo sapiens; identical to SEQ ID NO: 41462
  chr7:132418949-132419066
  hypo

SEQ ID NO: 96424 - DNA, 34 bp, Homo sapiens
  chr7:1325238-1325272
  hypo
ccgagggtgggggtacggccgggcgggtggacgc

SEQ ID NO: 96425 - DNA, 430 bp, Homo sapiens
  chr7:1325577-1326007
  hypo
gccctgcccctccagcgctgggcacctctcactcctttccagggacccccaggccatggcacagtgtcgcctggggacacacgtggtgcgtgtggcttttcagctgctcaacactcacttctgaggcccccgcggcgtggcacggcctgggcgttggatgcagcagtgaacgggacccacgcggggactcagggtatgacgggcagaggggtaggtggggtgggggcaggtgaggcgggggtgcccagcggtcagggaggggctctcgggaggtgacattcggccgagaccgagtgacggtgtggaacccgggcgcactgggaggcacgatccaggcggagggagcagccgtgccagggccctgaggtgggaggggccgggcggcctcaggctcagcgaggggctgaggggccaacgtggccggagtgga

SEQ ID NO: 96426 - DNA, 121 bp, Homo sapiens
  chr7:1328492-1328613
  hypo
tggctcctggaaacccggagaaagcagacaactcgtccgcgttgtcctggagatgcagccgacatcggcctgcttgtcctgctgccagggccgctgggggccccatcgatgtccacccggc

SEQ ID NO: 96427 - DNA, 67 bp, Homo sapiens
  chr7:1331210-1331277
  hypo
tccatctgtgagtggcggctggaagcttctcaggcctccagagcgggaacgccgagctccttctgag

SEQ ID NO: 96428 - DNA, 100 bp, Homo sapiens
  chr7:1333580-1333680
  hypo
gggaaggatgctcctcgccgtcataaacccgcgtgcaccgcgtcactccccgggcgccgagttccgccggcctggcacgggctcacgggcacccttggcc

SEQ ID NO: 96429 - DNA, 30 bp, Homo sapiens
  chr7:1335995-1336025
  hypo
ccagagctggaagcccggtctgccaggccc

SEQ ID NO: 96430 - DNA, 301 bp, Homo sapiens
  chr7:133812094-133812395
  hyper
tctcctaggcaaccccgctaaacaagatggcgacctccgagagggctctcctgaggaccagagctgcctctctcctgagaggcttgggcagatcccgaactggagcccgatcgttacagtttcgcgcagaaaaagagcgtcagccttgctggtcttttcccatggggcagaagacgaaaggcagctctaacatagcctcctcctacctgctccagcagctcatgcaccgctatcaggagctggactcggacggagatgaggaccagggcgagggcgaggcgggatccgaggagtcctcaga

SEQ ID NO: 96431 - DNA, 40 bp, Homo sapiens
  chr7:1339547-1339587
  hypo
agagagagggccaggcgtggtggctcaagcctgtaatcct

SEQ ID NO: 96432 - DNA, 141 bp, Homo sapiens
  chr7:134116486-134116627
  hypo
ctcaaaaaataaataaataagaaaagaactgctgcacaagagtgaatgtttgaagcaagcaggagggaggcgaattgcccaaagatcaggaagaaaagaaagaggctgggatggtcatagatctgccgaggagcacaagaa

SEQ ID NO: 96433 - DNA, 622 bp, Homo sapiens
  chr7:134142965-134143587
  hyper
attgtcattctcatccggctaggcacttctcggggacgctgtgtggtgttgaggttttacagggaaaatgctaaccttggcgcctcctgaattatcaactagctacggggtgcccagatttttctcccgagttccagacccagggcaccccgaggcggcgcctggccgaggagctccgcactgcgccttgttaacagctgggtccgggcaaactcgcgccacctaattctctgccctctaccggcttgagatgcttattcctcagggagggcaagaatcgaaacgattgagaccaactatttacaagtgaggcaaccgggctacaggtgcctcgagggaaaggaggctgggtctgcgctcccacaccttgccgacggctccacgtccctgtctgcgcccgaggtccaccggtctgtgaagcccactttccccgcctccctctcgcgttgtgccgcttggggcgcccgctaggacccaaaatgcggactggtgggccgcccatcaagggttgcccgcggtagggcgggggctcccgtgagctgctcccaaaccccactcgcaggatgctgccctgacgcccagggccaacccggggagccaaggcccccggtctctgcaaggc

SEQ ID NO: 96434 - DNA, 271 bp, Homo sapiens; identical to SEQ ID NO: 31568
  chr7:134143700-134143971
  hyper

SEQ ID NO: 96435 - DNA, 83 bp, Homo sapiens; identical to SEQ ID NO: 3121
  chr7:134143972-134144055
  hyper

SEQ ID NO: 96436 - DNA, 76 bp, Homo sapiens; identical to SEQ ID NO: 3122
  chr7:134144056-134144132
  hyper

SEQ ID NO: 96437 - DNA, 45 bp, Homo sapiens
  chr7:1347390-1347435
  hypo
gacaagaggcaaccacgttgctgggggtgccgaagccaggccagc

SEQ ID NO: 96438 - DNA, 36 bp, Homo sapiens
  chr7:134864251-134864287
  hypo
tttaccgaactgccccgagcacggggttatcagtac

SEQ ID NO: 96439 - DNA, 30 bp, Homo sapiens; identical to SEQ ID NO: 41464
  chr7:134880911-134880941
  hypo

SEQ ID NO: 96440 - DNA, 104 bp, Homo sapiens; identical to SEQ ID NO: 41465
  chr7:134885144-134885248
  hypo

SEQ ID NO: 96441 - DNA, 257 bp, Homo sapiens
  chr7:134918404-134918661
  hypo
tcctcccttttctgtcgccttcggacaacttgtaacactgtttcttccactgcccacacgcccattggcccgtcaccacgcatccccattggctgtggcggccagggacagggccgcgattggtccccacccctgtaacgaggtgccaggtctgttttctgacccagacaggaaccgcgatccccactccggcgcacgaagccgggtgactgctgtcccgggagtggggacgtcgcgtgcaccgttggcgagtaagt

SEQ ID NO: 96442 - DNA, 30 bp, Homo sapiens; identical to SEQ ID NO: 41467
  chr7:134953117-134953147
  hypo

SEQ ID NO: 96443 - DNA, 37 bp, Homo sapiens; identical to SEQ ID NO: 41468
  chr7:135125375-135125412
  hypo

SEQ ID NO: 96444 - DNA, 123 bp, Homo sapiens
  chr7:1351483-1351606
  hypo
cagggggctggcaggcgccggccgcggctgtctcctccagggcctgctgttgtggcgtctggccgcggcccagcaccgccgtcatctgggctcagctctctctgtccgcggggctgtctccct

SEQ ID NO: 96445 - DNA, 32 bp, Homo sapiens
  chr7:135196033-135196065
  hypo
gcagttttaaatttacgaacttaatttcataa

SEQ ID NO: 96446 - DNA, 32 bp, Homo sapiens
  chr7:135196365-135196397
  hypo
acgtgagccagggcacccggcctcattctttt

SEQ ID NO: 96447 - DNA, 38 bp, Homo sapiens
  chr7:135234576-135234614
  hypo
atcttctttctctgccgggcacggtggctcatacctgt

SEQ ID NO: 96448 - DNA, 69 bp, Homo sapiens
  chr7:135391578-135391647
  hypo
gtcacagaagtgtcccgtgtcactgtgtgcacttttccagctgacatcttaaagcgtcaacacttggag

SEQ ID NO: 96449 - DNA, 30 bp, Homo sapiens
  chr7:135393097-135393127
  hypo
aatcaaagaggctggcgaaggggaggcagg

SEQ ID NO: 96450 - DNA, 135 bp, Homo sapiens; identical to SEQ ID NO: 15032
  chr7:135401363-135401498
  hypo

SEQ ID NO: 96451 - DNA, 30 bp, Homo sapiens
  chr7:135412147-135412177
  hypo
tgctggggtggaggacgggcagaggcagca

SEQ ID NO: 96452 - DNA, 41 bp, Homo sapiens
  chr7:135854543-135854584
  hypo
agtttttttttttttcgagacggagtctggctctatcgccc

SEQ ID NO: 96453 - DNA, 17 bp, Homo sapiens
  chr7:135863468-135863485
  hypo
tccgtctcaaaaaaaga

SEQ ID NO: 96454 - DNA, 105 bp, Homo sapiens
  chr7:135898002-135898107
  hypo
ggggctgggcagaggcgctcctaacttcccagacagtgcggtggccgaggggtgaggtttaaatatgaattttaaagggacacagacattcgaagcatagcaaga

SEQ ID NO: 96455 - DNA, 23 bp, Homo sapiens
  chr7:135965324-135965347
  hypo
accatgcccggcatgactgctct

SEQ ID NO: 96456 - DNA, 30 bp, Homo sapiens
  chr7:1360286-1360316
  hypo
aagtcctgggtgtggcgtgcccgcctgcgt

SEQ ID NO: 96457 - DNA, 136 bp, Homo sapiens
  chr7:136327342-136327478
  hypo
aaagagggaaactccatctcaaaaaaaaaaagaaagaaaaacaatattttctttaatgcttcaagatacaggtttacattaattgagtgaaagaacatatatatttatgtatcgatgatatcgatacataaatata

SEQ ID NO: 96458 - DNA, 62 bp, Homo sapiens
  chr7:1363565-1363627
  hypo
tgccctggaccccaacggcggcatcctggggcggcaggtaccccgtccggtagcgcgaagcc

SEQ ID NO: 96459 - DNA, 144 bp, Homo sapiens; identical to SEQ ID NO: 41068
  chr7:1365367-1365511
  hypo

SEQ ID NO: 96460 - DNA, 90 bp, Homo sapiens
  chr7:136553405-136553495
  hyper
ctaatcgaacacacacgcacgaatacagacacgctctcctgctgtactaaaggcgccagggcgcaaagacctagggagcgcgcgcgggca

SEQ ID NO: 96461 - DNA, 471 bp, Homo sapiens
  chr7:136553555-136554026
  hyper
ttggccagagcctggaaatcgcagatttcaccaggaaatcgccgaggtacccgaataggtgttgcctcccaaaactaattcctacttccccaagcactttggtgaagaaatgaatccagcccagctcgccgaggcatccaggtctccattctattttggtctccaggctcttcgtgaaagccaggtttgaaagtcttgtttgcttctcctttagtggtttggcgtggagggcgggggcagcgtcaatttaactccagtctaaaccacgaacaggtcacagactagccaagtggctgagacgagtgtggggtgcgtgactctgcctgcgcgcgcgccagccccgcagctctcgccagagccttggggtcggttctctcccgcctctcccgcctctcccgccccacccctacagtgtctcggcatcaactaatcttttccttttcttttgcaagatcaagggagaaagagaac

SEQ ID NO: 96462 - DNA, 478 bp, Homo sapiens
  chr7:136554103-136554581
  hyper
cgctccttcaagcctccaccacctcgcagccggggaggcaactggagcgaaaccagcgacaggtaagggccccgcgctgtgcagctctccgcttacccactccaagggccctggcaccagggggtctctcccttcatatccccccaagccggaggctcaggggtcggggcttgggggaattggagggaggtcctccccacgtgcagattctcaaacggaaactttggatcctggggcttggagggttgcgagcagtgatggcgggtctgaaaggaaggggcaaacgaggcacagcgcgaggcgaggtacccctacgattccgacggtcactgagtccagccgaatgtggcgaaagcagcctgggagctgcgctgtcccggcgtcgctccctattccagccccccattccctctactgttgctgacccccctcccgccacccactccagatgcagccatggacaagacaaggagagctt

SEQ ID NO: 96463 - DNA, 376 bp, Homo sapiens
  chr7:136554625-136555001
  hyper
cgtcttctgtgcgtgtgggatggaggcccggctcgctcgggctccgagctgtcccccggctccgctttcggagcagcccttgggcgctggagaggtttcccattgcggtctccaggtcatggccaaggaggagaagcaattagaatgggggaaagggtcccaagacaaaggagagggaagcattctgcaatcccatcctatttgagccccgcgcaggagctggactgtccgccgtggctgggggacaaggtctcagcccgaagctcatgaggtaccagacagtgcctgggcttcgccacctaactcacaatgggtcctgaaccgcccgggcagtccccggggtcgtagactggggaccgctgcacccctccccgcc

SEQ ID NO: 96464 - DNA, 764 bp, Homo sapiens
  chr7:136555078-136555842
  hyper
cggtccatgcctggtgccggtagacgcgcagaaattccacctgtgcgcgctgcccggcgcccctggggcccctcacggggtaagtagagactcatctgggagaggtgaaaattccccagaattattgacacacacggcggcacaccctttgcctccgtccgcctccagcatccgcatccctttctctatcttcctgcccattgccgtcctcgaggctgccctgagatacagaattgtcccaggctgagtccaccgacccgccagtccctggcgatgatgccaaggctcttgcatgtacggaaataccagcagggaggttcgccaggggcagagaggctggaggagaacagagaattggaggtaaacgcgtaaagccagcagaactgtcggtggacatttcacccaggccgccctcccgcgtctttaagtcagttcaccgccacagcacgtctgtgactgcggccacccagggctccaagtctgccagcccaggcgccgcgagccaagaagagcgcggcgcctcccactcctcaagctccggaatcccccacatcgactttctatttccctgtcttcttttcttttttgtttgttttgcttttcctgctcttttcttagcgctgggtggcagtgggtatgcggcagccgtgtgatttgcccatcccctagtacacgcagccagcgacacaagcacacagcgaccagtccccacgctgtgccacacaccctccagcggtccggcgcgcagcccctgctccacagcc

SEQ ID NO: 96465 - DNA, 213 bp, Homo sapiens
  chr7:136556012-136556225
  hyper
cgggccgggctgtgcggagccctgagggctcctgcggctgcagcgctgcaggccgcccgcgtctcgccccgccccgccgctgggcgtccccgccaggagcccacccgcgggcggcagcttttctccatgctgcccagggaagttcgatgcctggtgctgggatgcgccagcgcttctgttcgcttctggcaatcctggcgtctcccaatgaga

SEQ ID NO: 96466 - DNA, 30 bp, Homo sapiens
  chr7:136849171-136849201
  hypo
tggcccctgatgccccgaaaggctgtggca

SEQ ID NO: 96467 - DNA, 81 bp, Homo sapiens; identical to SEQ ID NO: 41069
  chr7:1368971-1369052
  hypo

SEQ ID NO: 96468 - DNA, 30 bp, Homo sapiens
  chr7:1369753-1369783
  hypo
gatcgtgagcccctacgattgtttgcagat

SEQ ID NO: 96469 - DNA, 79 bp, Homo sapiens
  chr7:137028481-137028560
  hyper
gagggatgagaggagcgggccaggaggacgaaggctgggcgagggagggagagcgctttgcactcgagagctgattggg

SEQ ID NO: 96470 - DNA, 36 bp, Homo sapiens; identical to SEQ ID NO: 41476
  chr7:137092635-137092671
  hypo

SEQ ID NO: 96471 - DNA, 17 bp, Homo sapiens
  chr7:137273241-137273258
  hypo
agatggagtctcaatcg

SEQ ID NO: 96472 - DNA, 38 bp, Homo sapiens
  chr7:137285723-137285761
  hypo
aatgcaagaaggggccgggcacggtggctcatgcctgt

SEQ ID NO: 96473 - DNA, 627 bp, Homo sapiens; identical to SEQ ID NO: 724
  chr7:137531262-137531889
  hyper

SEQ ID NO: 96474 - DNA, 280 bp, Homo sapiens; identical to SEQ ID NO: 31578
  chr7:137531908-137532188
  hyper

SEQ ID NO: 96475 - DNA, 68 bp, Homo sapiens; identical to SEQ ID NO: 31579
  chr7:137532373-137532441
  hyper

SEQ ID NO: 96476 - DNA, 206 bp, Homo sapiens
  chr7:137637131-137637337
  hypo
ctgagaggatatccccgcccagccctcaggctctcagcctttcaactcaaatgtcaccttagagaaacagtgtccatgacccctacggtagccacaggtcccattttgtcatcttcactgcatttgccagtctgtgaaattagcttactgatttatctgttccagtttttatgatctggcccctgctttcccgcctttgcactaga

SEQ ID NO: 96477 - DNA, 87 bp, Homo sapiens
  chr7:137664095-137664182
  hypo
aaagcacagcaagggcgggtcatcaggccaagacatcaaaaagcacaggctgcaactggtcctaccagtccttagtttaatataaga

SEQ ID NO: 96478 - DNA, 18 bp, Homo sapiens
  chr7:137693378-137693396
  hypo
acacggcctcggtgtgtt

SEQ ID NO: 96479 - DNA, 140 bp, Homo sapiens
  chr7:138042204-138042344
  hypo
tgaaggtgggagatccgccagctctgtacaaacgcaggcattagaggctggccagagcaggcgggagggcgagaaacaccctactttgcatctcattcatgatatgggttttttttttctttgagacggagtctcgctct

SEQ ID NO: 96480 - DNA, 143 bp, Homo sapiens
  chr7:1384815-1384958
  hypo
ttctggataggggcacggtggatgggcaggctgcgccgggctgatccgctgtgaacagcggttttggagatggtacgtcttgcagaggcatggcaggaaccagcgcctggaggtgcgaatggcccagtcggctcagggggaca

SEQ ID NO: 96481 - DNA, 30 bp, Homo sapiens
  chr7:138574167-138574197
  hypo
tgattgatgaaacatcgagcagttaatata

SEQ ID NO: 96482 - DNA, 38 bp, Homo sapiens
  chr7:138794899-138794937
  hyper
ttgcttacctagaatcgctaactcggtgccctgaacca

SEQ ID NO: 96483 - DNA, 15 bp, Homo sapiens
  chr7:138845476-138845491
  hypo
cggcccaagtcactt

SEQ ID NO: 96484 - DNA, 74 bp, Homo sapiens
  chr7:138912533-138912607
  hypo
tcctgtatttaccaacgattccaacttcttggtttagccacgttgctgtgaactacgtccgagctcagagagct

SEQ ID NO: 96485 - DNA, 157 bp, Homo sapiens
  chr7:138913166-138913323
  hypo
tctcaaaaacaaaaagagatttcaagaattctgaatactggtttactggaaactctggttatttgtgtacagctttgtgagcaaggacttaacccagaattaataaataaccaaggaaatatcactggttattaaggagcttcgaaagactaccaaa

SEQ ID NO: 96486 - DNA, 82 bp, Homo sapiens
  chr7:138957148-138957230
  hypo
gaggactgccaggctcgtagtcaagctaagtgtgccaagtatgtatctcttctatttggactggcttttgcatttgagaagt

SEQ ID NO: 96487 - DNA, 82 bp, Homo sapiens
  chr7:139027220-139027302
  hypo
gatgaagtggtaggccgaacaggaacttaaactttattgtaagtgtaatgggaagccattctaagattgtgatcacctccca

SEQ ID NO: 96488 - DNA, 30 bp, Homo sapiens
  chr7:139106981-139107011
  hypo
cctcgtgacagagatcggaaagataagaag

SEQ ID NO: 96489 - DNA, 30 bp, Homo sapiens; identical to SEQ ID NO: 41485
  chr7:139112625-139112655
  hypo

SEQ ID NO: 96490 - DNA, 86 bp, Homo sapiens
  chr7:139115423-139115509
  hypo
ctgtattcataagagcggaaatatccatcaattagaaagcagataaacaggccaggtgtggtggctcacccctctaatcccagcac

SEQ ID NO: 96491 - DNA, 30 bp, Homo sapiens
  chr7:139123790-139123820
  hypo
taatccccaggaatccgggagaaatgaaaa

SEQ ID NO: 96492 - DNA, 296 bp, Homo sapiens
  chr7:139167531-139167827
  hyper
cggtcagctgcccagcggtccagggctgggcgggtgtgggggtttcggctacgtccacccgacctggcggcgtcggctgccggcgcaggtgagcactcacccgtaagcgttacggcccggggcagcttctcgtcgccgtccaaccccgcgcggggcaacagcgccgcatcctccttctccagccccagctccttgcagcggcagcacgtgggggagcccggggagccggcgcttccttccgcggggctggcccggccctctgcgtcgcagccgctctccgtccgggctgcagccag

SEQ ID NO: 96493 - DNA, 500 bp, Homo sapiens; identical to SEQ ID NO: 31581
  chr7:139168114-139168614
  hyper

SEQ ID NO: 96494 - DNA, 67 bp, Homo sapiens
  chr7:139168658-139168725
  hyper
cgggagaaaagcagaacaccagcggaggcttgtggcagggaacccggagccccgcctgacccttccc

SEQ ID NO: 96495 - DNA, 38 bp, Homo sapiens
  chr7:139207995-139208033
  hyper
taattgaatctgcaacgtcacttcgcttgctcctttag

SEQ ID NO: 96496 - DNA, 325 bp, Homo sapiens; identical to SEQ ID NO: 31583
  chr7:139208245-139208570
  hyper

SEQ ID NO: 96497 - DNA, 196 bp, Homo sapiens; identical to SEQ ID NO: 31584
  chr7:139208614-139208810
  hyper

SEQ ID NO: 96498 - DNA, 30 bp, Homo sapiens; identical to SEQ ID NO: 41486
  chr7:139245499-139245529
  hypo

SEQ ID NO: 96499 - DNA, 30 bp, Homo sapiens
  chr7:139546165-139546195
  hypo
tagatgtcaggtctccgtgtctcagtttcc

SEQ ID NO: 96500 - DNA, 205 bp, Homo sapiens
  chr7:1395730-1395935
  hypo
ctccttgctgcctcccgccttgtcctcaacagccctgaagtccgtcctccactcagcttctcaggtggttctcaaaggttaacacaaccatgtccctcctgctccaaaccctccatggctcctgagtgcccctggaatagagcccaggctcctccgggatctgcaggtgccgcctgcctctgccattctccgtcagcccacgtca

SEQ ID NO: 96501 - DNA, 159 bp, Homo sapiens
  chr7:139650627-139650786
  hypo
ctcgccctccatctacgggaccccctcgccctccatctacgggaccccctcgccctccatctacaggacccactccttcagcagaggagttgggcccctggtaacacaattctttccttacacccagagcacgtaggactgactcggaggaaactgcag

SEQ ID NO: 96502 - DNA, 30 bp, Homo sapiens
  chr7:139779255-139779285
  hypo
cacgtgaggatgagccggcaggcctttgag

SEQ ID NO: 96503 - DNA, 30 bp, Homo sapiens
  chr7:1397930-1397960
  hypo
tgctgtgaccccatacggagcatctcccca

SEQ ID NO: 96504 - DNA, 96 bp, Homo sapiens
  chr7:139842977-139843073
  hypo
tcaaaaaaaaaaaaaaaaaagacataaaagagtacatatgatatattctatgtatgcagaaaattcaaaactagggaaagccgaagtatactgttt

SEQ ID NO: 96505 - DNA, 30 bp, Homo sapiens; identical to SEQ ID NO: 41488
  chr7:139919897-139919927
  hypo

SEQ ID NO: 96506 - DNA, 195 bp, Homo sapiens
  chr7:139930151-139930346
  hyper
agggatagagacaggcggagaccgctggggagtttcccggtgctcagccatcgcataggggggaacggacccttttgtgggccctcgggtccccccgtggtccccgctggcgcgctcgtcctctgccacccccagatctctgcgcactccccactcctgggcgttcgcactgccccccggcgcactctcgccgcc

SEQ ID NO: 96507 - DNA, 213 bp, Homo sapiens
  chr7:139938997-139939210
  hypo
attgggtctaggtcacgcaggtagtaagcagagctgggctttgatgctgtggccgactctgcagcctctgcccaggttcttctttgggatacaactgctgacagctcaccgccagtctgttcccaggaatagccctgcctgaagggggctgcctggcccaagggtggctccttccttgcggggcagcctgaattcaaccgaaccatgtagggg

SEQ ID NO: 96508 - DNA, 68 bp, Homo sapiens; identical to SEQ ID NO: 41490
  chr7:140007275-140007343
  hypo

SEQ ID NO: 96509 - DNA, 232 bp, Homo sapiens
  chr7:140015548-140015780
  hypo
acgggggcacctggccgaaaaattatccccagaggcaaacatttaacagctgtgatgtcttaaataaatatcattcttgctgagcaagggaagaaagaaaagaataaacagaaaagagtgggagaaagaaagagaacagaatgcagattagatttaagaggggcagatacgatgatgaggggtggtgtctagatcagtgcaggagcactgagtagctcgctggggctaagcg

SEQ ID NO: 96510 - DNA, 21 bp, Homo sapiens
  chr7:140026923-140026944
  hypo
acggagcgagattctgtctca

SEQ ID NO: 96511 - DNA, 31 bp, Homo sapiens; identical to SEQ ID NO: 41492
  chr7:140096707-140096738
  hypo

SEQ ID NO: 96512 - DNA, 30 bp, Homo sapiens; identical to SEQ ID NO: 41493
  chr7:140097278-140097308
  hypo

SEQ ID NO: 96513 - DNA, 154 bp, Homo sapiens
  chr7:140156524-140156678
  hypo
agttggagaggatcccgaagcggcgctcactggggttggctttctcatagaccacctccatgcagatcccacacaccatgtccttgctgcgctgcacggcaaatgagagctccatgtccttctcatgggcctcaatgcacgactagagaaggtg

SEQ ID NO: 96514 - DNA, 19 bp, Homo sapiens
  chr7:140176253-140176272
  hypo
agagcgacactccatctca

SEQ ID NO: 96515 - DNA, 120 bp, Homo sapiens
  chr7:140180178-140180298
  hypo
ccgtctcaaaataataataatagtaatagataatagtacctacttcagagatggctgtgaaagttaaatgagaatctgtttaaaaacctttgtactggccgggcgcggtggctcacgcct

SEQ ID NO: 96516 - DNA, 76 bp, Homo sapiens
  chr7:140192162-140192238
  hypo
ccactggtgccactgcgagcccagcgggggcagagcgagattacagccccaggggacagagcgagactccatctga

SEQ ID NO: 96517 - DNA, 153 bp, Homo sapiens
  chr7:140227048-140227201
  hypo
gcagagccagcgccccgctctgttctccgcaccctgcagggagggggacagggctgagtgggagctcacctcttccagcggcagctccctgagcagtggcagcgagctggagagcagcccgatgaggaagggcgtcggcgagcacacgatgtc

SEQ ID NO: 96518 - DNA, 36 bp, Homo sapiens
  chr7:140268315-140268351
  hypo
catgggagcaggggtcgctgccgttactgcagccac

SEQ ID NO: 96519 - DNA, 30 bp, Homo sapiens
  chr7:14029041-14029071
  hyper
caaaactagcaatggcgatcaacgagactt

SEQ ID NO: 96520 - DNA, 62 bp, Homo sapiens
  chr7:14029493-14029555
  hyper
tcctcagcctggaagcgccacggagagactcgatttcctctgtaacccgctgcttattgtta

SEQ ID NO: 96521 - DNA, 384 bp, Homo sapiens
  chr7:14029885-14030269
  hyper
aaaattagatcctatcgttcgtgggacagaaacataaagaatctataaggaaggcacctaggagatgcagaattgctgattagcagaggttgtgatgggaggacaacagagcaagctaggtgaaaaagtataagtcaaaatggtccctacgtgtgcactgggaaaaggtacttccagtccactgtggctgtggggaggaggagggagtgcttggggttgctcgtatatcctagaacccgcacgtttcctgagcttttgttatgtatacacggaggcggagggtgtcacttactgtacttgacgctttcacttcctctccagcttttaaacagccagagcccagggttgggggcgagcggtgagatggctcgggtttcaaggaca

SEQ ID NO: 96522 - DNA, 43 bp, Homo sapiens; identical to SEQ ID NO: 31586
  chr7:140339825-140339868
  hyper

SEQ ID NO: 96523 - DNA, 260 bp, Homo sapiens
  chr7:140339965-140340225
  hyper
cgcgcgcgcgcggacacacacacactcacactcgcgccccgagggacccagcacggcgcagggcgggggtctaccggctttctgcaggtccccgaggcgcgagacggcggcgtccgggctcagtcctgggagtcagcccgagcccgggaggaacgcctggatcgcgctctgcacagtcccgggaccaggcgggaactcagactcccgtctgcagagccgcttcccccgtcagggctcaggccgcgcgagccgtttcctcc

SEQ ID NO: 96524 - DNA, 454 bp, Homo sapiens
  chr7:140340551-140341005
  hyper
ggcccagcgcaggctcgcccgcggcccctgcctcctcctgccgtggctccgcgacgatctgcgcgacgcgcgccccctcctcccgacccatcccgcccggcccagtgagctaatccgcagctggcgggcgcccggccggttgccacggcaacccctctcccagggcccggccccgcgcggagctgcggtaaacaggaccttctgccggactcgccccctcgcctctcggggtgggggagaggtggcttaacccttcctgggaggacgcccgccgcgcgcgggctccattccacccaggcccgggcggattcgcgaggtgcttccggcctgaggcttagacctggacgtccaagcctggggaacggcggccgcgtgcccggccccgcttactctaggcagttaacacactctcggcaccgggccggggccgggggcacctcgggcagtgagtcag

SEQ ID NO: 96525 - DNA, 23 bp, Homo sapiens
  chr7:140732424-140732447
  hypo
gaataggaagagctccggtctac

SEQ ID NO: 96526 - DNA, 226 bp, Homo sapiens
  chr7:140771324-140771550
  hyper
aatatggtggaggtgcgctcattttggctcacaagccccgttgtgcaaagcagggtgtcagagactctctttttccccagggcaactctttacccggcaatgccggacctcgactttggggtgagggtgaaaacgaggggtgagcattagagtgaaaaacccagcgtttgatgccgggagggagggtcccagcctttgcggcgccgtctcacgtgagcagagcagg

SEQ ID NO: 96527 - DNA, 72 bp, Homo sapiens; identical to SEQ ID NO: 31590
  chr7:140771769-140771841
  hyper

SEQ ID NO: 96528 - DNA, 395 bp, Homo sapiens
  chr7:140772281-140772676
  hyper
aagacttagacatttcgtgcctgggaaatggtgcagtttatctttaaggagactagaaaaataagagatgaggctcacgttgcacggatgacatcactagcttttggctgcgcgctcggtgttctcgtctgtgggttttagccaaggctgcagctacccgcgccggacgagagagcgcggcagcagcttcctccggcgcccgcacccgggcaatgcgatttccccagtcccctgggcgcagcctgggctctcgcgcctcccgggcaccagccgagcctgcgaggcctcggagccgccgcggctagaggaggaggcgacgaggggaagccgagtgacccagcctccctcccccaccctctccccattcatctcggcgaccaccgcgcgccgggagc

SEQ ID NO: 96529 - DNA, 1703 bp, Homo sapiens
  chr7:140772716-140774419
  hyper
cgctgtcgagtgagccggcatctcggcgcccgggtgggctgcgaagaaaatggtgcaatctgagagcgactgagcccagctgggcagagcagacggggtgccagagtgccaagggctcaggtgcctggagaaaggggcggattgtttggaggggccgggaccggggttttcttcggtgcctgcggcattttctttgcacctgggcggcaggctcccggggctcccgggtgccagatgaagtgaggcggaggcgtcgcgggagagccgggtccggaggcggtcgggtggacactccaggcagaagacggcgctgggaagagctgcgtgacgctcgggggctggcggctgggccggcagcgcgccgtggcggcgtgacctgtccatggtgttgaaggcgcggtgggccgagcccctagcgccgcgcgcagtgagcgctgcctggtgcaccctccgccgcgcagcccgcccctcgcgtccgccagcagccgcccagtctccgcagatcccaggccgggtctcgtccggtaacgccgcccgggtgaacacgctgtcggcccgaggggccgcctgaatggcgatgccagaggcagggcaccggggagctcgcggggaaaggtcggccgagagcgtgcgtccgcggggagtgcgcctctgagcgcagcacgcgggtcagaaggagcaaccgacctgctggtgaccagagaacggagattttaagaggacccgacccaaagaggaagaacatttctgggtgcgcgccccaggtctttgcttgcagacggggagggggagaggctctgagccagagacccaggagggactccgagaagccggccccagcacctggaggtttctttcgcccgccggccgcatccggggcgttctacttcacccggtggtccagtggcgcctcctgacagcaccccccgtccccctcagagagacaggcgagttctgtcccgtcaccatcctgcacaaagaagccccaccgcagccgaggacacttggcatttagtttccggcccgagggcagcggcgcccgaagccgggctgggagccgaggcggctgcttcggggcagtcgcttcctgcggggcggggagggggcgggaggcggccgcgctgggttcgccgccgccggaggctgcacctgcctcagaggatgcccaggagcccgcgggagcctctccggatcagaactttttaggccgcccgcccccatccccgcagtccccgggccgtgctccggtaggcgggggccgagggggcgccgcggcgcgagtccctctcctgccccctcccccagctcggccgcccgccgctttgttccgggtgcggcgagggaaggcgaggctgcggcggatcatgcccatggtgtagccgccaagcggaggcatggctgccggaaggttactgctctacactggcctctcgctagcgctctgcgccctcggcatgctggccgtggccatctgctcggaccactggtacgagacggacgccaggaagcacagggacaggtgcaaggccttcaacacccgccgggtcgaccccggcttcatttacaacaataacaacaacttgccgctccgggcgagccgctcgcgcctggaccgctgggagggcaaactcctccgggcccggaatcgccggcagctgttcgccatgagccccgcggacgagtgcagccggcagtacaactcc

SEQ ID NO: 96530 - DNA, 292 bp, Homo sapiens
  chr7:1408479-1408771
  hyper
ctgaaccccgggctgcgctctccccgcccctgcctggcgagtgcagattcccgcctattttccgacacccgcctgcagaggagtcgggcgccagatgggatcgaacccagcaaggtgagaaatccgggcggggtggcagatggggaggccttccccggggaactccaggagaggggaggacagcgagggccccgggcgcggcctctcgtgtgcccccagccgcggggcgcaggcccgcagccccccaggggcgccgcagctgtcactccgcggtgagtggcgccatccggat

SEQ ID NO: 96531 - DNA, 201 bp, Homo sapiens; identical to SEQ ID NO: 31000
  chr7:1408874-1409075
  hyper

SEQ ID NO: 96532 - DNA, 36 bp, Homo sapiens
  chr7:140992705-140992741
  hypo
gggcttacaagtgtgagccaccgcacccggccagat

SEQ ID NO: 96533 - DNA, 187 bp, Homo sapiens
  chr7:141007214-141007401
  hypo
aggggatcctggcagcggctgccactcacttgctgggtcccctacatgctttcctcctcagtagggctcctttctgggagcccccacccttaggccaacaggaggctcccatcagactctgccggagcacatatataccagaatccggcatttcagaggcactgaggggtcacgggacctctgaact

SEQ ID NO: 96534 - DNA, 30 bp, Homo sapiens
  chr7:141137501-141137531
  hypo
aggccttatgcagtacgtggcagggctgct

SEQ ID NO: 96535 - DNA, 236 bp, Homo sapiens
  chr7:141211363-141211599
  hyper
ctgctactagccagccggctggaaaatgtggccaagaaaaccgcagagaccaatgttcggaggagaaaaccagaaagaggggcctgcctggcccctttgatcctttatggccgattccgtggacattgctgctcctcacgccggcagccctctcttgagtacctcaattgcagtctccagaccctccaccccgccaggcattcctgggtcggtgtcccagtcggtcacagtcatcg

SEQ ID NO: 96536 - DNA, 29 bp, Homo sapiens
  chr7:141534669-141534698
  hypo
caggcgtaagccaccgtgcccggcctcgt

SEQ ID NO: 96537 - DNA, 24 bp, Homo sapiens
  chr7:141557650-141557674
  hypo
gtgagccaccgtgcccagctgcta

SEQ ID NO: 96538 - DNA, 210 bp, Homo sapiens
  chr7:1416015-1416225
  hypo
gcaaagtggtgggttcgggacgttcaccgcagtgttgtttgtaacagccaaaggctggaaatcagctggcagcccatcagaggacttgggtaagtaaatggcggccatccaccagcagggcatcgtgcaggcactaaactcaatgctacaggagaattcctcgtggcacaggaaaggtctcatcgtataccgttgcgggaaaagggcagg

SEQ ID NO: 96539 - DNA, 264 bp, Homo sapiens
  chr7:1423398-1423662
  hypo
tacctcggggagccccgcagagaaggatccttagccccactccatccttctctgccgctgttccgccccctgccccagcaggaacagtctctacccctcgtctgcctcagcatggacagccccaaaaggcccccgctccatccctttctcagcagggttggcctgcaacagaccagacatccagcctgccgaggaggggcagggggtcttgctgccttccccccgcccagtccctgctgcctccacggccggacccccagcttc

SEQ ID NO: 96540 - DNA, 306 bp, Homo sapiens
  chr7:143042619-143042925
  hyper
tgatcctgctgggctcggtggagcggtcggaactgcaggccctcctgcagcgccacctgtgtcctgagcgcaggctgcgcgcagcccaagagatggcgcggaagttgtcggagctgccttacgacgggaaggcgcggctggctggggaggggctccccggcgcgcctccaggccggcccgagtccttcgcctttgtggatgaggatgaggacgaagacctctctggcaagagcgaggtgaccgcgccgggaagggctagggagtgggatagatcaggagcaaagggaaaagcgtcgtctgggctgg

SEQ ID NO: 96541 - DNA, 84 bp, Homo sapiens
  chr7:143060085-143060169
  hyper
ttgggtttcaggagccgaggcacgaacccagggcctaccccgaggttctggttgatggattttgcgggccggggtcaggggatg

SEQ ID NO: 96542 - DNA, 42 bp, Homo sapiens
  chr7:143579623-143579665
  hyper
tcaccagcagaaatacggacacaaaggggattctctgtcccc

SEQ ID NO: 96543 - DNA, 285 bp, Homo sapiens; identical to SEQ ID NO: 31596
  chr7:143579666-143579951
  hyper

SEQ ID NO: 96544 - DNA, 143 bp, Homo sapiens; identical to SEQ ID NO: 9262
  chr7:143579952-143580095
  hyper

SEQ ID NO: 96545 - DNA, 30 bp, Homo sapiens
  chr7:143737774-143737804
  hypo
aattggttgggaggccgaggcgggtggatc

SEQ ID NO: 96546 - DNA, 30 bp, Homo sapiens
  chr7:144185679-144185709
  hypo
acacacacacgtgcacgtggaggcacacac

SEQ ID NO: 96547 - DNA, 144 bp, Homo sapiens; identical to SEQ ID NO: 31001
  chr7:1443541-1443685
  hyper

SEQ ID NO: 96548 - DNA, 41 bp, Homo sapiens
  chr7:1443733-1443774
  hyper
cggctggtctctttccctcccctctccgtgttcccaggcag

SEQ ID NO: 96549 - DNA, 30 bp, Homo sapiens; identical to SEQ ID NO: 41496
  chr7:144488206-144488236
  hypo

SEQ ID NO: 96550 - DNA, 30 bp, Homo sapiens
  chr7:144565945-144565975
  hypo
gtgagccaccgcgcccggccatgataattt

SEQ ID NO: 96551 - DNA, 132 bp, Homo sapiens
  chr7:1451244-1451376
  hypo
tcttttctgctggggcgcccggcgggccctgcctgtggttcgccctgtgtgcgggcggtgtgggcgtctttgccgcagggtgcttgtcgtggcaagggttctttgtgtgtacttctgcgttgacatgcatca

SEQ ID NO: 96552 - DNA, 104 bp, Homo sapiens
  chr7:1452435-1452539
  hyper
gcgcgcgcgggtgcacgtgcgtaatggatgcacacgcatgcagctggtgtgcgtgcagtcgggcgcacctgtaaccggtgcgcaccccgcgtctggcgtgcaag

SEQ ID NO: 96553 - DNA, 30 bp, Homo sapiens; identical to SEQ ID NO: 41075
  chr7:1453817-1453847
  hypo

SEQ ID NO: 96554 - DNA, 306 bp, Homo sapiens
  chr7:145812702-145813008
  hyper
gcatatgtatgagtacgaattaattacatatcgaaaacatgtgcattaacggcatctgcagtcctccctccctgctccagtcagtcgggatgtttagcaccgtcacttggtgttaggaccactcggaagacctgcctgtcggacgcctgactgtggttcccggggggccggagctccaggagcctgtaccatctttatctgaaggggaggagagaaggaaaggagaaggcatccgagcgagggtgttctccttcctgcagccgggtagggggcagccaggtttggagcagggttctaggattacac

SEQ ID NO: 96555 - DNA, 382 bp, Homo sapiens; identical to SEQ ID NO: 31599
  chr7:145813009-145813391
  hyper

SEQ ID NO: 96556 - DNA, 318 bp, Homo sapiens
  chr7:145813403-145813721
  hyper
cgctgaggccgtgcgtgcgccccggctgcgctgcgcgctccccacatacacaagctctccatgtgagctgacaggcgagtggaaacccctcgagtcacgctgcccggcggcggagggagcgctcgcccgcagtggcaacagctgcaccaccgtccccgtcgctctgccttcctcttctgcagcctctgctcttctgattacctccctcccccgtcctttggtgatttttttttttcaagaaggagagggcggggtaggtgtccgttccctcccctcttccccctcctttgccttcttggtttgaatttcctcccccgg

SEQ ID NO: 96557 - DNA, 254 bp, Homo sapiens
  chr7:145813945-145814199
  hyper
cgccgccggccgggaggcgaaggatgcaggcggctccgcgcgccggctgcggggcagcgctcctgctgtggattgtcagcagctgcctctgcagagcctggacggctccctccacgtcccgtaagtagccgtctcctcgctctgctctggagcagtttcagtgcggcattgatgtttggcaccagggtatcaactccgaagtgcatcgcagtgctggcaccctgatgtgtttgtgtctccgctgtcacacactt

SEQ ID NO: 96558 - DNA, 154 bp, Homo sapiens
  chr7:1458926-1459080
  hypo
aggcactcagtgttccgggccctgttacccctccagctcccataaccccgtctcctcctcctcctcgccctcctcctcctcgctgtctctgcaccacttccacctgcccgggcctttgcacctgcaggttcgtaccctacggggtgtgccctgc

SEQ ID NO: 96559 - DNA, 185 bp, Homo sapiens
  chr7:1460773-1460958
  hypo
gagcgtgtcatttcccgcatgtgacacagagtgcggactgtgcagaaggcggctctgtgcctcggaaggcagggtgcagaggcgtgcagcgctcaccacggggatgcggccggctcctgggacgggacctggaacgcggatgtggccggatgtttagtgggtgccgtgcacggtgtctgacacat

SEQ ID NO: 96560 - DNA, 22 bp, Homo sapiens
  chr7:146300226-146300248
  hypo
gggcgaggtggctcacgcctgt

SEQ ID NO: 96561 - DNA, 23 bp, Homo sapiens
  chr7:146757526-146757549
  hypo
tgtgcaggctgggcacgatggct

SEQ ID NO: 96562 - DNA, 18 bp, Homo sapiens
  chr7:146758938-146758956
  hypo
ttctttggccgggcacgg

SEQ ID NO: 96563 - DNA, 18 bp, Homo sapiens
  chr7:147750129-147750147
  hypo
ctccgtctcaaaaaaaca

SEQ ID NO: 96564 - DNA, 19 bp, Homo sapiens
  chr7:147816617-147816636
  hypo
actccgtctcagaaaaaaa

SEQ ID NO: 96565 - DNA, 58 bp, Homo sapiens
  chr7:147939618-147939676
  hyper
gttttctataaacaccgaccaaaaccagagtcctaggttatagcgcgggttacttgca

SEQ ID NO: 96566 - DNA, 27 bp, Homo sapiens
  chr7:147991189-147991216
  hypo
ggaaaaagcaggcggtgtttcctattc

SEQ ID NO: 96567 - DNA, 95 bp, Homo sapiens
  chr7:148224591-148224686
  hypo
tgagccaccgcgcccagccgacagcaatcttttattgaaccagagctgctctttgtggatgaggtctaactcctatacagcgtgctcagagtagc

SEQ ID NO: 96568 - DNA, 30 bp, Homo sapiens; identical to SEQ ID NO: 41499
  chr7:148500594-148500624
  hypo

SEQ ID NO: 96569 - DNA, 20 bp, Homo sapiens
  chr7:148582580-148582600
  hypo
aggatatttgcaaggcgcgg

SEQ ID NO: 96570 - DNA, 95 bp, Homo sapiens; identical to SEQ ID NO: 5071
  chr7:148640241-148640336
  hypo

SEQ ID NO: 96571 - DNA, 24 bp, Homo sapiens
  chr7:148819014-148819038
  hypo
tgtttttttttgagacggagtctc

SEQ ID NO: 96572 - DNA, 213 bp, Homo sapiens
  chr7:148841978-148842191
  hypo
cttctcggctactacattttaaataataaaattatacaacagaattttctttccaagaaaattcagattattatttttttgtaatctactcatattgtgagtcagagaatggcaattttcattattaagcattcaccatctgacaaatatgtatattcaggtaaatcccaaattacggactgcatatgtagccacaggcgaaaagtaacttag

SEQ ID NO: 96573 - DNA, 149 bp, Homo sapiens; identical to SEQ ID NO: 41502
  chr7:148846075-148846224
  hypo

SEQ ID NO: 96574 - DNA, 40 bp, Homo sapiens
  chr7:148883977-148884017
  hypo
gattacaggagtgagccaccgcgcccggcccgcgtaaagc

SEQ ID NO: 96575 - DNA, 37 bp, Homo sapiens
  chr7:148959621-148959658
  hyper
cccaaatgccaggcccggcgggcggggccccgacgtc

SEQ ID NO: 96576 - DNA, 110 bp, Homo sapiens
  chr7:149110-149220
  hyper
gtgggcagggctgcccgagagacccaggcggccattgcccgccctgcgtctgcgcctgcgccggagcctcctccacactgcgccagcgccgagtccggccgcctcctcat

SEQ ID NO: 96577 - DNA, 320 bp, Homo sapiens
  chr7:149111906-149112226
  hyper
ctttccaggagcagccgctggagatcctgcctctccaagagaacctggctaacccccacacttaggtcagaagaaatgtgtgatgggaaaccagccctctctgggagtgtgaaggtaaagacggtcctatatttcagttccagtggggctgcagggtcttttgctatcggtgtgctatgtatgcaggtcttgctagagactgagaacctctaaaagtcattgcgcagagggaacgcggatttacccggcatggtctttggaaatcagtgtgctgtggaagcaggtcttgctagagccaagaaacctctaaaagccactat

SEQ ID NO: 96578 - DNA, 5 bp, Homo sapiens
  chr7:149112420-149112425
  hyper
cgctt

SEQ ID NO: 96579 - DNA, 38 bp, Homo sapiens
  chr7:149118656-149118694
  hypo
aaaaaaagtgcaggccgggcgctgtggctcacgcctgt

SEQ ID NO: 96580 - DNA, 184 bp, Homo sapiens
  chr7:149119889-149120073
  hyper
cagcaccagtgagaccgacacggttgtgccccatcccacaggcgccaaatggagggcgcagggttttaggagctcgcgtagggcctctcgggcggcagcaatggagccgcgaggccggcggggagaccgaggacgggacccgctgagctctgggtgagctggggggactcgaggggacctggat

SEQ ID NO: 96581 - DNA, 172 bp, Homo sapiens
  chr7:149159300-149159472
  hypo
ataaactacagtttacgttccattccccctagaggaatgagaacaaacctgctgccagcgacatctgcatgcatgtctcattgtgcactgctaaagtgcgtctctagagacgcctagacatgggactctggatggcaagagcaccttcatctttccccggcttcccgaactg

SEQ ID NO: 96582 - DNA, 30 bp, Homo sapiens
  chr7:149184025-149184055
  hypo
ggggtccccatgccccggggaacctggact

SEQ ID NO: 96583 - DNA, 32 bp, Homo sapiens
  chr7:149389639-149389671
  hyper
tgcacaccacctaggcgcgtgtattagagcgg

SEQ ID NO: 96584 - DNA, 21 bp, Homo sapiens
  chr7:149389934-149389955
  hyper
cgcctccgcaccctggggagc

SEQ ID NO: 96585 - DNA, 389 bp, Homo sapiens
  chr7:149411339-149411728
  hyper
cagaggagagtgggccgcgcttccttcccgcatcacacgtttatttgaggcctactatgtgccaggaacaactggggttaccaccccagcaaacaggcacgcaaaatgtgacacgaaggtaggtcatggctgcggcgagcgggggcgcgggcgaaagacgtgaggatgtacgggggcctggcagctgctctgtcccacccacgcccggccggaccctcgacccctttcactccaggtcgggtttccccgaccgcggcctctgggaaagatgggtccctcttcatccccaccatcagcccctggcacatgggacgcgctgagtggtggctgcgggaatgaatgagtgataagcggcgcgtacccgcgggcttgcacgcccacagccgccc

SEQ ID NO: 96586 - DNA, 575 bp, Homo sapiens; identical to SEQ ID NO: 31605
  chr7:149411834-149412409
  hyper

SEQ ID NO: 96587 - DNA, 143 bp, Homo sapiens
  chr7:149427347-149427490
  hypo
gccccggctccagctcgagcttcagcggctctgaaggagaagacccgaggccagagcctgatctctggaagccgctcccccagggtgagcctgtgcggagagggaggatagcgggatgtgtgccagggcgccagtcaccactc

SEQ ID NO: 96588 - DNA, 30 bp, Homo sapiens
  chr7:149480372-149480402
  hypo
acgccttcgcagaggcggcctgtgccatcc

SEQ ID NO: 96589 - DNA, 30 bp, Homo sapiens
  chr7:149489914-149489944
  hypo
cacacatccccaattcggaacccctgccct

SEQ ID NO: 96590 - DNA, 47 bp, Homo sapiens
  chr7:149513473-149513520
  hypo
gctggccgcctgtaccgtgaatgccagcccggcgagggatgcccctt

SEQ ID NO: 96591 - DNA, 141 bp, Homo sapiens
  chr7:149518573-149518714
  hypo
tgcctgcagggcactcgctcccgcaccctgggggacagctggctgcagggggagtgccagcggtggtgagtgcagggcagggaggggggctggaaccgccctgctggagagcagagtcctgagtcccggctctttcccagc

SEQ ID NO: 96592 - DNA, 40 bp, Homo sapiens
  chr7:149529824-149529864
  hypo
tggccctagttcacccgctccctctcgcccaggagccata

SEQ ID NO: 96593 - DNA, 338 bp, Homo sapiens; identical to SEQ ID NO: 31606
  chr7:149744461-149744799
  hyper

SEQ ID NO: 96594 - DNA, 137 bp, Homo sapiens; identical to SEQ ID NO: 31607
  chr7:149744950-149745087
  hyper

SEQ ID NO: 96595 - DNA, 15 bp, Homo sapiens
  chr7:149745123-149745138
  hyper
cgactctacctggct

SEQ ID NO: 96596 - DNA, 15 bp, Homo sapiens
  chr7:149745575-149745590
  hyper
gcggtgggggagtcc

SEQ ID NO: 96597 - DNA, 37 bp, Homo sapiens
  chr7:149917110-149917147
  hyper
agccctgctgctggccgcgggtctacaaaacagcata

SEQ ID NO: 96598 - DNA, 74 bp, Homo sapiens; identical to SEQ ID NO: 31610
  chr7:149917321-149917395
  hyper

SEQ ID NO: 96599 - DNA, 51 bp, Homo sapiens
  chr7:149917773-149917824
  hyper
ctaggctctttcctgcgcaaggggtggggaaacccgcgaaagccagggagt

SEQ ID NO: 96600 - DNA, 303 bp, Homo sapiens
  chr7:149917888-149918191
  hyper
cgctccgctccagggcggatctttccacacccccctcaccctcaaaagctcaggctggagcggtcatcagtgcggactccggcaccccacccacccagcaggggttaaggagggactggtgcccactcttgcctacagctcctgcgcagggctccagccgccaaatcttcccgggatggtcgggaggtggcataagaggttttgccaggaaccactgcacaggcgaaagagagacagtggagtgggcggaggaggagctgggacggcacccgggctcgttagcccaggctgcacgagctacag

SEQ ID NO: 96601 - DNA, 15 bp, Homo sapiens
  chr7:149918262-149918277
  hyper
cggcccaattggctt

SEQ ID NO: 96602 - DNA, 93 bp, Homo sapiens; identical to SEQ ID NO: 41504
  chr7:150049533-150049626
  hypo

SEQ ID NO: 96603 - DNA, 1037 bp, Homo sapiens
  chr7:150068543-150069580
  hypo
ctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccattcagctgcaaagcggcccatcgcttgtcccaaatgcgagagacgcttctggcgacgaaagcagcttcgagctcatctgcggcggtgccaccctcccgccccggaggcccggcccttcatatgcggcaactgtggccggagctttgcccagtgggaccagctagttgcccacaagcgggtgcacgtagctgaggccctggaggaggccgcagccaaggctctggggccccggcccaggggccgccccgcggtgaccgccccccggcccggtggagatgccgtcgaccgccccttccagtgtgcctgttgtggcaagcgcttccggcacaagcccaacttgatcgctcaccgccgcgtgcacacgggcgagcggccccaccagtgccccgagtgcgggaagcgctttaccaataagccctatctgacttcgcaccggcgcatccacaccggcgagaagccctacccgtgcaaagagtgcggccgccgcttccggcacaaacccaacctgctgtctcacagcaagattcacaagcgatccgaggggtcggcccaggccgcccccggcccggggagcccccagctgccagccggcccccaggagtccgcggccgagcccaccccggcggtacctctgaaaccggcccaggagccgccgccaggggccccgccagagcacccgcaggacccgatcgaagcccccccctccctctacagctgcgacgactgcggcaggagcttccggctggagcgcttcctgcgggcccaccagcggcagcacaccggggagcggcccttcacctgcgccgagtgcgggaagaacttcggcaagaagacgca

SEQ ID NO: 96604 - DNA, 523 bp, Homo sapiens
  chr7:150069934-150070457
  hypo
gagccacatccgggacggcgccttctgctgtgccatctgtggccagaccttcgacgacgaggagagactcctggcccaccagaagaagcacgatgtctgagacggtgggcggggccgtgttggctgagagagggctggggtccttcgtggtgggagtcgcagtgggctgggggtgcctgcctagtgctggagtaggggacaatgggaatcctagaggggatggaagacgcggggagtgagctgggtgggccctgctagcgagagaggtcaaccccggtggccagggaacccacttccaagcgcagggacgccggcctccagctggtgtgtgctaaggctccgtcctgactgccctgtgccctggaaaagcagcaatagcatccgccccttagagccctctggctagaggagccaccagtggaaaggaagaccctccatcctctggtattaacgccttaatgcccctgtcttttactgtaagttacttaagatcatttttggaagcaggcgtggtagagtcctg

SEQ ID NO: 96605 - DNA, 152 bp, Homo sapiens
  chr7:150079238-150079390
  hypo
tcctgcatggtggagcgtggaggctcctgtgtggcgctgggggcctctgagattcccaactggctggaaggagtgatggcttaggaggagtgagtggcagcggggacgctggcagagaggcttgtacagatactgcccgatgcatccggctc

SEQ ID NO: 96606 - DNA, 185 bp, Homo sapiens
  chr7:150081081-150081266
  hypo
tgcctccccctgccccgggcctctccacctgctgctagctcaatcccctctttgtgtggttggtcttcagttgtcatggcagctgggcccaggctgaggcctgcccactgtgaggctcttaactgaactgcagcctgacccggtgcgcggagggccgggccagggccaggcgtgggaagggggcc

SEQ ID NO: 96607 - DNA, 48 bp, Homo sapiens
  chr7:150101959-150102007
  hyper
cagtcctgaaaccctcgcccagggccgctccgccgccgggctccggcg

SEQ ID NO: 96608 - DNA, 477 bp, Homo sapiens
  chr7:1503320-1503797
  hypo
catggcctgaggcatcgctcatttcagtccaaaacatccaccttggcttgcattagcttagctcctgggtccccaagaggcgctgcagaggtggggacccaggtgccacacccggaggggtggggcaggcttatgaggggttgactccttccaccagtggattcaaccctgaacgtcacctgaccaaggctgctgggccaagctggaacagaatcggatccttgagtctgggaggcggaggcggttcgggaatgcagagggcgtgagagagaaccaagggaggtgtcctggccgagtggtgtttcccgcgggacttctcagagccttcatcacctgatacgcacctccactcttccagggagaggacacactgcacagtggttcccaaactgacttgcccacaggacccctgtggacggttgtggggcaccacgtcagcccccctgcagagcgtggaagggacgttgccctccccac

SEQ ID NO: 96609 - DNA, 238 bp, Homo sapiens
  chr7:150497647-150497885
  hyper
gggcggggctggaggcgagaacgaccccacgggctttcccagggccgtccgcccgcggaccctcccagctccccagagcccagtgaccctcgcgcagcaggagaaccccagacggaccccaggccctgcagcctgtcatgaacccgaggggctgaagttcagccccacccccgcctcccctccccgcctccccctccaactctcaacccacttctccagccagcgccccagccctccc

SEQ ID NO: 96610 - DNA, 30 bp, Homo sapiens
  chr7:1505469-1505499
  hypo
cagcagcccctccaccgtatcccagctctg

SEQ ID NO: 96611 - DNA, 87 bp, Homo sapiens
  chr7:150554703-150554790
  hypo
tcatgagttagcccccggcatcgactgcccggagaccgccaccttcctggacactttccactactatgatgccgatgacccggtcca

SEQ ID NO: 96612 - DNA, 30 bp, Homo sapiens
  chr7:150609213-150609243
  hypo
cttggaggagaaaagcgggactgggttaca

SEQ ID NO: 96613 - DNA, 38 bp, Homo sapiens
  chr7:150653091-150653129
  hyper
tctccctgacacccccgcccagccggtccagtgctgag

SEQ ID NO: 96614 - DNA, 30 bp, Homo sapiens
  chr7:150660247-150660277
  hyper
cacagcccacactcccgaggcagccagcac

SEQ ID NO: 96615 - DNA, 243 bp, Homo sapiens
  chr7:150715080-150715323
  hyper
gaaaagcagaaacagcggggtgaggagcggggacaggagctcctccaggagggagacctggggaagcagcggtgaggctgagcaggggtcgctgaggggcccacgcgcgttatcaggaccaagcagtccccagcgaccctcgccagggcaagaagcctccccacccagtcactccctagactcctggtatagtccgtttgtctcatgccctctcccagacagaccctccgcgcagacagaccc

SEQ ID NO: 96616 - DNA, 742 bp, Homo sapiens
  chr7:150715618-150716360
  hyper
ggagaggtaaggattcggggggaacctcacatggccccagatcagagaaaccaacacacaccaccaccccgggcatctgccgtcgcacctggcgacggtggcggtgaccccgagcgcggtcatggcggtgagcacgtgctccacggctagcacgtcctcgtcgtagacggtgagcacaagcagcgcggcgaagagtgcacccgcgaagaaaacgagctggcgggccagcagcgtgcgcaggggcgcggggggcgcagcggtgcgcaggaaggcggcggcggggcggtaggcgcgggccaggcgcgcgcgcagctcgtgcggcagctcgttgaagtggcgcagctgcaagcgcgccaggcgggaccagccgcgcgcccccagcgcgccaggctcgcgccgcagcagctccacgtggctatagaagacgtgcagaacctgccaggccagcaccagcgggctcagcgccaggttcagggcggccagcagcagcactgtgcgcccccagcgcgctgctagggcgccccgctggtcgctgcgcttgtaggcgtgcggcagctcccagcccccgcggaagagcgagaagggaccgcggaagagcagcaggtcgacattgagcgccaggccgcggctgaggaaagccgcactgcctccccagggcagcgggcagcgggccggcagcaggcctttgttggccagcgccacctggtagttggtgtagcgcaggatgcggtggtggatgtcc

SEQ ID NO: 96617 - DNA, 294 bp, Homo sapiens
  chr7:150746049-150746343
  hypo
gcacgggctgggccacgtcttcgggccaggcagcctgagcctgcgccgggggatgtgggcagcggccgtggtcctgtcagtggccaccttcctctaccaggtggctgagagggtgcgctactacagggagttccaccaccagactgccctggatgagcgagaaagccaccggctcatcttcccggctgtcaccctgtgcaacatcaacccactgcgccgctcgcgcctaacgcccaacgacctgcactgggctgggtctgcgctgctgggcctggatcccgcagagcacgccgc

SEQ ID NO: 96618 - DNA, 542 bp, Homo sapiens
  chr7:150748043-150748585
  hyper
aggggctggggttttcgtcccatggcgggcagggcccagggagctgaggctgcttctaaagccatctccccggtacccgcaggcgacgtgccagtgtgcagcccccagcagtacaagaactgtgcccacccggccataggtaagggcgagcctcccccacctcccgtccgccccgctccgcccgcgggcgtctgacgcggcccggtggcccgcagatgccatgcttcgcaaggactcgtgcgcctgccccaacccgtgcgccagcacgcgctacgccaaggagctctccatggtgcggatcccgagccgcgccgccgcgcgcttcctggcccggaagctcaaccgcagcgaggcctacatcgcgtgagctgcgcggggcgggcgggctcctccgagccgggggctcccgacggggcggaacggggcaggccaggccgtagccctagtgcgcacagcccgggcggaggcagcctccgcagcctcactggctctggggctccgtgctggttgcttaatctttctggccccgggggatgctgacg

SEQ ID NO: 96619 - DNA, 156 bp, Homo sapiens
  chr7:150753912-150754068
  hypo
ggtccgcctgacagacgtccagtgtcagcccccgcctcccccaagcggccacaccggcaaggagcacccgcctcccgcacacctgacgatgttcttgtgcttcagctccttgagtaggcagatctcccggagggcggaactcggcacaccctgcat

SEQ ID NO: 96620 - DNA, 267 bp, Homo sapiens
  chr7:150758966-150759233
  hypo
ccctcccagggctctcgatggtgatcaggcctctcccccatccaggttatgcctccgcctcgttgccctgaaagccgcagcgacagcgaaaagggctaagattcggccatgagcagcgcccctcggcgccccgccaagggcgcagattctttctgtacggtgagtgtggcccccaggtcgccagcccaaccttccctccctgggcagccttgggtgctccggccaagggtcctcgccaaccaggggtgtgagcgtgtgtgagtgtgg

SEQ ID NO: 96621 - DNA, 171 bp, Homo sapiens
  chr7:150773894-150774065
  hypo
gggactccagttcctcgaagggtagctgtggggagaggagagggcggcaggttacccgcaggctgggagtgaggatgcgccacgggccaggccagggccactcaccggcaggagctggtagcccatcaggcctaggtgccgctccctcagggccctcgagcccagcagcac

SEQ ID NO: 96622 - DNA, 33 bp, Homo sapiens; identical to SEQ ID NO: 41512
  chr7:150774325-150774358
  hypo

SEQ ID NO: 96623 - DNA, 153 bp, Homo sapiens
  chr7:150774704-150774857
  hypo
cacctgtacttgcagcgggcacggtcggtgatgagaggctggggaaagatgggcacttgctgccttcggggaaggcggggaccccggtatcctgggagctccagctccacggccgtgtccagcagggagaggtagcgacgcacaatcagagca

SEQ ID NO: 96624 - DNA, 73 bp, Homo sapiens; identical to SEQ ID NO: 41514
  chr7:150811286-150811359
  hypo

SEQ ID NO: 96625 - DNA, 30 bp, Homo sapiens
  chr7:150813180-150813210
  hypo
ggaacctggaggtgacggagatgggggcct

SEQ ID NO: 96626 - DNA, 330 bp, Homo sapiens; identical to SEQ ID NO: 41515
  chr7:150823565-150823895
  hypo

SEQ ID NO: 96627 - DNA, 30 bp, Homo sapiens
  chr7:150826816-150826846
  hypo
actcgcgagtccttgcgaggcaatgagagg

SEQ ID NO: 96628 - DNA, 178 bp, Homo sapiens
  chr7:150864219-150864397
  hyper
ggctcggggttgtttcgggcggcagtggcggcggcggcggcagcggcggcggcgagctcctggggcccgtagaaagcgtcgggcggctccgcgaagctgggcagcgcggtggtcagcgccaccatcgagggcacagcctgacccagccccgcgcagaaggtgttggtaaggcggccgg

SEQ ID NO: 96629 - DNA, 314 bp, Homo sapiens
  chr7:150864610-150864924
  hyper
cgctaccgcctccggcccgctgcatcttgttcggagctgcggccgccccggggcgctcctctctgggcgcctccgtgcgccccgcggctcgggcgccccgcgcggacacgcagggctcgctccctggctcccgggccgaggtggcggcggggcgcgggctcggcgcagtgtggctccggcgccgcgctccctctctctcataaggagggagggggcgggcgagcaggcgggctgggggtgtcgccctccggactcatccatcttcctcaaattacgcttcatttcctccctccgcccgccgccgccgcgcccgg

SEQ ID NO: 96630 - DNA, 399 bp, Homo sapiens
  chr7:150870816-150871215
  hypo
ctccaaactctttcccgcaccagcgagcccgcactcgcatgatacccagacctgcgctcgacctggccccagatccccgtgccaagggccacagcctctgagatgcttcctaggcggctccagtgccatctccccagcaacggccttctgcttcccgttacttcctcgtcttccccatcttagcatctggcaccaccgtccaggggtccaagccaaaaacctgcgagtcgccctagacagcgctattctgcagccccctacatcccccccagcggcggccccccagttcttcccagggatcccgaatctcgcccgccgcgaccacctctggcctggaccaccgccgcaggtgccccccgacccacgcccgcagccaggacggtccgtcctgccactcct

SEQ ID NO: 96631 - DNA, 136 bp, Homo sapiens
  chr7:150872876-150873012
  hypo
acatcacccggctgccgctgtcggtccgcttctctgcattgggaattgcagcatccacacctgcctgcggagctgggcctcctgctgccagggctacctggcctgagttagtgcagaggcgcgccctctgcaggct

SEQ ID NO: 96632 - DNA, 83 bp, Homo sapiens
  chr7:150884625-150884708
  hypo
accttgccaggtccccggtgtagagggcattctgcagggccatgtcttggcagagcagtggtgatggccgagggggctcccag

SEQ ID NO: 96633 - DNA, 30 bp, Homo sapiens
  chr7:151077135-151077165
  hypo
agacctggccacccccgaggtctgtgtgtg

SEQ ID NO: 96634 - DNA, 76 bp, Homo sapiens
  chr7:151082136-151082212
  hypo
tggggtggcacaggtcgtgcagggccaagtcacttacaggtgcccgcgtggtacttgagggcgctcacgttgcgtc

SEQ ID NO: 96635 - DNA, 48 bp, Homo sapiens
  chr7:151088640-151088688
  hypo
gattctgtttctctgcgcaccgggtctggggcccgacagtccttttca

SEQ ID NO: 96636 - DNA, 358 bp, Homo sapiens
  chr7:151106208-151106566
  hyper
agggagatttcctgccgctggttgacaaatgatcttcgcctttgtagcggacgcccctcgacccacccacccgatcccggccgcaccctgctctgcacccgcaccccacccccagacctcaccctgccctgccgtgcgctcaacagccagatgctgggcccagacaagcgctcttccgctagtgtgccgggatgagcgggggctggacttctagaaaggggtctgcgggcgcaggagctggggtccgcggtctggggccggtgagctgcggcgaagaggtcagggagggagtgggagggtctaccttgcaggagcgcgcagcactggccgtccgcggtgctccagagccgggccgtgc

SEQ ID NO: 96637 - DNA, 400 bp, Homo sapiens; identical to SEQ ID NO: 3135
  chr7:151106589-151106989
  hyper

SEQ ID NO: 96638 - DNA, 242 bp, Homo sapiens; identical to SEQ ID NO: 31619
  chr7:151107395-151107637
  hyper

SEQ ID NO: 96639 - DNA, 205 bp, Homo sapiens; identical to SEQ ID NO: 31620
  chr7:151107638-151107843
  hyper

SEQ ID NO: 96640 - DNA, 81 bp, Homo sapiens
  chr7:151137032-151137113
  hyper
gtttacaccgggcagcgccctgctggctcagcgccgccccggacaaaagatttgctgggccggccccggagcgttagtgct

SEQ ID NO: 96641 - DNA, 417 bp, Homo sapiens
  chr7:151145500-151145917
  hyper
ggccgagggccccagcggagctcggcgggggtgcggggcggttccaggagcctcgccccctgctggggacccagcttgtgccctggcgtcgtggccgccggcaggcagcaaggaagggggtgtaaagagcccggttaggctgagtccctgcccttccgagggagcccgtctgcgagtgagcccgtctgcaagtgagcccgtctgcaagtgagctgggcctgggcctctgcaggggtcgccccgccagcccgggccccctggctgcgccccgtttccagccggcgtcagggagggggctgcagtgctccgggggtcatcggattcgggcggggaaggaaaggcgggacgtctgcgccccagaagacagtccccgggtctcccaccctgaaagccagcgaggttcgggtaaatgaaagt

SEQ ID NO: 96642 - DNA, 30 bp, Homo sapiens
  chr7:151423801-151423831
  hypo
aaattcaaaaccagacgatgccaatcttga

SEQ ID NO: 96643 - DNA, 32 bp, Homo sapiens
  chr7:151501814-151501846
  hypo
tccgtggtgttccatcgcggcacagagtcggc

SEQ ID NO: 96644 - DNA, 175 bp, Homo sapiens
  chr7:151553599-151553774
  hypo
gggttcaattggcctcgccgtggcccttaggcaaacaactcattctatctgagcctccgtttctccaactgtaaaaaccgggtgaatactaggaacaggcagagttgctgatgagttaaatggcaaaatatgtgaaagacgttaagtctggcacccacaccgaatataactcagt

SEQ ID NO: 96645 - DNA, 72 bp, Homo sapiens
  chr7:151569929-151570001
  hypo
ggaggctatccacagcgtccaccgcagcttcttcacgccttcaggagggggtcctcacgccttaggcctggt

SEQ ID NO: 96646 - DNA, 198 bp, Homo sapiens
  chr7:151574921-151575119
  hyper
gttcatcaaggtttgcgcagtggatccgcggtaagtgcgtgtccccacgccgcgggaaacgtggggctcctgagactgcggaaagaattgggagaaggggagggctcgaagacccgggcgagggttcccggtgcggcccaggtcctttagagccccgggtgggcatccagtaccgcctgctgccgagggccctagagg

SEQ ID NO: 96647 - DNA, 30 bp, Homo sapiens; identical to SEQ ID NO: 41520
  chr7:151585396-151585426
  hypo

SEQ ID NO: 96648 - DNA, 30 bp, Homo sapiens
  chr7:151585720-151585750
  hypo
agtgagaaacacaggcgtggaggattttcc

SEQ ID NO: 96649 - DNA, 336 bp, Homo sapiens
  chr7:151591649-151591985
  hypo
ggctcaagccctccccgatccctccgccctctccgatcctccgtcctccccactcctccgccctctccgatccgtcgtcctccccgctcctccgccctcccagttcctccgccctcctggcttctctgccctcatcgctcctctgccctccctgctcctccatcctccctgctcctctgccctccccaatcctgtctcctccctgctcctctgccctccccaatcctgtctcctccctgctcctctgccctccctgctccttcgtcctccccgctcgtcctccctcccgctcctctgtcctcccccctcctccatcctccccgctcctccgccctc

SEQ ID NO: 96650 - DNA, 63 bp, Homo sapiens; identical to SEQ ID NO: 41080
  chr7:1516637-1516700
  hypo

SEQ ID NO: 96651 - DNA, 185 bp, Homo sapiens
  chr7:151706792-151706977
  hypo
ccaaccataggtctacgctccctggaccttcccatgttccagtaactaagggaatagcacttggcagggcaagtctactctgatcgccgagggtctgtgccacacccttgttgatatttttagtaggatacttgcatcagtccccatggctgtaactaatacctgtatcacgataatatccaact

SEQ ID NO: 96652 - DNA, 30 bp, Homo sapiens
  chr7:151717267-151717297
  hypo
agggagccatgctctcgtgactttggctga

SEQ ID NO: 96653 - DNA, 36 bp, Homo sapiens
  chr7:151723170-151723206
  hyper
ctcctgaggcttgttcgcgggcgtgggggcgaggac

SEQ ID NO: 96654 - DNA, 38 bp, Homo sapiens
  chr7:151812801-151812839
  hypo
aaaacttacatttaccgccaggagcttgacagcttcct

SEQ ID NO: 96655 - DNA, 21 bp, Homo sapiens
  chr7:152085353-152085374
  hypo
tatgctctggccaggcgtggt

SEQ ID NO: 96656 - DNA, 196 bp, Homo sapiens
  chr7:152159631-152159827
  hypo
tagccaagggtttctcgtgtttgatgccaaatgccttgtgcggggattggctccaaacctcagcctcatcagtcaatttatccttacgttcaagagcagccatttacaaaacgagctcagaaaattaaaaaaaaaatacaaactttaaatcgccagaatactgcataaactaaaagtaggccgggcgcagtggctc

SEQ ID NO: 96657 - DNA, 40 bp, Homo sapiens; identical to SEQ ID NO: 41523
  chr7:152337514-152337554
  hypo

SEQ ID NO: 96658 - DNA, 79 bp, Homo sapiens
  chr7:152371357-152371436
  hypo
gattgcaaaaatcatcggaccttaacctgggtttcaaataatcatttaaatataaggttttggccgggcgcagtggctc

SEQ ID NO: 96659 - DNA, 19 bp, Homo sapiens
  chr7:152374378-152374397
  hypo
agcttaggcctgaatcgtg

SEQ ID NO: 96660 - DNA, 138 bp, Homo sapiens
  chr7:152537420-152537558
  hypo
acccactgtgcttgtcgccgtcctgccttccctgggccggtgctgacgtcattaccctctaatttcccctcagacctgcgagcggcctggtgatgtcttcacagatgagggcgtgggagcccacgggtggggggtttg

SEQ ID NO: 96661 - DNA, 30 bp, Homo sapiens
  chr7:152603655-152603685
  hypo
cagaaagaggcttcacgagaaactggagct

SEQ ID NO: 96662 - DNA, 18 bp, Homo sapiens
  chr7:152622496-152622514
  hyper
gggaacggtggaggccgc

SEQ ID NO: 96663 - DNA, 270 bp, Homo sapiens
  chr7:152622545-152622815
  hyper
cggcggggatcgcagggccgaggggccgggcgcgcgcgggggagggacccaggccaggggccgctcgcctcggggcggggtctctggagagcgcgcagaggggacgcttcgtgaatgcctgccggcctgaaggatgtcgctgatctctgcccccttcgccaaggccgggccaggcgagtaggggcgcggcctgagcccctgcggtgattccccaggtgtggaatcaaaacagatcccagagcgcgatccgcggggcttttggaaggagcc

SEQ ID NO: 96664 - DNA, 38 bp, Homo sapiens
  chr7:152622816-152622854
  hyper
cccagggctggagattccgacgcaaagacccggaggcc

SEQ ID NO: 96665 - DNA, 175 bp, Homo sapiens; identical to SEQ ID NO: 15049
  chr7:152693809-152693984
  hypo

SEQ ID NO: 96666 - DNA, 42 bp, Homo sapiens
  chr7:152775969-152776011
  hypo
ggcttcagaaagggacgaaatcttttttttccatgttaagat

SEQ ID NO: 96667 - DNA, 210 bp, Homo sapiens
  chr7:152782995-152783205
  hypo
ggagttaagttaacccgaggtcttaattttattaaatgatcactgcggtgcagtgggttgaatatgggattcagaaatagaaggtttggcttcatttggtccacaaatagtcattgctgtgttcacagattggtacacagtgatgtataatagcggagacagacagattgcaagctctgtgacagcgatgacgaacgtgggacgtgaaaa

SEQ ID NO: 96668 - DNA, 34 bp, Homo sapiens; identical to SEQ ID NO: 41526
  chr7:152984071-152984105
  hypo

SEQ ID NO: 96669 - DNA, 23 bp, Homo sapiens
  chr7:153041593-153041616
  hypo
tttttttttttgagacggagtct

SEQ ID NO: 96670 - DNA, 22 bp, Homo sapiens
  chr7:153041856-153041878
  hypo
ttacaggcgtaagccaacaagc

SEQ ID NO: 96671 - DNA, 198 bp, Homo sapiens
  chr7:153102258-153102456
  hypo
cagtgcccaaacaatcggctccccgttctcttacgtcacttcacaatggcaggggcctttccagcacccacttctagggcacacagggccttcccggcaaacactcaagatgatgcttaggtttggatcgagatttctttctgaggccctgacccacattctgagatagaaggcactctccagcggcattgtctaagt

SEQ ID NO: 96672 - DNA, 42 bp, Homo sapiens; identical to SEQ ID NO: 41081
  chr7:1532979-1533021
  hypo

SEQ ID NO: 96673 - DNA, 30 bp, Homo sapiens; identical to SEQ ID NO: 31625
  chr7:153445126-153445156
  hyper

SEQ ID NO: 96674 - DNA, 117 bp, Homo sapiens; identical to SEQ ID NO: 9283
  chr7:153446175-153446292
  hyper

SEQ ID NO: 96675 - DNA, 22 bp, Homo sapiens
  chr7:153505321-153505343
  hypo
gcgtgtgtgcacgtgcgtgcgt

SEQ ID NO: 96676 - DNA, 38 bp, Homo sapiens
  chr7:153519547-153519585
  hypo
ttacaggcatgagccactgtgcccggttaatcattttg

SEQ ID NO: 96677 - DNA, 80 bp, Homo sapiens; identical to SEQ ID NO: 41529
  chr7:153540019-153540099
  hypo

SEQ ID NO: 96678 - DNA, 228 bp, Homo sapiens
  chr7:153583302-153583530
  hyper
tttgaccaacctctgcgcgcgctcctgggagcgcgcatctgtgtgtggtccagggagccaaccgcgtttgtgaatggatgattgatgggaacagcgcccaggggcagcaggtggagacgggaacccaggtcgcggtcactggtcaacccgcctcttggggtggaggttagagaaatgggcgctgggatttggccccggccagtgctggggttccagggtagggagagc

SEQ ID NO: 96679 - DNA, 839 bp, Homo sapiens
  chr7:153583631-153584470
  hyper
cggaggcccggagggaagtggaggccgggaagccaggtgtgcggcggggagagcggcccctgccacccgcgctggtagccgggcgctgccattcactgcaaggtcctctgcgccctggaattgccgcggcggcggatgcagaggccaacccagagtgcaaccatggagacgcgacgtgtgtcccatagtaacctgttacaacattatttataagctgccatccctagccttcccccgcttcccctccgctccctcgccagacttgcgggcgacgggcacagccgcgtctggctcttcccggcctctcccttctctcgcgggcgcagccgatcaatagttaacacccggctgcggacggcggctccatccgcggcaatcaccgtagtgcttgtttgtggaagccgagcgtgcgtgcgccgcgcgcgcacccagtccagcgcggagtgggcgtctacccgaggaggggtgtctggggaggggctgccctcgttacccaaacagtttgcgctcgcttaaccttgatgcagctcgaggcttcccagtccagctcagttcagacagaaaacctggcgcgcgcgcgcgcacacacacacgcctcccctggcgtcgccgcccggccgggtccctgcccttagggaccagagcggcgaccgctgcaccccgcaccgcctgctggaggagcccccggagccggggccgagccgccggcgtccccgagtgcgccccctgtgcgtgccgccgcgctgttgctcgcagtgtgctggcgccgagctcggtggacacgcgcgcagtcagagctgcctctcgccctcgctagctgggctcgcagcctcttcctc

SEQ ID NO: 96680 - DNA, 368 bp, Homo sapiens
  chr7:153584779-153585147
  hyper
ggccatgatcaagaccgctaagatgcaggggaacgtgatggtgagtgccacggacagggcgcgcgctgggtcggggggacccaccgtgaggagcgatgctgggggaggtctgtccttctcagtcccgaacctccctggaaggacagcgaccccatgcccgcgcgcggcggcgcttctcccacttcccacccgagcccacccagcggcagggggatgcggaggagcaggcatttctttgcaaattgcaactttgcggctccgcggcccctctccttcgggcatgtggctttgtgttttgggcgcgggatgggaggaaggggctgcggggagccctcgctgaccgcgggtcggtccgagccccaagcaga

SEQ ID NO: 96681 - DNA, 5 bp, Homo sapiens
  chr7:153585601-153585606
  hyper
cgggc

SEQ ID NO: 96682 - DNA, 30 bp, Homo sapiens; identical to SEQ ID NO: 41530
  chr7:153641678-153641708
  hypo

SEQ ID NO: 96683 - DNA, 390 bp, Homo sapiens
  chr7:153749653-153750043
  hyper
agagccccggcttcgcgagccgccggggagggggcggaggaggctgagccaggcagagtcgccagcggagactcgcgagtggcgcgcgggaggagcggccgccggcgctgggcttgccttgctgctgctgctgctgctgcctccccaccgcctttttttttttttaatctggagcggggtggggagtgggaaccggagagaaagcaaaatattaaaaagccccaaagacagccagcaggagcgcggtgcccgatggcttcgctgtaccagaggttcactggcaagatcaacacctcgaggtccttccccgcgcccccggaggcgagtcacctcctgggcggccaggggcccgaggaggacggcggcgcaggagccaagcccctcggcccg

SEQ ID NO: 96684 - DNA, 76 bp, Homo sapiens; identical to SEQ ID NO: 31632
  chr7:153750249-153750325
  hyper

SEQ ID NO: 96685 - DNA, 30 bp, Homo sapiens
  chr7:153789907-153789937
  hypo
ttgatgattcttacccgagtcaagtattat

SEQ ID NO: 96686 - DNA, 324 bp, Homo sapiens
  chr7:153820811-153821135
  hypo
gacagttgtgctgcccgctcgtggggcttacctggggacactcactatgattacctgggacaaatgtgccgctcgctcacggggcttacctggggacagttgtgctgcccgctcgtggggcttacctggggacactcactatgattacctgggacagatgtgccacccgctcactatgattacatgggacagacatgctgcccatgccggggcttacctgggacagacgtgccacccactcactatgattacctgggacagacatgctgcccactcactatgattccatggggacagacatgccgcccacgcacggggcttacc

SEQ ID NO: 96687 - DNA, 30 bp, Homo sapiens; identical to SEQ ID NO: 41531
  chr7:153896397-153896427
  hypo

SEQ ID NO: 96688 - DNA, 6 bp, Homo sapiens
  chr7:154002083-154002089
  hyper
cgctgc

SEQ ID NO: 96689 - DNA, 30 bp, Homo sapiens
  chr7:154062573-154062603
  hypo
tgaaccagcttgaatcggaggggaacgtgt

SEQ ID NO: 96690 - DNA, 30 bp, Homo sapiens
  chr7:154063085-154063115
  hypo
cttgtctctatcttccggggtaagcctgcg

SEQ ID NO: 96691 - DNA, 30 bp, Homo sapiens
  chr7:154065573-154065603
  hypo
ctgcagtgtttactccggataattttgcca

SEQ ID NO: 96692 - DNA, 40 bp, Homo sapiens; identical to SEQ ID NO: 41532
  chr7:154088244-154088284
  hypo

SEQ ID NO: 96693 - DNA, 66 bp, Homo sapiens
  chr7:154186455-154186521
  hypo
tgagtatttgcaggacgctgttctgagattggtgtagacctttctaatatccggcactttgcagtt

SEQ ID NO: 96694 - DNA, 29 bp, Homo sapiens
  chr7:15431976-15432005
  hypo
tgagtcaacatgcccggccctatttcctt

SEQ ID NO: 96695 - DNA, 155 bp, Homo sapiens
  chr7:15435723-15435878
  hypo
ctttccatttcagaacggacagaaatatttgcatgcaaaagactgtaaaccttgttttatatgtcaatttagccctccctcgtccagaaatggtgggttcttggcctcgctgacttcaagaaagaagccccacggaccctcgcagtgagtgctac

SEQ ID NO: 96696 - DNA, 30 bp, Homo sapiens
  chr7:154438196-154438226
  hypo
cccttcaagccacagcgtcaaaacctcctt

SEQ ID NO: 96697 - DNA, 30 bp, Homo sapiens
  chr7:154468234-154468264
  hypo
gacctgctacacaggcgttccctgactgac

SEQ ID NO: 96698 - DNA, 30 bp, Homo sapiens
  chr7:154486585-154486615
  hypo
ccaccaccttctcctcgtgccacacacaca

SEQ ID NO: 96699 - DNA, 30 bp, Homo sapiens
  chr7:154540210-154540240
  hypo
cgcggcactagacaacgccaagagaatggc

SEQ ID NO: 96700 - DNA, 219 bp, Homo sapiens
  chr7:154542071-154542290
  hypo
gagggccgcctgtgccggagcaggccgcttctccgtagcaaccacatcccacagtgtggaggttcccagcggcgggtagtgcggaaaacagggaaggcaggaaagaaacttagccaggcactgagtgcgtgggaaggcaaaacactcttttctcctcccacggcgggggcgctccctgggcgatgctcacggagagtgggagggcgtcccgcaccgggc

SEQ ID NO: 96701 - DNA, 39 bp, Homo sapiens; identical to SEQ ID NO: 15050
  chr7:154561150-154561189
  hypo

SEQ ID NO: 96702 - DNA, 153 bp, Homo sapiens
  chr7:154597586-154597739
  hypo
taaaggcacctgggccgctgaagaggatgttgttcaggggagacctgaggcttgaggccagtggcgcattgtctaaatggtgccaatgcctgttgcccccgccccactgctgggacattgggaagcccccctggtgaacgcagcctcccttcc

SEQ ID NO: 96703 - DNA, 71 bp, Homo sapiens
  chr7:154622694-154622765
  hypo
caggattctctaccacggactctgttcttgcctctcaccgtccacgcccaggtgaccgtgtcatccccacg

SEQ ID NO: 96704 - DNA, 153 bp, Homo sapiens
  chr7:154665013-154665166
  hypo
tctaggtgatgtccacgcgctgacaccgcacggggaggcagtgcagagggggccacctggaccgttgagcaaatgccccaatgcacctcctggtctgtactttcaagaccacggagcaggagaaactcctgcacccctcgtagcctgggagag

SEQ ID NO: 96705 - DNA, 34 bp, Homo sapiens
  chr7:154667699-154667733
  hypo
ggtggtaaagtgtgacggccgtggcagcggcttc

SEQ ID NO: 96706 - DNA, 41 bp, Homo sapiens; identical to SEQ ID NO: 41536
  chr7:154670093-154670134
  hypo

SEQ ID NO: 96707 - DNA, 30 bp, Homo sapiens
  chr7:154674338-154674368
  hypo
aagggggcacctgtgcgttatgttctgcag

SEQ ID NO: 96708 - DNA, 30 bp, Homo sapiens
  chr7:154675853-154675883
  hypo
acacatgctcatacacgtttacccatacac

SEQ ID NO: 96709 - DNA, 30 bp, Homo sapiens
  chr7:154687918-154687948
  hypo
ctgcgtgttcgtagacgggcagctacgccg

SEQ ID NO: 96710 - DNA, 30 bp, Homo sapiens
  chr7:154697056-154697086
  hypo
gctgctagcactccacgccagccctgcaaa

SEQ ID NO: 96711 - DNA, 30 bp, Homo sapiens
  chr7:154708250-154708280
  hypo
tgggaacagatgggccgagtggggggcagg

SEQ ID NO: 96712 - DNA, 222 bp, Homo sapiens
  chr7:1547246-1547468
  hypo
tctccactgatggcccgggcaggaccacaggcgttccgtcatcctgggggggtgtgcagggtctgccctgtgctcttcatcggcgtctccctgatgagtaatgatgagcgttttctcatctttttttgtcatccgtgtatctgcattattggtgtctgttcaaattgtttgctcactttttgaaaatattttttatggccaggcgcgatggctcacgcctgt

SEQ ID NO: 96713 - DNA, 340 bp, Homo sapiens
  chr7:154861690-154862030
  hyper
ccacccctagagggacgtgtgggggtggctaggggaacgttttgaggaaagttcattggtcaacttgttcaacgtggcaaactcatttcaggcaagagaggcagcaccgtggacagcgccaaccctcctgctcccgggcggggcgaggtggcagcaccgcggacagcaccacatgtggtggcgcacactgggagccgccaggcgcggggagcgcagcagcaccgcggacagccccaaagccgcgcgctctgagccaggaggcggggagagatggccttatcagctgatggcttacgtagggctagatctccacttggataaggcaggtctcggtgggcgc

SEQ ID NO: 96714 - DNA, 400 bp, Homo sapiens
  chr7:154862031-154862431
  hyper
ccagcattcgctctccggagctgcagcctccgaaggggtggcgggggcaacagggacagaaggcaggtcccagaaagcaggttcccccaaaactggcttccctagcacggagttaaggctgcagccggctgcctagagagaagggtgggcagggagacaacgcggtgagagcgactgctctgacgcaccagcccctctcctgcacccacacgctgctggccgcccagcttctccccgatctgggagatgctcggctctgggcggccaaacagcctttccaccaaggcgaggagccctgggctcctgacagcttaggcgggccctggctgcgacacgcagcccctcgcctctgcttccttagcctctgagggcttcagacctgccgcgcttgcagccacac

SEQ ID NO: 96715 - DNA, 133 bp, Homo sapiens
  chr7:154922507-154922640
  hypo
tggatgttgtgtcaccgtccacactccccgctggtcccaccaataggactaaagccctcatccttctggctggccgctgccagtgccgtcagctgaaggctcccggctaagtctcttccggtctcatgggtcg

SEQ ID NO: 96716 - DNA, 203 bp, Homo sapiens
  chr7:154926142-154926345
  hypo
ttgtgaatgaatgcacgtctcaggttttaccttcacagcagtcacatattacctccttcacccactccaggacaagaacaggcagcacacagtttacactgctgtgcatcttgtttttctttttacgtaatagattgtgacactctttccgcatcagtacataagaatttcatctttggccgggcgcggtggctcacgcctgt

SEQ ID NO: 96717 - DNA, 30 bp, Homo sapiens
  chr7:154959001-154959031
  hypo
caggcagcgccctggcgcaggtgaagcagc

SEQ ID NO: 96718 - DNA, 30 bp, Homo sapiens
  chr7:154982436-154982466
  hyper
tctcaaaccccggggcgggaccctgcacta

SEQ ID NO: 96719 - DNA, 114 bp, Homo sapiens
  chr7:155018128-155018242
  hypo
tgacaaggtgcatggcgcggccaggacagccttgtgcaggggacagcggaagctcaggagacaaggtcagaggtggtggggccccgccacggagggcaccgaggggaggaactg

SEQ ID NO: 96720 - DNA, 145 bp, Homo sapiens
  chr7:155052879-155053024
  hypo
ttgacttcaaacttccggcttccaggatgacgagagcatcagttgccctcactttaaggtctcaagttctgtacattctgcacattcccagaaaaggttggtcacagcagcctacagtatttcagtttagcgtattcttctgtgt

SEQ ID NO: 96721 - DNA, 51 bp, Homo sapiens
  chr7:155053384-155053435
  hypo
gcagaggccagcactcgctttgcccacaggggcactcgcacccatgagcct

SEQ ID NO: 96722 - DNA, 162 bp, Homo sapiens
  chr7:155130632-155130794
  hypo
gtgcagggaggccagcggccgggacagaggcacgtataccgcggtcagtggccgggacagaggcacatgcagggggaccagtggccaggacagagactcatttacggaggccagaggcaggcacagaggcgcgtgcagggaggccagcggctgggacagagg

SEQ ID NO: 96723 - DNA, 44 bp, Homo sapiens; identical to SEQ ID NO: 41539
  chr7:155133192-155133236
  hypo

SEQ ID NO: 96724 - DNA, 145 bp, Homo sapiens
  chr7:155144931-155145076
  hypo
cctcctgatgtgtaccggggcgaggcttacctggatgaacaccgtgaatgaaatggaacagcagtgggtcgagccccgccttggggcatcgcagcaccaggaacgtggctcgcactaacatgcgtgacctcggctaagcttcatg

SEQ ID NO: 96725 - DNA, 2623 bp, Homo sapiens
  chr7:155164415-155167038
  hyper
aacaacttcgtgacccgctccatcccctctttccctgttgcaaggcgagcggaccgcgctgcacgggtccaggctgggtgcccctctcccctggggtaaagaggcagcacaggttgggacagctagatgggggcaatccaggcgtcctgcccacggtttcctgggagccaacaaaggcgccgagacctcacccgtgtgaggcaaccgccccgtggtcccacagagcttctggaagtctgcgtcccggccttcccgatgcaaggcgccctctccacctgcctcggccgtgagcaggttcaggagggcgagaaaggttaggccgagcggaaccgcgcggccagcgttacgcagggtgccctggacacccctaggcgcccacctggacttgttcccacctcctctcgccccttgccttcttaacccgcattacccgtgtaggcctggggtggaatcggactacttgttcgggatttgctcgagaacattctagggagaaggcacgcccggctttgggcttggccgagagtttagggcaggagcgccggcggggagctccccgggtgctggagaatgcgtgtccggaaagaagtagggcgcgcttcgtggatgcaaccagggccgtctcgcgcactttcttcctaccctgggacagcgcctgaactggagctgggcgcacacactttacggagccagctcgggttcttacgccctggctcacccccgcccgccgccccaggatgcaggtgctgcggcgctccctggtagcctcccgcgctccctgggggcgcgctttcctccatttcagggaagtccccggacaggtgcccacgttttacgctgtccggtagaagcccgcgggctcaggccgacttgcgcggccgcttctccccagggagagaagctggagcttcccccacgcggccctaaggcggggccggctgggccggagtgggcgcggccagggtgtcccagcgcgccccctgccgaccgcgcgctgcggggggcaactccacctcccctggggaggcctcgtccccgctgcagggagactaaagcgtgggtccgcgaccagccggtttaggaacgaaaactctggaactaaaaacaaaaaataaaactggtgagtgcgcagcgtggtcagtgtttccctctgggtaatgcttggccaagggggaagatcgagtactcccgcccacatccgcctcccccaggagggaggattccctctctgctcacccaccctgacccacgcctcccgccaggtccactgctcagacaaatctgtaggtttctgagtatccgtatctcgaaaagcttcaatgcacaaacgaggttttaagcccatcgcggcttcgcaaggggaaggggctgcttccctaaaaacaaaacacaacaaaaaaggcaagggggtactcttgcagatggactggaattagtaatttagccagggtctcttccaaactcactgcaaaattcgccagcgtctcattcttcacacacggggcaccacacgagaatcaccccctccccagaattttgcaaagcacgtttgctgagttttctcgcctttccttccgacaagctcgaactggaaccagcgctctcccctctagacctgcctccgcgccccacccttcttcccccacacagtccctccgcagggagaattcaggtgctaaaaatgctcgggcctcgcagcttcctccctcctcctcggttcctcgaatgacccaagctgcctctttccgggcccttggaagacggtgcgaattccgcggcggcccgctctcgccagcgccacagccctgactcccacccggaggcctgagttcaaccgctttcgcttccttgcgggccgttcaaccctctgaatacgcagattcatttatttatgttttttaatgtagtaagtgggcagctaaatgaattgcaatttgtcatttttatggttaatttgaaatctcgctcttgttgcctaatcctgttagttggtggcaaaacaaggagaaacgcgtgtttcggcagcagtgattctaacaggcgttttatgttaaattacagcagaacccagaacaaaagcaggcggcggacttgcagtcccagcggcctcggccggtccgcgctgccggtgtgagccccgaaggaaagcaccccaagctggctgaccccgcgcacccccggccacacccgcccatcctggcttcgagattaagaagcccagtttggcaccccaattatgtttggcaatgtccccggtgccccagacccgcactccgctgcctcctggcttctcatgcccgcgaagcacggcctcgccctgggcgcggggcatcaccggcgcggaggcccgagggcgggtcacttcggatccctttcttcccttcctcgtctctgcctcttttcctttcttttctccctccgcctctctgtcagctcttcccgtcgtttcctcggcacccagctccagtccaggcgctgtcccagggtaggaagaagggcgatgccccttcttccccttctctggtcccctccccagcctccggctccccaaggtgcagggctccggcgggggctgggccgggcgggtgggtttctgagccgcagcgcttggagctgggggagc

SEQ ID NO: 96726 - DNA, 51 bp, Homo sapiens; identical to SEQ ID NO: 728
  chr7:155167039-155167090
  hyper

SEQ ID NO: 96727 - DNA, 487 bp, Homo sapiens; identical to SEQ ID NO: 729
  chr7:155167174-155167661
  hyper

SEQ ID NO: 96728 - DNA, 11 bp, Homo sapiens
  chr7:155167833-155167844
  hyper
cgcccagggcc

SEQ ID NO: 96729 - DNA, 64 bp, Homo sapiens; identical to SEQ ID NO: 31640
  chr7:155167845-155167909
  hyper

SEQ ID NO: 96730 - DNA, 143 bp, Homo sapiens
  chr7:155168178-155168321
  hyper
cctcagattagggaccggaggaaggaagtgcaactcccagagagggcagccagccttagcggcggtgacagcttcctcacggtggtcctgcagctggagctccagagaaagaagggaggaagcacttccggaagtctctgcca

SEQ ID NO: 96731 - DNA, 85 bp, Homo sapiens; identical to SEQ ID NO: 31641
  chr7:155168529-155168614
  hyper

SEQ ID NO: 96732 - DNA, 761 bp, Homo sapiens
  chr7:155170182-155170943
  hyper
ggtgggctcctaaagcgtcccatttctccctttagatttggggccccccagctgataaaggagttgtgattgcaggtggatttgatctgatttcccctgaacaggctggcggtgggaagcaggcattggagtcccacggctcactggactgcagcagcgagcccttcacggttgcaaaggaaggaaattcctagcggggcaactcttcagcgtccgccccacagacctagcacgatgtccttttctgtctcaagatacatctggctgggcttccctaaaaccgggcttagttggactccttggacctggggatgaattcttgccaactatctccaaatatttcccctacaccatgccagtgcaattcatgtctccaaaccccctctcctccacaaaaacgaaacaaaacaaaaccccaggtccaggagctcaggcccaggccggatccaagacgcggcagccaggcagccccgccgcgagcctgtgcgggcttgagccggcttggcccccggaagccccagccccgcgctcggcagcgtgcgcccagcgcccagaagaagcagctccaggcggccgcgctccccgtcccgccgcggtgcggtcggatgcccagctcgcgtccagacccgcgggatgcagacccggatcagtcaggcttgagggctgctccgcatagaccaacgtccggggaaggcacacagtggccgagggcccgcgcgcttgggctacggctgtgatggtatctgcgctgcttgcgcctt

SEQ ID NO: 96733 - DNA, 1251 bp, Homo sapiens
  chr7:155173869-155175120
  hyper
cttcaccttccaaaccgcagtccctggtgatcctgacttttgcagcctggctctgggtccacacggggctggagaaggggattcggtctgaatgggttcgtggagggtggggcagggggctgagctgaggaacgcgctggcgagggagtcagatactgttacttcgtattttaggaatgtatttctcctgcacacccctccctcccctgcccacccccctctcccagtatcattgctctttgaaatgtcatgaacttggcgctttcagaccaaaccgccgggctcaggcccgagacaatgggattgtcagagggccagcgcggagctttttctgcgtgttcacggagcgttaagcctttatcccacagaacggctctgtctgaccgggtcagacaaaagccaacttgcatcttccgctccgaggggatctgggcagagcccgggtacagccctgcgcggccccagggagaggggggagagggcgcgtgtccccagccctgccaagtggcgtggggagcgcgaggccctcctcggtcagagccaccaactctggtctccgtggacatcccccttcccccgcccgctcccgaggctctagggcggcctcctggccgctgccttctcgcacccagggtcttcggcctgggctccacacctcaggcccctcaagtaatcggcctcttggtggccgggcactgcctttccggctgctctctgcacccgtctgcccctccggcctcccctggcggctacaggcgtccggggccctcgctccccagctccaggcgtcccgggagccaggcgcgcagcggggcgagttctcgtgtccgtgtgagcgcgggcgtgtgtatgcgtgcgcgtgcacgagcgtgagtgtgcgtgagcgtgagtttgagtgtgcatgcgggtgtgaatgtgtacatgtacacgaatgtgagtgtgagtgtgcatgagcgtgagcgtgcgtgtgcgtgcgagtgtgcacgagcgtgactgtgagtgtgcgtgcgtggaagcgcggcggggagcctggctgaaggcctgctgcctgcatggctgtcagagaaaaacagaagtgggagcctgctgcgggctccgagaggacttgatgggagccctggcgcgcgctgggcaccgcgcggtgagtgtcgggggtgggggccgcgggtctccagcagcccctgccctgtgcggaccgccgccccgagggtccctgcttgcgggtccggggctgggcgtgcctggctcccc

SEQ ID NO: 96734 - DNA, 161 bp, Homo sapiens
  chr7:155202728-155202889
  hypo
gcacgcatgtgagagcgcaggtgtctgtgtgtatagaagagtgtgttgtgtgaatgcatgcatgtgcttaccctttgtatcccccacctgcttccctgccttgcccacgctcatgcggggagggggcgcggggagggggcgcaggacgggcctggtccagg

SEQ ID NO: 96735 - DNA, 35 bp, Homo sapiens
  chr7:155215884-155215919
  hypo
cctgccagagagccccggcccgccctccctggagc

SEQ ID NO: 96736 - DNA, 30 bp, Homo sapiens
  chr7:155220048-155220078
  hypo
gggacggggactcctcgttccacacagagc

SEQ ID NO: 96737 - DNA, 172 bp, Homo sapiens
  chr7:155241318-155241490
  hyper
attctcggaggcctgcggtgggagccagggcgcggcggagagggtttcccacctcttccccagcaagcgggagggaggcgccgggctgaggctgcgctgagctcgagctcgccgcccgggtggacccgccctgttcaagcgcggaggggcggaggcctggttgggttgtagc

SEQ ID NO: 96738 - DNA, 818 bp, Homo sapiens; identical to SEQ ID NO: 31646
  chr7:155241491-155242309
  hyper

SEQ ID NO: 96739 - DNA, 140 bp, Homo sapiens; identical to SEQ ID NO: 31647
  chr7:155242379-155242519
  hyper

SEQ ID NO: 96740 - DNA, 835 bp, Homo sapiens
  chr7:155242699-155243534
  hyper
cgagccacgtcccgggacccggagagcccggggcgttgggcgctgcggaggaggcccggcttctgtcgctcccttcacctcccagcccgcgagggacttgggggaagggggagcaagctttcgctccggaagaaacgttcggaaccaaggagtctgactcctggatccgggtgcctgttggatccaggctcccactcccgggccctccggtcgaaccaagggtcccgacagggcccgaggcacccgcattcctaggagacaggagctcggccagggcgcatcaccgggtcctgctccgagccagaggatgtagtgtagacacccacccccacaccgcccctccacagagctcctctccccttggggcgtcgctgggcacagggcaggtcgctaggaatccccagtaaaaccacgctcgctcagaggttcgcggcttcctcagagggcgctggggaaagagaggggacctgatttcttcgaccctcggaggaaaagtgctcggggcctcctagggacacagccctggaagctcacctcatcttagcttaggccgcggcgaggtggggaggagagttaggagagggggagaggggctctgcgccctgcagaggcctttaattctggaggaaaaagactgggacacacccaagcgagccaaggcccgagccccacgcacctccacccacccggggcggcgcacagccagctcctgccgggcgtgagcactcgatcaagggagcaagtggaatgaaaatccagctgggggggtccccatcgacacaactgtcccgcagtcgagcttctggattcctgggagatgtggagagcctggggc

SEQ ID NO: 96741 - DNA, 615 bp, Homo sapiens
  chr7:155243755-155244370
  hyper
cggttttgttttccaggggtagtttctgcagaaaggagattctcctccgggccgaagggctaccagcctgcagtcagttcagccccggaccctgggagatgctcaccactctgcggatcttgatccgaaatcctttctggccgcccactgcggagagtgtcctcgtagagaggttttcaatcgaaggagcctgggctccacattttgtcttcaagcctgagctttcagggctgctttgcacgaggtgcagatgaacttgtgtctgcaaacaagacagaaaaccctaagtgccgcccgaccttcctcttttggggaacccgcactttgtcctgggagcgtgcccagcgccttagtaccaaactttctggccggggctggcagagctcagagtcccgcttccccctaggcgcggccccctaacatctgtaacccaaatgttgcgccgcggccaaaattagccctggcagtgcgaacagagaactaaaagcaggcagtgaatgagaacagctcgcatttctccttcctggtagacggggaggtgtaaatcccgaggaattctagggcattcgctccaaacgtgggaaatcttcgcgcgtatcccgtttcttcctccca

SEQ ID NO: 96742 - DNA, 30 bp, Homo sapiens
  chr7:155244661-155244691
  hyper
gaaaggatgggagtgcgtccaaaggtggac

SEQ ID NO: 96743 - DNA, 369 bp, Homo sapiens
  chr7:155246375-155246744
  hyper
tgggctcagcacaggcgcttctccagcgatcggggcagaaccaggacgtgcaatgcgactgcccccccctccccgctccccggcagagcttctgtccgcgccaacccacccaccaggctctgcccgcgccacgcgcgcccctggcaggcctggggcggggaaaggcgaagcgctgggcacgcgagggcctgtgcaccccagttcctacgacgctcctggcccttttcaggcccgccgctgccgcatttaaccccctccttccgggggttattctgaagaagtctcagaccctagacccagcctcccagaccccgtccccgagctcgcccggtgggcctgtaggccggtcctccttcgcccagaggagag

SEQ ID NO: 96744 - DNA, 622 bp, Homo sapiens
  chr7:155246858-155247480
  hyper
cggtggctctctgctcgccccggggaaggtgttgctctcctatcggccccaattccccgcccggcgcctggggcttggctgcggggctcggctcccagccgagggcgcagggctggccaggcctgctttggctgaggtggagatctcgctctcagggattgttgggcgtctctgccccgcgagtaacgagaccgccgcgagcgaacggctttcattgagtccatttttccaagtgtcaccacgtcaagctagagaagcgaggcgagtggaggggacgcagaggggccggaaaagtcacccttctctggcctcgttttcagataaaaacgggagcctggctcggcatccgggcgcccggtgtctccggggcgcttcactgaggttttgtttgcaaaactagcgtccgtgtcctgaagcgcacggcgtctggaagctgctttcctgctcgccctctccgaggcccctctttgtgcagcgagcctgagaaatatggaggaccgtcctccgcaagcgggtggtcgcgggcgctctccgattcctgggtgaagctagagggaaaacggggttcccgggtcagtgccccactttccatcccgggagaaactaatgtccggagagggct

SEQ ID NO: 96745 - DNA, 561 bp, Homo sapiens
  chr7:155247650-155248211
  hyper
cggccgaggccggtcctcatgcgcgcttctcgaagcttcctgaaacaccttgcggagttccgtgtgtatagaactcagcaccgcccagcccctgggcagctcaactttctgcagccccatcccagcttccccggccctttgaacggtgacccctcttaccgctttcccagagttgtttcgtgtttgggtccactctggggggcccggtaccctctagttatctctctcttcatttatttctctttctcctattcctccctccacctctcaccttcctcctttccaggagagcgacccacgaattcctcttcctccagccaaccccagggcccagcccgcagaccctgcgagggcaggtctctgcccaccggcccgccaggcgccctggaggtgacgctctgcttcccagagtctctgttgcagccacgaattggggtctgggtcgcaggaaagcacagggctgaagcccagcgtcttggggccatttatactgaggcagtcagaggcaaagagtcccaagaattcagaaaatacttctcaggaagccgcctaattggcttt

SEQ ID NO: 96746 - DNA, 1690 bp, Homo sapiens
  chr7:155248614-155250304
  hyper
ctctgaccagagccacgtccagtggccaggaggccagcccagcacctcctcccccaccattcccgtcctgggtgggggggtaattttcctgggagcagctgtgggaactgtcgtttctcatcccagcccagccagcactctgaagcctgcaggggaaggacagcacgtgggatggacactggggaaggagcttcgcaaggccagggtgcaaccttcaggccccaggtggcctggcaggccacgctgcctcggagatgcttgccagactccccaagttcactcagggcctggcagcaacctgctggctgcctctgcgggggtctgggttgctgagcacggtgcagctgcccagggccaatcagccctagggtgtccgtgccaggctgcggcctccccgcctcccccgcactgagggtactcatggcgtgcaaatgctcccgcacccccagagctgccctatcggatgtttccaggaattcacacatttccataaaaatgcattttaaatgatggacaggcgagcctggggtaacaacgggtgtttggtgggtagacaagagcaaatgggaaggagcccgagggaggagggggaagagaagaggaaacagaacttccagttggacattctgacaacagctggaaggaaagtctagaaaagatgaagagagaggaggggagaaaccaactggggctcccacccttgccgttggattcctaattctcgtttcaaatgggccctgctctccggcaaaattagtttaaaggattttaaaacaaagaaaacgagatgaccggtctgggagctcctcaatcagagtagagaagttagaggggggcgggcgacttggttttgaagtcttagctgaacagtcacccctcctctccttggcaaaaaggattcctttagaacctccgaggctcctggatttctcccttcgcaaatggagccgcatactgcattcccccgctctttcggatcgctaagcatgtttcatgagggtcgctgtccccgggtggaatgcggccgtatgcacgcgcctccctgcacacgcacacacacgcacacttacaataagtgtctgcaggaggagtgtcctgcgcgccagctctgcgtttaagacaggaagctgccgggttaccgagtcaaatgggagtgacactattcctctccatcagcaaggaaagcggaccacaaaagtccctttgtatctcggcagctcatttaatattatttatgcattttgtgcaaggaattgtgggatttcgccccacggtaaacaatatggaaatcttaaaaatagcgatcttcctgtgcgtgtccacctacgcgccccggggtgacctggcggggctgtcgccgggtgactcacacccctgaaccgcgaagcgacagggaaagcgcgggcgagcgcaggagacgcggtcgggggtctctccgggttcctgggctcccgcacccggagcgggggacgcggccgctttaaggggaggaggggcggcgggctgctcctgtcacccagcggcggccggagcgtcacgtgggcgcgcggcgccgcggccattggcccgaggcacgtgtccaggagaccggcctgcgacgtcactcgagggggctctgttaaaaataagaacaaaaatccagagtgaaagtgtctcaggttgcgccgagtggcctggaaatttccgagcc

SEQ ID NO: 96747 - DNA, 936 bp, Homo sapiens
  chr7:155250323-155251259
  hyper
cgagggcggcggacggccggggagcgcgggcggcccagcccggcccggccgggccctggcctcgcgtctctcacccatgcgactcgggccgcggagctctgcggggctcggcgggggcgcggccgcacgccggtggggcgccccggcccgcagcggggcggcggccgcgaggagggggcctccatgtgcgtgcgggcggtggcgggcgcgctgaccgcgggcgcccggcaccctcgagggccggctagggcgtgcgggcggggacggccgggcggcggcggcggccggagccggcccgggcgggcgtgagcgccggggaacgcgctgcctgcatgcgcgcagctctcgccccgggcggcccaggcggcggcgccggagcccgaggcggccggacgcggagaggagcggggagcccgggaggcggcccgcgtccccgccggaccactgcgactgtctagaccccggctgcgcggcgaagtcgaggacttggctctgttgaatctctcatcgtctgggcgagcggggcggctcgtggtgtttctaacccagttcgtggattcaaaggtggctccgcgccgagcgcggccggcgacttgtaggacctcagccctggccgcggccgccgcgcacgccctcggaagactcggcggggtgggggcgcgggggtctccgtgtgcgccgcgggagggccgaaggctgatttggaagggcgtccccggagaaccagtgtgggatttactgtgaacagcatggaggagaatgaccccaagcctggcgaagcagcggcggcggtggagggacagcggcagccggaatccagccccggcggcggctcgggcggcggcggcggtagcagcccgggcgaagcggacaccgggcgccggcgggctctgatgctgcccgcggtcctgcaggcgcccggcaaccaccagcacc

SEQ ID NO: 96748 - DNA, 204 bp, Homo sapiens; identical to SEQ ID NO: 31658
  chr7:155251346-155251550
  hyper

SEQ ID NO: 96749 - DNA, 194 bp, Homo sapiens
  chr7:155251661-155251855
  hyper
cggacagctcgcaagccggcgccaacctgggcgcgcagcccatgctctggccggcgtgggtctactgtacgcgctactcggaccggccttcttcaggtgagcccgcggggaccacgcgtcccggctcgccgcggggaggcccgcggagctggggggcggtgctggcgcgggaacttaccgggaggaaaacatct

SEQ ID NO: 96750 - DNA, 372 bp, Homo sapiens
  chr7:155251890-155252262
  hyper
cgacattgtgtgaagctgacgccggcccgggcagcggccaggagtccagcggcaggactgattcgctagggggtacagacttcttaggaccgcagaagggaccttctttctttctctgtctctctctctccttcctctctccctgtctcccctctctgtcttccaccccgccttggcgcatctcttcccagcccctagcccatgtctcccccactgtagttttttttggtgggaacgtggtggctggaagatgggcccggaagtgcacactctcatccccttccctacgatcttccaactcaggccaggccggggacgcatgccccagcccaccccagacttgtcctaccatccggttatcccggctgtgct

SEQ ID NO: 96751 - DNA, 812 bp, Homo sapiens; identical to SEQ ID NO: 31661
  chr7:155252316-155253128
  hyper

SEQ ID NO: 96752 - DNA, 551 bp, Homo sapiens
  chr7:155254848-155255399
  hyper
cccacttacatcacacgcagtcctccctcaccaagtggtggaggtccgcgttgagcccatgcccagtccgaagtctagccccacatctggcggttcagcctcgagtggccttgggcgagtcacttccctcttggggccccagaatccttacccggtgcctattgggtggcacacctctgggtaacctgacttctctctgtccaccgtatctacccaggtcccaggtctcgaaaaccaaagaagaagaacccgaacaaagaggacaagcggccgcgcacggcctttaccgccgagcagctgcagaggctcaaggccgagttccagaccaacaggtacctgacggagcagcggcgccagagcctggcgcaggagctgagcctcaacgagtcacagatcaagatttggttccagaacaagcgcgccaagatcaagaaggccacgggcaacaagaacacgctggccgtgcacctcatggcacagggcttgtacaaccactccaccacagccaaggagggcaagtcggacagcgagtagggcggggggcatggagg

SEQ ID NO: 96753 - DNA, 15 bp, Homo sapiens
  chr7:155256218-155256233
  hyper
caccaagggcccaac

SEQ ID NO: 96754 - DNA, 151 bp, Homo sapiens; identical to SEQ ID NO: 31664
  chr7:155256268-155256419
  hyper

SEQ ID NO: 96755 - DNA, 108 bp, Homo sapiens
  chr7:155257081-155257189
  hyper
ctgagctgggagtcccgctggtctccctgaggactgagggtgaacttcgctctttgccttaaacctctttatttcattgcagtaatagttttacgttgtacataatag

SEQ ID NO: 96756 - DNA, 1008 bp, Homo sapiens; identical to SEQ ID NO: 31665
  chr7:155257856-155258864
  hyper

SEQ ID NO: 96757 - DNA, 164 bp, Homo sapiens; identical to SEQ ID NO: 735
  chr7:155258914-155259078
  hyper

SEQ ID NO: 96758 - DNA, 504 bp, Homo sapiens; identical to SEQ ID NO: 736
  chr7:155259119-155259623
  hyper

SEQ ID NO: 96759 - DNA, 12 bp, Homo sapiens
  chr7:155259833-155259845
  hyper
cggggattcgcc

SEQ ID NO: 96760 - DNA, 112 bp, Homo sapiens; identical to SEQ ID NO: 738
  chr7:155259846-155259958
  hyper

SEQ ID NO: 96761 - DNA, 853 bp, Homo sapiens
  chr7:155260038-155260891
  hyper
cgccggcgggacggagagtggggtcccccggaccctgggtcgggcaggcctggcgctggcagctctgttgcacagatttgtgagcgatgctggtggccgcattgccgcgcggcgcgaaccccaagtagaccattcatgtttttattaataatctcaaacacttcattatatttatgctgcctgcccagagaaaataaaaggccattcttgaaatcgcctgaaatgtaataatattcattaaagcgcctcctaattatgtgatttaatcaagcgtggtgcgcccgcgctctcggctctcgctggaaaggctggcgatgacggttattattactgctgttgttagtggcctcgtgatagcagccggccagctcttcagtccaggcccagtttcctcagagagactcggggagccccactttgagggatggggttccccggaacgactccgaagtcccggagaccaggcgcggcccaggccctctgcccttctccagccccagccccagccccagccccagccccgggcaaactcttccaggccgagggcaggactttctccagacccttggggccctctgtgtcccctggggacgcccgacccggctttctaggagggggaactccgggtcctgagcccgggccccgccccgttggctgttccgccccctccagggctgagccccgcgcaatgcccgaagcagaaacaaagagtcgccgagatctgcctcctgggccgccttttcaccccctcagcctggaaggcgtcccagagaggccccacccccagcctccacggagacccaggagggaagaagagccgggacccggtagccctgaggggctgccgggcctg

SEQ ID NO: 96762 - DNA, 307 bp, Homo sapiens; identical to SEQ ID NO: 31673
  chr7:155261070-155261377
  hyper

SEQ ID NO: 96763 - DNA, 238 bp, Homo sapiens
  chr7:155262357-155262595
  hyper
gaggggatggggaggcgaaactctcccaggtgagcctctgcaccccccagcagtggcaccctccacagcccaggtgcggttttcagtagggcccttacaccttcttgcttttcccagccaatgaggcatccacgctgctgcttaggagtaggggaaaggatgtaatgcacgcgagaggcagtgtccacaccgtgagaaaaaagtgggacggtggcaggaggtgcgggagagtgggaca

SEQ ID NO: 96764 - DNA, 277 bp, Homo sapiens
  chr7:155264079-155264356
  hyper
ttttatatgtagagacgggaacgcgccctgtggattcagagccccaaggaaacaaaaacagcacgtcagaggaagaatgtcatacaaacccgctggagtcacaaggcaaaacagcccccatacctaaacgcccggcgtgacaatggcctttgtgcctggcgccgtcggggggagctgggcgcctagcgggtggggcaggcggaagttggacacatttccacgcaggtgaggccatccatggggtgatgcgggtgttggggctcgctgctttcgctcc

SEQ ID NO: 96765 - DNA, 30 bp, Homo sapiens
  chr7:155275898-155275928
  hyper
acccaaagtgtacagcgacttttctttctt

SEQ ID NO: 96766 - DNA, 139 bp, Homo sapiens
  chr7:155283645-155283784
  hyper
cagcacccagcaagccggggctgcctaaaggcctgccacaggggctgggtttctggaatgttctttcatcccctgggagtcctgggctgctccgtccggccctccctccgtgagaaggggaagccgaggcttggatgag

SEQ ID NO: 96767 - DNA, 24 bp, Homo sapiens
  chr7:155300117-155300141
  hyper
aaatggacctcctatcgaaggagc

SEQ ID NO: 96768 - DNA, 24 bp, Homo sapiens
  chr7:155300201-155300225
  hyper
acagctccccgaaatgattaaacc

SEQ ID NO: 96769 - DNA, 30 bp, Homo sapiens
  chr7:155301399-155301429
  hyper
agtcaagttactaaacgcatggtgagcact

SEQ ID NO: 96770 - DNA, 295 bp, Homo sapiens
  chr7:155301710-155302005
  hyper
cctcaagcttgtagtcgttcattcgctcacagactttctccaaaagatccgttaggaacgcctccgactgagctagggggatctaagaagaaagacagggcgaggaaacttgtcttaatgttaatgttacttcaaagaccttccggcgagtccacatggaaacgccacactctccctgaatgcaaacgtgtgccacttccctagcacgggcccagaagacggtaccgcagattgttattacaatgtaacaacgacctgctttacatcattacggggctagcgtaaattccagttt

SEQ ID NO: 96771 - DNA, 588 bp, Homo sapiens
  chr7:155302308-155302896
  hyper
aagtctggccctccccggggctgcccttggctgcgcgtcccccacgctgcagccgcgcgatggcccgggctggggtggacgtggggctgggagaggaaggggctcacggacgggcgccccatctcccaggcgggctcctcggctgctttctttgggaacagctggtgcacgtccccgcgcgcccctctccctccggaattcggcgaggattcagctggaccctttggccaccacctccgccccgggcgcgggtcaaagagcacccctcgcccttggtaacggagacaaaacgttcggggccgtctagacaggtcaaggtgcaggatgcggcgtccccgcggctccttccggaagggggcgtggagccgccaagggcgccggaccgcgccgcagcccgggcctttgcgggctttttccctctccaccctctgctgatcaaagtaggaagtttgcatgacaaccgcagtgaaaggggctgaatcacaaatgaactcgatttctgcagtgttgatctatccagcctccattgtcccctttcaggcgcagtatgaacccttccggtgccagcggccgcgctacattcacagg

SEQ ID NO: 96772 - DNA, 400 bp, Homo sapiens; identical to SEQ ID NO: 31678
  chr7:155302963-155303363
  hyper

SEQ ID NO: 96773 - DNA, 30 bp, Homo sapiens
  chr7:155309803-155309833
  hypo
tgaagccctaaaccccgggacctcagaatg

SEQ ID NO: 96774 - DNA, 30 bp, Homo sapiens
  chr7:155314707-155314737
  hypo
cctagtgggcacaaccgaggttcctctaga

SEQ ID NO: 96775 - DNA, 745 bp, Homo sapiens; identical to SEQ ID NO: 31679
  chr7:155325796-155326541
  hyper

SEQ ID NO: 96776 - DNA, 67 bp, Homo sapiens
  chr7:155326787-155326854
  hyper
gtatgtgcactgcagcgggttaggggccccaaaacaggtaagcaggaaaagccgcctttcctttccc

SEQ ID NO: 96777 - DNA, 229 bp, Homo sapiens
  chr7:155363288-155363517
  hypo
tccacagaacacctccgggtcccgggcactccgggccagcgcaggccccagcagcagggccagcagagccagaggcagcagcatgggccccatgccagctgtgccgccgcacaccggcctccttccaggcccctcacaggcccctccgcgagtgctgggcgtgcagcagacaaatggcatacaaaggtcctcgggccgcaccgccctagatacccgccctgccctgtgg

SEQ ID NO: 96778 - DNA, 103 bp, Homo sapiens
  chr7:155436120-155436223
  hypo
gcgtgagccaccgcgcccggccagcattttattatacgtaccgttttatcatctcttcacccatccaccaatgcatctcctgtatggacgtcttgattgttaa

SEQ ID NO: 96779 - DNA, 71 bp, Homo sapiens
  chr7:155579858-155579929
  hyper
ttgttttttgcggaacgtatgtcgtcaggcggtccttctgtccctgccccaaggtaagccccgaggcgtcc

SEQ ID NO: 96780 - DNA, 174 bp, Homo sapiens
  chr7:155580181-155580355
  hyper
gggccgcccctgtctcgggccctgccgcgccgcccgcccgctgcaggccaggactgcgctctgtctgcccacggcccccgcctggcacacacgctggggacctttcctcagtgctgcctcgacatccgaaggggctgggacgcccgtccctggtgggagcgagcaccggggcgg

SEQ ID NO: 96781 - DNA, 156 bp, Homo sapiens
  chr7:155580726-155580882
  hypo
ccctcgggcctggaccgtcaatgccggctccgctcacaccatctgtgtccacgcagagggtcgggccgtgggagccgcgagtgtctggcccacacttctgttcttaacctcgcaatgtattcaggtttccccaggcggagcgctcagcatatcgac

SEQ ID NO: 96782 - DNA, 635 bp, Homo sapiens
  chr7:155581242-155581877
  hypo
cgaagtaacaaagcgacaatcggccttggtcctgcgagggcagggagggcagggagggcagggagggcagggagggcagggagggcagggtccactgcccagccggggatgcaaggacggccatggggctccagcacagggaccgggccccgcgggctttgagtgacgcggtaggccaggacgagccccatccacacttggacaatgagcaaccgcagccggccgcgcagcctgggggccgtctccctctccagcccccgtgtcctctggtccacgactggctcttgccctcattccgttggggctgagtcacagccagggaaagggctgaggcagagcaacgctgggtgaaccccgtcttcctgaggccacgtttgcaccgggaagagaacacagtgaaccccctgagcaccaacacgctcccacaccccccacgagcagcccagccctggggaggagcccgtccttctccctgcttgccacaccggccacgtccgtaaccctgcccagcatcccacccaggttgtgtgggtccccacgtggtcaccagcgtcctttcaggacaagagaaaactgagcaggaccagggcttccgcctgccgcattcatctgccccccttcggctgtgccaggtg

SEQ ID NO: 96783 - DNA, 151 bp, Homo sapiens
  chr7:155582218-155582369
  hypo
ctcacacccgctgggcggcctttgcttcccggtgctggctgtgcccagacgcctgggcttgtgcgtgtttaacccgcccagagactggtgctgccgcatttgttcatcggtttgttttgttttgttttgttttgttttgttttgtttttgt

SEQ ID NO: 96784 - DNA, 156 bp, Homo sapiens; identical to SEQ ID NO: 31682
  chr7:155600567-155600723
  hyper

SEQ ID NO: 96785 - DNA, 390 bp, Homo sapiens
  chr7:155601020-155601410
  hyper
agccccccaccccaccgcagctccctcccctggggctgtgccgaagaagctttaaacagcttcccaggagggcagccagggagagggcggcagggtgaggatgacctggcccccagctctgtgagctgcgccacttgggcaggcatggaggaccccgggcagggagacccgggtccagccgggccgcgacgggaggtggctgcgcgagtgaggggcggaggccgagggttgctggagttggcgcccccgccccttgcgccctcctccggcccgggctccgcgcggcctcggctggcggcctctcctccgcccgcgctgggcgggattgtcgcaggcaaagccgggaagcccaggccggttattaattcattgggtcgtgtgccgcgaatc

SEQ ID NO: 96786 - DNA, 263 bp, Homo sapiens
  chr7:155601688-155601951
  hyper
gagcgtctttcctggcggccccagagcgcacattaaatctatttagtgtagcggctcgggaccccactccaggcttcagatccggccctctggcctcctgccccttaggagccccctggccgccagcaccctcgcctggcacctaggcccgcgcggggagagcgtgtctgtctgcgctttcctctcccgggttaatattaaccggcagctcctgcgttccggaactgctccgaaagttccactggggacgatctcgccatggt

SEQ ID NO: 96787 - DNA, 325 bp, Homo sapiens; identical to SEQ ID NO: 31685
  chr7:155602802-155603127
  hyper

SEQ ID NO: 96788 - DNA, 98 bp, Homo sapiens
  chr7:155604921-155605019
  hyper
tcgctccggctcgcccgctcgctctctccctcgctggctgcctcgctctttctcttcctatataaccttgcccgccgcggctgcgggggactctccac

SEQ ID NO: 96789 - DNA, 43 bp, Homo sapiens
  chr7:155605334-155605377
  hyper
taagataaaggtgggcgggagggaggagcgcatgtcttgtggt

SEQ ID NO: 96790 - DNA, 35 bp, Homo sapiens
  chr7:155623718-155623753
  hypo
gagaaatcttgtttccgaagcgcctctgcgttccg

SEQ ID NO: 96791 - DNA, 30 bp, Homo sapiens
  chr7:155674904-155674934
  hypo
gaggcggggcagaggcggagcccacggcgg

SEQ ID NO: 96792 - DNA, 50 bp, Homo sapiens
  chr7:155683057-155683107
  hypo
gtgtttgggggacaacgccctccgttatttgccctcgcagctgttctagc

SEQ ID NO: 96793 - DNA, 85 bp, Homo sapiens
  chr7:155752508-155752593
  hypo
tatagtttctgttttcggaggtgagtagctattatgtttcagtgaaagcctgactcagtgaagcggccagcgtgtcttccaatac

SEQ ID NO: 96794 - DNA, 105 bp, Homo sapiens; identical to SEQ ID NO: 41547
  chr7:155753582-155753687
  hypo

SEQ ID NO: 96795 - DNA, 34 bp, Homo sapiens; identical to SEQ ID NO: 41548
  chr7:155786790-155786824
  hypo

SEQ ID NO: 96796 - DNA, 35 bp, Homo sapiens
  chr7:155792417-155792452
  hypo
gagccctaggtatggcgggtcgtgttcaaaaatag

SEQ ID NO: 96797 - DNA, 136 bp, Homo sapiens
  chr7:1557959-1558095
  hypo
gtcgccatgtgattactgagttggaaccttcactccactccacctacccactcccgaactccagggatggggagctgaagatagggttaaatcacaacggccagtggtttaaccaagcatgcgtatgtcatgagac

SEQ ID NO: 96798 - DNA, 30 bp, Homo sapiens
  chr7:155838899-155838929
  hypo
ccactagggagaaaccgacccgggatccag

SEQ ID NO: 96799 - DNA, 344 bp, Homo sapiens
  chr7:155854210-155854554
  hypo
attaatctgtggctccgggacactcttgcttgccctgggatgagtaggggtttcctatggttccctgactgtggacatgagacctgttcccacttcccaccccaaccccatgtgaaaacatcctgatgatatggtcctcctggcccaccgtgattgttcagagaccgccgcgggtgcagagtgcaagggggtgtggtgggaagtgtaccagtggcctctagagctggaccatgcatggtcttttactgcaggaataacatgatccctggggttcactttcctgggccagaagcatggggctgacacacgctcagctctttgtgccaggacgcctgccctcctgt

SEQ ID NO: 96800 - DNA, 215 bp, Homo sapiens
  chr7:155871902-155872117
  hypo
tgtttccctctggcccgcagcgttgcccatggtgaagacctggttgaaccaagaagccgtggaatcattaggatatcagagtgcagacctgcctgctcccccacactcaggcttcccacaggctccctggatgggcagcccctgctggaattcctccagagcctgaaacgttggccacattacaaagccgcgttctccatcgctgggcacctctg

SEQ ID NO: 96801 - DNA, 141 bp, Homo sapiens
  chr7:155898166-155898307
  hypo
ttcgtcagagaagcacgaatgcgaaggccgaaagggaagcaagcctggggagctggaaacctgaataagacctgcggggccacatggaggcgaggggaagtcagaagcagtgagggtggagccccgcggagcctgtaagtc

SEQ ID NO: 96802 - DNA, 326 bp, Homo sapiens
  chr7:155898826-155899152
  hypo
aaggagctatgtttccggccctctcctttcagcttggcttgtgggcggagcagccctggggctccctggtgtgagggtggctccgggctgcgcctgcagacaggctttctgggtccttgcagaaagggcaccggtccttgcagaaagggcccagcaggcagggcaccggtccggcgtaagctcactctcagctttcagttagatcgcagctcctggattgagctgtatacccaaacccagctatatgctctttacaagcacatacaataaagtgacagaaagggatccaaaaagtgtactgggtgcgtgcacggagggaagaggag

SEQ ID NO: 96803 - DNA, 30 bp, Homo sapiens
  chr7:155917143-155917173
  hypo
gcgacaccggccagacggccagaaaggagg

SEQ ID NO: 96804 - DNA, 34 bp, Homo sapiens
  chr7:155919137-155919171
  hypo
ctggggagccctctgcgaacgctgccagagacag

SEQ ID NO: 96805 - DNA, 204 bp, Homo sapiens
  chr7:155920367-155920571
  hypo
gggtagccaaccccccgaaggaaaacacgatggaagtcttcatccttagaacaggaggacaacgggctcgggttgaagcagctgacccggtgctgggaatgagtgagaggaggcgcggcacctgccccggcccgcatggacgcaggcacattagatgccaagtagtagggagccctggttcacttcttacctggctcgctgcaa

SEQ ID NO: 96806 - DNA, 38 bp, Homo sapiens; identical to SEQ ID NO: 41553
  chr7:156012968-156013006
  hypo

SEQ ID NO: 96807 - DNA, 266 bp, Homo sapiens
  chr7:156025663-156025929
  hypo
aggtggagtggggaccgtagtgcccagtgtccacattagaaccctgctgttccgtgacccagaaccaggacaggagccacctgtggttcaggtgagggcaagagtccacggagcccggacaggagcggcagagcaggccgcacctcccgggcaccttccggggctgagcacccgaatgcaaatgcgcacccccctgtctgtcgcgggcggcgggcggggtcggggggagcagatgctgtcctctgacgaggcggctgttcttgctg

SEQ ID NO: 96808 - DNA, 30 bp, Homo sapiens
  chr7:156124519-156124549
  hypo
ggatgactgataagtcgtaggattactaag

SEQ ID NO: 96809 - DNA, 50 bp, Homo sapiens
  chr7:156138347-156138397
  hypo
ttccttgtttgccagcgagcggggaacagcggcctcgtgctctctcctgt

SEQ ID NO: 96810 - DNA, 197 bp, Homo sapiens
  chr7:156177617-156177814
  hypo
cacgttttgaagggacgtgccagccgtgttgtgtactcattcgtctccactgctagcaaggtcctgggcacacaggcagcggtcagtaatgtttgtcgaaagaagaaaagttgcccttttgtgaattgcattttagcagtggaggcccctgtaggaacaagccaggtaacctcactgttccacgtcctgtcgggcta

SEQ ID NO: 96811 - DNA, 30 bp, Homo sapiens
  chr7:156240296-156240326
  hypo
gagcagttgacttcccgtctttctgagcct

SEQ ID NO: 96812 - DNA, 30 bp, Homo sapiens
  chr7:156290677-156290707
  hypo
tgctgccgatggctgcggtgtctgctgaca

SEQ ID NO: 96813 - DNA, 30 bp, Homo sapiens
  chr7:156397201-156397231
  hypo
cctccaccaatgcaccggggcttcctcagc

SEQ ID NO: 96814 - DNA, 203 bp, Homo sapiens; identical to SEQ ID NO: 31687
  chr7:156409310-156409513
  hyper

SEQ ID NO: 96815 - DNA, 108 bp, Homo sapiens; identical to SEQ ID NO: 31688
  chr7:156409727-156409835
  hyper

SEQ ID NO: 96816 - DNA, 257 bp, Homo sapiens
  chr7:156432918-156433175
  hyper
ccagaaaactgccctcgactaacagcgcagcgaaggggcggtgcgctcgagaccctggaacgggaacgaccacagccaccgcagggaaacaaccggggcccaggcccaggtgggcgggcggctgaggagcgtggctgcgcccacaaagccgccgggggctgcggactacagcgaagccggcgcggggctcggccctcactacacgaggcctgggcgcctgcacgcccccgtgcttcagcccgcggctcccgaacacc

SEQ ID NO: 96817 - DNA, 30 bp, Homo sapiens
  chr7:156507056-156507086
  hypo
ggttttgccggagaacggctggtgaagaaa

SEQ ID NO: 96818 - DNA, 126 bp, Homo sapiens
  chr7:156701793-156701919
  hyper
cgccggcgactcactgcgccaggccgggccaccgtgcagaacgcgcgcggatctcacaccccaccatgcggaacgcgcgcgggtcacacaccgcaccgtacggaacacaggcggatcatgattcgt

SEQ ID NO: 96819 - DNA, 105 bp, Homo sapiens; identical to SEQ ID NO: 41557
  chr7:156744694-156744799
  hypo

SEQ ID NO: 96820 - DNA, 30 bp, Homo sapiens
  chr7:156778228-156778258
  hypo
tgtgggaacagcagacggggcccctgggtg

SEQ ID NO: 96821 - DNA, 87 bp, Homo sapiens; identical to SEQ ID NO: 31690
  chr7:156794072-156794159
  hyper

SEQ ID NO: 96822 - DNA, 26 bp, Homo sapiens
  chr7:156794459-156794485
  hyper
gtaagccactgcgcccagcctgattt

SEQ ID NO: 96823 - DNA, 357 bp, Homo sapiens
  chr7:156794998-156795355
  hyper
cacctcctctcccttcgagctgtttctttactccctgacaccagggattaaccggggtctcctggctgcctctcacctggcagccggagctccaggaggggctggaaaggagccccctgggcctccgtctggggggcgtgtgtgaactgttttctcccgtcacaaaaaaggcttcctccacatgcgtttgcacgcccggcagaattcgcccacagcaaggcccccctttctaagaagggaggagaacccacattggagcaaagaaaacggtggccaagaggtgggggcctcggtagggcaaggaggcaaggctgggttccaggggacagggtcagctttgggtggggcccagagccc

SEQ ID NO: 96824 - DNA, 235 bp, Homo sapiens; identical to SEQ ID NO: 745
  chr7:156795401-156795636
  hyper

SEQ ID NO: 96825 - DNA, 205 bp, Homo sapiens; identical to SEQ ID NO: 31694
  chr7:156795899-156796104
  hyper

SEQ ID NO: 96826 - DNA, 246 bp, Homo sapiens; identical to SEQ ID NO: 747
  chr7:156796494-156796740
  hyper

SEQ ID NO: 96827 - DNA, 1430 bp, Homo sapiens; identical to SEQ ID NO: 31696
  chr7:156797005-156798435
  hyper

SEQ ID NO: 96828 - DNA, 621 bp, Homo sapiens; identical to SEQ ID NO: 750
  chr7:156798526-156799147
  hyper

SEQ ID NO: 96829 - DNA, 220 bp, Homo sapiens; identical to SEQ ID NO: 31698
  chr7:156799290-156799510
  hyper

SEQ ID NO: 96830 - DNA, 225 bp, Homo sapiens
  chr7:156800853-156801078
  hyper
tgaccctgggctccacgaagctccagaaagcacccctaggaggcctaggaccacgggcccccggggctggccagccccctccgtgggcaacttagcgtccttggctctgggaaatgcaggtcatattggtggctttctatcagaagggatgggccctgggtcggcaccctgggtttaagcccaggctggcaggggattcgcagacgcagacgtgtctgaggtgag

SEQ ID NO: 96831 - DNA, 469 bp, Homo sapiens; identical to SEQ ID NO: 31700
  chr7:156801403-156801872
  hyper

SEQ ID NO: 96832 - DNA, 221 bp, Homo sapiens
  chr7:156801943-156802164
  hyper
cgccccagtgggggacctggcccaagttcctttccccggtgataagccctgacccccattcccgggcctgcctaattcagggcgctctcggctcgccttcccccggcgacttccttctcctgcagccttcgggttaatcattagatctcagtctcacacctccaactgccccttcccgttaagagaggaagagaaggcaaggcctgcgcatggccatttta

SEQ ID NO: 96833 - DNA, 124 bp, Homo sapiens
  chr7:156802413-156802537
  hyper
ccagctggaaggtgccggcgcccagcttgatggggtcggcggggtgcgcggggtgcgcgccttgcacctgcgggtacgagtaggagagcgccgggtgctggcccgccagcgcagccgccgccgc

SEQ ID NO: 96834 - DNA, 74 bp, Homo sapiens
  chr7:156803722-156803796
  hyper
ccctggagccagctgcgcgcgtcctctccggcctccttgtcggcgctggagtgggtccacgtctgccttgcgga

SEQ ID NO: 96835 - DNA, 655 bp, Homo sapiens
  chr7:156808858-156809513
  hyper
tagcattggcctgggcgcccaggcactcctttagaacccacctgttccccccacccaccctagtgggaggaggagagggttacactgacagataccggcagctctgcaacccgggaacaacgcagacaacatacaactcgacagagtcacagaaggtggcgtccatcgcgcctggatggtgactactgccctgcgggctgctgggtgggtgaaacacacagggaagaagcacaaatacacacacagatgtggctcagggacatttgaatgcttcagtgtgtgaattttttagcgcattctgactcgaaattatggctgaatagtggcgcactaatgtccaagtccatgttcgataatggcaggaagtctgcactaattggtctatttagtagttgctgaggtggcaaaagctgcagctgctggtggctgaaagagagagagagagagagagacctcctcttaggccacttcccagagctgtggcagtgggggagggggaattccccaggatggtgtttgtggtcaagttcacctctggcaaccctgcctaagctcttctcacaggtgcacgcattcaagtcctgaagagccctccccgcccccaacagtgttcatgtcccgggctgggggcccgcctgggaggggctctatatgc

SEQ ID NO: 96836 - DNA, 11 bp, Homo sapiens
  chr7:156809643-156809654
  hyper
cgctgcttagc

SEQ ID NO: 96837 - DNA, 485 bp, Homo sapiens; identical to SEQ ID NO: 31702
  chr7:156810037-156810522
  hyper

SEQ ID NO: 96838 - DNA, 204 bp, Homo sapiens; identical to SEQ ID NO: 754
  chr7:156810597-156810801
  hyper

SEQ ID NO: 96839 - DNA, 724 bp, Homo sapiens
  chr7:156811302-156812026
  hyper
cgacattctgtaaatgagataatgatccataaacccggatgatagatgtggcgtgcctgcgatgtcttctctaaatgagctgctcgcatcgactgctaataatggtgagtttatggaagcgatttcagcgcaaactgcgagagggtcttcttactctaatcagcctgcctgagctaatggacgagggggtcaggctgagagttattgacacgcccgtgcccttaacctgtttcccaataaagctgattagtttttgtcaattcatcagctaaccactcttgctggaactgcatcaaagccttatttgctcaggggaaatcaacaagtcacagatcagctccattaaggggcccggcccggcaaggacagtcctggagccgagggacgccccgacggacctcgggcctcccccgaggttcgcagaggggctgacagcgtggccccccttaactccgagcaccacgacccggatgcacataactgtgtccggaaacttctctttctctgcaggtggagcagcgcctgtgcggctccgcgctatggctccaaggctccggccctggcgtctgggctcggtcggggacagtttccacgcgaggcggagcctagctggaggtcacagggcggtggagagcgagggcatgagggagggagctgggaaccgcgcagtgtccgcggccacgaatctctcctacgcgtccccatgaggcgacctaaggggaag

SEQ ID NO: 96840 - DNA, 37 bp, Homo sapiens; identical to SEQ ID NO: 31706
  chr7:156812242-156812279
  hyper

SEQ ID NO: 96841 - DNA, 1038 bp, Homo sapiens; identical to SEQ ID NO: 31707
  chr7:156812788-156813826
  hyper

SEQ ID NO: 96842 - DNA, 244 bp, Homo sapiens; identical to SEQ ID NO: 757
  chr7:156813986-156814230
  hyper

SEQ ID NO: 96843 - DNA, 30 bp, Homo sapiens
  chr7:156815392-156815422
  hyper
agcttctattgtctacgtacgggttaaagg

SEQ ID NO: 96844 - DNA, 209 bp, Homo sapiens
  chr7:156832193-156832402
  hypo
atgaaaccaaaacagaatgtcagctaaaccaggtcacattccccacggcgagtctgctcagatggccccgaccgagtaccaagacacatccttgaaacgacagaaatctgttctcacagttctggggctgcaagttggagatccaggtgtgggtagggcctgctccctccagacgttcttggggatcgtcccgccgcctctcccagctc

SEQ ID NO: 96845 - DNA, 500 bp, Homo sapiens
  chr7:156832680-156833180
  hypo
caagtgtgctgaagacgcaaacctaacacgcaggaggcaggaaccgtctgaggcagcccccggcaaacgtcaggctgtgtggctcagacccggcacagcctccgcgatgggagctccggggggggctggctggggacaaggacaagcggacttgggagcgacggggtttgggcatctgggagacgggaactccttcccgggaggaagaccgtgagggaggcgtggaagtggatgtgagccggtgtgcactgggctgcagtgcgcgctgctgggccggtccgggagcccacactgttgggtgctggctgctagaagcccacagcaggggcccgaggcccaccccctagcctcagggcacagcttcccctgtccagccaaggctgccttacccaagccctggtcctgcctgttccgtgccttctcccgcaaggcttcttcaacagcacaccgcgaaaacgtgcaggcatcgcccccagcacaagggtcgctgctagggaagc

SEQ ID NO: 96846 - DNA, 141 bp, Homo sapiens
  chr7:156871012-156871153
  hyper
gggctcccctaaatccgaagctatcccctgccctcccttcctcgcgtggcttcccgggcgcgctctgcctgtctgcggggactccaggcgtccttgtgttttcagctcccggctcttgcccgcgcgtgtggcccggctggg

SEQ ID NO: 96847 - DNA, 70 bp, Homo sapiens
  chr7:156871282-156871352
  hyper
cgagctccagaggcgggggatctgaacactggcctgtgaaccccgagaaaacccccggtttgcagaccag

SEQ ID NO: 96848 - DNA, 68 bp, Homo sapiens; identical to SEQ ID NO: 41560
  chr7:156880531-156880599
  hypo

SEQ ID NO: 96849 - DNA, 411 bp, Homo sapiens
  chr7:156883232-156883643
  hypo
cacctggggcagcctcgaggcggctggactcagcacgcaggcccccgggctcttgtgtggccgtagggacttgcccagggagtcagcctggctgaccagccctgcctcaccctcccccaggaccccaaggtcaggggcgcctggcctgggccctggacgtcattctgaggactcagtgccagccttgcagctagcaggggcaagaccagccaactgcgttttggggacacggtggccctgagaacagcatctcaggggacgcaggctgagacaggacaggagctgtgcagggtgggacaccgcaggtaagggcagggactgccaggatgagctgccttgcggctgacaccgtgactttcgggtggcacagaagctgtaggcatcagcggagagcagcgcaaagtggacagc

SEQ ID NO: 96850 - DNA, 31 bp, Homo sapiens
  chr7:156922797-156922828
  hypo
agtcaccgcgcccggccggatgttatcttac

SEQ ID NO: 96851 - DNA, 47 bp, Homo sapiens
  chr7:156924103-156924150
  hypo
cggagctctgatgcccgcagacagaagatgaacgtcccagctcaaga

SEQ ID NO: 96852 - DNA, 21 bp, Homo sapiens
  chr7:156929628-156929649
  hypo
ttatttattttgagacggagt

SEQ ID NO: 96853 - DNA, 30 bp, Homo sapiens
  chr7:157074398-157074428
  hypo
gggtggggacaaaggcggggaccaaaaagc

SEQ ID NO: 96854 - DNA, 219 bp, Homo sapiens
  chr7:157075184-157075403
  hypo
cctcggtgcgttccccgggctgcgtgggccatggcggataacccgcctgaccccttccactcggctgtcggtacccacctgtcagccccacctgcgtgtccccctggaaggcagggcccgagtctcacccactctgcacgtcagggcctcacccagcagcaataaatgtttgttgaatgaacaaggaggctaatacagccggggcggggctgggggggt

SEQ ID NO: 96855 - DNA, 113 bp, Homo sapiens
  chr7:157082014-157082127
  hypo
tggggtccctccccacgactgccatccgcaggggcacggggacaagagtgagagtagcctctgctgctgcttgcaaagccctggaaaaagccagaccccggcagagtcaagag

SEQ ID NO: 96856 - DNA, 212 bp, Homo sapiens
  chr7:157084410-157084622
  hypo
caggccttcagagaccgcgcgcctggaggagcgtttggcatcactcaacactaaagtgcaaacgtgggctccaagagcaagtcaagggtgttaccagctgggctctgggagcaaagacaaaggccagtggcctcccacccgccgtggcaggacaagcagagtgtggtctccacgcaagaggctggagcctgcagacccgggagggccccggg

SEQ ID NO: 96857 - DNA, 291 bp, Homo sapiens
  chr7:157085343-157085634
  hypo
gggggaggccaggaccgtggagttctagagggggcaccaagggcccgtgtgtccgcgtggagctggacatgcttctgtgggccaggcaccctgaccctgatcctctccagtgaagaggccgggggcaggcggaactgggtcaggctccaggacacagcctcaccctatcagggcagcgagggctggggcggacaggggagccgtagacagcccgtccctgggtgggcctggccttcccggccctgactcagcgtgaaggggcagacagggcgcggccgcccacggggattc

SEQ ID NO: 96858 - DNA, 221 bp, Homo sapiens; identical to SEQ ID NO: 41567
  chr7:157085926-157086147
  hypo

SEQ ID NO: 96859 - DNA, 71 bp, Homo sapiens; identical to SEQ ID NO: 41568
  chr7:157099869-157099940
  hypo

SEQ ID NO: 96860 - DNA, 27 bp, Homo sapiens
  chr7:157110643-157110670
  hypo
ggcatgagccaccgcacccagcccact

SEQ ID NO: 96861 - DNA, 211 bp, Homo sapiens
  chr7:157129074-157129285
  hyper
gtcactattccctggcgaagtctccacgcgctcccgttcgccggggaacttagggtatccgggcttccctaaattgacaagcgggggccggcgccttcgcccgccttcgctggccgccgcttggtttgttcttcttctccttcggggacttctccgcccgcgcccgcgcccgcgccccagctttcgtcccgctgtgcggagatgccaccca

SEQ ID NO: 96862 - DNA, 49 bp, Homo sapiens; identical to SEQ ID NO: 31712
  chr7:157130967-157131016
  hyper

SEQ ID NO: 96863 - DNA, 41 bp, Homo sapiens
  chr7:157147812-157147853
  hypo
gccttgagcctttagcgttcccgtagtttcttttatttatt

SEQ ID NO: 96864 - DNA, 30 bp, Homo sapiens
  chr7:157151821-157151851
  hypo
cacagaaggctctcacggtaaccttagtct

SEQ ID NO: 96865 - DNA, 59 bp, Homo sapiens
  chr7:157200748-157200807
  hypo
ttctgcaggtgagcacgtggagttcccaaggggagaactggccccgggctaggtgaccc

SEQ ID NO: 96866 - DNA, 48 bp, Homo sapiens; identical to SEQ ID NO: 41570
  chr7:157217366-157217414
  hypo

SEQ ID NO: 96867 - DNA, 102 bp, Homo sapiens
  chr7:157217837-157217939
  hypo
aggggtgaaggccaccgctgttgcctgtgaagtagactcaggagcacggagccccctgtgagcccagagggccctggctgactggcacgtgggtcccaggca

SEQ ID NO: 96868 - DNA, 232 bp, Homo sapiens
  chr7:157218481-157218713
  hypo
gaggctcaattcagccggatgtttgtgctcacgtgctcacagcggcactggccatggcagctggggagggagtggatcccgtgtgcgggtgcagagatggatgtgctccctgcgcagtggggctgcgttcagccctccagaggacgggctctgatgtgctgcccgtggacccgccctgtggacacggtgagacccgccctgtggacacggtgagacccgacagtcaggaaag

SEQ ID NO: 96869 - DNA, 153 bp, Homo sapiens
  chr7:157220472-157220625
  hypo
tttgctttggggacccgcctgggtggacctgtcccggatctccgtccgggtctgcctgtggagtacctggcatctctgccgaggcctggggtgcccctgactggctccttgccaggggaggaggcctggggggacccccgggggctgctgagg

SEQ ID NO: 96870 - DNA, 58 bp, Homo sapiens
  chr7:157233964-157234022
  hypo
ccctccactgtggaccgcagagtaatggccctgatgacgatcacgtctcagccccaga

SEQ ID NO: 96871 - DNA, 123 bp, Homo sapiens
  chr7:157235673-157235796
  hypo
tgggtcccttgcattcgcaattcacaatggggttctctcccctgtgagactccagtgctgcagctgatctgccgggaggcggggctcaggctctaatgcttgcggcaccgccactcacctcct

SEQ ID NO: 96872 - DNA, 178 bp, Homo sapiens
  chr7:157239495-157239673
  hypo
ccatgcccctaaccccgcacccaactccagccctcaacaacccctcattggctttctgtccccatgagttgtgggttctggggactttctggagaatgggatcatacagcatgggtgcctgcatgccgggggccctcctcatcctggctttaaggttcacctacgtcatagcatgtgc

SEQ ID NO: 96873 - DNA, 261 bp, Homo sapiens; identical to SEQ ID NO: 31061
  chr7:15725085-15725346
  hyper

SEQ ID NO: 96874 - DNA, 261 bp, Homo sapiens; identical to SEQ ID NO: 41575
  chr7:157255061-157255322
  hypo

SEQ ID NO: 96875 - DNA, 570 bp, Homo sapiens
  chr7:15725636-15726206
  hyper
agttggagcacaggacgggcgggctgctccccaactctgggggccctccagagtcgggctggaggcagaggctgtgccgagccgcactcggtggggaagacatctgcgggaggtgccagttggtttgcagagcctggtgctgctgctgctgatggtggtgatggtggtggtggtggtggtggtggtggtgccccctgtgatgctggctggcaaacatgccctcttcgttggggtatcccgcgattatgcaagatgaggaagaagtagagagctcggggtaagacatatggtcagatcttccatggagggcgagagaggattgggagaacgggtgcaagccttgcgccgtggcgtgagggctgcgcaggcagccaaagagcgggtgttccatagcatgcaagtttcgggttccaggcagaagacttcacggcggttccaaaggccaccaccctctgtcactttttcactggaaaccgtgtgattttttttttaacctcccaaagcaatagcggtgcacttctgcagagctcggataatcccggtcctgagccccagcggccagtctccttt

SEQ ID NO: 96876 - DNA, 30 bp, Homo sapiens
  chr7:157261056-157261086
  hypo
ctggaacgttgtctccgaggctcagcagcc

SEQ ID NO: 96877 - DNA, 944 bp, Homo sapiens
  chr7:157262527-157263471
  hypo
agcccagcagtcacccggggtggggtcaactctggaaggcccctgtgtgttgactccagggtgaacccgggactcctgagtgggcgcccaggcccctctagtgctggccgcctctgcttccctctccaggcccacctgccggccaccacagtggcccccagcgcccagcccaggtcccccacgccggcttctctcggcccaggtcactctcttcacactgtcatctgccagtcacttgcacactctgattcccaaggcgactctgctgcaggcacacgccctcagcaagacctggctgagtgccgtctgtgcccgtggatgcacgcgcagctctcctggggacactggccctggctccactccctggacagatctgtgcccggcactgggtctgctccctgcacagacccacacctggtgctggcgccactccccggacacacctgcccctggcgctggcctgggttgggtgtgtccgtgtgtccagcgctggcctggattgggtgtgtccgtgtgtccggcactggcctgcgttgggtgtgtccgtgtgtccggcgctggcctgggttgggtgtgtccgtgtgtccggcgctggcctgggttgggtgtgtccatgtgtccggcgctggcctgggttgggtgtgtccgtgtgtccggcgctggcctgggttgggtgtgtccgtgtgtccggcgctggcctgggttgggtgtgtccgtgtgtccggcgctggcctgggttgggtgtgtccgtgtgtccggcgctggcctgggttgggtgtgtccgtgtgtccggtgttggcctgtgttgggtgtgtccggcgctggcctgcattgggtgtgtctgtgtgtccggcgctggcctgggttgggtgtgtccgtgtgcccggtgctggcctgcgttgggtgtgtctgtgtgtctggcgctccagcggggagtctgtggg

SEQ ID NO: 96878 - DNA, 620 bp, Homo sapiens
  chr7:15726457-15727077
  hyper
tggacggacgtagagcgtccacgcccgcccagcactgccggctgccaggactacaagcggcacgccaacgtctaagtcccgcccgggagggcagcagctctgccctccagactctggaggcctgggcgcggcgcacaccacccccaacctagcaccctgattcctacctactcactttcctctcggggaaacgtgacttgtcagtgtcatttgggaactgtcacctgcagaaaagctagggatacgcctatcctttcaggaacacgaaagaagtaatagggttaaaggaaaagaccagagctagtttggcgcaccctcgaagtttttcaaactttgcatcttcccgtgccccgggcgccgcagcgcgcctaggttttcgcagctggtttctgtcggtgggttgttaataggctgggacgccagatctgaggttgcggggatgagcaccatggcctggaaaaggcggttctcagtgcagaaagaagacggacctggttgggtgggtgggaggaaggcgtgagtctgaaagggttgcagatgcctgctccctggcatcctcacgtgcgatgccaggtggaggctcccttccccctctttcccggtcccgctcaatttcctag

SEQ ID NO: 96879 - DNA, 17 bp, Homo sapiens
  chr7:157271529-157271546
  hypo
ggcgtgaaccaccgcgc

SEQ ID NO: 96880 - DNA, 30 bp, Homo sapiens
  chr7:157271776-157271806
  hypo
tggtggaagaaaacccgtgtatcagtggac

SEQ ID NO: 96881 - DNA, 54 bp, Homo sapiens; identical to SEQ ID NO: 31064
  chr7:15727290-15727344
  hyper

SEQ ID NO: 96882 - DNA, 92 bp, Homo sapiens
  chr7:157274739-157274831
  hypo
cctgttgtattgtgtcgtgtgttgtgttgtgtgtgtgttgtgtgttgtgtcatgtatgtgatgtgtgttatgtgcgtcgtgtgtcgtgtcat

SEQ ID NO: 96883 - DNA, 53 bp, Homo sapiens
  chr7:157276004-157276057
  hypo
ttgcttctactgccacggggctgtttttaattcccgagcgttcttttgggtgt

SEQ ID NO: 96884 - DNA, 158 bp, Homo sapiens
  chr7:157276262-157276420
  hypo
ctcatgggccccttgcggacacccacttgggaacctcacggttcagatccagggacctgctccccgggagtccagcgtccttgcaggggcctgcgatgccttgtgcggcctgggccgtgctgcttggcgtctgcacgcaatggcgagggctcccggct

SEQ ID NO: 96885 - DNA, 256 bp, Homo sapiens
  chr7:157277538-157277794
  hypo
acgtctccagcgtcccgatgttgtgacttgagcgcttgtgagctctgattgtggctgtcgtgttggagatgcagtccccggacgtgagacctgtgcctgggggtgcacagctgacccagccctgctggggtgtagcctccctctgagcagaagggtgggttcaccgggggctctctgctgagtccacacatgcagccaggcctctccttctcctgtgcaagtgtgtaggaagagaagaagccgctgagggtcagcc

SEQ ID NO: 96886 - DNA, 174 bp, Homo sapiens
  chr7:157280193-157280367
  hypo
gagcccgagttcccacgcaggggagatgaagaccagggcgggcaggggcctggcccaggttctggagaagcaaggggtgcttctcggatatcacggtggatgagagtgacccagagtcgttaaccagagtgtctatgcggccgtgacgaggcgtggactcggctgtccccatca

SEQ ID NO: 96887 - DNA, 170 bp, Homo sapiens
  chr7:157280604-157280774
  hypo
ggcacacgggagagccggggagggcacacgggagagccggggagggcacacgggagagccggggagggaacacgggagagccggggagagcacacgggagagccggggcggcacacgggagagcagatgaaggtaatacatgcagtggcccagctcgggggtgtggattc

SEQ ID NO: 96888 - DNA, 409 bp, Homo sapiens
  chr7:157291421-157291830
  hypo
tgggcctggtgaagacgggcacaaaacagcagcagtgaaacacaaagtgaatcgaattagtcactactcaggcctggggcctcagctggaaatgaccttcagaattcaacggaggaggcccttcgtgggagacaaagaaggatggggcgtcattgtgggagctttaacgctgcacaaaggacgatcaggaggtggcaatgcatgtgtgacctgcgccgggcagggagggaggctctcaagaggcctctgcgcagggcggtgccctgtgtgcctctggaaatgaggcagaatttgtggtgacatcatgcccagtcttcctgccaacaaaagagtgtatcaggttggaagtgagttttccatttcataggagagtgggggtatggcaggagtccctcggaaatagtggagt

SEQ ID NO: 96889 - DNA, 230 bp, Homo sapiens
  chr7:157294091-157294321
  hypo
tgggcagatgctctgcgtgcgggaggctgcgctttcagtcattatttggatttcgttttccacatgaaaatatttagagatccagctcttggaagccaaggagaaactggcttttaaggtaaaggaaggcaagtttgccgaggtgatgggaagacaccttgcaactgcgaaacctccaaatttaccggtagaacctggcacacagcttttgccgtcgtttggagaattac

SEQ ID NO: 96890 - DNA, 30 bp, Homo sapiens
  chr7:157314286-157314316
  hypo
ggctggtgggagccgcgggccagagggtgg

SEQ ID NO: 96891 - DNA, 30 bp, Homo sapiens
  chr7:157318443-157318473
  hypo
cagggaaaagagggccgtgtgcagtgtcgc

SEQ ID NO: 96892 - DNA, 227 bp, Homo sapiens
  chr7:157319475-157319702
  hypo
caggcctcccaagaccgcttcacacttctgtgccgaccaggccaccagccagcgttgcctcttgcagaccactcggccgctagtggggtgcgcacagcagcaggctttctgtacccagagaggcggcagcaggagagccacagagagcacgggagcttctccacctcgcctggcccctcacgtgcggagcacgtcccctccagactgaagggcgcacatcttgggct

SEQ ID NO: 96893 - DNA, 30 bp, Homo sapiens
  chr7:157320033-157320063
  hypo
tgagggttttttcttcgtgctctccctgat

SEQ ID NO: 96894 - DNA, 63 bp, Homo sapiens
  chr7:157320767-157320830
  hypo
ttcagggttaggccccggaacctcacacatgagggctcagaacacccacgagaggtgggaatc

SEQ ID NO: 96895 - DNA, 30 bp, Homo sapiens
  chr7:157332948-157332978
  hypo
aagagaaatgccaaacgtgccttgtgtgcc

SEQ ID NO: 96896 - DNA, 30 bp, Homo sapiens
  chr7:157334100-157334130
  hypo
gcacccctccctccacggacagcctgccga

SEQ ID NO: 96897 - DNA, 71 bp, Homo sapiens
  chr7:157336122-157336193
  hypo
gtccacgctggacagcgagtgggaacgccccttctcaggctgtcctgggacaaccacggggtgcccacata

SEQ ID NO: 96898 - DNA, 142 bp, Homo sapiens; identical to SEQ ID NO: 41584
  chr7:157337964-157338106
  hypo

SEQ ID NO: 96899 - DNA, 83 bp, Homo sapiens; identical to SEQ ID NO: 41585
  chr7:157338308-157338391
  hypo

SEQ ID NO: 96900 - DNA, 30 bp, Homo sapiens
  chr7:157340396-157340426
  hypo
gcctccagacacacacgcctcagtgggtgt

SEQ ID NO: 96901 - DNA, 156 bp, Homo sapiens
  chr7:157341515-157341671
  hypo
tcagagcagagcaatcggtgtgcggctcacattaaaccaggccctccccgtgctcctctcaggaacacggccgcagagaggcaccttgaatgggtctgcgtcccggaggagagactgacagtaccttcgtctggaccatgccgggtctctggtccc

SEQ ID NO: 96902 - DNA, 88 bp, Homo sapiens
  chr7:157346653-157346741
  hypo
tacggccaggccgggcgccggatcctgcccgctctcgtgccctcctgggcatgggtgcggccaggccgggcgccggatcctgcccgct

SEQ ID NO: 96903 - DNA, 155 bp, Homo sapiens
  chr7:157346979-157347134
  hypo
tgggtgcggccaggccgggcgccggatcctgcccgctctcgtgccctcctgggcatgggtgcggccaggccgggcgctggatcctgcccgctcttgtgccctcctgagcatgggtgtggccaggccgggcaggggcacaacgttggcattgataa

SEQ ID NO: 96904 - DNA, 47 bp, Homo sapiens
  chr7:157347797-157347844
  hypo
agacaccaggctctgcgtgctccgctggcacccgaatggccactggg

SEQ ID NO: 96905 - DNA, 30 bp, Homo sapiens
  chr7:157348767-157348797
  hypo
tggcagagcaaaactcggctcaaggtaact

SEQ ID NO: 96906 - DNA, 76 bp, Homo sapiens
  chr7:157350791-157350867
  hypo
gttaaaagggaaagacgaatacgatggctccacaattccgagtcctatctgtgtgtgaacacgtgcacattggtgc

SEQ ID NO: 96907 - DNA, 149 bp, Homo sapiens
  chr7:157352962-157353111
  hypo
tacactcagtgaggacggctccatgcacagggacgaagacccccgaggagaccatcgaaggatggtgggcagtgctgcccacacggatgcccagagcgtgttccccaagaccagcgggtctcatgctgtccacacgctcccaccaggcg

SEQ ID NO: 96908 - DNA, 48 bp, Homo sapiens
  chr7:157361605-157361653
  hyper
tgttgagaaccatgtcgatcaggacgtaggtgccgctccggcctgcac

SEQ ID NO: 96909 - DNA, 39 bp, Homo sapiens
  chr7:157367437-157367476
  hypo
tctcacctttcctgtcgctgaaatcggggtggctatttt

SEQ ID NO: 96910 - DNA, 319 bp, Homo sapiens
  chr7:157370470-157370789
  hypo
atccacacgggcatgcggccctcgggggtgactcagcctccgtcccctgaacatggggtgcgctgagcctccctgcatgcggccctcgggggtggctcagcctccatcccctgaacatggggtgcgctgagcctccctgcatgcggccctggggggccctaacgaatcccattcggaggaggagcagggcccgtcctcgtccggctggtgggtcctgccctgggtggctctggtcggagtacctcatagatgtggtagagattggagccttcatccggccagtagtggtagcactgccggacgccgttctccgcgaggg

SEQ ID NO: 96911 - DNA, 30 bp, Homo sapiens
  chr7:157372062-157372092
  hypo
aaaacatgtttcttacgccaggcttttcag

SEQ ID NO: 96912 - DNA, 30 bp, Homo sapiens
  chr7:157381230-157381260
  hypo
gtggggccacgtccccgggaaggtgcagac

SEQ ID NO: 96913 - DNA, 378 bp, Homo sapiens
  chr7:157396375-157396753
  hypo
gaacggcacccactacgaacctctcctaaaagccatgtcttctagtcaggaaactgtccagtcaccattgctggatgttctacaagtcacggaacccaccgcccagcgtgagccgggacccacacggctcataaacagccccgctggtgaaggaacaggggagtggcgggagcccaatgggcagagtcggccctgtccaccgcagagacgctgagctgggtggggacgtgatttcccccgagaaccttcccacgtgatttgccgcgtccgtgccacccaagggaaagcctggggcccctgtcccggcagtgcacttacgatggggctagcgttgatgtagtctgagtggctgtggctgttctccgccttcagcaggac

SEQ ID NO: 96914 - DNA, 35 bp, Homo sapiens
  chr7:157402619-157402654
  hypo
aagcatgctagaggacgcggcggtatagtcattaa

SEQ ID NO: 96915 - DNA, 202 bp, Homo sapiens
  chr7:157403604-157403806
  hypo
gtcattcagggcctccgcagctcagcatacaatgctgcatctgggcagactgggacaggctggggctcatatccagaaagccctgctacatccagagatggtcatgaaaatgagacctgccccacccaccactcaggaggcacgctgctcaccgctgagctgaataaccgagcgcgaggctggtgtccggcttccacactgg

SEQ ID NO: 96916 - DNA, 30 bp, Homo sapiens
  chr7:157404012-157404042
  hypo
ttcccatacctgaagcgattttaacccaca

SEQ ID NO: 96917 - DNA, 198 bp, Homo sapiens
  chr7:157404368-157404566
  hypo
acacgggagggagagcgcccgtgtgaagacgaagacagccgcggtcatgctggggacacgcggagggagcgcgcccgtgtgaagacgaagacagccgcagtcatgctggggacacgcggagggagagcgcccgtgtgaagacgaagacagccgcagtcatgctggggacacgcggagggagagcgcccgtgtgaagac

SEQ ID NO: 96918 - DNA, 175 bp, Homo sapiens
  chr7:157408585-157408760
  hypo
ggcctcagaatcagccggcgctgagatgtgcacctggcaggatgaacgtaacttctggtggataaagtgggaggcctgatccaggaagaagcacaccgtggcctggggcccctctggagggtaggtcttccaagtcacgggaaacagggcgcccaggagacggtgagcccggctg

SEQ ID NO: 96919 - DNA, 189 bp, Homo sapiens
  chr7:157409685-157409874
  hypo
ttttcccaacacacacgcacaatctcaggtgagcccaagacagcctatgaggatggcactggggagtctggatttcagctctgacgggcgggctctaaaccccaaagttcttgtcggccaagtgggggggtttcttgtgaggaccagaggtggcacatccacgggcatgggggacgctggctcacgatg

SEQ ID NO: 96920 - DNA, 49 bp, Homo sapiens
  chr7:157414092-157414141
  hypo
cctccctctgggccacgaacgagctgttgggctccgcctggtaggcgca

SEQ ID NO: 96921 - DNA, 101 bp, Homo sapiens; identical to SEQ ID NO: 41594
  chr7:157437497-157437598
  hypo

SEQ ID NO: 96922 - DNA, 84 bp, Homo sapiens
  chr7:157443172-157443256
  hypo
caaagctggagagttcgccctgcggcctggtttactcatcaggcctccgcgccagcacccgagccagagcgagaacggccagcc

SEQ ID NO: 96923 - DNA, 72 bp, Homo sapiens
  chr7:157446076-157446148
  hypo
gctgctggatcaccacggaattggctgccttgtagctgtgatgagtcggaaggtcggcgactctgatgcgtt

SEQ ID NO: 96924 - DNA, 123 bp, Homo sapiens
  chr7:157448403-157448526
  hypo
aggcagccagcaggacgtgctgcgctattgacagctgtcctaataacacccggacattcattatgtatggagtggcaatgcacggccacacacgcgtgatcactccagcgaggaccctggaaa

SEQ ID NO: 96925 - DNA, 30 bp, Homo sapiens
  chr7:157448928-157448958
  hypo
gggtgcagccatcatcgcccagtccccgag

SEQ ID NO: 96926 - DNA, 231 bp, Homo sapiens
  chr7:157449174-157449405
  hypo
gatgcgtgacgtgtgcgggccctcaggtcggtctggtggccgcgtggccatacgctggcggcacagctcctgcaggacagggggaggaagagcagggggttagtggcattggggacacccagcaggacgagggccacggcacccacgtggcacaaccccttctcctgctaagatccaaggttcaggcaggcgagagtttaccccagggcaggccagcgcaacatgacggtc

SEQ ID NO: 96927 - DNA, 106 bp, Homo sapiens
  chr7:157453759-157453865
  hypo
tagagctggacaagccgacatcgcctcctccggcgggtggctcagtgcccagtggctcagtgctggtgcacggtgagggagacccagggttcggtgcctctcagcg

SEQ ID NO: 96928 - DNA, 125 bp, Homo sapiens
  chr7:157455446-157455571
  hypo
gctctgcatccatgccgcgactgctttcggaatgtgcttttccagggcgagccttctttttggacatgggatgtacccgatgtctacaagcttgaagtaacattgccgaccgtgtgcttcttgtg

SEQ ID NO: 96929 - DNA, 30 bp, Homo sapiens; identical to SEQ ID NO: 41599
  chr7:157455840-157455870
  hypo

SEQ ID NO: 96930 - DNA, 53 bp, Homo sapiens
  chr7:157457934-157457987
  hypo
tctgtttatgatccgcgactatgcaccttcagccacagcggcccagtgtgtgc

SEQ ID NO: 96931 - DNA, 48 bp, Homo sapiens
  chr7:157462508-157462556
  hypo
gcaccagccctttctcgagtccccacacaacctcgaggccgggctccg

SEQ ID NO: 96932 - DNA, 165 bp, Homo sapiens
  chr7:157464660-157464825
  hypo
ccctggaggaaaacccgtgagcgagtcgtggagggagtgtgagggtttttggggagtgaactttgcagagggtgctgggagcagccggcccgaggacaccgctgactggggtacaggggccacgggtcgcacgtggggtgtcagctctgccgcctcacttggggt

SEQ ID NO: 96933 - DNA, 110 bp, Homo sapiens
  chr7:157467603-157467713
  hypo
acgatgccctcctcccgagggacggtggccccaaggggagccgggagagcagaggctacaggcagggagtggggagacccagccttcaagcacagcgccccttgggtggg

SEQ ID NO: 96934 - DNA, 45 bp, Homo sapiens
  chr7:157468290-157468335
  hypo
gggagcagctcatgccgaggaggaagtgtgcggaaacgggtaccc

SEQ ID NO: 96935 - DNA, 100 bp, Homo sapiens
  chr7:157476555-157476655
  hyper
gtgaatgggggagcacgcccggccttggtcctggctgctacaagatgagaacaattagcaaacccctttccaccacctaatttcgcgtggtaacaaaatg

SEQ ID NO: 96936 - DNA, 103 bp, Homo sapiens
  chr7:157476871-157476974
  hyper
gcctccttttgccttcggtgcagcggattagctggtgccgggactgagttaatggaaacgcgggttaaatgagaaaagacgcccggattttcctgcctggatg

SEQ ID NO: 96937 - DNA, 495 bp, Homo sapiens; identical to SEQ ID NO: 31715
  chr7:157476994-157477489
  hyper

SEQ ID NO: 96938 - DNA, 110 bp, Homo sapiens; identical to SEQ ID NO: 31716
  chr7:157477710-157477820
  hyper

SEQ ID NO: 96939 - DNA, 17 bp, Homo sapiens
  chr7:157481533-157481550
  hyper
cgtccctcccccctcgc

SEQ ID NO: 96940 - DNA, 315 bp, Homo sapiens; identical to SEQ ID NO: 31718
  chr7:157481759-157482074
  hyper

SEQ ID NO: 96941 - DNA, 308 bp, Homo sapiens
  chr7:157482200-157482508
  hyper
cgggagactctctccggccctaaaaggcaattgtgctgagattttaactctaacttgggggttcgcccgattccctggagcaacgcttctctaaaaccacggagcaggccagtgttcggaactgcacaggtagttacgaaggaaggaaatgaagtccctcgttccaacagcttcgggtccagtcacaagtttctctctggcgagcacgcggccgcctcacctggggtgggggaggcgctgagaaagcgcagttctctttgggggaggagagatggcctctcagaggcgtccccacctgcctctggaac

SEQ ID NO: 96942 - DNA, 1977 bp, Homo sapiens
  chr7:157482509-157484486
  hyper
cctctccctgcaggccccctcggttccctgcaattcgccgcccgctgggatactcccatggctcggaggcgcgctcccggaccctggtgaggagggtgaagagcgccccaaaatgggctgagaggaaaatgcgcccacactggcgcctctccatcctggctgctcgccccttccctcctcctttcccacacgcctcccatctccgtgcctgcacccccccacccccagcaccctgcaatggtcggaactgcagggagtggggagcaacgcgaaaggccgagagaagagcgctggggagaagtcccggaggtcctagactccttggggcggtctctgcggggcgctgggccaggacagctgccaaccctccaaatctgtgcgctcagaaggagctgccctttgcccgctcctcctcacaggcccaccctagacccacttggggatgatcccaggcgcagctctcccctgccggcccaagcctttgacaggagtcctgcggcgaggcagagaccccctgaactgagctctccgacgccctagttgcccgttagagcccccatgcgcgccctccagccttcgaaagctctcttcctcgccccaccacctacgcgcctggtgatgctctcgtgggcccttcctgctccctccgcccccatcccagcctctctcgcctcttccagggcccacccaaccgcactacgagcgcccgcgccccgcccggcacccctggttacctgcagctgggccggcgcccagcgcccgcgcgggaggaggtgggggcgtgcgccgggccgagcggcctcggggcgcagcagctgcgggtagcggcagcgccatcatcacagccagctgcttccctgcgctggagccacagactagcggggtcatccgcttctgaccacaaacttctagggcggccggaggagacaaaggtgccgcgcgtcgctgctccagcagcagcggctgcgcggcggcacgggctcggagcccgcaggcgccggagctctgcgcggccgctcggcccagctccgcgtgctccgccccggcccggcccccgggctaggcacgctgggccggggcgcggcgcgggcgggctcagggcgggctccggacggtcccggtagggccgccggccgcgcgcgtagcaccaaccagcgcggccgccgcgccccgccttatatccggcccggcgcgcacccggccggcggcggcgcggctcgcggcccagccaccggttgctatagcgatgtccccccccccccccacatgttgctgacagcaattggctaaggggccgcggctctccaaacaccctctcccgcccgagactatgaatggacatcagctttgtcagtcattggtacaacgccgaagccagggccttcgccttttctttcttttcagtgtttctccctttcatcgttcatactgggcaagttcagggtagcaccgaggggagagagacctcggccagaaaagtcaaggcgcgcggctctgctgtgacctttgtcctgggaggggtgggtggggtgcgtcgccactcttggcaagagaaaattgcacggcatatcgttcttcccagttaccttttccagtgttgccgttcgggcctttttgctccctttccaaatggaagcaggccaatgattcagggcgagtagacgagagcccctctgctcactttaccagggtcctcccgagtgtttaggtcccgatgcgcgtagaaagtgtcttgcgagacgcggaactggtgagactttgccaccatttggtccaggccaatgtcggccgccagcccaaaacgccgaagggagacggcggtgaaaacccaggcgtgcgagctgcgtccttgcccttccccctacccaggtcaatggtctggcctagaccaccgctctgcgggcgaaaggagtggagcagaatcacaggccacgctcccagtcgttcgagcctgcccacataacccccggcccctgg

SEQ ID NO: 96943 - DNA, 1095 bp, Homo sapiens
  chr7:157484507-157485602
  hyper
cgagaagagctagggtctcggggcgactaggaccactgagcacctcccccccgcgcctcccgcccatgctctctctccccaggccctggaccccgggccacagccacaggttggggcaccccggtgcgcggcgcccccgcggagctggcgagagccggagagctgaaacccaacatctgtgtgtacaatgcgctctccgaggcccacagctgcaggaacaaggagaagaaaggaagaggggggcgcagatcttgtcacacgcagatgacagtctgcggagggctctttagtttctccttttctggaaaccccagcggccccctcctaggcccccctctcccaccgcctggccattgttccctgcgcccgggacagctggagacggcggcccgcgccactcgacgcccctcccgccgcacacccggctgcccgcggcgcccgctcccggcccctccggggccaactcctccacaccccccacctccccaggccaggcccaggcggcgcttccacagtctcccctcccctcccttgcactctggcgctgcccctagacctgctcggtgcagagggccttgcctggcgcttttctctcacaaacctagttctgtaaaacctgggggcgagccccagggggcagggctcagaggcgggggttgtccacagatatgagtacggtgccgtccgctgcaggcccctgtctaaaagtggccgaaggaccccgtttcctctgactgcaggcccaggctgagttccgcatttatttttgtatttatagggcaaggccagagcgcttcataaagctccagggcaaagaagtggcctcgcatcgggccatggttcccgcaggcctgagcgggctgcaggaggcccggtgcggctcggcgggggcgcgagaggcgagaaactgcggcgtcactggcgtcctctgcccatgagtgaacccctccagtaggcggggacggggtacatcaccttggccctctcgtcccccctgcccagggcaaggcccgcaaaaacccccgcaccctggctcgggggcggcgcggcggcgggcaggtcagagagaagcggtactcgggttcccccagcgcc

SEQ ID NO: 96944 - DNA, 433 bp, Homo sapiens; identical to SEQ ID NO: 31725
  chr7:157485649-157486082
  hyper

SEQ ID NO: 96945 - DNA, 211 bp, Homo sapiens; identical to SEQ ID NO: 3189
  chr7:157486204-157486415
  hyper

SEQ ID NO: 96946 - DNA, 128 bp, Homo sapiens; identical to SEQ ID NO: 31727
  chr7:157486475-157486603
  hyper

SEQ ID NO: 96947 - DNA, 15 bp, Homo sapiens
  chr7:157486656-157486671
  hyper
cgcagaccctgccgt

SEQ ID NO: 96948 - DNA, 30 bp, Homo sapiens
  chr7:157505944-157505974
  hypo
tactcaacccaatgacgcatctttaattct

SEQ ID NO: 96949 - DNA, 54 bp, Homo sapiens
  chr7:157506246-157506300
  hypo
ccatcagcaaagagacggtgtgacgcccggctccctccccgtcactgatacggc

SEQ ID NO: 96950 - DNA, 44 bp, Homo sapiens; identical to SEQ ID NO: 41600
  chr7:157511451-157511495
  hypo

SEQ ID NO: 96951 - DNA, 152 bp, Homo sapiens; identical to SEQ ID NO: 41601
  chr7:157512238-157512390
  hypo

SEQ ID NO: 96952 - DNA, 216 bp, Homo sapiens
  chr7:157527539-157527755
  hypo
cacaccaggacctggcgctcggccatgtgcctgcgttttccaatattgatgtcgacgtgggaggcaagttgctatggaggaaacgcgcacacacatctgagattattaaatagcagccgctaactgcctcgatgcaggagtcccatctccccaaacaaattctggctgtgatgccaactgcagcaggacggttagtggtgccgctggcaccgagag

SEQ ID NO: 96953 - DNA, 30 bp, Homo sapiens; identical to SEQ ID NO: 41603
  chr7:157530181-157530211
  hypo

SEQ ID NO: 96954 - DNA, 118 bp, Homo sapiens
  chr7:157536623-157536741
  hypo
tgtgtcctctttgcacgttgcatgtgtcgtggtgggagctgtgaggcggtgccgtgacggggcgatgctgctgcaggagacgtgctccggggcacgactctgacgcagcttagaagag

SEQ ID NO: 96955 - DNA, 30 bp, Homo sapiens
  chr7:157544564-157544594
  hypo
aaggacagagaccaccgtgaacacatctcc

SEQ ID NO: 96956 - DNA, 58 bp, Homo sapiens
  chr7:157546564-157546622
  hypo
cacagcacccccatccgcggccatggctgctgtccaggcatcacgcccacacctgcca

SEQ ID NO: 96957 - DNA, 34 bp, Homo sapiens
  chr7:157550924-157550958
  hypo
aaatatggatgatgacgagcgtggtgttgcccac

SEQ ID NO: 96958 - DNA, 103 bp, Homo sapiens; identical to SEQ ID NO: 41605
  chr7:157551220-157551323
  hypo

SEQ ID NO: 96959 - DNA, 153 bp, Homo sapiens
  chr7:157552297-157552450
  hypo
gtggggctcactgtccggggcggcctggctttttatcttcagcggttgctgttattggtcaatgatgttggtgttcagatctgcaagttctggactcatgactttgaggctttaaaaattactttaacaaataatgtacgcgttgagaatggt

SEQ ID NO: 96960 - DNA, 151 bp, Homo sapiens
  chr7:157565500-157565651
  hypo
cttctctggcctctgcgccccagctcctttgtgcgaggtcccatgtgctgctaggccacgggtggctgtccagggtgtggcttggagccgtggagctggaggcctgggtgatatggtccaggctgcatgccgactccgggtgtacactggg

SEQ ID NO: 96961 - DNA, 134 bp, Homo sapiens
  chr7:157568187-157568321
  hypo
cctgaatacaggactcgatgcctcgaggagaggagcgtggagcacgcccggggcacatggggacacagcagcgctgggaaggcttcgtcctcgggagccggcgctcacatgcagggagtcgcccaggacagcaa

SEQ ID NO: 96962 - DNA, 62 bp, Homo sapiens
  chr7:157578615-157578677
  hypo
gcagggtgggagggccgggtggggatggctgcagggaccccctgggccggctctgggtgctg

SEQ ID NO: 96963 - DNA, 30 bp, Homo sapiens
  chr7:157581557-157581587
  hypo
tgctatgctggaggccgctggaaccacctc

SEQ ID NO: 96964 - DNA, 341 bp, Homo sapiens; identical to SEQ ID NO: 41609
  chr7:157583900-157584241
  hypo

SEQ ID NO: 96965 - DNA, 30 bp, Homo sapiens; identical to SEQ ID NO: 41610
  chr7:157584643-157584673
  hypo

SEQ ID NO: 96966 - DNA, 84 bp, Homo sapiens
  chr7:157585079-157585163
  hypo
ttgctgtggctctggcggacattagccagcagtggagagaagcccatctccacccccagggagctcagccgaggtctccgcgtc

SEQ ID NO: 96967 - DNA, 441 bp, Homo sapiens
  chr7:157588586-157589027
  hypo
cacatgtgatgctgacgccctcagaaacctggggctaaggccacacctgatcaccgtgatggaggggggcaggcgccgaggcgaacttgggagaggccctatggtgcacacccctacccttcctggctggagaaaaatggcccgccccgtgaaacagcaaataaacacacgcgttccaggacgtgagatacggcctccacatcaatcagagggacctgcccagtcctgtcaattttccatctaaattacataactgtcctccttagagacgcggggatgcccaggcacaggcatgaaagatcggccttgaggttattttgtctctgcaagtattgatgcgaggacttgtggcgcttttctttcccggtgaactttcccaactgctgatgttacgtgcactaagcacatgattttcctattcattcccgaatctcacatttt

SEQ ID NO: 96968 - DNA, 35 bp, Homo sapiens
  chr7:157589600-157589635
  hypo
caacactggggattacggttcgacaggagattttg

SEQ ID NO: 96969 - DNA, 30 bp, Homo sapiens; identical to SEQ ID NO: 41613
  chr7:157601854-157601884
  hypo

SEQ ID NO: 96970 - DNA, 33 bp, Homo sapiens
  chr7:157603115-157603148
  hypo
ggctctccacggggacggcggggctgctgggca

SEQ ID NO: 96971 - DNA, 349 bp, Homo sapiens
  chr7:157606439-157606788
  hypo
gctgtctacacagcacgcattccttaccccggtggttttcatctggaccctgagtcagaatggcctggagcgcgggtaaaacagctcggggccagccagagcttctgagccagggctgggcccaagaacgtgcatttgcgttgttccccaggtgatgctgctggtgaccccggggaccccgccgtgagagccccgacacaagtcgcggtttgtggtgctttggaggagtttgctccttagagtgagggggattgttctgccccaatggcctcttcagagctgcgagactgtgcccacgcgaggcagtggtcgccacacccacactgccgtgctgcgcaggtgaggcctg

SEQ ID NO: 96972 - DNA, 44 bp, Homo sapiens
  chr7:157607996-157608040
  hypo
gcgccctcccatggccgtggcctcttcctcggtcctttgccctc

SEQ ID NO: 96973 - DNA, 30 bp, Homo sapiens
  chr7:157612336-157612366
  hypo
acctccttttggcagcgcaggtgcattcag

SEQ ID NO: 96974 - DNA, 31 bp, Homo sapiens
  chr7:157613184-157613215
  hypo
agcagatccaacacacgcattcttacacatg

SEQ ID NO: 96975 - DNA, 41 bp, Homo sapiens
  chr7:157624712-157624753
  hypo
agcacctggcacctccgctaattctccggggtggaggcact

SEQ ID NO: 96976 - DNA, 30 bp, Homo sapiens
  chr7:157626674-157626704
  hypo
gaaagaaggagctggcggatttctcctctg

SEQ ID NO: 96977 - DNA, 123 bp, Homo sapiens; identical to SEQ ID NO: 41615
  chr7:157633412-157633535
  hypo

SEQ ID NO: 96978 - DNA, 30 bp, Homo sapiens; identical to SEQ ID NO: 41616
  chr7:157642058-157642088
  hypo

SEQ ID NO: 96979 - DNA, 35 bp, Homo sapiens
  chr7:157645946-157645981
  hypo
tcacatgatgacggccgagccgggcctgcaacgga

SEQ ID NO: 96980 - DNA, 30 bp, Homo sapiens; identical to SEQ ID NO: 41617
  chr7:157654407-157654437
  hypo

SEQ ID NO: 96981 - DNA, 30 bp, Homo sapiens
  chr7:157655687-157655717
  hypo
gggattcacgtcaggcggcacttggtgggc

SEQ ID NO: 96982 - DNA, 87 bp, Homo sapiens
  chr7:157656677-157656764
  hypo
tacaggctccaaaaacgctctctgcatgtgtgattctggccaggaccaccctgcccgaagccacggctatgtcgaagctaattgtgc

SEQ ID NO: 96983 - DNA, 217 bp, Homo sapiens
  chr7:157659256-157659473
  hypo
ggtctgcaggaaacacgtccatagaggtggagctgaggctggtgtgcattctcccaggcacccagcatgagtgcccagctcagggtctgcaccgaggctgtctggcccgagtcccaggctcgccccagtgcttgccacacacaccctggggtctcctcagaagcagtgcctgtgccccgagatgcacggccaccaccccgcccctgaggccctggat

SEQ ID NO: 96984 - DNA, 80 bp, Homo sapiens
  chr7:157660078-157660158
  hypo
ccaccctgtccctgacgccctggatacacggccacctggatacacggccaccaccccgcccctgacgctctggatacagg

SEQ ID NO: 96985 - DNA, 33 bp, Homo sapiens
  chr7:157690247-157690280
  hypo
ccagtttccatcagtcgccggctgctctcctct

SEQ ID NO: 96986 - DNA, 30 bp, Homo sapiens
  chr7:157695195-157695225
  hypo
cgtggggaccagccccgtggtggcctggag

SEQ ID NO: 96987 - DNA, 459 bp, Homo sapiens
  chr7:157702952-157703411
  hypo
acgggtgcaggaccacgcacgtacgccggatcacgcacgtacgccgtggggacgggtccaggatcacgcacgtacgccgtgggaacgggtccaggatcaggcacgtacgccggatcacgcacgtacgccgtggggacgggtccaggatcacgcacgtacgccgtgggaacgggtccaggatcaggcacgtacgccggatcacgcacgtacgccgtggggacgggtccaggatcacgcatgtacgccgtgggaacgggtccaggatcacgcacgtacgccgtaggaacgggcgcagaatcacacacgtacaccgttctgcacagctggcggacgcttcctctttcccacatggtgtggtgtaacctgatcgtttgtatgcaaagcaaacccatgcacagctgactgtgtcaaaacacagccagaaagatgccatgcggcagggcacgtgtgtgtgtgtgt

SEQ ID NO: 96988 - DNA, 30 bp, Homo sapiens; identical to SEQ ID NO: 41622
  chr7:157718446-157718476
  hypo

SEQ ID NO: 96989 - DNA, 49 bp, Homo sapiens
  chr7:157722602-157722651
  hypo
gggccaggcatgaagcgaattcagtccacatcagcgggtccaagcctgg

SEQ ID NO: 96990 - DNA, 301 bp, Homo sapiens
  chr7:157776661-157776962
  hypo
cggctcacccagcgccgcgagcatctcttcctgactcgcagggggcccgtgagatggagaatctgcctgacagggtgcacttgcacagccaagcaccaagaaggaaaatggcatttcattagccatggagacagccgggaacccagcagccttctttattctggctcatattttctcatcattctcagggagttgtccaggtaacaatgaccttgtgtaaaccagcgtccctgcctgagtcctcttcacctgaaaccaccgccccacgccaggctccacctccccacgccaggctccaccc

SEQ ID NO: 96991 - DNA, 71 bp, Homo sapiens
  chr7:157778447-157778518
  hypo
cctgagggaggtgcacggaaaccatgcatccaaatccggagagcagggagaccagccggatagcccacctg

SEQ ID NO: 96992 - DNA, 35 bp, Homo sapiens
  chr7:157793339-157793374
  hypo
gtgggggctggtgtccggccgcaggtggggtgcag

SEQ ID NO: 96993 - DNA, 77 bp, Homo sapiens
  chr7:157793825-157793902
  hypo
aggtggggtgcaaggtggggctggggtttggccgcaggtctggtgcaacgtggggctggggtcgggccgcaggcggg

SEQ ID NO: 96994 - DNA, 145 bp, Homo sapiens
  chr7:157794503-157794648
  hypo
tgttgtgccctcacccggaaccgtgccaggcaccgaggaggtgctcagtaaactatggggttgcatcgtatttgaggtcatccggaggcacccgctgctgcactgggactcctggagatcctcctccagccggaagctggccaag

SEQ ID NO: 96995 - DNA, 30 bp, Homo sapiens
  chr7:157795418-157795448
  hypo
gcaggtcagctgcagcgagagaaatggact

SEQ ID NO: 96996 - DNA, 30 bp, Homo sapiens
  chr7:157853764-157853794
  hypo
caaccctgagccaggcggctttgtccgtgt

SEQ ID NO: 96997 - DNA, 180 bp, Homo sapiens
  chr7:157877427-157877607
  hypo
gatgcccatccacacagatgcccatacactccgacactcatccacacccacgatgcccatccacacggatgcccatacactcctacaatgcccatccacacccacgatgcccatccacatccttgatgcccatccacacccatgatgcccatccacatcctcgatgcccatccacaccca

SEQ ID NO: 96998 - DNA, 43 bp, Homo sapiens
  chr7:157886934-157886977
  hypo
ccaggagcagcagaacgctcgccattcccgaaggaccagggcc

SEQ ID NO: 96999 - DNA, 30 bp, Homo sapiens
  chr7:157890829-157890859
  hypo
atgagcacacacgcacgcaggcaccagaac

SEQ ID NO: 97000 - DNA, 235 bp, Homo sapiens
  chr7:157891284-157891519
  hypo
aaaccagaggctccccgaggcacacgcctccctcgcccgccccggcctggcatctgccagtcccaccattttgctgagactctgtgaaggtgaatggggttgcttgggctcggggactggaagaagaaggacgtttatctcgtgaacgcgggacgctccttatgggagaggagtgggagacatgaagcaaagcgtgaccaccgaggagctggggagaaagcgagaaagcaaggaa

SEQ ID NO: 97001 - DNA, 193 bp, Homo sapiens
  chr7:157932110-157932303
  hypo
gaacagaatgggagacgttctgcagaacctcagtcacccctggggcatccaagccgtcggagtcaggagggcacgggggggtgggaaaggaaccagaaacacctgaaagaaagcccacaagtctctcaaatctgggaaggattgtcactcagggactcaagacagtcactaagttccacgataataaaatgca

SEQ ID NO: 97002 - DNA, 66 bp, Homo sapiens
  chr7:157934593-157934659
  hypo
tgtgacggacacgggcgttctgatcggagcgtgctgggcgttcactgccaccgatgtcccctgctg

SEQ ID NO: 97003 - DNA, 185 bp, Homo sapiens
  chr7:157955324-157955509
  hypo
tcaccggccactgcacgtcacctgttgtcctccccgtcaccccaccttagataggccttccactgaacctgctttaaagctctttgaaaggagaccagatgtgaattatgaataagtgaaggaagagagtctctttttaaagcttttaccaggtaaacttttgtcatatgcgttcagcccgcagc

SEQ ID NO: 97004 - DNA, 158 bp, Homo sapiens
  chr7:157956509-157956667
  hypo
attctctgtatatttcgtaggtgacgcctgtacggggttctcaattctctctgcatatttcataggtgatcagtattctctgtgtatttcataggtgatacctgcatggggttctcaattctctctgcgtatttcctatttgccgttttacatgaggc

SEQ ID NO: 97005 - DNA, 190 bp, Homo sapiens
  chr7:157958513-157958703
  hypo
tttctcccctgggcccgccctgacgtggcttaactcaggtagcgacaccggaagccacggtcttggcagagcagtcacctcgaggccgacactgttcagctagtgcatggtgagcagcatgaaatccagacagggggcttcggaggatgtggcaaaccgccataaatatgggctacggtcacatgctggg

SEQ ID NO: 97006 - DNA, 63 bp, Homo sapiens
  chr7:157984975-157985038
  hypo
aggaaaagccaaccccggcccggggaggaagtggaagggtcacctcagcggggggtctgtcct

SEQ ID NO: 97007 - DNA, 124 bp, Homo sapiens
  chr7:157987024-157987148
  hypo
atgtccataaaagaacgggcatcaccattaaaaagatgggccagtctgggggcccttgctgtccggctctgctgcccacagacaagggcagggccctctgtgaacctgccgccctcagcaatgc

SEQ ID NO: 97008 - DNA, 87 bp, Homo sapiens
  chr7:158037639-158037726
  hypo
agcgacaggcctgagcgaggccagcagttcgaagcccctgctccctggctgtgtcatgtggacaagtgacgtcgtcttgaggatggc

SEQ ID NO: 97009 - DNA, 30 bp, Homo sapiens
  chr7:158039764-158039794
  hypo
aaaccatccctggcacgggctgcctcaagg

SEQ ID NO: 97010 - DNA, 266 bp, Homo sapiens
  chr7:158040050-158040316
  hypo
gagggcgctcttgaccgtgtctgcgtgtctaagcaaaggatacaggggcgcaaagggaaggagtggccaggggtgcccgtcccaggtgtgctcttcttcacggcgcccctgcttccccaccacgcccatgtccacggctcgtgggcagctgggcactgggccactcagacaccgtcctaaacactccacacaggtaacttgctccctctccagccacacagcaaacacagcaaaggggacttgggtgtctgcggtttttttgtttg

SEQ ID NO: 97011 - DNA, 92 bp, Homo sapiens
  chr7:158046523-158046615
  hypo
ggcatccatatttatcgagcagaggaagcatccctgtaactgcacggcggcacagagccactgcccacggcacgacccgccctccatctcta

SEQ ID NO: 97012 - DNA, 30 bp, Homo sapiens
  chr7:158054306-158054336
  hypo
actccatagagcacacgaagaggataaaac

SEQ ID NO: 97013 - DNA, 176 bp, Homo sapiens
  chr7:158059198-158059374
  hypo
cagtgaggctggggacggtgtctgctgcggtgtgatgtctggcagaaagagccggggccagtgtggctgtgagcatcaggcctgaattccgtgaactgaggaacagcctgacagagggacccagcagcagcggcctcaggacaggcacaacggccacttcccggcttaacctgggc

SEQ ID NO: 97014 - DNA, 277 bp, Homo sapiens
  chr7:158059722-158059999
  hypo
gtgcctcatctgcagcgtcgtctccagtgactggcacctcagacagccccacacccgcggcaggtcccgcctggcactcgggaagctcttgcatttaagagatctagaaatgttgacactttgcgtggaattttaaaagctgcttaatcaggaaggagccagtcaggaaaagggacctgccaacctgcttgttagccgagcagcgaggcactgtgagcacacgggatgatgggtgctgggtgctggagttgaccggctggcccggcagagctggttc

SEQ ID NO: 97015 - DNA, 153 bp, Homo sapiens
  chr7:158065251-158065404
  hypo
ccacctcaaagacaccgcacgcggcccacctgccttgcaccccagacaccagggttgaaagcctgagtccaggcaggagccaacctcacagagtcaaatctcggagcaccaggtgaggggaggtctcagcgccactgccgggataagccctca

SEQ ID NO: 97016 - DNA, 120 bp, Homo sapiens
  chr7:158066949-158067069
  hypo
cggggagccgcagacacagggggagacgcagacacaggaggagacacacaaggagccgcagccacagggggagccgcagacgcgggagagccacagacacagggggagccgcagacacag

SEQ ID NO: 97017 - DNA, 44 bp, Homo sapiens
  chr7:158075807-158075851
  hypo
gatgtcaggggaagacgcattcgacaacacgcatgaaaaaaaac

SEQ ID NO: 97018 - DNA, 30 bp, Homo sapiens
  chr7:158103351-158103381
  hypo
gggcgagccctgagccggacagagcgcaag

SEQ ID NO: 97019 - DNA, 103 bp, Homo sapiens
  chr7:158113168-158113271
  hypo
gagcagctgtgatggcgcccccatcgcccgcatcctcagcagcgccaggtggcgtccgtgttcccgcgtcctcggcagcgccgggtggcgtccgtgttcccac

SEQ ID NO: 97020 - DNA, 47 bp, Homo sapiens
  chr7:158144245-158144292
  hypo
gcgtttcttactacacgaaacatggttacctacgagtgaaatggcag

SEQ ID NO: 97021 - DNA, 30 bp, Homo sapiens
  chr7:158167123-158167153
  hypo
cctcaatatcaacagcgcagaaactccact

SEQ ID NO: 97022 - DNA, 145 bp, Homo sapiens
  chr7:158187594-158187739
  hypo
ccaggctgtgcaggccgcatctctgcaacgcgtcagccagagaaagccgggggcaccccagccagcactcaggaggccctgcccgtccacacgacacctgggccaaccagccctttctgctgtaaaacttcggctcctctacctg

SEQ ID NO: 97023 - DNA, 45 bp, Homo sapiens
  chr7:158188532-158188577
  hypo
ggatcccaccagccccgaattcgggcagagcgccatggagggccc

SEQ ID NO: 97024 - DNA, 30 bp, Homo sapiens
  chr7:158207406-158207436
  hypo
atgtggctcattcttcgaggctccactgaa

SEQ ID NO: 97025 - DNA, 33 bp, Homo sapiens
  chr7:158246475-158246508
  hypo
ccatgtgcagggaaccgacggagacacttagaa

SEQ ID NO: 97026 - DNA, 96 bp, Homo sapiens
  chr7:158249132-158249228
  hypo
gagaacataatggcacggacgccatcggcaatggccccccattgctctgcagagaacataacggcacggatgccatcggccatggccccccatcgc

SEQ ID NO: 97027 - DNA, 47 bp, Homo sapiens
  chr7:158277680-158277727
  hypo
ggcacccctcccagccgctgttgctgtggccccggccgccagcgtcc

SEQ ID NO: 97028 - DNA, 205 bp, Homo sapiens
  chr7:158282122-158282327
  hypo
agcgagactctgtctcaaaaaaattttttaaaaaaggatgaaaaacttgccgaaggacagagcaaaacaaaatcagaaagcaagggttggtgcgagcgatgggcgcccagaacccgggcaacctcttctccccacccaccgaggccgcagcccatggctccggggttccatccgcctcctctcggcagcgcgccccgggcggccc

SEQ ID NO: 97029 - DNA, 32 bp, Homo sapiens
  chr7:158282841-158282873
  hypo
gctcaccgcacgcaccgcgtccctggaagcaa

SEQ ID NO: 97030 - DNA, 48 bp, Homo sapiens
  chr7:158283188-158283236
  hypo
gctggcaaaggttggcgttcggctccacgtccacgcctgtcttaaaca

SEQ ID NO: 97031 - DNA, 436 bp, Homo sapiens; identical to SEQ ID NO: 41640
  chr7:158301251-158301687
  hypo

SEQ ID NO: 97032 - DNA, 30 bp, Homo sapiens
  chr7:158319411-158319441
  hypo
gtgaggacacagacacgcacagatggacaa

SEQ ID NO: 97033 - DNA, 30 bp, Homo sapiens; identical to SEQ ID NO: 41641
  chr7:158332352-158332382
  hypo

SEQ ID NO: 97034 - DNA, 291 bp, Homo sapiens
  chr7:158349456-158349747
  hypo
tgctcccacgcaggtcgctcccacgcaggtcaggcggctcccgcgcaggtcgctcccacgcaggtcaggcagctcccgcgcaggtcagacagctcccgggcaggtcaggcggctcccgtgaaggtcagggggctcccgtgcaggtcgctcccacgcaggtcaggcggctcccgcgcaggtcactcccacgcaggtcaggtggctcccgcacaggtcaggcggctcccacgcaggtcgctcccacgcaggtcgctcccacgcaggtcagagggctcccgcgcaggtcactcc

SEQ ID NO: 97035 - DNA, 30 bp, Homo sapiens
  chr7:158355894-158355924
  hypo
cacaagtttgcagctcgagaccttgtccag

SEQ ID NO: 97036 - DNA, 421 bp, Homo sapiens
  chr7:158379278-158379699
  hyper
caggaaaggaggtgccggggactggaggttttatgggtttaaaacaggggcgtccgcctgggaaagcagcggcttccactccctcgctgccgtgaagctgccgccctccctttcctcccgcggctgccacggaggaaaaatgtcctctgatttcggcggcgctgcccgcgggggggtgcgggggacgcaggtagaagcgggtgcagcgggacatccgaggcccggcccctcgcggcacacgcggcggaacacgagcggggggcgcacccacgccggaccagggccgcgcgctccagggccaggggagtgccgagtggcggggctcggggcgtgaggcccaggagccggggtagaggcaggaggcggcgccggggaggaaactgaggcaggggcgcgagacctgctccgagcccccagtgag

SEQ ID NO: 97037 - DNA, 117 bp, Homo sapiens
  chr7:158380279-158380396
  hyper
ggacggacgaaggggcggcaggcaggacgcgtggcggcagcagcagcagtagcagcagcagcagcgggagcggcggccccatccccgcggcctggccggcggcgctcagtccatggc

SEQ ID NO: 97038 - DNA, 401 bp, Homo sapiens
  chr7:158380813-158381214
  hyper
cctgccgccgctccccgcccggcccggtgctgggggtcgcactgtccctggggacggcgggggcctaagccgcgcccttggcccggacgggaaggcccgaacctactctgctggggacctgggcaggcggcctctacccgcggggccccgcgcgcgtcgaattaacgccttccaaccgtttctttaatttaaacgtaacgggccacttgcgcatcggggcgcgcggaggtggacccagtcgacctcccctgcagcgcgggcggcgcccaggctcggtcccaggaaagctcccggagggcccagggcgtgggctggggccaggcgggctctggggcagagcagggtgaggcctgttgcgggcctggtctcctcgccgccgtcccgcccggggtcctggggga

SEQ ID NO: 97039 - DNA, 30 bp, Homo sapiens
  chr7:158450990-158451020
  hypo
ttcctacttttctaccgtaccaaaaaacag

SEQ ID NO: 97040 - DNA, 30 bp, Homo sapiens
  chr7:158522269-158522299
  hypo
gtgaggatgtgctggcggggaggagcaagt

SEQ ID NO: 97041 - DNA, 240 bp, Homo sapiens; identical to SEQ ID NO: 41643
  chr7:158550099-158550339
  hypo

SEQ ID NO: 97042 - DNA, 30 bp, Homo sapiens; identical to SEQ ID NO: 41644
  chr7:158564374-158564404
  hypo

SEQ ID NO: 97043 - DNA, 18 bp, Homo sapiens
  chr7:158594958-158594976
  hypo
tccatgtcctatgcacga

SEQ ID NO: 97044 - DNA, 277 bp, Homo sapiens
  chr7:158766828-158767105
  hypo
ctgtcctcccagggccgatgccagcgcccgccctccgcgttcccggcattgacagaatgtccaggcgcgcagggcccgtgggtggggcctgggcacccggccctgccctcgcgcaccctccagacccgccacttcttagatagagagcggccgcctccccgccctcctttcagccactcgctccgcgcagtcagctctgctgactcttccggaggattctggaaggttccagagggtgtgccgccgaggccctgcgagagggcgttccctggggaga

SEQ ID NO: 97045 - DNA, 139 bp, Homo sapiens
  chr7:158788416-158788555
  hypo
atcccacgtcctcctcggctattcccctgctgctgaccacctgtcccagcctcacctgaaagcacatcccgtcctcccatcctcagtcccaggagcatcacttgctgagggattgtcacggccgcgaggcttcagcccg

SEQ ID NO: 97046 - DNA, 30 bp, Homo sapiens
  chr7:158815031-158815061
  hypo
atcctcacagcatggcgactggagggtctt

SEQ ID NO: 97047 - DNA, 30 bp, Homo sapiens
  chr7:158817049-158817079
  hypo
gagctcggccaggcccgaggttgagctgtg

SEQ ID NO: 97048 - DNA, 356 bp, Homo sapiens
  chr7:158823309-158823665
  hyper
gatgaccgaggtctccgtttgcaggaaggactgggcgcgggagccgcggtggaactgcagggcgccctccgagccgttgcgggagaaggaggaaccgcagaccctgtaatcccggctcgcggacggggtcgggcaccggcttcgccattttcgcttcagctcgcactgcacctgggaggtgagggcagcgggaacgcccgtgagcctgggcaggtgcgggcggctgctatgggaagcgcggcccgcgagcctccagctctccctcccgcctgctcccgtatctgtgttgccagcagatggacagaaacagaaacggccttgggggcagaggctggagggagcgggaactggacggc

SEQ ID NO: 97049 - DNA, 93 bp, Homo sapiens
  chr7:158857187-158857280
  hypo
actgtggtctcaagtcggggcggccagctgggtgctgggctgaaggtggcagcagccacccgctgtcgggtggggcttcgaggttgtcagcag

SEQ ID NO: 97050 - DNA, 77 bp, Homo sapiens
  chr7:158868410-158868487
  hypo
cagggccagcacccacggacccactgcatcagtgagtagcccagggccggcacccacggacccgctgcatcagtgag

SEQ ID NO: 97051 - DNA, 203 bp, Homo sapiens
  chr7:158933031-158933234
  hypo
tcagcctgtagattccggttcacatcgctgatagcatctttattctggtaacttacttctatttacatccctggcatttgagccacgcatatttcaaagagtacagaaaaacaaaagagtggccaggctgaggccccggcatgctgctgcttctctcctgaagggcagtgtcttgttaccaagtacttcgtgcaagtcaaaaa

SEQ ID NO: 97052 - DNA, 569 bp, Homo sapiens
  chr7:158936522-158937091
  hyper
tactttccaaggacccgctccgcaaagcgcccaccctcgagggaggaaagccgagctgcgcctccgcgcaaggccagggagtgtggctcgagccccgctgcagaccgggcgtcgccggttaatcaatgacactgtcgggtcagcagcgcagcctcccagctgcggaggggccgcggatcgatccagacctgcctcggctgcgacgcgcacgaaaaccgcgcgcaccgcaaacccgcttcagtctccaagaggaaagcaagaaacaaggctcgggtttttttctttcttttttctttcctttttttttaaggttcacagagggaataattcagaactccatgtgcgaaggcacttaatcaacaaacttatgagcagttagttcctccagtgcccttgggaaaaagcaactatttccaaaaggaaactttatttaaccgacgccacgtccccccgacactaaaactaaccagtaagtacagggagggaccgagaggcatctgcggccaacgccaaccccgatctccccgtgaaacgcgcagcccgcgcaggcgcccgcagctcccagctcc

SEQ ID NO: 97053 - DNA, 173 bp, Homo sapiens; identical to SEQ ID NO: 31733
  chr7:158937202-158937375
  hyper

SEQ ID NO: 97054 - DNA, 34 bp, Homo sapiens
  chr7:158937576-158937610
  hyper
cgcagctgtagccgagcgcccgagcgcgggggcc

SEQ ID NO: 97055 - DNA, 384 bp, Homo sapiens
  chr7:158937611-158937995
  hyper
ccccctccgtcccggcagctggagcgcgctcaatgcacgcccgtcccccacgcgccccgccgctccgccccccgcccctgtccccgccccgcgctgccccaatcctcgtctccctcctcccccgagaacccccgctccgcgcccctcctcaccgccccccacttccccttccgctgcgccccgcgccctctcctcgcccctgggctctctgtccccgccgcgcgcgctccctctggtctcctcgacccccccagcctctctctccgttctcctcccctcttccctggcccacgcccccctcccggccgcgcctccccgatctgtgggcggaggggctgggaagcggggtgctcagtgcgcgcccggctccgagtagagagaact

SEQ ID NO: 97056 - DNA, 223 bp, Homo sapiens
  chr7:158938210-158938433
  hyper
tttggtggggatccccgcagcctcaaagaggacatcaggtcgaacagaaagctggagaaaaacgcagacgggggtataggtgggtcccagcctcagctgggtggcgggttttgtgtcctgcgtttgcaaaacgggggtcattctctccccgcaaacgcggcggcgggtggggaacgctgggcggggactcacgcggtgccactggggccgccccgccgcgccc

SEQ ID NO: 97057 - DNA, 108 bp, Homo sapiens
  chr7:158948149-158948257
  hypo
tttcataagcaccaccggcatgttgacagttgcgtggagttcagagtccatggaccctggggaccatgacgcccccgtgtgcaggtgacaacacgcctgctgaaggcc

SEQ ID NO: 97058 - DNA, 30 bp, Homo sapiens
  chr7:158950620-158950650
  hypo
gcctggggctggccacggcgacatgaatgg

SEQ ID NO: 97059 - DNA, 549 bp, Homo sapiens
  chr7:158963388-158963937
  hypo
gctcactaatggggccgctgcgagaatcgcgtgagcagaaacacggatgatcatggctcactgacggggcaactctgaggatcacgtgagcagaaacacacaaataatcacagaatcactgacggggccactgtgaggatcgcgtgagcagaaacacacagataaccaaggcctgaccaacggggctgctgggaggatcccgtgagcagaaacacggacgatcacagcatcactatcgagacggctctgaggatcctgtgagcaggacactggtgtgttatgctttaaagcttttccttgatcttggtgatttcacgtcttaggaaacctccctcactaatcagccggccccgtgggcaatgcagcttctcctgaaaagcaaacacttcaactttcaggcttcgtggccactgacccgcttctggccaggggcagcctcctccctacccctcgtgtaacggactacgggactggacatctgtcacgatgccatttgagacggaaagggcactgggccagtgtctggaactggcccgcacgcctcaggtc

SEQ ID NO: 97060 - DNA, 43 bp, Homo sapiens
  chr7:159023728-159023771
  hypo
gggccataaagaggccgtggccggaggacggagcgggggcgtt

SEQ ID NO: 97061 - DNA, 17 bp, Homo sapiens
  chr7:1596347-1596364
  hypo
atttgttttctgggccg

SEQ ID NO: 97062 - DNA, 854 bp, Homo sapiens
  chr7:1598548-1599402
  hypo
cggctgagccagatgcgccagctcgggaaccgtggaccaagtgtactggtctggggatgtcaggagcagggcctggtccccagggaggggcagtcgggaggttgaccgctctgccacctgctcacagggctcgccggctgatcgaggcctcacccggtgctggtgtcacagcctctgcgcccggtcacaggaggcggcagggccggctgggcctgatttttctggcgggggcgggacactgaccaagcccattgcaggacagacctgtctgcccagatccaggcgacggggccctctgaccattgttcactgcgtccaggtgcccagagctgtggggaggctgagaagccgcccagccagtcccacaccctggccctggcacagccacctcctcctgctctcatgagaaacccggctgagggcccatgagctgttgcctggttccaggccggctgccctgctagtgcccaccccgaccccctgcctgcccgtctctctgcagatgcggacaggcatggtgtacccccctgcctgcctccttcactgctgggtggaactcggggcgcccaggagccgcctcctcagggctggctcatttgatgtcccaggctgagctgcacactagggggatgaggtgaccggtgggcacccatctcagacacccggcttcccaggtcccgcggccctcccctgggggccctggccagcagttcaccaaggcagcagccccgggtgtgagcagggggtgacagggatggggctccacatcctcccggctctgcttctgggattcccccggctcctgtccacgggcacggcctcctgagagccgcgtggggcgggcaggcagcatg

SEQ ID NO: 97063 - DNA, 316 bp, Homo sapiens
  chr7:1600538-1600854
  hypo
tgggtacagctggcacggaccacaccctccaccttcccccctgcccggattttgggacccacatctgtccacgtgccacccctgcctcctgccatcccagcgggtgtgagcctggaccaatctccctgtccggtggatttcagacgtgggaccacaagtgggctggggtcccgatgccccttcacgagtgacgcagcccctgcctccccttctttggccccctcacccctgaaaagtcccattcgggagcctgagggtgtcgggacacggatcgccaccaagctctgcccctgcccacgcacgcctgctacccggg

SEQ ID NO: 97064 - DNA, 789 bp, Homo sapiens
  chr7:1607231-1608020
  hypo
agttcctccctccaccggggagggaggtgagacttgagtccctgagtgggtgtctgggtgttcacgtgtcctgctgagcagcgcggggcggctgcctccaggtcaccacacctggcacacccggatcacctccctcagcgccttcagcccctccatgcttttgtccttcacggccacggcgaggaggactgctctgtttccagcttcttgagacacaaacgctaccaggttctttgcaaagacatggatgagaggctggtaaaggaaggagaagaaaccattttaactgcaagaaacctggttttttcctcaatgctttcatgaagtatcccttaggaacccaggcaggcttcccacaccaccattaaccgccacataagtccatgcaactgtgactcagagttctggcagcactcagaacactccagtcacgggcacactgctaaagaccatcactccattcattttcccagcgccttccgcagccccgcctcttctggctctctctcatctaaaagaacccaggaaagagaagcctgcagaagcgagtgctgtcgaatctcacgtgtgatctccacagagcacagcacagccagccgcctgctcacgtaatgtaccatggcaggggaggcggctcgaatgacaaaactgctgcttctgcttgtctgctggataaaatgcctgcgggctggacaaagcatccactgagggcaagcagggcgccttgagacccacaaatgcccggaaaatgctatcgctgtaggggtatttgtccgccagatgccccat

SEQ ID NO: 97065 - DNA, 78 bp, Homo sapiens
  chr7:1615015-1615093
  hypo
tgaactgaagtatttcgtttaacaccacacagtaaacacaaaggaaacccaccgttgctgggccgccttccatcatgg

SEQ ID NO: 97066 - DNA, 36 bp, Homo sapiens
  chr7:1620503-1620539
  hypo
tagagaaaagggaaacgagaccgggcagccaggttc

SEQ ID NO: 97067 - DNA, 40 bp, Homo sapiens
  chr7:1621494-1621534
  hypo
ccccaatcccctcaccgtcttttgccgtcagccctctgcc

SEQ ID NO: 97068 - DNA, 123 bp, Homo sapiens
  chr7:1624765-1624888
  hypo
tggtgaaccccaacacgaggacacaggcagtgccctctcaggaccactgtgggtgccaccaggcacgacttcctaaacacccacagagcaaaaacctggaaattcagccgaggcactgggacc

SEQ ID NO: 97069 - DNA, 15 bp, Homo sapiens
  chr7:1625802-1625817
  hypo
tcctgggagtcagcc

SEQ ID NO: 97070 - DNA, 30 bp, Homo sapiens
  chr7:1640689-1640719
  hypo
gggtgctgtggccagcgctgtgggggatag

SEQ ID NO: 97071 - DNA, 308 bp, Homo sapiens
  chr7:1641670-1641978
  hypo
cagcctcagccctcccggtgccaagattcttcaacgtcctcgggatgcacctccgcactgtggggccatctgggtcagcccggacgcaccggcctctgtctgggtcccagtcttctcaccgccaggcgggcaggtcagcagaccaggcaggaccgagcccgtcgcccggggctcttgttgtctgtgccatttcggtgccttttgtccttgcttcccgccgctccttgaggatgtttaccggctgctggggccgtgccttccaggtgaggcctcggtcattccaggtgcagcctcggatcagggatgac

SEQ ID NO: 97072 - DNA, 92 bp, Homo sapiens
  chr7:16437156-16437248
  hypo
acaacatgtgattgacgaaatgtgatgtgaccaatttgactgacatatgagacgtgacagattactgacgtgtgacacgtgacacgtgacca

SEQ ID NO: 97073 - DNA, 191 bp, Homo sapiens
  chr7:16460326-16460517
  hyper
gcagagccccaggaccgcgagactatccgcacagcttctcctcaggccccacagctagaaccccaaatcgcctagtcccaacccatgcactctctaatcggcgccacacgacgggccttccccacaacctcatctgcttggggacgtaaagggctctgtgggggagctgcagctttcgtgcccatctgtta

SEQ ID NO: 97074 - DNA, 408 bp, Homo sapiens
  chr7:16460890-16461298
  hyper
actcaggcaaggacccggctccgccggcctggcgctgcccggcggcccggcctccatggctgcgggcggaacggcgagccccgctagcctcgggccgatgcgaccccgcgctgctcccaccctcggccggggtcgcggggcgaagggcagaccacggagagggacgcagagcgcgcaagcagaaggcgcccccctcagccgtcggagccccgctgttgctgccccgcaggggacgatcccgacagctacggcagcagctgaggctgccgatctgccctcgcggctcggctgcggcctccgcacccggtcccagcgcctgcgggagggctgacttgcccgctctgcgcttcccccgggcaggcccagctgtcgccgcaagtggaaatgtcagaacgccctacatatcta

SEQ ID NO: 97075 - DNA, 189 bp, Homo sapiens
  chr7:16531866-16532055
  hypo
atgggataacgtagacggcttaagcttttgtgaattttgccgataggcattttaaaattctggatcatgataatacaacacgctgtatcagatgactttcatcctgaggctctttatgcctaacaggacaacgacaaattaatatacagtatatatttcttccacgtagtctcacgaagcctgtacata

SEQ ID NO: 97076 - DNA, 30 bp, Homo sapiens
  chr7:1654887-1654917
  hypo
atgattgaagttggacgaaaggattttcta

SEQ ID NO: 97077 - DNA, 63 bp, Homo sapiens
  chr7:16566510-16566573
  hypo
tctcttcggtgccaccggcgggcgaggccggattaatcaccgctgcttcggccgcccatgtgt

SEQ ID NO: 97078 - DNA, 30 bp, Homo sapiens
  chr7:1659704-1659734
  hypo
gcaccctggagcctccgacggggcggccac

SEQ ID NO: 97079 - DNA, 47 bp, Homo sapiens
  chr7:16793964-16794011
  hyper
tccgctttcccaccccgtacccttctgccgctcgctcctgacatcca

SEQ ID NO: 97080 - DNA, 136 bp, Homo sapiens
  chr7:1680137-1680273
  hypo
ccttggagccactggcgttggaagcaccgtttcctgccgtgtctcggaagggggcgctgtggcacgtggcagcagagccagcgcgctgcagccctctctgagccccgggtggtccacccctcggcccctgctgggg

SEQ ID NO: 97081 - DNA, 50 bp, Homo sapiens
  chr7:1681189-1681239
  hypo
gctacccccttctcccgccccccagctctttccatcgcattgccatggtt

SEQ ID NO: 97082 - DNA, 227 bp, Homo sapiens
  chr7:16844142-16844369
  hypo
ataatatattccaagcgggcaatccgagctgaggtgtcatagtggagaagcctatggggctttgctttagcccgtgggaaagaaagctttagatggtgactgagacgaaaatccctggaccctgtcccaggcttgaaaaatcctaggattcacctactcttggaaattttgtttcgcaaaagagaaagcatttctctgaactaactcgggaacgtcacactgtgcca

SEQ ID NO: 97083 - DNA, 100 bp, Homo sapiens; identical to SEQ ID NO: 41092
  chr7:1684968-1685068
  hypo

SEQ ID NO: 97084 - DNA, 151 bp, Homo sapiens
  chr7:1688950-1689101
  hypo
cctccctggatctcacgtcctcatttggcaaacagggatagtcgtgatccctcccttagggccggtgcttggaaagaatgaacgaacatgggtaaggtgtgcctggtgagcgctgtctgggctgaaggaggagtttgagaaggcggcttta

SEQ ID NO: 97085 - DNA, 279 bp, Homo sapiens
  chr7:1690421-1690700
  hypo
acgcaggggaaggcccgctgcaggagaaggggaactgaagtaggggccggggctgggccagtccacttggcaaggacgtggcttgcagggggtgctgagaccttggccttttgccaaagcaccccgctccctggagccacttgcccacccctcccccaggctggttcggccccagccaggtaggtccaaagtcctgtgctgccggagtggagtctaataagcccctcctggcaaggggctcaccaccaaggcaccccacgatgacggctcaggaagtgg

SEQ ID NO: 97086 - DNA, 30 bp, Homo sapiens
  chr7:1690977-1691007
  hypo
ccagagaatcttgcacggtgaagcgggcgg

SEQ ID NO: 97087 - DNA, 242 bp, Homo sapiens
  chr7:1693830-1694072
  hypo
ggagaccagcccccacgcagaccccgccctgcctgcccatccagctcctggagccagcgggcgtctgcgccccagtgtttggctgcagtgagtcaggccttggggagcaatgcgccatgctcagctctgggagcgggccagggcactggtcctggggctaaggcccagcgtgtacaggctgtttgctgagggcgtgctttgaggaagagcatacccgggttccaaagcgcctacagtgaaca

SEQ ID NO: 97088 - DNA, 106 bp, Homo sapiens
  chr7:1694880-1694986
  hypo
ctagagtgactcacacgaacgcagatggcggagcctaccccacgcctgggcctcgcggtacagcctgtggctccggggctacacacccgcacggcaggtgactgca

SEQ ID NO: 97089 - DNA, 1035 bp, Homo sapiens
  chr7:1704118-1705153
  hyper
cggagtttctgggctgcggagaggccgttggacccacgtccggacaggagccccgcgcgcccatccccggcccggccatcctcggggcgcgctgtctgcggcctcccgcgccacccccacccctgtcccgggacctcctccgggaaagacacccggggagcagccccctcccctccagtagtcccctcccctcccctctccctgccctcttgacggtgtggggctccccggccggaggggcgcggcgctggcagcggggtccagagtgtcgcgcccagcgcgcgctgggggtcccgggctccgcagctccgcacgcggccggtttgtgaagcggcgcgcgggggcttagccgggcgagggcgctcttgagcctggtttggaatttttagcccacacgaaagccgcaggctggggaaggggcgggtgggagcgggagacgccctgggaagccgtgagaccgctcggcgagggctcgggaccaccagggagcgacgggggacccctcggctcagagcccgagggcgcgatttcggatccgctgggattccggaggcacatgaagggagagggaaatccgctaaaccgaaccttccgggaatcggaaggcgccgggccgctcccacgcctccccctcctcccggccgaaaggcggggggcgacgcgcaacggggagggaagggagggaggggtcggcgaccttaggggagggcgagtctctggggacgcggggccgccaggggcccgacgaccctctcgctccacctccccgcccccaagtgccccgctctccccccgccccgcaaacgcgcgtcctgcgggctgtgctttggccctcgcggacgcgcgcgctcacagagggtctgacttggggtcaacttccacgaggttgccgggcgcctgtgagcacagccgtgtccccacccaggggcccacctcccagcgccaccagggtcccgacccccagaccttcggacgcttctcttccaaaccgaagcctgggagcctctgggtggcctggggcgggggcagggggcg

SEQ ID NO: 97090 - DNA, 307 bp, Homo sapiens
  chr7:1705386-1705693
  hyper
aatgtgctacaacctcggcgctgccgcggccgccaccactgcgcccgcgcccgagcccgagtcggagccggagccgccgctcccccgcctgcccggccagccccgggctccgagcgcgcggtccccgccgccgccgccccgcgctcgccccgcgcttgacgcagtgagcgccgcagcctggctcccgccggctccgctgggctccgggtcgcaggccgagtccagccgggcgggctccgggaggggccggcagggcgggagggggaggagggctgtctggagccagcgagcccggaggaggaagagg

SEQ ID NO: 97091 - DNA, 538 bp, Homo sapiens
  chr7:1706195-1706733
  hyper
ctagggctagggaggcgccgcggggaccccgaaactttccggagcgcgctgagagcaaaaagccggctgggcagaaagagggggagggggctgggcgcgccttcgagtgcgctggggtagccgcggcgccccaagttgaaccacagacgaacccctcttcatctgaaacctggtctcggagtcggaggtggggagggagtgggctgtgggtgcctcgacttcgcaaagccggcgtgggggggcgcagcgccccgccccgcgccgcttgaacctccggagggggtgttacgggacccccgcccccaccccagccggtggctgggctctgccgaccgctgcggagctcccgggaaggacccgctcgcggctattaataggcgtcggtgaccctagcctctcccggtccgggaagctggcgcggcggggctgggctgggctgggctgccgagtggggcgggaccccggggcccagagcggacccccagctctcctggtccctcttccgccgctcttccctccctgccgcctgctttcctcc

SEQ ID NO: 97092 - DNA, 370 bp, Homo sapiens
  chr7:1706939-1707309
  hyper
cttcctcccaacccacggcgagcgcaacacattcgcccgcccctgcggccccatctgagggcggggagaggtcgctgggggcagcttcgggggttgtggagggcaggggggacccgcgaagctcctggagcgtttagggatgcagctcgggcggcgtgtgcagggaggaagcagcgtcccggcgtccccccttcagcgtcgccttcgcgcgcctcgagggcccaggagggttcggtctcccccaccccacctggacactcaggtctgagcctgagtggatttgaggatctgggggacggggaatacggagtccttcttcctgcctcggtgtctgcagagcccagccctcaggcagcgtggggatctttgt

SEQ ID NO: 97093 - DNA, 502 bp, Homo sapiens
  chr7:1709060-1709562
  hyper
ggcttgtccaggcaccgccggggcctgcccggcccgagcgtggagtcccgaggctcctgccgggggtccaggctgcccctggggctctgccttcgacgcgctgtgtagggccagattctgggcctctcttgactcagtttcccttcctgtaacatgcggacgggggcttccgcacaggcaggttgtcagggtgaaactgagccgaagagtgctccagaaccccctgaagtcctcacagaggttggggtgaatgaaggaaggaagcggggccagggctgggcagaggaggcccggcctgcgccctgcgttctccgcccctaggtccctgccctcccggataaggggcggaccgacgggaggacctgagaacgccttggctttgcttgaggtggtgggagtcgcgggtagcttgttcagccaacagctgtcgcccccactccccccacccacccacccaccccctccaccttttagatgtgggcggggagggccggggacggac

SEQ ID NO: 97094 - DNA, 306 bp, Homo sapiens; identical to SEQ ID NO: 31010
  chr7:1709617-1709923
  hyper

SEQ ID NO: 97095 - DNA, 289 bp, Homo sapiens; identical to SEQ ID NO: 8844
  chr7:1709955-1710244
  hyper

SEQ ID NO: 97096 - DNA, 46 bp, Homo sapiens; identical to SEQ ID NO: 31012
  chr7:1710324-1710370
  hyper

SEQ ID NO: 97097 - DNA, 76 bp, Homo sapiens
  chr7:1712668-1712744
  hypo
agcggatggtggcaccgccgcggacattggatacatttgtcatctctccagcgcccccccccgctctttccttttt

SEQ ID NO: 97098 - DNA, 193 bp, Homo sapiens
  chr7:171314-171507
  hypo
acagacaaggaaaaccgccgttacgggcactgctgccatctcgcaatttacataaagtctcagctctgtgcgtgggacagcagcgtttgaagctgtccccatcaagggcctgtacaaccacctccttcacagttaggggttggccgtcctgaggctgcccgaccccctcccggctccccgaccccctcccggc

SEQ ID NO: 97099 - DNA, 50 bp, Homo sapiens; identical to SEQ ID NO: 41096
  chr7:1714947-1714997
  hypo

SEQ ID NO: 97100 - DNA, 178 bp, Homo sapiens
  chr7:1717985-1718163
  hypo
tcagagcagctctcccgccccaccctgcggccctgcatgtcagttgtgggtaaggcccgcgccactgggaatcttcacacagcccggagggaggtgctgtgtgcccatttcacagaccagaaggccgaggcatggagtggggaagtaacatggtccaggctcacggctcacatgtgcc

SEQ ID NO: 97101 - DNA, 158 bp, Homo sapiens
  chr7:1719538-1719696
  hypo
ccagatcaccatcctcgaggaaaggagagggcagggacagagatggaacggggagcagaagggggcgcgtgtgcccctgagcgctcctgtgtgcaggtgcacagttcattaaacatgaccatgaagtcgggacatgggagttacgcattagaagtgtt

SEQ ID NO: 97102 - DNA, 206 bp, Homo sapiens; identical to SEQ ID NO: 41098
  chr7:1731744-1731950
  hypo

SEQ ID NO: 97103 - DNA, 278 bp, Homo sapiens
  chr7:1733166-1733444
  hypo
gcaagaacacatacacgcctgtggacgtagccttgctgggtgtgtgcacatctgcagaggggtcggtgtacaccgctgtgtgaacacctccggcggtgcccagtccgtgtgaacacatgcaggtgagcacagacacatgcgtgcatgccctctgtgtgtctacagacagctgtgtgcgccacactcaccctcccgctcgtccccatggcaaccccagagcaggtgtctgggagaccctgatcagtgctgacagacacggggtgcgggacacgtgggat

SEQ ID NO: 97104 - DNA, 30 bp, Homo sapiens
  chr7:17339561-17339591
  hyper
tgggagtggatgcaacggacaggatacggt

SEQ ID NO: 97105 - DNA, 30 bp, Homo sapiens
  chr7:173466-173496
  hypo
gctgcctgcctgcagcgggagctaacgggg

SEQ ID NO: 97106 - DNA, 366 bp, Homo sapiens
  chr7:1734686-1735052
  hypo
cctcactttgagttacgctgcagacggctccggatgcacgtggctgtgccaggcagcagacgtggccgacaggcacatggtgggacctgctctgtggctccagagctcatgcgcagcccgctggggctgtgagggttctgtccatccaccaggaaggccaccaggaccctgctcctgcctgagaaccccaggaagtagtagcgtgccaggtgcgtggccggcctcccagcccttcccagcaccagctgcgtcctcctcctccagggctgcagctcagggctcaggtgtccgcgtcgagggcactccctaaagggcaggagcaggaccattggcacaagcctgggcgagtctcgctgggaggcagga

SEQ ID NO: 97107 - DNA, 34 bp, Homo sapiens
  chr7:17413242-17413276
  hypo
gtgagccgccgcgcccaaccgcaaagtgcacttt

SEQ ID NO: 97108 - DNA, 174 bp, Homo sapiens
  chr7:1744404-1744578
  hypo
ggacttgagtggcaacgtcacctgtctgctgagggcctgcctgctgtatgctggggtgtgggctgggcaggccccacaccaagggtcagccctgtccaccagggctcgaggtcagcttagagcctcatggagctcccggctggagagaaggcagccgtgcgtgtccccgtcaga

SEQ ID NO: 97109 - DNA, 558 bp, Homo sapiens
  chr7:1775495-1776053
  hypo
cacaaccctgggaggcggacaccgtgatgatctctgtttgacagatgaggggactgaggctaagagaggttaagtgacatgcccaaggtcacacagcaggcgcacggcagagccaacaccatctcctggcccacgatggttctgtgtcccctgacgcagcaggtgcacaggcgggccccccacctgctcctagctgggccgggtcaccgtggcaggccttgcggctcgaggcccaactgccctgatatgcctatcacagcctcatgggctctgcggcagagcccagggagacagacagggcgagagccaagctgcagaggcaggcagacgttagcagtaaacatgatctatcggcaaaacattggaacgatgaaaagttatcgatctatagctttccaaccatctccccgcctcccccacacgtctggccctccgcccacctttccccctggagctggaaacttcgctccatcagcagaatcctcagtccagccccggccccggccccacaccagccctggcctcttgtctggtttaaatgatcgagacgaggaacaa

SEQ ID NO: 97110 - DNA, 30 bp, Homo sapiens
  chr7:1777547-1777577
  hypo
gtgaatagggtatgccggccaccccttcca

SEQ ID NO: 97111 - DNA, 51 bp, Homo sapiens
  chr7:1779654-1779705
  hypo
gagccacaggggacccgtggccaccctgttggacagcgcaagtacagaacc

SEQ ID NO: 97112 - DNA, 192 bp, Homo sapiens
  chr7:1783194-1783386
  hypo
ccagagggggcacagcgtgccagggacacagggcgggcgagctcagaccgagacctggcagacacgagtccccggacaggccagaatacctcccggtgcctccctcccagagggctggagaggagcccgcgccccggaaggattctgtgttgagggctgcggaccctgcggtgagtgcgcagggtagctcct

SEQ ID NO: 97113 - DNA, 231 bp, Homo sapiens
  chr7:1784226-1784457
  hypo
gtcccgatggccgggcgtgggtggggcgcgctgtgggtgtgcgtggcggccgccaccctgctgcacgctggcggcctggcccgcgcagactgctggctgatcgagggcgacaagggcttcgtgtggctggccatctgcagccagaaccaacccccctacgaggccatcccacagcagatcaacagcaccatcgtggacctgcggctcaacgagaaccgtatccgcagcgtg

SEQ ID NO: 97114 - DNA, 237 bp, Homo sapiens
  chr7:1784690-1784927
  hypo
ggagtgtcccaacatcgtcaacatcgacctgtccatgaaccgcatccagcagctcaacagcggcaccttcgccggcctggccaagctgtcggtgtgcgagctctacagcaaccccttctactgctcctgcgagctgctgggcttcctgcgctggctggccgccttcaccaacgccacacagacgtacgaccgcatgcagtgcgagtcgccgcccgtctactccggctactacctcct

SEQ ID NO: 97115 - DNA, 506 bp, Homo sapiens
  chr7:1786393-1786899
  hypo
caccgccgccgcctccgcacgagggcctggggcgcaaggcgtccatcctggagccactcacccggccgcggccccgcgacctcgcctactcgcagctgtccccgcagtaccacagcctgagctactcctccagccccgagtacacctgccgggcctcccagagcatctgggagcgcttcagactgagccgccggcggcacaaggaggaagaggagttcatggccgcgggccatgccctgcgcaagaaggttcagttcgccaaagacgaggatctgcacgacatcctggactactggaagggcgtgtcggcccagcacaagtcctgagccccccaagaccggcgatgcccactggaccaaaaaggatgcaggatccacccagagactcagcaccaaacccaacacacgcacgccaccacagcaactgtgacagcggggggccctgcagaggcgaggggggagcgagtggggacagacaagggggacacgtcccgagctcctgtggcc

SEQ ID NO: 97116 - DNA, 282 bp, Homo sapiens
  chr7:1787137-1787419
  hypo
acataaaatgccatccgtggggggtgtggccggcgtggccacctcggggcccctcacgtgatctcctcggtccgtggttttctgtggattctctgtccagtccgtctcttcattgccgcctccggagtccactgcagaggggcagagtgaatgccggcggccaagtggcctccgggacaggtcctggagccctgctggactcagggtgggtggaggctgtgcctgtggacggccggggtggccaggacggccaagggctgggaggcacgtcccccagcccag

SEQ ID NO: 97117 - DNA, 30 bp, Homo sapiens
  chr7:1790379-1790409
  hypo
ctggttatccattgccgtgatcatgctgcc

SEQ ID NO: 97118 - DNA, 73 bp, Homo sapiens
  chr7:1795137-1795210
  hypo
gcttttaataagtgccgtcaccttcagctgtgcccagtgtccttaagtccaaagtgttcgtgattcttccttt

SEQ ID NO: 97119 - DNA, 30 bp, Homo sapiens
  chr7:1797456-1797486
  hypo
tataaatagcaccaccgtgtcaacgtgtaa

SEQ ID NO: 97120 - DNA, 30 bp, Homo sapiens
  chr7:1798877-1798907
  hypo
ccaggccccccagcacgccaggagctgctg

SEQ ID NO: 97121 - DNA, 91 bp, Homo sapiens
  chr7:1800821-1800912
  hypo
agccaaaaatagaaacgactgaagcgtccaccaacaggggaaggaccgaattacaatatgaccagagactaaacgccggcagcggtgaaga

SEQ ID NO: 97122 - DNA, 90 bp, Homo sapiens
  chr7:18125972-18126062
  hyper
gagccacggggggcgcgagagggcgaggcagcggcctggcttctccccagcaccgttctctgtcacggccgccgcctgaccatcaccccg

SEQ ID NO: 97123 - DNA, 143 bp, Homo sapiens
  chr7:18126082-18126225
  hyper
cgcttcagaaatcccaagtcgtcttaggttccctggtccttcccctgggggggaaaaaaaacgctggtgcagcccagagcccttttccgctccaccccgggatgtcctcgctgccctcccgcctcccgcgcgtccttcccagc

SEQ ID NO: 97124 - DNA, 15 bp, Homo sapiens
  chr7:18126443-18126458
  hyper
ttttagcaaattctc

SEQ ID NO: 97125 - DNA, 578 bp, Homo sapiens
  chr7:18126465-18127043
  hyper
cgccgcccgctcagctcgcagctcgcagccgcccgctgccgccctcccgagccccccccgcgcggcggcggcggcggcggcggcggcggcgcgtcccgcacatcgcgcagcgcgcaccgagccggccgcgccgcgcccgccgctctcgccgctttcgccgcggtctcctcctctagcgcccgccgcggccggtaaatctcggctggaggagcagcggcggcccccgagtcaactttcattccctttttgcttctgcctcaccattctcttctcctcctcgaaagatggctgtttggagaagggggagaagttaagaggtcgccagcgcggagcgaaggagggcgcgatagcctcagcaggagcgggcggaggtgagtggcaccacggcagagtccccggctggtgcttgaggaaagccctgggaattgggggccaccggtcctcaggatgcgccgcggtattcccttctcgggttccgcaggttaacagcatctcagtccggactctgatgccacttgccttgcatctcgcagcccggagaccggtgggtttaagggaaccttcgtcagaagttgggt

SEQ ID NO: 97126 - DNA, 30 bp, Homo sapiens
  chr7:1819163-1819193
  hypo
gtatacacagtcgtgcgccgcgtagaaaca

SEQ ID NO: 97127 - DNA, 79 bp, Homo sapiens
  chr7:1838908-1838987
  hypo
gaggacatggaggaccggcattcccaaacactgcttatgagagtgacgccagtcactagaaatctgtttggcagtgtct

SEQ ID NO: 97128 - DNA, 49 bp, Homo sapiens
  chr7:1849747-1849796
  hypo
gccaggactgtcaggcgccagctccctcggtgaacgtgacaaggcccct

SEQ ID NO: 97129 - DNA, 51 bp, Homo sapiens
  chr7:186628-186679
  hypo
aggattagaattgcacgcggcgcagcatctggcgcccgctggacgctcagt

SEQ ID NO: 97130 - DNA, 40 bp, Homo sapiens
  chr7:1879361-1879401
  hypo
ttagaacatcccccccgcctccccccggctcccagggcaa

SEQ ID NO: 97131 - DNA, 30 bp, Homo sapiens
  chr7:1883040-1883070
  hypo
gaaggggcccaggtgcggtgtagacctcct

SEQ ID NO: 97132 - DNA, 30 bp, Homo sapiens
  chr7:1888859-1888889
  hypo
gcggcacttgggaagcgctgctctgtggga

SEQ ID NO: 97133 - DNA, 30 bp, Homo sapiens
  chr7:1913796-1913826
  hypo
gcagacagtggctggcgccagaggtcagtg

SEQ ID NO: 97134 - DNA, 86 bp, Homo sapiens
  chr7:19145808-19145894
  hyper
aatccccccattccccgttcccaatctattacatttcaaaggaggagaaagaactggaaaaccccgtttcctttgagaaacgcgtc

SEQ ID NO: 97135 - DNA, 154 bp, Homo sapiens; identical to SEQ ID NO: 634
  chr7:19146031-19146185
  hyper

SEQ ID NO: 97136 - DNA, 345 bp, Homo sapiens; identical to SEQ ID NO: 635
  chr7:19146237-19146582
  hyper

SEQ ID NO: 97137 - DNA, 974 bp, Homo sapiens
  chr7:19146925-19147899
  hyper
cttctaaacccaatacgcttttctggagtcctcggaacagctggccggggcttttagcacacgggacgggaccttcgcctttgcctgtttttttttcgaccaggagaagcaggtgcgagagtctggggcttaggaggtggaaggcggggaaagagaatccactaggtcctcgtgtagagaacaacagtcgctccttagatattactccaggacggaaacctgattgcaaaccgctgttccttcgaaacttgcaaaacccggaacagaaaactcccgcccagccaattttagctctcgctgaactctcccgcctgcgttacgtttgcacagcaactctttgtaaatgtccgagtcctctcggaggaaagatcgttagggcgacgagaacattaagaggggacctggagggcagatatcctcgatcccaagagagcaactttgtcgcctcagaaaacacgccaacttccctcctgctctttccttggtcaactcagaatcaaccgattgtattgaaatctcctgaaatcccgaacagggattggcccagtcggcttctgaaaccgaggccggggaatggcaggaatggggggcagagaggatcggaaagaagagtccttcccccacagacattcccagctgggacacgagctcgctcgcagcgcgtttatggaaagagggggcgctgggaaccgcgctggcggcgagcagactccagggtcgagattattcgacacgtgtcttttattcctcacaatccatttcttacgggtgatttatgaacgaatctctttgatcagggacggttttatctgtccactgctacagatgacagatgcggctgctaaaatgcctggtccccgctgcctaaaaggttgctcccccccttcccaaatgctgttgctttttctctggcggtccccaccccctgcttcttcgttctccttccctacccccaaccccgtttgctgtcttag

SEQ ID NO: 97138 - DNA, 68 bp, Homo sapiens
  chr7:19152223-19152291
  hyper
cgcgagccgggcccgccacccacgcaggggagaccgtgcccgtgcccctctcccgcgcctgccgcagg

SEQ ID NO: 97139 - DNA, 99 bp, Homo sapiens
  chr7:19155963-19156062
  hyper
acaaaaattgaaagccgaaagaaagggtggcgctgacaaaacggtccttacccgtgaccctgggtgtctctgtctcccctcctgtcacgcacactcacg

SEQ ID NO: 97140 - DNA, 8 bp, Homo sapiens
  chr7:19156125-19156133
  hyper
cggccttc

SEQ ID NO: 97141 - DNA, 341 bp, Homo sapiens
  chr7:19156303-19156644
  hyper
ggccctgctgagggggtggggggctccgcctgctagtgggacgcggacatggaccaggccccctccatcctccagaccgagaaggcgtagctgagccgctcgtgagccacatagctgcagcttgccatcttggagtccagctcgtcgctctggaggacctggtagaggaagtcgatgtacctggccgccagcttgagggtctgaatcttgctcagcttgtccgagggcagcgtggggatgatcttccgcagcgcggcgaacgcctcgttcagcgactgggtgcgctggcgctcccgcacgttggccatgacccgctgcgtctgcagctcctcgtaagactg

SEQ ID NO: 97142 - DNA, 42 bp, Homo sapiens
  chr7:19156704-19156746
  hyper
gcccgcagacttcttgccgcgcttgccctgggccgggctgcc

SEQ ID NO: 97143 - DNA, 138 bp, Homo sapiens; identical to SEQ ID NO: 640
  chr7:19157055-19157193
  hyper

SEQ ID NO: 97144 - DNA, 69 bp, Homo sapiens; identical to SEQ ID NO: 641
  chr7:19157194-19157263
  hyper

SEQ ID NO: 97145 - DNA, 303 bp, Homo sapiens; identical to SEQ ID NO: 642
  chr7:19157264-19157567
  hyper

SEQ ID NO: 97146 - DNA, 466 bp, Homo sapiens
  chr7:19157633-19158099
  hyper
cggtggcagccccatccggagtggctgtgacagcagcaatggcaacagcttctacacagtgggtgatgtctcatctcgcccaagagccctctaggtccgtggggccgatttgggattgctggggctgggggggtggtgtggcgcggggtgggggggcatgccaagaaaagtgtcaaccgcggagcccacccaatggtcaggtagacgaaccccttggagttccaaaggccaaaccgcggcggcccagcccggaggtcctgggcgtttctgaagacgtggccgcgccgcgggggctgaggatttgcgtcccggcctgctctctcgcccttctgggccctcctttcccctctacaacgacccagtctgacgctccccaacatccaaaggactacgcctcggaaggtgctcgaaagaggcagaagttcactcttcggtggaaggaaacccagtccatgggaaaggcagc

SEQ ID NO: 97147 - DNA, 90 bp, Homo sapiens
  chr7:191827-191917
  hyper
cacacacacatgcgcacacacacgcacacgcctgcactcacacacccccgtcggccccaagcaggaaggcgcccccggcacaccagcccc

SEQ ID NO: 97148 - DNA, 99 bp, Homo sapiens
  chr7:19183647-19183746
  hyper
actttagatgcaaagcgtagatttgcactctggctaaggcactgaatgaacaccactgtggccctgggacaaggagctgtggtccgtctgggatcaact

SEQ ID NO: 97149 - DNA, 368 bp, Homo sapiens; identical to SEQ ID NO: 31082
  chr7:19184058-19184426
  hyper

SEQ ID NO: 97150 - DNA, 321 bp, Homo sapiens
  chr7:19184564-19184885
  hyper
cgatccgggacagccttttctcgtaagcaaacgtgggcaccttcctccgcagctggtcaaaggcctcgttgaggttgaacatccgcttcctttcgcggatgttggcggcctggcgctgggcgtaggtgatcacccttttcctcttggggcggcctaatagggagacacctcttccgcgctcctcttcctcctcctcttctccgtccccctggtccacttcgcactcctcttcttctgggtccccctcttcaaaccgcgccatcctcctgggtcttccctctcggagcgcaagggctgggtcccccaaggagaccccgggtg

SEQ ID NO: 97151 - DNA, 66 bp, Homo sapiens
  chr7:19184960-19185026
  hyper
cgcagctctccggataggccgccatcgcttcggcttggccctgcctctcatcggttttccgcaggg

SEQ ID NO: 97152 - DNA, 184 bp, Homo sapiens
  chr7:192430-192614
  hyper
gaggaggaaggagagcgggagcgcagccggcccgggcccagccgtgactcgtggggcggcggctccgccaatctgtgggcgctgacgcggggggcggctccgcggcgctcgatatctgcccgcccgggacgcggggcgccgagaggctcggccaggcgggagctgcgctcggggcggccgctgc

SEQ ID NO: 97153 - DNA, 125 bp, Homo sapiens
  chr7:192976-193101
  hyper
tccggagaggccgagcggggacgggcccgagatggcgcggggacccagcgctccggcggcgggcgccctgcacgcggcccgggcccggggacagccccggagctggtagccgcccggcaccgatg

SEQ ID NO: 97154 - DNA, 104 bp, Homo sapiens
  chr7:1931869-1931973
  hypo
tgcggcccaagggtgcgggaggctgcacggcccaggctcgtacaagtcattctaggaagttcccgcaaagacaacactgcccaccagcacgttcctcagcatgc

SEQ ID NO: 97155 - DNA, 96 bp, Homo sapiens
  chr7:193612-193708
  hyper
gctgctgcgagaccccggcccgcgtcggtccgagtcgccccccggccccggcggagacgcctccctcctggccaggctgttcgagcacccgcttta

SEQ ID NO: 97156 - DNA, 39 bp, Homo sapiens
  chr7:193984-194023
  hyper
cttgggaggggctgccggctggtccgggagctgtgccct

SEQ ID NO: 97157 - DNA, 150 bp, Homo sapiens
  chr7:1962361-1962511
  hypo
caccagccaggtctgcggtgagctgcacggtttctgcagatgctctttggcaaacttgggggttctcggcttctcctggtttgccgagtttccccatgaacgtgtgttgggcctcgctgactgcatttgtgcatccgttggtttggccat

SEQ ID NO: 97158 - DNA, 52 bp, Homo sapiens
  chr7:1970869-1970921
  hypo
caactcctcaccccacgcacggtcacaggagcgagggcgcgtcgtggggtcc

SEQ ID NO: 97159 - DNA, 30 bp, Homo sapiens
  chr7:19813245-19813275
  hyper
atgcctacgtcaacgcgggctcattctgag

SEQ ID NO: 97160 - DNA, 30 bp, Homo sapiens; identical to SEQ ID NO: 41114
  chr7:2024812-2024842
  hypo

SEQ ID NO: 97161 - DNA, 35 bp, Homo sapiens
  chr7:2037950-2037985
  hypo
tcaagatgccagctccgaggcgtccgtgcctctgt

SEQ ID NO: 97162 - DNA, 132 bp, Homo sapiens
  chr7:2056554-2056686
  hypo
ttgtcagtaccaacgcgcggacgccgcgcaaggccggggcgggggacttcccttggtaaacaagctgtaattgtctcttttattgatcagtaaatctctgagagcttctcttcgtgacggctctcttcagcc

SEQ ID NO: 97163 - DNA, 24 bp, Homo sapiens
  chr7:20710238-20710262
  hypo
aagaagcaagctggccgggtgcgg

SEQ ID NO: 97164 - DNA, 44 bp, Homo sapiens
  chr7:20719837-20719881
  hypo
tatgctgttagaaatcgggatagtggtgacccttggtataggtg

SEQ ID NO: 97165 - DNA, 139 bp, Homo sapiens; identical to SEQ ID NO: 41210
  chr7:20720174-20720313
  hypo

SEQ ID NO: 97166 - DNA, 30 bp, Homo sapiens
  chr7:20756837-20756867
  hypo
gtgtgttagtcagctcgggcttccataaca

SEQ ID NO: 97167 - DNA, 16 bp, Homo sapiens
  chr7:20757821-20757837
  hypo
gcgcctggcccaaata

SEQ ID NO: 97168 - DNA, 324 bp, Homo sapiens
  chr7:20816252-20816576
  hyper
cgcttcccagctttccggaccccggagagagggggtgggggtgtgggctcacatcgccggctggcttgagggaggagagtggtggcggctccggaggtggacgtgtcaattatatcctggagctccgggaagccagattgcttctaccggcggctgcaggggcttgcaagcgaagataggcggccctccttccttccccactgtgggggattggggtcagtggagcccgtggatttagccacgaggggacatgactggagccctgtcacgcgcaggtgtgcgtctccgagagctctttcaatataagtgcgggagaagatttat

SEQ ID NO: 97169 - DNA, 83 bp, Homo sapiens; identical to SEQ ID NO: 31085
  chr7:20817170-20817253
  hyper

SEQ ID NO: 97170 - DNA, 420 bp, Homo sapiens
  chr7:20817537-20817957
  hyper
gaggccctaggatggcgcagggcagcgggctggtgcgggaaaactacagagcaagcgagggagggaagcgaaggcaggggaatccctcaccccgtccggcccgagtgtcttttgagagcccacaggcgagcggggcggggggaggctccccgcgcattcccaccgtgggtttgcccaaggtcagaggcccgggactggcggggcgggtctggccggcattgcccgcgctgagcgcgctgcagaacgggagcagggcacagggtggcgctcgctgtccgtgcagcgggcggaggcggccgcggtgcctttgtgtgcggtgggcgcggcgatgggctgctccggcccgcagcccgaggggagcggcgggcccgggccggggccagggctcgcggggagaccccagaccaccacctcactctt

SEQ ID NO: 97171 - DNA, 309 bp, Homo sapiens
  chr7:20817982-20818291
  hyper
cggatcgccagttcggaaccctccccgggagggccccggggtctttctcaatgtactgggcacttcgaggagctgggaagaggaaagcggagggtagcgtttagaaagggagggaaatcctcccaggctcaaaacctctcgcagaattcattcgaaaagagaacgaagggaactttgggcaggccggacctcggctcagcgccctgcgagagaagcagaggtcgctgccagcgtttcctcccgcgcagcaagaaattggtgcctgagaagcaaagttgaggaatgggctttttaaaagcggcagcccca

SEQ ID NO: 97172 - DNA, 145 bp, Homo sapiens
  chr7:20823186-20823331
  hyper
tgctgaaacttgcatcggttccacctcagggaacaaagaaaaagaggcagactgacattgggagatctaaactctacaaactctgggtctcgggctgccaaaagtcacccccaccaagccccgacagcctgagtaggacgtccgg

SEQ ID NO: 97173 - DNA, 497 bp, Homo sapiens; identical to SEQ ID NO: 646
  chr7:20823382-20823879
  hyper

SEQ ID NO: 97174 - DNA, 225 bp, Homo sapiens
  chr7:20823919-20824144
  hyper
cgttgcggtgcccgggctcggggggctgcagcagctctggggagtggcagggcgggctgcccgcggcgctgtgctcgctgtcggtgtcgctgcccttcttgccgccgctgcccgagcccgccgagccgccgccgccgccgccgccactgtgcgtcttcacgtgcttgctgaggtggtcgctgcgcatgaagcgcttgttgcaaactggacaggcgaagcgcttct

SEQ ID NO: 97175 - DNA, 345 bp, Homo sapiens; identical to SEQ ID NO: 31091
  chr7:20824475-20824820
  hyper

SEQ ID NO: 97176 - DNA, 425 bp, Homo sapiens
  chr7:20824835-20825260
  hyper
cgccatgcccacccgcgggtagatgccctgcagcccgtccacagaggtgtgcaccttggagatgaacaccggctggtgggagccgtcctgcgagtgcgcggaggagccgccgccgccgcccccgccgccgccgccgctgcccccggaaactccgggggcctggaaaacagagtagtcgttggcgaagggcgagctggaggcggcggctgcggcggcggcggcggcggctgcggcgctgctggaggtgagggagaaggcgctggagccaggcgagccgccgcagctgaacgagtcggacaccagggccgcggcagccgcggctgctgccgcggccgccgcagccgccgaggacgagccgccgttcctggaggccccggacacgccgaagcttgagagactggaacccactacgttgcagctggcgg

SEQ ID NO: 97177 - DNA, 339 bp, Homo sapiens
  chr7:20826499-20826838
  hyper
tacaatgatcagttccgcccattccaccacaattgtagctccctctccggctttgaagtgccgcggaggcgcggccagccaatctgcggcctcgccgggccgcgcggcgcgcgcgccgtgaggtcatcggcgccgccgcctgccgccgtggtggaagggggagtgggagcggagggggcgggggcggctgcgtgtgttacaaagcgcaaagcgcgcgctcgcgtgtatgagtgtgtgtgtaacaatgtaactgtgtgcgagtgtgaccaggcgtaggagaggacagtgcggagactggagggaggggggatgggggtgtgacaccgtaacagtgacagt

SEQ ID NO: 97178 - DNA, 155 bp, Homo sapiens
  chr7:20827308-20827463
  hyper
taacttggtaaacagcgtcactacatttttgaagaagatctttaaacccaccttttctttcccggctctccaacgaaatagtagaaaggttgagaggctaagggttatttttagggatgcgttgggacgtggatgcgcgcctgcgcgcccatgag

SEQ ID NO: 97179 - DNA, 34 bp, Homo sapiens
  chr7:20827523-20827557
  hyper
attctgctttagaagtgcacgtctcactctaggg

SEQ ID NO: 97180 - DNA, 111 bp, Homo sapiens
  chr7:20828484-20828595
  hyper
tttctccctgcaagccgctctgaatgattttagcgtgttgagaaggcgtgacaggccagcccagaaggaggaaggggtgggggaaggagggtactccgtttaacaaataaa

SEQ ID NO: 97181 - DNA, 779 bp, Homo sapiens
  chr7:20830608-20831387
  hyper
tctcggtttctagagcgttggcagggacatgcagctctggaagctgaccggcgggtgcccgcgggagacagagcgaacgcagtgctggcactgcgtccctggcctgcgcctctcccagaatgggaagacgacccccaaccccttgactagtgtgcggggtcctcgcacgcggacgtgttggctactaaataaagcgtgaagagggatcgctgggtagctgagcgccgccggcggccgccgggagcagcgagctgagccaggttgggtgggggtgtttcctcgtcgagagctctctggtcaaagtttccttcccgctggaaaacaaaaacaaaaacaaaaaacaaaccaaaaccaaaacaaacaaaaaaaaaaaacctggctaggcgtggacctgtgaattcctgaggggtgccccttagcagtccatttctctttcgtgtggttttactaagaagttacctaacatttcctgggaagagaggtaatacaagcccctcgctggtggcagattgttgagccgtaggtgggaagagatcagtcggccagagcccagagagggctgtattttcctgattggaaaatgggaacttccacgctgaacaatagcctctattagtgaggttatttggttccaaactgtccggccacatttatagccgagtccttacttttctggtagtgcttaattggatgcatttgttgaccacaacgaagcaatagtgactcttgatctactggcacaggagcttcttggtgatgaaaagcgttgccttgatgac

SEQ ID NO: 97182 - DNA, 454 bp, Homo sapiens
  chr7:20833089-20833543
  hyper
tgctttagaatcattcgactctgagtccaggaaaagcagggggtgtggtggcagtgggggtggctagggaggggtgtatatgagtgggggagccgatttcatctcggatcgcaggaagagaacttgctcaaaagaatttttccccagcaaaagtggtataatttacagcgcaacttaataatccgaggggcaatgcaaaagccctttgcgttgtaaaccgcttctaattacctgccagagcaattagctgactatcacgaagaaattagatcgctcaatgtagcataaataatgcgaataattttgtaagaagaatggaaagcgagacctggtgtttctttataaggaaataacacctcgtactgtaagagccctccatgaacacatattaatgtctaggcatgcatggcaatgagtccgagcaggagccctctggctgcggttcagcactttt

SEQ ID NO: 97183 - DNA, 84 bp, Homo sapiens
  chr7:20834292-20834376
  hyper
caactccaccgctttcctgtgccgcccaagggaaatgggtctctcttgagcccgtctttctctagtaaacgaggtgggtcatac

SEQ ID NO: 97184 - DNA, 54 bp, Homo sapiens
  chr7:20834576-20834630
  hyper
cgaaagctttggccccgctcatttttgaaacatttttcacgactgagttcaggg

SEQ ID NO: 97185 - DNA, 30 bp, Homo sapiens; identical to SEQ ID NO: 8910
  chr7:20836099-20836129
  hyper

SEQ ID NO: 97186 - DNA, 218 bp, Homo sapiens
  chr7:20836779-20836997
  hyper
aaggaaattacaagccgatgctgattgacttttgaaaggcctggcacgtcccagtctatataataactcagttggaggaagaacctcgaggaccgagtgtctccagatcacttaatgcatcggcatccaccacgctcggctcatgggcagggcccccgaggctgccaccaacccacggagccttgaggagctgcgcttccccgcgatggtccaacgaa

SEQ ID NO: 97187 - DNA, 50 bp, Homo sapiens; identical to SEQ ID NO: 8912
  chr7:20838460-20838510
  hyper

SEQ ID NO: 97188 - DNA, 30 bp, Homo sapiens
  chr7:208441-208471
  hypo
gtaagcacacctggccgtcccttctaggag

SEQ ID NO: 97189 - DNA, 30 bp, Homo sapiens
  chr7:20930367-20930397
  hypo
tccttaatcttgcatcggtgatttattcaa

SEQ ID NO: 97190 - DNA, 30 bp, Homo sapiens
  chr7:21006501-21006531
  hypo
aaactcttagaaactcggatgttctaatca

SEQ ID NO: 97191 - DNA, 114 bp, Homo sapiens
  chr7:2110154-2110268
  hypo
gaagagaggccacaccggggagggtgcgagtccgcggagggagggcccatccctactcagacagcccaggcaggcgcagagcggaacggcgctggaacacgggagctgcacacg

SEQ ID NO: 97192 - DNA, 30 bp, Homo sapiens
  chr7:2120265-2120295
  hypo
agcgctgggctctgacgccaagtccatccc

SEQ ID NO: 97193 - DNA, 280 bp, Homo sapiens
  chr7:21370232-21370512
  hypo
gcactgctcccccaccggcggacaactcgcccggcccatggcggaggcccccagggcggcaggcaaggtgcaggtggcccggcagccctagccaaccccgcacaaacgaacccaatgttcccatggccagccctgcgagttctggctacgcctttggccaggtgctcatgggaccccgggacacagccgggagtgaggctgaggctgtggtggaggctccaggcctgagagggggtcctgcctggccgtgcaagtgtggaggtagcgcagtagctccctc

SEQ ID NO: 97194 - DNA, 30 bp, Homo sapiens
  chr7:21400528-21400558
  hypo
gtgcacagtggctcacgcctgcaatcctag

SEQ ID NO: 97195 - DNA, 121 bp, Homo sapiens
  chr7:21582520-21582641
  hyper
tcgggacctagagcccgagggcctctcccctcggccttggccttggcgtatactgggcggtggcgcggtgcgctcactccgcccccagcgggctggggcggggacaccgtcccccgggaaa

SEQ ID NO: 97196 - DNA, 487 bp, Homo sapiens
  chr7:21582791-21583278
  hyper
cgctcacttcggggggcccagagtctcgggtgaggagccagccggcctcgcgttccctcggacggttgcccaatggcagcccaggtggcagcccgggaggcgcgagacttcagagaagccccgacccttcgcctaacctcgggggccggcctggaggcagtgggcgctgtggagctcgaggaggaggaggagaacgaggaggaggcggcggccaggagagcgcggagtttcgcccaagacgcgcgggtgcgcttcctcggcggccgcctggcgatgatgctggggttcacggaggagaaatggagccagtatttggaaagcgaggacaaccggcaggttcttggggagtttctggaaagcaccagcccggcttgccttgtgtttagcttcgccgcctcggggcgccttgcggcttcccaggaggtaagaggcgacgggcaaggggacctgcccatccaacaaaactacccaggggagacagcccagt

SEQ ID NO: 97197 - DNA, 149 bp, Homo sapiens
  chr7:21583303-21583452
  hyper
cgctcactcgggcactttaacaaacttggcttgaagtccccatcctgaggcccgcaggactcctccccacgtgcacccactctgcagttcagcagctgcaggttagtttcctaagtcagcagtttgtatctgaccgagaatcccgcgtt

SEQ ID NO: 97198 - DNA, 103 bp, Homo sapiens
  chr7:2163294-2163397
  hypo
tgcgataccaggaagcgagtcggaggcaattaagcctgtttcagagtgcacttcgcaggcggcgctgaatcgatagatcctccggcggcgtggtgctgcaggt

SEQ ID NO: 97199 - DNA, 57 bp, Homo sapiens
  chr7:21690874-21690931
  hypo
taggtagggcaaatacgaacttagatataggcagaaagcaagcggtatggtttgaga

SEQ ID NO: 97200 - DNA, 30 bp, Homo sapiens
  chr7:2197210-2197240
  hypo
agggcagacacctcccgagaagccctggga

SEQ ID NO: 97201 - DNA, 317 bp, Homo sapiens
  chr7:2206439-2206756
  hypo
catcatcatgccaggcgaacccagtgacaagggcctcaaacagaagaggcccagggaagggcagcccatgggcctgagaagcaccactacacacctgggcggcgcactccgctcacaaagcactcttccaggaagggccccgggctgctggagactgaaccggaatctgcctaactggtggaatccccttttacaaagaagtgcctgtagctcacggggctagaacccaggaaggccccaggtgagctcgaaaccctaaagcaaccccgctgtggacagtggcatcgcagataggagagtgccggtgaaacagtaag

SEQ ID NO: 97202 - DNA, 120 bp, Homo sapiens
  chr7:2208724-2208844
  hypo
ttcacaggaggcaaacgatccgtgacaggacaagcgtgggatggcctcctgtgtggcagaaaggacattcgggacctatgacgcaaacgcaggcggctacacattcgcctgcaggactgc

SEQ ID NO: 97203 - DNA, 165 bp, Homo sapiens
  chr7:2232891-2233056
  hypo
acttgcccaagcaaccggggtgagacaagggccacccagctccgacagccaccacgtcctggagagaaagcgtccccgcccagaggacggtccttgtcctagaacagcaaggccctccaactcttggtcctcaaagcccttccccgcctccgcacccagcaccac

SEQ ID NO: 97204 - DNA, 178 bp, Homo sapiens
  chr7:2233292-2233470
  hypo
taccaaggggtaacacggccgcgggtaactccagattcctccggaaaacctcactgtgcactgccaaggctccagccagagcaggtgctgagccgcgatccgggagacgccagtctcaccctaggctctcttccacaaccaccctcaggcaaggccacaccgtcgcccaactgtccca

SEQ ID NO: 97205 - DNA, 154 bp, Homo sapiens; identical to SEQ ID NO: 41122
  chr7:2238153-2238307
  hypo

SEQ ID NO: 97206 - DNA, 95 bp, Homo sapiens
  chr7:22539833-22539928
  hyper
gcctgctgcaggccccgcctccttgtcagttgcgcgtccagcgccacctgctggcgccccgcgtccgcagggttcgggaacgtccttggaggcta

SEQ ID NO: 97207 - DNA, 28 bp, Homo sapiens
  chr7:22540572-22540600
  hypo
gcgtgagccaccgcgcccagccacctta

SEQ ID NO: 97208 - DNA, 657 bp, Homo sapiens
  chr7:22589295-22589952
  hyper
agcctcaaactatctcgacggtcaggcccctttcccaggtggtgccgtggtggccgtggggtgaggaaaatatgtacggctgtagcccgtccatttctcatcctgggatagcgaggggtttccggaggaggcgtcagcggtgggaagtgggagaaagcgagcaaaaggggcgggggcgaaggagcggactcgcctgctgccgcgggggcgggaatccgcaagccagcctgggagaagggacagaacagcggctgatccttccctgggctagggaaggaaaataaactgtgctggcctcggagtgggggatggagaggggcgatggcgctgcatctgcaggacgttgcaagggctaggagcgggcaagactagtgtcggcaggaaggtagtggtggtgatggcgggggtgtgtggcaaacagagcccgagcgaaagcctgagaaggttctggttgccccccagcctactttagtccctaaccctccagcggggcgaggagggagcgcatcggagaggtacctgtgcgatgggcagcggtgcttggcacctgagcgtaggtacgatactcagcaaggcacctgggtgggacataggagaaggaaatctccaccccaaccccccaaaacaccgcccagaagtgggcggtgaggcccagtg

SEQ ID NO: 97209 - DNA, 230 bp, Homo sapiens
  chr7:2265011-2265241
  hypo
gtctgggccgaccctcgccccgcctgaacccacctcgtagttcctggcactggtgctggctgctctctccagctccactcgagccctcttgtgactcagctccatctgcattttctcccgctccacctggatgaggtgggacttcgaacggatctgctctgctctttcctccagctgagcaggtcgcacccaaagaaaaacagaatcctcagtgacggcatcaaaccagg

SEQ ID NO: 97210 - DNA, 85 bp, Homo sapiens; identical to SEQ ID NO: 41123
  chr7:2265530-2265615
  hypo

SEQ ID NO: 97211 - DNA, 30 bp, Homo sapiens
  chr7:22893577-22893607
  hyper
tcctctgaccttcaacgaggtaaagagaca

SEQ ID NO: 97212 - DNA, 173 bp, Homo sapiens; identical to SEQ ID NO: 41212
  chr7:22981026-22981199
  hypo

SEQ ID NO: 97213 - DNA, 16 bp, Homo sapiens
  chr7:2300787-2300803
  hypo
ctgggcacagaggctc

SEQ ID NO: 97214 - DNA, 30 bp, Homo sapiens
  chr7:23009058-23009088
  hypo
acaggcatgagccaacgtctggccatcctg

SEQ ID NO: 97215 - DNA, 53 bp, Homo sapiens
  chr7:23053027-23053080
  hyper
ttgtggccaccagaccggacggacagtggcggcctcgccgaagtagagggcgc

SEQ ID NO: 97216 - DNA, 16 bp, Homo sapiens
  chr7:23129478-23129494
  hypo
ccgtctcaaaaaaaaa

SEQ ID NO: 97217 - DNA, 30 bp, Homo sapiens; identical to SEQ ID NO: 41213
  chr7:23220685-23220715
  hypo

SEQ ID NO: 97218 - DNA, 78 bp, Homo sapiens
  chr7:23223070-23223148
  hypo
ctaaggtgatactcccgcttccgtctttcaaagtgctgggattacaggcgtgagcgaccgcggcgggcctcatctaac

SEQ ID NO: 97219 - DNA, 145 bp, Homo sapiens
  chr7:23287206-23287351
  hyper
agcagtgtgcagattcgcgagaggaagagagctgagccgctgtaaccctgggcctgggattgcggggacgggacgggtgggaagcggccaaaggcgcagcggcttctggtcagagccgcagaggcctgagacgtgggccgcgccc

SEQ ID NO: 97220 - DNA, 122 bp, Homo sapiens
  chr7:23287532-23287654
  hyper
ggcactgtgatggtcccgcttcccacacgaggccacgggccacagagtgggcaaggaactcgccccaagccacacagcgggtaagttgaggaggcagccttccatcccgacctctgtccttc

SEQ ID NO: 97221 - DNA, 30 bp, Homo sapiens
  chr7:23340392-23340422
  hypo
ctctgggtgcatacacgtctatctgcttgg

SEQ ID NO: 97222 - DNA, 79 bp, Homo sapiens
  chr7:2349353-2349432
  hypo
gagactccatctcaaaaaaaaaaaagtataaactttaagtgacagcgcaatgaattctgaccaacgtattcacacagag

SEQ ID NO: 97223 - DNA, 1745 bp, Homo sapiens
  chr7:23508102-23509847
  hyper
ttgcctttttgggaccgagtgctcaacttctatgggtttcccgtgcagttctattttacctgcggacacacaagaagtgagacggtcggccgagttcagcggctctccctgcccgaagacccgcacagcccaagcggcgacacaaatggcctcctgaggccctcgaagggcccccgaggcccggacgcggctccaggcggagggagaagccgaccccctcgagcggcgtgggcatttaactcgcagatggttggggagcagggtccgctggcgggcccactacttgggtatcagtccagtctccaagcctcccccacccacccctgggggccaccaacaccacgaggcccgcaagagggacgcggcccaccctctcaccgccctggacacgctccacagggcagactcggggcagggggctcccctggctttcttcaggagggggcgccctggccctgccctctgcttcagcccagacccgccgggaacactcagcggtgggcttgaggaagacagggagtggcgagaaagggtcggggacggcaggggagaccacgaacgggagaactggcagaggcgcagctcggcacaggctgaaccaggcgcgaaggacggcgaggcgcccgcaccacgtctgaattgattaaaagggaagccgaaaggcacggggctcccatggggaccccaacgcagccttccccctgggcgtcctgctccgcccggcaccgtccctcgccctggcggagccatacccggaggccgcagccccgcgccagggcccggagagcggcgggcggccggtgcgtggcggcgactcccttccaggcgaccagccgcccccgcccacctgcccctatcgctcgtcggaccaggggaggtggaacggggaaaccgggcacacactctctcctcccacagggtggggaggaagcgcggggccgcctgtgcgaggcaccagcctcgcggtctcactcggcagcacggtcgaggccactttccgttctccacggccgggggtttcggggcgcagcacagacagcgccgtaaataacgaccgaggaaagcaggaaggaacgaggcacaggcgggcattctagctcggcccccgaggcccagcgtgccggggcctggagcacgcgcctgggcccgggcggggcgccgggggagcgcgcctcccccagccccgcgccccccttagccagcgccggggctttcttgacagcgcgttcgccctcacccagcaaaccccggccggggaagcagagccgcgggccggagtgggagccggagctgaggagagccccggcccccacgcgcgtgggtgtgggcgctcaggcctcacccccgctcccccagcgcgccgggcctggggcccgcggagccacccggtgggcctgggcgggcggtgcagggctggggcgagagcccgggtggggccaggcccgggcccacctgaaagcgcctcgatggccttgagggcccagctctcgtccgggcagtccacgaacgcgtagccagtcttcaccaggaagggtcccgacaccgggatcttggcgtccttgaagatactttctaggtccgagggggcggcgttctcgctgaggtttccgatatacagtttgttcattgtgaagagtggttgtttaaaaaaaaataacgagaaaaaacgaaaaattaaaaccacccacggtgatggatggatccagctggttttgttcccctcgtcttctcgcctttaaaataca

SEQ ID NO: 97224 - DNA, 183 bp, Homo sapiens
  chr7:23510841-23511024
  hyper
ggggcggcccggccccggagtggtgggggatgggatcccgcagcgtcctgggcgggtgtctgggcgacacctcctccgcctccgcctgcgctcgcggtggctctcggcttcgcgtttgccattggttgcgcgattcagaaaaggctccaggataaatgaggccgggggcgggcttggccactg

SEQ ID NO: 97225 - DNA, 951 bp, Homo sapiens
  chr7:23513474-23514425
  hyper
ataaaaatggtgccccgggagagaagatggggttgtttcctttttcctctggctctgccccgagaaagagggcgggatcctcacggctcacagtggggagggtctttcgtcggccgccggctcgcctcggagggcctggaccactggaccgcccttccccggggccctgccgcgggaccgcgggcttctggctcctcctggggctgcgtccgtatgcgcggagcgtgtggccgggccgtcgccgcgccaccccacctgagtccgccggccagcgcggggacgcaccgggcagcgtgtgtttggcgaccctcccgcacctctggtctcagttgcgtgtgtgcacgaggggttccatagggcccagggatgcttggtacccacgggggagaatccctcgccgaaccctgcgggtctgcggggcgggccgcgagactggcgcgcaaaagcggctccaaggcggggctcccgcgctccccggggccggcttgccgagtccaagttgagcaaccggcgtcgagagagacaccgcccctgctgcgggcgggggcctctcctcgcttccgattggctgacggggggaacctatcgccgtcggccgcctccgccagagcggtttgctggttttcattcattggccccggagccgcccctggatttccatcttttgtggcgcgaaaataaccctttgctccctcgttggttttgttgaggttgaggggtgggactgtgttcccctctgctcgctctcgtttttcctgccctttaacagctcgcccccagccccaacccccaaggaagaaagagggaggtaacgctgaggaagggtggaaagcagttctgcgtccgtgggtggagcccgccccttggctgaccgcatggtgcccgcacggtcccttcccttcccccagcgtccagcgcccggaggttctggatttgcgccatgctcagcag

SEQ ID NO: 97226 - DNA, 136 bp, Homo sapiens
  chr7:23514666-23514802
  hyper
actatgctgagaccacgttttcgttgaagctgccctaagaccaatgaagctgagaccgaccttcaaggattaacgatttctgtagctgaaatgttctaatttcactgacgtttggtggagacggtgagaaaaaata

SEQ ID NO: 97227 - DNA, 33 bp, Homo sapiens
  chr7:23525018-23525051
  hypo
aatcttttatgaaaacgtattgttggccgggca

SEQ ID NO: 97228 - DNA, 30 bp, Homo sapiens
  chr7:23553199-23553229
  hypo
gcactccagcctaggcgacaagagtgttag

SEQ ID NO: 97229 - DNA, 30 bp, Homo sapiens; identical to SEQ ID NO: 41215
  chr7:23568103-23568133
  hypo

SEQ ID NO: 97230 - DNA, 138 bp, Homo sapiens
  chr7:23569163-23569301
  hypo
gccactgcgcccggccagaaacgattttaaaaagggcatctccagacaagcttctcgcattgttctaattctttaaccaattacaaataaagacaattatctcatcctataaaaactaaaagacgaaaaataaaaaga

SEQ ID NO: 97231 - DNA, 34 bp, Homo sapiens
  chr7:23578823-23578857
  hypo
tagatttttaaagctgaggcggagagtagtaaag

SEQ ID NO: 97232 - DNA, 125 bp, Homo sapiens
  chr7:23719533-23719658
  hyper
atttacaagaagactcgccggtccagggaagggagaggggaataggtgcaaggtttgtggagggcggcaaactgcactccatgtggcgcgaggctgcgcttgcggagatccgggttctggtgcct

SEQ ID NO: 97233 - DNA, 123 bp, Homo sapiens
  chr7:23749706-23749829
  hypo
gtcggcagcagccagcgtcaggcggctcccgcacgcttcttcctaggcggcaggccgtggctgccacgtgactcccgctaacaccggatgatggcgcagcgctgtgcacgcaggcgcagtgtg

SEQ ID NO: 97234 - DNA, 120 bp, Homo sapiens; identical to SEQ ID NO: 41219
  chr7:24099277-24099397
  hypo

SEQ ID NO: 97235 - DNA, 83 bp, Homo sapiens; identical to SEQ ID NO: 41126
  chr7:2420313-2420396
  hypo

SEQ ID NO: 97236 - DNA, 30 bp, Homo sapiens
  chr7:24323498-24323528
  hyper
aaggaaagcagggatcgggcactgcccgag

SEQ ID NO: 97237 - DNA, 60 bp, Homo sapiens
  chr7:24324091-24324151
  hyper
ccctctgattgtccacggcccttctcccgggcccttcccgctgggcggttcttctgagtt

SEQ ID NO: 97238 - DNA, 161 bp, Homo sapiens
  chr7:2436226-2436387
  hypo
caaactccaactgaccgtaaccctatccgtcctgcgggagaaggtcctttctgctctgggcttctgcagggatgtaacctcatccctaaaataggagtgatggctgggagtgtggctcacacctgtaatcccatgggaggctgaggcgggaggctttcagt

SEQ ID NO: 97239 - DNA, 21 bp, Homo sapiens
  chr7:24580785-24580806
  hypo
ccttcgcgcccagccacaatc

SEQ ID NO: 97240 - DNA, 61 bp, Homo sapiens
  chr7:24749659-24749720
  hypo
tccctaagatccaaccgaggtgagtcctgccgagtggactgggcctcggcggcatcacctc

SEQ ID NO: 97241 - DNA, 224 bp, Homo sapiens; identical to SEQ ID NO: 41221
  chr7:24761204-24761428
  hypo

SEQ ID NO: 97242 - DNA, 180 bp, Homo sapiens
  chr7:24771552-24771732
  hypo
ttaccaccctgaattcggcctaaaaatacctccacctgccaataccaggagaccagcataaagaggtactgccagcccctcccatcccagaccttgggatgccccggtttattgtgaccagttacacctgccctggaaggagaaacacagcaaaaagagaatcagcgacaggaccagaat

SEQ ID NO: 97243 - DNA, 30 bp, Homo sapiens
  chr7:2477693-2477723
  hypo
aagcaaagtgggtggcgtgtgcattttgtg

SEQ ID NO: 97244 - DNA, 705 bp, Homo sapiens
  chr7:24796332-24797037
  hyper
ccctcggggtgcagacggcaagcggctctggaaagggtcagaggtcctcaaatggagaccaaaggaagccacgcgggcagctcttgagagccattccagcgcatgccaggcacaccgagtggggcttggcctcctccccaagctaggagctctctagataccggagcaaagtggagggggacttttttccgtccagagagactgaactccgtatctgttccgcggtccgcctccctgcacacacgcccccgagccgggagagcctccgcagcacccagagaagagaccggaacacaaaggatgaacgaatggggagggggggtttggggggttgggagaacgaaaataccagctgcgcttccaacatccaaggaaggaagtggcagcggggacggggagaggatgggaaggggatgctgactgcgagttggggcgggacgcggtgatgggaggggaccgggccgggaatgcgggaggcgaggggagcgacgggacctgccgttccggcggccgggcagccaatcgattcgtctcccctaggaaggagcgaggggagggtggcccagagagaaagcgccgcgcggcctcggctgcccccggcccgggacacccaaacagaccaaagaggatccggagtggagcccggagcggatcccgcagcccgcgcccgccgcgcacttacccgcgcgcccgctgctgggtccc

SEQ ID NO: 97245 - DNA, 543 bp, Homo sapiens; identical to SEQ ID NO: 31118
  chr7:24797067-24797610
  hyper

SEQ ID NO: 97246 - DNA, 30 bp, Homo sapiens; identical to SEQ ID NO: 41222
  chr7:24799881-24799911
  hypo

SEQ ID NO: 97247 - DNA, 157 bp, Homo sapiens
  chr7:2480354-2480511
  hypo
caagaagaatgccgccgctcaggtttatctggtagaataagctgtttgaacaaagatctggaggttgcacaatcctgtgtcattctggatttatcttggggtcgggagtcaacgatacttcttgtgctgtcgtttctccggccgtgtgaagttacca

SEQ ID NO: 97248 - DNA, 30 bp, Homo sapiens
  chr7:2480719-2480749
  hypo
ctgggtcagcaggggcggctgggcttgact

SEQ ID NO: 97249 - DNA, 30 bp, Homo sapiens; identical to SEQ ID NO: 41223
  chr7:24845483-24845513
  hypo

SEQ ID NO: 97250 - DNA, 37 bp, Homo sapiens
  chr7:2499681-2499718
  hypo
gggttggccgtgcctcggacaccggcctctgcagctt

SEQ ID NO: 97251 - DNA, 124 bp, Homo sapiens
  chr7:25100258-25100382
  hypo
gcccccaggaggctgcgctgtgtggtgtggcagggagccaccgaccatgaaggctcaggccaccaggagaatggtgagactgtcacctcagagagaacgagttgtcagtcgctcattaggtcaa

SEQ ID NO: 97252 - DNA, 42 bp, Homo sapiens
  chr7:25132402-25132444
  hypo
ttttctatcttctcccgggatttagaaattacttccggccgg

SEQ ID NO: 97253 - DNA, 31 bp, Homo sapiens
  chr7:25133418-25133449
  hypo
tgcaaatctttaggccgggcgcggtggctca

SEQ ID NO: 97254 - DNA, 47 bp, Homo sapiens
  chr7:2515514-2515561
  hypo
cagcccaaggcccagcgaggggagggcggtgccgctgacctgtcctc

SEQ ID NO: 97255 - DNA, 120 bp, Homo sapiens
  chr7:25165828-25165948
  hypo
tacaataaattattgttgagtgtagtcaccctgttgtattactagaccttattcattcttcttcagtggcgccatttaatgtctcagccccccaagtagctgggactacgggagcaaacc

SEQ ID NO: 97256 - DNA, 197 bp, Homo sapiens
  chr7:25335888-25336085
  hypo
cacttatgtatatggcgggtgctcagctctgtcctgcttgagatgggcaggagttttctagaaagagcctctcaaggggaaaggagaaattgggaaaaggtcatgagttggttctatgagcagttcaataagcagggatacctagttttgggaagggcttgcatttctgctgtgcgtgtgtccgtgcatggccatat

SEQ ID NO: 97257 - DNA, 164 bp, Homo sapiens
  chr7:2544463-2544627
  hypo
gcctcctgggggctgcgggagaggcagcagagccagcccgctcaacagcagggccacaattgcctgtggcccctggggagtgacaccccccccccccccccccggctccacagaggcgaggatgggaagaggcggaggaaccggctgtgcgggacacctgagcc

SEQ ID NO: 97258 - DNA, 190 bp, Homo sapiens; identical to SEQ ID NO: 41224
  chr7:25495487-25495677
  hypo

SEQ ID NO: 97259 - DNA, 33 bp, Homo sapiens
  chr7:2551467-2551500
  hyper
ctcctcccagccccccgccgtgggctcccccgg

SEQ ID NO: 97260 - DNA, 84 bp, Homo sapiens; identical to SEQ ID NO: 41225
  chr7:25530809-25530893
  hypo

SEQ ID NO: 97261 - DNA, 30 bp, Homo sapiens
  chr7:25569127-25569157
  hypo
gggaccccaagcatgcgtggcacaggatgg

SEQ ID NO: 97262 - DNA, 10 bp, Homo sapiens
  chr7:2558415-2558425
  hyper
ttccggagga

SEQ ID NO: 97263 - DNA, 20 bp, Homo sapiens
  chr7:25603450-25603470
  hypo
gatttgggccaggtgcggtg

SEQ ID NO: 97264 - DNA, 89 bp, Homo sapiens
  chr7:2560970-2561059
  hyper
gggggcggcgggggccgtgggttttgtttggcggccgggccgttaggattcccagcgccgggcggctctcacgccggccccttgggcaa

SEQ ID NO: 97265 - DNA, 438 bp, Homo sapiens
  chr7:2564642-2565080
  hypo
gggcgggggcggggccgccctggaaggggctgggctgcgggagggtccacaggcccaagccccgagctagggtgggggaggctacggccgccgggcccagcttgaactagggggcttttctcgagcccctgggccctgtggcgtcccccaggccaggcccctctctgggagccggctcagacctactcacagccgctcccctgtccacaggcaacgtggtcatcacaaactgctcggccgcccacagccgccaggcgctgtcctgcaagatggccgtggagtatgaccgcttcatcgagtccggcaggaagtgagtgtggccccgggggacccccatctccctgcccgagcctggcagcgcccgccccggcatgccctcccccgatggccctgccttgtcctcaggtggttctgccacgtggacgatgacaactacgt

SEQ ID NO: 97266 - DNA, 617 bp, Homo sapiens
  chr7:2566041-2566658
  hypo
aggtgcaccatcctccgggccccgccaggactccgagagcacaggaagggacgtgtggctgccgagaggggcgcagtggggtggggcactgttctaaacagggaggccaggcagcactccactgtcagccagggggggtcactcctgccatgagctcaaagctgtttatggcgggttgttttcctgccgtctcttctcttcactgtgatgcgcctactgtgcgtattttgtccacgctggcaatgcagccagccccagctggtccccagtttgggaccttattcctggggtgtgcagggcaggtgtccttccaggtccaagggaggccagggcagggccgttgcctcactcagggctgtgtggccagcctggggcggggcccagggatgtcgggcccctcccggcatcactccgcccgctccccacaggtgacgctgagctacggtatgtttgaaaacaagcggaacgccgtccacgtgaaggggcccttctcggtggaggccgacccatccaggtaaggaaaccccggcccagatgggcttgcgtagggtggcctaggggcgtcagggggcctcgtggagctgcagcagggtctctctaagcggcatgactctaca

SEQ ID NO: 97267 - DNA, 44 bp, Homo sapiens
  chr7:2566895-2566939
  hypo
ccagggaccctgttgcgctgccctggcctcggcattcgaggctc

SEQ ID NO: 97268 - DNA, 186 bp, Homo sapiens; identical to SEQ ID NO: 41226
  chr7:25802276-25802462
  hypo

SEQ ID NO: 97269 - DNA, 297 bp, Homo sapiens; identical to SEQ ID NO: 31119
  chr7:25891946-25892243
  hyper

SEQ ID NO: 97270 - DNA, 384 bp, Homo sapiens
  chr7:25896230-25896614
  hyper
ctgcagatgaaggtacggctgggatgtgaagctaatttagtgtgtgctttacaaggaatgcacaaatcaacacagcgctcaaattaaatctcttcttgaggggcttaagtatcttcttcaggaagagtaaagcatgtcttctagttctacttccttcccggttagccagctgctggagagccccctcagtaaattccttccagatcgacctcagtgtgggtgagagcgcagtctgtgaccaccagcgcttctgactcagcggaaaacgccggcaaacaggactacacctcaccgcggcggcaaaagcggcctcagctccagcactcacagccaccactttcaccgtcgccccgccaccaccaccttcgctgcctcaaccctgag

SEQ ID NO: 97271 - DNA, 264 bp, Homo sapiens
  chr7:25896674-25896938
  hyper
gcgcgcacaaacacctctccctgctgtcaatcatacatgcgcgccatagcgcgcatgcgcactggtggactccagcccccaccgatcctacgccctgtctctgcgtctgggaccagacgcaccaataagagagcggattcgggggcgggccacaaggaagtagccaatgagagcgcggttggaagccagggctagagaggagtaaatccttctgtcgtccccgttctgccgcccccgcgatgatttatgcgtcctttttattat

SEQ ID NO: 97272 - DNA, 32 bp, Homo sapiens
  chr7:25902106-25902138
  hyper
atgtaaatgagaaaccgcgagcatctcccccc

SEQ ID NO: 97273 - DNA, 304 bp, Homo sapiens; identical to SEQ ID NO: 31122
  chr7:25902345-25902649
  hyper

SEQ ID NO: 97274 - DNA, 218 bp, Homo sapiens
  chr7:25990010-25990228
  hyper
ggcgggggcgctgcacgaggacgaatattcggagctgaaagagttaaacggtggggaacaaatacaggcccgggaaaagcccctaagatgggacgacccaagaaagacccgctttgcggggcctcccctgagacccccttccccagccattcccagtactctattcccggtcttccagccgcccgcgcccagccccgggaactcgggtcgaagtcgtc

SEQ ID NO: 97275 - DNA, 30 bp, Homo sapiens
  chr7:2612457-2612487
  hypo
atgagccaccgtgcccggcctctctcttta

SEQ ID NO: 97276 - DNA, 63 bp, Homo sapiens
  chr7:26192685-26192748
  hyper
gaggtaggtgcagagcgggaagcgagcgaagtgcggcgtctacgccgccgggagcccccgagg

SEQ ID NO: 97277 - DNA, 40 bp, Homo sapiens
  chr7:26217186-26217226
  hypo
aggctcagcaatggagggagaccgtcgaaaggagggaagg

SEQ ID NO: 97278 - DNA, 17 bp, Homo sapiens
  chr7:26222458-26222475
  hypo
gctggagtgtggcagcg

SEQ ID NO: 97279 - DNA, 120 bp, Homo sapiens
  chr7:26283695-26283815
  hypo
agctcctcagcctccagtcgcctctctgtgcatgcacctcggtcactggtctcgactaatggtttctccgggagcccagttaacagggaaaaattcgcatggcctctcggtttcttcggt

SEQ ID NO: 97280 - DNA, 781 bp, Homo sapiens
  chr7:26415774-26416555
  hyper
gccgcctgttggttgcggcgcctccgcggcccgcgcgcatcccccgcgctgcgtcccgcacacgcgcgctcccgccgcgtcccgcccgggccgctccgctggcggcggcgactgggctgcaggtagcgagccagccggcctcggtccggtaacccatggcaaccgccctggtaacccatggcaactgcgcggcggaaagaaaaaaaagaaccgtggtggggcggggggcggcgggcggtgaatgggaacaacgaccgcaaagagacagcgatttaccgcgcgggcctgcggctcccggccgcacctgctgcagacggcccgcgaggccccttcccgcgctacggtgacgattctggctgctggggaaaagagcaataagcagaaagccctcgtgcagaggggatccgggcggtgcacttggtgtgggaggctgccttaaacgccgatgaccctcccggcctccgcgtgtcccggcttccagggccccgccaggctggagagcgcgcgtggagagggccttgccgcctgggggttggttgaggggcggccgcgccggggccggggctggactccaggctttgttctgcagacgctcgcgcccggccggaggaggggctacaccgtgctgccccggccccatggggcccggcccccgagggtccccgcgagcggacgcggtggggccgggcaaactctacgtgccctaaattttgtcatctgcacacgcatcgcacacattagttaacccctttcccttctaggcccccgagaacctaacctg

SEQ ID NO: 97281 - DNA, 37 bp, Homo sapiens
  chr7:26437864-26437901
  hyper
agggcgcagcacacccgccgcccgcttgcaggcgaga

SEQ ID NO: 97282 - DNA, 30 bp, Homo sapiens
  chr7:26439820-26439850
  hypo
gcgtggggaagtccccgagtgtgcattgat

SEQ ID NO: 97283 - DNA, 23 bp, Homo sapiens
  chr7:26513167-26513190
  hypo
agttttgatattggtcgggggca

SEQ ID NO: 97284 - DNA, 55 bp, Homo sapiens
  chr7:2652597-2652652
  hypo
ctaccacttcagggtcgacgttggtggcaggtgttgttcacggtgtactgattgt

SEQ ID NO: 97285 - DNA, 81 bp, Homo sapiens
  chr7:26555405-26555486
  hypo
gctgtctcaaggcaccgagggtgctggtcaaaggactcaagatttgtggttcccacagcttcagggcgtccccaggaaatc

SEQ ID NO: 97286 - DNA, 35 bp, Homo sapiens
  chr7:2658370-2658405
  hypo
gctgtttgcaatccacgtgacggctgagaaatctg

SEQ ID NO: 97287 - DNA, 165 bp, Homo sapiens
  chr7:26652551-26652716
  hypo
ttggcaatgctaccccggccgcatgatgcagaaatgggagccaaagctgggacaaggtagagaggagggaaggagccccagtgcctgcagaaagagcagagggttggaagactactgtcggctagctcaggccacgccaactgacacatacggagtgtccactgc

SEQ ID NO: 97288 - DNA, 35 bp, Homo sapiens; identical to SEQ ID NO: 41231
  chr7:26762298-26762333
  hypo

SEQ ID NO: 97289 - DNA, 463 bp, Homo sapiens
  chr7:2686448-2686911
  hypo
ggtccacccctccagcgccgcttcctgcctgccctcaggccctgctgctcctgggggccgccgccctggcctgcctcgccctggacctcctcttcctgctcttctactccttctggctgtgctgccggcggcgcaagagcgaggagcacctggacgccgactgctgctgcacggcctggtgtgtcatcatcgccacgctggtgtgcaggtgagcgcggtggggcggggacggagggcggggccagagggggcggcccgagggggcggggctggagtggggtgtgtgtgggtgggcggggctacatctcacgggcccgccctctccagcgccggcatcgcagtgggattctacggcaacggggagaccagtgatggcatccatagggccacctactcgctccgccacgccaaccgcacggtggccggggtccaggaccgcgtgagtggccgcggagttggggcc

SEQ ID NO: 97290 - DNA, 30 bp, Homo sapiens
  chr7:26979426-26979456
  hypo
tagaggccctctttacgtcctctactcatc

SEQ ID NO: 97291 - DNA, 62 bp, Homo sapiens
  chr7:2700087-2700149
  hypo
acgtgccggcgagcacgtgagcttctcccgctggccccacggtggtgcgggtgcctgcttgg

SEQ ID NO: 97292 - DNA, 44 bp, Homo sapiens
  chr7:27128016-27128060
  hyper
ttgccgcagcctagccggccgggggcaggcgctggtgccccccg

SEQ ID NO: 97293 - DNA, 505 bp, Homo sapiens; identical to SEQ ID NO: 651
  chr7:27135266-27135771
  hyper

SEQ ID NO: 97294 - DNA, 445 bp, Homo sapiens; identical to SEQ ID NO: 652
  chr7:27135979-27136424
  hyper

SEQ ID NO: 97295 - DNA, 365 bp, Homo sapiens; identical to SEQ ID NO: 31130
  chr7:27136425-27136790
  hyper

SEQ ID NO: 97296 - DNA, 203 bp, Homo sapiens
  chr7:2718466-2718669
  hypo
agtagggtggcgggacgtcagtttagcctcaggattcgactccgagcctcttgcgagaccacgtcttgggcagcatcgtagacccggctgtgagcacagagtggctcttccagaaagtttgttgaatgactgactaagtcagcccctgtgccaggcagcccagagggaccagcccagagcctccttctcggggtgcaagcctg

SEQ ID NO: 97297 - DNA, 1128 bp, Homo sapiens
  chr7:27190145-27191273
  hyper
tcctggagccaaagccgtccttctttgccatagccaatcctcctcagagcagccaggcctacaggcctcaggactacaggtagtctctccgattgcagaatcccaaagccagagtgttccctgaaccagcgtgcgcccccagaacgccttgggacgcgcagtttggacagaagcagccatgacgtgccaggcggcctgtgcaaccagtctccatggtgctggagtgggggtgggggaggacccgagtctataacggcgtccagctccggtcaggggtagccgaggcggggagatttcccggccatataggctctgggtgatcgccccccaggtccccttgcgtccccctctaccctgcttgctgggaaatctctgaggggccagtacagcagtcgcgccaggctgcaagaggcgggctgcagctggcgccggtcccggcgacggccacggcgtggcagcagcgagcgccagcacggtcgcaataaataatcggcccgcggcagccgcagtcaggaaggcggcggacctaggatgcaaatgcgccgctttatccgccccgagcgcacgcagagcacgggctaacgtcctaaacatccacagccccttcctatttatcgaatccataccaagatattgtctcaagttggggaaacaacaacccaaacaaaaaacaaacaaaaagaacctcggactcttttcttgtcgctgtccgaggagttctcggggcaaatctggtctgatgtgcacttaggccgagctacagttcgagccaccgcgctacgcaaagccaccgccagcagcacgctctgcgcttcctcccgggcagctccaccatcctctccccgctcgcggaaggtggggagtgcggtcgccagtccgttgcgccaaggtggattggggggtccccctatcgcccagactcggtttgcgtccttccttcaaccttagctgcgggaccctgccacgcgcgctaacagcattatgtcctctgcaccgaaacttcccaccaagtaacacccaattaatcccatcctctcctccaacacagaattccacccacgcacctattccccctcccagcgcttcagacacctctctcatcgaaaaaccgggcgaagggaagccggc

SEQ ID NO: 97298 - DNA, 77 bp, Homo sapiens
  chr7:27191507-27191584
  hyper
aacccaaagggctggcggggaacacagtgtgccgggccacttccttttgggcttcacggggtcgctagggaagggga

SEQ ID NO: 97299 - DNA, 16 bp, Homo sapiens
  chr7:27195586-27195602
  hyper
atgctatgggctccac

SEQ ID NO: 97300 - DNA, 27 bp, Homo sapiens
  chr7:27195866-27195893
  hyper
cgcctttggcgaggtcactgcagagcc

SEQ ID NO: 97301 - DNA, 1 bp, Homo sapiens
  chr7:27196152-27196153
  hyper
c

SEQ ID NO: 97302 - DNA, 132 bp, Homo sapiens; identical to SEQ ID NO: 658
  chr7:27196154-27196286
  hyper

SEQ ID NO: 97303 - DNA, 351 bp, Homo sapiens; identical to SEQ ID NO: 659
  chr7:27196287-27196638
  hyper

SEQ ID NO: 97304 - DNA, 127 bp, Homo sapiens
  chr7:2720013-2720140
  hypo
aggcactggagaccccgggagaccccggatcctgcagggcttctccaggtgtttccaggagcccagacatgcagccgccctgggccgcgaagcctcaagagggagccgggcacgtccttggcacccc

SEQ ID NO: 97305 - DNA, 30 bp, Homo sapiens
  chr7:27204111-27204141
  hyper
ggctgccgccgctcacggacaatctagttg

SEQ ID NO: 97306 - DNA, 386 bp, Homo sapiens
  chr7:27204384-27204770
  hyper
tcgagaggcttccagcgaggacgaaggcaggctcgagagaaacctggcgggccagcagatccgggaggccggcgtggaggcggcggcggatttgaagggaggagacacttactgggatcgatggggggcttgtctccgccgctctcattctcagcattgttttcagagaaggcgccttcgctgggttgtttttctctatcaactggaggagaaccacaagcatagtcagtcagggacaaagtgtgagtgtcaagcgtgggacagtcaccccttctggccgacagcggttcaggtttaatgccataaggccggctggagggcaagcccgcgaaggagagcgcaccgggcgtgggctccagccaggagcgcatgtacctgccgtccgg

SEQ ID NO: 97307 - DNA, 116 bp, Homo sapiens; identical to SEQ ID NO: 31139
  chr7:27205265-27205381
  hyper

SEQ ID NO: 97308 - DNA, 408 bp, Homo sapiens
  chr7:27205382-27205790
  hyper
attaaaagatcaaatctagccttgtctctgtactctcccgtctccccccccatacacacacttcttaagcggactattttatatcacaattaatcacgccatcaagaaggcgcgggtcccgcgtgcgagtgcggccagcggagcccctcacataaaattagacaataattgaagccataaaaaagcagccaaatcgcattgtcgctctactgtatttaaatctatatttatgatatttcataaggagttattgtttcagaagccacacaggctggcgggaagtcggaaacgaccaacagattcgtttgcctcgccgtggctcccagctgtaaaaatttacgaggacttggaaaggttagactgttgtgtttggttggcgagctccctgtaaataatccctgcggtccc

SEQ ID NO: 97309 - DNA, 36 bp, Homo sapiens
  chr7:27208865-27208901
  hyper
ctaccacgcccccggcgtccgcgaaggagcagccaa

SEQ ID NO: 97310 - DNA, 178 bp, Homo sapiens
  chr7:27209503-27209681
  hyper
aatcttgcagcccagcgagccggcgccaagaggcggtagccgtggaaggctcgaaagcgccagggacggtacagatcccggctccctgtctggccccggcctcccgcctctcgctctccccctctccctcctagctgcccgcccgccggggcgcgcgctcctgcgccccctcccctta

SEQ ID NO: 97311 - DNA, 637 bp, Homo sapiens
  chr7:27212347-27212984
  hyper
atagctgggcgattccgaggtccaggggaagggaaatggcccttctctggctctcagctcagggccccccgcttccaggccggatttgccttttcttcttcccgcaacgaagattcccgcccctcagcaactttgaaaaaagcatgggggatcgtaaactcgaacttcgccggttaatgggcttatttattggcgctggcggctgcttattttggatgccttacaaacatccgcgctatctgcgggcgagctactttccctccctccccctccccccgcgtgggccgcgccgcgcaggctgggcagggaccagggctctgggtcctcccggccacaggaaagagcgcacaggagggggcctgctcgctggtgtcctcgtccctagtcagggggagctgaggccagcgccgaggacgtcttgctgtggggcgctaagccggacatgaattttactgcgtccccacgcccaaatattaaaaagcaagttcacaaggtcagcctgcctgcagcttgggccaaggccggccggctgctgcgcgggctcctagttttctgatccttctcctccttgtgtctgcctgtctgcccgcctgactgcagccctctgcagccctgcttacccagggaatccttctcc

SEQ ID NO: 97312 - DNA, 796 bp, Homo sapiens; identical to SEQ ID NO: 661
  chr7:27213188-27213984
  hyper

SEQ ID NO: 97313 - DNA, 277 bp, Homo sapiens; identical to SEQ ID NO: 662
  chr7:27213985-27214262
  hyper

SEQ ID NO: 97314 - DNA, 68 bp, Homo sapiens
  chr7:27214329-27214397
  hyper
cgcagaagctgccactagtccccggtgtactctaaccactgaagcggccgtgtcggggactcacgcgc

SEQ ID NO: 97315 - DNA, 524 bp, Homo sapiens
  chr7:27219320-27219844
  hyper
gctcgcgaggcctagcgaatgcgcgttgctttaaattaccataccaatcacttcttgagggtgagtcccctttttctgttatgaaggggagcgggacaagtgaaataatgtaccgtgctgctcttagtatcagaagcgaacaaaggccaagaatcatgctggggttcccggctccccggcggctttgacattgatcggaagtgcgccatctcgtggcggctgcgcgcctaggttgggccggagttccagccccgagccgagagacggaaaccagctccgggcagagagagaaggagagaggagaggatgtgcccagcccgctgctattgagatctcatttttacatctaagaaatcgctgcaaaaccccagccgggtttatagcggcgcattccaaatatgcaaattggccggccccggacgggtttacgaccacattgtcacagccatcggaggatgggcttttatagggctcagaaatcaaacccgcgcccgcccgccgcccgcccgcgagcagtcctcctg

SEQ ID NO: 97316 - DNA, 79 bp, Homo sapiens; identical to SEQ ID NO: 31148
  chr7:27223114-27223193
  hyper

SEQ ID NO: 97317 - DNA, 85 bp, Homo sapiens
  chr7:27223221-27223306
  hyper
cggaagccccctaccctaggccttcgctgagcaccacggccacacggccatcctgcacacggcagagcagcggctctatcttagg

SEQ ID NO: 97318 - DNA, 1484 bp, Homo sapiens
  chr7:27223574-27225058
  hyper
actttatctgttaaacgcgctcctagcgccgtcgttaaacagcgacgcctttgaatcccggccgggactggagtcccggcgcaacacatggcttttataaaaatctccggattacctcgctatcaaaagctcccgaagcccttgcagggggaatttacaggcgcccacctccggctccccagcctggagctggccccgagcggggtcgagctgctgggcttgggagctgagaagggaaaaaagggaaaaggggagttgtttttttttgcaggcatgccttggccggtgggtatttcacggccaatttcagcactcgccacgtgatcccgccttttataacaaagttttgttgggggaaacctaaaggcccttcataaaccttatatgcttataaaacagcatataaaaatttaacagcggtgctgcgctagatttccaactcccctttcataaagcgcagggcgctgcctttatacgtactggagccgccggccttgtcctcagtgtggccggaagacgactcggggctgctgctgctctcggggcgccgccgccgctctttctcctctgctgccgccgccgtctcccggcagccgccgccgccgccgctgtccgaacttgaagttgccggcgcgcccgttgcagccgccgccgccgccgcggaggtcgccgtggccgccgggggccccttctcggcgctcttgtccccggggtagtcggaggaggcgaggttttccggggtgccgtaggctgtctcgaaaaactggtcgaaagcctgtggcaggacgccgttcctgcccacggtgctatagaaattggacgagactgcgggggtggggtggtggtagacgttggccgagctcttggccagcacgtcgccaggcacgccggccgcgctgggcgcctgcaggcagtctctgtgcacgagctcctccgcggagtagcagtgggccagattgccgcgggggtgccatttagtggcgggctcaatggcgtactctctgaaggtcacttcgcgcacgggttggacctggggcaggttggaggagtaggagtatgtcattgggcgcgaagacggggtctggggcagaaaagaagggaggctggagaaatctggacccgagacgtagtaagtacaacttggcaaatacatgttagaggagcagggaccacgctcatcaaaatccattattgggctaccttgggctctccgcagtagccgagcttaacatgattctccactgcagctgcctctttgaagcggatccgtgaagtagaaatttggagacgtaagctgacgtggaaatctatccccatccttagcagggaggtgctggtcatgtgacccgatgttgaaattgacaagctgctagctagtccgggccttttccccccccctttccttttttttttttcctcctctcccctccctcccggcttcctttctttgtagccacctcaggggaagcaacagatcgtcactc

SEQ ID NO: 97319 - DNA, 268 bp, Homo sapiens
  chr7:27227776-27228044
  hyper
tggggctgagaaaggcgctccgggagcggctggcagggcaattcggcaggctgcaccgaagccgagtgcccggagggacttgccgcccggaagggggtgtgtgggggcgctgccgtgaagatggatgagggaaaaggtttttgatatcagcagaagggaaaacgcctggagtggccgaacacttttagttgcccagcaggaataggagacgggtactcagctccccaaggctgcgcaatatcccagctttgcccgctcctgccctcgt

SEQ ID NO: 97320 - DNA, 52 bp, Homo sapiens
  chr7:27228676-27228728
  hyper
gaaggccaacgcctgcgccaggcttgtcaggcggaaacggctaacaaggaga

SEQ ID NO: 97321 - DNA, 887 bp, Homo sapiens
  chr7:27232211-27233098
  hyper
ccaaccgggacctgccggtgccacggtcccgtgcgccgggtcccggcctcgggctgcgggcggcttcggggcctacagcccagcggcgcggagcgtggcagaggcgcggggcgcagcgcagcccgaggctgcctcccgcccgggcggacggcgcggccgctggggtgcacagcgtagccccgcgtgcccggctcgctctccgttccctcggatagctcccaccgctcggctccgggctcagaaagcggaagtatttggtagagaaaaacacggtttcttttcagctcgtctcaaaatcccttttagagaaaatgctcctgtcaagttttatttcccgttgcaaaccaccttccacgctgccaagaattaagaccgggagagattaaatacccgattattctcctggggagggcggggcggggccgggaagtgggcacccacaccaaacattccttgaagtaggcttgtcctgatccagccgcgcccggggagccccacgaaggcccgcgcggcctgcggtgacgtcagcctgcagttgcggggccactcacccgcacagacacggcccttgctgttccgcgccgggacctccgccagccgtcctgccgcagccccgactggcccgcgtgccgtcagagggaggcccgctttacaccggcctgagcctccattttgagtagggggttcttgtagaagcgtggagggtttggggccgcgcctctgtccccgaggggcgcgacatcaggtagctctccgagttcacaccccagtacctgggggaggacctatgtcgccgcataaccgcccgcagaggtttggaaatctctgagacccgttgtaattatttctgcccagtggatccggctcttcagcgtcacgagagccgg

SEQ ID NO: 97322 - DNA, 30 bp, Homo sapiens; identical to SEQ ID NO: 31155
  chr7:27237273-27237303
  hyper

SEQ ID NO: 97323 - DNA, 30 bp, Homo sapiens
  chr7:27237530-27237560
  hyper
acttatctgaaattgcgtattttgggggtt

SEQ ID NO: 97324 - DNA, 179 bp, Homo sapiens
  chr7:27237991-27238170
  hyper
ttggtataaggcacgcgcttctttctccccctcctataggagctggcatccgagggatgggagaccacgtctagaagacaagggagaaggcaagttacacagggatcggaccccagccagggcataggcgacagctcgatctgagccacccgccttgcagcgcccggctgctctttgcc

SEQ ID NO: 97325 - DNA, 410 bp, Homo sapiens
  chr7:27238507-27238917
  hyper
aggggctggggagggcggggcgcagagggagagggaagctagccgaggtctccacaagccacccctcacccagggagagccagggaccagctcaactcgaggcagtgcaggcagacccagccagccatgctcgggctcccaggggtgcagagccgctagggcagaccaggaagagaacagaaacgcacccgggatcgcccgggtgcgagcggagaagaagctggagcagagccggaagaccagggctgggaataggtcgtcatttaccgggcagagtggacttccagaggtggggaggctgcgcctgctctttggggcagtacatttggccgttccagccgttgggcagcgcccagggctggtagctttccatgggaagacccaagggttcgtggcgcgactcgccgggg

SEQ ID NO: 97326 - DNA, 32 bp, Homo sapiens; identical to SEQ ID NO: 8952
  chr7:27239141-27239173
  hyper

SEQ ID NO: 97327 - DNA, 1099 bp, Homo sapiens
  chr7:27239225-27240324
  hyper
cgagcaggggctgcattgcttggcggcctctgcgcccgccgggcccgccgggccgggacctcccgaggacgacgcggcggcggcggcggcggctgcagcggcagccgcggcagcagcggcggcagccgacgggggcgcctccccgggggcgctgctgtaggcggacgcggctcctggcgccaagggcgccgggtgcgccatcaggttgcggcactggttggccgcggccgccgccgcagccgcggccgccgccgccaccgagaagttgccccctgccgccgcagccgccgggtgggggaagcccccgcccccggccccggcagccgccgccgctgcagccgctgctgcagccgccgccgccccttccatgttcttgttgagctcgtcggccaccaggccgccgccgttgtcgtagagaaacatgacggtgggctcgatccagcgggggtggaggagcacggaggctgtcatagcccgagccgcatggagaagaccccagtggcgctgttttaaaaagcccccaagaagtgaagagcgcgcggcgcggggccggggcccgagcgaggggggcggatcgcgccccgcggggtcgcgccaggcggccgcccattggcccggcccccccgctccgcccacggcgtatgcaaagcgggcggctccgactccagctctgcacggtgcacccgtcgtccccgccgcggcccgcgccgtccccagcgccagccgcgcggccgcgcaccattcacccgggggagaggcggaggaacgtgcgggtggggcagggaaggaaggcggccccatctccgccccccttcccttcctttatcccagtggggcccagacccgcgcaaccaggcggggaggggaggtgggcgcgcgattgggttgcgatctggagcagtggggacaggtcaggtaattctgccggcggtcagggatgggagagtggggaggacgggaccagcctagctcagaatgggtgtttcttggagcctctgggactgttttctttccaggaaccggcgcgtatttctgcagtgagaccacaggacggacatcggcgccttcggcttcgatggagttgcgattttgctctttc

SEQ ID NO: 97328 - DNA, 181 bp, Homo sapiens; identical to SEQ ID NO: 31161
  chr7:27240992-27241173
  hyper

SEQ ID NO: 97329 - DNA, 32 bp, Homo sapiens
  chr7:27242143-27242175
  hyper
tagccccgaaccctgcgcgcagagaaagggtc

SEQ ID NO: 97330 - DNA, 72 bp, Homo sapiens; identical to SEQ ID NO: 8957
  chr7:27244539-27244611
  hyper

SEQ ID NO: 97331 - DNA, 513 bp, Homo sapiens; identical to SEQ ID NO: 31163
  chr7:27244797-27245310
  hyper

SEQ ID NO: 97332 - DNA, 114 bp, Homo sapiens
  chr7:27245526-27245640
  hyper
gctggtgacatacttcgctggcgcatctccttactcactcttacttttccgacccctcaccattccctctcctgtggcttggtaaatacacctgccctccgtggaaggtgagtc

SEQ ID NO: 97333 - DNA, 165 bp, Homo sapiens; identical to SEQ ID NO: 31165
  chr7:27250066-27250231
  hyper

SEQ ID NO: 97334 - DNA, 449 bp, Homo sapiens
  chr7:27252370-27252819
  hyper
acctcttcaggcgaccgcacccttccgctgaagtcccccacttctgcccctccgaggtggggtgggggtgttctgaaataacggtggctgcagttagatggctgaggacatagaaagcggttgttatttattccaggcaccatcacaaaaggcttccaaaaatatcgagccgagatattttattgtccagcctgtctgcagcctgtaattatgcgttcaagatgtttaatgtgtgcaaatgcattagccgctttcgctggtgaaaaccctagctgggggcggggtagaggcaagtctggagataattatgtcgtacagtcgcaaacattattccgttcttactgtaaacggccccggccacctttacgagaaaccaggaaacttctgagagttactagcagcgtttacgcgggcaaactgagttctttttctttctctcccggattgtt

SEQ ID NO: 97335 - DNA, 297 bp, Homo sapiens
  chr7:27252895-27253192
  hyper
cggagaggcctacgcaggtccccggtgcccgcggccctcggaggccgggccctgcgtcttggccaggcactgggtggcagctgaggctggtggcccggagccctcgcggccgcgggcaggccccttcttgggcagggtcgggcactcccgctgtccagggctcttcggcaccctccttccaatcaggtcgctctcccctgctccccagactcaactcctccgaagctgctccaggttgaaatgtgaccgctaggccgactccctgggcccgcgagcagttctcgaaaggtgcggact

SEQ ID NO: 97336 - DNA, 1013 bp, Homo sapiens
  chr7:27264571-27265584
  hyper
ttgaatgcattcattcgggaatatttactagattattttagtgataatgaaaactatgcaaattttcagaagtgacatttcagggacaaaccgaataataactgtaaattcataaatgtcaaaattgccttcaaaaaggttttgccgttttgttttttgtttgttttaacgttccaccaatggttttcgggtgacggtgtccttgcacgatgtagtccgtcttcaaagttcttttacacaacgtgaattatattgaaattgggctacttcatagagcttcgcctcagtggaggacagcctggaataggtgagggggtctcgaaaggaataccaggccggggagtactggcaagtgtcggaggggaagggcaggtcggggagaggatccccaggggctgggtgtctgcagggctccccgtaactcagaggggccggcggccgccgcccgaagcctgagcttttctcagcagatggagaattcatttttaacccccaggaaggaatgggctgagacatcagaccaccgctcctagagggtcaaatttcctccccataaatccaaaacattctctttagggagttccctccgtggcgcgcaaacccgggaagccgcgcgccctggggtttcttggcgggccgtgcgcgcagcctgaaccgccaaagtcgcgtcatcccgcatttgcctgcacccaggagtttgcaacccgcagagcccgcagaggccaccgccaagagtgcgcgccttggcgccccgtcggcctctacttcctcggatctgagccagcgccgctaatccgcaggctgcagcagaacctgtcgccagcttggagagtccctcgcgctgccctggcttcccggtccgcgggcgactcgcgctgctcccgggtttgtcgggaccccaggagggcgctcaagcctgtcggcccctacttgtgtgtagagaataggcccgggtacaccacctcagaaatgcagaggaagccggggacactgaagcccgggtggttgcagtg

SEQ ID NO: 97337 - DNA, 452 bp, Homo sapiens
  chr7:27274962-27275414
  hyper
acctatcacccatcccgcttagggtccagctcagagagcgggcgcatagggcctggtggaacaggctgccctctggggatgggggattggggccgctgctccgggcagagccgcgggatccgagccagcaaggatgctgggactcgccgcgacttccgcctctggcgatcggcagtggggggcgcaccaagacagcagttcgggagctgcgctttgtcaccgaggcggcgaggggcggagggcgcagaaaggggccgcggagaaaggacaaggcggccgaccagctcccaggatggaaagggaccctcaaggggctccaggcagcacctggggcaaggggagggactgatactcccggccggagcccaacctgtggcgcgtgcttcagtcctgagccagcggctccctggcttctgggctggcatccgtcctaccctcctcccgctgcaaca

SEQ ID NO: 97338 - DNA, 406 bp, Homo sapiens
  chr7:2727853-2728259
  hyper
cgagctgcccacgctgctgcccggggctcggtgcccggcgcggcctctgccggctccggcgggcgcgggactgcgaggtaggggggcgcgcggggaagactcgggggcgcagggaccgagagggacctccgtgccggggcgggtgggtaggggcagctccgggtccagcccggcccgcgcaccaagtcccgagggcgcccgggcggcggcggctacgggcgcgcggggaccgcggagacgcgaagggcgcacttggcgagggtttggtgcagcgccgcgccggggtccgcacagccccggcaggtcctgcagagggaaggccgggccagggaagggccacgcgccccctccccgccatcctctcccaggccagggcgacctgcgcgcttcccgatgggagcaaact

SEQ ID NO: 97339 - DNA, 132 bp, Homo sapiens; identical to SEQ ID NO: 665
  chr7:27279237-27279369
  hyper

SEQ ID NO: 97340 - DNA, 206 bp, Homo sapiens
  chr7:27279453-27279659
  hyper
cgccgggcctggagcggcctccacctcagctgctatcaccccctctccgctgtcatgggattgcccaggcttaatggggttgtgcagggcttcacttgctctcggaatttaccttccttctcgagccgtgccgcgaataaccttcacgacacagtgataacgatgttattaaatactccccccacattcaccgcccaaaaaaccaa

SEQ ID NO: 97341 - DNA, 1347 bp, Homo sapiens
  chr7:27281948-27283295
  hyper
ttgaggcttgtaagccgggcttcacacttctaaaatgcagttatggattctttcatcggtgttagatcaaggcaccaagttaagaaaacaaaagtcaaaacaacaataaaagaaaaaatcaaaagcttatttaattaccgagtcccgctgcccctgcggaactcgccgcgcgcgttaagctctcttttctttctgcggaattccatttgcatcccctctgcctgggtgtctccctctctcagtgtgtgtgtctctctgtctgttttcacactctcctccccaatcgagcgaggcccacacctggcgcatcactgccgagccattagctgcgggtttcctttcatcttcgctgtggcagacgtttctatttatccacttgcgctcgccgagtggcgtcaccagcggtactgtaatgacgattgcagcaggaggatgacagcttagaaagaagagggcaatggggcttcctcccagaggcggtgcggcacagaggagcgctcgcttcacaaggtgaccctagctcccaccgccaccgccgcggtcgcggtccagaccgcgctccagcagctccgcgccctcccaggcacccggcctttctttctccctcttgcaaccaagatccgtccggccgctggagacccagggagccggggttaggaactcacttggggctttcccctcccccaccggagagccccgggatggagagccgaaaggacatggttgtgtttctggatgggggtcagcttggcactctggttggcaagagagtctcaaatttgtccgaagccgtgggcagcccgctgccggagccgcccgagaaaatggtgccccgtggttgcctgagccctcgggccgtccctccggccacccgggagcgcggcgggggaggcccggaggaggagccggtagatggactcgcaggcagcgcggcggggccgggcgccgagccccaggtagctggggcggccatgctcggcccaggacccccggccccctcagtcgacagcctctccggacaggggcaacccagtagctcggacaccgagtcggatttctatgaagaaatcgaggtgagctgcaccccggactgcgccaccgggaacgccgagtaccagcacagcaaaggtagccaccgtgcccctccgctccccgggcctcccactgcgcccacccttcacttcggcgcaggccaggaggaagacactcccttcccctagggcaggatggctggggggacccacctgagcaactctctctgctatctgcgttctggcgggggtctcctactgtgttctggcattggcgggactgagggtgacagcagtgccttgagtgcggggtgct

SEQ ID NO: 97342 - DNA, 15 bp, Homo sapiens
  chr7:27284655-27284670
  hyper
tcgctgtgcagggtc

SEQ ID NO: 97343 - DNA, 74 bp, Homo sapiens
  chr7:27285445-27285519
  hyper
ctggcctctgagcatcgggccaagtccagctactgaacctgctccgctcctctccccaggtgtggttccagaac

SEQ ID NO: 97344 - DNA, 205 bp, Homo sapiens; identical to SEQ ID NO: 31175
  chr7:27285620-27285825
  hyper

SEQ ID NO: 97345 - DNA, 121 bp, Homo sapiens
  chr7:27289445-27289566
  hyper
tttttctgtcctacagtttgatcctgtctcccaatgtggcatgccccacgaacggtttctttagtgattatgttgactccaccttcctagtttcaaaccctgcacccgcactctccagaca

SEQ ID NO: 97346 - DNA, 93 bp, Homo sapiens
  chr7:27289789-27289882
  hyper
attattccccaactgcggaaacaccagccaccatatgtccgccggagaataagcgtgagtgtcgcggtggacagttgccgccaaaggtgtcca

SEQ ID NO: 97347 - DNA, 173 bp, Homo sapiens; identical to SEQ ID NO: 667
  chr7:27290946-27291119
  hyper

SEQ ID NO: 97348 - DNA, 864 bp, Homo sapiens
  chr7:27291314-27292178
  hyper
gggctgggcaagccgaggaacagcgagcccccggacgctgactgcaggacgtcccagtttgtgcccgggtctccgtccctccccgtacggggctcgtacccccgggcctgggtctgacccacagggcgctgaggcctttgtagctgaagtcggaaggcctcgttgcgagcgcggcacaggttgctggtagcttctggactctggaggcttggccttccttctaagccgatggcggggaaagaacctcgtttccacagcttccccgacccccgccgcttgccatttggggacgggaagcgcgcccgggtcgcttcacgtccctctgggccggagccctttccatggctggctcctctgggggcccttgggcctgtgagcagcgtctacttccctcagagaagaatcctttccttcccccatcgaagtgtccctttctgtatcctgaaataacccctcctgggtgaggccagttcccctctgtcgccctcctcccgcaggcgtccgggagcctcgtgaggaccccgtgcagttgagtccaggcgacaggtgcctccccaggtgtctacttgccctccctcaacctgtttagggaaagaccagaacgatgtgcgcggggaggtggttttgtttctcccgaaactggcgctcttgggtaaaaccgcgtgccgcgtctacgcgggctctgttagtgtgcgtgtcccagaagagtgggccttctaggcggcactctttggagaagtaagtgaggtgaactcagaacagagaagcgggaacgatcgtttgatgtgccgagccggaaaaagagaggagagggagaggctcccagcgagcgcggagacagaggagcccacgcggcacagcacg

SEQ ID NO: 97349 - DNA, 17 bp, Homo sapiens
  chr7:2731870-2731887
  hypo
gggttgaaagaggaccg

SEQ ID NO: 97350 - DNA, 98 bp, Homo sapiens
  chr7:2747103-2747201
  hypo
gggcttctggtttcccggctttgatgccatcgtgcccaggttcagcccctgggcctctcctgtatctgtccacactcatgctccggggaaccatgcta

SEQ ID NO: 97351 - DNA, 56 bp, Homo sapiens
  chr7:27531197-27531253
  hypo
atggggttggagtgccggctccagcagagttgtctgagcagcggcctgaggtgctg

SEQ ID NO: 97352 - DNA, 203 bp, Homo sapiens
  chr7:27555618-27555821
  hypo
tctctctggaaataccggtcttgccatctttcaagcaaatagcggctcactggtaggaatttcaaaacctgtgcttaaactgccaaattcctttcctctgctgttcccatttctctgtaatgatggccccagaagggaggcttggtgcaggctgacgctttctctgccttgggcagcatggaatgtctcgcctttgacacaca

SEQ ID NO: 97353 - DNA, 30 bp, Homo sapiens
  chr7:27591774-27591804
  hypo
acaatcagtttagagcgtgccatgtttgat

SEQ ID NO: 97354 - DNA, 47 bp, Homo sapiens
  chr7:27686768-27686815
  hypo
acctgaaaataagcacgcgatatcacaacacccgatcactgaggcgg

SEQ ID NO: 97355 - DNA, 30 bp, Homo sapiens
  chr7:2770610-2770640
  hypo
ggattcagtagctaacgtgacagtttccat

SEQ ID NO: 97356 - DNA, 32 bp, Homo sapiens; identical to SEQ ID NO: 41235
  chr7:27903816-27903848
  hypo

SEQ ID NO: 97357 - DNA, 67 bp, Homo sapiens
  chr7:27905659-27905726
  hypo
tacctagaatgggttcgcagacaggttcaagtcttgcagcacaacctcagctcgtcttcatcgagtg

SEQ ID NO: 97358 - DNA, 242 bp, Homo sapiens
  chr7:27907826-27908068
  hypo
tattgggatgagtcacgttgcttgctcaacaactttaaggcctaggatcagtgacagaactccaggagcagcggggttaacacgggtgaccaatttctcctgcccactgtcactcacatggcccatgcctgctcctgcagatgccgttccccggtcctcaccgcaactccctgtggggttgactgccgcttgcttctcccgctcccatccccctctccagattcctccgcccctgcatgggc

SEQ ID NO: 97359 - DNA, 99 bp, Homo sapiens
  chr7:27916674-27916773
  hypo
agaagggcaggctaccgagagggcgctagactttggcagaggccgctgctggaaagccagcatccccagctttatcaccgaccacgtttattttcttcc

SEQ ID NO: 97360 - DNA, 30 bp, Homo sapiens
  chr7:27980078-27980108
  hypo
cacatgcccagatgccgtctcagcagtcag

SEQ ID NO: 97361 - DNA, 80 bp, Homo sapiens
  chr7:2798456-2798536
  hypo
tgagagggttatcaccgcatgtatcaacatgatgggtctctgctgggcgcggtggctcatgcctataatcccagcgctct

SEQ ID NO: 97362 - DNA, 24 bp, Homo sapiens
  chr7:28049405-28049429
  hypo
tcaccattgcgttttttaaaaatg

SEQ ID NO: 97363 - DNA, 116 bp, Homo sapiens
  chr7:28050616-28050732
  hypo
tctggtggtaactagcgggctcctcacaatcccacatcacctggcagggtgtttctgcttacgatgctaatgagattttacttgaaagatgtaattattgccgcaacccaagaaaa

SEQ ID NO: 97364 - DNA, 30 bp, Homo sapiens; identical to SEQ ID NO: 41239
  chr7:28055637-28055667
  hypo

SEQ ID NO: 97365 - DNA, 30 bp, Homo sapiens
  chr7:28241732-28241762
  hypo
agaattgagagtcctcggccgggtgcggtg

SEQ ID NO: 97366 - DNA, 128 bp, Homo sapiens
  chr7:28258505-28258633
  hypo
gtgaatgttcccaagcgctcgggattaaggttgatttaatctggttgcttctattttgccatgttgtgactttcacgtgcatcccattgcctgatgcttataaatgatggttgcgcataatgtcccat

SEQ ID NO: 97367 - DNA, 24 bp, Homo sapiens
  chr7:28310468-28310492
  hypo
acagaatgagtccagcgggcctga

SEQ ID NO: 97368 - DNA, 183 bp, Homo sapiens
  chr7:28351972-28352155
  hypo
cccatgatacctactcggatttcacagagggggaggcacagagtggtggagctgcaaggaatgctggcaggagctgagggggctcagtgacaagaccggtgcagccagaggtggcttgggagaccatggacatgcagaaagtctctggtgtacaaagggggagggaagcgggtggaggcgaag

SEQ ID NO: 97369 - DNA, 25 bp, Homo sapiens
  chr7:28366473-28366498
  hypo
tatttaggctgggtgcggtggctca

SEQ ID NO: 97370 - DNA, 590 bp, Homo sapiens
  chr7:28448701-28449291
  hyper
ctaatgtcagggagccgtgtcacacggcgctgggctctgcaagctgttgcttgcgcagtcgcccccgccgctgccgctcccgggcgggtgcaccagggtccgcgcgggcggggcggggtcggggcgggaccggggcggggcctgccccctcgacgcgccggccccgcccctcgctccgtccctccccagcggaccgcaatgatttagaagttcaggaatcccacgtgacgtcaccgggggggtgatgtaatgcactctaaatagaatgtattgtaatctttgctcagtccaacgtggtcccttcacccgggctccgctcttgccttctccacacttgtttggtaagttcctaaaaatacggctcggccacttctggggcttttgcatttagccacttttgttgcacttgccgcaggagccatctcgggagtgtacttgtttgcaggggttggttctcggcagcagccgcgaggttacttggtccagtgggcaggtcacagggcaaggagtagggaagatgcgatgcatttttttctggagggtgatctgtgtttgtaaacattttggcggaccagagggaagtccggccc

SEQ ID NO: 97371 - DNA, 124 bp, Homo sapiens; identical to SEQ ID NO: 3013
  chr7:28449658-28449782
  hyper

SEQ ID NO: 97372 - DNA, 383 bp, Homo sapiens
  chr7:28449857-28450240
  hyper
cgtccgctccagtccactcctccggccgcctcctgcctccgctgctttcttgctggcatcgttacctcttcccggccgctgccccaaatgacagctccggctcgagctttggcggcgcccaggcaattcccaagacctggcggcggagtctccccctgcggcagattctcggcagaatcacttgaacttttcacgaagttcttagaggggcaagatgcgaaggaaggaaccaaggagatgttttctctcagcagctgcatcccgcttcttctttgccatagatttatttttaaggggcgtctggtagataaagccctagaccttgtccacactctcacccccatccccaactttccctggaccggtgccgcccccacttgatg

SEQ ID NO: 97373 - DNA, 99 bp, Homo sapiens
  chr7:28450611-28450710
  hyper
tccctggggcgagcacggtccctggagtgtgggtaaaagcttctggggtctgaggggaccactgtacctgatcagcgcgcaatccgcccttttgtatta

SEQ ID NO: 97374 - DNA, 30 bp, Homo sapiens
  chr7:28535177-28535207
  hypo
acctgtaatcacactcgagcaacaaatgtg

SEQ ID NO: 97375 - DNA, 21 bp, Homo sapiens
  chr7:28571358-28571379
  hypo
ctgaggctagccgggcgtggg

SEQ ID NO: 97376 - DNA, 30 bp, Homo sapiens
  chr7:28572177-28572207
  hypo
cagtgcctcgggtctcgtggatcggaaggt

SEQ ID NO: 97377 - DNA, 75 bp, Homo sapiens
  chr7:2864022-2864097
  hypo
gctcctctgggtctgcggaggcctctgcacttggggtgctctccccatcacctctgcaggcggctccctgccacc

SEQ ID NO: 97378 - DNA, 50 bp, Homo sapiens
  chr7:288278-288328
  hypo
aggatcctggacttccgccgggtccctcccgtggccggcaggatggtcaa

SEQ ID NO: 97379 - DNA, 30 bp, Homo sapiens
  chr7:28887552-28887582
  hypo
ctgcagaggctcacccggcctcatctgtgt

SEQ ID NO: 97380 - DNA, 221 bp, Homo sapiens; identical to SEQ ID NO: 31183
  chr7:28893380-28893601
  hyper

SEQ ID NO: 97381 - DNA, 197 bp, Homo sapiens
  chr7:28907350-28907547
  hypo
agacttccacgaggacgtgatttgccctttccatggggttggggagttgatgggggtcaggatggctgcaaaaggaggtaagggagatcacacagggcctcaacagctgtgctgatgactttagccattatcccgagagccgaagagcaaggggaatccactggagggtcgcaatgggtgtgcggagcaggaagaga

SEQ ID NO: 97382 - DNA, 32 bp, Homo sapiens
  chr7:28988955-28988987
  hypo
gggcgcagtggctcacgcctgtaatcccagca

SEQ ID NO: 97383 - DNA, 151 bp, Homo sapiens
  chr7:28989227-28989378
  hypo
aaaaaaagtacagctgaccttcctgagtctcggattatgtatctgtgaattcattttctcaccaaaatttgtttgtgaccctagaatcaacactccatagcactgtcatggtcattcgctgacatgcttagggcagcgaaaaatctgagct

SEQ ID NO: 97384 - DNA, 425 bp, Homo sapiens
  chr7:28995567-28995992
  hyper
tcagcagctggtagtcgacgccgccccggctcccggcctccggtagggtgaccagccccgcgcagtggtcccggggagccacagggcagacacggcccccaagcacgccctccacgcacaccaggtagggggtgtccccgcgcagctcgcgcagcgtggccgagtcgctgctctcaggcaggtagacgaagcggtggaacttgggctgctggccaaagcggtcaaagagcaggcggaagcgcgcgccgcccagcggccggggactgcggtgctcgcgcacggcccagcgcaccgaggcgctgtctgcgcccaccgcctccaccgtcaggttgcacagaatgaacttgttgaagtcgcatgggtcggacaccagcggcggcagcccggccccaccgtcggactgggcggcacgctcctggtgctcc

SEQ ID NO: 97385 - DNA, 1161 bp, Homo sapiens
  chr7:28996324-28997485
  hyper
gagacctgcaggtggcgtcatctcctcccctgcggccgtgggtaggggctgccgcctgcggtcagcggtcagggaagctgagggcgagggatccgcgcaggatccattttgcagctgctggtcatccaggtaatccaggtatttgcctcgcagggccggggggtggcgacactgcacgaagacagtgaggagccggccctgcgagtgccagtcgcccatccagcgcttcaggcctcgcagccggcagtcgcaggtccagccgttgccgtctagatccagccgataaagggctgggctggcggcgaagatgtccccggatagggcgctgagcgcgttgttgcgcaggctgagctcgcgcagccggcccaggtggccgaaggtggccgggtgcagggcggacagctcattgccgctcaggtccagcgcctccaggctgtgcagaggctccagcagcgcagttggcagctggctcagccgattaccctccaggcgcagctcgcgcagggcctccaagccccaaaaggcctcaggcgcgaggtgcgtgagctggttgcccctgagcgagagcaggccgagacgtggcaggtgctggaagatgcgcggcccgaggtgctgcaggttgttggccgagaggatgagggaggagagggagcgcagcggtgcgaaggtggccgcgtggcgcagggagggctgtagctcgttggcagagaggttgaggaagcgcagcttgcctagctgggcgaaggcgttcttgcccagaaagcggatccggttggactccagatgtaggtagagcaggttgcccaagggagcgaagaccgcgtccggcagcgcccccagggcgttcccgtccagccgcagcttgactagactctccaggccctcgaaggagccgcggcttaggcggctgatctcgttcccgttggcgtagaggatgcgcagcttgcgcagcggggccagcgtgcccggggcgagcgcctgcaagaggttgttccccaggtacagctcttccagccgcgagagcttctcgaaggtcttggggtgcagagagcggatctggttgtactgcaggtccagccgtctgagctgccccagacggtggaagtcgaaggccgtgatgttggttatgaagttgccgccgaggctgtaggtgagcacgtc

SEQ ID NO: 97386 - DNA, 160 bp, Homo sapiens; identical to SEQ ID NO: 31187
  chr7:28997486-28997646
  hyper

SEQ ID NO: 97387 - DNA, 533 bp, Homo sapiens
  chr7:28997676-28998209
  hyper
cgtgcagcggccggatcgtcctcttggcccgccggctctgtgtctcctctgcattccccttagcctggccagagtcgctaaatggcctctttcggacttcgcagcgccgtccagcccctcctccgtcctttgtccggaggccggcccgggtctctgcaggcgggcttcgcccggccaagtcaggcggcgcggggcgctctgcagaccccgggtactacttgttgcatttctgtataaaactgtttctccgggtgcgcgtcggcgggcgggaggagggagcaagacccggcgctttttgtttgcagctgagtccggagagctggattccctggcgcggattctcccagccgagtggattccccagctgcaggcgggagccgttccaagagcttcgcggggcgcggcttggcagcagagccccggctgctcggcccccgcagacggcaccttctcgctcgcggtcccggacggggagggcggctccagtgcaatagctcggggagcacgcgggctgcgtccggaagggacccaag

SEQ ID NO: 97388 - DNA, 164 bp, Homo sapiens
  chr7:2900214-2900378
  hypo
acccaagacttatttctggtttggggactctcttccatatcatctcaccccaggatccaggctgacgcagcagccactgtcttgaacgttgttggccactgagccaagagaaagaaagagcttgggaaagttttgtgctgacaggtgcacggcctgcaagtgac

SEQ ID NO: 97389 - DNA, 44 bp, Homo sapiens
  chr7:2916072-2916116
  hypo
ggcttcccagcggggcgctgcctgaggcccggtttgcccagaga

SEQ ID NO: 97390 - DNA, 382 bp, Homo sapiens; identical to SEQ ID NO: 31189
  chr7:29185815-29186197
  hyper

SEQ ID NO: 97391 - DNA, 30 bp, Homo sapiens
  chr7:2920175-2920205
  hypo
gaattgggggcagggcgatgatggagagaa

SEQ ID NO: 97392 - DNA, 382 bp, Homo sapiens
  chr7:29234504-29234886
  hyper
cggcggcgtccgcaccggggctgagcgagcagcgacgcgaggggcgcgcggagatggcagcgtccagcaactccagcctgtccggctcgtcggtgtcctccggtgagtttcagcccgtcgggcgctgctgccgcgccgggtctcgccccactgccctcgccccgcagcctgggatggacagagcctacctgtggccatcccgcccgctctctcggaatgggggcaggcgtccggggtgatacttgtttggttcgccagcacctcggtgcccagagcacctccgcgcctgacatctgacagcgcagaggtgggagagcggtggtgcccttagtgtgcggacgcgggtgttccggggcttggagtgcagcgagcgaaaagcgaa

SEQ ID NO: 97393 - DNA, 206 bp, Homo sapiens
  chr7:2923723-2923929
  hypo
aaaaggacaggcactcggttgaggtcacacagcaagggagtcgggaagttggaaggaggaggatgtggaagacgcagtttgctcctgggtcctcagaaaggaggctgggtgtcaaattctacccttaggaattttagtgagcaggcggtgcctttgtgcatagaaaaagatgccccatcctctgggtggcccggcccagcaccagg

SEQ ID NO: 97394 - DNA, 69 bp, Homo sapiens
  chr7:294045-294114
  hypo
gggcaggcaggtgatcggggcgttggaaccagaccagccgggacctgccgggtgcgtggggtgtggtgg

SEQ ID NO: 97395 - DNA, 30 bp, Homo sapiens
  chr7:2946546-2946576
  hypo
gccacccctgactgccgtggtccccacccc

SEQ ID NO: 97396 - DNA, 105 bp, Homo sapiens
  chr7:29482437-29482542
  hypo
catttattttttcagcgattaatacctgaatgctgcctaggtttttccttatttattccatttctatgattttctccacttaatccccatcgctttcaatttcat

SEQ ID NO: 97397 - DNA, 34 bp, Homo sapiens
  chr7:2950000-2950034
  hypo
gcagagatgaggccccggacggggtgaaccaggt

SEQ ID NO: 97398 - DNA, 30 bp, Homo sapiens
  chr7:2954959-2954989
  hypo
tcgttgctgttcatccgcttatacttgttc

SEQ ID NO: 97399 - DNA, 30 bp, Homo sapiens
  chr7:2958214-2958244
  hypo
ctgggctctggggagcgaagagaggagcct

SEQ ID NO: 97400 - DNA, 30 bp, Homo sapiens; identical to SEQ ID NO: 41142
  chr7:2958507-2958537
  hypo

SEQ ID NO: 97401 - DNA, 1463 bp, Homo sapiens
  chr7:29603263-29604726
  hyper
tacagcctcagcctccgggtctcaggtctccgccgtttcttctcaaggagtcggtcgggggagcggcactgcacagcttttctccaatcagacacctcaaggctggcgcctgatccaatctcctcccctggagggtgggaacgcgaagttcctacctgcacctgtggcagcggtgaccgcctcctgggttattttcttttctcccccagctgccccagggttctggtttcccgaatcacttggcaaataaccagcaggtgggcagatgtcttttttgcgttcctacggacgcgtaggcaagttcgatgcgccggagtgaacagccagggtcccatctctcagccggctcccgggcggtgctagcagggaagagggacgcgccggcgaatgaaacactactagcccggaaagccgccctggaccttccacccgggcagcgagtctggcggcccctcgccgccgccccctccgaccagaacagactgcgctgcgagccccgggcttccgccgcagcgcgcagcaattggaggtgccagaggagaccagcagcagcacttgatttagctgggctgcgggaattccgacctgtacactttccagaagcctgatctctccaagtccgcgcccagggactcgagccccggcttccaggttgacccgagcgcgcccccttcgtgctctcggccgcgttcaccgcgcgaggcctccgggtcctgttaagcccgagcaggtgagcgactgggggtggttcggcgtccgccgagacagagcctggccccgggggtcaccctggggtgctgcctggtacctcccaggtacccgcctcccggagccctaagagaggctgaaaaccacggacgctccaggactccgttttctgtacttttgagtaatttgccatcttttccttgcgcaattcgtacaaagcccttccgtgctcacaaagttgatgattgtgaagaagaaaatgtaggttagaggagaggaagcagcatcaggacaccttaccaccactgttagtaaatgacttgggggtacgggttgcttttccgatctgcaaagtaggagggaatgggatgtttgcagacgcagttgctaattgtgcctgagggcgtgggtgccttttgtaccgaaagaacttttggccgttttttcttgtattgttttcaagtcgctgcccgagtgtgtcctcagggcatcctggggaggagccggtgttgcggtttcggggcgcagccgaggccgccccgccgcctcccgtaggcgatcagacttcctctccctggcggttccgggaggagaacctcctacaacaaacaccgccgaagtttccctctccagcgcgatcgccaatcccaggagcgcccggcgcgtgggctgggaaggagccgagcggaaacctggaagtgagccgcggcgcaggcgaatcctgccgttgctggtggcagcgcccaagagacccc

SEQ ID NO: 97402 - DNA, 203 bp, Homo sapiens
  chr7:2960538-2960741
  hypo
gaccatggcacatgtcgttttaaccttatttaaatgtcatcaacctcccaagtaaagttttgcaaatactttgtgagggagcggggcataaaccatgaatgcaacaaatgcagcaagctctgctatgatatcaaaccataatataaacccccacatcagccccacctgctgagggctgtataatactgcggaagctaaaatgg

SEQ ID NO: 97403 - DNA, 30 bp, Homo sapiens
  chr7:2961827-2961857
  hypo
tctccatgcccagtccgtgggcagactgac

SEQ ID NO: 97404 - DNA, 34 bp, Homo sapiens
  chr7:2963968-2964002
  hypo
ggtccgaaggagtagcgttcgtgactgtcatctg

SEQ ID NO: 97405 - DNA, 73 bp, Homo sapiens; identical to SEQ ID NO: 41143
  chr7:2966469-2966542
  hypo

SEQ ID NO: 97406 - DNA, 97 bp, Homo sapiens
  chr7:29679947-29680044
  hypo
gtgagggtgaccaattcagccttctgtgccaagttacctgccggcagtgcctgggcctgcggtatatctgtctccatagtaacggctgcaccagcct

SEQ ID NO: 97407 - DNA, 160 bp, Homo sapiens
  chr7:2972398-2972558
  hypo
gacgacaagacacagcggctcccctgggcttgaatcaggcagctgctggtatagacaagctctcctcccagggcggccgtgtaatatggctcatggcagaagacaggacaggagccaagagcggcagaggggaccaagtgatgtgcggggagtgtgaagc

SEQ ID NO: 97408 - DNA, 67 bp, Homo sapiens
  chr7:297499-297566
  hypo
agcaaagcatggaggcgagtaactcgggcaggaggacgtccattcccaggctcggaggcctcagaga

SEQ ID NO: 97409 - DNA, 63 bp, Homo sapiens
  chr7:2976839-2976902
  hypo
gtctgagcttcatctcgggagtggaaggcctgccagggagaagcgggacgaaggctgctttgg

SEQ ID NO: 97410 - DNA, 124 bp, Homo sapiens
  chr7:29845873-29845997
  hyper
tgctgggccgtgtgccgcccgcgcaacagctcctatttggggaattccagccttaggcctcagtctctccgcagctgagacttgggactctgtacccgggaggcgcgcccgccgacttgggacc

SEQ ID NO: 97411 - DNA, 547 bp, Homo sapiens
  chr7:29846202-29846749
  hyper
ctgcgggacggagcccggagccggaggcggcggcggcggagacgtcggccggagctcgagtccagtccagcccccggctccgccacctgcaggtagcggcttcccgcgcgggtgcgggtcggtgcccgagggtggaaggaacgggcggtgtggcggccgccgccctggtcggtcccggagcagagtggcccggcccgggacagagatcctgagggcgtgggagggccggggaacccccgccgggctgcagccccgggcccaggaggttgtcgacgtgccgcgcggcgctcacgccccccacccgcaccctgccacgccgccccggccgggccgggccgggccgggcggaaacaaaccgcggggtggggagcgaggtcaccacggggttgcttggtgacttctccggactggactccccggtgagcagcccctggcaccgaggccgcctcggcctggtccttcgcgacgctctctcttctccgcttcgcccccggaacaaaaggctggggtctcgctggggagggggctgtcgcgggaagggctgggg

SEQ ID NO: 97412 - DNA, 38 bp, Homo sapiens; identical to SEQ ID NO: 41244
  chr7:29876677-29876715
  hypo

SEQ ID NO: 97413 - DNA, 218 bp, Homo sapiens
  chr7:29883063-29883281
  hypo
taagccgctcgcaggcggtgtctgagctgagggttacggcaggaaggtgacagggggtacaatgccaaagggtgaccctagggtttgtctctggagcaatgattcctaactggagctttctgttatacccaaatcttctggctctttgccttggaaatattttaagattccagggtaactaacgattcctagaaaactgccagcgaacctttcctccc

SEQ ID NO: 97414 - DNA, 30 bp, Homo sapiens
  chr7:29884235-29884265
  hypo
ctccagctgcgtgaacgggttcagtaagtg

SEQ ID NO: 97415 - DNA, 30 bp, Homo sapiens
  chr7:29966074-29966104
  hypo
ctttcgatgatggcacgtgcccactcgtgg

SEQ ID NO: 97416 - DNA, 30 bp, Homo sapiens
  chr7:29977605-29977635
  hypo
aatcagaattggaaacgtctctgcctcttg

SEQ ID NO: 97417 - DNA, 369 bp, Homo sapiens
  chr7:30028510-30028879
  hyper
atttctctcggccctcgcgagtgaggtcgccaaatactcgacgcctcaagagcgagccgaggaggcagaggccgaccaagccggcctctcggcagccccgcccggcgccccgcggagaacgcccgggtgcggctcgagggaagttgtgtcaagtcccacgcgcggcccgcggagaacccaggggcggcccgcgcgcgtcggcctagcggggagggctgctccgggacacggtgcggcggccgcgggcgagttggacgcgctggcagagccgggccgaaggcggcgggcgtctccgggcagccatgttcgcggcgcccgcccgcgcagcaggtacggcacctcggggaaggtgcccggctcgccccagac

SEQ ID NO: 97418 - DNA, 54 bp, Homo sapiens
  chr7:30029248-30029302
  hyper
gcggctcacctggggcggcgggctccgggctccgctctccgctctgcggtgctg

SEQ ID NO: 97419 - DNA, 38 bp, Homo sapiens
  chr7:30180528-30180566
  hypo
ttacaaatgaatacacgaggctccggttaaacattgcg

SEQ ID NO: 97420 - DNA, 153 bp, Homo sapiens
  chr7:30206381-30206534
  hypo
caccctcaataccaccgccactgctggatgactgtcgtgctattgtgcagaaggaataagtgcaaatctgagaccccatttcaaaggcaaacacaattcacttttgagctcatcgggttgtttggatcatctctgccacgattttctccattc

SEQ ID NO: 97421 - DNA, 173 bp, Homo sapiens
  chr7:3026166-3026339
  hypo
aggattaaatgttaccggtaagctgagtttgtgtaaatcaaactctcttctccccattgactggatttagagctgactcctcacctatgcaactgccctccacagcccctgctcacagcctcaaattcctcactcaaagtgtcgcccatcggccgcagcgtcagcaggtgctt

SEQ ID NO: 97422 - DNA, 321 bp, Homo sapiens; identical to SEQ ID NO: 41146
  chr7:3033477-3033798
  hypo

SEQ ID NO: 97423 - DNA, 38 bp, Homo sapiens
  chr7:30340811-30340849
  hypo
aaaggggccaggtgccgtggctcaagcctgtaatccta

SEQ ID NO: 97424 - DNA, 30 bp, Homo sapiens
  chr7:3044096-3044126
  hypo
accgtgaagataccacgtgccttcccaggt

SEQ ID NO: 97425 - DNA, 59 bp, Homo sapiens
  chr7:3052608-3052667
  hypo
aaaaaaggactctcccgctgtcttgaggggaatctaaatgggtccggccagtttttgag

SEQ ID NO: 97426 - DNA, 41 bp, Homo sapiens
  chr7:30565248-30565289
  hypo
cattgtctgagtcaccgctccatgatgggggagggaaacac

SEQ ID NO: 97427 - DNA, 45 bp, Homo sapiens
  chr7:30603391-30603436
  hypo
tgctcctgctgaagccgctgggggaggctccgtgtagtttctggg

SEQ ID NO: 97428 - DNA, 190 bp, Homo sapiens
  chr7:30687808-30687998
  hypo
ggaggcctgctgcagcgctgtatgggagggccccgaggcctaaacaaacaaatacctaagaggaaaatctggcagaaactcagtcaacacagggcagtgatgccctctgcccattcctcctgctaattaacatgtctaagtggcacagccccctcaggaaaattaacggcaccttcgaggcagagcctgg

SEQ ID NO: 97429 - DNA, 114 bp, Homo sapiens
  chr7:306957-307071
  hypo
gggcgtggcggtgcccgctgggcccgtaccagccataccctagcctaggttgcccaggtcggccacccagctaggctactgtggggggctccggccagccggccccttcccaga

SEQ ID NO: 97430 - DNA, 30 bp, Homo sapiens; identical to SEQ ID NO: 41248
  chr7:30699730-30699760
  hypo

SEQ ID NO: 97431 - DNA, 741 bp, Homo sapiens; identical to SEQ ID NO: 31193
  chr7:30721202-30721943
  hyper

SEQ ID NO: 97432 - DNA, 96 bp, Homo sapiens; identical to SEQ ID NO: 31194
  chr7:30722018-30722114
  hyper

SEQ ID NO: 97433 - DNA, 343 bp, Homo sapiens
  chr7:30722115-30722458
  hyper
ggtacagccgctccgccgcggccaatggctgcgccggggggcggggccgggcggctcctctcggaggggctcagtctccagcccccgggccctccaccctgcccaaagtacggcttctcagttcgcagctctcttccactcgcggcgtccagaggagggcggtgggctggagagcgtgggcctggggtgacggaatgctctgtgcggggatcgcaggcccccgagctgcagggggcagcaaagcgcgcccacctgcccgcctgcccgaggagaacaccgcagctctgctaatcgagggacagccgcaacccaaagttcggcagctttccgcctgagcttcccc

SEQ ID NO: 97434 - DNA, 30 bp, Homo sapiens
  chr7:3074446-3074476
  hypo
ggcccggtaaaaggccgtcctttaagaagg

SEQ ID NO: 97435 - DNA, 165 bp, Homo sapiens
  chr7:30744677-30744842
  hypo
gagtctaaggaaagccggcacctgtcgagaaacggacctctgccctgcatttggggccaccacacagaccacatctctgcctgtgactaagactgctcagacccagtgccataggagacgaggtgccttgggtcccgcagagggagctcccggctccaccccaac

SEQ ID NO: 97436 - DNA, 58 bp, Homo sapiens
  chr7:30780708-30780766
  hypo
cagcctggcctgcaccggctttggaaggtttctctggggagaacggactggggttggg

SEQ ID NO: 97437 - DNA, 162 bp, Homo sapiens
  chr7:3083126-3083288
  hyper
ggatacccccagcatcgcgggaccagcgggagccactcccatcccccgacgccccccccgccaccgtgtcatctcactgatgccccccatctcctccccgtgccctcttctcttcccccaactccccgcctcgtgctccccctccgccagctcccccatccc

SEQ ID NO: 97438 - DNA, 3 bp, Homo sapiens
  chr7:3083330-3083333
  hyper
cgc

SEQ ID NO: 97439 - DNA, 4 bp, Homo sapiens
  chr7:3083334-3083338
  hyper
gggc

SEQ ID NO: 97440 - DNA, 263 bp, Homo sapiens
  chr7:3083339-3083602
  hyper
cctcctccacgcaggcctccggcttcctccaggcgaccaggccctccgtccccccgggcccggagccgtcctccgaggggcgccgcccgcccaggggctgcagggccgggagggggctgcgggcggcgcgggcaggagtccgaaggccagaggaggcaggagagaaaaaaggagagaaagtatgtcataggctgggaggggcgggggagggaaatgcaaaacccgacaggaaatgagactaaaaaatgcgaaaggttagaaaa

SEQ ID NO: 97441 - DNA, 179 bp, Homo sapiens
  chr7:30899905-30900084
  hypo
cctctgctgtggattcgggggaggacagtgggggctctgtggcctcgtgcgccaggctgcctgctgcttgctgcttctgaccttattaaatgcgtgtgagtacacagcgctttccaacttctaatcctgccataatgatatgattcattcctggcgtggactcacgtgcatggagacca

SEQ ID NO: 97442 - DNA, 30 bp, Homo sapiens
  chr7:31018956-31018986
  hypo
agctgttacccagcccggggcaggtgcagc

SEQ ID NO: 97443 - DNA, 272 bp, Homo sapiens
  chr7:31091895-31092167
  hyper
gtgagcagggggaggcggtggtcggtcgcctccctccagcgcccagcctggcttcgcggcggaggcggcgcctctcccgcaggacggagccaagctggactgccgcgccgcgcggggcgggcaaagggggcgctgcgctcggccccgggcagggagtgacggcggcggcggcggctccgggcgagcgtggtccccgcgtgcgcacacgcacacgccgccgcgcagggacacacggaccccggccgccagccggccacacaggcgcggagacc

SEQ ID NO: 97444 - DNA, 458 bp, Homo sapiens; identical to SEQ ID NO: 31197
  chr7:31092241-31092699
  hyper

SEQ ID NO: 97445 - DNA, 167 bp, Homo sapiens; identical to SEQ ID NO: 8988
  chr7:31092713-31092880
  hyper

SEQ ID NO: 97446 - DNA, 296 bp, Homo sapiens; identical to SEQ ID NO: 8989
  chr7:31092894-31093190
  hyper

SEQ ID NO: 97447 - DNA, 84 bp, Homo sapiens; identical to SEQ ID NO: 41251
  chr7:31116600-31116684
  hypo

SEQ ID NO: 97448 - DNA, 248 bp, Homo sapiens
  chr7:31118287-31118535
  hypo
gcccgttggggctggcgcacactcacgtttgctcagcagagcattttctgggccctagctgccctcaggcagttacacgggctcaagatgggaggagctggaccttgggctacctggggagagggtgccacacacggggagcagtgccacagtgctgtcggtgacttgtggacgtgggcttggaggcgcgggtgtgcgatggcgcctccctgagagggaaggctgggtgggtgcggtgtcctgcagac

SEQ ID NO: 97449 - DNA, 40 bp, Homo sapiens
  chr7:31232678-31232718
  hyper
gcgggagcctggctgcggattgccgcgctgcccctagagg

SEQ ID NO: 97450 - DNA, 46 bp, Homo sapiens
  chr7:312592-312638
  hypo
agcccctcctcagctcgcagtccaagggacccgtaaatgtgtgagc

SEQ ID NO: 97451 - DNA, 221 bp, Homo sapiens
  chr7:31375997-31376218
  hyper
cggctcaggaagtcccgccagccgtgggaggagcagggcagggtcagctctcggctgcacttgggcaagagatagctggagctatcgccgcctgcgccgcgtccctgcttgtggcacaaggggcgggtgaaggggcaaccccctttctccctctccgagcgagtgcggggcagagcctccaggcccgcgcgcggcggtgcgctcgccgctctccatgccac

SEQ ID NO: 97452 - DNA, 158 bp, Homo sapiens
  chr7:31518808-31518966
  hypo
tcccctgccctgcttcggtccagcatggtgcccgatacattttaagtactgtaaagtgaaatgtttgaggatttggacaggtgcatttggtctggaagaagactagatgagggattagtacctgagttcagtttatcacctgccggtgggcaggccac

SEQ ID NO: 97453 - DNA, 159 bp, Homo sapiens
  chr7:31528357-31528516
  hyper
taactccaaggagcccgggtatcattgtagtccatgtcaatggcgccccctggtgttcgggggcgcagcagccctgtgcgagtcctgcagcaggccctcctggcccatccactcggtataccccacttaacttttttgcgggggcggtttcatttttgc

SEQ ID NO: 97454 - DNA, 34 bp, Homo sapiens
  chr7:31939253-31939287
  hypo
aaaaggaggcttccacgtgcgggagacagagaag

SEQ ID NO: 97455 - DNA, 49 bp, Homo sapiens
  chr7:32110065-32110114
  hyper
tctcctcgcccagctcgcgatgcccagccaggcgcggcgcgcgtttgcc

SEQ ID NO: 97456 - DNA, 343 bp, Homo sapiens
  chr7:32110180-32110523
  hyper
cggcaaaccatggccccaggtgcgctccggaggcagctgcgggaaccagccatggtcccgggctaatgcccagggataagcacagggatagggatagagatagggattgggattggactccagctccaagagaaagcacctcgggtctattcgtattctccccctacccccaaacaaagccacagaagcgatcagcgcgcagctaaagggtttggaggtgaaaaggagggctgggtggggaggagagaaagtgagaagggagagaaaagcggcggctgagcaaagcgggagccggcgcgggcggtggggcctgacccggacgccgcgcacccggctccgcccc

SEQ ID NO: 97457 - DNA, 126 bp, Homo sapiens
  chr7:32110524-32110650
  hyper
cgcccagcgccccgctcactccctggccgcgcctgccttcgcgcccctctgttttctctcacttaccagcagctctgctgacaagcgagaaaactgacaagtgagaaaagtcgtctgtcagcgccc

SEQ ID NO: 97458 - DNA, 41 bp, Homo sapiens
  chr7:32110651-32110692
  hyper
ggctggtgtctgggctgtcaccgcgggcgcggagggagggg

SEQ ID NO: 97459 - DNA, 379 bp, Homo sapiens
  chr7:32110703-32111082
  hyper
cgccgtctgccgggcacacgctgggctccgaccccggccgggcacactcacccccgcagggcagccgcggccaccaccgacctgcggagctgcgtgggcttccggaaccctcacctcaacaagagctcggctccgcgcgcaagtaggagggaagggaaatccttatcctcccggggccagggcacgcagaagccgcgaggcttcgcggaggttgggcctggaggtcccccacagcctcactctcgcacccgccacagaaccggatccattttgaaatattgaagcgactgatggggacgaagggaaccacacaccacactcaaaaactcttgatgttttcttgctaaaggggctctctcgctcgcgctctctctcctcc

SEQ ID NO: 97460 - DNA, 158 bp, Homo sapiens; identical to SEQ ID NO: 41253
  chr7:32128181-32128339
  hypo

SEQ ID NO: 97461 - DNA, 216 bp, Homo sapiens
  chr7:322599-322815
  hypo
actccatcttcacagcgaagacgtctgatgggcgtcccgttacctggctctgtgtggccggctcaggagactccctgaggcctgtcctgctgagcgctgggggagggtgctgctgccaagtgggcatcgggctgccggcccctcctcccagaatgccaccttcactctcctaaggggacccagatccccatcctgtctgcccggggccctgttaac

SEQ ID NO: 97462 - DNA, 16 bp, Homo sapiens
  chr7:32276939-32276955
  hypo
ccgcccatctcggcta

SEQ ID NO: 97463 - DNA, 30 bp, Homo sapiens; identical to SEQ ID NO: 41255
  chr7:32323599-32323629
  hypo

SEQ ID NO: 97464 - DNA, 217 bp, Homo sapiens
  chr7:32337766-32337983
  hyper
gtctgtcttgacgtccgcctctatctctggggcctaggtgtttctatcagtgtccccgtgtctggatgttcctgccgctctgtctgtgtgtctctatcatgtccacatcttcctgtcgctttctgtctccctctctcggcactatcttcatctctccatcgcagcgtctccagccctatttccacccctcctttcccccggcctgccttattaaaat

SEQ ID NO: 97465 - DNA, 175 bp, Homo sapiens; identical to SEQ ID NO: 31206
  chr7:32338043-32338218
  hyper

SEQ ID NO: 97466 - DNA, 814 bp, Homo sapiens
  chr7:32338283-32339097
  hyper
cgatgctgaaagtggcgctccggcattttttgaagccctccttcctgttgccggcgtccgtcatggctcggccggccgggcaggggcctcgcagcgagaccagcggcgtctgcggtcccccccacggcggagtgagcagcccggggctcggcggcgaatcctcccccggccgcgccgcgctgtcactctcagccccgccgcgcgctggcagctgagcgcctggagacaacagcggggacccaatgtcaacagctaaagcgctaggagctcggcggaggcaggagccgtcgcgactgccccatctccaagccgagttccagaggcggcgagaggagtgtcaggaagggaggacgcgcgcccgagcgcgtggacggggctgaccggtgggcgcggagatccctgcctggccacgctactctctgtcagccgcggatcccgcgcgccacaggaaagtctgttttctacttcaccttctccttccgtctctggtggctggggggatttggggacccaagggaatggctgaattggcgtcgtgcgtcttctagatatgttttctctggcagaccggggagcttccagaaagcacatcaacagatggaaaggcaaacccctcagccatgagatgttgccgaagtttactccaaacaaggaagtcgggaaaatcgccacgcccacttccttctagccactgcccccagcactggcctggagccccgatagtgtttcttctccactgtccctgccaggaaggtaattgtcaaagtcaccggaggctctatgatgtgaaatgtacaatcgaattagaactcgc

SEQ ID NO: 97467 - DNA, 497 bp, Homo sapiens
  chr7:32467159-32467656
  hyper
ttctccccatggtgccggccccggtactaagctggggaaagggatccttagggtgtaaactgtcttgccacctactgtttaaacctctgtgaaagataagccttctgaaatagcctcctattcaacccagaaatcaatcctaacttgtaaaagaagttatggacacgaggacgagaaacgggaaatcctgcgggagatagcgctttctcttttcccccagaaagtctccaggcagcagctctgtgagatccttaagcaaggtaaggaaactcacccgctgcgctgcggcttcgtggccagcagggctgggacatactcgcctcacgcttcagcaccggggacagctcctgcctcgccaacttcggcagctcttctcgatgtctcgccgcgggctgtgcctcacaggctacgggaggggagagtgtctccccacgccggggtcccggcctctgggttttagggagcgcgaatgggtctccgacagcaacgggagcagc

SEQ ID NO: 97468 - DNA, 116 bp, Homo sapiens; identical to SEQ ID NO: 31211
  chr7:32467946-32468062
  hyper

SEQ ID NO: 97469 - DNA, 30 bp, Homo sapiens; identical to SEQ ID NO: 8997
  chr7:32468472-32468502
  hyper

SEQ ID NO: 97470 - DNA, 89 bp, Homo sapiens
  chr7:32801573-32801662
  hyper
cgcgggcagtccctgcgtgtccccccacgtgctccccagcactcgcaggacccccgcctccgagcttccctgagcgtgcagcttccagt

SEQ ID NO: 97471 - DNA, 160 bp, Homo sapiens
  chr7:328246-328406
  hypo
gatgtgtctgagagccgctggatttgtgagattcactgctggtctttgagaacgtccccaaaacaggctgcagctcccgactggctgatcgccggctctctgtttcccttgcgcgtgtgggaatcaagtgattctcctgcctcagcctcctgagtagctg

SEQ ID NO: 97472 - DNA, 396 bp, Homo sapiens; identical to SEQ ID NO: 41147
  chr7:3283498-3283894
  hypo

SEQ ID NO: 97473 - DNA, 39 bp, Homo sapiens
  chr7:328586-328625
  hypo
tgacatccgattaaggggacaatacggagtcactgaagt

SEQ ID NO: 97474 - DNA, 25 bp, Homo sapiens
  chr7:3287058-3287083
  hypo
aatagggccaggcaccgtggctcac

SEQ ID NO: 97475 - DNA, 72 bp, Homo sapiens
  chr7:329622-329694
  hyper
cccggaaagcaccaccgagtctcaggcgcgcccagggcgcacgggaccggggctcacggcaccggggcgctc

SEQ ID NO: 97476 - DNA, 167 bp, Homo sapiens
  chr7:329764-329931
  hyper
cgagccctgccctgagcgccccaggaagggagccgggtagggggggccgccccgcccgtcggaccacccagcgcgccgcctcctcctccctccccccgcggcggtcagagggtcacccagacgccccacaccgctcccctcggccgctttaccggtggctggggcct

SEQ ID NO: 97477 - DNA, 158 bp, Homo sapiens
  chr7:32982112-32982270
  hyper
ttgaacttgcctgttcggtccacaaatgccgagcaagcgccaataactcttggcttccccaaaagaggcgacgcccacaccaaagcgggggcgaggagcgcaagccgctgccgcctccccgggccgaggcccccgcccacccgcgccgcggcctccag

SEQ ID NO: 97478 - DNA, 438 bp, Homo sapiens
  chr7:32996944-32997382
  hyper
gcacattcccaatgccgggcggggcagggcgcagcaggcccgccctcggcgcgcggccaggctgggctcctcccctggagctgcggccgggagggcgggcggccggggagacggggtggcggctgcagcccgggtagggccaggagacccggtccacgtttgcaaacgcagccgaacgcccaggccgacccgtgccgcccgagcgccgcgctgcgtccgcgccactcttctcgccgccccgatggcgttccggggctggaggcccccgccgccaccgctgctcctgctgctgctctgggtgaccgggcaggcagcgcccgtggcgggcctgggctccgacgcggagctgcagatcgagcggcgcttcgtgcccgacgagtgcccgcgcaccgtgcgcagcggcgacttcgtgcgctaccactacgtggggacgttccc

SEQ ID NO: 97479 - DNA, 253 bp, Homo sapiens; identical to SEQ ID NO: 30964
  chr7:330425-330678
  hyper

SEQ ID NO: 97480 - DNA, 108 bp, Homo sapiens
  chr7:330720-330828
  hyper
cgccaaccagcgcgcctggcagaactccatccgccacaacctgtccctcaacagctgcttcgtcaaggtgagcgccgcccccgacgggccccgggtgtcccagcgtgg

SEQ ID NO: 97481 - DNA, 884 bp, Homo sapiens
  chr7:3339931-3340815
  hyper
ttacatgatctcatgcgaccatcatcacacgtccccaggctcctcccgggccaactccagaggcagtgcgtgtcacctccagctctcctcccacaaaaatgctggcctttcagcctccagtgcgcttagttcaccccataaactctgctaatgcttaccacatgctgagcgtcggcgcccgtccccacccccagccccacaggctcccgggtcccgccctgggagaccctcccactggccgaccctgccccaagactcgcccactccacggtgggaaacctgcaatgtgtccctccctaccccgccctcctccagcgccggccaaaagtgaccttggacgcttctacaatgccatatccactcctctgaacaggaggcgagtttgcacccagtggtgcctttggttgctagaaattaaaaacccgattgcgcgtgtttgcaattacggtaacttggcgcgtcacccccaagcactgagctagctggtggtagccgggcgcctctcggggcgcgccctattccgccctcggccctgggctgccgcacgatctgcgcgtcctgctgcacctgagcccttcccactcgggcgcccgcaccgctgcggggccgggcgaggatgcaccacccccgcccgcgagcccgccacgggagcgcgtgccgaatcgacgccgcctgcagtccccactacgggtccctagggggcgcagccggcgcgggaagccgcccgagccaggcgccgcggccggcacaaaattgcaggcgggcgggcgccgcgactttgaaaacaagcgagggcctggggggcgggccctgggagcgggcgccgcctccctcggccaatcaacggcgggcggcgggcggcgggcgcgggcggcgcgtgcggc

SEQ ID NO: 97482 - DNA, 123 bp, Homo sapiens; identical to SEQ ID NO: 31017
  chr7:3341286-3341409
  hyper

SEQ ID NO: 97483 - DNA, 715 bp, Homo sapiens
  chr7:3341569-3342284
  hyper
cgaacttgagcagcgagagtgtgtccggggtccccccgcttcccggcccgggtcgggatgcgccttgctgggggctctagggagcccaggggctcctccacgccagactcggaggagagggaaacggagccccgtagagcctgcaccccgtctgctactttgcgttttattttttttataccgcagtagcacaaacaaaaatttttaagttgaggacccatttctcagctccttaaaaggatgcccgagtccccttcccattgcatggatgaaaaaggggctggtctgtacctgagtcttcgcaccgcagggtctggtttccggtgagtgacatccagaagacttggaaatatcaagtgccagtcgctgtgaaaagccttttccagcccctccccagggcctcgtcctctccccagcccccgcctgctcctgactcccccaagtcccaaagcccgaccccaagtgggtgctgcgcggccggtggagcaaaactttcagtgcccacagcttttgcacttggctttgtttttctccctctattggcttctgtttagaatacagtggtgagctctgaaatagggaaagaggatctgctgaatggaaatgaccttttgaaacgagagatgggatctcttgtgaaacgagctttccttcccaaatctgggcttccctccaccccctccccgcccccgacaaaacccgtaacgtacccctg

SEQ ID NO: 97484 - DNA, 77 bp, Homo sapiens
  chr7:33545157-33545234
  hypo
ggtgattctgctgatcgcgctgtggcagaagcttagtgctgaccaggttgctattctggaagcggcatttctgccgc

SEQ ID NO: 97485 - DNA, 2103 bp, Homo sapiens
  chr7:33943451-33945554
  hyper
ctcgcatcagctcctcggtgtgtcgcgatgttggcaatgttgcactaattaagtgaagtctccaaatcactcgaaaaaacgaataaacagtcaacgaggcagggaagggttaaggtgaagctagattaaacctgtcagcaaacagactcatttattttcaaagctgtagtttccacaatggaaacaacccactttgcctggagacccttaggtccgttccgtggggacccggtttcaactcttggacagaggaagtcggtagtccaccgtgagctcaaggacagctagctgatcgtcaggtcccaacacttgccaagcgtccctcactcccacctcgcgccttcgtactttggttacaaaaatcatctctctgcgattgcaccccttttgagtagagggtgccactgcgtggggaggaggcggcgattcagcagggggatcacaggagctgactccccgacacccagtgctgcagaggcgagagggcgcagccgggctgagagagcgacggagctccgagctgcagaggccgccgcgcggcggcccccgccagagatgagcggtggggcgggggttcctccctcttttcgggtgaatgaatgattagtcaaacaccacctccccgccccggtccgcccgagattggaagggaggagtctcggagcgactgttcattttttaaggacgaaaggcgtttgcctcggtacgtttttaaatcgaccttgtgtgtgtttcaacttcggtcatccctagtgtcaggacgcgcagacagctaagcacagaacacatctctaaggccacttgcccctctgtccgctcagccccctgagttcgctgtcgcgcccccgccagagggaagcaaagcagggcatgaaaagttgcgggggccctactgccccgggtgtgtcgctccttcccaaaggtggggcacccgggagcgagcagggtggtggggcgcccctgcgtcccgtttgctgctccctcgctggattggggcacccgggcctgagcgctagtgctgcggcatccccggggctcccccaagaaagggaggaggagccgcgctcgcccggacagtggagacgcgccttctcggctctggtccgcgccctggggccctggcctccctggaggggctggggaactggaagctgggccgagagagttcccgctgcagctatcgcgcagtccctcctgcgcccgggcgcccccagcgggttccgggaggcgcccggtgagcccacgtctgttgcggcggagcgagcgcgctccgggagggccgagagccggcggggctggcaggaggtgaggagtgcgggagtggaggacgctgcggcagcgacagcgacagcccccgaaacagtagcggcagcccgggcggcggctgagcggcagtgcgcagtcggcagcgccgcagctcctctcagtctatctccggctgccgcaacaccccttcctcctggccccctctccggcgctgaggggctgactgctaagccactgcaagcaactccctcaggaaaaaaaaaaaaaaagccgcatcggaggagcctggccgcaggacccctcctccccgggcgcccccacaccttggtctctccccccgccctccctcacacccccccgccccccagctctcgggcgcccgcctccctccttcgcggacggtctcccgacacgccggctgagagcccttttcgactgtgagctgcggcagctgagcagaggcggcggcgcgggacctgcagtcgccagggattccctccaggtgacgatgctctggttctccggcgtcggggctctggctgagcgttactgccgccgctcgcctgggattacgtgctgcgtcttgctgctactcaattgctcgggggtccccatgtctctggcttcctccttcttgacaggtaggggagggggcgggagggaccggccctccgggacgccggtttggtacctgggaaaggtggcgctggcttgccccggggatgggagggtggggagcgcgcaccttggcgcttgccctgcgctggtcgatggggatgaagcgaagccccgggagggctgggaaggctggtgaagaggttgcgggctgagaggctg

SEQ ID NO: 97486 - DNA, 30 bp, Homo sapiens
  chr7:33963977-33964007
  hypo
gcttctcctctcacccggaatccagcttga

SEQ ID NO: 97487 - DNA, 30 bp, Homo sapiens
  chr7:341655-341685
  hypo
ccccagctgacctcccgaagctcctgtacc

SEQ ID NO: 97488 - DNA, 313 bp, Homo sapiens
  chr7:345295-345608
  hypo
gctcctggagcttcccggagctggtcctccagtagaggtgctggggatggggggacgcagccacggccttcatgcaccaacctggggtctccacgagcaaactctgtgttcaaggaggcactcggcctggggacgcggtgggaagagctatcggaggagcccctcggagctgcctcagcacagctgatgaaagcaatcagcgcccgcctgagctggatgtaaaggttaatacataaatcaaagggaaatgtcaggtgccttttaacactgattgagatgtaattgggcagggaccgtgcgccaggcacccgcg

SEQ ID NO: 97489 - DNA, 25 bp, Homo sapiens
  chr7:35190140-35190165
  hypo
atcttttttttgagacggggtcttg

SEQ ID NO: 97490 - DNA, 561 bp, Homo sapiens; identical to SEQ ID NO: 31218
  chr7:35225273-35225834
  hyper

SEQ ID NO: 97491 - DNA, 479 bp, Homo sapiens; identical to SEQ ID NO: 31219
  chr7:35226044-35226523
  hyper

SEQ ID NO: 97492 - DNA, 54 bp, Homo sapiens; identical to SEQ ID NO: 31220
  chr7:35226556-35226610
  hyper

SEQ ID NO: 97493 - DNA, 117 bp, Homo sapiens
  chr7:35226611-35226728
  hyper
ccacttccttggcacggaacagcgtttactgaatcttagagcaaaatgcttttccaatgaggttcctcagaagtcatcggccctaggagcggtgtgctcaagcgctttcagcaccag

SEQ ID NO: 97494 - DNA, 210 bp, Homo sapiens; identical to SEQ ID NO: 31222
  chr7:35292877-35293087
  hyper

SEQ ID NO: 97495 - DNA, 296 bp, Homo sapiens; identical to SEQ ID NO: 673
  chr7:35293182-35293478
  hyper

SEQ ID NO: 97496 - DNA, 646 bp, Homo sapiens
  chr7:35294031-35294677
  hyper
cgcccgagatccgggcatggcccagttggggaagctatgaccagaccagtggaagcctcgggagttctcgctttttccattctttttcttacctgcgctcaaagttccaaaagaaagtagggaagcgctcagtagaatccggcgcctctgagccggcgccaactggccaggtccatactcggggcagatcccagggctgggactctcattcgatggtcccaaatttgatctctttgacagtggggctgagcaaatgcagccctgaaaaagataagcttagcgagagctgcgggcatttggcaaaggatgctgctctcagaaccgtggcttctgctcctcaccagtgcgtctctagcctggggctcctattttccctagagggaccctggaaaatgggacggctgccgaagagaaggcgaaggtcagggcgcggagctctacggtaaccacgcgacgcgtagtgggagagtgcgaaccttatggtagcgcccggactaagcggacacagacccctctggttttacaaaggcggctgtgacgaggacttcccacggccttgttggagggcgtcctgttagccctgctcagcctgaataactcaaattctccgaattcgcagggtaatccgcttcgcttggagccgtgt

SEQ ID NO: 97497 - DNA, 29 bp, Homo sapiens
  chr7:35295077-35295106
  hyper
gctggaaggaatttacgctgtcttctagc

SEQ ID NO: 97498 - DNA, 32 bp, Homo sapiens
  chr7:35295864-35295896
  hyper
ctttccaagtgcctacgcggccttagcccagc

SEQ ID NO: 97499 - DNA, 266 bp, Homo sapiens; identical to SEQ ID NO: 31226
  chr7:35296739-35297005
  hyper

SEQ ID NO: 97500 - DNA, 217 bp, Homo sapiens; identical to SEQ ID NO: 676
  chr7:35297137-35297354
  hyper

SEQ ID NO: 97501 - DNA, 547 bp, Homo sapiens; identical to SEQ ID NO: 677
  chr7:35297470-35298017
  hyper

SEQ ID NO: 97502 - DNA, 51 bp, Homo sapiens
  chr7:35298121-35298172
  hyper
cgagctcactaccgcagggaccggccctcagagccccgggcctcctcccgg

SEQ ID NO: 97503 - DNA, 231 bp, Homo sapiens
  chr7:35300778-35301009
  hyper
ggtctttctgccgcacgtggacaacgggcccgggcggcctttgtaatgttattttttcttttctgaagataattacctagtattctgcaggttcctctggtgcaacagagactgccgcggggcgggggagaaggtggtgaggggggtcgcgcatcgctcagtgcaggtctgtgctttcacttggcctgcgctcaggtcagtgcgccccttaccggagcacccatggcctcc

SEQ ID NO: 97504 - DNA, 865 bp, Homo sapiens
  chr7:35301101-35301966
  hyper
cggagccttagtttccctagttgtgaagagggagggtgtgaccatggcccggagctctccgaaaggctgtgcggattgctcggtggcgggatgtggagcgcgtcttctatgatgccaggtgctggccaagcgctcgatgcaggctgctccagttaggtcgatgcgatggcgggaagcactttcctctgcaatggagagacgccgacaccccgagcccgaaggcttgcaaggcgcgctctcgccactggggtcggggatccgtgggttctctatcccgcttacccactccatccttagcagctgtcgtcggtcccagacctctaccttggagagaccaaggcggcccagagcccaggagactactgcgcggtacgccaggatccagaagtggattctgacttctaaagacccctcccaagccaacgctatcagggtccctgcaagcggttgactgtggcggaggcagaaccaaaacctttgctctgcccgcggcgctccagcctctcacccaggacagtgctctgggctccagccgctgcagtggggtcgggacacagacgccgagttagaagccccgccgctgcaggtccctgcttggtcggcgcggtgacggtgtcgctggcggcggcgggggccttcctttggctgcccggccatttaatcagagctattatcagacagggcttgcaggatggcgccggccgagctttacccccattagcacagggcaggctgggggctgggtcctgaggccaccgccggtcccggccagctgcagcttttctggggagctatgagaaaggcaggcctggtggctccggccttctctacccggccactctcaggctgacgagttattagaatt

SEQ ID NO: 97505 - DNA, 25 bp, Homo sapiens
  chr7:35327606-35327631
  hypo
catgagccaccgagcctggccagaa

SEQ ID NO: 97506 - DNA, 87 bp, Homo sapiens
  chr7:35350106-35350193
  hypo
ctcactccctggaagcgatcactgctaattacatccagttagaatgctcaagcaagcaggtttcttttttttttcttttctttttgt

SEQ ID NO: 97507 - DNA, 4 bp, Homo sapiens
  chr7:35494329-35494333
  hyper
gcgc

SEQ ID NO: 97508 - DNA, 6 bp, Homo sapiens
  chr7:35494469-35494475
  hyper
cgccag

SEQ ID NO: 97509 - DNA, 30 bp, Homo sapiens
  chr7:355057-355087
  hypo
tcactctgtgtttgccgtggttttacctta

SEQ ID NO: 97510 - DNA, 185 bp, Homo sapiens
  chr7:35579059-35579244
  hypo
actcagtggctgacacggtagagattcagtatatgtctgtttgttgaaaccaggcccgataatatgaaagcaaggttctttctacacagatgaatagactgaatggccaaaaacatcatttgccaaaggtattctgggaacagcactgtcttgggatgttaataaatgtgcgtcaaacgtgggct

SEQ ID NO: 97511 - DNA, 30 bp, Homo sapiens
  chr7:35689006-35689036
  hypo
taaaacgttagtaatcgttgtcaacaaaaa

SEQ ID NO: 97512 - DNA, 138 bp, Homo sapiens
  chr7:35839940-35840078
  hyper
caatgggggctacagcggccgacctctggggctgtgccaggccactagagtgtgatggcgcgagggaagggtcggggaaacagggcctaacctcacttttcaccccgaaagtcaagatagccacggaaacagggatga

SEQ ID NO: 97513 - DNA, 88 bp, Homo sapiens; identical to SEQ ID NO: 41257
  chr7:36428640-36428728
  hypo

SEQ ID NO: 97514 - DNA, 30 bp, Homo sapiens
  chr7:36441223-36441253
  hypo
agacgtgagccacctcggcaggccacctga

SEQ ID NO: 97515 - DNA, 30 bp, Homo sapiens
  chr7:36923939-36923969
  hypo
tattctgaggcgctacgagctaaaattaat

SEQ ID NO: 97516 - DNA, 272 bp, Homo sapiens
  chr7:369844-370116
  hypo
gacaagttagcacaacgtttatggccacgaagttggcaacatcaataaaaatgtaaatgcatctgccctttggcccggcaattctgcttatcctatagataccattgcgcacaggtgaggccgtctatgtgtgaaattactcactgcagcattatttacaatggcctaaaagcccgttgataagaggttgttatataaatcataatagatccataaagtgaaacacaactgtaagaaaaacgaggaggctgggcacagtggctcacacctgc

SEQ ID NO: 97517 - DNA, 26 bp, Homo sapiens
  chr7:37025520-37025546
  hypo
tactcaccaagctcccgtaagtccat

SEQ ID NO: 97518 - DNA, 60 bp, Homo sapiens
  chr7:37136264-37136324
  hypo
agctctatactactgcggccaaagggacattcatgcttgtcttctcgactactgttctca

SEQ ID NO: 97519 - DNA, 39 bp, Homo sapiens
  chr7:37211371-37211410
  hypo
caggcgtgagccaccacgcctggccgcctttctcttcta

SEQ ID NO: 97520 - DNA, 30 bp, Homo sapiens; identical to SEQ ID NO: 14984
  chr7:37264509-37264539
  hypo

SEQ ID NO: 97521 - DNA, 38 bp, Homo sapiens; identical to SEQ ID NO: 41148
  chr7:3727142-3727180
  hypo

SEQ ID NO: 97522 - DNA, 181 bp, Homo sapiens; identical to SEQ ID NO: 14985
  chr7:37279183-37279364
  hypo

SEQ ID NO: 97523 - DNA, 30 bp, Homo sapiens
  chr7:37347397-37347427
  hypo
ttgtcaatctctatgcgaattttaaaacaa

SEQ ID NO: 97524 - DNA, 119 bp, Homo sapiens; identical to SEQ ID NO: 41261
  chr7:37399153-37399272
  hypo

SEQ ID NO: 97525 - DNA, 24 bp, Homo sapiens
  chr7:37423707-37423731
  hypo
gtgcccggccgaaacatacaggtt

SEQ ID NO: 97526 - DNA, 208 bp, Homo sapiens
  chr7:37424312-37424520
  hypo
actccgtctcaaaaaaaaaaaaaagaactttccagtttgtttatttgtcaagaaaacagtaagttctagatctacttgagaggttgcctcagaaatctgacctcaacaaattacttctttcactctaatctgcaataaaactagcaacggttgtacacacaaaaaaagacatgagtaaaaatgcacacgaattcgtttgagcttgtga

SEQ ID NO: 97527 - DNA, 43 bp, Homo sapiens
  chr7:37446822-37446865
  hypo
tggatgagggtctggcgcggtggctcacgtctgtaatcctagc

SEQ ID NO: 97528 - DNA, 30 bp, Homo sapiens
  chr7:37484434-37484464
  hypo
agttaagtcaatagccgacagaactgcatc

SEQ ID NO: 97529 - DNA, 138 bp, Homo sapiens
  chr7:37487113-37487251
  hyper
ggtcaaggcaggtcccgacccgcctccaacttcaaatggccccctaggcgggagagggtcactgggcggggagttcctggctgtgcggtcacacacacacacaccgactcacacacacacccacaacaccccccccac

SEQ ID NO: 97530 - DNA, 83 bp, Homo sapiens
  chr7:37487371-37487454
  hyper
cggcacagcaccgacttcccaaccccaaacacacgcgcgcacccccgggacagctgagttctgtatttcctcttcctcaaagc

SEQ ID NO: 97531 - DNA, 211 bp, Homo sapiens; identical to SEQ ID NO: 31235
  chr7:37487755-37487966
  hyper

SEQ ID NO: 97532 - DNA, 1204 bp, Homo sapiens
  chr7:37487984-37489188
  hyper
cgcacctccagcgccccctccctccgctcccactcccactcccgccatccccggagctcagacttccccaactgcagagcgccccgacgcgcccgcagccctcaccctgccgagcgcggcggccacccccgcccgagccgcggcgcccccagggaggaaacaaaagtgtctccgcggcgcccggagtcccccggagcaggacgcctcctcccggccccagtcccggccccctcccctgccgcgccgaggtcagcgagtcggggcgcggcgccagcccaggaaactttacgaacctgcttggggtcgcaggacagcagcggcaagggttcccggcgatcagagctccggcgacccgccaccattgaaggggaactggaggctctgtcgcccagcgtggggccgcggcggcgtgggtggctctgcctctatcctgtgcccatcctcgcccgctcccgctcgccccagcacacgcacttacactctgggtcggccggctgctgcaccgccggctgccgctgctctcacttcctcttccttcctcctgctggccagagacacattttgcatctgcaaggcatccggagatcagccgcgaactctcctcccgagcggacgctgcggagttgcagccgccgcccccggcacctgcgccaggacactcgtggtctgcgcgttcgccttgcgcccgcaccctgcctggtccctgcccactgcactttgcctagggggatgcccacgactttttgaagtccccctacttaaaagacagaaatgtcaaacaccatgcatgcctcagatctgctataaataatatgtgtgcagagcatgacttcgatgagctcacacacggcgtttggaggcactaattaactccgtcaccctcatagcgccatctccgggaggccaaaagcgagtagcatcttttcacatccttttttaatttttggcaaccggttccggatattaaggggaaacttcggtgggctgtttgaacgctactttaagacgtgtttgttttgacgctgtgcctctacccttggacagagtggcaaaaaaaaaaaaaaaaagtttcctccctctccgtcgacatctatgtatttactaaccctgcaattgaaactacaagatgtatttctaaccaattaagccagggacttcctaattttgcataactttgcataaggcaagacgttccacccataat

SEQ ID NO: 97533 - DNA, 30 bp, Homo sapiens
  chr7:37533583-37533613
  hypo
caggcccttgcgtaacgggccccgctctcc

SEQ ID NO: 97534 - DNA, 30 bp, Homo sapiens; identical to SEQ ID NO: 41265
  chr7:37686948-37686978
  hypo

SEQ ID NO: 97535 - DNA, 33 bp, Homo sapiens
  chr7:3771086-3771119
  hypo
ccagctgacagcttccgacgagttgccagatga

SEQ ID NO: 97536 - DNA, 142 bp, Homo sapiens
  chr7:37727598-37727740
  hypo
gaatgcaaccacagacgatgcataaataaataagcttggctgtgatcagataaaaactgtgtttacaaaaacgagtggccagcccatgggatgtactttgctggcccatgaactatattgaatgcttcgtgtcaacttttaa

SEQ ID NO: 97537 - DNA, 146 bp, Homo sapiens
  chr7:37770953-37771099
  hypo
caagcaagtcatgcacgtggagaacgaggtgtctctctgaaagaaatgtagagagaaaattttaggtcaactaattaaaaattcccatcaatctctagaatagcatcccatatgcaaaggaatactctgtcgcccaggctggagtg

SEQ ID NO: 97538 - DNA, 178 bp, Homo sapiens
  chr7:37835728-37835906
  hypo
atggttatgatgttacgtatgatcttcaaaacaaatagccaatcaatgatcggtacaatcatcttcaatatcatagtgctgcactccatcctcctggtcagccttccgttccacctcagctattatgtcttagtcatctgggagcttggatttctttacctgccgagtggttagcatc

SEQ ID NO: 97539 - DNA, 187 bp, Homo sapiens
  chr7:37868787-37868974
  hypo
ctcagtagaaggctgcggtggttttgcttgccctcaggctgtatacccagttcttcatacctctcccaggctcctccagatctgcctcctgctgaccttgtacccagctgcagcgacaccgagctcctcacagcttcccaaagtgggctggcccctctcacgacagggtcatcgcacaggctccctc

SEQ ID NO: 97540 - DNA, 30 bp, Homo sapiens
  chr7:37888029-37888059
  hypo
gagagccttctgctccgatttgaggtgtat

SEQ ID NO: 97541 - DNA, 30 bp, Homo sapiens; identical to SEQ ID NO: 41268
  chr7:37907440-37907470
  hypo

SEQ ID NO: 97542 - DNA, 30 bp, Homo sapiens
  chr7:37953791-37953821
  hypo
aatggctttaacagacgacttaccatagct

SEQ ID NO: 97543 - DNA, 419 bp, Homo sapiens
  chr7:37955637-37956056
  hyper
tggcagccacagccccgggcgcctcctcgcctccctccatccttcctacggcctcaccctccgggaggtccgtgacgatggcttcaggcgagatgcacacgccacggtcatagacaggcagctcgtcgcaggccaggctttcgggccagctgtggttgtacatcttcatgaggggctcgcagtcgtcgcgcgcgcgttggcacaccgacttgcacggcttgatagggtcgtgcaggaactccagggtgcaaatgggcgcgtacatggcacagaggaagaagcgcagcacggcgctgcagttcacgtccaccagctcctcgtactgctcgatggccaggatggcgttctcctgcgtgctgtggtgcaggtggttgggcatccgcgtgatgttccagggcatgtgccggcacatagggatg

SEQ ID NO: 97544 - DNA, 308 bp, Homo sapiens; identical to SEQ ID NO: 31238
  chr7:37956260-37956568
  hyper

SEQ ID NO: 97545 - DNA, 373 bp, Homo sapiens
  chr7:37960164-37960537
  hyper
ccccctcttaaaacacgatgcctcccaggatgctagtggcaccactgccactgcatttcctgttggcagcagtgagcagtgaaaaccgaagcggcagaaggcagtggcagcaggcagtggcagcaggcagtggcccaggcagaaatagctcccgcgcgattcactggagccttccccgggccctggtcccggctaccgggactcgcgcgtccggatctcaaaagcggcagaggccaccgaagggacaggaagcactttggtccagaccacactcccggcacagtgcggaaagagccggcgggagccactctgatcccggacgcctcagcgcccccttgggcttgggcttgccctcgggccggggaaggctgac

SEQ ID NO: 97546 - DNA, 396 bp, Homo sapiens; identical to SEQ ID NO: 9019
  chr7:37960562-37960958
  hyper

SEQ ID NO: 97547 - DNA, 41 bp, Homo sapiens
  chr7:37961158-37961199
  hyper
ccctgcagtctagggcgtgtcttctgcgctatctcatttct

SEQ ID NO: 97548 - DNA, 30 bp, Homo sapiens
  chr7:37962835-37962865
  hypo
aatcttggagattgtcgtagtggtccaggt

SEQ ID NO: 97549 - DNA, 30 bp, Homo sapiens; identical to SEQ ID NO: 41269
  chr7:37969938-37969968
  hypo

SEQ ID NO: 97550 - DNA, 38 bp, Homo sapiens
  chr7:37973881-37973919
  hypo
ctgccattcttagcatgatggctcgtagttccaagatt

SEQ ID NO: 97551 - DNA, 30 bp, Homo sapiens
  chr7:38044515-38044545
  hypo
accataaggagagcacgatgcaccaggcat

SEQ ID NO: 97552 - DNA, 32 bp, Homo sapiens
  chr7:380766-380798
  hypo
gcctccggtgctggccgcggtccttgccactc

SEQ ID NO: 97553 - DNA, 30 bp, Homo sapiens; identical to SEQ ID NO: 41021
  chr7:381568-381598
  hypo

SEQ ID NO: 97554 - DNA, 37 bp, Homo sapiens; identical to SEQ ID NO: 41270
  chr7:38170685-38170722
  hypo

SEQ ID NO: 97555 - DNA, 30 bp, Homo sapiens
  chr7:38422917-38422947
  hypo
atttttatgtacctacgaacataaacatgc

SEQ ID NO: 97556 - DNA, 97 bp, Homo sapiens
  chr7:38508402-38508499
  hypo
tataagagcatattccgatgtgaccctggcttgtaaaaacttaatgtaaccagcagtagaacatacagacggccgggcgcggtggctcacgcctgta

SEQ ID NO: 97557 - DNA, 358 bp, Homo sapiens; identical to SEQ ID NO: 31241
  chr7:38670306-38670664
  hyper

SEQ ID NO: 97558 - DNA, 29 bp, Homo sapiens
  chr7:38670956-38670985
  hyper
cgggtccggggagctgcgaagagcagagc

SEQ ID NO: 97559 - DNA, 188 bp, Homo sapiens
  chr7:38670986-38671174
  hyper
cgcagcggggctggcggcggcgcggaggagcgggaggaggagcgggaggaggaggagagggccgagcaagggaggagcgggagaagcggcggggagccgcggagcgcggaggggtgagggcggggcgcggcggcgggaccagcttaaagcgacagagcgggggcgggatgcgtcgggactggctgtga

SEQ ID NO: 97560 - DNA, 79 bp, Homo sapiens
  chr7:38731677-38731756
  hypo
tggggttttacatgccggcatatttcccgggtcttgcgtcccttttcccatgattcttcccttagggtgggccaccaca

SEQ ID NO: 97561 - DNA, 195 bp, Homo sapiens
  chr7:38740329-38740524
  hypo
cttgttttctgagctcgctgggggattgatgctccacggagcgctgctgggaaacgctggaccagagccagttccaaagacttccttctgaaaatcctaggtttgttctgcaggtgtggcctaacagctccatcttttttgtgttcagaaacattcatcctgtgctatcacatgcggcatcgcctcaggtaagac

SEQ ID NO: 97562 - DNA, 30 bp, Homo sapiens
  chr7:38752794-38752824
  hypo
attcttgggcttacccgatggtcttagtac

SEQ ID NO: 97563 - DNA, 34 bp, Homo sapiens
  chr7:387990-388024
  hypo
cacagaggcccccaccgggcgtctgggggcaggg

SEQ ID NO: 97564 - DNA, 239 bp, Homo sapiens
  chr7:389663-389902
  hypo
accagcagggtgtcacggggcaagtacctcatgttcgagttctccacgccacagccttgctgctgagagaccacccactatggaaagagcaggcgtgcacagctatgggtcagcagggcctcagatggacggtctctccctctgcaggctgtggtcagcaggcccctggatgcaggctggccctggatggacggtcctcctctgcaggccgtgtttggtgagttcggttcacatgcatc

SEQ ID NO: 97565 - DNA, 536 bp, Homo sapiens
  chr7:39015528-39016064
  hyper
gggaagttgagcctccgatcgggtggcagcgcgtggggaacccaggctgcactacagaggacgcaggacgccaaaaccaccccggggctcacgccatccgcgcaccggctctgctgcctaagtccgaggacgcaggcggagggcgcggggctcccgggcgcccaggagggcggtgccgccggggtgcgctccaggcttggctgcaaaccccccaagaattagaaagcgggggcggctgctcagcggctgctgcggcctgggactgcagctcgcccctcctccgcaacttcccactggtcccgtcacctggctttctgtctagtgtccgcccaggcggggtcccaagaaggcgatgccaggagcagtcgcgccccctgccctctgtgagcccgcaggtttcgggcaagtttggctcagtccttgtcgatgctccaggctcggcttccctggcctccccttccctggccaaaggagatgatgggaagcctgaggttctgatctgggataactgcagaaacccccgggtaggacttcag

SEQ ID NO: 97566 - DNA, 30 bp, Homo sapiens
  chr7:39056562-39056592
  hypo
gagctctagggaacccgtgaatgtcataaa

SEQ ID NO: 97567 - DNA, 30 bp, Homo sapiens; identical to SEQ ID NO: 41273
  chr7:39192698-39192728
  hypo

SEQ ID NO: 97568 - DNA, 199 bp, Homo sapiens
  chr7:39317796-39317995
  hypo
gaaaagcagagaaggcgtttcggaaaagctcctgagataggatccatgggacactttggcatcactgtgatcagaaactggaagtaagctctttccatagatccaggcccaggagacacaaaccaatggcattgagcctgtttatggtcaccttctgcatggtgttgggggtaaggggagttggcgcacctggttttgc

SEQ ID NO: 97569 - DNA, 34 bp, Homo sapiens
  chr7:3942787-3942821
  hypo
tttttttgagacagacgagactccgtcgctcagg

SEQ ID NO: 97570 - DNA, 763 bp, Homo sapiens
  chr7:39453541-39454304
  hyper
aagatgccccacaaacgacggtcccctggtccgaggagccgggcagcgccgcgcagccgtctcgcgtgggacccacccgcgggcggagccaggcggcagggctgccccaccgagcttcaccccagcaacccctttaactttcttaaccctgtattccccaaccgaacacttcccagagttcacgctggcagagcccacttcaaaaaatgctgcaggaagccattcacactcattcctatccacgtttttaaaaatgcgaaatagtgatttaaatcagaacagaacctcttccaatgggggtttcctttgcaaccggggcttcgcggtgatttctgtgctgttttgagggcacacacctacataacacgtttgcagagataagggatctcaaactgttcccaaaagtcccagggactcgtaatatgcaaaccgagggcaaatgaacgtgggaggatccgaggcgctcgctgaaggggctctcctgcagtgcccaggcagagggagagtggagggggcggctgtggagtgaagggcggaagtgccctcgccgtcctgaggcctgggaccctcttgatggtaaatggcgctgttgagccccgatgcgcagggactccgcgggcggcggacttgacaggaagctttgctgcggggcggcccagctgcggacgcgcgggacgtcagggccccagcagaagcgccgggctgtgcgtccttaagactgcgggtgcggccccgcccaaggtcgccccgccctccatccttc

SEQ ID NO: 97571 - DNA, 57 bp, Homo sapiens
  chr7:39873278-39873335
  hyper
cagagaccttcttgtcggagattcgatgggaaaaaaacatcacgttgggagaaccgc

SEQ ID NO: 97572 - DNA, 30 bp, Homo sapiens
  chr7:3991878-3991908
  hypo
ctcttatttggctatcgtgatcggtgttca

SEQ ID NO: 97573 - DNA, 101 bp, Homo sapiens; identical to SEQ ID NO: 41275
  chr7:39921805-39921906
  hypo

SEQ ID NO: 97574 - DNA, 41 bp, Homo sapiens
  chr7:4000133-4000174
  hypo
gctgtgccacccttccggtgcagcggcgtgtcacccttcca

SEQ ID NO: 97575 - DNA, 30 bp, Homo sapiens
  chr7:4000394-4000424
  hypo
gagagaagagtaagacgaattttacgtgga

SEQ ID NO: 97576 - DNA, 30 bp, Homo sapiens
  chr7:4006028-4006058
  hypo
ggggttccggttaatcgttattgggtagca

SEQ ID NO: 97577 - DNA, 93 bp, Homo sapiens
  chr7:40157085-40157178
  hypo
gatgataacatggtatacgtattgttatgaaagtgaccgtgtccataaataggagaaatcccataactcctactacatcggttctaccttttg

SEQ ID NO: 97578 - DNA, 37 bp, Homo sapiens
  chr7:40401724-40401761
  hypo
aagttcaaccatgcccggcgcagtggctatcgcctgt

SEQ ID NO: 97579 - DNA, 142 bp, Homo sapiens
  chr7:40407687-40407829
  hypo
ctctattgtcatctccgaaagtcttccttgacctcttacttcctgcttttccctcgtaagtcagatctcacattataacattttagtctatacttttttattttgtgattatttatttatttatttttgagatggagtgttg

SEQ ID NO: 97580 - DNA, 188 bp, Homo sapiens
  chr7:4056761-4056949
  hypo
cagttatttccttatcgtgatgggcttccttcgtggcgcaggtaccgcctggctggccttcccggagagtaccagcagcggaacatcaccagcccggaggtgaactactgcctggtgacagacctgatcatctggacacagtatgagatacaggtggcggcgtacaacggggccggtctgggcgtctt

SEQ ID NO: 97581 - DNA, 159 bp, Homo sapiens
  chr7:40603511-40603670
  hypo
gtcccccagagatgtcgaggagacaaatacagatatcagtccttaaaagtccacagcacaatgagtgggatatgtatatacagagaaaaaaatatctagaagtaaacataccaaaacgtttcttatctttgggttgttgagttgtaggtgatttatttg

SEQ ID NO: 97582 - DNA, 30 bp, Homo sapiens
  chr7:4066497-4066527
  hypo
gactctaccaggtaacgaactcaccgctcc

SEQ ID NO: 97583 - DNA, 30 bp, Homo sapiens
  chr7:4070228-4070258
  hypo
cgggcttttcatacgcgccttggtgctatg

SEQ ID NO: 97584 - DNA, 30 bp, Homo sapiens
  chr7:40938913-40938943
  hypo
ctttatttacccctccgcctcccattttgg

SEQ ID NO: 97585 - DNA, 46 bp, Homo sapiens
  chr7:40943566-40943612
  hypo
gcagtactggatggccgctgcccaagcttggcgcagcttacatcac

SEQ ID NO: 97586 - DNA, 179 bp, Homo sapiens; identical to SEQ ID NO: 41023
  chr7:409602-409781
  hypo

SEQ ID NO: 97587 - DNA, 97 bp, Homo sapiens
  chr7:4096353-4096450
  hypo
acgctgcaccccacacgcccgagcccagagcagctactatgcagtgctgctcaaagagcccagccccaccagaacattccgccgtgggtcccaccag

SEQ ID NO: 97588 - DNA, 459 bp, Homo sapiens
  chr7:409986-410445
  hypo
aggaggcctcagcttcggactcagcccaggcctggcctcccgactcccaccaccaggggcctggctgtacctgtgggggctggagccccagggcagacacttcgcagactctgtgcagggccaggtgagccccagggcggagctggcagctgagggtgctccgtggctcggtgcactggccctgactcacgaatgccgcagcgcgtcctacgggaagccatgtcacagcctccgtcctgcagggcaaagggggctgctgcgggcaaagatggccagtgatcttctaggttactgggtgcaggaagcaggaaaaggcccagagacactctcagttcttccagaaagccctgggggatttgactttgaccacagtgcgtgcgtccaggtattacctcattccttggcttttcgctacagacagactgacctggctggccgggttgccgcctcccagtcaca

SEQ ID NO: 97589 - DNA, 30 bp, Homo sapiens
  chr7:41189426-41189456
  hyper
tgctgggtagggctccggtctccaccctcc

SEQ ID NO: 97590 - DNA, 30 bp, Homo sapiens
  chr7:4119957-4119987
  hypo
tggcattggtgaagccgtgcaatctgccac

SEQ ID NO: 97591 - DNA, 30 bp, Homo sapiens
  chr7:4139378-4139408
  hypo
tggggcgtgtgtgagcgggatgtgatggga

SEQ ID NO: 97592 - DNA, 30 bp, Homo sapiens
  chr7:4147449-4147479
  hypo
ctctgtgctgtggtgcgtgttctccattac

SEQ ID NO: 97593 - DNA, 30 bp, Homo sapiens
  chr7:414915-414945
  hypo
gtctcacaaagggtacggggtccgtgtcgg

SEQ ID NO: 97594 - DNA, 193 bp, Homo sapiens
  chr7:41699313-41699506
  hypo
gtctctttcatcccccgtaatatcccattgcaagagtacattaacctaggcaaccggcatagtgtcaatttctttgcttctcttggagggccataactgtcagtggaaattattttagttatgtcagctctgcagaggaaagtacaaaaacaagggagtctaagtccttggagttctacgtttgtctcagtct

SEQ ID NO: 97595 - DNA, 89 bp, Homo sapiens
  chr7:41745163-41745252
  hyper
gcaaatgtcagggagcgggacctgcggaggggccggctggctccccgcggacagaggcgagccgggagcgctcgcgcaccagccaactg

SEQ ID NO: 97596 - DNA, 96 bp, Homo sapiens
  chr7:41814070-41814166
  hypo
aatcacaataactttcgcaccaatctaataatatagagtgaccaaaagataaatcccttaaaaataagaaaactgttgggaggccgaggtgggcgg

SEQ ID NO: 97597 - DNA, 160 bp, Homo sapiens
  chr7:4183288-4183448
  hypo
gtgggccctggggtccgtggttccgagcaacggggacctggcgaggggatgctctccctttgctcacagatcggcatgggtgtttgcttctcccaggaagagtaggcacccatggggctccagcccgactctctcgtcactttctcgctggggacccatc

SEQ ID NO: 97598 - DNA, 30 bp, Homo sapiens
  chr7:41840845-41840875
  hypo
gaaaagaatgctacccggtacttggctcac

SEQ ID NO: 97599 - DNA, 43 bp, Homo sapiens
  chr7:41850638-41850681
  hypo
tagccatataaagaacggtaaaagaggccggcctgtaatcctc

SEQ ID NO: 97600 - DNA, 56 bp, Homo sapiens
  chr7:4187810-4187866
  hypo
cagaacgtgtgcttacggaggcaagtgctgatgaagtgagacgggagccctcctcc

SEQ ID NO: 97601 - DNA, 42 bp, Homo sapiens
  chr7:4189003-4189045
  hypo
ttcaccatgcaggtgcgagagctgcctcggggtgagtggcag

SEQ ID NO: 97602 - DNA, 30 bp, Homo sapiens; identical to SEQ ID NO: 41280
  chr7:41923780-41923810
  hypo

SEQ ID NO: 97603 - DNA, 30 bp, Homo sapiens; identical to SEQ ID NO: 41281
  chr7:41943672-41943702
  hypo

SEQ ID NO: 97604 - DNA, 17 bp, Homo sapiens
  chr7:41981795-41981812
  hypo
gggcgtggtggctcacg

SEQ ID NO: 97605 - DNA, 159 bp, Homo sapiens
  chr7:42005369-42005528
  hypo
ttaaatactgcaccacgtcgtccggcaggaaatcctcatcgttcaggttggcatcagcgtccatggtcagggactccagggtgacgttctcggtgatgctgggaggacagggggacgagtggaagtttcgggactggccgccctcgggccgcgtgtaat

SEQ ID NO: 97606 - DNA, 30 bp, Homo sapiens
  chr7:4206325-4206355
  hypo
cggcccgggggaccacggtggccggatcag

SEQ ID NO: 97607 - DNA, 30 bp, Homo sapiens
  chr7:4211243-4211273
  hypo
aggctggagcagagccggcaccaaggtccc

SEQ ID NO: 97608 - DNA, 172 bp, Homo sapiens
  chr7:4214921-4215093
  hypo
ctccctgggctctgtcgcaaaatcaaaacagcacagtagaagggccccgggatgcggctgggcttacgcacctggtcgcgcagctctccctgaggtggtttgctcggctcctccagccggggctccctgcgtgagcatgagtcagctgcacctgccccggggtgaccgggag

SEQ ID NO: 97609 - DNA, 50 bp, Homo sapiens
  chr7:4215324-4215374
  hypo
ctcccttgttcctgccgcacatcacctgcgatggccgtgtccctgcgtgc

SEQ ID NO: 97610 - DNA, 104 bp, Homo sapiens
  chr7:42267608-42267712
  hyper
aagggatgtttttcacgcctttcaccacttttgcccgcgcctgcgtcccctgcccgaggtcccaggccgcggcggcggcgcggtgggttcattagcgggcgcgc

SEQ ID NO: 97611 - DNA, 1 bp, Homo sapiens
  chr7:42267821-42267822
  hyper
c

SEQ ID NO: 97612 - DNA, 1287 bp, Homo sapiens
  chr7:42275617-42276904
  hyper
aagcctggggtgcagcgcctctcgggggacggcatcttacagaaggaggtgcaatgggggacaggagcacaaagttcaggaaaggataaaaggccgggtgcggggtggagcgtccgcttcggacaatctgcttaaaagtcgcttcacaaactctgcaagtttgggatcaatatttacaccctctctgccttctcccgcccgttttcccgctgctactcaagaaagtaactgtcccctgctgctctgtgtaaacgcggcaccttaaatgattattgcatggaccacggttactttgtgtgtctgtgcgcgctgcccctggaaaggaaaagaaataagagaatcccaaatcatatacagatggtacaactttcacttttcctctatgacgacgaaggcgcgcctctctccatccgctcacaccacacccccgccctccgaagcatagcccgggctggagaagccccagcggcggcggcccccgcggcggaggtccccgcgcgcacccaccatgcctcccgcctccttccgcccatcccgagcgccgtgcgcgcccgaagcccgagccgtagagcgccaccgcgcaaaggaaggagccaggcgcgtgcggggctcgcggagttcttctgaaccctttggatgggggcggaggcgaggggcgccgccaccactgcggcaaacttcgtcccccctccgggaggtgaaattctccaatccgtctccggccggtccgcgggtcggactcttcggaaaggaccttccaggaggagggagcgaatgcaagccttgctcggacgcctcaccggcggctctctaaatctgggcgccttttgacagccattttcactccatcccgtccccacgctggggaccacctctggccccggaggcgcgggcgcggccgcaggagcgggctgcggggtccgcgaaacaaagaacttcgagcgggacgtacctgcggcggcagcggctgtcaagtccccgaacttcccatagacccgcggacggggcgcaggctggcggctccccgctccgcgcggccgcgggcggctacggctaccgcgagcggccgggctgggcgcggggtgcgcccgccgcgggcatggtgcggcgcgggcggccgcggggcgcgcggggaaggcgggagagcggcgcgggtgagtgggagcggcgggtgtgcgcgagtgcgagtgtgcgagcgcgccggtggcgctgcccctgcccgctccctcccgctcgtgcagctccggcatcagtttcggggatcgtgtaatccgatcccttctgact

SEQ ID NO: 97613 - DNA, 276 bp, Homo sapiens
  chr7:42277312-42277588
  hyper
cgctgagcagcaggacgcctgccgccgcagggggcgaagttgggaaaacttggagtgctgctcgccttacttttgctttctcgctccttccaggccgcgccgggagcccccgcttctcccgcccgccgggtccccaagcccggagtgggtcccagctgcgaggcgggcggcggcggctgggaggcggcgcgtcgcgggccggggtcgggggctgggggggagcccgggcgccgcgagccacgcgcgcgctccctccccgccctccgccgccgccgc

SEQ ID NO: 97614 - DNA, 215 bp, Homo sapiens
  chr7:42277648-42277863
  hyper
ccctccccggtcttcacacagacacattcatgcctgctcctcctcttccccctacttgaccccgcgccctcccggcgcgccgaagccccacccacccggcgaggggaagggggcccgggcgtgatgtcacccgcgccctctctcttctctctccacaccgccaggacaccccccaaatgcgcgccctggcactcgtgctgcgtcctgtctgctcc

SEQ ID NO: 97615 - DNA, 30 bp, Homo sapiens
  chr7:4251136-4251166
  hypo
gaggaatgggggttgcgggcaggtggctct

SEQ ID NO: 97616 - DNA, 43 bp, Homo sapiens
  chr7:42533038-42533081
  hyper
gacagcaggagcagccggattttggaaagggaggaggccggga

SEQ ID NO: 97617 - DNA, 172 bp, Homo sapiens
  chr7:42533256-42533428
  hyper
cggttgctctgccgggctgcgggggcggtgccctggaaggaggggctgtgcatctgcaccatttctaggaatgtccgccctctgggaacccagccctgaagtgctctgagaatgagccgtgtttacggaaagcctctgtctcatgctccgcattctccgttctgattctgac

SEQ ID NO: 97618 - DNA, 30 bp, Homo sapiens; identical to SEQ ID NO: 41152
  chr7:4260867-4260897
  hypo

SEQ ID NO: 97619 - DNA, 30 bp, Homo sapiens
  chr7:4265593-4265623
  hypo
catgggaagttgagacgccccctcccttca

SEQ ID NO: 97620 - DNA, 55 bp, Homo sapiens
  chr7:4275488-4275543
  hypo
cagggtgtcctgccccgtatgagagtcctccaggacagcccggccttcctttcct

SEQ ID NO: 97621 - DNA, 30 bp, Homo sapiens
  chr7:4287245-4287275
  hypo
gggccgctgctctttcgagtatccaggcac

SEQ ID NO: 97622 - DNA, 26 bp, Homo sapiens
  chr7:42909823-42909849
  hypo
actgggagtaatggccgggcgcggtg

SEQ ID NO: 97623 - DNA, 385 bp, Homo sapiens
  chr7:42927790-42928175
  hyper
aatccctgagtgtgacgccgccccaaagggccccaagcaggtagatcccatgctgatgctcttttatcctggcctctcagctgttgaggagagtaattgccgggctaaactgataaagtttcattccaaacaattagcctagtctgcaggattgcagtcgcggcttggacaccatcccggtgtctgtcccccgcagagggcttgctaccttgctgtatcagctggcccagcaggtctggggccgcgcgctgcttacaggcgctggatctcgctgctcgtcgctgcgcgctactaggtcctgctgtcgtccgagtcgcctccgggactctccggaattgtagcggctgtagccggctccttgcctgcggcgcggagggcaggtccc

SEQ ID NO: 97624 - DNA, 92 bp, Homo sapiens
  chr7:4299734-4299826
  hypo
ggaagatgtgttcatcgtcacctgatggagaagctggctgctccggggtctctgtgtgtgtgggaagatgtgttcatcgtcacctgatggag

SEQ ID NO: 97625 - DNA, 132 bp, Homo sapiens
  chr7:430257-430389
  hypo
aagggagacacaaggcggaaggcgtgagggcaggagggtgggaggaaggggaatagcgggcagatgggaggatgaaatcacagcagggtggggccaggtggccagggagggcctggccgggaggcaacagtc

SEQ ID NO: 97626 - DNA, 30 bp, Homo sapiens
  chr7:4308164-4308194
  hypo
gcgcctccacagccccgggaggtggctcac

SEQ ID NO: 97627 - DNA, 397 bp, Homo sapiens
  chr7:431386-431783
  hypo
tgtgggctccactcccgggctcacccaggccagctctggatgctgaagccaccaggcacggggctgtgtgtgcagaagcagccaggcagggcggcccagcagacgcagggagcggccgccagccgctaggatcccgatgccgccgcaagtaaggacaggcccgggtgctgccgcaggaggccaggcctgcgctcgccgctgtggaatgtgtgtttgtctgatgagcatccctgcagggccccagatggagggtgtgacaaggatgggggctgagtctccagggcccgggggcacctgcacgctgcccctggcaggggcccgggcatcccacctgagctggcagccctgagcctgagaccagggctctgactcacttctgggccgccctcctcacaga

SEQ ID NO: 97628 - DNA, 238 bp, Homo sapiens; identical to SEQ ID NO: 31255
  chr7:43151970-43152208
  hyper

SEQ ID NO: 97629 - DNA, 787 bp, Homo sapiens
  chr7:43152413-43153200
  hyper
cgccagggtcccctccccagccagtcccaggcgcccggtgcactatgcggggcacgtgcgccccccagctctaatctgcgcgctgacaggagcatgatctgtgcccaggccagggctgccaaggtaagcgggcgtagcgcggggacactgtctgccgccccttcccccccgcccttctctgggcggcttccccgccgcacgcgaggccccggcagcgccctcccttctcggggccgagatccaccctcctccccaccctctcgcttctcccgcgaggttcaattgtcagcctgggtcgcgccgccgcccggtccgggccggcatccccgggtggcgaccccggcttgggtactgcaggcgcacccggccctcctgcggggtacggagagaaacaaagaagcccccaagcgggttcgcagcgcctcccccgcccctcagcgccctcccagtggcgaggaggtgtcaggggagggggcggagagacctacgtaatcccccttcccagcccacacccaccccttgtgaaccaaagctctggatttgcgcttcgccttgggctcgcttttgaacaattgtgtcccatgcaatgcccgtggttagcccagagagcgcccagagcctccgcacgggctcgccggtgctcgctcgaggggcgcgtggccaggtccggcccttgctcccatggacgggtgcaggaggggaggaggcgctgtgtgggtgctcccccagcgcctccctgttaccggccggctgcgccgctcagccgggcctgccacctgagttttag

SEQ ID NO: 97630 - DNA, 355 bp, Homo sapiens
  chr7:43153229-43153584
  hyper
cgacttgcagacaggcagggagggagctgccggggcggggagggggggggaatgcgtccggtccatttttggctggaggtgcgcttcctgctacccccacgttcccgggcggtgacaatgcagcaaaatccgagggctcaaacaatgtggcccctccatccccggctccagggcattctgattgctctgccgctttgacgtcccggccacttggctgattttcagagccatgatgcgcggtgtctctgtcttgcacacagaggctgggcaccataacttcttccctgccgaatttcagcgcgtagggggagctggcagggacacaggctgcagagatgcccggcttcctgtggtt

SEQ ID NO: 97631 - DNA, 177 bp, Homo sapiens; identical to SEQ ID NO: 41284
  chr7:43237814-43237991
  hypo

SEQ ID NO: 97632 - DNA, 285 bp, Homo sapiens
  chr7:43279396-43279681
  hypo
ttcttagctgtgatgcgctcttacagccccagacctgtagggacatgtccctcccagaaggcggcacactggctgggcctctctcaaaccaccccataaaaaagagaaccttacccgaaccaggacttctggctttcttctagggtggggttctgagtgacctttcatcatattgtttgtcgtccgtatggcttggcttttcaaaagcaaatgtactttgtttctataattaggaaaaaaagttttttttaaatgtcatcttttgccaggcacggtggctcacgc

SEQ ID NO: 97633 - DNA, 30 bp, Homo sapiens
  chr7:43282402-43282432
  hypo
ggctgtggcagggagcgggaaggagcaagg

SEQ ID NO: 97634 - DNA, 30 bp, Homo sapiens
  chr7:43304457-43304487
  hypo
aaaaattgctattgtcgagaaatagttctt

SEQ ID NO: 97635 - DNA, 69 bp, Homo sapiens
  chr7:43351483-43351552
  hypo
catggacctcaggggcggcccccacgatggcgtcaccattccccgctccaccagcgacactgacctggt

SEQ ID NO: 97636 - DNA, 88 bp, Homo sapiens
  chr7:4342694-4342782
  hypo
caacccactgtgtctctgctcttctgtgcaaacaatcccagcaccaggaaggagccagccctgccccccgctgcggccctctccatgg

SEQ ID NO: 97637 - DNA, 30 bp, Homo sapiens
  chr7:4345969-4345999
  hypo
gaaaaaaagaaataccggaggtgaaccaca

SEQ ID NO: 97638 - DNA, 30 bp, Homo sapiens
  chr7:43656702-43656732
  hypo
gactggaaagtgtcccgtgggacccagctt

SEQ ID NO: 97639 - DNA, 153 bp, Homo sapiens
  chr7:43767840-43767993
  hypo
gggattacaggcgtgaggcaccgctacgttttaaatggtgaactctacggtaggtgaactatgtgtcaggaagctgttttatttttttaaaggactgaagacttttgttttgtgttttgttttgttttcattttatcccgtttttaaaacagt

SEQ ID NO: 97640 - DNA, 202 bp, Homo sapiens; identical to SEQ ID NO: 41286
  chr7:43865061-43865263
  hypo

SEQ ID NO: 97641 - DNA, 25 bp, Homo sapiens
  chr7:44083435-44083460
  hypo
ccaccgtgcccggcaggatttatat

SEQ ID NO: 97642 - DNA, 43 bp, Homo sapiens
  chr7:44097753-44097796
  hypo
ggaaaagcggcgggccgaggaggcacagcggcagctggagcag

SEQ ID NO: 97643 - DNA, 51 bp, Homo sapiens
  chr7:44143891-44143942
  hyper
ccgggggtggggagccggctccggaagccccggcgcccccgccccgggccc

SEQ ID NO: 97644 - DNA, 495 bp, Homo sapiens
  chr7:44144029-44144524
  hyper
cgaccacccctgagcccctctggcttcggagccccccagcaccccttcccgggtcccctcgcccaccctaatccactctccctccctttcccggattccctcgctcaccccatcctctctcccgccccttcctggattccctcacccgtctcgatcccctctccgccctttcccagagacccagagcccctgaccccccgcgccctccccggagccccccgcgcgtgccgcggccatggcggccgtgcgcggggcgcccctgctcagctgcctcctggcgttgctggccctgtgccctggagggcgcccgcagacggtgctgaccgacgacgagatcgaggagttcctcgagggcttcctgtcagagctagaacctgagccccgggaggacgacgtggaggccccgccgcctcccgagcccaccccgcgggtccgaaaagcccaggcggggggcaagccagggaagcggccagggacggccgcagaaggtaagag

SEQ ID NO: 97645 - DNA, 41 bp, Homo sapiens
  chr7:44149886-44149927
  hypo
accaggaggactacccggttcacaggcgtcatcacccaggg

SEQ ID NO: 97646 - DNA, 71 bp, Homo sapiens
  chr7:44151000-44151071
  hypo
gtcatgcccgtccctcgccatagagcaggccctggaagtggaaggggcatggtcagcgggggacggattgc

SEQ ID NO: 97647 - DNA, 501 bp, Homo sapiens
  chr7:44151276-44151777
  hypo
gagctcactgcctcccgcctgttccggagcctctctggggattctggcttgtcttacagggccctaggagccccagctgtcccccagaccctcgggtatgaggtgggtctgggtccttcctcagctgccctgggcctcgggagactgagtgctcactgaggctcccgcccttgcaggggagcccgagttccgctacactgctgggatccatggcaacgaggtgctgggccgagagctgttgctgctgctcatgcagtacctgtgccgagagtaccgcgatgggaacccacgtgtgcgcagcctggtgcaggacacacgcatccacctggtgccctcactgaaccctgatggctacgaggtggcagcgcagatggtgggttgaagggtgaggctggccagggtccaggcagctgggggttgtgggggtgtgggtagccgatgcctaccctgctggctccccacagggctcagagtttgggaactgggcgctgggactgtgga

SEQ ID NO: 97648 - DNA, 96 bp, Homo sapiens
  chr7:44152156-44152252
  hypo
gtatccacggaggtccgggccatcattgcctggatggagaagaaccccttcgtgctgggagcaaatctgaacggcggcgagcggctagtatcctac

SEQ ID NO: 97649 - DNA, 194 bp, Homo sapiens
  chr7:44153428-44153622
  hypo
cgacgcctgcagcagcgacgcctacaacaccgcctgcggcttcgggcacagatgcggctgcggcgcctcaacgccaccaccaccctaggcccccacactgtgcctcccacgctgccccctgcccctgccaccaccctgagcactaccatagagccctggggcctcataccgccaaccaccgctggctgggagga

SEQ ID NO: 97650 - DNA, 35 bp, Homo sapiens
  chr7:44164101-44164136
  hypo
gtttgtttgaggcagcgtcttgctctgtggcccag

SEQ ID NO: 97651 - DNA, 30 bp, Homo sapiens; identical to SEQ ID NO: 41290
  chr7:44193301-44193331
  hypo

SEQ ID NO: 97652 - DNA, 189 bp, Homo sapiens
  chr7:44258465-44258654
  hypo
ggtgtgtggggataccgggcacggaaaacccacacctagcccttcaggggatgaaaggaagggaagggaaagcaggaacaacagcaactctcaggcacaactagcgggaaaggaggcagcccagcgggcccccacagcccctcccaagagacagctgacagtcacgacagccagcgagcacaccacgtg

SEQ ID NO: 97653 - DNA, 53 bp, Homo sapiens; identical to SEQ ID NO: 41292
  chr7:44259286-44259339
  hypo

SEQ ID NO: 97654 - DNA, 30 bp, Homo sapiens; identical to SEQ ID NO: 41293
  chr7:44275594-44275624
  hypo

SEQ ID NO: 97655 - DNA, 30 bp, Homo sapiens
  chr7:44279543-44279573
  hypo
tagtgttggtgtgaccgtgtgcacgcgttc

SEQ ID NO: 97656 - DNA, 30 bp, Homo sapiens
  chr7:44298773-44298803
  hypo
cagtgcctcaccctccgctgccagtctggt

SEQ ID NO: 97657 - DNA, 205 bp, Homo sapiens
  chr7:44304621-44304826
  hypo
tctcagggtgcaggacggtgagttcacggggttattgttttctttcctagtatctttcttaaactgattgtgaacatttttcagacttagagaaaaactgcaacaacagtacagagcaatcgtgtacagcacttctgtacaatctccctgccccgcccctgcttccatataacacactcgcttcttctgacgcgtgtgtaacacc

SEQ ID NO: 97658 - DNA, 30 bp, Homo sapiens
  chr7:44307247-44307277
  hypo
ggtggctaagagagacgctggcaaaagcat

SEQ ID NO: 97659 - DNA, 47 bp, Homo sapiens
  chr7:44307677-44307724
  hypo
agaagcacccccagccgagccctgcacagccacgctgagctcatctt

SEQ ID NO: 97660 - DNA, 48 bp, Homo sapiens
  chr7:44349559-44349607
  hyper
ctcgcgaaggacacgcgggaagagcctttccgccggctgagccgtggg

SEQ ID NO: 97661 - DNA, 74 bp, Homo sapiens
  chr7:44349655-44349729
  hyper
cggtggccgagaccgggcgggggcgggggcgctttgggagttaggatacgctttgtgcccgcttgctgcttttt

SEQ ID NO: 97662 - DNA, 194 bp, Homo sapiens; identical to SEQ ID NO: 31262
  chr7:44364485-44364679
  hyper

SEQ ID NO: 97663 - DNA, 384 bp, Homo sapiens; identical to SEQ ID NO: 31263
  chr7:44364698-44365082
  hyper

SEQ ID NO: 97664 - DNA, 141 bp, Homo sapiens
  chr7:44365117-44365258
  hyper
cgggagacacctcggctcgcggcgccaggcgggggccgggctgggctgcgccgggcggcgagcgcacgcgagatctgctcgctccgtcctcgccaggagcgcgccgcacacctacgcgcggggaggcgcgggcgccgctgt

SEQ ID NO: 97665 - DNA, 40 bp, Homo sapiens
  chr7:44430994-44431034
  hypo
tacgatgtattaatacgtgctgtaccggaaggtaagacta

SEQ ID NO: 97666 - DNA, 37 bp, Homo sapiens
  chr7:44517855-44517892
  hypo
ttatttactttgggccgggcgcggtggctcacgcctg

SEQ ID NO: 97667 - DNA, 59 bp, Homo sapiens
  chr7:44582470-44582529
  hypo
ggccttaggcagggccgtgggcacttgcgacaagaagacactgtcggcatgcacagagc

SEQ ID NO: 97668 - DNA, 83 bp, Homo sapiens
  chr7:4463665-4463748
  hypo
tcctctgacaccagccgattaccaagcaattgatgtgcttgctgcccaatgtgcacagaggccaataccatggcaccagcttt

SEQ ID NO: 97669 - DNA, 30 bp, Homo sapiens; identical to SEQ ID NO: 41296
  chr7:44717883-44717913
  hypo

SEQ ID NO: 97670 - DNA, 30 bp, Homo sapiens
  chr7:44746915-44746945
  hypo
tattatgacctcacccgggagcgcaaagca

SEQ ID NO: 97671 - DNA, 30 bp, Homo sapiens
  chr7:44796802-44796832
  hypo
acctcagaactgtggcgctgatcagctgga

SEQ ID NO: 97672 - DNA, 30 bp, Homo sapiens
  chr7:4479737-4479767
  hypo
caatacgtctctattcgtttgcatttgtat

SEQ ID NO: 97673 - DNA, 30 bp, Homo sapiens; identical to SEQ ID NO: 41297
  chr7:44801185-44801215
  hypo

SEQ ID NO: 97674 - DNA, 277 bp, Homo sapiens
  chr7:44835107-44835384
  hypo
ggctcaagcaatcctccccgcccagcctcctgagtagcgagcgcctcgacgcccagctaatttttatttttatttatttttttgtagagacggcgtctctctaagatgcccaggctggtggccggtgtcgaactcctaagatgaagcgatcctccccggccttggcctccgcgcctcctaaagcgccaggtatgagccaccgcgcctggcctacaagtgcattttaattaaagtattattaatgtctttgcctgaagaaattcgcttttaaattgtg

SEQ ID NO: 97675 - DNA, 42 bp, Homo sapiens
  chr7:44896731-44896773
  hyper
tggaaagactgaaggcgccctccagtccgctttctgtttctc

SEQ ID NO: 97676 - DNA, 216 bp, Homo sapiens
  chr7:44924253-44924469
  hyper
agcgcttggagtccacggtgatggaggtgccctccgggagctctccatacaggccgccccctgggcccccggcgccgcctcccgggccgcctgccagctcgtcgtcctcgcctccgtagtcgtctatgagcttcgccagcgcgtcgcggaactcgatgaggccctgcgcaggcagcgcgatggtctggccgctctgcaagccgcccggcccggggc

SEQ ID NO: 97677 - DNA, 40 bp, Homo sapiens
  chr7:44967575-44967615
  hypo
aatagtcactgtatgcggccgggcgcggtggctcacgcct

SEQ ID NO: 97678 - DNA, 30 bp, Homo sapiens
  chr7:45005732-45005762
  hypo
agtgtccggggtgagcggatgaacagcttg

SEQ ID NO: 97679 - DNA, 27 bp, Homo sapiens
  chr7:45027184-45027211
  hypo
attgttaagggacgaaagggccaagag

SEQ ID NO: 97680 - DNA, 34 bp, Homo sapiens
  chr7:45038532-45038566
  hypo
aaagaattattaggccgggcgcggtggctcacgc

SEQ ID NO: 97681 - DNA, 109 bp, Homo sapiens
  chr7:450465-450574
  hypo
agggaaaggacaagccgggtcacgcggggtgtgacttctgcaggggcagccgcacaccccaggacagggcatcatgtatggagacgcggacctgcggcaggtggcaggg

SEQ ID NO: 97682 - DNA, 34 bp, Homo sapiens; identical to SEQ ID NO: 41301
  chr7:45125675-45125709
  hypo

SEQ ID NO: 97683 - DNA, 680 bp, Homo sapiens
  chr7:45128453-45129133
  hyper
cgggcagcagcagctcggcgcgggcagcctccccaggcatggcctggccgtgcgcccgcccgtccctcagtccttccgaccctccgtcagtccgtgccgccgccccgccgagcctgcgcggccaccgcccctcggccgggcggtgggggcagtgggtgacgtcaggccgccccgcccgcctgtcccagcgagtgagcgtgcgcgggctcgccaggcactgcggagggcgtagggggggctccctccccgcccccaccccacccggctgtggcctccctctcgctgtgggcggtttcgtgggggagcgggggtgggcgcctgcgcccggtcccaccctttccacagcatttacgagggagggtttcagggccaattggaagctgggttgcctcagggtggcattcgcccgtggccaggaagaggcggggacgcccctagaaccctggttgtgggaggctggggaggtggttgggattctgggatgctcggagcgctttgggtggagttggcggcgcagcctccttccccgctgaccaagcagagggtgcagggcctggggagggagggggccccgcccagcccgatgcctccatgcaaaaggtgagctggagctgcagctctggagtgattggctggtcctggcagtcgtcggtctccgtggcaaccgcctcctgtctcca

SEQ ID NO: 97684 - DNA, 37 bp, Homo sapiens
  chr7:45197017-45197054
  hyper
tgcatcccagcccaccgtcagccggcccccacgctca

SEQ ID NO: 97685 - DNA, 214 bp, Homo sapiens
  chr7:45197376-45197590
  hyper
cagccgcgcccccagcgggaccgagcgtgacccagctgcggccggccagccatggagactggagcgctgcggcgcccgcaacttctcccgttgctgctgctgctctgcggtaagggggcgacggcccgcaccgggggcgcccccactcctcggggttcaccggacccgggtggacccgcgccttcccgcacctgcgccgcggtccttcccttgc

SEQ ID NO: 97686 - DNA, 108 bp, Homo sapiens
  chr7:45222863-45222971
  hypo
cttctccaactgcaccgtggacagggtccacttggaggaccccccagacgaggttctcatcccgctgatcgttatacccgtcgttctgactgtcgccatggctggcct

SEQ ID NO: 97687 - DNA, 45 bp, Homo sapiens
  chr7:45293665-45293710
  hypo
cctgggattacaggcgtgagccaccgcgcccggtcttccctaagt

SEQ ID NO: 97688 - DNA, 30 bp, Homo sapiens
  chr7:453753-453783
  hypo
cgaagcctcagtggtcgggcctttcctgac

SEQ ID NO: 97689 - DNA, 392 bp, Homo sapiens
  chr7:45613422-45613814
  hyper
cgcccacagggtctccgcgaccctagagcttagggaagaattgccgaggggcggggggtccctcatgcgcatggaagggacgtacgccccaggcctccaccttcctcctgaccccggggattcttggacgtcgattctccgtctcgtaggggcgagggccctgggttcgcagtcagacgcgggcccctctcaaatctagtggcctggttttattgagtgggggaaggcacatattttccaagattaactgccccgcaacagggaatttcgcaggatttcagtattttcgactccccaggtgacgccaagagggtgggttccactgtgcacggtggggaaactgaggctcggaggggacaaggaaggtactcgaggtcacgcggctcctccgg

SEQ ID NO: 97690 - DNA, 1102 bp, Homo sapiens
  chr7:45613857-45614959
  hyper
cgcccaggttcgcggctcccggggctcggctgtcgcagcgcggtcgccgccgaggaccacggtcggggcgcgggcgggctccagtgcgcaggcgcggcgggcgggaggggacgcgctccgggcgcgcgcgcggggcagccggcgccccaactccgcccgccccgcgccccgcgccccggcgcctcgccgcccgccgcccgcccgccccggcgccgccgcccgcgccccggcgccccgggccggcgaggggcgcgcccgcggccgcggccgctgcatggcgctgagatggcgggggcgccgcgcggcggaggcggcggcggaggcggcgcgggcgagcccgggggcgccgagcgggcggccgggacaagccgccggcgcgggctccgggcgtgcgacgaggagttcgcttgcccagagctggaggcgctgttccgcggctacacgctgcggctggagcaggcggccacgctgaaggcgctggccgttctcagcctgctggcgggcgcgctggcgctggccgagctgctgggcgcgccggggcccgcgcccggcctggccaagggctcacacccggtgcactgcgtcctcttcctggcgctgctcgtggtaaccaacgtccggtccctgcaggtgccccagctgcagcaggtcggccagctggcgctgctcttcagcctcaccttcgcgctgctctgctgtcctttcgcgctgggcggccccgcccggggttccgccggggccgctggggggccagcgaccgccgaacaaggggtttggcagctccttttggtcaccttcgtgtcctatgccttgctgcccgtgcgcagcctgctggccataggctttgggctcgtggtggctgcgtcgcacttgctggtcacagccaccttggtccccgccaagcgcccacgtctctggaggacggtaagtgcagccgcgcacccctcatctggtctcggacacacttgctgggacgatgctgggaatgcccggagtcgggcgcgctttttcctatgcggcgggtggggacactgaggctccgagtgggggtgtgttcaaggtcactcctacgagttggggacgcagtcggggctggcaccct

SEQ ID NO: 97691 - DNA, 30 bp, Homo sapiens
  chr7:45615610-45615640
  hyper
ccatctccaacgggccgcagggatggggct

SEQ ID NO: 97692 - DNA, 30 bp, Homo sapiens
  chr7:45717349-45717379
  hypo
tcagattcccaaacccgaccccaccctgca

SEQ ID NO: 97693 - DNA, 30 bp, Homo sapiens
  chr7:45807201-45807231
  hypo
gtgtaaagccaggcacgatggctcattcct

SEQ ID NO: 97694 - DNA, 30 bp, Homo sapiens
  chr7:45807471-45807501
  hypo
aggggcgtgagccaccgggcctggcccaat

SEQ ID NO: 97695 - DNA, 33 bp, Homo sapiens
  chr7:45928114-45928147
  hyper
catctgccgccgcgccgccgccaccctcccaga

SEQ ID NO: 97696 - DNA, 243 bp, Homo sapiens
  chr7:45928349-45928592
  hyper
ctccgccgagaagctcgcgctctgcccgccggtgtccgcctcgtgctcggaggtcacccggtccgccggctgcggctgttgcccgatgtgcgccctgcctctgggcgccgcgtgcggcgtggcgactgcacgctgcgcccggggactcagttgccgcgcgctgccgggggagcagcaacctctgcacgccctcacccgcggccaaggcgcctgcgtgcaggagtctgacgcctccgctcccca

SEQ ID NO: 97697 - DNA, 1583 bp, Homo sapiens
  chr7:45959968-45961551
  hyper
cctgggattgcagtccgtgtgcacccccgtgcggggcgaggagaatctcctgtgtccaggatctttccaacagctaaacatcggtaccgctcccctcagctccggaaacctttaacccattttcactgaaagcgctttgcaatttacaagtactctgcacttagagaatcgagcaagtagagggccggctggggagggtccctccggcgaccgccttcacctttcccggagcgccttcagtttccccacatattatctccagtgagaagaaaagcggagtctcccgcagcggcacccagcaacccccaggcccttcggcgccagtgcgccgggtgctgcacgcagcgcacctggcgcgggcggctcacctggagctggcggcgctggcagcaggtaggcgcgcaggcggctgacggcactagcgttgacgcagagcccgcggccgtccagcagcgcctgcagcggtcgcgcctcgtcgggcgacggctggcagcgaaggccggagccacagcgctcggtgtagatgccgcacggctggccctcgctcagtgcgcacgtcaggcagcagccgcagcccggctcgcgcaccagctccgcgcacacggcgggcggaggcgcgcactgggccagtgcacgcgcgtcgcacggctcgcagcgcaccacgggacccaagcccgccgagctcgcgccagcccgcgccaccggcggcccgcggagcagcaccagcagagtcagcgcagcggcccagagcgtgggtcgcgcccgctgcatgacgcctgcaaccggggcacgctgcttggcaggctgggcgcgcagggatggggcgacagtacacggcgcgaagctgtggaatccaggcaggaagcggctgatcctcagcgcccagccgcagtgctcgcatctgggcggcccgggcgcgccggccgctatatagaagccggggtggcccaggacacgccccggaacggcgcgcccaggagtgggggttgggaggggggcgggtcggcgcaggcacggctgcgggggcccgtgcttcgccctgagcagccggggccgagctcgggggcgtgcagctcgagactcgcccgggcacctgctcctcgtgcgcacgcccggagcccgggtcaccttgtcgtctacaagaaccaaggtgtgcccggccaccccggcactccaggccacctcagcacccccggtcaccccagtcactcctggccaactcagcacccccgatctccttgaccccgccgcccttaccccttccgctctcggggtgaggtctccctgcggcgagccggtgtcggggaaactggcatacagcgctccgcattcgtgtgtacctcgtggagctttctaaaatttaattccgttggcaggcgaagtcttgggacatttctgacttacatttgggtctcagggagccaaggcactgcggggtttaatttacacccgctgggctgtttatatccccaggggcccacaaatacgcatctgaagatgcgcccggggccttcgcccctttccaggcttacttctcaacgcaagaagactctcacgtgttgctacaccgcaagtctccaatt

SEQ ID NO: 97698 - DNA, 218 bp, Homo sapiens
  chr7:45961756-45961974
  hyper
gtcattttttgaaggcgacttcgtattactgtattctcgatgcgttgggattctagcttatctctgcaatctaaacacttttcagtaaagttcgggggcgcaattgcgcgctgaggtcgctgtaactcctgtcggccttctctggcactcgagtttcttcagttttgtctgcgcaccccctcccttcggtgaccaacagaggacgctggtggtccagg

SEQ ID NO: 97699 - DNA, 30 bp, Homo sapiens
  chr7:466547-466577
  hypo
tgtgctgggtgcaggcggcacagcagagtt

SEQ ID NO: 97700 - DNA, 37 bp, Homo sapiens
  chr7:471149-471186
  hypo
gtgtctgtctgaggtcgggtcacgtgggtgtcaccgc

SEQ ID NO: 97701 - DNA, 53 bp, Homo sapiens
  chr7:472685-472738
  hypo
agcaagaggggtcctcggacgtgatgagctccctgtcacgggaggtaagcaag

SEQ ID NO: 97702 - DNA, 241 bp, Homo sapiens
  chr7:47394691-47394932
  hypo
cacgggtggagccggcgtcaaggacagataaggaaacgtgctgagggctgcccagccagcaagttgcgcagggtcacctgagactccgccacgcccagcgggatctgggattcaccacagggtgcaaaaggacaccgagcctgcgaggcaggaggacgctcagtcattccggccccacaggaggagctggggatggtggggcctcagccccaggtgcatcctatgacgtaccttatccaaa

SEQ ID NO: 97703 - DNA, 45 bp, Homo sapiens
  chr7:47409164-47409209
  hypo
tcttcctcaccttcgcgtaaaggctgccatcgacagggccctgcg

SEQ ID NO: 97704 - DNA, 203 bp, Homo sapiens; identical to SEQ ID NO: 41306
  chr7:47420119-47420322
  hypo

SEQ ID NO: 97705 - DNA, 142 bp, Homo sapiens; identical to SEQ ID NO: 41307
  chr7:47420382-47420524
  hypo

SEQ ID NO: 97706 - DNA, 30 bp, Homo sapiens
  chr7:47446763-47446793
  hypo
caaaagatgcactcccgactctgatgggag

SEQ ID NO: 97707 - DNA, 30 bp, Homo sapiens; identical to SEQ ID NO: 41308
  chr7:47449194-47449224
  hypo

SEQ ID NO: 97708 - DNA, 121 bp, Homo sapiens
  chr7:47513123-47513244
  hypo
tgtggtgtatagacccgtgtctgtgtttctgaagtttactgaggggtggaaacaatctataagcaggaaataaccactgtccagtcaaatacctggacttatgggccgtgaggacaagaaa

SEQ ID NO: 97709 - DNA, 181 bp, Homo sapiens
  chr7:4751426-4751607
  hypo
accgtagagaagcaacgcaaggtcagagagaaaagattgcggccggccggtgtcaaggcgggggacctgtgagctgggcctggagctgaggcagaacttgatggactatgactcaaggttgagatggggcagggactccgggggaggggcagagggcaggtgccgccgagcaggagggagg

SEQ ID NO: 97710 - DNA, 30 bp, Homo sapiens
  chr7:47515683-47515713
  hypo
cttccccacacatcacgtgtcttccctgtg

SEQ ID NO: 97711 - DNA, 61 bp, Homo sapiens; identical to SEQ ID NO: 41309
  chr7:47586473-47586534
  hypo

SEQ ID NO: 97712 - DNA, 119 bp, Homo sapiens
  chr7:476416-476535
  hypo
cccggcacaggcatccgagggccaaggctgcaggaaccgtctctgctggtcacgtctggagtgtgaggccctggaggcccccgtgcacgtccgtgcgatgatgccgcccacaaccaccg

SEQ ID NO: 97713 - DNA, 30 bp, Homo sapiens; identical to SEQ ID NO: 41310
  chr7:47702782-47702812
  hypo

SEQ ID NO: 97714 - DNA, 150 bp, Homo sapiens
  chr7:4771565-4771715
  hypo
agacctgaggccacacggaggccgggctggccagggcggggctcagattcagtgacttgcccaggtgcccccagggcatctgagcagcccaggctccagccaggcaggtctgacttcacctcccttgccgtgagccgctgcactgttcca

SEQ ID NO: 97715 - DNA, 147 bp, Homo sapiens
  chr7:4781931-4782078
  hypo
atcccaggctggtcacgtcagtccctccctgctgatctgcgcactctgctgaaccccggccgcaccttggcttgcttttttctttttttcctcttgcagctgtaggagaagaaagggcttttgtttgtatttcagagacagcgtctc

SEQ ID NO: 97716 - DNA, 30 bp, Homo sapiens
  chr7:4782599-4782629
  hypo
gccccgggctcaggccgggcatggtcacct

SEQ ID NO: 97717 - DNA, 40 bp, Homo sapiens
  chr7:4784887-4784927
  hyper
gtggagtggctggctcggtgtaggccgggctcgcccaggg

SEQ ID NO: 97718 - DNA, 68 bp, Homo sapiens; identical to SEQ ID NO: 31019
  chr7:4785735-4785803
  hyper

SEQ ID NO: 97719 - DNA, 37 bp, Homo sapiens
  chr7:4802552-4802589
  hypo
gaagccaggagctgccgagccacggaccacctaacag

SEQ ID NO: 97720 - DNA, 30 bp, Homo sapiens
  chr7:4805834-4805864
  hypo
taatccctcaccagtcgggccgagtgtggc

SEQ ID NO: 97721 - DNA, 1012 bp, Homo sapiens
  chr7:48074892-48075904
  hyper
ctcccacccccgctgcgtcccgcccggttccccgtggcatcgctgcgctgccctgccctggtccggctctgggctacgggcagttgacaggcggcgcccgcgctccgcttcctgccctgattggcccaccgctccccctcaggcttcccctattggctgacagtgctccagccgcgcccgccggttggccgttcagccgttgccctggcgacgccgatgttgtggttccgcggcgcgctgggagtttgggtttggttggctgcagccagccagccgtgtaaaaactccaacgccgggcgccgcgggcagcacccacggagacccgcggggagctggtgagcctgagcgggctggaggacaatgggggcgcccactgtggtcccgggccttgtccactgtgcggagctcgcagtgcgggcagtgcgcgccggggctggagggaggggaccaccttgtcgccgggttgggatgagcacagggcgggatctccaagcctgcccaagtcccgcggccccttggttacctgttgcttatcctctctgtacttgctgtgtccctggcgtggacgtgcctgtactggatacccggcgtgacgtgccccctctgtgtgccccgcacgcacgtgtctctgctgaataccccgcgtgaatgtgcccctgctgtgtacccggagtgcgtacgtccctgctgtgtaccctgtgtggacgtgccctgctgtctacccggcgtgcgtgtgttcctgctgtataccggcgtgatgtgctcccttctgtttacctggcgtggacatgccccctgctgtataccctgcatggaagtgccagcgctaggcgatcgtaaggcgcctgcaggcgtgtcagggcgaggcgtacagaccgacccagagcgggcgcgcggattttgcttttgcagctgcagctcctggcaactggtcaagcaggcagcgtccagcgcacccgcgaacaccaggtccggcagcatctgtcttttcccgcagcgtgcagcgcctgac

SEQ ID NO: 97722 - DNA, 157 bp, Homo sapiens
  chr7:4813713-4813870
  hypo
ttttaccctagtaaacgttaaacactggcagtaggctttccatagactacctgtcaccagctttcctttgccagtcttcaacctgcggctccaggggcacccgccgcactccaccgactcccatccaccgctcaccatccaccgattcccatctctt

SEQ ID NO: 97723 - DNA, 137 bp, Homo sapiens
  chr7:4837861-4837998
  hyper
cgggtcggcagagggcgcggggcggacgcgctgcacctcgccgtagcgcacaccagggggcagcgtggagctgcacgaggcccagggcctgggacagacccaggacaccgatctggggaccccgcacagacctctgt

SEQ ID NO: 97724 - DNA, 288 bp, Homo sapiens
  chr7:4839163-4839451
  hypo
cccacagggtgcagccgggcctctcctttaccccaggtccactcccctgagcagggcatctgggagaaggggccgggcgtgcatgcggtgggggtacctcaggtagccaaggcccaggaggctgctgccattcacctccaggatacggtcccccagcgacaggcgcccgtcggccgctgcggggctgcccgggagcagggtctggatgtagagcccgggggcgcccaggtgcgtgtgctggggacaagcagaggcctcagagctccgcaggcccgactggctgtcccc

SEQ ID NO: 97725 - DNA, 175 bp, Homo sapiens; identical to SEQ ID NO: 41160
  chr7:4840176-4840351
  hypo

SEQ ID NO: 97726 - DNA, 30 bp, Homo sapiens; identical to SEQ ID NO: 41161
  chr7:4840692-4840722
  hypo

SEQ ID NO: 97727 - DNA, 177 bp, Homo sapiens
  chr7:4841057-4841234
  hypo
agtatctgcccaagacgtgtcagcgactgagcgaccgtgtggcccagctgctgggggctgagcagccctgagccctctccatctggccccgtctcaggttgcaggtgtctgtggggcaggtaaggaaacctaggacccaaggggggaacgatcccaggggaccggccatcagggtgc

SEQ ID NO: 97728 - DNA, 138 bp, Homo sapiens
  chr7:4843211-4843349
  hypo
gcctgccagggctgccggggctggctctgctccgcagaccccacagaaagtggcggacgtagagcaggtgctggtagatgctgtcgtccaggcagttggcttccaagtccacctggaagccgtcgctgggcaggacga

SEQ ID NO: 97729 - DNA, 18 bp, Homo sapiens
  chr7:48465341-48465359
  hypo
atttatttattttttcga

SEQ ID NO: 97730 - DNA, 152 bp, Homo sapiens
  chr7:4855938-4856090
  hypo
tgcacctgcagctgccgcaggaggtccagggctgcctggtacacagacaccacgcggcgcagctcctcgggcagttcgggggccgaggaccagctctcacggcgctccgtctggaatggcgggcactccaggagtgccgggaggcagatgta

SEQ ID NO: 97731 - DNA, 453 bp, Homo sapiens
  chr7:4856843-4857296
  hypo
tgcagaagcagagcccgtccgtgcaccttggagacatagtagacgcactgctggaaggcgtacagcaccacctcctccagcaccgccatggcctcctcgctggccgtcagcgtgcaggagaacagcgattccttcgagcctgccgggagacagccacgccaatggtcacaacgggcacagcgctcaggaacgcagcaactcagccagccgccagctctttccctggcgcgggcaccacccaacgcgcccatctggggtccagatgcgataaactggccgagggactctgggccctggctgggacgagcgcagcaaacctgccgccactcttacctggggaggggaatgccgggaggggcaggaggggtccagacacccaacatctcaatgcccagcccagcccagcccaagcgctcattcactcccacgttctggatacgttttctgttacaa

SEQ ID NO: 97732 - DNA, 355 bp, Homo sapiens
  chr7:4857971-4858326
  hypo
gccaggacaatggtgcgccaagcccttggacaagcccctgtcactttcgctctgccgctcctggtgctcctccttcaggggcttggggctgcctggcccccacccaccaagcccgctccccaagaacctgtgaagccccccagtgcctgccccacagggtcacatctgggaaccaggcagggcagctggagggaccccggggtccggggcagtaaggggctctcgggctctgccaacctcaacactgtgcccagaagcctccaggcctgtggagacacacaaggtggcccgacggcgcccacagcgagtgccggcaaaggatattcacagccacggcaggcgggtcaggaggctg

SEQ ID NO: 97733 - DNA, 30 bp, Homo sapiens
  chr7:4864784-4864814
  hypo
ggcaggaggaacaggcgtagctggctgggg

SEQ ID NO: 97734 - DNA, 112 bp, Homo sapiens
  chr7:4867556-4867668
  hypo
gtagaccagttttaccgataaattcagatgggaaaatcctaattaaaagatcaacagtcaacatcactaattctcggggagatgccaatcaaaaccacgagacgccacctca

SEQ ID NO: 97735 - DNA, 30 bp, Homo sapiens
  chr7:4873587-4873617
  hypo
tctaggggtggaggccggggatgctgctga

SEQ ID NO: 97736 - DNA, 30 bp, Homo sapiens
  chr7:4874233-4874263
  hypo
tgacccagacagtctcgcggatcagcctgg

SEQ ID NO: 97737 - DNA, 59 bp, Homo sapiens; identical to SEQ ID NO: 41165
  chr7:4875008-4875067
  hypo

SEQ ID NO: 97738 - DNA, 30 bp, Homo sapiens
  chr7:4876009-4876039
  hypo
cagaaggagcagatgcggggactggtacag

SEQ ID NO: 97739 - DNA, 30 bp, Homo sapiens; identical to SEQ ID NO: 41166
  chr7:4876594-4876624
  hypo

SEQ ID NO: 97740 - DNA, 205 bp, Homo sapiens
  chr7:4918324-4918529
  hypo
gaaacacaatgaggtcgcctaagtaagacacgctccgctgcagggcttggatttctggaaagtgctgggcgcagcgcccgtgtgcagtgagcatcaaggagcgccccacccggagccggccccagcaccatcacagccacagaagagcagcgggcagcccaagggcaaagcttcgcctctccgtaaacctcgtgtctcctacccc

SEQ ID NO: 97741 - DNA, 158 bp, Homo sapiens
  chr7:4922549-4922707
  hyper
gatggtccgcagccccgccagggccctgccaaccccaccaacaggctcctcctgcgaggccccaggagctcggctcagcatctgttatcttggatgcagtatttgtcgaggggctggaaatggtacataaatagccgggaaacaatgctttgagctgg

SEQ ID NO: 97742 - DNA, 135 bp, Homo sapiens; identical to SEQ ID NO: 31022
  chr7:4922839-4922974
  hyper

SEQ ID NO: 97743 - DNA, 302 bp, Homo sapiens; identical to SEQ ID NO: 31023
  chr7:4923327-4923629
  hyper

SEQ ID NO: 97744 - DNA, 39 bp, Homo sapiens; identical to SEQ ID NO: 41168
  chr7:4931853-4931892
  hypo

SEQ ID NO: 97745 - DNA, 20 bp, Homo sapiens
  chr7:49493501-49493521
  hypo
cagcccgccatgcctgagcc

SEQ ID NO: 97746 - DNA, 49 bp, Homo sapiens
  chr7:494963-495012
  hypo
gcagaacagcatgtccgttgggctgcagatgggacggtgccctggggac

SEQ ID NO: 97747 - DNA, 174 bp, Homo sapiens
  chr7:4956774-4956948
  hypo
aagagcttagtggttcggatccaagctgtggagccaaaaggcctgggttcgaattccagctctacacttcaggagtacataaccttgagcaagttacctattcgctctaggtctcagcttccttctctgtaaaacacggaggatgccagcaacctgacacggggctgtggggag

SEQ ID NO: 97748 - DNA, 30 bp, Homo sapiens
  chr7:4966300-4966330
  hypo
gcttcttttgcttaacgtgatttttgcgag

SEQ ID NO: 97749 - DNA, 203 bp, Homo sapiens
  chr7:49700763-49700966
  hypo
accgcgcccccggccggtccttgtttttaaagaatttacaattgaacgggcagaagcagatagtaacaagtgaatgaaagtagtaagatctcagctttacagacaccgtattctaactatgtttagagaaaaaaagtgcagctttcaaatttcatttacagtccgtctttcacatagtctcccatccacgacagtgtgagcag

SEQ ID NO: 97750 - DNA, 179 bp, Homo sapiens
  chr7:49740612-49740791
  hypo
ggaaggagctggcagcgctgcggcgacgcatccccagaggagcagcagcctctgacagcaacaccaagtgcaggagcggagggcgggggaagtcacctgctgccagggttccaccgtggggatgataagagggaacagcatgcaccactaagtgtgggagtcaacgataggtaggtttc

SEQ ID NO: 97751 - DNA, 167 bp, Homo sapiens; identical to SEQ ID NO: 41029
  chr7:497742-497909
  hypo

SEQ ID NO: 97752 - DNA, 327 bp, Homo sapiens; identical to SEQ ID NO: 31277
  chr7:49812691-49813018
  hyper

SEQ ID NO: 97753 - DNA, 284 bp, Homo sapiens; identical to SEQ ID NO: 31278
  chr7:49813809-49814093
  hyper

SEQ ID NO: 97754 - DNA, 630 bp, Homo sapiens; identical to SEQ ID NO: 31279
  chr7:49814121-49814751
  hyper

SEQ ID NO: 97755 - DNA, 134 bp, Homo sapiens; identical to SEQ ID NO: 685
  chr7:49815116-49815250
  hyper

SEQ ID NO: 97756 - DNA, 109 bp, Homo sapiens; identical to SEQ ID NO: 686
  chr7:49815656-49815765
  hyper

SEQ ID NO: 97757 - DNA, 27 bp, Homo sapiens
  chr7:4985872-4985899
  hypo
cacaccccaccccgtgcacacaatccc

SEQ ID NO: 97758 - DNA, 422 bp, Homo sapiens
  chr7:4998165-4998587
  hyper
cagaggtggtaccaacgccttttaccatgaacaagagtgcccaagagagaccgagcgtaactgcccgagcgtagctggcctgggctccaggcgctgcgcaaagtgctctgcaaggaccagctcgcttaatcctcacggcgacccaggacacggggactcgcataacccccgttttgcaaacgtggaaatgaggttcagagaagtgaagcgacttgcccaatggcacccagcgaggaggcgcgggcgccccggttactccatcccagcgagaagacgaggctgcctgggtcctggttttctcgggcgggggtcaggggtccgccgatcccctctagcgctccgggcggcggggcccgagaaccaaggtggcctccgcggcccccgccgccgcgcgcccctccctccctccccgcggacctccg

SEQ ID NO: 97759 - DNA, 353 bp, Homo sapiens
  chr7:4998770-4999123
  hyper
cggcgcccggagccggagccggagcccgagccggagctggaggcgcccggagccgccgacgccaaatcccgagcagatggtggcgggggcggggcgggcgggggcacgggggggctcccgggctcgcgctgccaatcgcctaagcccggccccctccctcccgcgaccccgccgcctccgctgaggtggaggagggtcgtggggagatgggggggtgggagaggtgggggtgaggaagtgggcgtaaggagtgggggcgggacggggggggtcctggctgcgcgcgcgagccacccatcgcccaggcctggggcggccctggccccggccccttttcccggtgccctccctgg

SEQ ID NO: 97760 - DNA, 30 bp, Homo sapiens
  chr7:50140443-50140473
  hypo
aaaataaaataaaatcgtttttctcaagat

SEQ ID NO: 97761 - DNA, 20 bp, Homo sapiens
  chr7:50141622-50141642
  hypo
aatgccaaaatttgccgggc

SEQ ID NO: 97762 - DNA, 37 bp, Homo sapiens
  chr7:50207925-50207962
  hypo
cagaagtacctggcacgttagacgcaatcaatacata

SEQ ID NO: 97763 - DNA, 100 bp, Homo sapiens
  chr7:502263-502363
  hypo
tctgctgctaggagccgagagcgccgcccgcagtgggacggagccggccccacagctccgtgcactcgcgacgtgcggcggacggcggtggctgtgggtg

SEQ ID NO: 97764 - DNA, 80 bp, Homo sapiens
  chr7:50231283-50231363
  hypo
aatgtgagaaggaggcgatcctggcttctcgtctcattgattctcgcacgtcttttcaacgtgagcggccgagctgagtg

SEQ ID NO: 97765 - DNA, 30 bp, Homo sapiens; identical to SEQ ID NO: 41313
  chr7:50241354-50241384
  hypo

SEQ ID NO: 97766 - DNA, 206 bp, Homo sapiens
  chr7:50243557-50243763
  hypo
gtatgataggttcctcgccttcataatattctcagttgtaaccatacagtcatttatgtgatactttggttaatctccatctccctccacgaggctctatgctttctgcaaacaagcaccatggtcattttctctcagcgccctatttccagtacccagcatagtccctgcagcaagctgtttatgatcatcgtttgcataagtga

SEQ ID NO: 97767 - DNA, 255 bp, Homo sapiens
  chr7:50251373-50251628
  hypo
gaggaggcatccacacgctggcatcgggaggcaggtatccacacactggcatcgggaggtgtccacacattggcatcaggaggaggtgtccatacgctggtattgggaggcaggtgtcagcactctggcatcaggaggaggtaccctcacactggcatcgggaggaggtacctacatgcttgaatagggaggaggtgctcacacgctggcatcgggaggcaggtgtccacacgctggtatcgggaggcaggtgtc

SEQ ID NO: 97768 - DNA, 392 bp, Homo sapiens
  chr7:502708-503100
  hypo
ctgatacagcggggtcgtgggtgctctggcgggacggcccccaggcagccccgggccaggccagcccagaagggcctaggaggcagccgcgtggttaaagtgggggtgctgtttttgttgcgggatgtctgtgggtttgaacccccttgccctcatcacactggtggtgtgagccttgctcggaaagctggatttgaacgtcgtctgggtttggcgttggccctcagggcccggcgtccttccccggcgctgggacccagcctccggggagccgtgaagccctgccgtcttgtggctccaaagccggtccaccaatgacctcgtgccagcggcatcacgacgctgcctcacaccgcacaagactcgccgggaagatgcgagacccatgacag

SEQ ID NO: 97769 - DNA, 262 bp, Homo sapiens
  chr7:50293897-50294159
  hypo
tattgtgtcttcttccgagtatcaactccactgtggcatctgcctatgttcattcaccccggtgccttcaggttatatttttgtgttttgtccagggtttttagctggtctctgggaggtttggtccagcaggagctaacacagccatagcggaagctgccataggattttgtttattttcttttccttctgttttgtatttgtgaattttctttataagatcaagaaaggattcctggccgggcgcggtggctcacgcctg

SEQ ID NO: 97770 - DNA, 22 bp, Homo sapiens
  chr7:50294459-50294481
  hypo
catgaatcggtattcaattgta

SEQ ID NO: 97771 - DNA, 30 bp, Homo sapiens; identical to SEQ ID NO: 41317
  chr7:50337681-50337711
  hypo

SEQ ID NO: 97772 - DNA, 30 bp, Homo sapiens
  chr7:50342284-50342314
  hypo
taagagctgcatatgcgctcagggagaatg

SEQ ID NO: 97773 - DNA, 282 bp, Homo sapiens
  chr7:50343208-50343490
  hyper
cctcgggtgggcactcgcatcctggggccggagcctgaacccgggagccaaggggccccagttccagggacgtgaagctgagcgtacagcgggcgctcccagacactggggaaagtgctttacgatgtcccgagtccctccagtctcgccagcggggcgagcgtgagggtgccccgaccgaccagcggccccgggtgcagggtggcgggcccggcggcgcgcgtccccctccccctcctggcggcccgcacgtgtcgcccgcgccgcgcccccacgggttac

SEQ ID NO: 97774 - DNA, 320 bp, Homo sapiens; identical to SEQ ID NO: 3046
  chr7:50343974-50344294
  hyper

SEQ ID NO: 97775 - DNA, 36 bp, Homo sapiens; identical to SEQ ID NO: 3047
  chr7:50344295-50344331
  hyper

SEQ ID NO: 97776 - DNA, 406 bp, Homo sapiens; identical to SEQ ID NO: 3048
  chr7:50344332-50344738
  hyper

SEQ ID NO: 97777 - DNA, 42 bp, Homo sapiens
  chr7:50365027-50365069
  hypo
tgaaagaggtgaaaacgctaagatatttagcaattattactt

SEQ ID NO: 97778 - DNA, 354 bp, Homo sapiens
  chr7:503676-504030
  hypo
cagcccgggagggagcgtgaagtggaggatctcggcaggcgtggctgtgtccaggcaggcgggtgctgccgcgtccccggctgcagggtcttggttccccggagccacaggacggcagggcttcacggctccccggaggctgggtcccagcgctggggaaggacaccgggccctgagggccaacgccaaacccagacgacgttcaaatccagctttccgagcaaggctcacaccaccaggaaagccgatacactttctaaactccacttctgagttgaatattcgaaataggctcttaaagcaaatgttggcccccacgtcagagtcaaccatgttcatcggatgcctccagcc

SEQ ID NO: 97779 - DNA, 34 bp, Homo sapiens
  chr7:50423090-50423124
  hypo
tggggtaccggccaacgcccgccttgaggcctgg

SEQ ID NO: 97780 - DNA, 166 bp, Homo sapiens; identical to SEQ ID NO: 41320
  chr7:50438618-50438784
  hypo

SEQ ID NO: 97781 - DNA, 156 bp, Homo sapiens
  chr7:50444259-50444415
  hypo
gatgaagagaatgggcgtgcctgtgaaatgaatggggaagaatgtgcggaggatttacgaatgcttgatgcctcgggagagaaaatgaatggctcccacagggaccaaggcagctcggctttgtcgggagttggaggcattcgacttcctaacgga

SEQ ID NO: 97782 - DNA, 30 bp, Homo sapiens
  chr7:50454697-50454727
  hypo
acatctctgtccagtcgctggcatccacgt

SEQ ID NO: 97783 - DNA, 30 bp, Homo sapiens; identical to SEQ ID NO: 41322
  chr7:50471189-50471219
  hypo

SEQ ID NO: 97784 - DNA, 106 bp, Homo sapiens; identical to SEQ ID NO: 41323
  chr7:50560557-50560663
  hypo

SEQ ID NO: 97785 - DNA, 30 bp, Homo sapiens
  chr7:50561907-50561937
  hypo
gttattaagaatttccggccaggcaccgtg

SEQ ID NO: 97786 - DNA, 30 bp, Homo sapiens
  chr7:5081846-5081876
  hypo
ccgcctgatccaccacgcccagccacaacc

SEQ ID NO: 97787 - DNA, 99 bp, Homo sapiens
  chr7:50860193-50860292
  hyper
ggcaatcagcaaaggcgaagagttgcatcagaaatttccttctgcaaacggtaccgctcttatcacatttccacggctggcgggcggctaatccgcgag

SEQ ID NO: 97788 - DNA, 27 bp, Homo sapiens
  chr7:50861076-50861103
  hyper
aactttgggctccaccgggtctccgag

SEQ ID NO: 97789 - DNA, 196 bp, Homo sapiens
  chr7:50861335-50861531
  hyper
ggcgtggcgcgggggcgcgggccgcgggccggacggccggggggccagaagctcccggaggttcctgccccgggctgctgagcgggttcccccctcctgctgtcctcgggactcgggcgcgggaccacgaccgccgcggctcaggaggcttcgccagtgaaaggacaaattggacctgtcccgaaagacaatttat

SEQ ID NO: 97790 - DNA, 30 bp, Homo sapiens
  chr7:5112197-5112227
  hyper
agaggaagtcagggacgcagggaaaggaat

SEQ ID NO: 97791 - DNA, 62 bp, Homo sapiens
  chr7:51383330-51383392
  hyper
gtccccggcgcgccgcgctgaaaactacaaagtccaccgggactgcgcgctaccccgcggcc

SEQ ID NO: 97792 - DNA, 669 bp, Homo sapiens
  chr7:51384251-51384920
  hyper
gccccctctccaccccgcccgaccgcggggccgcttacccggtcgggggcttggccgccgaggcgcgcggcgcgtccatggtgccgggggccgggacgcgggcggtgctccgggcccgccgagtcaggcgctggctaccgccgccaccgctgccgccctcattcactttttccgcgctgacccatcgtcctcccacgcgggccggcggaggacagcggcggagcgcggcggacggaaggggctggaatcgtctctagcgggcgggggcgccgggagcgcagggaggggctggcggcggcgcggggcgggggcgccgggagcaaggtgcgccgcgcccccgccccggctgctctgccgcgcccaccggagcgccgcccccgccccgccccgccccgcctgctcagagtcccgacccggcccgcggcgagcgtccggggaaggaatcctccggcacctgggccctgcaccgacacccgcgggtgcggcagagggcttctccccgtgctcctccacccctggggggagcgcgaccctctctgggcggagtgggggatcccggggccggcgcctcctggcggagttgggggaggggaaccacctggagcctggaggccgtgcgagggcgaggtgggcggaccagcccgggaggactgacgttggagggtgaga

SEQ ID NO: 97793 - DNA, 105 bp, Homo sapiens
  chr7:51408343-51408448
  hypo
gagagtttcaggcagcgagtgtgcattctttagtgattagttggacaagtggaatgcctggtggttttcaaatcttgttatgtttaaaagtttcatatgaggcca

SEQ ID NO: 97794 - DNA, 37 bp, Homo sapiens
  chr7:5165566-5165603
  hypo
atcagcatgaatcaacgccacacgaaggtgagctggg

SEQ ID NO: 97795 - DNA, 30 bp, Homo sapiens
  chr7:51873296-51873326
  hypo
atctacttttattaccgtcaacaatcttct

SEQ ID NO: 97796 - DNA, 69 bp, Homo sapiens
  chr7:51886447-51886516
  hypo
ggcccatggatgcgtcggacagtgttccatcccacgtgcctcagaaaatgcaggcggaggcaaaggagt

SEQ ID NO: 97797 - DNA, 28 bp, Homo sapiens
  chr7:52268621-52268649
  hypo
ttttgtttgtttgttcgtttgtttgttt

SEQ ID NO: 97798 - DNA, 30 bp, Homo sapiens; identical to SEQ ID NO: 41325
  chr7:52499272-52499302
  hypo

SEQ ID NO: 97799 - DNA, 65 bp, Homo sapiens
  chr7:5262558-5262623
  hypo
gggccctccagtgcccggcagctcccagcctgctgtaagggacggggcggcgacgtcatgggtag

SEQ ID NO: 97800 - DNA, 61 bp, Homo sapiens
  chr7:52736850-52736911
  hypo
ccatgcctgaggagtcgggcaggcggcccgcccaggccacgctttccgtgtcctctggccc

SEQ ID NO: 97801 - DNA, 111 bp, Homo sapiens
  chr7:5305461-5305572
  hypo
aagtgcgtgcatctgcgtgagattgagtgtgtgtgggtgcgtctttttgtgtgtgtgtctttgtgtgtgtgtgtctaggtctgtccatctgtgcggcgcctttgtctcctg

SEQ ID NO: 97802 - DNA, 30 bp, Homo sapiens
  chr7:53103556-53103586
  hypo
tacttccagtgggggcgcccggtgcccagc

SEQ ID NO: 97803 - DNA, 60 bp, Homo sapiens
  chr7:53104173-53104233
  hypo
gacaacgccttcctgcggcagctgcagtagggtctccttcgccctcgaggtcacccagtc

SEQ ID NO: 97804 - DNA, 128 bp, Homo sapiens
  chr7:5316311-5316439
  hypo
ccccgaaagcccagccggccagccccctctccctctgcctccgcagggaaccgtgtcccaagcagggcccttcaccccatctctgtctgatctccactgcgtgtacggattgacgggaaagattctaa

SEQ ID NO: 97805 - DNA, 19 bp, Homo sapiens
  chr7:5320472-5320491
  hypo
cagccgtcatgaactttaa

SEQ ID NO: 97806 - DNA, 39 bp, Homo sapiens
  chr7:5323361-5323400
  hyper
gggcagcagaggcatcgttagccccggttaacggggacc

SEQ ID NO: 97807 - DNA, 125 bp, Homo sapiens
  chr7:532811-532936
  hypo
ttcctcgggaaaccccgtcctcccccattttctgtcttgtgcttctgatggaaatctatcccacaacagaaacggtacatgggactcagacccagcggatcccaggactccggatggagccaaag

SEQ ID NO: 97808 - DNA, 30 bp, Homo sapiens
  chr7:5328996-5329026
  hypo
cagcctgagcaacggcgagactctgaaaaa

SEQ ID NO: 97809 - DNA, 98 bp, Homo sapiens
  chr7:5334502-5334600
  hypo
gcttctacgggtacacggggatgctgcccaagcggtacacgcagggggtgatgaccggggagagtgagtatctgcagaccccccggggagggggtgct

SEQ ID NO: 97810 - DNA, 105 bp, Homo sapiens
  chr7:53364374-53364479
  hypo
agatatcctgtagatcggggtccccatgctccaggccatggaccgatactgttaggaactgggctacacagcaggaggtgagccgggtgagcaagtgaagcttca

SEQ ID NO: 97811 - DNA, 160 bp, Homo sapiens
  chr7:5342789-5342949
  hypo
cagcactgtgttctgcgtttggtctcatacctgcgtctaccttccatctgtgtccagcggccccggctccagcccagccagcactctgcagggtcacacgcaccgtgtccccacccaggacagcagacacccgccagagtgtgcgcgcccagtgactgca

SEQ ID NO: 97812 - DNA, 185 bp, Homo sapiens
  chr7:5343701-5343886
  hypo
caagcagagtttgtgcgtggacgggggctgggactgccatctcgggataccggtggaactcgggctgccccgcataagccggtcctcagtcttcccatctgtgaggtgggccgggtggatcagggagcaggagggtgtcctcacactgggtaggcttggtttgtgggcagcgctgggtagtgggg

SEQ ID NO: 97813 - DNA, 37 bp, Homo sapiens
  chr7:543015-543052
  hypo
aggctagaaaggaaacggaggccgggtcaccccctga

SEQ ID NO: 97814 - DNA, 142 bp, Homo sapiens; identical to SEQ ID NO: 41173
  chr7:5441304-5441446
  hypo

SEQ ID NO: 97815 - DNA, 661 bp, Homo sapiens
  chr7:5458939-5459600
  hyper
cgcaggcggggagtgcgcgacgccccttcccagcctcgaaaaagccaagcgcaggcccagccagccagagagacccgggtaccgattcccaggcttggggggggcccccctgccaccactccgggctggaccaaatgacccaaaagacacacgcatgcacacacacacacatcacggtggacttgtggggagcgcaaaaggggacagctcagatggtctctgtaccccagggccgccccccaagttcttcctcgggggtcccccgcgcccctccctcgccacaacacgccactagagaacaaacccttgccccggtcacagaccccgggcggaatacgcccccagctccggagggacacaagcaggtccgggggccaagacctggttcttgcgccccggctggcggggatctccgagctcccggcccccgggcgcgcgcccctcccccgcccggcgcctcacaaaggccctttgtcccgccgagcccccgggactccagttcctgaaaagttccaggagaaaaatcaaagagagagcaaaatcggcgagctccgccgagcgggcggggcaaggccgaggtggcagctcctgagagaccccaaggaagaggggagcatcgagggctactctggaaattgcaaaaatccgaaactgcaattcg

SEQ ID NO: 97816 - DNA, 93 bp, Homo sapiens
  chr7:5460480-5460573
  hyper
tacggaaaaggtagccgagccgcgcgacactctccaccgccttggctccgggaccaggagtttcccagccctgggagccgagtctgcccgcac

SEQ ID NO: 97817 - DNA, 371 bp, Homo sapiens
  chr7:54609581-54609952
  hyper
aaattcgtgtgaaatcgtagcatgtgatgctcctggttggagcagttaataactgggtaagcggcatttccctaaatggctgttttcctcggcccacccgtctctcccccatcccattgctccccggtcctcagcaatgccccaactccctcccggaaccttttgctccgagccccccgccagcgccgcaatcccgtcactgtattgtcctcctcggcaccgagcgatctgatccgccgagccagaaagacacccgatgggggagagaagcaaagtggaaaaaaaccgacgtccctgctctccagaagggagaccccagcggcgccgacgagccctgcgccctccgcggccgcccggcgcgagctcccggg

SEQ ID NO: 97818 - DNA, 31 bp, Homo sapiens; identical to SEQ ID NO: 31289
  chr7:54609991-54610022
  hyper

SEQ ID NO: 97819 - DNA, 313 bp, Homo sapiens
  chr7:54610023-54610336
  hyper
cgagcccggcgaagtcctcagcccgccccgcttgcccactccccacttcccgagccggctccgtgtttagggagggcagtgatcacgcaagccggagcggcgggctgacgttggacgagctgccaggtagctgaaagcaggcagccaggcagccgagacacttcccagcgattccagcctgggctccgcaggaagcctcgctgaatcccagccagctggttctaaccttccagaatcgcaatcccttctccccacagccagccctcgccaagcaagcagcaggatgtttgcagtgtcgcgcccagggctctga

SEQ ID NO: 97820 - DNA, 489 bp, Homo sapiens
  chr7:54612317-54612806
  hyper
aatttaccgagtttccgcggaacgtgacggcgaccgaggggcagaatgtggagatgtcctgcgccttccagagcggctccgcctcggtgtatctggagatccaatggtggttcctgcgggggccggaggacctggatcccggggccgagggggccggcgcgcaggtagcggagcccgccgaccccgcgtctccccttcgctcgcccggtcctcagggtgtccggcccggggctgggggccgaggtgctgcctggacacccctggggacctgcccggttctgtggaagcgagtgacccccagggcttctagggagggaaagggaatttgtcctggggacgcgaagttaaaacccagaaggaagtcctgctgcccagtttcttcctgttaaaccgggaagcgcctcctcctgtaagttctggtacttaggcagatgcccgccttgcccctaccacgctgccacatcccgggacatccgggagcccctttcc

SEQ ID NO: 97821 - DNA, 148 bp, Homo sapiens
  chr7:54614009-54614157
  hyper
ggaaaaggaaaatagcgggaggaggggagaggggaagggggtccgggcgagggagacctagttgagcgagaggcggcgcccctgcgagccagcaagagaatctggggccaggagcgcggggcgggacggcaggcgggatggtggccgg

SEQ ID NO: 97822 - DNA, 153 bp, Homo sapiens
  chr7:54614380-54614533
  hyper
gcgccgggacagccccgggacagccccggggaaagcgcggggacggcgtggggtatgccagggacagcgtggggtatgccagggacagcgtgggggcggtgcggtctgggcctggacaggggtggccacgcccctggtcgctcccctgtcccc

SEQ ID NO: 97823 - DNA, 38 bp, Homo sapiens
  chr7:54614739-54614777
  hyper
gcccttccctgtccccgagaaggcggcttgccagcgct

SEQ ID NO: 97824 - DNA, 50 bp, Homo sapiens
  chr7:5464999-5465049
  hyper
aaaacaagagaagcccgctctttcgccccgcgctgcggactcagcgtttt

SEQ ID NO: 97825 - DNA, 30 bp, Homo sapiens
  chr7:5466477-5466507
  hyper
ggagccatcttggggcggaggaccgatccc

SEQ ID NO: 97826 - DNA, 716 bp, Homo sapiens
  chr7:5467189-5467905
  hyper
gctcccgcgatcagacggtctctctcaattcggcgttgaacccggttcttcccaaattctggtattgctggccgcttggacacgttctccccttatccctcccccagcggggaaagaaaaagccaggatcctttccttggcgcggccacccgagccactccacccgtcgcgccaaccgcctttccaggtggggaccaaagcccccactctccgctggcatctcattgaagggcacccccccgagggattgccagcttctgctgccagctgagaggccgtgtggctgggcgtcttaagcgccggtttccgcaggtcccgtgtctggcgggcgcggctaaaacccggagaggctgtgcccgggaaagccacgttcgccgtcccctcgctgcgacaggcccagccgcgatacagcgccaagtctaggtcgggccaacccagccaggagctgcccggacctgcctgaaagaccagggacgcggcgccagcgccccacaccccaccgagaccagggcgcaaggcgggcagaattcggactgatgcgccaggcccagccccgatggattccagctcctctcggccccgcctccggccctggcctcttcctccagccggggtcgggtcctccactccactgtttggctgggaaaggaccgagacgcgctcagtgcacagggggccggctgcggccataaatctccgggcgggccctccttccc

SEQ ID NO: 97827 - DNA, 510 bp, Homo sapiens; identical to SEQ ID NO: 31295
  chr7:54732044-54732554
  hyper

SEQ ID NO: 97828 - DNA, 253 bp, Homo sapiens
  chr7:54794703-54794956
  hypo
cacaccacagcctcacggcttgttctgttagaccgatgcctccgcccggctctctccgtgtcctgcacacagtacgccactacccggggtatgaaatataatacgtccaaggtcactcaaagggcatcatatttaagacttaaaatctcttcaagttccctgccacctctgaaaagagtagcagataatgaaattcagaacttcgttgtccgagtgacccggcacatgtgagactctccggagttttagggag

SEQ ID NO: 97829 - DNA, 30 bp, Homo sapiens
  chr7:5483425-5483455
  hypo
aaatccaatgactcccgtccttaagagaca

SEQ ID NO: 97830 - DNA, 19 bp, Homo sapiens
  chr7:54846014-54846033
  hypo
tgccatggctgggcacggt

SEQ ID NO: 97831 - DNA, 30 bp, Homo sapiens; identical to SEQ ID NO: 41329
  chr7:54866907-54866937
  hypo

SEQ ID NO: 97832 - DNA, 33 bp, Homo sapiens
  chr7:5494673-5494706
  hypo
gagtgccaccttccacgccgtcactttaggagt

SEQ ID NO: 97833 - DNA, 118 bp, Homo sapiens
  chr7:55086571-55086689
  hyper
ctggccttgggtccccgctgctggttctcctccctcctcctcgcattctcctcctcctctgctcctcccgatccctcctccgccgcctggtccctcctcctcccgccctgcctccccg

SEQ ID NO: 97834 - DNA, 820 bp, Homo sapiens
  chr7:55086983-55087803
  hyper
ggacggccggggcagcgctcctggcgctgctggctgcgctctgcccggcgagtcgggctctggaggaaaagaaaggtaagggcgtgtctcgccggctcccgcgccgcccccggatcgcgccccggaccccgcagcccgcccaaccgcgcaccggcgcaccggctcggcgcccgcgcccccgcccgtcctttcctgtttccttgagatcagctgcgccgccgaccgggaccgcgggaggaacgggacgtttcgttcttcggccgggagagtctggggcgggcggaggaggagacgcgtgggacaccgggctgcaggccaggcggggaacggccgccgggacctccggcgccccgaaccgctcccaactttcttccctcactttccccgcccagctgcgcaggatcggcgtcagtgggcgaaagccgggtgctggtgggcgcctggggccggggtcccgcacgtgcgccccgcgctgtcttcccagggcgcgacggggtcctggcgcgcacccgaggggcgggcgctgcccacccgccgagactgcactgtttagggaagctgaggaaggaacccaaaaatacagcctcccctcggaccccgcgggacaggcggctttctgagaggacctccccgcctccgccctccgcgcaggtctcaaactgaagccggcgcccgccagcctggccccggcccctctccaggtccccgcgatcctcgttccccagtgtggagtcgcagcctcgacctgggagctgggagaactcgtctaccaccacctgcggctcccggggaggggtggtgctggcggcggttagtttcc

SEQ ID NO: 97835 - DNA, 135 bp, Homo sapiens
  chr7:55145845-55145980
  hypo
tatttgggtgtgtggcgtgtggggaggggagaaggagcaaggcggcagggaggggatgaggaccaccctgtccatgggacaggccctgggccccgcacacaccccaagccccgcgtcccgcgtcctcactgtcct

SEQ ID NO: 97836 - DNA, 112 bp, Homo sapiens; identical to SEQ ID NO: 41034
  chr7:551572-551684
  hypo

SEQ ID NO: 97837 - DNA, 66 bp, Homo sapiens
  chr7:551953-552019
  hypo
ccctgccctgcccatcgcggcctcctggactcaccgatgcttctcttcctccgaatgggcaggggc

SEQ ID NO: 97838 - DNA, 195 bp, Homo sapiens
  chr7:5521589-5521784
  hypo
ttacatgggtggccacggagggggcggagcctgctggggaagcccaggaggcactcacacctgcctccccgtcccgggctcacctggggctcccagacagaccatgcctgccagagtcaccctctaagtgcctcaagggccctgtacgtggcagacagagctggggaggagcacggcagccgggaacaggccaca

SEQ ID NO: 97839 - DNA, 105 bp, Homo sapiens; identical to SEQ ID NO: 31029
  chr7:5526299-5526404
  hyper

SEQ ID NO: 97840 - DNA, 142 bp, Homo sapiens
  chr7:552953-553095
  hypo
ccaccccttcacaggcgctgacggctacagcagacaggctgggggagtctcaggtctctccaaatcccgcagtagggagaggacccacagtcctgcccatggacacactgcccgcacctgggcaccgcgggtggctctgggc

SEQ ID NO: 97841 - DNA, 116 bp, Homo sapiens; identical to SEQ ID NO: 41174
  chr7:5529839-5529955
  hypo

SEQ ID NO: 97842 - DNA, 194 bp, Homo sapiens
  chr7:55382606-55382800
  hypo
agttgaataaagttgcgctcaattttggctcatgtattgactcagttgccagtttgggctcatttattctgtatcactgaaggtggtcctcagacagtgatgaagggccctcctcagccagaagcagagccctggcaggaaagcgcaagacagctcctattgtcaggccctgggcaccacgccacctcctcctg

SEQ ID NO: 97843 - DNA, 305 bp, Homo sapiens
  chr7:55410019-55410324
  hypo
gggtcagggcagaggcgcaggtggtgcgacgccacggagttggtccccatggccgtgagccagccccagcggcacagccgccctgtccccagcggcatctaggtgatggccaactccaggccgctctccagctgcttggcctggcacctcagctctgccagctcccggaagcaacaggccaccaagcggccccgggctcccgtggcagtgagccctctactctgctctcaaaaactgatgccgccaaggagcccgccatggccagccctgctcaaagccagggccagccccgggagccaagccgc

SEQ ID NO: 97844 - DNA, 30 bp, Homo sapiens
  chr7:55432093-55432123
  hypo
tggattttcctacaccgtctaggtatgaaa

SEQ ID NO: 97845 - DNA, 30 bp, Homo sapiens
  chr7:55570199-55570229
  hypo
caggccccagctactcgaaggagcacacaa

SEQ ID NO: 97846 - DNA, 30 bp, Homo sapiens
  chr7:556686-556716
  hyper
gcccagggtctgggccggatcctgccgctc

SEQ ID NO: 97847 - DNA, 127 bp, Homo sapiens
  chr7:557093-557220
  hyper
gcctctcgatcacctcgcgggggatctcggcttcctgcaagcagaggccacacggtcagcgcccgcggccccgaccccgccggcacgcgcccccggccgccaggagcgccgccgccccgggcccgag

SEQ ID NO: 97848 - DNA, 157 bp, Homo sapiens
  chr7:55838624-55838781
  hypo
gcctcccaggcagggcggtgcctgttctggaccagatcccaggtccaaggggatttcctctacaccgcagacttctctttgatcttcccttctttgaaattacagggcagggatgcgatttccatccaggtagttttgtttgtttgtttgtttgttt

SEQ ID NO: 97849 - DNA, 136 bp, Homo sapiens
  chr7:5589419-5589555
  hypo
gggctctttgggaagcgtctggagagactttggtggggaggtctggactggacaccatttctatcctggccagtacccagcaaagtaagtgaagaggccgggcgcggtggctcacgcctgtaatcccagctatttg

SEQ ID NO: 97850 - DNA, 19 bp, Homo sapiens
  chr7:55940140-55940159
  hypo
tttatttttttgagacgga

SEQ ID NO: 97851 - DNA, 360 bp, Homo sapiens
  chr7:56017869-56018229
  hypo
tgagccgagattgtgagcgagactccgtctgaaaaaaaaaaaaaaatctaattgtatagaatattgttacaaccacacagaagaaaaaaaaagaatcccaagaaatgttgaacacagtgctgtcattgtacactctaaggacaaaaagaaccacaaaaaataatctcacgcatcacttagaaagtttgtttttagtcgggatattgttagtacaactccaaaagcatatagtgtatactataggatttagcattaatcattgatgttgtcggggtagggaccagagttctaactgtggaagaaaggagataaaaatacggaactggtgaagcaaaagaagaaacccactggtggctcatg

SEQ ID NO: 97852 - DNA, 161 bp, Homo sapiens
  chr7:560181-560342
  hyper
ccagtcccccactcccgcgccgaaggcagggccgcgccctgagccgggaagtcgaggggatggaagggaaaggagccaccggtgagggtcccccgggttctgagcctcccgcgtcgggatccgtggggcgcacagagcgccacctccggccgaggcgcagc

SEQ ID NO: 97853 - DNA, 240 bp, Homo sapiens
  chr7:56018469-56018709
  hypo
cgacagagacagcctccgtcccaaaaaagaaagaaacccactgctgtttaaaggtaggtgtgtgtgtgcgtgtgtgtatgtttcaatgtatcgatagctacatctgctgaaatagcctacaggcaggaaaatcccagtagcaagttgctcacctagcactcagagctttgttgctaagtaccactccccactgatatttttcgtttgaaaaacttctgatacaataactggtcagggaaa

SEQ ID NO: 97854 - DNA, 23 bp, Homo sapiens
  chr7:56031846-56031869
  hypo
tgttaaagcgttgtggggctttt

SEQ ID NO: 97855 - DNA, 40 bp, Homo sapiens
  chr7:560554-560594
  hyper
gtgctgtgcagaccccgaggctagacggcctaggcccctg

SEQ ID NO: 97856 - DNA, 317 bp, Homo sapiens
  chr7:560928-561245
  hyper
cgcagccccacaccacgacccccgcggtcaagcatgccctctgggtggtcaggaccaagcgggaccgggacagaaccaggggagccttggaaacgtggaggagccccttaaagccaggccttgtccctccagggggaacttgcggcttgggaggggacacccactgcatggcttctggaaagagccggactcgcagggccaggacgcaggccggaccccggcctcattcttcggccagttatcccggagtggcgcgcatcctgtcttcctgggcctcggactgctcgcgcgcagagggggcccgaggacacctctgt

SEQ ID NO: 97857 - DNA, 25 bp, Homo sapiens
  chr7:56120758-56120783
  hypo
ttaccaggcccgtgcccagctgggt

SEQ ID NO: 97858 - DNA, 198 bp, Homo sapiens
  chr7:5614360-5614558
  hyper
taaaaattcatgccccgtgtgcacttcagtctagaacacacttccttttgttttaacgtgatacagcgttttcactatacaacttctggtaaaattgctgcctggttatccgggggctgtgtctggtcagagagggggcctggcaggctgggaaggacagggaggggtgggggagggggaagacgggtgggggaaggt

SEQ ID NO: 97859 - DNA, 30 bp, Homo sapiens; identical to SEQ ID NO: 41334
  chr7:56144506-56144536
  hypo

SEQ ID NO: 97860 - DNA, 17 bp, Homo sapiens
  chr7:56172896-56172913
  hypo
cccggccactttaatct

SEQ ID NO: 97861 - DNA, 35 bp, Homo sapiens
  chr7:56176289-56176324
  hypo
taatggcaggctgggcgtggtggctcacgcctgta

SEQ ID NO: 97862 - DNA, 121 bp, Homo sapiens
  chr7:56183581-56183702
  hyper
tgcggttccctaatacggttccctcagaggcagccgactctgcccagggcgagcagcgccgcgccgtggggggacgctcctagggtccccggggcactggttgggggaggtgttgggcgca

SEQ ID NO: 97863 - DNA, 332 bp, Homo sapiens
  chr7:56183846-56184178
  hyper
cgccgagtccggcccttgctgcgccctgccccgcaggccgggaagtcgcgcaggtagtagtagtccaggcagtcgtaaagctcctcctcgtagcttatgggtggcggcggccgagccagagcctgcagacgtggaagcgcccgctctgcgggcgcttccatcctgcccaggcctgtggccaccggcggccacctgcccgcgtctgggcgctcctggaagacccagcagccccgcctcgagttccgatgggctccgcgtgaaggtgggggtgccttcggcgacgccacagaggcggaccttcgacgacgtcacagtggcggtacagtgcctgg

SEQ ID NO: 97864 - DNA, 171 bp, Homo sapiens
  chr7:5626087-5626258
  hypo
ggtcctcccggctgacggtgacgtcactatgagccaccacgcctggcccggtgggtgtttacagcagaggtggttcagggaggagtgagtggcagatggtgcaggctcagggaggagtgagtggcaggtggggcctgaggccagaggcaggaggaccgttcaagactgagg

SEQ ID NO: 97865 - DNA, 211 bp, Homo sapiens
  chr7:562619-562830
  hyper
ggcacccagggagggcgggaaaggccttggccattcctctgggtaggggactggagaggggaagaaactttcgccgagtccagcgctgccccctcatacccatccccacccaggctgcgtgtccggggcccctccggggcttggcaccagcaggcacgcagcgatcgccgtcgttgttatttagtagtagtagtaacggctgacatttaca

SEQ ID NO: 97866 - DNA, 43 bp, Homo sapiens
  chr7:5629890-5629933
  hypo
ggactggcctcacctcgtgccacgccctcgtaccaaggtggct

SEQ ID NO: 97867 - DNA, 569 bp, Homo sapiens
  chr7:5632903-5633472
  hyper
ggcggcaccgaggaccgcctgtcctgcttcgcgcagacggtgtcccccgccgagaagtggagcgtgcacatcgccatgcaccctcaggtcaacatctacagcgtcacccgtaagcgctacgcgcacctgagcgcgcggccggccgacgagatcgccgtggaccgcgacgtgccctggggcgtcgactcgctcatcaccctcgccttccaggaccagcgctacagcgtgcagaccgccgaccaccgcttcctgcgccacgacgggcgcctggtggcgcgccccgagccggccactggctacacgctggagttccgctccggcaaggtggccttccgcgactgcgagggccgttacctggcgccgtcggggcccagcggcacgctcaaggcgggcaaggccaccaaggtgggcaaggacgagctctttgctctggagcagagctgcgcccaggtcgtgctgcaggcggccaacgagaggaacgtgtccacgcgccagggtgagtggggacgctgcccccgcctctcctggtccgtgcacaaagcgcaccccacccgcgcccctccagcctc

SEQ ID NO: 97868 - DNA, 62 bp, Homo sapiens
  chr7:56355682-56355744
  hyper
cgcggtcccggacagctccgtctctggcgttggcgctgcagccgtgacggaggactacggcg

SEQ ID NO: 97869 - DNA, 102 bp, Homo sapiens
  chr7:5635640-5635742
  hyper
gaaagggatgtgggacggcgcgggggtgggggtacttgggggccgaggttggggctcctctggcctcagatcttggggtccttatctcgtttctatgtcagc

SEQ ID NO: 97870 - DNA, 32 bp, Homo sapiens
  chr7:5637847-5637879
  hypo
gggtgcctggccccccgcggtgggtgcctcac

SEQ ID NO: 97871 - DNA, 23 bp, Homo sapiens
  chr7:5644690-5644713
  hypo
actgcggccgagcagaacacgtt

SEQ ID NO: 97872 - DNA, 30 bp, Homo sapiens
  chr7:5645977-5646007
  hypo
tctttccgtccttcccgtccagccccagcc

SEQ ID NO: 97873 - DNA, 581 bp, Homo sapiens
  chr7:5647838-5648419
  hypo
agccaggccaggggccgggggcatctctggggtcccaggtgagatgcgggtcgagggagccaggccacggttctccagactcgcgtggaggccacgagcgtcttctggaggagcgggcactgcgcggaccggcagactctggggcgctcaggctccccatctcctgaccttttcctaccttcagttccctcctgtcaggacaggttctggggctcgccggggcagggagccagggcagagggtgcagtttccgctcctgcctgagtcaccttcgctttctcagcgattcttcattcacaagggcgtggcccatcacacgcactcacacacttgtgaacttgcacgcacacacacatatggacctgtgcaaagagccccatgcacaggcaggtacacgtgcatgtaggcgtgcacacagacacgcacagatgcaggcagaccaactcccaggaatctgtctccagcctacagggattcagcactcagggtaccagcctctgtcccgtgcacccccattcccggcagttctcccaggtgggtcgggggccactagggaccccataccccgagggtggctcctc

SEQ ID NO: 97874 - DNA, 30 bp, Homo sapiens
  chr7:572406-572436
  hypo
ggctaagtctgggctcgtgctgccccaggt

SEQ ID NO: 97875 - DNA, 167 bp, Homo sapiens
  chr7:57247720-57247887
  hypo
agcacacagcaacagcggcccaaacgccgtgcaggccacacctgtccactaggtcacgctttccactccactgcttggccaccgtctgcagggctaagagcagtgcaggaggaggctgcggacaggtcgcatcaggtacctgagacgatccgcgccatctttgctga

SEQ ID NO: 97876 - DNA, 45 bp, Homo sapiens
  chr7:57259548-57259593
  hypo
ctttggctttgaagccgtggcctgatattgacactttgtagatgt

SEQ ID NO: 97877 - DNA, 104 bp, Homo sapiens
  chr7:57259653-57259757
  hypo
aacagtaccattgacttccaatcagtttcgacaacatccgaaaaagagtaattaacctgccctagcagtcaacaccctattagctctatcgctaatagttatta

SEQ ID NO: 97878 - DNA, 21 bp, Homo sapiens
  chr7:57655640-57655661
  hypo
ccaccgcgcctggcccatata

SEQ ID NO: 97879 - DNA, 30 bp, Homo sapiens
  chr7:57832360-57832390
  hypo
tgcccagaaggtgttcgggtgagtctcccc

SEQ ID NO: 97880 - DNA, 126 bp, Homo sapiens; identical to SEQ ID NO: 41036
  chr7:578922-579048
  hypo

SEQ ID NO: 97881 - DNA, 17 bp, Homo sapiens
  chr7:57928223-57928240
  hyper
accgggggaaaaagccg

SEQ ID NO: 97882 - DNA, 16 bp, Homo sapiens
  chr7:5862009-5862025
  hypo
gcgcccaaccccaaaa

SEQ ID NO: 97883 - DNA, 30 bp, Homo sapiens
  chr7:5864832-5864862
  hypo
cctaaatactgttgacgaccctttgtactc

SEQ ID NO: 97884 - DNA, 251 bp, Homo sapiens
  chr7:5896830-5897081
  hypo
atggaggaaattacccgagcaagactaggggaaggaatcacacaatagaaacaggcagaataattccaaagtccacaaaaagctgggaaccgttcgtgtttccagcaggcaaagtgaaaaacctcataatacctggggcattgaatcaagtgttcagaggggcgttgccttcgtggtgcggcagaattggccctagactaagggttggtctagttctgcaagtctcaaaaggaccacgcatctgggtgcgg

SEQ ID NO: 97885 - DNA, 30 bp, Homo sapiens
  chr7:6060451-6060481
  hypo
ccaggattgaaggcacgcagggctaagcta

SEQ ID NO: 97886 - DNA, 56 bp, Homo sapiens; identical to SEQ ID NO: 41180
  chr7:6060716-6060772
  hypo

SEQ ID NO: 97887 - DNA, 147 bp, Homo sapiens
  chr7:6068145-6068292
  hypo
gtgctgggattacaggcgtgagccactgcacccaaccctgtattgttatttaagactgcagaataagttgaatgaaagggcagaaagcaacaaatactaccttggcatcatactcagatccttccaactgttcgggtgaagcgtaca

SEQ ID NO: 97888 - DNA, 30 bp, Homo sapiens
  chr7:6068539-6068569
  hypo
aaaacttactcttcccgtttctgttggtcc

SEQ ID NO: 97889 - DNA, 17 bp, Homo sapiens
  chr7:6099217-6099234
  hypo
tatgccacaaaaaaacg

SEQ ID NO: 97890 - DNA, 94 bp, Homo sapiens; identical to SEQ ID NO: 41182
  chr7:6124620-6124714
  hypo

SEQ ID NO: 97891 - DNA, 68 bp, Homo sapiens
  chr7:612677-612745
  hypo
cctgtctgatgctgtcggtggccgccctggacgtgcggtccacagctggaaaccgcaataagctgcga

SEQ ID NO: 97892 - DNA, 33 bp, Homo sapiens
  chr7:6143243-6143276
  hypo
gcatcaggtcttgggcggtggctccggagtgta

SEQ ID NO: 97893 - DNA, 30 bp, Homo sapiens
  chr7:6188726-6188756
  hypo
aggagaatgtggagacgttgtggggcagtg

SEQ ID NO: 97894 - DNA, 32 bp, Homo sapiens
  chr7:6189029-6189061
  hypo
cctgtggaaagtatgcgcgggtaggagggatt

SEQ ID NO: 97895 - DNA, 30 bp, Homo sapiens
  chr7:6203535-6203565
  hypo
ctgacctgtatgaaacgctgccatgtgtgt

SEQ ID NO: 97896 - DNA, 64 bp, Homo sapiens; identical to SEQ ID NO: 41184
  chr7:6241990-6242054
  hypo

SEQ ID NO: 97897 - DNA, 30 bp, Homo sapiens
  chr7:63020296-63020326
  hypo
ggggttttagaggggcgatccggagaaggg

SEQ ID NO: 97898 - DNA, 24 bp, Homo sapiens
  chr7:63393338-63393362
  hypo
gtgcctggccggtttggaagaaat

SEQ ID NO: 97899 - DNA, 30 bp, Homo sapiens
  chr7:63562154-63562184
  hypo
cacaaaccgccttggcgattgatctgtcct

SEQ ID NO: 97900 - DNA, 46 bp, Homo sapiens
  chr7:63574716-63574762
  hypo
cagcatcaacaagcacgaggatgcggacctgcgtttgtgctcctgg

SEQ ID NO: 97901 - DNA, 156 bp, Homo sapiens
  chr7:63652683-63652839
  hypo
tggccaacacctccccggagctcctggagagcgaggcgaagaaagactcagccggcacaaggcaaaggttcagcgggttgagggttcaaggacacggaacgggtgcctgggtggaaagcggtcaccaggtgtgagtgtcaccgtggggccagtgcc

SEQ ID NO: 97902 - DNA, 180 bp, Homo sapiens
  chr7:63666583-63666763
  hypo
acgagagagaaccgggaaggtggggaggggagatgtgccacatttttaaaccatcgggtatcttgagagctcccttattatcccaagaacaggatgaggataatccaccccaatgatccaatcacctcttacacagtccctaccgtgacacatgggaattacaattttttttttctttga

SEQ ID NO: 97903 - DNA, 30 bp, Homo sapiens
  chr7:63709605-63709635
  hypo
ggacccaaacttcctcgcagtcagctccgg

SEQ ID NO: 97904 - DNA, 30 bp, Homo sapiens
  chr7:63767097-63767127
  hyper
gcagcagggggtgagcgggcagcactgctt

SEQ ID NO: 97905 - DNA, 503 bp, Homo sapiens
  chr7:63767577-63768080
  hyper
acaggcgaaaaccaccgcgccctgccgccctgccgccctgccgccctgcctctctttctaaagctatgcccaaaccccgagcccggagcatgccgggattgtagtcctgcagtcctgcaacctagggactgcgagaggttaagagactacatctctcagcatgtctagctaggcgcgcaccgccgtgtccccagggcttcgcaccgcccccagacttgcgcatgctgggattgtaatactgtcgccttgccaccaacgggctacgagcggttaagagactacagctcccaggatgtacggtgatggcacccgtttggactccgcccctctgcgcgtctagagctgttctcccgtgcggaggggatcctggctgttcccaaatctcgcctgcctgcgaggagccagcgtggcccgggcagctgatctcaacctgtgattgtgacatcacccctacctgaggaagcctcttccagcctgctcaaggttgccgtagttaggtttac

SEQ ID NO: 97906 - DNA, 30 bp, Homo sapiens
  chr7:63804386-63804416
  hypo
aagaaatacaagggccgagcatggtggctc

SEQ ID NO: 97907 - DNA, 156 bp, Homo sapiens
  chr7:63813303-63813459
  hypo
gtcctacagaccatcactatcagccccctggattctgcctctttcctatgggtatgttcaggggtgtaacctgctttgctcgagttgcagctactttttctgggaagcctggaaagccagtatctaaggctcttgaatctgcgcaggcctaagtgg

SEQ ID NO: 97908 - DNA, 46 bp, Homo sapiens
  chr7:6386422-6386468
  hypo
ttgatatggccaaaccgacgttagaaagggacggcacctgcagtgt

SEQ ID NO: 97909 - DNA, 40 bp, Homo sapiens
  chr7:63867671-63867711
  hypo
ggccaagtgtgaggccggggcgtggcggctgatcccactg

SEQ ID NO: 97910 - DNA, 38 bp, Homo sapiens
  chr7:63931021-63931059
  hypo
tgaagaatgtgtggccgggcacggtggctcacgcctgt

SEQ ID NO: 97911 - DNA, 111 bp, Homo sapiens
  chr7:64030481-64030592
  hyper
aggtgtagaggccctcgtcgccgagccccacctcggtgacgaggatggagaactcctcgggggtgttgatgagcagccgcacccgcgggtccctggtcctgcggtcgttgc

SEQ ID NO: 97912 - DNA, 139 bp, Homo sapiens
  chr7:64030846-64030985
  hyper
aagggggggccggtccggggcgcgcgaggcctggggggagaggggcaagggggagggggaagggggagggggaccccgcctgcggctgcaccggcccggggtcgggggagggggctggggggcgcgatccataattttt

SEQ ID NO: 97913 - DNA, 30 bp, Homo sapiens
  chr7:6431846-6431876
  hypo
gttttgtgttttgagcgttaccagctgttc

SEQ ID NO: 97914 - DNA, 301 bp, Homo sapiens
  chr7:64330254-64330555
  hypo
cgcctcctcctccagcgggatgaaccacggagacgccccaaagaggctgtactgtcgagacttctagggtcccacagtgggttgtcgcaggcagcctttttctttagatcagaccggctatgcccgtactattttcccctgcttaggcaggctgacatccctgacagctgggcgcccgagccggcctcgcgaatgcacatacgccagttgcggggcaccaggcacgagtggtgagctgcggctgtcgtcacagtgaacgccaccgttgcctggccacgggtccctgcggcttggcaaacca

SEQ ID NO: 97915 - DNA, 153 bp, Homo sapiens
  chr7:64337977-64338130
  hyper
gccactgttgcctggcgacgggtccctgcgtcatggcggagaaggggacctctgtggacgtgcatcgccgttggactctcgcctgtcttctctgaaggatccatgggatagtcccgcgatcctagaagtgtgctggggcgacccagcctgaag

SEQ ID NO: 97916 - DNA, 30 bp, Homo sapiens
  chr7:64340264-64340294
  hypo
gcaacgttgggggcccgcagtacttgttgc

SEQ ID NO: 97917 - DNA, 50 bp, Homo sapiens
  chr7:64345161-64345211
  hypo
cccacctcacattctcgaatcgccttttcctccagcgggacccgactaat

SEQ ID NO: 97918 - DNA, 98 bp, Homo sapiens; identical to SEQ ID NO: 31301
  chr7:64349041-64349139
  hyper

SEQ ID NO: 97919 - DNA, 55 bp, Homo sapiens
  chr7:64349409-64349464
  hyper
ccacaaagcaggaagcgaagaacgtttctcctacctagagcgcagccgttttgcg

SEQ ID NO: 97920 - DNA, 36 bp, Homo sapiens
  chr7:64350000-64350036
  hyper
ggggctgctgctgaccggagccgcctgggtctgttc

SEQ ID NO: 97921 - DNA, 78 bp, Homo sapiens
  chr7:64362694-64362772
  hypo
agaagctaggaaggtcgtaaaatcggatattaaataatgttattatattttttccatttgttaatagccatataattg

SEQ ID NO: 97922 - DNA, 42 bp, Homo sapiens
  chr7:6438069-6438111
  hypo
ctctgtcttcaccatcgttgaacttaacgcctgcttttgacc

SEQ ID NO: 97923 - DNA, 454 bp, Homo sapiens
  chr7:64407780-64408234
  hyper
cgcatcgctctgtccctctcatgtcaggcaagccagttccggaccgcgtggcaccaggagccgccaggagccggggcgacccagaggtctccagcgacctggcgtccggcgaggacacagcccccaggaggggttagaccacgggagccggagcccgagtcccagggccgccgagccagtttagagtggtctccaggccctagtgggaaggggctccgcgcttctgggcgtccacaggagctgcatggccctgcccgctgacgcccggtcgggacgctccacaccctgtgtgggggcggaggggacgcggtgggtgcggcctgggcgcgggtgggctagagcctggagaccgccgggagcccgacttcctggcgctttgccctttggggagcggagccaaggaacagcgccaacctctctccacaagccagggaccctacgacccaccgccgca

SEQ ID NO: 97924 - DNA, 17 bp, Homo sapiens
  chr7:64416654-64416671
  hypo
gccgccagtgggctctt

SEQ ID NO: 97925 - DNA, 196 bp, Homo sapiens
  chr7:6443279-6443475
  hypo
gtcttgccagattaccgacactgtcacttgaccaatactgaccctctttacctcgcccacgcggacacacgcctcctgtagtcgctttgcctattgatgttcctttgggtctgtgaggttctgtaaactgtgctagtgctgacgatgttctgtacaacttaactcactggcgagaatacagcgtgggacccttcag

SEQ ID NO: 97926 - DNA, 30 bp, Homo sapiens
  chr7:6443689-6443719
  hypo
cagtcattttcaatgcgtgtctccacacag

SEQ ID NO: 97927 - DNA, 34 bp, Homo sapiens; identical to SEQ ID NO: 41186
  chr7:6443956-6443990
  hypo

SEQ ID NO: 97928 - DNA, 93 bp, Homo sapiens; identical to SEQ ID NO: 41187
  chr7:6444050-6444143
  hypo

SEQ ID NO: 97929 - DNA, 29 bp, Homo sapiens
  chr7:64450761-64450790
  hypo
tggccactggcccagcggattaacatcca

SEQ ID NO: 97930 - DNA, 131 bp, Homo sapiens
  chr7:64458258-64458389
  hypo
ctggtaaataaaagtcggttgcccccccttgaacctgcccctgttcatcataatagataggtccccgtgtttcacggaggggcatctgccacactctggtgtggccaggtcgaaggcggcctgcttgatca

SEQ ID NO: 97931 - DNA, 79 bp, Homo sapiens
  chr7:64459087-64459166
  hypo
tatgagtcctgaacccggaccaccacaatctataagttgtggggcacctccctaagccatatgccgtagccccaaagga

SEQ ID NO: 97932 - DNA, 39 bp, Homo sapiens
  chr7:64540683-64540722
  hypo
caggcgtgagccaccatgcccagccgaaaatccatttta

SEQ ID NO: 97933 - DNA, 62 bp, Homo sapiens
  chr7:6456254-6456316
  hypo
cacctccacagcccccggggtggggagaaggcgtagcacctgacctgcgggtaggcggctct

SEQ ID NO: 97934 - DNA, 428 bp, Homo sapiens
  chr7:64700283-64700711
  hyper
ggtgggcaaagagggcggctccttacgtaggcgggcagagacagaagctggcgtggccgggctcctgctcccctattctccgacccccgccacctagcccgcgccacccagggctcctggatcgtctggctcggggcctcctccccgctgcgttccctccctggcggctgcagagccctcctgggcagcggaaacaaacttccccgagcaggaagcccgtgccccagcctcctctcggcaaggaccagcccgcggaacaccccggcccctcggcgcctgccctgtccttctggctacgggtccaggagggctggcatgagaccaatcgcgaccctgcggttccagagcctgcgtcccgcactgccgagaccacacagtctcctctcttaggagccttgacatggccctcttgacgggtggttggggga

SEQ ID NO: 97935 - DNA, 806 bp, Homo sapiens
  chr7:64712198-64713004
  hyper
tgctgccttaagtcccgctgtccctgtcacccgtgttcccgtggctctgggcccctgccacgccaggcgtgctcttctgtttctggctgtcccaccggcgatgctgcgcttccacaccacccggcgcacaggcgttggtagatgtggaaggtaccaagagcggcaggaggaaggggcgcgcggacacccagccccttcccgcgcacccagagcaggaagagcagcgcgcacccggtcagcgacgcggcgggctccactgtggcgcgcgcactccgagcacggagggctgcaggctcacgccacctggctccgcgcccatcccaatccgcacccgccgcccaggaaccggggctcaccctccgcctgacaattgtctcggggtgccgagggtccgtggcccgttgcccgggaggtgaccactgaggagtcgcgctgggtatcggaccaggaactcactgctttcattggctgcggaggtcagaccgtcccaccctcttctccccgccgccgcggcaaggccagggcgaaagggacaagtgcgctgctggggtcctctgcgctgtgcgggtccgggactcagggttcccggctgctaacaaggctgcgtagcttccccctcccctcctccttaggtggcaacttgtggacacacccattaagcggtcaggcgtcaggtttcctcccgagaggtgggaggcgccctggccttgattcatcgtgaagctaggcaggagatttcccagccacggagggtggaaagcttgccttgacctcagcaggtcatgtcactccgtgtgcacaaggcc

SEQ ID NO: 97936 - DNA, 642 bp, Homo sapiens
  chr7:64734196-64734838
  hyper
tgtcagagtaggaaccgtcctatcaggcacgcagttggggaggagggcgtggcttccagcgtttggcgcggcctttgtctctggctcaggccggagcctgagatccatctctactgtcccgcgtgttgcccctcgggagcactaggtgactttgtcacatcctctgttgccctgagatctggaggtactgggaaatgcatagctaagatgccaggacatcctggaaaccaggaaatggtgagtacgcggggttgggcatcccaagaggggagagtgggctggttgaaaccagcggaaccggcctccccacggtcagctcccgggtccacagacctgagtccccgttggcgcagctgggccctcagtacccccggagagtggggtggggggcggtgcaagacggcagctgagccagcggactttgacccctcaccgtcctcttcccgcgccgcgacctgcctgaaactctctgggcagcgctgcacccgcagccccgactctctcccagattgttcagggatgacagagggtcattagagcagaatcccgactcggtgggtgcgtgggaggagctgcggccagtggggtccccagtgtctcctgttaaaaaaatttttttttgagatgaagtctcgctgtcac

SEQ ID NO: 97937 - DNA, 22 bp, Homo sapiens
  chr7:64824069-64824091
  hypo
ccgcacccggcaataaacactt

SEQ ID NO: 97938 - DNA, 180 bp, Homo sapiens
  chr7:64974268-64974448
  hyper
gtcgggggctaaaagccgcaaaaagccgcggaggggggagcgaaaagcagtgggagctggggcaaaaaaccacaaaaagccgaggcagcggcggcagaaaacctcggcagcgggggcaaaaagctgcagcggcaaaaagcggcgacgggggcaaaaagccgcggtggcaaaaatgcgcgg

SEQ ID NO: 97939 - DNA, 480 bp, Homo sapiens
  chr7:64974508-64974988
  hyper
accacaaaaagccgcggcagcggcggcagaaaacctcggcagcgggggcaaaaagccacggtggcgggggtaaaaagcagcggtggcaagaagccgcgacggtgggggcaagaagccgcggcggcccaggcaaaaggccgcaaaagccgcggcgacgggggcgaaaagccgcggcggcggaggcaaaaagccgcgacggcagggggcaaaaagctgcaaaagcctcggtgcgggtgaaaaaagtcgcggcgagaaaaagccgctgaggcgggggcaaaaagccgcggcggcaggggcgaaaaccagcaaaaagccgccgcggtgggggcaaaaagcagtgggagctggggtaaaaaaccacaaaaaaccgcggcagcggcggcagcaagccacggcggcgggggcaaaaagccgcggcggcaaaaacccggggtggcaaaaagccgcggcgccgggggacgaaaagcttcaaaggccgct

SEQ ID NO: 97940 - DNA, 264 bp, Homo sapiens
  chr7:6499118-6499382
  hypo
atatgtactatgttacgctgcaaatggcttttaaagtgcagggacaaaaggaattgtttcaaaactggagaaacacccacagcacttccagcagattccaggctacagattccagttaacccagatagttgtgaggatggctgggtggtacgaggacagaggcacacagaaaacacccacgcagatccaatcaagctagcctcagatgggtggctgcttttggaaggtaccaaggagtcaatttctttcttttttttttttttt

SEQ ID NO: 97941 - DNA, 30 bp, Homo sapiens
  chr7:6501094-6501124
  hypo
cctccttccacactccgaatcttcaagcag

SEQ ID NO: 97942 - DNA, 102 bp, Homo sapiens; identical to SEQ ID NO: 31309
  chr7:65037609-65037711
  hyper

SEQ ID NO: 97943 - DNA, 23 bp, Homo sapiens
  chr7:65234809-65234832
  hypo
attacaggcgtgagccaccatgc

SEQ ID NO: 97944 - DNA, 78 bp, Homo sapiens
  chr7:65236247-65236325
  hypo
atccaagtgtacaaccgggagggactgcttaaagaacacatgaggctccctgggccgtgctatcccggcactttggga

SEQ ID NO: 97945 - DNA, 38 bp, Homo sapiens; identical to SEQ ID NO: 41189
  chr7:6524573-6524611
  hypo

SEQ ID NO: 97946 - DNA, 180 bp, Homo sapiens; identical to SEQ ID NO: 41190
  chr7:6524911-6525091
  hypo

SEQ ID NO: 97947 - DNA, 189 bp, Homo sapiens
  chr7:6543051-6543240
  hyper
cagccctggccacagcgacagcccctgtggagccggccgaggcctcggggcggggttgtggtcgcggcacctgcaggacgaactggtccggctcgctgaggcggccgggcgcctcgcggaaggcctggtagcgctgctcctcgtcggcgtcgggcgcgaagagcagcagctgcgcgagatgtgcgggct

SEQ ID NO: 97948 - DNA, 30 bp, Homo sapiens
  chr7:65441788-65441818
  hypo
gcgtgcttgcagccccggcagccccagcta

SEQ ID NO: 97949 - DNA, 91 bp, Homo sapiens
  chr7:65446021-65446112
  hyper
actgtcaccttctcccgatccccgggcccagctctgtgcagtgcatgccgctgtggccagagtgtgtgggtggctcatgccagtaatcagc

SEQ ID NO: 97950 - DNA, 311 bp, Homo sapiens
  chr7:6545692-6546003
  hypo
agaagccagatcatccgagtcaccgggtgctgagccagcgcctcctggggtcaatcgagactcaagacttggaacactactcgtgcagaagccagcaaggtgggactgcagcgggggcatgaaggagctgtgaagaggctagagccaagtaaggggctaccggaggtggctcaggggtctggctctgtcatcaggtctccttggagagcggtgagttcaccagggctgccctgggcagagtgagctggtgctgagagaactgcaactgtgacagcctaggggccagacgctggacacgtggctgtgatgaa

SEQ ID NO: 97951 - DNA, 139 bp, Homo sapiens
  chr7:65508904-65509043
  hyper
tacctggacctgattcgtctctcctccacctactttcagggcggacagactcaggcctttacagcctgctaagtcccgggtcggataccaggctgggctccacccccgcactgtgacccagaaacgctggtaaatgaat

SEQ ID NO: 97952 - DNA, 30 bp, Homo sapiens
  chr7:65509512-65509542
  hyper
tggggggggtgggggcgtgttcctgtatcc

SEQ ID NO: 97953 - DNA, 43 bp, Homo sapiens
  chr7:65553975-65554018
  hypo
ggctgccttcctccccgtcccacccctccgccagacctggcca

SEQ ID NO: 97954 - DNA, 30 bp, Homo sapiens
  chr7:65554426-65554456
  hypo
gcacacagctccatccgtggctgcccttga

SEQ ID NO: 97955 - DNA, 62 bp, Homo sapiens
  chr7:65575903-65575965
  hypo
ccaatccctcggcctcgtgtgcttttccctcacccacttcaaaggcccgtggctttgggacg

SEQ ID NO: 97956 - DNA, 228 bp, Homo sapiens; identical to SEQ ID NO: 41192
  chr7:6560173-6560401
  hypo

SEQ ID NO: 97957 - DNA, 185 bp, Homo sapiens
  chr7:6566051-6566236
  hyper
ccagatgcccagccccgcccctacgccctctccccgggtctcggtcccgagcccacccgcagggaggcgcccgctgccagtgcctgtgagccccgcgtacctgcgcgcgcccccggggccggcgaggccgcccaccagcaaggaggccctgcgcgggggcggctcatcggggcggcgcggcgggg

SEQ ID NO: 97958 - DNA, 448 bp, Homo sapiens
  chr7:6566246-6566694
  hyper
cgtggacaccaggaggcgctccggccgctcctcgctgcggctccggcgcagtcgctgcgcgccctgggcccggcgtgcgcggcacagcttgcccaggaggccctgagacaccacctcgtcgaagcgcgcccggtgcttcttggggatgaagatcctgccggcgaggacggcggagtcggggcgcgttcccggaccccggatctctgcaaaccgcggcccgaaggcgcgtcctcgcgggcgccgccctaggctctcccacctcttcctaggagtggcggagggctggggggatcgggatgagcagccggtagcaccccagtctccccctcgctgctcggatttgcgcccccagctaggacttggcgtcctgctcgcttcacctcgggaatggcccgttcggaccgtcctccatgactctggccactgcagggcccgagcccctcaaagc

SEQ ID NO: 97959 - DNA, 409 bp, Homo sapiens; identical to SEQ ID NO: 31035
  chr7:6570454-6570863
  hyper

SEQ ID NO: 97960 - DNA, 309 bp, Homo sapiens
  chr7:6570900-6571209
  hyper
cgccccctccaggtagccccgcctctgccctgctgggacccttttggtcgctctggggtgcagcggaaactggcggcggtttgaagccgccgcgctcactccccttggctctctccgttattcccttcccaggatcctcgcctgcgtcctctccagctactgcgccccggacccccacacagtggcgagtccccgcagttcagaggaagccccgacggcctttggtagaacatgcaatattttccggaggggatgccctttacgctgggcctccagggctcagcaggagtcggccggctagaagaagcc

SEQ ID NO: 97961 - DNA, 64 bp, Homo sapiens
  chr7:6576033-6576097
  hyper
gggggttccccctcccgcgccctgcccgacccgctgccgcagctgccggcggcttggggaccag

SEQ ID NO: 97962 - DNA, 22 bp, Homo sapiens
  chr7:65877882-65877904
  hypo
tccgtctcgggggggaaaaaaa

SEQ ID NO: 97963 - DNA, 22 bp, Homo sapiens
  chr7:65879595-65879617
  hypo
gtaaagtaattgggccggcccc

SEQ ID NO: 97964 - DNA, 81 bp, Homo sapiens; identical to SEQ ID NO: 41342
  chr7:65880043-65880124
  hypo

SEQ ID NO: 97965 - DNA, 77 bp, Homo sapiens
  chr7:65969578-65969655
  hypo
tgtgaagaggagaggcgcactgggcgtcaataactttaaaaaggggggaaaatatcagttcccgagtctccatgcgt

SEQ ID NO: 97966 - DNA, 30 bp, Homo sapiens
  chr7:65973031-65973061
  hypo
accagacacgtaccccgcagagaactcaca

SEQ ID NO: 97967 - DNA, 17 bp, Homo sapiens
  chr7:66105665-66105682
  hypo
gtagtccaggccactcg

SEQ ID NO: 97968 - DNA, 196 bp, Homo sapiens
  chr7:66105802-66105998
  hypo
gggcaacaccatcgtaaaaataaataaataaataaataaattggggaggacagcctcactggtatcagacttacaggaccagatagacaagatgggtataaggggagctgaagtctgtgttcatatgaggaagagaagaccaagccctgggactttggctgaattcctccgtggggctggacggcagtgatctcct

SEQ ID NO: 97969 - DNA, 30 bp, Homo sapiens
  chr7:66150814-66150844
  hypo
gtttaatttctggcacgtggggttttattg

SEQ ID NO: 97970 - DNA, 97 bp, Homo sapiens
  chr7:66215014-66215111
  hypo
ataactggtgtctcacgagataatacgtttgggtcctgtttagcaagttggattatatttttatttgtgtaaatttattggccgttgcagttggggt

SEQ ID NO: 97971 - DNA, 30 bp, Homo sapiens
  chr7:66293248-66293278
  hypo
aggtgtgagccaccgcgcctggcttccacg

SEQ ID NO: 97972 - DNA, 400 bp, Homo sapiens
  chr7:6654761-6655161
  hyper
ggcctctccagggcccgctcgggccgggcccggatggcgcctactccctctccgagtgccatcgaattgtgtgctaattagccacaatttgcaccgcggcaggggcgccccgaggccacgcctgccctctagggggtggcagggatcgggttgggtaccccccacccagacacccaggcagtgacagtcgccaaccccgtggcgcgaggacacgcgcagcagggatgcggcacagcgcgcgctgcgctcggcaccggccagcccgggacgccccaggggccgccgcatcgtgtcccccgggccgggtgagtggccgggccgggaatggttaagcccaccgagctgcggctgcctagagcggcggcggcgacggcggcggcggcggcgggggccggggcgc

SEQ ID NO: 97973 - DNA, 30 bp, Homo sapiens; identical to SEQ ID NO: 31039
  chr7:6655418-6655448
  hyper

SEQ ID NO: 97974 - DNA, 186 bp, Homo sapiens
  chr7:6655668-6655854
  hyper
cccggggtggccctgcgcctcctggctctttctggatggaggcgcctccggaaggagccggctgcacgccgtggccttcacctcgcagcctctgctgaccacacctccctagcgcagaggctgcccgggagcaggaaatgctccaccaggtgaggcccagggggtcgttggcgctgggcaaccggg

SEQ ID NO: 97975 - DNA, 30 bp, Homo sapiens
  chr7:67033662-67033692
  hypo
aaagggtcccagacccggaccccaagagag

SEQ ID NO: 97976 - DNA, 220 bp, Homo sapiens
  chr7:6703488-6703708
  hyper
agaaggtgtgccaggcgatggagggggtcggcgggggcggggcccgcactgtccccgccccatgtgggtggagcctcctgcccgggcctgtgtcgcggcagagcctggcgggctttgtgcgcaggcgcttgcggcttcgcggggctgaccgtgcgcttcgcctgcggggtcgtgctggggcggcgggtgagcctggggggctgcagagcgggcgcggggc

SEQ ID NO: 97977 - DNA, 94 bp, Homo sapiens; identical to SEQ ID NO: 8858
  chr7:6703709-6703803
  hyper

SEQ ID NO: 97978 - DNA, 66 bp, Homo sapiens; identical to SEQ ID NO: 8859
  chr7:6703804-6703870
  hyper

SEQ ID NO: 97979 - DNA, 173 bp, Homo sapiens; identical to SEQ ID NO: 8860
  chr7:6703915-6704088
  hyper

SEQ ID NO: 97980 - DNA, 40 bp, Homo sapiens; identical to SEQ ID NO: 41345
  chr7:67161739-67161779
  hypo

SEQ ID NO: 97981 - DNA, 38 bp, Homo sapiens
  chr7:67478598-67478636
  hypo
ctttgcagcactcagcgggcctgcgctgggacccaata

SEQ ID NO: 97982 - DNA, 17 bp, Homo sapiens
  chr7:67478991-67479008
  hypo
gccggtatagggattgt

SEQ ID NO: 97983 - DNA, 30 bp, Homo sapiens
  chr7:67665226-67665256
  hypo
ttcagtcatccatcacgcaggcccttccat

SEQ ID NO: 97984 - DNA, 120 bp, Homo sapiens
  chr7:68000314-68000434
  hypo
cagctgctggcggaggtgctaagcccctccctgccagggctggcggggctggctggtggctccgactgtggggccctctgagcccacgcccacccgaaacttgtgctggcccgcaagcgc

SEQ ID NO: 97985 - DNA, 30 bp, Homo sapiens
  chr7:68149438-68149468
  hypo
cagcacctgcctagccggcagatggctgcg

SEQ ID NO: 97986 - DNA, 30 bp, Homo sapiens
  chr7:68150297-68150327
  hypo
accctctgattggcccgctttccttgaaca

SEQ ID NO: 97987 - DNA, 159 bp, Homo sapiens
  chr7:68191278-68191437
  hypo
cgaataacgggacttcgcagggaggtccagagggaataaagatttacctaacaatttatgtcgctcttgacatgccatgcttttttccttgcccaggagtccgatagcacaaatacatgccttgccatgaaaaattcacaaccgcgcattagtcagata

SEQ ID NO: 97988 - DNA, 206 bp, Homo sapiens
  chr7:68204758-68204964
  hypo
ttcagaagtgactttcgaggaaatttggtcccgttcccaagcaataaagccgtcgcatcataatcagcttagaacaatttgccaatgatagttttctgtgttgcgccatcagagattctgattcagcaagtcctcgttggatctcatacatctcaattaaaaatcaacaatagatcgggcgtggtggctcacgcctgtctgtcatc

SEQ ID NO: 97989 - DNA, 20 bp, Homo sapiens
  chr7:68237178-68237198
  hypo
gactccgtctcaaaaaaaaa

SEQ ID NO: 97990 - DNA, 185 bp, Homo sapiens
  chr7:68238305-68238490
  hypo
gcctcgacaagacagcgcaggtctgcaggagttcaagggttgtatgaatggcagatttcaatactttatgacaaagaagattcggtgactctaggaagatgcccaggaggtgttttcccctgcccaatctagtctcagggataaacaaggacacagaggaaaggtgggaacggctgcagaaggaa

SEQ ID NO: 97991 - DNA, 32 bp, Homo sapiens
  chr7:68358134-68358166
  hypo
ttagaggcatgagccaccgcactccacccctt

SEQ ID NO: 97992 - DNA, 33 bp, Homo sapiens
  chr7:68527746-68527779
  hypo
gtcggccttgcgggccgccggtgaactaccact

SEQ ID NO: 97993 - DNA, 30 bp, Homo sapiens
  chr7:68904116-68904146
  hypo
tcagcatcggcttctcggagcctgttcata

SEQ ID NO: 97994 - DNA, 27 bp, Homo sapiens
  chr7:68982718-68982745
  hypo
tgtgagccaccgcgcctggccattgct

SEQ ID NO: 97995 - DNA, 30 bp, Homo sapiens
  chr7:69033875-69033905
  hypo
cgcagtaaaaaaacccgaagctggaattga

SEQ ID NO: 97996 - DNA, 42 bp, Homo sapiens; identical to SEQ ID NO: 15004
  chr7:69036110-69036152
  hypo

SEQ ID NO: 97997 - DNA, 140 bp, Homo sapiens
  chr7:69048212-69048352
  hypo
cactgtcaccagtttcgctgaagtcctgaatctccttgctactgatagacacgcatgtgacagtgggtttagtggggacaaatagcttgggcttcaatatggattaaacaatagcaacacaatagcagaaatccattcct

SEQ ID NO: 97998 - DNA, 679 bp, Homo sapiens
  chr7:69062359-69063038
  hyper
aaagtaaaggaagcccgcggggcagggactgcggtttgccggtctaacgggtcctcgagctggggcggcggtcccggccccttcggccccgcccctcgcccgcggccgcctccgaggttcaagttcggcccccggctgttaggcctcgcgctcccggatctgaagccgcccgtgcgtccctaggtcccccgctggaagacgaggcgggaatcccaggggtcatccgggcgcggggtcgctcgtccacgcactgtggtgccacgtggaggaaaagtttccaactctgccagttggtgctcccactgcgcccaggcggagcaaaggcccgcgctttggcacccgctccccgttctgtctcctccagtcgcgccccctcccagggacgccccccttgtaccccttctctgaattcccttctctcctcgcagcgcaggtagccaagggaaaacacccttgggggctggtggggcttcccgagaaggcggcctcgggccggccaggggtagaggatccagggacaagtgtcccgaggaggatgtggggggcgcgcgcgcgaagtggcctgggagcaggggcccacacgcgtccccgctgcgacaggcgggatcctccggcggcttccacgccctggcgcgccaactctgcccggccgcggccgaccccacgcgggcgccccctc

SEQ ID NO: 97999 - DNA, 93 bp, Homo sapiens
  chr7:69063459-69063552
  hyper
cagtgcccgggctcccgctgcagccgcccggggacacgccgtgcaccctccggctcggggctttctcggcggcggcggcggcagcagcagcag

SEQ ID NO: 98000 - DNA, 30 bp, Homo sapiens
  chr7:69063870-69063900
  hyper
ctccttcccttcctccgcctcccttctcct

SEQ ID NO: 98001 - DNA, 590 bp, Homo sapiens
  chr7:69064182-69064772
  hyper
tcggggggcggggggcgcggcggagaatggccgcggggagggctccccggagcctcccagtctcttgatcaaagcattccgctattctgatttattgcttgcttggtgagttatttttttttcctctaaaggagacctgtgtgttcagccattactttgctcggcgctgctcccaggcatctccgaccctcggtgctgtggggagccccacacttgggctcctcgcctctcgccctcgctccccgtccctcctcccctctctccgccccttcccccttttctttctcctctctttcttcccctctctcccttctttcggccgccgtctcccccgcgccctcctcggggcggagggaagccgtgaagggggagggagggctcggtgtcaatttttttttgtgtggctgcggccgtagcctgtggcgggcaagcggggagaccccggcgcagcagaaccatggatggcccgacgcggggccatggactccgcaaaaagcggcggtcgcggtcgcagcgagaccgggagaggcgctcccggggcgggctgggggccggcgcggccggcggcggcggggctggccggacccggg

SEQ ID NO: 98002 - DNA, 328 bp, Homo sapiens; identical to SEQ ID NO: 31314
  chr7:69064833-69065161
  hyper

SEQ ID NO: 98003 - DNA, 16 bp, Homo sapiens
  chr7:69092470-69092486
  hypo
ccgtctcaaaaaaacc

SEQ ID NO: 98004 - DNA, 30 bp, Homo sapiens
  chr7:69206297-69206327
  hypo
aactccaccccacctcgaaccccgatttgg

SEQ ID NO: 98005 - DNA, 30 bp, Homo sapiens
  chr7:69217444-69217474
  hypo
ttctgaaccagatgccgtgaataactgccc

SEQ ID NO: 98006 - DNA, 215 bp, Homo sapiens
  chr7:69313658-69313873
  hypo
tacatttgtcttccacgtcaaaggattctgtgaaatacaagtcccatttcccgctttctcctttttttcttaagactgtctagggaaggagctttagataaactatacatccagcacaacattcaattgtctgcacaattgagttagcctactttatttgacttttatgtttacatttgaagtggactccccccgccccccgccaccaccttttc

SEQ ID NO: 98007 - DNA, 86 bp, Homo sapiens
  chr7:69499763-69499849
  hypo
attggtagttgagcacgtcttgagtgtgagtgtcatactcagaacaattctaattttttaaaaattacttttttagaggctgtctc

SEQ ID NO: 98008 - DNA, 25 bp, Homo sapiens
  chr7:69499909-69499934
  hypo
tgggcccaagcgatcctctcacctt

SEQ ID NO: 98009 - DNA, 30 bp, Homo sapiens
  chr7:69510019-69510049
  hypo
tattctgcttggacacgctagacttgtgaa

SEQ ID NO: 98010 - DNA, 48 bp, Homo sapiens
  chr7:6966936-6966984
  hypo
tgggaggtacagggacgatgtgtcaaacagcgtcgcttctcccagtga

SEQ ID NO: 98011 - DNA, 146 bp, Homo sapiens
  chr7:69696309-69696455
  hypo
gacatgtccagcacccgttaatctttccttcctagccttctagtttcatcccagagttaaccactgtcctgacctctgtcattacagattactttttgtaatctgtgtggtttttttgttttttgttttttgtttttgagacagag

SEQ ID NO: 98012 - DNA, 30 bp, Homo sapiens; identical to SEQ ID NO: 41352
  chr7:69698849-69698879
  hypo

SEQ ID NO: 98013 - DNA, 136 bp, Homo sapiens
  chr7:69745578-69745714
  hypo
gccaaataagggaaactttttagaggatctttggcttcagtcatggagaaaaagaagaaactataaacacttggaggtctgaacagttcattgattgttaagaacccaaacaaaaacactccgtccccaaccccga

SEQ ID NO: 98014 - DNA, 227 bp, Homo sapiens
  chr7:69897720-69897947
  hypo
gggttgaccatcattcgtctctgccaggggctggcactcgaggctccagagagtggagctgtaaattggatggtgcgctcctgctgagctcacggcaaagtcctcaggtcagtatgggaatttaataccagaaatggaactgttttctcagcacaccatgtggaccccagtgcagcagagactgttttggcagactccacgactggccttgtcgaggagctgtcact

SEQ ID NO: 98015 - DNA, 134 bp, Homo sapiens
  chr7:70061015-70061149
  hyper
gcaggtgacctcccccgggcccgggaataaattgtcaagtttccccaccgtgggtgtctttgctagccggcgagttgcagtcttctgagctaattaggagacggtcatgaggagcgaggcgggccggggcgctc

SEQ ID NO: 98016 - DNA, 141 bp, Homo sapiens
  chr7:7019112-7019253
  hypo
ccttgacgccctcctcggccagatggtccaggttgggggtgtccacatcctcatcctagttccagcggaagccctggaaggtgatcagcagcagctgtgagtgctcttcttccctgggacggggtggccacccagtaggac

SEQ ID NO: 98017 - DNA, 30 bp, Homo sapiens
  chr7:70311103-70311133
  hypo
aaaaaaaaaacaaaacggctgtacctccct

SEQ ID NO: 98018 - DNA, 269 bp, Homo sapiens; identical to SEQ ID NO: 31315
  chr7:70596147-70596416
  hyper

SEQ ID NO: 98019 - DNA, 258 bp, Homo sapiens; identical to SEQ ID NO: 31316
  chr7:70596453-70596711
  hyper

SEQ ID NO: 98020 - DNA, 168 bp, Homo sapiens
  chr7:70597490-70597658
  hyper
aaatccctggcctttcgcggagacgcctggacggggccgtgcgccgtggactgagcaggcgtctcggggagcacttctgcagagcgaggacttccatgtgagcgattccgttctccccaccaccaatccgacctcccagccgtctccgccgcccgagcatccttgagg

SEQ ID NO: 98021 - DNA, 134 bp, Homo sapiens
  chr7:70597990-70598124
  hyper
cgctgctggaggacatcgtgtaccggcagctgaatggtaaggacgcacgccggcgcctccggggctcgacgcgggcgggccgggcacagggtgagccccagggtccttgcgcgctgcgccctgtgcctgggagc

SEQ ID NO: 98022 - DNA, 346 bp, Homo sapiens; identical to SEQ ID NO: 31318
  chr7:70598169-70598515
  hyper

SEQ ID NO: 98023 - DNA, 30 bp, Homo sapiens
  chr7:70699941-70699971
  hypo
gttcggtctgttcagcggggcgcggtggct

SEQ ID NO: 98024 - DNA, 39 bp, Homo sapiens
  chr7:70728615-70728654
  hypo
cctcagtgatctggccgggagcggtggctcatgcctgta

SEQ ID NO: 98025 - DNA, 30 bp, Homo sapiens
  chr7:70802549-70802579
  hypo
ttgccttttaaaaagcgtgaggctggcagg

SEQ ID NO: 98026 - DNA, 138 bp, Homo sapiens
  chr7:70840301-70840439
  hypo
tcatttctctgctgacgttgcagggtaacaacttttaggaccagtttggagctctgtaaagggccaaagaggttggagggtgagacattgagtgagagcaaagggttttatggccttcagagatggtctcgctctgtt

SEQ ID NO: 98027 - DNA, 97 bp, Homo sapiens
  chr7:7097210-7097307
  hypo
cattactccccacatcgcagggaatgaaagcccccttaagatatggactgtaacatccagagagggagagaataatattactccccatatcgcaggg

SEQ ID NO: 98028 - DNA, 217 bp, Homo sapiens
  chr7:7097367-7097584
  hypo
ccatatcaaaggggatgtacacctcactctggtattgtccgtaatatctagggagggggagaggatgatgcaactccccaaatccaggggcacacccctgcgatattgtgtgtaaagtccgggggtggagagaaggtgtacacacccctgcgattttgtccataatatccagaaagggagacgatgatgtatctctccatatcgcaggaggtgtaca

SEQ ID NO: 98029 - DNA, 80 bp, Homo sapiens
  chr7:7098076-7098156
  hypo
ccccctttccccccccggctactacgatccacatcgcagggggctgcacacaccccaccgtgatgcggggagtagtagca

SEQ ID NO: 98030 - DNA, 93 bp, Homo sapiens
  chr7:7099482-7099575
  hypo
ttcttcgatattggtagtaatatcaacctctcccccttggatatatgaaacaatatgacaggcggggtggacacacctcgccatatagggagt

SEQ ID NO: 98031 - DNA, 51 bp, Homo sapiens
  chr7:7101398-7101449
  hypo
tattactcccaatatcgaaggaggtgtacaccctcccgtgacagtgtcctc

SEQ ID NO: 98032 - DNA, 45 bp, Homo sapiens
  chr7:7101778-7101823
  hypo
cattgtacccaatatcgcagggggtgtgcaccccccctgcgatat

SEQ ID NO: 98033 - DNA, 45 bp, Homo sapiens
  chr7:7101883-7101928
  hypo
ccccacttgtgatactgttcttaatatttacggggggagacaatg

SEQ ID NO: 98034 - DNA, 30 bp, Homo sapiens
  chr7:7102527-7102557
  hypo
tattactcaaaacagcgcaggaggtgtaca

SEQ ID NO: 98035 - DNA, 30 bp, Homo sapiens; identical to SEQ ID NO: 14975
  chr7:7102938-7102968
  hypo

SEQ ID NO: 98036 - DNA, 37 bp, Homo sapiens
  chr7:7105793-7105830
  hypo
cgttgctcccagtatcgaagggcgtgtaccccctctc

SEQ ID NO: 98037 - DNA, 30 bp, Homo sapiens
  chr7:7106198-7106228
  hypo
aatatcaaaggtggacgatgatactactct

SEQ ID NO: 98038 - DNA, 61 bp, Homo sapiens; identical to SEQ ID NO: 41195
  chr7:7109343-7109404
  hypo

SEQ ID NO: 98039 - DNA, 162 bp, Homo sapiens
  chr7:7110642-7110804
  hypo
caacaattatgtaactcccactatcgcagacggtgtaccctctcagtgatattattcgtaataaccaagggggagatgacgttactctcagtatcacgggggtgaaccgcctgtgaaatggttcataatatccaagctggaagaggacgttactcccaatat

SEQ ID NO: 98040 - DNA, 360 bp, Homo sapiens
  chr7:7111756-7112116
  hypo
ttcgtaatatccctgcggggaagagatgacgttacttttaataatatcgtaaggggtgtaccccctctgcgagattcttcgtaatatcccaatggggaggagatgatgttactcgtaaaaatatcgtggggtgtaccccctctgcgagattatttgtaatatcccgggggagaggatgatattactcttaataatatctcagtgtgtgtaccccaactgcgagatttttcataatatccccgggggaggtgacattacccctcataatatcgcaggggggtgtaccttcactgtgagattcttcgtaatatcccagaagggagatgatattaatcctaataatatcgcagggggtgtaca

SEQ ID NO: 98041 - DNA, 42 bp, Homo sapiens; identical to SEQ ID NO: 41197
  chr7:7113636-7113678
  hypo

SEQ ID NO: 98042 - DNA, 39 bp, Homo sapiens
  chr7:71211002-71211041
  hypo
cctcggatatgtctttatcagcatcgtgaaaacagacaa

SEQ ID NO: 98043 - DNA, 245 bp, Homo sapiens
  chr7:71217033-71217278
  hyper
atgcagaagataaaacgtttcgcagcaccgggtccaaggaagtgcaatacaacagcaaaatgcaatggccgcagcagctcagtgatgggccgagactcgtcccgtgtggcggagatgctggcatcccccctgtggctccaagcgctgagcttggcggcggggacctggcggccccggctcggctcgggacaggcaggtgtggggagccggcgggttggagggcgttttgacgctagagggcgctc

SEQ ID NO: 98044 - DNA, 30 bp, Homo sapiens
  chr7:71252818-71252848
  hypo
aggccatagcaaaggcgcatatgaggctct

SEQ ID NO: 98045 - DNA, 30 bp, Homo sapiens
  chr7:71265604-71265634
  hypo
aatataatatgctttcgtcggcaatgaaat

SEQ ID NO: 98046 - DNA, 150 bp, Homo sapiens
  chr7:71296028-71296178
  hypo
cataaatgcagaccccgagttcaggagctaatggactcataatctaggatggattctgccactaactagttgcgtaccctgaagcaggtcatttaatgacttggaatctgtttcctcatacatttaatagataatcctaatgataaaaag

SEQ ID NO: 98047 - DNA, 79 bp, Homo sapiens
  chr7:71299737-71299816
  hypo
gacaaatgcagactgcgtttaagccatagtcactggggcacatatatggtgtatgggaatgtggtacaggactctgttt

SEQ ID NO: 98048 - DNA, 30 bp, Homo sapiens
  chr7:71398187-71398217
  hypo
aagaagacaagatggcgccagttaagtggg

SEQ ID NO: 98049 - DNA, 34 bp, Homo sapiens
  chr7:71416278-71416312
  hypo
aaagaatagcagaaacggccgggcgcatggctca

SEQ ID NO: 98050 - DNA, 216 bp, Homo sapiens
  chr7:71420713-71420929
  hypo
ggaactcaggagatccgtcctggaaggagtcagattccaacatgacctgactatgatgcacttatttcagaccaagcagacagacaacctcctctgggaggaaagtcagaagtagaatgtactctaagagggcttgagggctgaagattgaaaagccgctatttagtctggcacctgggtggtacctggtgatctcagagccggcagtttcactga

SEQ ID NO: 98051 - DNA, 143 bp, Homo sapiens
  chr7:71472525-71472668
  hypo
tgtctcaaaacacaaaacaaaacgaacaaaacaacttaatattatctgaaatttccttattcattatcaatttatttaatgcctatctttctcctaccccttacactaaaatgtaaattccatgagtgcgagagccttgttta

SEQ ID NO: 98052 - DNA, 41 bp, Homo sapiens
  chr7:71643690-71643731
  hypo
aaagaaaaggttatttgacaaactcccgctttatttttcac

SEQ ID NO: 98053 - DNA, 76 bp, Homo sapiens
  chr7:71669270-71669346
  hypo
cacccagccaaagccaagaggactcttttttaatgttaattgtattcaactatacacagttcgttgttgcctttgt

SEQ ID NO: 98054 - DNA, 198 bp, Homo sapiens
  chr7:71737907-71738105
  hypo
cctaggatgaccaaacgtacaagagtagcttgggaatgggaaggagagaaggagagaggaagaacaaacaacatagatggagaattctgtggcatagggcgcaaagacagcaggaacaaccaccgagacccccacctctgcccagagccatgggctacatgaatgtcttctggaaactggagacggcatgcatatcaa

SEQ ID NO: 98055 - DNA, 39 bp, Homo sapiens
  chr7:71775955-71775994
  hypo
taaacaatatgacattgaaaggcacgggtgtacttatgc

SEQ ID NO: 98056 - DNA, 126 bp, Homo sapiens; identical to SEQ ID NO: 3053
  chr7:71800631-71800757
  hyper

SEQ ID NO: 98057 - DNA, 172 bp, Homo sapiens; identical to SEQ ID NO: 31321
  chr7:71800933-71801105
  hyper

SEQ ID NO: 98058 - DNA, 141 bp, Homo sapiens; identical to SEQ ID NO: 31322
  chr7:71802206-71802347
  hyper

SEQ ID NO: 98059 - DNA, 7 bp, Homo sapiens
  chr7:71802389-71802396
  hyper
cgcactc

SEQ ID NO: 98060 - DNA, 67 bp, Homo sapiens
  chr7:71802456-71802523
  hyper
cacgcggggggcgagcaggcgcttggcagacggtgctccttccttcccttcccaaagaggctgccca

SEQ ID NO: 98061 - DNA, 204 bp, Homo sapiens
  chr7:71802577-71802781
  hyper
cgccgccttcactacttcatcccaggtgcccacaccctagatccacgattacacctgagcccagggggaaggcggggcgccgaagtggaggggccaatggccgaaactgcggggaccagcattccgcgtgaccgcccctggagacgtccagggaggcacggctgccgcagggcatcgcccacccaccagcgatcccactcctcc

SEQ ID NO: 98062 - DNA, 30 bp, Homo sapiens
  chr7:71871052-71871082
  hypo
ctggtgccctcactgcggcactcgcgatgt

SEQ ID NO: 98063 - DNA, 25 bp, Homo sapiens
  chr7:71877300-71877325
  hypo
cggatagcaccccagcgagcttccc

SEQ ID NO: 98064 - DNA, 30 bp, Homo sapiens; identical to SEQ ID NO: 41356
  chr7:71880817-71880847
  hypo

SEQ ID NO: 98065 - DNA, 183 bp, Homo sapiens
  chr7:71912763-71912946
  hypo
acacacatgcctgctcgtgtatatgcatacacattcctatgtacacacatacccacccgtgtacacacacattcctgcccatgcacacacacatgcctgcccataccacacacacgtgcctgcccatgtacacacatacacacacgcttgcccatgtacacacacagacgcctgcctaggtat

SEQ ID NO: 98066 - DNA, 30 bp, Homo sapiens
  chr7:7284851-7284881
  hypo
agtaatttcttttttcggagactgtctcac

SEQ ID NO: 98067 - DNA, 30 bp, Homo sapiens
  chr7:746995-747025
  hypo
ataacacattattgtcggcaaccctttcga

SEQ ID NO: 98068 - DNA, 4 bp, Homo sapiens
  chr7:751761-751765
  hyper
aggc

SEQ ID NO: 98069 - DNA, 163 bp, Homo sapiens; identical to SEQ ID NO: 2953
  chr7:751986-752149
  hyper

SEQ ID NO: 98070 - DNA, 156 bp, Homo sapiens; identical to SEQ ID NO: 30968
  chr7:752150-752306
  hyper

SEQ ID NO: 98071 - DNA, 129 bp, Homo sapiens
  chr7:752350-752479
  hyper
cgccccccgccccctccactcagactctgagtcgcccactccagccggtgcaggccgcggggccgcctctgatggcctgggcaccccccactcccgccccgttcacgaccaccgcggctgcctgagctg

SEQ ID NO: 98072 - DNA, 30 bp, Homo sapiens; identical to SEQ ID NO: 41357
  chr7:75975426-75975456
  hypo

SEQ ID NO: 98073 - DNA, 30 bp, Homo sapiens
  chr7:76033259-76033289
  hypo
gtgagtcaccgagcccggccttcttcttat

SEQ ID NO: 98074 - DNA, 279 bp, Homo sapiens; identical to SEQ ID NO: 41198
  chr7:7605145-7605424
  hypo

SEQ ID NO: 98075 - DNA, 158 bp, Homo sapiens; identical to SEQ ID NO: 41199
  chr7:7605664-7605822
  hypo

SEQ ID NO: 98076 - DNA, 94 bp, Homo sapiens
  chr7:7606031-7606125
  hypo
ccgacaccgagcgggcgtccctcctgtgtagcactgtgttagccctaccaagtcaaggctctccttgcctgtttcctgccggaaccatgtcttt

SEQ ID NO: 98077 - DNA, 49 bp, Homo sapiens; identical to SEQ ID NO: 41358
  chr7:76106331-76106380
  hypo

SEQ ID NO: 98078 - DNA, 185 bp, Homo sapiens
  chr7:76145361-76145546
  hyper
gtgcaaaacctcaagcgtccatctgtgcacaaggccggtggttcccgtcgtcgccactcggggtcgccggtgagccgcagccaggccgcctcacggccagtgtgcatgctcgctgctattcgctgccccttctgcctccgaggcggtagcagatgccacgttggcggggtcggtgaaggtcagga

SEQ ID NO: 98079 - DNA, 30 bp, Homo sapiens
  chr7:76604327-76604357
  hypo
tttagctgaagtcctcgcctatatttccca

SEQ ID NO: 98080 - DNA, 93 bp, Homo sapiens
  chr7:76631511-76631604
  hypo
agcgtctggatacagcgatgtgactgacagcaaggcaatcgggcccctggctgtgggctgcctcaccaagtgcagccacgccttccacctgct

SEQ ID NO: 98081 - DNA, 40 bp, Homo sapiens
  chr7:76751676-76751716
  hyper
ccctttcgctaaggccgacgggatacgtagttctaaagcg

SEQ ID NO: 98082 - DNA, 20 bp, Homo sapiens
  chr7:77051320-77051340
  hypo
accaccgtgcccagccaaca

SEQ ID NO: 98083 - DNA, 28 bp, Homo sapiens
  chr7:77309374-77309402
  hypo
tggagtgcagtggtccgcctcccgggtt

SEQ ID NO: 98084 - DNA, 28 bp, Homo sapiens
  chr7:77309582-77309610
  hypo
aggcgtgagccatcgtgcccggccagac

SEQ ID NO: 98085 - DNA, 93 bp, Homo sapiens
  chr7:77315389-77315482
  hypo
taaacacttaatatacgtgaaaaataagaaaaagtagacttattgggttagctttaaaagttaaataaaagagtggttaggcccggcgcggtg

SEQ ID NO: 98086 - DNA, 35 bp, Homo sapiens
  chr7:77324362-77324397
  hypo
acatccataaataatcgccaacgaatttttcctgg

SEQ ID NO: 98087 - DNA, 30 bp, Homo sapiens
  chr7:77413267-77413297
  hypo
gaaattcagaacttacgcatctatgttgtt

SEQ ID NO: 98088 - DNA, 28 bp, Homo sapiens
  chr7:77928410-77928438
  hypo
aggcgtgagctaccgtgcctggctataa

SEQ ID NO: 98089 - DNA, 97 bp, Homo sapiens
  chr7:78598432-78598529
  hypo
gtgtcggggtcatggcgcaggacaagtaaagccatctgtgcaggtgtactggcgaccacctggtagtagctgtatttgcacagtaaaagattagggt

SEQ ID NO: 98090 - DNA, 36 bp, Homo sapiens
  chr7:78598589-78598625
  hypo
ggccttatgtaaatcaatcaccgcctcttcaagcct

SEQ ID NO: 98091 - DNA, 147 bp, Homo sapiens
  chr7:79081745-79081892
  hyper
gaagacccgtcaaagcgcccaaagcaatttgtcccttcttttcttcgccagcggtggctcacggatccctaagggacagctggggacccaggcgcccccagcccagccccagaaacgctggacgcagttctccgctcaccccaccac

SEQ ID NO: 98092 - DNA, 420 bp, Homo sapiens; identical to SEQ ID NO: 31327
  chr7:79082159-79082579
  hyper

SEQ ID NO: 98093 - DNA, 15 bp, Homo sapiens
  chr7:79083020-79083035
  hyper
cactcctgcgtggtg

SEQ ID NO: 98094 - DNA, 821 bp, Homo sapiens
  chr7:79083190-79084011
  hyper
cgcgccgggtggggagccacggagggcttcgccgctgcctccctccctccctccgcagcttgacccggtagtgaaggcagagagagaggcaggctgggtccgcctggcagcctacgggaggaggcgggagccgggaaggaggggagcctaggcccggcgtggggaggccggcaggaagggcctcgagcccagtgcggacctttcttcagcctctgtgcgaccgagccgcgcgccaggctcctgtgcgaggaggacgcgctgactccctccgacctgggctccgatggagcagaaatagcgggacctggacttgtggcgcgcctggtgccacatctcgggctctgcgagcgtcctggcgcgggatcctgccgtgagaaggagttggggcgggggacccggcggggcattgcgggagaaggcctgggatccctgggagccttgtagcgtgggggagttcactgtgtagagaggtttcatgtcttcatctatatagtcacttatttgtcttaaagttctcgaaattccctcttagagaaggagaaagttagagaactggaggctgcgtaccctgattacgcagaagggaagcagcctcgcattccccggggcaggcccccgcccgcgcgtcccgccagtaggggaatttagcggacggctgcggttgtctggtgaaaggctatccaaggataaggggcttcacttttcccaagtaggggaaagagaaggggtctacagggctaggggtggagggagcggatgcagtgagcagcctccgcagagaaattgacaatttaaccagggacctgcggcagagacaaggc

SEQ ID NO: 98095 - DNA, 56 bp, Homo sapiens
  chr7:79764157-79764213
  hyper
ggcttggcgaggctgcggcgcggccaccggcgggagtgcagcggccactgtaccca

SEQ ID NO: 98096 - DNA, 241 bp, Homo sapiens
  chr7:79764471-79764712
  hyper
gcaccatgggctgcacgctgagcgccgaggacaaggcggcggtggagcggagtaagatgatcgaccgcaacctccgtgaggacggcgagaaggcggcgcgcgaggtcaagctgctgctgctcggtaagggcggccgggtcggggcccgggggtcggcgggggaccgggtgcggcgctgcgcggccctcggcgtttggaaacccggagggaagggggaggaagcgcccgaggaggcttctga

SEQ ID NO: 98097 - DNA, 285 bp, Homo sapiens
  chr7:79764928-79765213
  hyper
agatgaaggggcattcgcggctagaaaatgaaaacacccccccccccgcgccaccaaccccctcccggaaaacccttcttcgtgtgcggtgtaggttgtgtttcgactgtggttttctcatgcccagagtgccacgtttggtgaaatcagtgcaccttttgtggggcctctgagatggggctgaagcgtctttcctgttaacttcctatggcgactccttaagtggtcaaggagcgctgattacattccccctgcgctgagaaaaggctgcgctggatgcttgat

SEQ ID NO: 98098 - DNA, 42 bp, Homo sapiens
  chr7:80134959-80135001
  hypo
gcgtgagccactgcgcctggcagagagcgatatttctagata

SEQ ID NO: 98099 - DNA, 183 bp, Homo sapiens
  chr7:80135488-80135671
  hypo
tcgaatgaaaatatgcgaatataaatatgttctgtaatattactagagagcttgttaaactgtagttagcaagagtcattgtcagcaagccagaattttcaacctccttagcaaatactatcatttggctaagtgtggaatgttttactaaatggtttgcatcttttacgcgagtgccttacg

SEQ ID NO: 98100 - DNA, 368 bp, Homo sapiens
  chr7:803247-803615
  hypo
gtctcgccctgcacccgcggctctcgctctcctgcaccctgggcggggctccctgtggcagcctccctcccgattatcctggcaggcccggcctgtgtggttcttacgcgtgagggggatagtgagtcccagcaggcaggcaggcttgagccctgagtgttggaattgtctcagtctctgacttgtaacctccaggcacaggagacgatggactcactggccatggtggagggtgtcagcagctgccaggacctctaccgcaagcacattggtcccctcctggagcgggtgaccgcgtcgcaccttgactggaccgcacactcgccggagctcctgcagttcagtgtcatcgtcgcacagtcaggtga

SEQ ID NO: 98101 - DNA, 37 bp, Homo sapiens
  chr7:80702421-80702458
  hypo
tagaagcatatctcacgcctgtaatcccagcactttg

SEQ ID NO: 98102 - DNA, 120 bp, Homo sapiens
  chr7:80790105-80790225
  hypo
tgcgcccagccgcttttctcactcttaagaaaagtcacaaacacatttcaactttgctgactttggagatgcgtggaaatcgtttttaggactaggagaagatctgccagagagaaaaaa

SEQ ID NO: 98103 - DNA, 49 bp, Homo sapiens
  chr7:808528-808577
  hypo
ctgggtcagaagcagcgtggttctcgtggcagggcggcacttggcccaa

SEQ ID NO: 98104 - DNA, 30 bp, Homo sapiens
  chr7:808818-808848
  hypo
cgaggtccccagcaacggctcaaggtgact

SEQ ID NO: 98105 - DNA, 30 bp, Homo sapiens
  chr7:80896305-80896335
  hypo
tgacggaccactgcacgagcccgcaatggg

SEQ ID NO: 98106 - DNA, 37 bp, Homo sapiens
  chr7:81644079-81644116
  hypo
tctttcatggccagacgcagtggctcacgctcgtaat

SEQ ID NO: 98107 - DNA, 30 bp, Homo sapiens
  chr7:81928003-81928033
  hypo
agcaggggctataggcgcatgctaccacac

SEQ ID NO: 98108 - DNA, 298 bp, Homo sapiens
  chr7:819400-819698
  hypo
tcaggggtcccaggtcgccaggagcaccttgcatgtggctcgggatgcacggagtctcccgtgaggtgtgggtttcttaggaccccagggcaggtgtcccatgggagtatgaactaaatgcctttgtggacgtttagacgtgaaatgtctgctctagactcacacacctgtctcgctccctccttccagaactcttaaaacgcctagatgacgtgtccaacgatgtgaggatggcagccgcctccaccttggtcacctggctgcagtgtgtcaagggtgccaacgcaaaatcctacta

SEQ ID NO: 98109 - DNA, 556 bp, Homo sapiens; identical to SEQ ID NO: 31332
  chr7:82072006-82072562
  hyper

SEQ ID NO: 98110 - DNA, 57 bp, Homo sapiens
  chr7:82072646-82072703
  hyper
cggccggcgctccctgcccggcccgccgacttacgtgacggccgaagggaacggctc

SEQ ID NO: 98111 - DNA, 44 bp, Homo sapiens
  chr7:82073054-82073098
  hyper
agacctcggcgagcccgccggcgctcgcgcgctctcgctctccc

SEQ ID NO: 98112 - DNA, 59 bp, Homo sapiens; identical to SEQ ID NO: 31334
  chr7:82791978-82792037
  hyper

SEQ ID NO: 98113 - DNA, 34 bp, Homo sapiens; identical to SEQ ID NO: 31335
  chr7:83277925-83277959
  hyper

SEQ ID NO: 98114 - DNA, 53 bp, Homo sapiens
  chr7:83278217-83278270
  hyper
agaaaaaaacaaaaccgagcacacgcactcccttctcccgtggaggtcctctc

SEQ ID NO: 98115 - DNA, 570 bp, Homo sapiens
  chr7:834303-834873
  hypo
ctgtgggctccatcccgggatgcaggacagagatgtgggatgcggaagggttccccgcagggatccaggtccgggggcaggaggagcccagagggtggcaccatcacgcaaaggcctccagaggcgtggcccgggacaagcacagcgccagccgcctgcgctgccagggcagggtccacacccacagactgtaacctggacccgggcagggcggggtccacacccacagactgtaacctggacccaggtggggtccacacccgcggactgtaacctggacctgggcagggcagggtccacacccgcggactgtaacctggacccgggcagggcggggtccacacccttggactgtaacctggacccgggcagggcggggtccgcacccgcggactgtaacctggacccgggcagggcggggtccgcacccgcggactctaacctggacccaggcagggcagggtccatccacacccacagaatctaacctggactggggcagggcctaaacccagggactctaacctggacccgggcaggggaagggtccacacccgcagactctaacct

SEQ ID NO: 98116 - DNA, 40 bp, Homo sapiens
  chr7:8343744-8343784
  hypo
tattcggccatcttgcctcctcccccggaattttcttaat

SEQ ID NO: 98117 - DNA, 71 bp, Homo sapiens; identical to SEQ ID NO: 31337
  chr7:83824239-83824310
  hyper

SEQ ID NO: 98118 - DNA, 39 bp, Homo sapiens
  chr7:8391330-8391369
  hypo
aaacttaggattgggcggggggtgggggaggagccaaga

SEQ ID NO: 98119 - DNA, 386 bp, Homo sapiens
  chr7:8473070-8473456
  hyper
agagacagccagagtcggagcacagaggccgagtctgggagacgctggttgagtgggaggtgtcagtagcgagggaggtggtgacggctcgaagcatcccccgtcctcctcctcccccttcacgctcagcccagccggcggcgaggagtccagaggccaaggtcgcccagtcctctcggctgtctcgagctgaatggctggcagtctgcggctcccccgcctccggcccggcagccacaggtcggaggcgcccggcgtcggcgctcgaggccggcaggggcgccctgcaccctcccgcgcccttccccgccctacgcgactcccggctgctcttcccgccactcccctgggctttgcgatcttccctacgccccccgggaaggggg

SEQ ID NO: 98120 - DNA, 763 bp, Homo sapiens
  chr7:8473479-8474242
  hyper
cgggagccacttgtccctgtgggcccagcccgcgagagcctgagagccggatctgtttacacagggtactaattagtctttgaggaatcattcacccacgtgccaaagtaattgtccgtgtcaggaaggtaggcgtgccaagccgcggctctgcggagaaaccacgaccaccgcggccgccggaaacccaaagcgctccagagcgtccccgggtggccgggcagcaccagggacagcgcccgggactccactggggaccggctcctgggcttcccagcgtcgcgggtagaggtacagctgctccgtgtgccgcaggctccagattctcgccaccccacccctccctcagaaactcggactgctctcgtctgccgtgtggttctcttttcttccgaaaggccagtgtcttatctctccacttcaagtccagaggacttgctcagtctcctccccttaagtcatttccaccatcctcaggcagctgtgggaagccgagagtcctggactgttcgtccgggtgccagcgctggcagtcccagtccgtccggtgcagcagcccggcgcattcccctctctccctccctcttgctctccctccctttctgtcttcctctctttcctcctctactgctccctccctctcttgcctcttaagtttcctgcaccgtgaatccaactgtgccaagccttggctcccgcgaaccaatcctgagcgcgacccgggcactgggacggcgactccgccaaagctggacgaggcagc

SEQ ID NO: 98121 - DNA, 925 bp, Homo sapiens
  chr7:8474515-8475440
  hyper
cggaggaggcttcttctctagaagttagcgaccggctgtaccctttggctcgaaaaaagtagtgctagagatgtgactgtgagcattcgtgggtatctctgtgtgcgccaggggttcgaatgggtaaactgatccctgctttcctgtatgcaaattgcattctctttccccacccccacttcaccgaacgtgttgaggtacctagcacctaatcgcggtcagttctacctacctcttcctctcaccgcgcccccctcgctcaatctctctctctccctttatctttcccctctatctctctctgctggtgtgtacgtgtgtgagcactgccagggctggcgaagaaccagccgccgcctttagtccgagccgccgggccacccaacacaagggcaggtctcgctgccggagaagcctgggctccgaaccagcctgcacgcggctcagtgtgctccgccgcctgggaactcgcacccgaggagcgcagggggcaaggagcccctcaccctccctctcgtccgcccgcccgcctccccagctgcggaccgcgcgcttgctggtctcaggcgctggatttactcgcttttcaatttttcgtaccctccctcccttttttttttggtcccccactccccgctacgaccccctttccccgcttgattgtcaagcctaaccttgcccgcgtagtcatgggatgtctaattttatttgcatctaggctgctgagagcgctccttgctctgtaaagtggatgtcaggtggatctatgtttctgaaggaacaaagactcaaagaaggcaccgccaaggaagtttgagacgcgggagaatgcaggctgcgtgctggtacgtgcttttcctcctgcagcccaccgtctacttggtaagtcttggaaggttcggggctttcgcatttttaccccggc

SEQ ID NO: 98122 - DNA, 445 bp, Homo sapiens
  chr7:8476305-8476750
  hyper
ttgtgttcagtgtcccgacccccatagcccatcctgggctgcgggagtgcaccgagggctcgctatgttctgtctaggggtgaggtgcgctaaagcagcccgaactctctgatgggctacacctctgattggaggtgatactggcgctcctcaatcccaagagccttagatagaacccataagcctgaaagaattgccatccctacaattgacagcgtttctcggccgttgccctggtgcatgtggctgcaaagctgcgagttgtgtgaattctgtgtatgtgagtgacacgtatatatatgtgtgtgtgaatgtgtatttaaccgatttcagcttcaatccaagaaccctcaatgttgcctgtctttgcccctttatcgcctgaccgtagcagccgcggacgccagagggcgctgcgcatcagcgtcctcgcccacaggacacc

SEQ ID NO: 98123 - DNA, 30 bp, Homo sapiens
  chr7:84773311-84773341
  hypo
gcaccgagcctggcccgagacttgtaattt

SEQ ID NO: 98124 - DNA, 30 bp, Homo sapiens
  chr7:8477418-8477448
  hyper
tgctgattcaattaccgtttagttacagac

SEQ ID NO: 98125 - DNA, 329 bp, Homo sapiens
  chr7:8480721-8481050
  hyper
tgggcaaccattgtccgttaggggcttcagatctcattttaagaccttaacagtcctcgccgttctaattaaggaaaggcaggcgagcctgccagccgagagcggttgggtcagcggcttcatggtgcagccgagtctcaaagcgggtctgcactctcgcctccctctgcattctcttagccactatttgcctggtcccgtcgcgtgtgtgcaggaagtttcagtcttgatttatccactagtcaagttcccgaccagctctttttctggatgtcagcactaaccccctcccggagcttggtaaacacagcgcgcgcatttttctgcct

SEQ ID NO: 98126 - DNA, 988 bp, Homo sapiens
  chr7:8481310-8482298
  hyper
caagctttccaagagcggctttttattgagataatatattttggcggcttcttcaaacccctccgcgcgcccaagagcgcgtttgcgcattttccaagtttgccctgccctcgcgggttggtggctgttgtttaaacttctgatgagcgcgctgcgtttctgctacgggatgaaaacctaattacctcctctgcaaagagctttccctagtatattttattgattgcggaggtgggagccggcagggggtctgtgggggtgggcggggaggggattctcttgctccggtgccctctgttgccgaaagttccttaggcgtctagtcaggggttcggggtggtggaaagcgagatggcgttgggagccagggcgttgggacggcacaagcagtggggtcccaggagcagcaagacagtagctcctctcgggccacggcttacgaaaagctttcctagctccttcttcctataaattaatgagggtattttactcgttcaagccggaaatacgatggggagggggagacacaggccgcatccagagcgcatcgcctcatctgcatgagaatggagaaccgggaggcttttcttgtactgtttctttctcccacaataagacaaattgctgcttagaaaaactgagtgtttccttagaaactggcttgcgggagctctgcgcgtccccgctgaacctgcctctggccgcgcctcgccatcacccccgccgccctaatggattctgaagcgaaggatcctagctgccgcggctaagggcgcagggggaggccgcgcgtcctcgccacaccggaaggagagggcatccggctcacacatcccaccctatgtcttagaccccgtcctcacacattgactttaaaaggccattttccttcgtcttctacaagaagcaagaaacttttttcgacgtaggcttcataccctcccttcggaaactcagtccgctgaccaaagccgcagtgttcaggccc

SEQ ID NO: 98127 - DNA, 302 bp, Homo sapiens
  chr7:84814630-84814932
  hyper
ggagatcctccccctcgtctctgcgcgcccccaccccgccatcccccgctagcgcacacatgcaggagaaccctttttaggctaaaccggaaagtttaggtcttctcccctcttcttttgcttgtgcaaatagcactaagctaaacggaaagtggtggggttttggtgatgaaataagagtccacgcacagaagcttgccttttattaccgcttcgctcgaggcgaaatcgctgaaagttcggctatttaactcctgtccccataactcggaatcccggacaccagcggccccagctgctgg

SEQ ID NO: 98128 - DNA, 54 bp, Homo sapiens
  chr7:84814985-84815039
  hyper
cgtctcctcctcctgtcaacttccctccttgcactgtgacggaggcaaagcaac

SEQ ID NO: 98129 - DNA, 55 bp, Homo sapiens
  chr7:84815396-84815451
  hyper
cgcccattcctcttccaaaacgctacaacaaaaaccaccacgcttcccttccttc

SEQ ID NO: 98130 - DNA, 737 bp, Homo sapiens
  chr7:84815717-84816454
  hyper
ctcgtcagaaggctccgcagctgctgaggcggggtgggactgcgccccaggggccgcgctgaagctggcgccgcgattactgcgcaccgatttcgcccactctctgtccgctcccgggagccttctctgtctcaggacggttccttatctcccaaaccatgctcgtcctccacttcggacccacagccacccccaaatcccggctatccccgcttagcaccgcggtctccagcacaccctcccactggagtagcaggtgacccaaaccagacttacctgctgtgaactcttctctccctctctcttttcctggtgccttttcagggagaggggaacgggatgcaggctgaggtccagcggcgcggcaacccggggcaccggcgcgcgttcctctgagccgcagccctggctgagcaagcggagccgccggcagccctggcagagccgggaagctgcggccgcaggggccaggccgggaggcagggggcgctgctgcctcccccgagagccgcgctaggacaggcggagagcaaggcaccagctggagctttggggaggagagggtggcgaggaaaggcacgctccaaacaggagggcggcttttaagtttgtggtgtgaccgcagcagctgtcctgggagagactcagtctttctaaaaagaggatgctgaaaacgccggggattacctttccccttccgatctcctcccccagccctcgccccctccttccactgc

SEQ ID NO: 98131 - DNA, 33 bp, Homo sapiens
  chr7:84816455-84816488
  hyper
cacgccagaactcccaagcgtgcagaagttcat

SEQ ID NO: 98132 - DNA, 156 bp, Homo sapiens; identical to SEQ ID NO: 2965
  chr7:8482669-8482825
  hyper

SEQ ID NO: 98133 - DNA, 1139 bp, Homo sapiens
  chr7:8482884-8484023
  hyper
cgtgatcaccacggagattttgcgaatccttcttttccccaacttctccccctacccagtctcccattctttcacagttcattaaatctacccctcccccgaaacagaaacgtgaaggctgtaacgaagagctagaagtgtctctagtaatgtaaaagtctcaactgacagacaaggaaactgaggcaaccaacttattcgcaagagtaaaaccctatggggagaagcgattcctgcccctcttcccccggcgaggaacacggctggagccacccaggcgccttccaggctaaggcgcctttagcggcgcgcaggggtgagggagagggtggggagagtcctaattattatgaatttctaaaggcgcagtaattattcacggggagcaggacaaaccatggctaggcagggaaatcgatatatttgctatcgaaagttcctggctcgcctttaatgcagacgaatgggggatgcagcctcattattttccgtggttaggctcgccagcgtggggcctgatgcagcgtgaaatctatcatcattagacccgggatggagcggcgggggggagtttctctttacttaccaaaccgcaacaacaaacaaacaacgacgaacaaccgccccctacaaacactcattctcacacaacgttgccctacctccctcgccgcttgccctggccgctgttgcacactcccctgggggctgtctgcacgccctagagcagacactgcggtcacttaaagtgcgcccagttcctccaccgcagcggtcacaccgttgatttgatccagaaataagacggatagtaccgagcgttggcgctaggggttgtctatgtcaaaggcgaaggttggctgggaagttctgtccgtttctcttgccttagcataggagtcaatccttttcttgtcacccgattctgcaaattctcgctgtattaaaggagcagagatctggcatgtagtgctccattaacccgtagcataagttagctcggacataaggcaagccctcgagaagggaacgaatcagaaggtgaaaagagcggtcggaaggtgaggaagagaaggtttaggcgcaacgcctcggaggtattctctgaggccctggcgagatttcggcctttagcttaa

SEQ ID NO: 98134 - DNA, 23 bp, Homo sapiens
  chr7:84936791-84936814
  hypo
accgcgctcggccttgtttacca

SEQ ID NO: 98135 - DNA, 28 bp, Homo sapiens
  chr7:85220892-85220920
  hypo
gatctaggccgggagcggtggctcacgc

SEQ ID NO: 98136 - DNA, 207 bp, Homo sapiens
  chr7:852590-852797
  hyper
tctgttacagctctccggcaagttcctttcaccactccccacagtctcacacactgaaaccacagcaggggccgccctcactcaccgcaggggacaaccacccaccaaaaaccatttcctctgcggatgcttcccgcccaaagaaggaaccagaagcaggcaggatggggaagcagctggtggagaagccaaattgtttccttaaga

SEQ ID NO: 98137 - DNA, 27 bp, Homo sapiens
  chr7:86228129-86228156
  hypo
aggaggctgaatccacggggctgagca

SEQ ID NO: 98138 - DNA, 510 bp, Homo sapiens; identical to SEQ ID NO: 3058
  chr7:86273208-86273718
  hyper

SEQ ID NO: 98139 - DNA, 398 bp, Homo sapiens
  chr7:86273719-86274117
  hyper
gcttcagcctggtcaaggtgaaggaaagttgcttccgcgcctaggaagtgggtttgcctgataagagaaggaggaggggactcggctgggaagagctcccctcccctccgcggaagaccactgggtcccctctttccccaacctcctccctctcttctactccacccctccgttttcccactccccactgactcggatgcctggatgttctgccaccgggcagtggtccagcgtgcagccgggagggggcaggggcagggggcactgtgacaggaagctgcgcgcacaagttggccatttcgagggcaaaataagttctcccttggatttggaaaggacaaagccagtaagctacctcttttgtgtcggatgaggaggaccaaccatgagccagagcc

SEQ ID NO: 98140 - DNA, 189 bp, Homo sapiens
  chr7:86274257-86274446
  hyper
cgtggggcaggcgcagccgggaaagttgaggtagagcatggaccagtccctacagtcctgactggagtgggaagggtggagggcagaggcgatgtgggtgtgcatgagtgagagtttgtgtgtgtgcgcccacgtctgtgtctgggaggagggagatttcagggcatagatctgcggccagggtgcgag

SEQ ID NO: 98141 - DNA, 42 bp, Homo sapiens; identical to SEQ ID NO: 41364
  chr7:86416083-86416125
  hypo

SEQ ID NO: 98142 - DNA, 102 bp, Homo sapiens
  chr7:86688425-86688527
  hyper
cagaaaagcatcccccgagagacagcgaagccacacaccctctccgggccagctaccagggcgggcaacttcacccctcgaagcaaacgaaagcccctgttc

SEQ ID NO: 98143 - DNA, 627 bp, Homo sapiens
  chr7:87104741-87105368
  hyper
ggcgccaggctgttccgttctttgccgcctcaagatccatctcagcctgaggagaaaccacagcctcagaaccaagtacaccctctccggcggcccggcgcacgagtcgcggggcccgggggcactgggtggaggtccggccactcccgccccgcgccccacgtcccgggtctcccttcgaggccagacgcgcccggacctctctcacctcgaacctcgcgcgtgtctggcagggcctctggacgcgcgggcgctgcagcagaggggcctggactttgctcgccgcggcctcgcccccgcccccgcccccgccccccacgcgcgtccggcccgggaaacgcctaccgttgcagccagggcgagggccgcggcccgcgagagcagctcccgccgcccgcccagctctctccccaggctaggcgcgggccaggggcgcagcctgccgctcttgccgccggggcgcccggctggggccgccgcccaccctggcgacccgccagaaccagcccggtcgcaggataagaccgagatcaggctggagcctcgggtgccgagaaagcctcgcctgatgggccacccaagcccctgcagatgactgtcacaccccatgggcgctcagttttgttt

SEQ ID NO: 98144 - DNA, 812 bp, Homo sapiens
  chr7:87229377-87230189
  hyper
aaattactcaaatctcgcaactatgtaaactatgaaaatgaaacaagctagttaccttttattgttcagtttaaaaaagttcttcttctttgctcctccattgcggtccccttcaagatccattccgacctgaagagaaaccgcagctcattagccaaatgcatgagcctcaggcgcgctggaggtgagactaacctctagtcccccgtcgaagccagagagcagtaagagggagcgcccgccgttgatgccccagctgctctggccgcgatgggcactgcaggggctttcctgtgcgcggggtctccagcatctccacgaaggcagagttgggggtctggcagcgcgttctggactttgcccgccgccagtgcgattctccctcccggttccagtcgccgcggacgatgcttcctcccacccaccgcccgcgggctcagagagcaggtccccgcaccgcgcgggctgtgcgcgctccgggcaacatggtccagtgccactacggtttgggcgctgctccaggagctcctgagtctagatctaaccccacttggtccccatggacttgccagaggacttcacactatccacgcctcaagaagcccttctcccgtgaagaccaagttcaggaaatctgaaagcctgacacttgggaactgtcccatagtagctcccagctttgcgtgcccctacctcgcgctccttggaacggccaccaagacgtgaaattttggaagaagatactccgactttagtggaaagacctaaaggaaacgaacagcggcctctgcttctttgagcttggaagagcc

SEQ ID NO: 98145 - DNA, 154 bp, Homo sapiens; identical to SEQ ID NO: 31349
  chr7:87230190-87230344
  hyper

SEQ ID NO: 98146 - DNA, 178 bp, Homo sapiens; identical to SEQ ID NO: 3062
  chr7:87230345-87230523
  hyper

SEQ ID NO: 98147 - DNA, 162 bp, Homo sapiens
  chr7:87256912-87257074
  hyper
ctcctgcaggtaaaacggtgggtagtgagaagctctaggaagggggcgcttccgaacacgcgcgtcgaggagggcgttccaggactctgagggagcagcccagctggaccgaggccgcgtcgttcctgggcttactattcccagacccggactcccgattcc

SEQ ID NO: 98148 - DNA, 820 bp, Homo sapiens
  chr7:87257075-87257895
  hyper
gagtcacggcccaggacgcgaaaagactctacactggcaccacgctcctccttaggcgggccgtcagtcccgggtgcgggctgcgctggaggctgaggtgggagcgacatggtgtggaggggcaagaaatgtcggcactagacgcgccaagaaggagattctacgagcaattcccccctcgggccattgtgttgctgtttattagcccctgggagggcgtcaggacaaaaggaaccctcctcccttcttagtacttaggcccaaggtcgggtgtgggagccggcgcgctgctttctaggcaggcactgaagctacggcagccacgcaaataggtatcagccgttaaagcttggctacaggcaaggggggggcaataggcccctggcgctgtggggccccgcatcccacaatccccgcggctagcctgtgtggctactggcggcagctagcgggctgcgaaagcgagcccagcgtccttgacagcagcccacgcgtcggggcggggcttgagcccgctgctttaaaaggtccgcgcggccggccccgcccctctggtgccgcgattggatccggcgggggtagcgttgatttgataggcgcagagagggtggggctgcgcacgcgaggccgggggccttgccgctgcctcccgggctggggcacgagtggctgcggagtgtgggtggttgggcgtgaggggccgacgggctcgcgcgcgcgccgtctgctgaggtccctcgggaaggaggagagcgcctgacgccgacccgcaggcgcagcccggcagtcggcggcgcgccgagggcggaggtggtgcgtg

SEQ ID NO: 98149 - DNA, 443 bp, Homo sapiens
  chr7:87257955-87258398
  hyper
agggcgagccgtcagtccccgggtgcgagtccctgctgtcttccacacccttcctccctccaggctcctttcctacatccttcccgcgcccccacggttgcggaccgagcgagaacccccttaagcaggtgtggggggcgtgcggggtggcacgagacaaaaggggcacgggggtaagcccgccatggcctcccggagcctggggggcctgagcgggatccgcggcggtggcggcggaggcggcaagaaaagcctgagcgcccgcaatgctgcggtggagaggaggaacctgatcaccgtgtgcaggtacggcagcgcagggcgaggggaaccagcctcccgccggggctgagagctctgggcttccgcgcgggtccttgggggtcccgggcatgatgggctgccgcccagtgcccccgcctatgttgcgccagccaaatctg

SEQ ID NO: 98150 - DNA, 30 bp, Homo sapiens
  chr7:87564329-87564359
  hyper
cctgcctggaggagacgcctcattgatgga

SEQ ID NO: 98151 - DNA, 49 bp, Homo sapiens
  chr7:87564603-87564652
  hyper
aaatgagttgggtcccgatgcgagtcatgcatggcgctccctgtgcaaa

SEQ ID NO: 98152 - DNA, 30 bp, Homo sapiens
  chr7:87850928-87850958
  hypo
ggataaacggctatacgaattggcatatca

SEQ ID NO: 98153 - DNA, 86 bp, Homo sapiens
  chr7:87936120-87936206
  hyper
cttccaaggaggaagcgtccagcgccaacggtgcgcgccgcgggccgggcgggtagagggaagtttcgccgcgcctgcagctcagc

SEQ ID NO: 98154 - DNA, 58 bp, Homo sapiens
  chr7:88387729-88387787
  hyper
actggggagaattagcgcattggcggtagcctttcaattccagcgctgaagcaacaga

SEQ ID NO: 98155 - DNA, 42 bp, Homo sapiens
  chr7:88387989-88388031
  hyper
ttaaattacggtaaacgaaataaggtccgttaaaaaccactt

SEQ ID NO: 98156 - DNA, 364 bp, Homo sapiens
  chr7:88388282-88388646
  hyper
gctcattcttgcaaccggctggggagctgttgcttctgccaacgccgccgtcagccagagcgctgaagaaaagctgaaggccagcaggcaacgaaagagtaaagaaaacgccctcctcctgcccatctcctccaccacagcctccccagtcctcccaggtgactcccaaacagtagaaagttggctcagagatagggcagaagaaccggggggctgggcggctgaggccgggaggtgggagaggcgggtcctgcagccccgagagccccccgcggctgcagcggcagctgtcacctcctggcctcgccccacagcacacctgagcctcctgggcagccccgagcccacagctcccagcagaggc

SEQ ID NO: 98157 - DNA, 255 bp, Homo sapiens; identical to SEQ ID NO: 3064
  chr7:88388647-88388902
  hyper

SEQ ID NO: 98158 - DNA, 250 bp, Homo sapiens
  chr7:88389046-88389296
  hyper
cgccgggtcccctccgtgctctgtgctgtcgccgccgccgcctctgtcagagcagcagctgtcggcagcaggagccccgcacggggcgcggagcagggacgcgctgccaccgcctccccctgcgtcctgctggccgcgtcttctcgggaggtggtagtcgctgttgccgctgagaaacccgcccgctttccacggctggtcgcctggtgaggagttgagactctgcgcctccgcccggacccacatggct

SEQ ID NO: 98159 - DNA, 30 bp, Homo sapiens
  chr7:88719-88749
  hypo
ctctggcgccatggccgtaaagagaaaacc

SEQ ID NO: 98160 - DNA, 283 bp, Homo sapiens
  chr7:89748011-89748294
  hyper
cgggcactgactgtccgatacctcagcgatcgtaggagagcagagacgtccctcatgccgggcgcaccaccggcgggccggcggttccgttggcttccctgacatacttcctacagtcatttctttcagctgagatcttcccctttaatacctcgttaattaacgtgtaaccttttggttaaaatgtcagagctaagactaaatctgaagaaaagaatgaaaccaccgtaagttcttcagactcagtcgtcagcaaggttatggcccgaagccgtgcagaggc

SEQ ID NO: 98161 - DNA, 268 bp, Homo sapiens; identical to SEQ ID NO: 31362
  chr7:89748295-89748563
  hyper

SEQ ID NO: 98162 - DNA, 41 bp, Homo sapiens
  chr7:89748925-89748966
  hyper
ctcccccttcccccccgcctccgccccggagccggaggtag

SEQ ID NO: 98163 - DNA, 15 bp, Homo sapiens
  chr7:89841157-89841172
  hyper
tcccctggctgttcg

SEQ ID NO: 98164 - DNA, 183 bp, Homo sapiens
  chr7:89841213-89841396
  hyper
cgccgcggcagccaccctgcaaccgccagtcggaggtgcagtccgtaggccctggcccccgggtgggcccttggggagtcggcgccgctcccggggagctgcaaggctcgcccctgcccggcgtggagggcgcggggggcgcggaggtgagcgggtcggggaggagcgcgaaagaaggtagcg

SEQ ID NO: 98165 - DNA, 539 bp, Homo sapiens; identical to SEQ ID NO: 31364
  chr7:89950183-89950722
  hyper

SEQ ID NO: 98166 - DNA, 312 bp, Homo sapiens
  chr7:90225745-90226057
  hyper
cggcccaggccggagcggagcctgccgtcctccgcctgcctgctgctcgcctccctagacctgcgcgtcgcttcccggcccgccgaggaggtggtggaggaggaggcgccgctttccccgcggcgcgcgccctcgccgttgtctgagctgtgcctggaccagtttggggaagttgtcggggctccgcgtcgcccagatgtgtgacctcattgagccgcagccggccgagaagatcggcaagatgaagaagttgcggagaactttgtcggagagtttcagtcgcattggtgagtagcgcgctgcccccggccc

SEQ ID NO: 98167 - DNA, 16 bp, Homo sapiens
  chr7:90226268-90226284
  hyper
ggttctcccctcctcc

SEQ ID NO: 98168 - DNA, 461 bp, Homo sapiens
  chr7:90226285-90226746
  hyper
ccactagtgctcgccctttcgcgcgcgtgggggacgggcgaggggacccctcggcccccaccgcgcaaggggctgcgcggctgcttgggccacttgttattttttgcgcacaggcttggatattgggcgtttagtcagtaatttagctttggaaattggtgaaacgttagactgtgccctggtattgtttaacgtatccaacctaaagggaagtgggacagttaccttgggacctattgttcggtacttcgggtcctggaaagcgagatttgggtgttcagtctcgaggtctctgaatcttcccgctgctggagagaaatgcgcgctgtggagttgtctggacatttaggaatgtctctcgaacttgttccatttaatagagctcaggggctgttgtctttaaaccaaacaacaaaccaactgaccaacagtgtttaggacagtgacgaataaatgcatgt

SEQ ID NO: 98169 - DNA, 76 bp, Homo sapiens
  chr7:90269559-90269635
  hypo
ctattcggccatcttggctcctccctctcttccttatgtttaataactatcacagtaaacacgctttttgtttaat

SEQ ID NO: 98170 - DNA, 146 bp, Homo sapiens
  chr7:90558629-90558775
  hypo
agctgttcctattcggccatcttggaacctctggaacctgttttaaatggactgatttttaaatcattgtcttgcatatttcatggtgatggttatttgactattttaaagtataattactgggcaagggacgattttaaaaatag

SEQ ID NO: 98171 - DNA, 30 bp, Homo sapiens
  chr7:90720178-90720208
  hypo
ctaagctctgtcactcgtcacctgtttgta

SEQ ID NO: 98172 - DNA, 30 bp, Homo sapiens; identical to SEQ ID NO: 41041
  chr7:907656-907686
  hypo

SEQ ID NO: 98173 - DNA, 89 bp, Homo sapiens; identical to SEQ ID NO: 31367
  chr7:90894938-90895027
  hyper

SEQ ID NO: 98174 - DNA, 130 bp, Homo sapiens
  chr7:90895028-90895158
  hyper
cgccctcaaggtgccctcctacctcaactaccacttcctgggggagaaggactgcggcgcaccttgtgagccgaccaaggtgtatgggctcatgtacttcgggcccgaggagctgcgcttctcgcgcacc

SEQ ID NO: 98175 - DNA, 45 bp, Homo sapiens
  chr7:91510048-91510093
  hyper
gaaaagactaacttccggcctcgggtcgcgcgcagaggtgatgtc

SEQ ID NO: 98176 - DNA, 48 bp, Homo sapiens
  chr7:91510834-91510882
  hypo
attaattgtgtctgtcgagttatcctcaggagacgatggtgatttggt

SEQ ID NO: 98177 - DNA, 63 bp, Homo sapiens
  chr7:915323-915386
  hypo
cagggaaggaccgcaggtggcctttcaaagaggaggaacgcccctcagcgatcctaagaggtt

SEQ ID NO: 98178 - DNA, 467 bp, Homo sapiens
  chr7:91808202-91808669
  hyper
ttcagtacaggctaacgtaacgtgggacagcatgcaaagccatgagaagtgggaaaatgagagagaatctgggcgtggcttacagggctgctgaagtaagacacacccttcgcttcacctgtggcctcccgcggcggctgcggctccttcgcaggaccggtagggggcgcgcgcggttgagtccagcaattgcgaggacctccgcaggcgcagcccagcactgacgcctctccgggccgtggctcctctttcccaggccgaaagcggccgggccctctgctccgctgcgccctggcgcggccgcacccactgcgcgtttgtgagctggccatcggtcacactgggatactcgaggaggaggcctggggcctgcattcaattccctaagagggacccgcgctggccgctgcaggcgggtggagaacgggcgtctgagtctttggctttcgtaccggaatctccccggg

SEQ ID NO: 98179 - DNA, 30 bp, Homo sapiens
  chr7:91889676-91889706
  hypo
tcaccttctttagctcgttgatgaaacgtc

SEQ ID NO: 98180 - DNA, 25 bp, Homo sapiens
  chr7:92076443-92076468
  hypo
tgagccaccacgccagacctggatt

SEQ ID NO: 98181 - DNA, 62 bp, Homo sapiens
  chr7:920918-920980
  hypo
acacagaagataccacggcactgtggggctctgcaaccaggcctcctcgcccccactcccac

SEQ ID NO: 98182 - DNA, 30 bp, Homo sapiens
  chr7:92439285-92439315
  hyper
tccttttctcagtaacgcagggtaggtcat

SEQ ID NO: 98183 - DNA, 193 bp, Homo sapiens
  chr7:92466288-92466481
  hyper
aaaatttccggctttcgctgaaactgtagtagggggatcctgcgactaaaataagcggcattagtgggagagagtgggacgtgtcgtcgggagtcggcggagtttccaaacccagggtcgcccagagttggggttttgacagggtgaagcggggggcatcctcactgtgtgacgtggacggatgggaaaaaca

SEQ ID NO: 98184 - DNA, 464 bp, Homo sapiens
  chr7:92689310-92689774
  hypo
attgttttgtgatttcggcaattagaaatgatgctacaggagactcgttctcacctaaggagattttgcttcctaggagacattggtcaacgttttgagacttttcttattgtaacaactggcaagtgctactggcatctagtaggtagaagttggagtcctgctaaacgatctacaacgcacaggacagccacccatgacaaagaattaacacacctataaagtcaatagtgctgagcttgacaaaccctgctctgggttatattgttgggagagaaattgctggctgataaagtatatttatcttcaaacttatacaatactaccattctgttttctagagtgattgtatcaatttacactgccatcatcagagtgggaggcttcccgatgctgtatatctgcaccagcgctaaatatcaccagcttaaaaatattttgctccaggcacggtggctcacgcc

SEQ ID NO: 98185 - DNA, 30 bp, Homo sapiens
  chr7:92731846-92731876
  hypo
ccgcctttttgacttcggatacaatctttc

SEQ ID NO: 98186 - DNA, 30 bp, Homo sapiens
  chr7:92732475-92732505
  hypo
agtagttcccacattcgatgacctctgttt

SEQ ID NO: 98187 - DNA, 30 bp, Homo sapiens; identical to SEQ ID NO: 41367
  chr7:93055830-93055860
  hypo

SEQ ID NO: 98188 - DNA, 235 bp, Homo sapiens
  chr7:93203561-93203796
  hyper
caaatcgttaagtcccgctcatttccaaacgctccttacctggaattctgtcactgggcggctgggcacagctcaatagaagcaaagggtgttcgcaggtgtggctccagggactcaggcgctcaagcttcagcgcccatctcctgggcaggagatgtcagccgcagggtgaggtgcggacgtgcgcacttctccaacccgggaaggtccgccagccgcgcggcgcagcccaccc

SEQ ID NO: 98189 - DNA, 15 bp, Homo sapiens
  chr7:93204217-93204232
  hyper
cgagctggtgagctc

SEQ ID NO: 98190 - DNA, 816 bp, Homo sapiens
  chr7:93204298-93205114
  hyper
cgctccagtcagggctggggctcaccctgcgagtccgggagactaaagcgccgcgtaaacacaggaagcaggcgagggacccgagttagaccttgagtagggagggagaggggggcgacagtctggactgggagacagctttctgggagccctgtcccctccccggagaatgcaaattccggagggaggtgagtttccacaagaaccttatcccagagacattgtgaccctggcttcttcagccgccactccggggacagcactagggagcctgtggagggagggtcggtagtgggctaggtagtgaaagtggggtgaggacgtgggaagacggctggctaagagctggggtgctaaaaggaaaaaagtgctgagaggaaggagatgagaagagacaccttgggggtcaggcaagccctgggaaagcgtccggagttgggcggctgtaggctggaggcataacttggatttggagaaagagtgccctccgtgtaggggactgctggtgggcacagtgttttagggtgaatgaaaacagagaggatggcgagggaagacggggatatggggtgcctgacttggtgccggacactgcgactcctcttctttccccctaaagccctcgatgtcagcaggagtccgggacaatccaataccaggcggggcgcagcggaggctggcaggcacgccctgggaggcaggcaagttgattccaaggacgagtcaccctcaacctcttttagcccacaactgggtggatcaaggcaggagccaacacttttttccctaactctgtttaggcggtgttggactaag

SEQ ID NO: 98191 - DNA, 29 bp, Homo sapiens
  chr7:933292-933321
  hypo
gttgggcgcaggcgcggtggtttgtgcag

SEQ ID NO: 98192 - DNA, 146 bp, Homo sapiens
  chr7:93511549-93511695
  hypo
agtgcgatgtaacatcgatgtaaagtgcgatgtaaattccttaaagtgcgatgatgattaggatgtacatcctaatcatctggagttgttgtttaaaatgtgcatctttgagtgccaactcaaacccactacgtaaaaacccctgg

SEQ ID NO: 98193 - DNA, 562 bp, Homo sapiens; identical to SEQ ID NO: 31375
  chr7:93519204-93519766
  hyper

SEQ ID NO: 98194 - DNA, 170 bp, Homo sapiens; identical to SEQ ID NO: 9105
  chr7:93519854-93520024
  hyper

SEQ ID NO: 98195 - DNA, 441 bp, Homo sapiens
  chr7:93520025-93520466
  hyper
tccgagaaagcgcctggcgggaggaggtgcgcggctttctgctccaggcggcccgggtgcccgctttatgcggggcgagcgtccggccgacccccgccggggcggagcctgaggggtggctgattcatgcacggggactgtcaccccgccgcccccgcgctgcaaactgtgtaagagggagaggaattccccgccaagttgaaaagttgaacctgcctcccaaactttctcctgtagtccagacggggacgccctgagggagcgtttgtgtcagtaatgggaaatctgcaagctagacggaaatgacctgctagtgattgcgctgtaaagaagccggaatccacctcttgaaggcatgaagttcaggtatttgaaaggctggtggagagaaagtgcggagttcttgggtcagagcggagcgggattcgttgcaatggacct

SEQ ID NO: 98196 - DNA, 28 bp, Homo sapiens
  chr7:93520878-93520906
  hypo
actccagtctgggcggcagagtggaact

SEQ ID NO: 98197 - DNA, 534 bp, Homo sapiens
  chr7:93550996-93551530
  hyper
aaaggagcgggggtgcgcggagaacacaaagtaaaacttctgctgttcccagtcctgcagccccagcccagccgtcccccgcgggcgtggcaggtcctgagtcagggcctgtccgtggccagcatccctgctgggcgattgagcagcgggaagctgcttggacccagtctcaaacttaaccctcatctagcacccgggcaggcctcctgggttgcagggacttgagaaaaggcagagttctcaggtcctaggaagctggggcacgctggcgtgacaagcgtcccggagaaagccaagccctcggggagctggggaccgcagcagggctgcagtcacatcctgcgcgggtgggcggcgggccaggccttcagttgtttcgggacgcgccgagcttcgccgctcttccagcggctccgctgccagagctagcccgagcccggttctggggcgaaaatgcctgcccttcacatcgaagatttgccagagaaggaaaaactgaaaatggaagttgagcagcttcgcaaagaagtgaag

SEQ ID NO: 98198 - DNA, 33 bp, Homo sapiens
  chr7:93605811-93605844
  hypo
ctagtcaagcttgaacgccggcaggatctctga

SEQ ID NO: 98199 - DNA, 37 bp, Homo sapiens
  chr7:93641681-93641718
  hypo
ccgaggaggagccaatagcgagcgagagctgccagca

SEQ ID NO: 98200 - DNA, 30 bp, Homo sapiens; identical to SEQ ID NO: 31379
  chr7:94024050-94024080
  hyper

SEQ ID NO: 98201 - DNA, 39 bp, Homo sapiens
  chr7:94138061-94138100
  hypo
caaaacattaaccaacgttagtagcggggatgattgtca

SEQ ID NO: 98202 - DNA, 783 bp, Homo sapiens
  chr7:94284364-94285147
  hyper
catagtacaaatgcacgcaaatatttgtggccgaatctcggcaacccgctggaaaggattaaacgtgcggttgccgtgactaaacgcattcattcaccctacaagatttaggaaaatgtaacgttgcaagggaagcaaggtctctgtgtaaacctcgtaatcgccaccaaaagtcggtagctgggagccttcaaagcccgccaaacacactggaagcatccacagctgttttaaattggttttggtttctggaaatagcgcactcggtacggcagcatctctggcctccagccggggttaaccctgacctgaacgccctgtttagctcccagcatttcatgattccgcttccctgctccgtaaaaccgaagaaaaccgagatttccgtcaccgagaaatgcacttagcaagagggggaaattcggtgttttaaatgtcacatttttgtgttctctaccactatcaagaaaaggaaaaaagatgtgtttgtgtagcggggacgcagcttgacacccatttcctttggctcgcatcgcggtcgcagagcccaatcgcggggaaacgggccccccagaaaaacaggcaacgacccccagctctttgctacagggatcgggagaggactaccctggggctgggcggggagggggatgttgggaacaggaattggagatggaatttctgcgcccgcagagcagggaggggcccgcgggggcgcggagaggaaaaaaaggccaggggtcaagcctggggagagagaagctgggccggggaaatggggta

SEQ ID NO: 98203 - DNA, 751 bp, Homo sapiens
  chr7:94536847-94537598
  hyper
gccggagaggcccctcgcccacggccgagggggtggggcggcctcgcctcgggccggtgcttttcgcccttccttggccgccagaggctccctctctctccctctcccgggattttgctgccgggctccctctctctgcggccctagagttaatcccatcagccgaggtgaggcacctgttaccccggccttcctcacccccgcggcctctcctccattacaccgcggccgccgaaacggcccggcgtggcgaccgcacgtgggccaaaccccttccccggccggcacccctggccccaggccggcccgagcgtgcgggcgcgtcgctgctcgggccgccgcccgcccgcaatggcgttggggagcgcagcgcgcctcccggggccgcccgccgcgggcagggagcgcctgggggccgacgcgcgagtggaagcggccgccgcagccgccctacgcgctgcgccgtgaggagcgggttgcggtgtacccagcgggccggcgccgagccgagccgccgcgtccaccgtggggcggggggcgcctgcgaggagggggtgggagccgcggcggcccgaccctccccgcccgcggcgctcccgctcgggtaagggggaggctgagcgcggggcgaggagttggggagggtggagaggaggaaaaaatcggcttgtacaaaggctgagttgcaggctgggggtgggggtgggttgtggtggaggagcaataggttgaagatcggaggcattatcag

SEQ ID NO: 98204 - DNA, 30 bp, Homo sapiens
  chr7:94537877-94537907
  hyper
accgggcttgggaatcggctgcctctcaag

SEQ ID NO: 98205 - DNA, 385 bp, Homo sapiens
  chr7:95225822-95226207
  hyper
agtcttcccaccagccgccgccgcccgaggttttatttgtctccccgcactctccccccgagtcccaaacaggaggagtcactggaacttggaaacgcgtcctgaactccaggtcgcgccaatcagatcagagaaagaactatgggctccgcccctccagccgcggtcatcacagaatggcctggcacggtgaccacggagtgccctggcaccggtgcccgcggctgtgacggaaaaagggtgggaagaacagggaagaggaagcagaaacaggtatctggggcaacgtgggcttaagattagcctcttgggacggggctccgagtcgcgtgggctggggtcccgcccaggctcgcccttgtttacaactcggaggctgtctcaa

SEQ ID NO: 98206 - DNA, 48 bp, Homo sapiens
  chr7:95401676-95401724
  hyper
aggtctaagtcctaccgacgttagagggatagacgaattgacctttcc

SEQ ID NO: 98207 - DNA, 420 bp, Homo sapiens
  chr7:95402025-95402445
  hyper
ccgcccaggagccgccgccggctcggggagcccagttccgccgctgccgagcgcgtccaggtaaactggagcgggatgtcgccgctccccggacggccgcctccgcacctctccccaaccctccccaccccggtgtcgtctgcgctgggaaccaggctggagccgaggcccctgcagccgcagccggacccttgtcctggccccctgcccaggctcctgcgtgctccgctgagcccgaaggcggccaaagccccccagtgacacccccctctcggcagagccgagagactagggcagagaaggaagggtcgtggtgtcaccacctggtcgcccaccttgtgggctgggaagggcgtcccagtgcgccccgcctcggtcttccccgggggagcagtgggcgagcggcgctgaaatctgcac

SEQ ID NO: 98208 - DNA, 396 bp, Homo sapiens
  chr7:959576-959972
  hypo
aggccccaccccacccgggtggcctcacctgccgagtagggctcctgcttctccgggtagatgaactcctgtcgctcgtacttggcccggatccactgctctcgaaggagcctgtggggagaggagagactgagccactgggccaaggcggcctccgacccagcacacgccgctctctggcccggaccctggacatctcaagaggctcatagggacccccggcagactcgagccgcccctctgggcacaagatcccggaagaaatgcagggtcagcctcctgcccgggacgcttctcactctgatattagtttattggtttcttgtgcgttcggcccccggagcatcaggcctcacgttctgcacaagcgttcccggtggacgggctggtgcctcc

SEQ ID NO: 98209 - DNA, 37 bp, Homo sapiens
  chr7:965972-966009
  hypo
ccagccccaccccagcgccccccgccccagaaccaaa

SEQ ID NO: 98210 - DNA, 30 bp, Homo sapiens
  chr7:96619573-96619603
  hyper
agcggtgtcctatcacggggaaacagtcat

SEQ ID NO: 98211 - DNA, 634 bp, Homo sapiens
  chr7:96621715-96622349
  hyper
ctgtgattccaggagcgcgtgtgggcgcggtcctcgccgcgacgccgcgcgcgggtcaggctcaactgcgaaccttgccaccgagctttcccgcgggaggcttcgaatataaccttgcctatttctcgcctactgagatttctttccagaaaaggacattctcctgctccgaggagatggatccctgaggtccccatgcccgcacagggtgtcctggaggagtttagaggacactcctggggcccttccctgtgtagtacgcttattcccgaggtgggggctgagaatcgaagagcagcgccccccacactgggattgggggtggtcgaggggctacagatgcccgcattgggcttcttagcggcctaggctgatgcctggaggtaggggggattgggtttggctggcgactagctttaatgcccatcgagttcctgggacacccaagttcagcacttctgcatgaaaccgaaacggccagggaggggcggagtgggccgaggctgagggagcggcggtgttgacgccctcttcccacccaggatcgatcgatcggtagggaattttttatctttgggaaggagaggtgaggaagcggacctaaaacgaggggaaaattcgaatttaatatcct

SEQ ID NO: 98212 - DNA, 642 bp, Homo sapiens
  chr7:96625570-96626212
  hyper
gattctggagtccaccggcgcttgggcaggtagcaagcagagctagctgcacgttgccccggccggcgttttcaaacaacttgaattacaggctacatcttgaatatgaattagccttccgcactggtgtgaattcgctttgaaactcaacttgtcaagtatggttttaattaaacatcttccggcctcgaaagattacatgttttgtaaaatatattctagcatgaaatttacttccacgatctgaaattagttttttggtaaatgttttcataaaaaagaaatacgaggtgtgtgtgtgtgtgtgtgtgtgtgtgtgtgtgtcagagagagagaagagaaggggggtatgaagtagtttatattcactgccttcctttaaaacgtcctaccagctggacttggagcctgacaggtcccgggtcccaggtcccaggcagccccggccggggcagggccaagaccgcgtgcccaggacaagtaagtaactcaaacccgacccggcaagcgtggcccaagctgcttttgcagttggggacaattgagcggacacacaagttaatcccgcactgatttgtttcggatccatctgcaggacgcctgatgcctcccccttggctgctgcagcggacacctgcctcc

SEQ ID NO: 98213 - DNA, 126 bp, Homo sapiens
  chr7:96627308-96627434
  hyper
agtactcagttgccacgtctcgcaggaactttggagcaagttttcagctcccaggtgtccaacctttaaaaggaaaagcataataatactaacctttctttcacgaccacgcgaaacgcaaaggat

SEQ ID NO: 98214 - DNA, 36 bp, Homo sapiens
  chr7:96628041-96628077
  hyper
ttttactattaaaaacgctgccgagcaacacattga

SEQ ID NO: 98215 - DNA, 144 bp, Homo sapiens
  chr7:96631691-96631835
  hyper
gagagaaatgactgtcggaagaggccctgcggtaaatagcctctgagccgcgaactctatgcgccgtggccggtggcagaggccacacctggcagccactcgtggcgcgccaccttggcatgttgtgtgcgggtcacactatct

SEQ ID NO: 98216 - DNA, 30 bp, Homo sapiens
  chr7:96632234-96632264
  hyper
tccgaggccctgccacgacatactctaatt

SEQ ID NO: 98217 - DNA, 30 bp, Homo sapiens
  chr7:96632789-96632819
  hyper
ggagggggagaggagcgcaaacgccgctga

SEQ ID NO: 98218 - DNA, 500 bp, Homo sapiens
  chr7:96633044-96633544
  hyper
agttaaaggggcaagcggcaccttttctctatttctcagtttccttcggtcctgtaacttatggagtccagaagaagtaggatatacagaagtcctcagtagttttcccaaagggagacactgtctccttcccgcaacctccagacactgcagtacagggttgttagatattagatagtacgtttctccgtgtgggcaaaggctcgcggcttaggtctctaagcagatcgaaagtcggggtccagaccgagaggatcttcaggtctcgtccacccaatctcaagcctctggaagggcgggctgccggcgacctcctccagtcccgggacccggaacccgggaccctggacgccggtgcgggcgggcctgccctcctctgtgcctggcccccagtctggccctcctacctgttgaccaggcctgaaccacgcaccggggctccgctgtctctgcttggctgccttaacctgcgtgggtctggagaccggagggagaaaggc

SEQ ID NO: 98219 - DNA, 50 bp, Homo sapiens; identical to SEQ ID NO: 31392
  chr7:96634276-96634326
  hyper

SEQ ID NO: 98220 - DNA, 267 bp, Homo sapiens
  chr7:96634652-96634919
  hyper
gcatcggcggccggccgggcagaggcgcctccctccccaacggccccgggcgccacacagcgcggcccccggctgcagctccggctgggattggaactgcggaaggtaggcgaagaactctgcaagtcgcgcacacgccagtagaagccgtgcgcctgtgacgtcagggggcgactgaccaatggggaggcactgccctttggagacaaaccattcgactcgtggcgtctgcatcaagtctgaaagcagacgcgcaactttcgcaga

SEQ ID NO: 98221 - DNA, 248 bp, Homo sapiens; identical to SEQ ID NO: 31394
  chr7:96635204-96635452
  hyper

SEQ ID NO: 98222 - DNA, 104 bp, Homo sapiens; identical to SEQ ID NO: 9117
  chr7:96635486-96635590
  hyper

SEQ ID NO: 98223 - DNA, 353 bp, Homo sapiens; identical to SEQ ID NO: 31396
  chr7:96635619-96635972
  hyper

SEQ ID NO: 98224 - DNA, 774 bp, Homo sapiens; identical to SEQ ID NO: 31397
  chr7:96636033-96636807
  hyper

SEQ ID NO: 98225 - DNA, 55 bp, Homo sapiens
  chr7:96641698-96641753
  hyper
gaattattcaaattacgttagggagaatgctaccatacatcgaaaccaacactaa

SEQ ID NO: 98226 - DNA, 106 bp, Homo sapiens
  chr7:96642021-96642127
  hyper
tggtaagcggattcccgagggagggattggtaggaggggcgtgggcgaaaggcatcgcccagtggtggtgcctacgacgcctccccacgttcggacttctccagag

SEQ ID NO: 98227 - DNA, 60 bp, Homo sapiens
  chr7:96642748-96642808
  hyper
gcctttgcaaatgtccgcatacctgtggttctaaaggagccccgtcgcgagctccgtttg

SEQ ID NO: 98228 - DNA, 1720 bp, Homo sapiens
  chr7:96645617-96647337
  hyper
agatgcaacagaaaacgctgggggttggcgcgggggggaagagacagggctgcgtagaaaatatttaaccaatcccacatgtgccaccgctatttgggctatttttaaggcccagagttcgctgcgactgggctgaggttgaaaaaaaccaagcactgtgtgcaaagaccgcgggcaacctgggagcgcgagccgaggccgagagcaagccgcagcgccccctccccaagctctggagcggcgggagcctccaccggctactgtgggagggggtgcttaagggtggaggagctgggtgaccgcaggcggatccgccggcgtggcgagcttcccagaggtgcccgagggcgtctgccctctgggtgtgcctccgggagggctagagagctctaggttggcaagatcccagtgaccattgggaggcgcgcgatccaaggggttgcagggatggggcggagaggaggggcggttgggtagcctaaaggtccctctcccagaatacaaggaagcgctaagaaggaggatgtgggggcagtgttccagcaggcatcccaggctcttccggctggagagctcaggagactgagcggtgtcaaggctggagtgagctatagggtgcgctgggaggaggtgagcgcagcctggctttggcgcgctgtgggtgactcccaggacggcgcggccaggacgccgcgagccgtggggcgtccggtgggatcaaaggaaccagaggaggccagccgacgcgtctgggattgtgggataaggggcgggagagaggagattgacatgggcggggagatcctggcctggcctgtgtcaccggagggggttgtgtgcgtttgtgtctttgtgcggatcaacgctctcgggcctgaggccgtgccctgggtggatccgagtgtgagtggacaggctcccgggtgggtgcccagacgggagggagagcgagcgagcgagatcaagggcagcgaggtctgcgggttcctctgtgtgtgtgtctcaggccctgtggctcagcactggagccgcctggcacccacaggaatgcggcttctctcggatccccaggccgccccttgtcccacaaggaggtggccgccaggaaaaaggggggaaaaggggcagaaatccgcctagctcaacccgagcctcaaacaaaggccaatttatctgatctcttacaggatggcccaggaggtggtctgggcaccgaagaatcgcgctggccctgaccgcatgccccagccttcctggggtttgtgaggagctctgaaggtgggggtgaggtgttgtaagtaaggggtggggagtatgaagacgcccactgaaaagaacattaatcttagaaaggacttgattcgtcttgggagcactatactgagagctaggcaagtggaaaccggaaggggcaggcagaggggtcacccagtgcgatgtcaagagtggggccggctggtccgggaatatgctggggagtggagcacgtttatattcgacgtaggaaaaacaatggagaggaagagaaggtggaagggagggcaagggagagaaacatcacatagatatttttagactttgctgaagatctgttatttttacatccttgggctcgggacggcagggagttaaattcccctgagagaatccccatggggccagggaaagcccgctgcagactggtttaccagaatatttttgtccacggctcccagaccaa

SEQ ID NO: 98229 - DNA, 769 bp, Homo sapiens
  chr7:96647540-96648309
  hyper
ttctctagaagaatccgaaccctcccttccctcagctcggccgcgcccggtgaatagggatgaggaagggatcccccttcttttccaccagtaatggggctggggagttgatagggacagctggaaaaatatctgccctctttgtgtgcacaaaggaaaacagtatgttccaagcacattcttgccactcacaggcagccagtaggtgagaaatattggaggtgtgcagtgggtgcgccctcacccccaaccttcccaaacacgcaccccttggcagggagaggcgtccgcgcaggggaaagccaggcgctggcacaccgcgggcgcgggtttctcccagtcggagtcgccagaaataaagcgctagctctcggtgtaatggaaactcccgaaatccttacaagcaaagaaagaaaagcaggaagtggatatcttcatctcttccccaatccccctattctctgtgagcgcagaaaacaaaatggggcaccctttggcttcccgcccccccccccgccccccgcaaaccttcctattgccccctcttccccgcacccagtgctccttccgagaaagtacggctggagcggactggggagacggaaatattgagtcgcggccgctgggggtgccggaggaggggtgcacaggccaggctgccgggcgtagttctgcctcggagccaggctgcgggatatgtctaaagagcggtcaaaatactgattcctccaagaagcaagctgttccacactggcgggcctggtaactc

SEQ ID NO: 98230 - DNA, 16 bp, Homo sapiens
  chr7:96650421-96650437
  hyper
tcgcccgcgccttccc

SEQ ID NO: 98231 - DNA, 326 bp, Homo sapiens
  chr7:96650751-96651077
  hyper
cgcgagcccggcggggaaggggcgtggggcgggctacgcgcgcctgtggtcagaaaaaggagcgagctcccaacctcccgtcctactcccttcactccctctgcagctcagagaggccagaatctgactgcagctcttggcggcgactcgaacattctttatgcttccgtaggccccagctgggttggaggagtaaaaggaatgggacaatccaggaagacttctcacgtacaatagcgccccccacctcgcgacccttcggtggccgtggcctgaagctcccgtaggctcagggcacgacccttcagtttctccgctccaggcga

SEQ ID NO: 98232 - DNA, 366 bp, Homo sapiens
  chr7:96651136-96651502
  hyper
cgaggaggctctacattgttaagaaaaccagatagctgctctgggctgcctaggccgccctagaaataaccctccgcttgctttcaacccgcgaaattggccccacagctccggaggcccgctacggggtgggggcggggggcgcggttagtgggaggtatctccagaccgctgatgaataccatccccaccgtctcaaggcctgactcaccgagttaaagcataggggctgatgtctttgggtctgttagtttctcacgggtactgtcaaaacagctccagtcccatcgagactgaaccgcgcgacccaaccagacgtgcagctcaggcaggtctagtgcatggcagcgccgtatttacctgtgt

SEQ ID NO: 98233 - DNA, 118 bp, Homo sapiens; identical to SEQ ID NO: 31404
  chr7:96651845-96651963
  hyper

SEQ ID NO: 98234 - DNA, 413 bp, Homo sapiens
  chr7:96652017-96652430
  hyper
cgtttccgcccctccccaggcttcaagaacaccagcccctccccaggcttcaaggaggtggccctgggccgtgaccctacttctgtcggcgtctgttcgggcgcccgcagaagccagactcttgggcagggaagacgctaaccgaggtctccaaagttcaaagacccacaagcaaactgctccttcacttcagcagcaagcggtcggggccgccgcagacagagggtcgattatgcaacccccataatctcgctgcagatctgcgagggcacagatgtgtctggtttcttttacaaatagacttaatatgttcttggcaaaaaaaaaaaaaaaaaaaagaaatcttccacttatgcacggaatacagagagagtgaaagaaacgtagacacctcaacccggggctctctttta

SEQ ID NO: 98235 - DNA, 30 bp, Homo sapiens
  chr7:96652891-96652921
  hyper
gacgaaaaaggaggacggaaagacaaattg

SEQ ID NO: 98236 - DNA, 638 bp, Homo sapiens
  chr7:96653182-96653820
  hyper
cgcaccaacccagcacgcttaccaaaattcccaagtaaccttctctttgttacgcaaacgccaggagctgcttgattctttcttctctccacccctatcccctttccagcctagccggcttcctggccgggcaagctgggaattcagcgactgaagggccttggaaggtgccggaggggagagacgctagttcgaacctccacagggctctcctactaaaaatccctaaaatgctggcccgagaaactctctttgttggagggtctgagtcctactcccttctgccgcgtgcgcccccactgccgtgaaccgctgtgacccccaatctaccaccccatctcgcgcccccagcgtcctagtcgccctgtatctgcccagccttccccctgtccatgtacctggctggttggtggcgcttgggacgcggttgtaggcgccgccgtactggtggtaggagctagcgtagctatagtcggcataagctttggctgggtagctcccggcggagccgttcacgccgtgatactgatactggtaggggttgagagctttgccataggaagccgaggtaggagagcagtagccgtgcggggctccccccgtagggctgtagtagtcagaatcggtagctgaagact

SEQ ID NO: 98237 - DNA, 304 bp, Homo sapiens
  chr7:96653862-96654166
  hyper
cggacgtctggaacggagcttggaagtcgccggatcggatgctggggacccttctgtcaaacactcctgtcatcgctcacgggcggcggcagcggctgtccttgctgttgtggcggcggcagctgccctagttggctgtggggctgctctggtctaagcagacatggctgtgggagcgagggaggaggaggaagaggaggaggagagaaggaggaggcggcggccgcggcgaggaggagactgggagtcgtgaagtctctgtctccggccggctgactgctggctgaggcgcagcacagccttg

SEQ ID NO: 98238 - DNA, 83 bp, Homo sapiens; identical to SEQ ID NO: 31408
  chr7:96656775-96656858
  hyper

SEQ ID NO: 98239 - DNA, 221 bp, Homo sapiens
  chr7:966840-967061
  hypo
gggagaaggaaacggcgccgtgaaggaggggaggtgctgcaggaggctgtcgttccaggaggctcgtgctccaggaggctgtcacgcacactgtgctcctggcaggcgcaaaggccctgagggtggacgctggcaatgaccctgccgccagccaggtatggtgagccttgagcagcaggaggggccgccacaccccacgccagccccgagggcatgggaga

SEQ ID NO: 98240 - DNA, 39 bp, Homo sapiens
  chr7:96747112-96747151
  hyper
cctcaaatccctgggcgaccagtacgtgaaagacgaatt

SEQ ID NO: 98241 - DNA, 22 bp, Homo sapiens
  chr7:96968265-96968287
  hypo
gccaccgcgcctggccctattt

SEQ ID NO: 98242 - DNA, 26 bp, Homo sapiens
  chr7:97234138-97234164
  hypo
gccaccgcgcccggccaatacaatga

SEQ ID NO: 98243 - DNA, 418 bp, Homo sapiens; identical to SEQ ID NO: 31409
  chr7:97361005-97361423
  hyper

SEQ ID NO: 98244 - DNA, 261 bp, Homo sapiens; identical to SEQ ID NO: 31410
  chr7:97361520-97361781
  hyper

SEQ ID NO: 98245 - DNA, 518 bp, Homo sapiens; identical to SEQ ID NO: 31411
  chr7:97362187-97362705
  hyper

SEQ ID NO: 98246 - DNA, 610 bp, Homo sapiens
  chr7:97362706-97363316
  hyper
gcaccgagacaagacaaagtcaggtggcggcgcagcagatgagggaaggtccccgggctgggaggaaagagcggaaagcgctcgaagcttgaagacgccgagccagctgctaactcgccctggcaggcttgcggggggcgggacgcgagttcggcggggaggggcgcagagaggcagcgcctcgggagggaccccgctcagcccgagcgtggggaaggccgcctccccacgcctcggggccggagtacagcggggggaagggctcgggttgctgggtgcctcgctctggttgccttacacgccctttgtccgtgcttttgtctcccaggaggaactgccggagccctttgagcatcttctgcagagaatcgcccggagacccaagcctcagcagttctttggattaatgggcaaacgggatgctggtgagataggcgaccgtccctaggtgtcttgggcagcccgccctgtctgctcactccttcctggagtaccccagggtctctcgctctgaatagagatttccactccaagaggggtgtaattccccaggcgcgacattggcccacaccgcactaaggcacgcacgggcccgcggggggagggaaag

SEQ ID NO: 98247 - DNA, 120 bp, Homo sapiens
  chr7:97589532-97589652
  hypo
gatattacgtgtcatattctctagaaatattactcgtatgtcacaggtcctatacaccctttaatattcttcataatattgtaggaataggtgactactaatgtcacagggcgagtcgga

SEQ ID NO: 98248 - DNA, 242 bp, Homo sapiens
  chr7:97591231-97591473
  hypo
aggggctgtacaccccgtgatattattcataatatcttaaagaaatattaccactaatatcacaggtggtgtacaccctgtggtattattcccgatgttgtagggtgatgttactcctaatgttacagatggtattcacattctgataatactcgtcataccctaaagggatgttactactgatgtcacaatgcacgtacacaatctgatattatttcttatatcctcgggcaatgttgctt

SEQ ID NO: 98249 - DNA, 136 bp, Homo sapiens
  chr7:97600089-97600225
  hypo
cttagctattgaaaacgctaagttcagtgtcgacctcttgtgtcgcacatgctaatgacaaaaccaaagaaaaaccggttttagaaaaacaggaattgtaatcctagcactttgagaggccgaggtgagaggatca

SEQ ID NO: 98250 - DNA, 76 bp, Homo sapiens
  chr7:97600285-97600361
  hypo
aataataacaggaattatctcatcattgtgcaaatactgcccaacagtcagaaggcaatttcgatagtcaataagt

SEQ ID NO: 98251 - DNA, 25 bp, Homo sapiens
  chr7:97602847-97602872
  hypo
tctccgcctgattgacggaatgaac

SEQ ID NO: 98252 - DNA, 78 bp, Homo sapiens
  chr7:97627595-97627673
  hypo
gtaatctgtgggctccggtgcacggtgaaaatgcaagtcctgccgggcgcggtggctggtgtctgtagttccagctac

SEQ ID NO: 98253 - DNA, 30 bp, Homo sapiens
  chr7:9766521-9766551
  hypo
agcttctgattgacccgccccggtatatcc

SEQ ID NO: 98254 - DNA, 151 bp, Homo sapiens
  chr7:97680597-97680748
  hyper
cccacttccgggatccggtttggctccgcccccgccctgctgtatccatggtaaccaggtctccttcgcaaggctggaccagtcgccacgacgagctccggggcgccaccggtggcctctctgatggcccgctcggcgaggggtccccagc

SEQ ID NO: 98255 - DNA, 30 bp, Homo sapiens
  chr7:97689387-97689417
  hypo
gacacatcaaaccctcgtaatgtggaacat

SEQ ID NO: 98256 - DNA, 22 bp, Homo sapiens
  chr7:9772342-9772364
  hypo
ttacaggcgtgagccaccgtgc

SEQ ID NO: 98257 - DNA, 30 bp, Homo sapiens
  chr7:97738118-97738148
  hypo
tatattttgaagtatcgattctttatagga

SEQ ID NO: 98258 - DNA, 102 bp, Homo sapiens
  chr7:97797696-97797798
  hypo
cgaggccccgggcttcgcggaggcgtggcggcgtcagctgccccagtctgcatgtcttctatttcattagcagaagcgggggtgttgcgctgtctatatcat

SEQ ID NO: 98259 - DNA, 30 bp, Homo sapiens; identical to SEQ ID NO: 41372
  chr7:97804272-97804302
  hypo

SEQ ID NO: 98260 - DNA, 30 bp, Homo sapiens; identical to SEQ ID NO: 41373
  chr7:97807742-97807772
  hypo

SEQ ID NO: 98261 - DNA, 134 bp, Homo sapiens
  chr7:97834167-97834301
  hypo
gctcttcagcaggctcgtaagagcacttgacccctggacttgggaccagcccacatgccctctggtgctgcccctggaatgttggttttgctgctgagtcttggtcctggtgtggctcccgagggcggggtggg

SEQ ID NO: 98262 - DNA, 41 bp, Homo sapiens
  chr7:97839783-97839824
  hypo
aaaaacaaacaaacaaacaaaacaggcgttcccaaggactg

SEQ ID NO: 98263 - DNA, 30 bp, Homo sapiens
  chr7:97844525-97844555
  hypo
agagctccgaaggcgcgatccccatcccca

SEQ ID NO: 98264 - DNA, 144 bp, Homo sapiens
  chr7:97844894-97845038
  hypo
tcagcagcgagaggacgcgtcactctgccgttctgcagggtgacgccctccccgtacctcgctgagagccacctgcagacacagcaggccacagcagaatgcacaggtcactgttgtaggggaacaaatcgtaatgcccagaga

SEQ ID NO: 98265 - DNA, 57 bp, Homo sapiens
  chr7:97846981-97847038
  hypo
caaggccgcgggccccgctcaccccgatgccgtagtcccagccgtggcccttgggct

SEQ ID NO: 98266 - DNA, 87 bp, Homo sapiens
  chr7:97852229-97852316
  hypo
gggtctgagccctgccggactccagagcaaaggtctcatttcaagaagaatctgtctggccccggcactcaccgcagggttgagctc

SEQ ID NO: 98267 - DNA, 30 bp, Homo sapiens
  chr7:97852802-97852832
  hypo
acatttactcagattcggcttccctcttca

SEQ ID NO: 98268 - DNA, 31 bp, Homo sapiens
  chr7:97869134-97869165
  hypo
gtgactggccaggcacggtggctcatgcctg

SEQ ID NO: 98269 - DNA, 330 bp, Homo sapiens
  chr7:97869405-97869735
  hypo
gcgacactccgtctcaaaaaaaacaaacaaaagaaaaaccctgtgagtaatcggaaatcggctggttttattggacttgccgctgataagatgcaaaagacaagcagtgactagaggatggggaggcgcttggttaatcaagggcttcaggaaattcgcttccgattcttcgaaatgttgcagcctattaggtgatacttgcagttgctgcatttgggtaccagcgtgtgggtggaagaggattttacggcacaaaacgtcctggagattggcaacaatttcagcaacaaacaatgcatggtgctcagctggtgccggatttgttctaat

SEQ ID NO: 98270 - DNA, 30 bp, Homo sapiens
  chr7:978819-978849
  hypo
gtgatggagactctacggccctaaaatatt

SEQ ID NO: 98271 - DNA, 42 bp, Homo sapiens; identical to SEQ ID NO: 41377
  chr7:97882348-97882390
  hypo

SEQ ID NO: 98272 - DNA, 77 bp, Homo sapiens
  chr7:97899729-97899806
  hypo
ctgtccagttcctcccgggcctcccaacgcccccgatggctccttccccctggccatctgtccggtccctccttcat

SEQ ID NO: 98273 - DNA, 30 bp, Homo sapiens
  chr7:97917070-97917100
  hypo
ggaggctggtgtgggcggggcccccaggca

SEQ ID NO: 98274 - DNA, 65 bp, Homo sapiens
  chr7:97925156-97925221
  hypo
cgcagcaagaagcaccgactcctgccaggaggactgaggaggaaaaagaacgcttaagatgacag

SEQ ID NO: 98275 - DNA, 30 bp, Homo sapiens
  chr7:98088677-98088707
  hypo
tgctgggccccgcaccgtgttccccagcca

SEQ ID NO: 98276 - DNA, 22 bp, Homo sapiens
  chr7:98121341-98121363
  hypo
agaaattaacagggccgggcgc

SEQ ID NO: 98277 - DNA, 62 bp, Homo sapiens
  chr7:98121881-98121943
  hypo
ttttgcttggagcatcgacttataaccccagcccgagagagccgtggcgtccttgtgtgggt

SEQ ID NO: 98278 - DNA, 30 bp, Homo sapiens
  chr7:98122148-98122178
  hypo
cctcgtggctccttgcgaatacagcggacc

SEQ ID NO: 98279 - DNA, 198 bp, Homo sapiens; identical to SEQ ID NO: 15009
  chr7:98183080-98183278
  hypo

SEQ ID NO: 98280 - DNA, 223 bp, Homo sapiens; identical to SEQ ID NO: 695
  chr7:98245856-98246079
  hyper

SEQ ID NO: 98281 - DNA, 204 bp, Homo sapiens; identical to SEQ ID NO: 696
  chr7:98246304-98246508
  hyper

SEQ ID NO: 98282 - DNA, 1315 bp, Homo sapiens; identical to SEQ ID NO: 31416
  chr7:98246533-98247848
  hyper

SEQ ID NO: 98283 - DNA, 102 bp, Homo sapiens
  chr7:986234-986336
  hypo
atggcgggaaccccacggtgaaggccatccccagtcctccctggacccaccctgtcccggagcccactctctggggcccccaccccgcgcccctccaggctc

SEQ ID NO: 98284 - DNA, 109 bp, Homo sapiens
  chr7:98635920-98636029
  hypo
gcaggcctcacacagcgaaggagctacagcaactaaatgcaggctcagccgcgccccaggcacctggccgtccccgacaggtggcattaccggacgtattctttcttat

SEQ ID NO: 98285 - DNA, 30 bp, Homo sapiens
  chr7:98964581-98964611
  hypo
ggaggccctggggcccggtgcccacagcat

SEQ ID NO: 98286 - DNA, 30 bp, Homo sapiens
  chr7:98966380-98966410
  hypo
gcccactccagtcaccgcagccagaagccc

SEQ ID NO: 98287 - DNA, 95 bp, Homo sapiens
  chr7:98970776-98970871
  hypo
actaccctagggggtcgaattcagtggaaaagagagcggcggctaagggcacctccaatggggagggtgtcggggcaaagcgacctgagaccccc

SEQ ID NO: 98288 - DNA, 80 bp, Homo sapiens
  chr7:98971520-98971600
  hypo
ccaccgcgaccggccgaggtaaggttttcactggggtctcttccatctgcctggccgccaggccacgtatccactgaaga

SEQ ID NO: 98289 - DNA, 316 bp, Homo sapiens
  chr7:98991466-98991782
  hypo
catttgcctgcacctcgcatgccactgtccccaaggcagaactgacttctaagcccactacaccccctcggtacttctcactaaagcccgctccccaagaagtctgggagcgcctggtggacagggtgggcctgagcccagcgccagcacaggttgaattcataagctcctcttcctctttgcagccagatctcggtgctcagcggcggcaaggccaagtgctcgcagttctgcaccactggcatggatggcggcatgagtatctgggatgtgaaggtgaggcttgcccctcctggcttcccgccatgcctcccag

SEQ ID NO: 98290 - DNA, 403 bp, Homo sapiens
  chr7:99020763-99021166
  hypo
ttggctcacaacaaatctcaggtattcaccccagacaatgacaccacttcactgcctgcccagtccctgagcaagcgacaacctgtttggagtacccagcaacgtgcaggtgctggggacccagatgagcacagcagacagcctctgcctccagaagcctgatacagggaaggccagggctgcccatgagcacatgatccaagactgtaggacacggcataaaggaacagagtgggaagggggaggggagactttcatcccaggtcagagcggcagccagctgggcatgtctgagggccacttaagcagagacctccaggaaaagtgggtgccacctgaggcagcgggaacaccaatcccgaagcaggcaagaggttggtggcctctgcgaactgacagaagg

SEQ ID NO: 98291 - DNA, 31 bp, Homo sapiens
  chr7:99101324-99101355
  hypo
agagcactgggaggtcgatgcgggcgcatca

SEQ ID NO: 98292 - DNA, 185 bp, Homo sapiens
  chr7:99103865-99104050
  hypo
gctctcagccaactccgggtgctctgctgtgagtggctgaggcccgagctgcacacgaaggagcagatcctggagctgctggtgctggagcagttcctgaccatcctgcctgaagagttccagccctgggtgagggaacatcaccctgaaagtggagaagaggcggtggccgtgatagaaaatat

SEQ ID NO: 98293 - DNA, 35 bp, Homo sapiens
  chr7:99104258-99104293
  hypo
gtagaagacaatctgcgatcttatttattttttaa

SEQ ID NO: 98294 - DNA, 247 bp, Homo sapiens
  chr7:99149175-99149422
  hyper
cggacactggcttaacgagcccatccgaataaaacaaattataaggccaatggcacttggtatcgtgtaagatcgccagaattttacaactcggggtacccaggaaaccagaaaagcccccaccacaagaaaaaccagtgggcacaactggggagcacagatatctgactggggtcattttgtccgcgcgtctttggggtaaaacaccaggactgggggtccagaagggacacgcagaccgcctctc

SEQ ID NO: 98295 - DNA, 63 bp, Homo sapiens
  chr7:99155751-99155814
  hyper
gacctactgagatttcgatcccacaacttagtgggtcccatctcacccaggccccgcaatcct

SEQ ID NO: 98296 - DNA, 195 bp, Homo sapiens; identical to SEQ ID NO: 9139
  chr7:99155931-99156126
  hyper

SEQ ID NO: 98297 - DNA, 473 bp, Homo sapiens
  chr7:99156127-99156600
  hyper
ggcccagctcctcctccgagttcctcatccggggccgtcactcacatccggggccctcactcacatccgggaccctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcggtgagtacccggaagccgttttggggtcgcagcggggtggcagcttgttttgccttcacgggagtagaaggaggcggcgtccggccgcggccgacggtagttcgcttccccgagagtgcgcggaggcccgggtgcgaggagggcctgtttctcttcagccctggttcattcacctcgcggaccgagggcc

SEQ ID NO: 98298 - DNA, 167 bp, Homo sapiens
  chr7:99156815-99156982
  hyper
ccgctcaaacctgttcgaaccgcagctcttacctgcgttgctctcaggattccgggaaaaggccggtctagctggtctgagttagcgaagggcctgaccccaaaagtggagttttattcgccaagcccgtgtagtaaatcggagtgggctgacggtgttaccaagac

SEQ ID NO: 98299 - DNA, 589 bp, Homo sapiens; identical to SEQ ID NO: 31423
  chr7:99177694-99178283
  hyper

SEQ ID NO: 98300 - DNA, 95 bp, Homo sapiens
  chr7:994535-994630
  hyper
cctgggtgggaccctcgtgccgccgcgcgcggtgggacggagcctgcacacctactgtggggggcgcagagggcacctgccgagccccccaagac

SEQ ID NO: 98301 - DNA, 23 bp, Homo sapiens
  chr7:9955375-9955398
  hypo
actgtgcccggccatgttgatga

SEQ ID NO: 98302 - DNA, 31 bp, Homo sapiens
  chr7:99591731-99591762
  hypo
tgcactccagcttgggcgacagagactctgg

SEQ ID NO: 98303 - DNA, 153 bp, Homo sapiens
  chr7:99595183-99595336
  hyper
cttttgactcattttgaggcccccgtcgtagggtacacgccctgggaatcgggggtcttccagtatagggaaccaccgagatgcgggccctccgaagtcctagagagggcgcctcggccgccggcacccgccacacttccggcctttgtgggc

SEQ ID NO: 98304 - DNA, 182 bp, Homo sapiens
  chr7:99595462-99595644
  hyper
cgccagtctccggctgttgcgccctgggcgccgcctctctccggcccccctttgtttcctgagccagctgggaagactaaaagggtgggtcctgggagcggcccatggttcgacccttcttttcaggcatccttggagcatgcaggctgcagatttcaggccgaccccgctagcaccaaagt

SEQ ID NO: 98305 - DNA, 21 bp, Homo sapiens
  chr7:99648525-99648546
  hypo
atttgtgtggccgggcgcggt

SEQ ID NO: 98306 - DNA, 24 bp, Homo sapiens
  chr7:99649202-99649226
  hypo
ccacggcgccgggccccctaggga

SEQ ID NO: 98307 - DNA, 43 bp, Homo sapiens; identical to SEQ ID NO: 41387
  chr7:99691859-99691902
  hypo

SEQ ID NO: 98308 - DNA, 85 bp, Homo sapiens
  chr7:99700198-99700283
  hypo
actagtaagaggcatcgggatccgagctcaggtctcctgggttctgatcactccacctccctttttttaacgcctctcttctccc

SEQ ID NO: 98309 - DNA, 156 bp, Homo sapiens
  chr7:99723084-99723240
  hypo
ctcaattttctatatcgctattaaacttttttctttttttctaaaaactagctgggcccaaagtttcaaacaacagccgggcacacatagctagctggtcgatgaggcagcacccagaatggccgctgtcttgttaagctcaagctccagcctgag

SEQ ID NO: 98310 - DNA, 49 bp, Homo sapiens
  chr7:99725588-99725637
  hyper
ggagatgtgtttgagcgagatggggacgaggattcgtggcaggcactga

SEQ ID NO: 98311 - DNA, 30 bp, Homo sapiens
  chr7:99736081-99736111
  hypo
tctctgttccccagccgtgagtgcccttct

SEQ ID NO: 98312 - DNA, 30 bp, Homo sapiens
  chr7:99745367-99745397
  hypo
accaccacattgtcccggactgaatctggg

SEQ ID NO: 98313 - DNA, 30 bp, Homo sapiens
  chr7:99751448-99751478
  hypo
ttccctctcctggggcgggggaaggtgtgt

SEQ ID NO: 98314 - DNA, 41 bp, Homo sapiens; identical to SEQ ID NO: 41390
  chr7:99839918-99839959
  hypo

SEQ ID NO: 98315 - DNA, 30 bp, Homo sapiens
  chr7:998684-998714
  hypo
gaccagcagggtcctcgggggccggaatca

SEQ ID NO: 98316 - DNA, 25 bp, Homo sapiens
  chr7:99934958-99934983
  hypo
tgagccaccacgcccagctgccttg

SEQ ID NO: 98317 - DNA, 154 bp, Homo sapiens
  chr8:100026613-100026767
  hypo
gggattataggcgtgagccaccgcgcccggcctgcataatttttaaaaatagtttgttcccagttttggtatattagaatgggattacttaaagttgctttgacagaaagacgatttcattgttcatgtcagaattgttcggtctacttactca

SEQ ID NO: 98318 - DNA, 159 bp, Homo sapiens
  chr8:10005422-10005581
  hypo
cgaaactccaaagagcgggaaaacgactttagagggaccggaaaggggaagcgagtctcccatggtttgaggtgttgctgcccgtacctgtgcacttggccacagtccaaagtgactccattgcgggcacagccgtggggctgacgtgagaccccagcc

SEQ ID NO: 98319 - DNA, 44 bp, Homo sapiens
  chr8:1000543-1000587
  hypo
aggaagtaaccccattataagccaaggagcgcctgtccctgaat

SEQ ID NO: 98320 - DNA, 35 bp, Homo sapiens
  chr8:10019317-10019352
  hypo
gaccttcgtgaatcccgccccgcccctgataacca

SEQ ID NO: 98321 - DNA, 156 bp, Homo sapiens
  chr8:10022508-10022664
  hypo
ccctgggcgacagagtgaaaaaacaacacaaaaaactgtattgatgtctgggctgcatcctagaccaattaaatcagactcttggagagtgaagtccgggtgttaatattttaaaaaggctccccaggtaattctaatgtgcggcctaggttgaga

SEQ ID NO: 98322 - DNA, 36 bp, Homo sapiens; identical to SEQ ID NO: 41867
  chr8:100245127-100245163
  hypo

SEQ ID NO: 98323 - DNA, 101 bp, Homo sapiens
  chr8:100359726-100359827
  hypo
cccaatttctacacccgtgttcagattatcatcaggccaatgtatgagatgggctgtatgctaggctgctggtactccacagtacgcgtgtgccaccttca

SEQ ID NO: 98324 - DNA, 145 bp, Homo sapiens
  chr8:100519073-100519218
  hypo
ggctctatctttaaaaaagaaaaatagacatagatgttactcttatcgaggagatggaagtaaataatcagccaaataaatacataatttaccatgaagacaaatgttcttatgcagaactgtcagagtgcggtgctaatgtaaa

SEQ ID NO: 98325 - DNA, 103 bp, Homo sapiens; identical to SEQ ID NO: 41869
  chr8:100904181-100904284
  hypo

SEQ ID NO: 98326 - DNA, 216 bp, Homo sapiens; identical to SEQ ID NO: 41870
  chr8:100906569-100906785
  hypo

SEQ ID NO: 98327 - DNA, 29 bp, Homo sapiens
  chr8:100961902-100961931
  hypo
cctaaagatttcttcgtacatagtaaact

SEQ ID NO: 98328 - DNA, 30 bp, Homo sapiens
  chr8:1010325-1010355
  hypo
gggcgttggtccctccgctgagtgcttgtg

SEQ ID NO: 98329 - DNA, 486 bp, Homo sapiens; identical to SEQ ID NO: 32203
  chr8:101118005-101118491
  hyper

SEQ ID NO: 98330 - DNA, 150 bp, Homo sapiens; identical to SEQ ID NO: 41871
  chr8:101156747-101156897
  hypo

SEQ ID NO: 98331 - DNA, 48 bp, Homo sapiens
  chr8:101158248-101158296
  hyper
tttgggaagcattaccgtatttaggaatgctaacgtggcctacagtgg

SEQ ID NO: 98332 - DNA, 23 bp, Homo sapiens
  chr8:101241341-101241364
  hypo
aatgaggaagtaggccgggcgtg

SEQ ID NO: 98333 - DNA, 39 bp, Homo sapiens
  chr8:101257404-101257443
  hypo
attacaggcgtgagccaccgtgcccgaccccagcagcct

SEQ ID NO: 98334 - DNA, 30 bp, Homo sapiens; identical to SEQ ID NO: 41873
  chr8:101299821-101299851
  hypo

SEQ ID NO: 98335 - DNA, 30 bp, Homo sapiens
  chr8:101300280-101300310
  hypo
tctgaacccatttgccgatgtaaactcatg

SEQ ID NO: 98336 - DNA, 30 bp, Homo sapiens
  chr8:101428824-101428854
  hypo
aggagcagcagcgagcggctgctcagcaag

SEQ ID NO: 98337 - DNA, 30 bp, Homo sapiens; identical to SEQ ID NO: 41874
  chr8:101438141-101438171
  hypo

SEQ ID NO: 98338 - DNA, 79 bp, Homo sapiens; identical to SEQ ID NO: 32204
  chr8:101661840-101661919
  hyper

SEQ ID NO: 98339 - DNA, 274 bp, Homo sapiens
  chr8:101693763-101694037
  hypo
ccacttttcacatatcgagtgacggatgcagacttgcgagggtttgctaagttcttgtaaaggggcaggggtggctgcaagtttcgtcatgcagaggatggatgcaaagtcaaatgctctatctagcaggtcaatttgttttcttgcttgtttgttttttttttccaaaatactgtttaaaaaaaaaatctgttggaaatagtttgagcagtcaagaaaaacaaaagcaaactcagggaaagacaatatactgtctacacgataccaaaacagg

SEQ ID NO: 98340 - DNA, 30 bp, Homo sapiens; identical to SEQ ID NO: 41876
  chr8:101717092-101717122
  hypo

SEQ ID NO: 98341 - DNA, 36 bp, Homo sapiens
  chr8:101726909-101726945
  hypo
tcacgtgactgcactccagcccgggtgacagagcaa

SEQ ID NO: 98342 - DNA, 42 bp, Homo sapiens; identical to SEQ ID NO: 41877
  chr8:101729504-101729546
  hypo

SEQ ID NO: 98343 - DNA, 40 bp, Homo sapiens
  chr8:101736275-101736315
  hypo
actgcactccagcctggtgacagaacgagactcaaataaa

SEQ ID NO: 98344 - DNA, 27 bp, Homo sapiens
  chr8:101766351-101766378
  hypo
cctcaagcgatccgcctcagcctctct

SEQ ID NO: 98345 - DNA, 173 bp, Homo sapiens; identical to SEQ ID NO: 32205
  chr8:101821973-101822146
  hyper

SEQ ID NO: 98346 - DNA, 140 bp, Homo sapiens
  chr8:101872139-101872279
  hypo
cctggaaaatgaatacgtgaatgaatgaatgaatgaatgaagtgagtaaatgtatcctccttattctaactacaaccacgctccagggcctccctggctttccgtcctacctcgcacccgtttcacgaggcagttgggcg

SEQ ID NO: 98347 - DNA, 78 bp, Homo sapiens
  chr8:10192879-10192957
  hypo
accttggccatgccccgtggctccaaagccgcgaggacagcactccattgcgacgtctactcccgagcctgaatgttt

SEQ ID NO: 98348 - DNA, 68 bp, Homo sapiens
  chr8:102039492-102039560
  hypo
cttcaggtcactaaccgccccattggagagggttcacgcagctcacgtgtaaacggacccctctttcc

SEQ ID NO: 98349 - DNA, 153 bp, Homo sapiens
  chr8:102092984-102093137
  hyper
tgagtcacccacctgcgtggtgagtcaggggaggaggccgagaaggcaggtgggcggcgcggcagggcgccgggcttcgcggggaggggagcgctgtctccccacgcgcccctcccccacgagcggcttccagaaacccgtttgcccatcccc

SEQ ID NO: 98350 - DNA, 75 bp, Homo sapiens
  chr8:10210850-10210925
  hypo
tgaaagaaattgctacgctgatctggtactgaagaccaccagggccgtccgtggcgtgtacggaggagggacctg

SEQ ID NO: 98351 - DNA, 213 bp, Homo sapiens; identical to SEQ ID NO: 41880
  chr8:102155655-102155868
  hypo

SEQ ID NO: 98352 - DNA, 100 bp, Homo sapiens
  chr8:10218064-10218164
  hypo
gacagggccccttgccgaacgtctgacggcacttcacatattgttctgtgtgcaacatggattcgataaatgtttgtagcatacacgaaactgtctaact

SEQ ID NO: 98353 - DNA, 39 bp, Homo sapiens
  chr8:10224220-10224259
  hypo
tcctgctagactcctcgtggtcggcggctgtcttaactg

SEQ ID NO: 98354 - DNA, 30 bp, Homo sapiens
  chr8:10248245-10248275
  hypo
actccattccaaaggcgaagacattaagga

SEQ ID NO: 98355 - DNA, 32 bp, Homo sapiens
  chr8:102504728-102504760
  hyper
gatccaggaggactccgcgccgcccggccgcc

SEQ ID NO: 98356 - DNA, 446 bp, Homo sapiens; identical to SEQ ID NO: 32206
  chr8:102505540-102505986
  hyper

SEQ ID NO: 98357 - DNA, 38 bp, Homo sapiens
  chr8:102506405-102506443
  hyper
gtcatggagaagtggcggggacccgtcccaagttgagg

SEQ ID NO: 98358 - DNA, 30 bp, Homo sapiens
  chr8:102517511-102517541
  hypo
aaagtctaaatgggccgggcgtggtggctc

SEQ ID NO: 98359 - DNA, 148 bp, Homo sapiens
  chr8:10261838-10261986
  hypo
ctttctccccagccccgtgacaaacgacagtcaagcttgctgccagggaggcagggaagtgacgatcccgtcaccaccccccaaccctccgtggggaggggcaggcgggtgtgggatccatcacgcccgcccacgtggatggcttcaa

SEQ ID NO: 98360 - DNA, 624 bp, Homo sapiens
  chr8:103135899-103136523
  hyper
tgcagaccacttcctcgtccgtgttcaaccagcgcctttcggcctctcccttggccccctccccagacgcccacgccccgcactcgcctcctgtggcctttccgggcagactccgcaggcccgggatccagcgggtgccccggcccccggccccggccccggcccccggggcgggatgctccagaggtccccgggccgccaggctcaccaacgcccccttctgcccagcgcgccccatcccgccggccccacgcgcctctgcgcggccctctgcaaagttgctctctccttttctgccgcccaccctcaaggtctgtaattttgttttgttttccctcagaggcactgggggaatgacagaggaattgacagggtgaactgcacccaggagggagctgctggaaccaggttcccagaaccgcgcgctcctcgaacccacccctgcgcccgcggcgcaccgagcgcacgggtcccccccagcagccgcccccggcacacccgccccggctgcaactccgactccgctctggctcccgagaagcggagggaaggcgctgcgactcaccgcctcggccgctcccagcgtctgtgtcgcttcgggcgaggcggcggcagcagcggcag

SEQ ID NO: 98361 - DNA, 30 bp, Homo sapiens; identical to SEQ ID NO: 41881
  chr8:103403324-103403354
  hypo

SEQ ID NO: 98362 - DNA, 90 bp, Homo sapiens
  chr8:103613211-103613301
  hyper
ggggccacgggacagcgtggagggctctgcgcgcagggcagagactgcagttcactgccctgcggttttgcacttcgccccggccctgct

SEQ ID NO: 98363 - DNA, 94 bp, Homo sapiens
  chr8:103618015-103618109
  hypo
attttagaacattttcgttactctaaaaggaatcctgttgcacccgttagaaattgccccccgtttctctgccctaccccgccccctgaagccc

SEQ ID NO: 98364 - DNA, 41 bp, Homo sapiens; identical to SEQ ID NO: 41882
  chr8:103629841-103629882
  hypo

SEQ ID NO: 98365 - DNA, 214 bp, Homo sapiens
  chr8:103768734-103768948
  hypo
tcggaaaacaatatccggcaagttcaggttttagtgggaaaaaaatgttttggaaatcaagattaaattagagacctgtctgtatttatcttcatttgaagcaaccctctcaagcagatgtcagcaggccaccgagggcagggacccagcagtatggcccagggccttcctacctggtgagaacatgctccctgacccccgccttgtcccgaca

SEQ ID NO: 98366 - DNA, 851 bp, Homo sapiens
  chr8:104152711-104153562
  hyper
gccagagactgggaacggtaatgccggccagacgggtccgagcgcctcgggagccccagccctcctccggctgcggggccgctgctcctgctcccgggccgtcacggagccctgagggagggggcgggcgagcgggggccttggggcggccagggcgctgggagggaggactgggcggtggggaccggaggggagggagggccttggaggcggagaggagggacgggctgggagagggcccggactaggggcggcgggcaccgcaggagctccgcgcggctgcagcgcgggcgggagcggggacgcgatgtcgccgccgccgcctccttgcgggccggggctgcgcctccggggctgagccgccgccagagccgacagccgagcagccgctgggcgctcccgcggcgcaggaggatgggctgcggcgggagccgggcggatgccatcgagccccgctactacgagagctggacccgggagacagaatccacctggctcacctacaccgactcggacgcgccgcccagcgccgccgccccggacagcggccccgaagcgggcggcctgcactcgggtaagtggccgggcccctgcagaccctcgcccgcccgctaccccgggcgccttggcccgggcactgagagaggagccggttccctgaggaattgatggcgcggcgggggtggctgggaggaagcagaggcaggacctgcccactgatcagtggacagatgcaagcccagggagtggggtcgaccagagccccttaccgaaggctgcgccgatgccccagcttccagcagcccaatgctctttggccttgtccaaagcttgctcgctggtcgggagac

SEQ ID NO: 98367 - DNA, 15 bp, Homo sapiens
  chr8:104153681-104153696
  hyper
cgtacccagccgggt

SEQ ID NO: 98368 - DNA, 20 bp, Homo sapiens
  chr8:104235237-104235257
  hypo
tttaaaactttttggcgggc

SEQ ID NO: 98369 - DNA, 93 bp, Homo sapiens
  chr8:104310870-104310963
  hyper
gtggaggtggcttcccggccccgcagccggacctcggcaccccgagcccgttcaccggggccgggtcctggcgggccgcggagtgaggccggg

SEQ ID NO: 98370 - DNA, 72 bp, Homo sapiens
  chr8:104311349-104311421
  hyper
aacggcgggacggcccgcacctgagtttcctcggaagcgggaaccggctctgaaaggcgatgccggggcccc

SEQ ID NO: 98371 - DNA, 165 bp, Homo sapiens; identical to SEQ ID NO: 41884
  chr8:104382635-104382800
  hypo

SEQ ID NO: 98372 - DNA, 207 bp, Homo sapiens
  chr8:1043858-1044065
  hypo
gggtctcaaaggtgacgatgggtgccagccgaggggtctgtctgcatctgaggaagcggggctgaagtccatgcctctctgtgtgcaggtgcttgtggatggattgaagtccatgcaggcgctcgtggatggagggcagctccccggtggagggagggcagcttcgcggtgggtggagggagggcagctccgcggtggagggagggc

SEQ ID NO: 98373 - DNA, 23 bp, Homo sapiens
  chr8:104488605-104488628
  hypo
actgcgcccggcccataatatat

SEQ ID NO: 98374 - DNA, 574 bp, Homo sapiens
  chr8:104510980-104511554
  hyper
attgcttgcccagggcgcctggaagagctggcgagcccgcccagctctgttcacccggccccgccccgccccctccgggagggctctccgggcggcgcccagccccgagcagagcaaaggacggcggcggccacctccgttctccggccgctggtttctcgtctttcctcgtcctttcattgaacccatctccgtgcttcgaaaatctgactctaacccgatctcttcgcgtctccgcctcttctttctagagtgagcgccaaaaagggcctgacagacagaagcctttggccccagcaccggcccagcccgtctctagacgattcttgctcctttcaccctcacagcctccagtggtcgcttcatcttcgcaccctcccggccaaccctaactctcctcgtctctcctcgcgctgtctcgcgtcctcccctcaggatccttccgcacattctcagcgtccagcgcggtttcccacaacttcctcacgccccgctcccctcgccctgtccccgccctcgacaccacctgcgttccccactcgctccaacctccctcccccgctatccccacttg

SEQ ID NO: 98375 - DNA, 1926 bp, Homo sapiens
  chr8:104511983-104513909
  hyper
ctccccgcccggccccggacccagcctggagatcgcgctcgggaggggcggctgccgcccgcggggcgcccgcggtgcccgggcctgggcagcgaggaggtgacgccgcccccgcgggatgagcccgggaggcggaggggcggaggaggtgctggcggcggcactgagcggcggcggcgcagggcgcgcgggccttccgcgccgactccatcgacccaaggggcggcggcggtggcggcggctgagcgaccctgggccgggcgcgtgatgaggaggggccggcgccagaccccgctgcacgtcggagctcgcctggatccgggcgttggcagccgaagggccctggccccgggactctccgccgctagcccccgtcatatcttctccgctttcgcttctccactctagccgggggtggggtgggtggggttggggtctccgcgggggtttccggccccgcggcccgctcccgggtgtgcctggaggagttctccctctgtggcgcgcgggagccctgtgatgcgtcagccggcgggacggatgagttgcttctccgggaaaccgtcctcgcttcctcacgaccctctcggctcccgcctgggtgcccctcgggccggcagtactccgcctccgggcgctcgaagcgagttccccgggggcttgttcgcaggcaccccttcccctccgaggcggcgcgcgcgctcccggccctgaccgcggccggacacactcgcgccccggtccgcctgtcgccctcccgcctgctccctccagtcaccccacccttagctgtccccgccaccttactccaccaccctcccccgcctctccgcgcactccgcgtcccggcctccagttcccctttcccttgaaccgctcacttcacagcccttcgcccccgggaagaagaaacatttcccgaagcgcactcctcagccctccttccccacgcgctcgccctcccctccccctgcttttcttgggggaggggggctgtcgccttggattgaaggccattgatttgtatgtatttgtcccagcgctggaggctgccccagccgccgcgccggtgccgccgctgccagtggagttgcctccccgcttccctagggtggttcggctccaccaaacatgtcggctcctgtcgggccccggggccgcctggctcccatcccggcggcctctcagccgcctctgcagcccgagatgcctgacctcagccacctcacggaggaggagaggaaaatcatcctggccgtcatggataggcagaagaaagaagaggagaaggagcagtccgtgctcaagtaaggacctggctccatattcccgcctctctccctgccctccgccccctcgcccactgccctgcggccgcctgcgcgccccagttcgccgccctccctcccgctggcggcgcccaggccacgagggctgcggccagcgccggccgcccgggctgttttaggggtgtctgagagcaggggtgtgtgtcggggagggagggcgccaaggccggctgaggtgagggtggcgagccttaggcggtgtgattttccttggcgcctttccggatttcctcgctggtcatcttggctccggggccccagcgggactggggctgaacccaggctctgtgcgtaccctctcctttcccgccgcgctgaggcagtgactggggcacagaatccaatatggccgtgcacaggtgctccctggacggacccgggcgaaggcgcgctggcaggggatgcggacgccaccctggtcccacgcctccgcggggcggctctaccagcaacgcgggacagagcagggctgcccacagtggctgcgagcagcgggcggcggcgcgggctaggggcctaagctctgtcgcggtcgggtgggtgtgcgtccgccgccatcttccagcccctccccctc

SEQ ID NO: 98376 - DNA, 16 bp, Homo sapiens
  chr8:104513910-104513926
  hyper
gcgagtgctaacaccc

SEQ ID NO: 98377 - DNA, 246 bp, Homo sapiens
  chr8:1048526-1048772
  hypo
ggaggacaggcacagcgggctggccccaccctgcgatggccacccacagacgccgcgacccacaccaggctcccggccgcccacgggcgccgccacccacgccaggctcccggccgcccacggacgccgccacccacgccaggctcccggccgcccacgggcgccgccacccacgccaggctcccggccgcccacgggcgccgccacccacgccaggctcccggccgcccacgggcgccgccaccc

SEQ ID NO: 98378 - DNA, 84 bp, Homo sapiens
  chr8:10509949-10510033
  hypo
gcaccagacacttgacgaatgcgatgtcatctaactctaatattccttcctgctgggtataaccagccccgcagtatcttaaag

SEQ ID NO: 98379 - DNA, 140 bp, Homo sapiens
  chr8:1051534-1051674
  hypo
gggggcatttcatggcggcagacgctcagtctgggaagatggaagagttccggagatggtgacacgacaatgggaaggtcctcatcacccctgagccaaacatgacacgacgatgggaaggtcctcgtcacccctgagcc

SEQ ID NO: 98380 - DNA, 253 bp, Homo sapiens; identical to SEQ ID NO: 3356
  chr8:105235249-105235502
  hyper

SEQ ID NO: 98381 - DNA, 161 bp, Homo sapiens; identical to SEQ ID NO: 32215
  chr8:105235643-105235804
  hyper

SEQ ID NO: 98382 - DNA, 260 bp, Homo sapiens
  chr8:105235863-105236123
  hyper
cgggtcctcgtccaagatgggccggcagggcttggggggtgccagcgctgcggggcgctccatgcagcgctcccagagccggagtagcctgtctgcctccttcgaggcactggccggctactttccctgcatgaactccctggaggaggaagaaggaggtgagacaccccttcccccgtagttggtgtctctatctgtttagaaagtcggtggctggagggttggccggggcagagagaactccacgtagcagtgtccca

SEQ ID NO: 98383 - DNA, 142 bp, Homo sapiens; identical to SEQ ID NO: 41704
  chr8:10528983-10529125
  hypo

SEQ ID NO: 98384 - DNA, 30 bp, Homo sapiens
  chr8:1053744-1053774
  hypo
gacggtgatgactggcggggccttggttga

SEQ ID NO: 98385 - DNA, 227 bp, Homo sapiens
  chr8:105385866-105386093
  hypo
caaatggtgcagagccgggactaatgccgggttcctggagtcaagcccacactgcatcatgggaagtgcccctggcagaggcgctgatggttatgggatagcccaggaacagcgtgtcctcattgactctgcttcaagttcagtttttggatgactggagggctggcgtgaccaggcccccactggtctgtggcactttctcagcagcagagcgacccccacctgga

SEQ ID NO: 98386 - DNA, 40 bp, Homo sapiens
  chr8:105456591-105456631
  hypo
tccactgcctctgggcggcacagctcgtggccctcagggc

SEQ ID NO: 98387 - DNA, 184 bp, Homo sapiens
  chr8:105459406-105459590
  hypo
tccgtttccgagccacggaaaatccatttctggatttctcatcttccaatgcattaaatgagtttacctatgtaggcccaatcatcttcaccttatgttatggctgctgtcatttctgtagaagctttggaatgcaaatgcgtacctctgcaattaagtctccattttccgcatggacctgggc

SEQ ID NO: 98388 - DNA, 52 bp, Homo sapiens
  chr8:105478728-105478780
  hyper
ccctctgacacccgccggggctgcgctccttcccgcccacccagctcctcgg

SEQ ID NO: 98389 - DNA, 187 bp, Homo sapiens; identical to SEQ ID NO: 32217
  chr8:105479247-105479434
  hyper

SEQ ID NO: 98390 - DNA, 77 bp, Homo sapiens
  chr8:10548185-10548262
  hypo
tggcgcatctccccccggctcgcccagcccagactccgggtatgagggcccaaggaagccaccggagccccctggtc

SEQ ID NO: 98391 - DNA, 120 bp, Homo sapiens
  chr8:105565464-105565584
  hypo
agggggaaaatggggagtgcagatacatgcacagaagtcttggcaggggcagaggcatgaaacctgaaagccctgcttgctttctcagcagggaagtttgtagactgggccaagttctca

SEQ ID NO: 98392 - DNA, 155 bp, Homo sapiens; identical to SEQ ID NO: 9720
  chr8:105600526-105600681
  hyper

SEQ ID NO: 98393 - DNA, 677 bp, Homo sapiens
  chr8:105601010-105601687
  hyper
gttcggtcagcggggcgcggggacgcggacacttaccgtacaccccagcgaggaaaagcaagagcaacgcagacctccaccgcggagactcttttgtgctccagcgacaggccataaccacagcagatggagagagagaggaggagacggaggaggagggaggagaagctggaggtagacgacgccgacgccgccgccgccgccgccgccgccgccgagccaccggctgctccctgcgctctccgcggctgcgggagggggaagggaggggccgccgccgcccgcgcgcgctccctcctccctcctccctccggctcgcctgctcccaccccgggcggtgcgagagccccacgcggggcggccctcctgggggcaagggcaaggagctcgcgcgccagcgcgagacgagagggtggcggacgccggactccggcctcgcgccgctcgggctagccggcgccgccactcgccagactgagcgcgcgcccatccgtgcgatcggcaatcccctggcccgcctgcctcggttccctccccgcgctccgctggactttccaagtttcgggccgatttccacgcgacgggagcccaaggagcaaggcagcgccaatcgatgacagagcgtgcgaacgccggctgctggatgcccaggggctggagcgcggggtgtgtggagg

SEQ ID NO: 98394 - DNA, 152 bp, Homo sapiens
  chr8:105601931-105602083
  hyper
cagtgtggactcccacgctcaaggtgcccggaatgagtcgggcaaggcttgtgcagagcccctccagtctggcgtggaagcgccaagaggtcatttgacatctcacgctgggtcgggtgcagctgggccaggatgttcggcagggctggagc

SEQ ID NO: 98395 - DNA, 165 bp, Homo sapiens
  chr8:10562094-10562259
  hypo
gagggatggagaaggcgctgggcgacctgaaagggcagagtcaggctccttctgtcaagacactgaggctcacacacagttgatgttcatttcacaaacattaattgaccaattatctgtaccagaggctgtcaggcacggaggacccggcggtaaacaagccag

SEQ ID NO: 98396 - DNA, 120 bp, Homo sapiens
  chr8:105645375-105645495
  hypo
ggggccagtggcgcccgccggccgctcccagtgctgggccctccgagcccatgcccaccctgaactcgcactggtctgcgagtgccgtgcacagccccggctcccgcccgcgcctctccc

SEQ ID NO: 98397 - DNA, 30 bp, Homo sapiens
  chr8:105692986-105693016
  hypo
gttccaagtcaggcacggtggctcatgcct

SEQ ID NO: 98398 - DNA, 181 bp, Homo sapiens; identical to SEQ ID NO: 31764
  chr8:10587422-10587603
  hyper

SEQ ID NO: 98399 - DNA, 115 bp, Homo sapiens; identical to SEQ ID NO: 31765
  chr8:10587893-10588008
  hyper

SEQ ID NO: 98400 - DNA, 109 bp, Homo sapiens; identical to SEQ ID NO: 31766
  chr8:10588184-10588293
  hyper

SEQ ID NO: 98401 - DNA, 27 bp, Homo sapiens
  chr8:10588640-10588667
  hyper
cgacgcccccgccgcccctggctctca

SEQ ID NO: 98402 - DNA, 78 bp, Homo sapiens
  chr8:10590855-10590933
  hyper
ggtcgaggctaggtgcggcgaatcatcacggcgcggaccctggaagacctggaggagaaaggtcgaggcccagggcta

SEQ ID NO: 98403 - DNA, 28 bp, Homo sapiens
  chr8:105977049-105977077
  hypo
gccatcttgtaaccgcccattttattag

SEQ ID NO: 98404 - DNA, 41 bp, Homo sapiens
  chr8:1060967-1061008
  hypo
gatgcatctgccagccgaaggtcacacgtgggtttgagcag

SEQ ID NO: 98405 - DNA, 185 bp, Homo sapiens
  chr8:106155895-106156080
  hypo
tcatgccaactcgcccgttatcgccggcacatgcctgaattgcaaaagaatccgctcttcaattggaacttattgatattctaagaaaaaaaaaaagagagaagggggaaaaaactgaaaatccttaagtttaagccgcagatttttaaatggattaatttcgctgcaatcgcagccatctaagg

SEQ ID NO: 98406 - DNA, 639 bp, Homo sapiens
  chr8:106330435-106331074
  hyper
ggccctcctccaagccgtccccacgcctcccctccaactcccacccacccctgcccccatcccccaccaccgcctggatcccccgcacttcgcccgaccaaggccggggccgtagtttgcatccggactggatttggatgcagccaatcctcctttggctgatggaatagtctcccctccccacagccccggcgcgcccctccctcgcgcgcctcgccgcctcccgccgcagaacaggagctgcgcggcccggagcggcggcggcggcgccggagtatccgtcccgcacgccggggcgaggggcgagcgagcgcgctcctcctcccgcgccctgcgcccccgcgctccccctctcctcgctgctcgctctcccgtccctccctccttctcttccttctttccgtgttatttttctcttctctttccccttttctctctccctgaccgttcgcttgtacattcccattctccccccgtcgctctcctctccccctcccctcctcactgtcacactctctgtgcccccgtctctcttctctcatttgcttgctcatctccgaacgtgaatccgcggctcccggaggagcccagcgcccggagcacctggagtccggccggcggcgggccgagcctggccag

SEQ ID NO: 98407 - DNA, 174 bp, Homo sapiens; identical to SEQ ID NO: 32224
  chr8:106331083-106331257
  hyper

SEQ ID NO: 98408 - DNA, 131 bp, Homo sapiens
  chr8:106331843-106331974
  hyper
cgtgtcctgggacttcgggcgggtccggctcacgccgccaggacgctcagccgagcggggattcgggtggtgtctggccctggtggcgcgcggagtcctccctgggaggggccgccagtcacttcccagcg

SEQ ID NO: 98409 - DNA, 185 bp, Homo sapiens
  chr8:106332003-106332188
  hyper
cgcaggggagtgcatggccctgagcccccgggtgcccgggggtcccgatggtgcttagaggacacggcgggtcaagagacaccttccgaaacaggcacgctcgcagagatcaagtcggtcaacttttcttggcttggggagaattcctccaatagcgttttataggcctgcgacatatcttcaac

SEQ ID NO: 98410 - DNA, 84 bp, Homo sapiens
  chr8:106433918-106434002
  hypo
aatttttctcagtgacgcataattatgttttattgccaattgtgaggaagaggacagattagcaattaaaagagtagaagttgc

SEQ ID NO: 98411 - DNA, 27 bp, Homo sapiens
  chr8:106466086-106466113
  hypo
aagtgatccacccgcctcagcctccca

SEQ ID NO: 98412 - DNA, 77 bp, Homo sapiens
  chr8:106475039-106475116
  hypo
tggccaaagaaatagcgaatccgtttgtatctatgttgttcaaaaaataaaagtcgtttattcgattcaacgtcctt

SEQ ID NO: 98413 - DNA, 30 bp, Homo sapiens; identical to SEQ ID NO: 15145
  chr8:106500552-106500582
  hypo

SEQ ID NO: 98414 - DNA, 53 bp, Homo sapiens; identical to SEQ ID NO: 41660
  chr8:1066123-1066176
  hypo

SEQ ID NO: 98415 - DNA, 38 bp, Homo sapiens
  chr8:106706481-106706519
  hypo
gggattacaggcctgagccaccgcgcccagcctctcca

SEQ ID NO: 98416 - DNA, 28 bp, Homo sapiens
  chr8:106713096-106713124
  hypo
gcgtgagccactgcgcccagccatccct

SEQ ID NO: 98417 - DNA, 56 bp, Homo sapiens
  chr8:10694858-10694914
  hypo
gctctggaagcttgacgcctggcttagcctggactttgccccgtgcatcttttcct

SEQ ID NO: 98418 - DNA, 2 bp, Homo sapiens
  chr8:10708309-10708311
  hyper
gg

SEQ ID NO: 98419 - DNA, 12 bp, Homo sapiens
  chr8:10708327-10708339
  hyper
cggggaacaacg

SEQ ID NO: 98420 - DNA, 986 bp, Homo sapiens
  chr8:107281909-107282895
  hyper
aacatttttttcctccgtaaatctgaacaaatttccttgcagctttccttgcagaagcttttttatcgctttaacaaaactttcctctgcttctctagggagagcctagtattagagctgcccgacaggcgggaccccgaaatcggggcagctctggcttagtccaggctattcgagtgggcgcctgaactggaggcgccgtctccaccgggatggggatcctagtgcaggcagacgcctggcaggactcggcgagctggggtccccaccgcggtagccagagcagaaacccgaaccccagccagaggggccgcgcgcggggaggggtgcgcgctaagccagcgtggcttccgcaggagctatttttagcggtgcgtgcctccccccgcccccggcgtggtagcctccggctcgcggcgccccacggctcctctcagtctcccccgccgctgccggctcttggtagcttccacgcgggcaggtccggaaactgagcatgtctgcaagcgctcagcggcgccggcagcagcggggctagagctgggctgcgtcaggctgagcccattcacctcgcggccacaggagctcagcgccggcgccgcgccgcccagccccgccgagaggggcgcactcgccgccgcggggcccgccgccgctcaccgcagccccctcctggcgacccgcaagtaagtttgtgaggctgctgggcgttagggcgagggcttggcgcccgggggagtccaggagggatagcgagaggcgcggctggcgcccgggagagccggctggcctctgccccctgtgcctggcgcctctccgagccacttagccaatttgaaagcgggtggccattgggatgctcgagcggggacgacgggcagagcaggagggcagaactagctccagcgggggcccagagggcggacttgggaagaaggaaagaccgcgcggcgagggaggagaccgggcggcgagggaggagaccg

SEQ ID NO: 98421 - DNA, 942 bp, Homo sapiens
  chr8:107283112-107284054
  hyper
agggacagtgggctccggaggggcgagtggattcggataatttggggaatcagtaaaaggctagggggcacatcatgatggagtcagcctggaatctgtctcccgctagagtacccgaggccacatgttgggaactggctggggaaaggatggatgtagaaagtggcctggagggccgactggaaaatcgctgagggatttgggtgaagagggggggagctgtgcagtatcgggcggaggaactgggctgctggtagggcctgaaaggttcaggagagggttggaggcttccccgtgccgccccttgaatagtgatttagtactgttatctgaggttcactttcacccctggctcctcctccgtctactacccggcttggacgcacctcggctcgctgtaggcgagctttaggagatttaaatagacattaggcagtggggaaggtagtcgtttacggggggagctgctcgggcttccgttcagtggttcccggcacgctcagggtgcagtgtagggtctgaatgtgtgtattgcgggggtagggggagtggtgtcagttctaggccacaggaattcgtggtctggccccagaggtgcggtgtttttggccgggaagtcaggcagaagtctgcagcgtgcaactcgcagcggggcgtgtgtgtgcgtgtgtgcgcgcgcgtgtgcatgtttccggcccggggtcgcgtgtgtggctgcagcctgtctccgtgacaagaagatccagggatctacgggcggcacggggaagggattaaggggaacatacttccctacgtcttttctgcctccttttcccagggtagcattctttgcttatccaatgatgcctctttctaacctctccctctccacttacatcccaaacctgatgcgggtcttctctgattcggcactctaaggaggactcagccgccggctgc

SEQ ID NO: 98422 - DNA, 181 bp, Homo sapiens
  chr8:107284055-107284236
  hyper
accaccgtggactccctctatggaagggaatcctgggagtcccggccgtcagaggggttcccaaatccaaagggtccatctccaaggcgtcactccaggggtccgcggttcactttgctgccccttgcaggtgatgctgtgattgttgcctgcggactgggaagcacgatggctccaaaag

SEQ ID NO: 98423 - DNA, 30 bp, Homo sapiens; identical to SEQ ID NO: 41892
  chr8:107359293-107359323
  hypo

SEQ ID NO: 98424 - DNA, 185 bp, Homo sapiens; identical to SEQ ID NO: 41893
  chr8:107531614-107531799
  hypo

SEQ ID NO: 98425 - DNA, 286 bp, Homo sapiens
  chr8:107670003-107670289
  hyper
cgtcttttgctcccccgacgcgtggtttcctgatggtccgtccccgggcagagagagggacgccccctcctcctccccgcctcttgtgaggcgcgcggagccgcctcccctgggtcaggtctgatgggccggtgggcgcgctagtggtggccgccaccgccgaaaccgtcgacctcctgggccccagttccgcgtccagccccgcggcagcatggactacctgacgacgttcaccgagaagagtgggcgccttctgcggggcacggccaaccgcctgttggggttc

SEQ ID NO: 98426 - DNA, 56 bp, Homo sapiens
  chr8:107670922-107670978
  hyper
ctagttgacattttgcgtcgtgtactttttgaacggctgcacgttgtcttgtggtg

SEQ ID NO: 98427 - DNA, 18 bp, Homo sapiens
  chr8:107789174-107789192
  hypo
gcccggccagctgtggat

SEQ ID NO: 98428 - DNA, 164 bp, Homo sapiens
  chr8:108134662-108134826
  hypo
catgacgccggctgccgtgtgggaggtgccgctggggctgcctgctccatggagcctgcaggatccaggacaggtaggagccccgcccctttctgagtgggaggggcaggagccccaccctcccaggggtagctgcagccacccagccacggttgtggacctgg

SEQ ID NO: 98429 - DNA, 312 bp, Homo sapiens
  chr8:108509338-108509650
  hyper
ccaaacccagacagccgtcttgcaattgcaaacactgcccccctggagcaaaaggtaaatacacaaatgctcccctaaggaactttaagttagctgcagtgcaagaaaggaaaaaggtccgtgctattagaaactgaaagcaatcacttactttttgcagccactgagtataattttccatcacatgttccagatgttgaagtttctgggaagagaaatccggttccacgtgtggagcatctctctgcagagcgtttgtgttgtactggtctgtcgtactctcacgacagttgccatcgtgttctggaagaa

SEQ ID NO: 98430 - DNA, 50 bp, Homo sapiens
  chr8:1085553-1085603
  hypo
ctgaaaaggggcatgcggtctttcaggagacggagcgtggcacacctaag

SEQ ID NO: 98431 - DNA, 30 bp, Homo sapiens
  chr8:108581145-108581175
  hypo
tatttctcccgatatcgctggttgtgtaaa

SEQ ID NO: 98432 - DNA, 77 bp, Homo sapiens; identical to SEQ ID NO: 41895
  chr8:108582504-108582581
  hypo

SEQ ID NO: 98433 - DNA, 17 bp, Homo sapiens
  chr8:108582641-108582658
  hypo
ggcggagaaaatattac

SEQ ID NO: 98434 - DNA, 30 bp, Homo sapiens; identical to SEQ ID NO: 41897
  chr8:108588091-108588121
  hypo

SEQ ID NO: 98435 - DNA, 30 bp, Homo sapiens
  chr8:108592924-108592954
  hypo
tactactcccaatttcgcaggaagtgtata

SEQ ID NO: 98436 - DNA, 41 bp, Homo sapiens; identical to SEQ ID NO: 41898
  chr8:108593714-108593755
  hypo

SEQ ID NO: 98437 - DNA, 30 bp, Homo sapiens
  chr8:108594004-108594034
  hypo
ggggaggacacactccgccacatcgggagt

SEQ ID NO: 98438 - DNA, 393 bp, Homo sapiens
  chr8:108601650-108602043
  hypo
ggtagtgtccacccccgtatgatattgttcattatatccggtgggaaagaggatgatattactagccatattgcaggagttgtgatattgtttgtaatattcagggcgagggaggatagtattaccctccatatcacaaagtgtgtacacatccttgtgatattgttcgtaatatctgggggggtaggaagataatattactgcctatatcgcaaaacgtgtacacccacgtgtgatagtctccaaaatatttaatgggggaaaggataatatcactccccatatcgcagagtgtatacacgttccccgtgataatgttcctaatatcggggagggggaagaagatgacatcactccccatatcgcagggtgtacgtgtccctctgtgatatt

SEQ ID NO: 98439 - DNA, 208 bp, Homo sapiens
  chr8:10873441-10873649
  hyper
cgactcctgcggactcggctgcaggcgggctccatgagggcgggcagcagggctcagacgatccggctcggtttggtcagcagacccccggtaacgccccgcaccgtcggcgatccctgcccccttccactgcgcccccacaagccccgagctcgccagtccttccccgcggcgctccgctctgtggccccctcgcatcccaccgtgg

SEQ ID NO: 98440 - DNA, 153 bp, Homo sapiens
  chr8:10873889-10874042
  hyper
gggacgccggggactcggggtcctagtgccaccggacgcagcgggagtagcgcaggtctgggggcggggtctctcgaggcgcagacaacaagctagatcctgagccctctgcttcaaagcgggtagcgccttcgcccacgccttccctcccac

SEQ ID NO: 98441 - DNA, 30 bp, Homo sapiens
  chr8:10874300-10874330
  hyper
accactcttctctctcgggccagccgagcc

SEQ ID NO: 98442 - DNA, 96 bp, Homo sapiens
  chr8:108767551-108767647
  hypo
gaatgacgcagaagccgaagggaatgtggccagggcggctggaggggagtctggccgctgagtgacctgactccagagagaaaccaccttcccact

SEQ ID NO: 98443 - DNA, 30 bp, Homo sapiens
  chr8:1088028-1088058
  hypo
cccggccccctctctcgatggaagcttttc

SEQ ID NO: 98444 - DNA, 30 bp, Homo sapiens; identical to SEQ ID NO: 41900
  chr8:108957755-108957785
  hypo

SEQ ID NO: 98445 - DNA, 501 bp, Homo sapiens
  chr8:109093679-109094180
  hyper
aaaagtccaaagtgccgaatgaaatagacagctctcaccaggtccctgggaaggggctgctgcgcgcccttcctgcgcgggtaattcgatgtgcgtgtggtgagtggtttatgtttaaatccacccagaaaattgaatcgtgtctagccgcccttcttctaaaatgcagttggattagttgcatctccagcggactccgagacagaaatacgcactaaatctgcaggaaagcgagttccccgaaacctttctggaggcttccacccgccttctccgctacgcacaagtgatggagagggagggagcagttaaaaagccgcaagtgaatttcattgagaacagaagcctccaccggtgtggctgcttttgcaaagcaaatggagagagcgaagtggggcctgttttaaaaacaaacctctggaggcgaggactccccagaaaaccagcgcgggaattgctgcttaattcagaaagttcccatctcgtcgcagtttccagaaa

SEQ ID NO: 98446 - DNA, 1040 bp, Homo sapiens; identical to SEQ ID NO: 32233
  chr8:109094397-109095437
  hyper

SEQ ID NO: 98447 - DNA, 63 bp, Homo sapiens; identical to SEQ ID NO: 32234
  chr8:109095505-109095568
  hyper

SEQ ID NO: 98448 - DNA, 405 bp, Homo sapiens; identical to SEQ ID NO: 32235
  chr8:109095569-109095974
  hyper

SEQ ID NO: 98449 - DNA, 148 bp, Homo sapiens
  chr8:109104980-109105128
  hypo
caaaaatttctctgtcgccaccacactatggtggctgggcatgcttggcttctcagacatgttagtggctcctctgatcctcccgttcccttttcggaactttacttcctcagctgtaagatctcgttcctatcgtaaatccattatt

SEQ ID NO: 98450 - DNA, 43 bp, Homo sapiens
  chr8:109144123-109144166
  hypo
gaccaggaagggccgcgttaagatgctgcgcttcccacaactg

SEQ ID NO: 98451 - DNA, 255 bp, Homo sapiens
  chr8:10916999-10917254
  hyper
cggagccatctgctgcgcgggcggcgccgctccagtgtttgtttacaacccggcccggcgagcgacaagagctcggctcctcttccaggcgcgcggcggtgccagtggaggaggagcagggcgctgggggcgcggggggcgcggggcggggcgggacaggtgcggggggcgcggggcgggacaggtgcggcgggcgcggggcgggacaggcgcgtctctgttccccggctccccggcccgcgccccccggacccc

SEQ ID NO: 98452 - DNA, 56 bp, Homo sapiens
  chr8:109273857-109273913
  hypo
caggctggactgctccggtgcccacagactgccagcaggagcgccaccctggctaa

SEQ ID NO: 98453 - DNA, 30 bp, Homo sapiens
  chr8:10928999-10929029
  hypo
cgagtccatgagccccgagtctatgagccc

SEQ ID NO: 98454 - DNA, 30 bp, Homo sapiens
  chr8:109311321-109311351
  hypo
acaggtgcaagccaccgcatgtgtagaaat

SEQ ID NO: 98455 - DNA, 30 bp, Homo sapiens
  chr8:10959729-10959759
  hypo
cccagcccagcatcccgaggacttgcctgc

SEQ ID NO: 98456 - DNA, 57 bp, Homo sapiens
  chr8:10966208-10966265
  hypo
tgctccattccaaggcgacagagaatcaaccacagatgggcgcgagaacagagtcag

SEQ ID NO: 98457 - DNA, 326 bp, Homo sapiens
  chr8:109799414-109799740
  hyper
aggcaaggctgatctcggggaggcgacctctggatgcgccctgtgcgagcaaagccgggagagcgagccccaagcacctggcagcggtgcccccagcaggcgccgaggaatccggctatccatttctggtgaactctgcgcccactgaggcattcgaggtacggatgtgtccgcctagtactcggagacgaaggagagagagcggggatatgcgctccagctctgctaggctccagggctctcacccttgcattcaaagcctccaccccatcccactccccgccactcaccttctgcttcggccacccggtgcggctccagcaccg

SEQ ID NO: 98458 - DNA, 15 bp, Homo sapiens
  chr8:109799888-109799903
  hyper
cgggagttgtaggcc

SEQ ID NO: 98459 - DNA, 28 bp, Homo sapiens
  chr8:110086844-110086872
  hypo
caacaaaagaatacgcaggtgcacagta

SEQ ID NO: 98460 - DNA, 31 bp, Homo sapiens; identical to SEQ ID NO: 41901
  chr8:110274990-110275021
  hypo

SEQ ID NO: 98461 - DNA, 104 bp, Homo sapiens
  chr8:110406021-110406125
  hypo
gaagacagactggggcggtcagcggaagatcccagcctttataaagggtaatccttttgtatgcttttttatgtcaatataatttcttaaaatcaactgtaggg

SEQ ID NO: 98462 - DNA, 224 bp, Homo sapiens
  chr8:110479232-110479456
  hypo
gacagagagagggagcgttggcacagcccttggagcaagtaaaaatgtaccagtgttcctgccactcaaagcaaatgtttttgattgtccttgctgattgagatgggatgggggagcatttactaggttaatagctgcctaacaggtgccagggattgtggatttactgatttgttccggtaaaggtacaatacctggaacaccagatacgcttggcatcatta

SEQ ID NO: 98463 - DNA, 34 bp, Homo sapiens
  chr8:11049928-11049962
  hypo
ttacagacgtgagccacagcgcctggcctacaaa

SEQ ID NO: 98464 - DNA, 33 bp, Homo sapiens
  chr8:11053392-11053425
  hypo
cctcatgatccgccacctcggcctcccactgag

SEQ ID NO: 98465 - DNA, 171 bp, Homo sapiens; identical to SEQ ID NO: 15148
  chr8:110548417-110548588
  hypo

SEQ ID NO: 98466 - DNA, 15 bp, Homo sapiens
  chr8:11058152-11058167
  hyper
gcgctgcgcccccgg

SEQ ID NO: 98467 - DNA, 601 bp, Homo sapiens
  chr8:11058198-11058799
  hyper
cgggccgcgccgtggacgtagccggcccccatcatgggggggccccggctggtgagcccctccacggcgcccagcccgccgcccgtgtagtcctgcacgaaccagcggaagctcaggctctgcaccagcagcgacggcaccagcacgaagaagagggtcagcccgaagtagacgtagtcccccttgcggtagtagtcgagggccagccacaggtcggtgcccacgtccccgaagaacaccagcagcgccagcacgatccacaggcagtcgagccacggccgctccacctgcggcggcggcggctccggccgcgcggccgagggcgtcgggggttggcggccggcgccgggggccgcgggaggctgcagcggctggtcccccccgtcggcggcggcgctgcggcgcggcttcctgcccaggagggagcgcaggcaggcggagcggcagccccagtagcacgaggaggtgttgcagcagtggcagatgtgcatcgagctgctctcgccgggctcgctgccgtcgccgccgccgccgcagccgcctcccccgggctccccgtcctcctcgccgccgctgcccaccgcctcgtccaggttgtgca

SEQ ID NO: 98468 - DNA, 51 bp, Homo sapiens
  chr8:110592338-110592389
  hypo
cgcaatacaattattcgtgtagactgtccttaggagcggccttcttcccac

SEQ ID NO: 98469 - DNA, 409 bp, Homo sapiens
  chr8:110703524-110703933
  hyper
actgacagcagagaccgcataggcgccccggtcttaccctttctcgcccagaagggccccatcgcgctgtccaggaggaggcacctacgtgcgcccgggagaccgggccccggctgggccgggtgccggtgcggacgggaccccgcgtcgctgctggtttgcgctcaggcccggggagccgggcccggcccgctccgcccgccttagcccggcttggacacgtggtgccgcggaatcccttgcgctccggtgccctcggcccctcggcctctgcagccagccgggcggctgctggggctgaggacaaaatggagagaagggcgggggaccaaagggcaggcaccgctgggtggggcgcagcggcgtgagcacgctgagggccgcgcgccgggggcgccaggattctgct

SEQ ID NO: 98470 - DNA, 116 bp, Homo sapiens
  chr8:110704189-110704305
  hyper
gcacccttgtcctcacgctggagaggaagagccctgaacactgacttcagcgtgaacctaaggtgccctttaggacagtctccctgggaaaatttatctcgcgaccacagcctgcc

SEQ ID NO: 98471 - DNA, 30 bp, Homo sapiens
  chr8:1108569-1108599
  hypo
tttcatggctttggacgatacctgtgaaat

SEQ ID NO: 98472 - DNA, 30 bp, Homo sapiens; identical to SEQ ID NO: 15149
  chr8:110961977-110962007
  hypo

SEQ ID NO: 98473 - DNA, 52 bp, Homo sapiens; identical to SEQ ID NO: 9735
  chr8:110986212-110986264
  hyper

SEQ ID NO: 98474 - DNA, 691 bp, Homo sapiens; identical to SEQ ID NO: 32241
  chr8:110986328-110987019
  hyper

SEQ ID NO: 98475 - DNA, 202 bp, Homo sapiens; identical to SEQ ID NO: 9738
  chr8:110987020-110987222
  hyper

SEQ ID NO: 98476 - DNA, 275 bp, Homo sapiens
  chr8:110987681-110987956
  hyper
gaatttaaatagtaacgacggcctccctcggtaaagggagaagccgaggccagcgcccaggtgagactagaagtgtacccacggggcccctggaagctgcgctccagccaacctgttggactcggggtgaggaggtgggggtgggagggaagagcaagtgactcacctgcagctcccggcacatctggtctgcgcacaaccggcgccgcaggtaacgtactcttcttttgatcctcttagtctacacgtgaggtctgactcgaccggtccaggag

SEQ ID NO: 98477 - DNA, 29 bp, Homo sapiens
  chr8:111003707-111003736
  hypo
gagtgcagtggctcacgcctctaatccca

SEQ ID NO: 98478 - DNA, 18 bp, Homo sapiens
  chr8:111194106-111194124
  hypo
gcccggccagggtttttt

SEQ ID NO: 98479 - DNA, 30 bp, Homo sapiens; identical to SEQ ID NO: 41905
  chr8:111586661-111586691
  hypo

SEQ ID NO: 98480 - DNA, 244 bp, Homo sapiens
  chr8:111747443-111747687
  hypo
ggctgcaactgctcccgggaacatggggctcttggccggccacctcaccccaaaccagccccctctggctctgtggagcacacagccccggccatgcctcccccgctgaagctggcatccctgcagcaggtgctccagatgggctgccgctgccatcagtattatgttccgtcataatcatacgtgctatgcttttatacaactgacagcacagtaggtttgtttaaaccgacatcaccacaaa

SEQ ID NO: 98481 - DNA, 687 bp, Homo sapiens
  chr8:11204479-11205166
  hyper
gattgcaatatgcagcggagtttgagaaccagcgccttggacccagcttcttaagctactgcgcgcaccggcgtcccgctgggggcgcgcgagccccacccccagagatgctgactcagcaagtcgggaggggttgggggtgggacctgccaatctgcatttccaaccggcgcccaggtgacgctgactctgctggtctaccgtcttgggggtcacctaatttttcagcgatgcctcccagctggggaggccaagaagtgcctcgctcaaggtcttccaacacccgacctccagaccctcaatcctgggccagctacaccgcaaacctttccagctgtctctcctgcgccctgcgtttcttccccacgtcacttgccagggagccgctaaacagcaagaccgcgcgctctgcggctccagagtgcggatttcggtcgcgtgcggctctgaccgcgtcgccccatccctggcggggccacgcacggacgccatggctggcgccgcggagccgggcgatgcgcgcggactctcccggggccctgactgtccctgagtcctccctgcggggggcgtgcgcggcccgccccccgcggcgccacgcggcccctcctcggccggggattggtgcgccgggcggggcggggcggggcgggataaaggcgcggggtctggctgcgcggggtctgc

SEQ ID NO: 98482 - DNA, 255 bp, Homo sapiens; identical to SEQ ID NO: 31773
  chr8:11205167-11205422
  hyper

SEQ ID NO: 98483 - DNA, 257 bp, Homo sapiens; identical to SEQ ID NO: 31774
  chr8:11205445-11205702
  hyper

SEQ ID NO: 98484 - DNA, 61 bp, Homo sapiens; identical to SEQ ID NO: 9392
  chr8:11206007-11206068
  hyper

SEQ ID NO: 98485 - DNA, 28 bp, Homo sapiens
  chr8:112347537-112347565
  hypo
ctgatgtgttcctcacgacgtccagctg

SEQ ID NO: 98486 - DNA, 67 bp, Homo sapiens
  chr8:112636560-112636627
  hypo
aggtggatggcctaccgctgttctggagtctgtgggcgtgctcttccacgggcgtgctcttccacgg

SEQ ID NO: 98487 - DNA, 218 bp, Homo sapiens
  chr8:11302089-11302307
  hypo
gaccgcgcagtgagccgcacagggcgccctcctggaggctcgggtctatgatccgtcctggaagcctgtgggtgccatgctccacagaaggcaggaacagacagcgtcgcaggaatctcggggcagcctgtgccaaggtctatctgtcctgaacgcactcgaagaccagactggcaggaagaaggcccagagctctctcttctcgggaagggcaggtg

SEQ ID NO: 98488 - DNA, 16 bp, Homo sapiens
  chr8:113095708-113095724
  hypo
acgctgtcacctctca

SEQ ID NO: 98489 - DNA, 150 bp, Homo sapiens
  chr8:113146123-113146273
  hypo
ggcttttccttagtacgcatgtgaagaatgagaggtaaggagtgagagacagaaagagagagagagagacagagggagacggagacagtcagcctatttgtataaggccaccaatcctagtggattaggactacacgattaagaccttat

SEQ ID NO: 98490 - DNA, 203 bp, Homo sapiens
  chr8:113175066-113175269
  hypo
ttcactgtaaagtgccgagcatatctgtagactccagaaagtgtcccacctgtgcttacaaacaaggtgggtgttgagggttctgccgctgctgcacttttgtggggccagtctcctgctgcatccgataaggatctgcaggtgagctgagaagccctcctccattcacccagtgtcgctgtctcccccgagattcctggttg

SEQ ID NO: 98491 - DNA, 30 bp, Homo sapiens
  chr8:113221643-113221673
  hypo
aagattaaacctggccgggcgcggtggctt

SEQ ID NO: 98492 - DNA, 43 bp, Homo sapiens
  chr8:1133089-1133132
  hypo
acacaaatgcattcacgttcgattccctcgagatgccttgtgg

SEQ ID NO: 98493 - DNA, 30 bp, Homo sapiens
  chr8:1134528-1134558
  hypo
gggaaatcatcactgcgaattctagtgacc

SEQ ID NO: 98494 - DNA, 56 bp, Homo sapiens
  chr8:1136167-1136223
  hypo
ttggtgccaggattgcgatgggtcggtggcaccgagggcagcgctgcagtctgtgg

SEQ ID NO: 98495 - DNA, 30 bp, Homo sapiens
  chr8:1136428-1136458
  hypo
cagcccgctgtgcagcgagttcagttgctt

SEQ ID NO: 98496 - DNA, 139 bp, Homo sapiens
  chr8:1137213-1137352
  hypo
ttcacacgggacctccgtgacgtttgcctcatggaatctcacacacacgggacctctgtgacgtttgtctcatggaatctcacatgcccgggacctctgtgacatttccctcacacgcccaggacctctgtgacgtttc

SEQ ID NO: 98497 - DNA, 112 bp, Homo sapiens
  chr8:1139159-1139271
  hypo
gttcgggccccaggccgattccgcggttggggttgaccttacacaggatttgggccccaggccggttccgcggttggggttgagcatacacagggttcgggccccagcggga

SEQ ID NO: 98498 - DNA, 37 bp, Homo sapiens
  chr8:1140563-1140600
  hypo
cagggcactgcgagccgcctgtcgcaatcagcattga

SEQ ID NO: 98499 - DNA, 15 bp, Homo sapiens
  chr8:114444379-114444394
  hyper
ccaaccagatgattc

SEQ ID NO: 98500 - DNA, 60 bp, Homo sapiens
  chr8:114444481-114444541
  hyper
cgttcaagccctgtcagtccggtaaattgggttaacttagcaactcggtggtgcaaagcc

SEQ ID NO: 98501 - DNA, 447 bp, Homo sapiens
  chr8:114444784-114445231
  hyper
ttgcagcacttgagccgggggctgccctcctgctggcctttccgtcgtcgttgaacggatctgggggacggggacgttgcagaggagccacaatccccactcgttgtttccccaatgtgctttccgaactccccgagtgcgtcttagataagttatttgagtgaggacagcgctgcggtccgcctggagaaagggagcttcctccgcacttctacttcatcgtgacagcagtggtcgcagcgccactggccatctggagtcctgggaacattaaagcgctgttacccgccaggcgtttccgcctaggacacactcacacccaccctcggagactcctaaaggtttctccgtgtcaattcatgtgtcctcctcccagcagcacacacgcacacacgcacatcaacagccaagtcagccacccagtttcaacttcgggttgtccatgaa

SEQ ID NO: 98502 - DNA, 500 bp, Homo sapiens; identical to SEQ ID NO: 32247
  chr8:114445521-114446021
  hyper

SEQ ID NO: 98503 - DNA, 415 bp, Homo sapiens
  chr8:114446931-114447346
  hyper
tctccaaagctaaaccgattatatcagtccaaagtaaattaacgcgcctttcctttctatcggcgcatctcattcggaaaatacggtaggtgcgggcagccggggctctaattgcaggcggcgcggatcagcgttagtcaggctgtaatgctcgccccgcttcggagacttccctccccctcatctgcccccgaatgtgttttggctcaacaggtatcacatgaaaactcgcacttaaaccctggtcatcttctcacaggagccacccttacatttttctgccagggctgctgctggctattcgcgcctcccccacgcgaagcgcgcgtctagcaggcagccccagggccatccattaaccaccaactcccagtggcaggcgaactaagcataaatgtgtggctcctcacccgtc

SEQ ID NO: 98504 - DNA, 101 bp, Homo sapiens; identical to SEQ ID NO: 32249
  chr8:114447347-114447448
  hyper

SEQ ID NO: 98505 - DNA, 63 bp, Homo sapiens
  chr8:114447789-114447852
  hyper
tgttgacagccctggcgcgcctgggccaaaacagcaccccctttcccgcgatcccccgccccc

SEQ ID NO: 98506 - DNA, 849 bp, Homo sapiens
  chr8:114448753-114449602
  hyper
ctgagggggggagaacgagctgtgaatcaactcctttagtattatcagattattttatcggtgcaaattgcaaagtaagctgccagcctctctccatctacaagtcagcccacctccatccaaagcggaggggacccccaaagcagacctacctttcacacaagacaccgtcaataaaaagacgaggttccaaaacgtaaatccacttttaatccccattttcttcatcaggatgaagtctaggcggccacatttagcgcatcttcgcttgccaggctcccagggtttggattcctttgctcggctttcccctttgcggatccctttcatattattcgcgagctcctaattcctgctcctcagcccggcgcagtggagttgttgctgttgttggtgcgcggtcacagctcggagtgaatggtgtttctgggataccacagcaaccttgacgaggactcaaccatctctccaacgggggcacaaagtctccgctactctggattctgtcttttcttgtgcgttttttcccctccaccaaaatctaccccaattctggctcgttatagcaaccaccagaaaccactagtgagcctcttaaagcccacctctgctctctgataaactccacacaatatttgaaattaaggggcttgctttttttccccgaatagatcaattctgcctgtaaaagcagcccaagaaataatgttagtgagctctccgttgcaggctgcgaatacagaagcatgtcaaaggaatattttaatcggaggatctgtgttgcttttggggaaaccgtgacgataatgaatcgggctccatcgatgcccacgtcgttataatgggaca

SEQ ID NO: 98507 - DNA, 30 bp, Homo sapiens
  chr8:1148027-1148057
  hypo
gaaatgagccatggccgtggatgaggaaca

SEQ ID NO: 98508 - DNA, 29 bp, Homo sapiens
  chr8:115020800-115020829
  hypo
gcacccggcggggctcggtggctcacgcc

SEQ ID NO: 98509 - DNA, 20 bp, Homo sapiens
  chr8:115089750-115089770
  hypo
tgagtgaatgccagccgggt

SEQ ID NO: 98510 - DNA, 95 bp, Homo sapiens
  chr8:1151094-1151189
  hypo
gctgctccccgtccccgaggcctggagccgtgggaggaagaggaggatgccacggagccctgtggaggctgaagccgctgcgtagggagcccctt

SEQ ID NO: 98511 - DNA, 136 bp, Homo sapiens
  chr8:1152943-1153079
  hypo
tcccgagaagctgagcgacatcacggtttccgtgtactccggtgattgcagagttctcctcgccaccaccccatccatctgccgggcacccacatccacgccggttccgtaagctgctctccggctctcccaaatg

SEQ ID NO: 98512 - DNA, 118 bp, Homo sapiens; identical to SEQ ID NO: 41667
  chr8:1153298-1153416
  hypo

SEQ ID NO: 98513 - DNA, 219 bp, Homo sapiens
  chr8:11536805-11537024
  hyper
gaaggttctcagactcggggatgggggaggaaggggacgtttctagaagaaacttaaagggggctcgcgccgcacgactgtaggtggagggcgtgcgccgcgggacgccccagccgggtctgataaagccccgaagccgatctaaggtcaataaaccaggcggcgtcaggcttgggccgagggccgggaggagaggagagtggagccctctcaggctgg

SEQ ID NO: 98514 - DNA, 127 bp, Homo sapiens; identical to SEQ ID NO: 31777
  chr8:11537156-11537283
  hyper

SEQ ID NO: 98515 - DNA, 51 bp, Homo sapiens
  chr8:11538169-11538220
  hyper
cgccctttgcgtcagagaccccccccttggggagaccggaatcctccagcc

SEQ ID NO: 98516 - DNA, 30 bp, Homo sapiens; identical to SEQ ID NO: 31778
  chr8:11540426-11540456
  hyper

SEQ ID NO: 98517 - DNA, 343 bp, Homo sapiens
  chr8:11550025-11550368
  hyper
gaaactatgctcatgcggatctagattgaatctgatccttcgggccgcggcggctccgcctgggagggcgtggcccccgcgctggggcgggaaccggcttctggggacccgcggcctctgcgcctcagccgacctccaccgcgggtgcgtgcgggggtgcgggggtgaggggtgcggggctgctccgtcgggaggctgggagggagagcaggcgccgggacccacgcgagggcgcggacggacggggggcgggaagcgaggctgccgaggggaggaagcggggccggcgcagcgggcgccaggccgggcagaggcgggggcggccggccgggggctgaccccg

SEQ ID NO: 98518 - DNA, 82 bp, Homo sapiens
  chr8:11550619-11550701
  hyper
cccagtgtctgttaacgatgtggtgttcatttgttcctaaagagctgtaaggaagcttagaaatgattcggcaagctgggcg

SEQ ID NO: 98519 - DNA, 198 bp, Homo sapiens
  chr8:11554969-11555167
  hyper
tggggaagcggtgttcggaggggagcagcgctctcggtgggcacctgctgcagttggggagggagaggtggtcgtggaggccactttcccctccaccgccagggaagcctggtctgtctgaaggggtcctcgcctgcgccgaggatggccggacggccgggcctccggccccagcacagcccccctttcagaggaccc

SEQ ID NO: 98520 - DNA, 48 bp, Homo sapiens
  chr8:11555473-11555521
  hyper
cgcgggtgtccctaccataaccactgtcctccccgggagctgggcaag

SEQ ID NO: 98521 - DNA, 73 bp, Homo sapiens
  chr8:11558318-11558391
  hyper
attataagactctggcgaccttggtggcgccagattttttcagatgttgcttttgttccgggtgtagcggcca

SEQ ID NO: 98522 - DNA, 15 bp, Homo sapiens
  chr8:11559650-11559665
  hyper
actactaggagaagc

SEQ ID NO: 98523 - DNA, 828 bp, Homo sapiens
  chr8:11560067-11560895
  hyper
gtgctccggagaccgcttttccgcagcgccggcctccgagatccccagcaccccttcagccttaagttcccacgtttcgggtccgtggcgccaattctgctaagtagcaggctaggaattgggggaagtcggagaagaaaccctaagtgtgtcgcccccagcttccgggatgcaggcccgccggggtctagaggggcggctgccgtgcgtccagcctgtgcgcaggcctttcgccgctcggcgccccaggcagcctcagtttcctttcctctgtttgcgccccagtgaacctccgcacctctcattcagggaagagaattccccgcgcagccgcgctcgtttcttcctctgggattttcctgagaatccccaggagttggccacgatcccatggggggtttccttctacccagccccgcgtcctggcctcgtccttaacccccgggttgccttcactcaggctgggaatccacgattgatttcctactacggaagcgggtggcgttcccagcctgctttcggagcagcacgggtttcgtgcagggtgttatcccgaccccttcccccatccctctaatctggcttgagaagcccgtgctggagagaaaaacgcggccttaaaaaaaaaaaaaagtttaaccgaaagcgtgagagccacccgccggctgttatctggggctgaaggctgcggtaatcgatgggttatttttacgcggtaatagggccctgtgattgctctattaacctttagacctgtctgagggactctccggctcgcagccccgctgcgctggggcctccaggctctgacgccgactcccaactcag

SEQ ID NO: 98524 - DNA, 30 bp, Homo sapiens; identical to SEQ ID NO: 9400
  chr8:11561116-11561146
  hyper

SEQ ID NO: 98525 - DNA, 333 bp, Homo sapiens; identical to SEQ ID NO: 31787
  chr8:11561391-11561724
  hyper

SEQ ID NO: 98526 - DNA, 471 bp, Homo sapiens; identical to SEQ ID NO: 3202
  chr8:11561725-11562196
  hyper

SEQ ID NO: 98527 - DNA, 821 bp, Homo sapiens
  chr8:11562235-11563056
  hyper
cgcccaccagcgactccggggacgcagggtggcagtgccaggcagctccgctgggcctcaggggcccccgggagccgctctgaggtgcggagaggctgctgagtggcggaactattcatgccctttctggccggcctcctcgccctcggggctggggtccagggactgaatgctcctctggaagctcaccaccccacctgcccgcgctgcttctacctgaaactggccaagggcccgagcccggaccggagccgtgacttccctccgccggccacggggctgcccggatccgccgggttatgtcgcttggctttgggctcaggggtcaccgtgggcagaggggggtgccggggtcgcggactgccaccaggttgaggaaaggaggggccttttggctggggaaagagcgtggtgggggacccgcggccgatggaatccctggggcagcgcggcccgcaccgtggaggttggggaagcgcctcggggaagtgtttcctgtgttcccagaaaaggaagacaaccgagagcaggtttcaggcttttaaagaaagcctggggtgtggaggtgatgctccgcacacgtctgtgtctcctcccctgctgcggccggcttggttgtgccggctagcgtgcgaccgtcctcctcgctgcaggccgagagcggaggcgtaaacccaggccagcgaggagtgtcctataaagggacggggacttttcggcgcttgcaattctcccattctgaaaaatagatcggaagagggctattggttgattcttgaaaggggagcgcatttcctgttggcctgcgaatttggggtgaa

SEQ ID NO: 98528 - DNA, 37 bp, Homo sapiens
  chr8:115649501-115649538
  hypo
gtagacctgggctgttcctattcggccatcttggctc

SEQ ID NO: 98529 - DNA, 30 bp, Homo sapiens
  chr8:11615747-11615777
  hypo
ccaagccctcaggagcgtctccatgggcct

SEQ ID NO: 98530 - DNA, 28 bp, Homo sapiens
  chr8:116354110-116354138
  hypo
tttttttttttgagacggagtcttgctc

SEQ ID NO: 98531 - DNA, 30 bp, Homo sapiens
  chr8:11656439-11656469
  hypo
agcttagaccacagacgggcactttgaagg

SEQ ID NO: 98532 - DNA, 277 bp, Homo sapiens
  chr8:116660295-116660572
  hyper
aagaggaaatcagagcgtcaaatcaaggaggggtggcagcaaagaggaagcaaaagagaagacaagaggaaagagagtttatggagagaggaagccaatttgggaagtggggagaagggcaggctggccaggggatgcgacgcgacagggcagagggagtgggaagaagcgggcaggaggcggcctccacgcagctggcagggcaggcagcgctggagagggaggaggagagggaggctgcaggcaccgcgcagcagccgaggatgagagaggtaac

SEQ ID NO: 98533 - DNA, 208 bp, Homo sapiens
  chr8:116660615-116660823
  hyper
cgataacacgcccacagcccgggcgccgagcacgcgtggtggcggccgcaggcccggggctcctgcgagagcgaacgccagcgacacacacgcagctcctgttgtgtcgccgctgccgcctaggcagggccgcagacagcagcctccttcccagactgagccaactcactctcaccgtagctgctccagaatccgtgaaaagaaaatg

SEQ ID NO: 98534 - DNA, 170 bp, Homo sapiens; identical to SEQ ID NO: 41911
  chr8:116710279-116710449
  hypo

SEQ ID NO: 98535 - DNA, 30 bp, Homo sapiens
  chr8:116991751-116991781
  hypo
tattgcaagacaccacgatattgataattt

SEQ ID NO: 98536 - DNA, 134 bp, Homo sapiens
  chr8:11704540-11704674
  hypo
catcagccatcagcacgcacctgacttgtagagcaggaagtccgaatacacagagaaagctccctccacggggccgtttttgtagatctcggccatgatgtccttctcgctattggagacgctgtaggaattgt

SEQ ID NO: 98537 - DNA, 238 bp, Homo sapiens; identical to SEQ ID NO: 41707
  chr8:11705917-11706155
  hypo

SEQ ID NO: 98538 - DNA, 153 bp, Homo sapiens
  chr8:117065205-117065358
  hypo
ccaagaagagggttacgaatagagagaacaagaatgggatgtctttagtagagcaggtcataatctagttaacatcagaaatgagatgataaaaacgcacggcgccttgcaagtgagtgccagtggaacatgtatagacgtgcatattcagca

SEQ ID NO: 98539 - DNA, 64 bp, Homo sapiens
  chr8:11708426-11708490
  hypo
tgtggccattgttcccgtgcatcgaagcttgcaggcagcttcaggtcctcggtaaacataactc

SEQ ID NO: 98540 - DNA, 36 bp, Homo sapiens
  chr8:11726469-11726505
  hypo
cagaggggctgggttcggtggctcacgcctgtaatc

SEQ ID NO: 98541 - DNA, 30 bp, Homo sapiens
  chr8:117572696-117572726
  hypo
gaggctggtggttaccgtccttccctctgt

SEQ ID NO: 98542 - DNA, 18 bp, Homo sapiens
  chr8:117621492-117621510
  hypo
gagcgagactccatctca

SEQ ID NO: 98543 - DNA, 131 bp, Homo sapiens
  chr8:11772171-11772302
  hypo
atagatatgactccccgcatcactgggagtgtccacccctctgcgatgtggctcgtcttatcgggggtgggttggtgatatttctccccgcatcgtgggggtcgcccgccccgctgcgatgtgtatcgtaa

SEQ ID NO: 98544 - DNA, 147 bp, Homo sapiens
  chr8:117824014-117824161
  hypo
aacattgtgcactcacgttttgccaggctctgtgacaggtgttgggatacagaaacaaaagagactgtctttgactcgtaagagctcacattcctgactgggcgtggcaggagaattgcttgaacccaggaggcgaaggttgtggtg

SEQ ID NO: 98545 - DNA, 639 bp, Homo sapiens; identical to SEQ ID NO: 32256
  chr8:117950319-117950958
  hyper

SEQ ID NO: 98546 - DNA, 23 bp, Homo sapiens
  chr8:118453896-118453919
  hypo
agccaccgcgcctggccacgcaa

SEQ ID NO: 98547 - DNA, 172 bp, Homo sapiens
  chr8:1184672-1184844
  hypo
taaaattatgtcccacgagcttgactttggactgacagtgattctgttgcacgtcacaccctttctgggaactcataggtggttaggatcaagctgcctctgccttgcgcaactggggcctttcatgtgccctcaagtgagtgagttcacggcgtcacgtcaggagtgatac

SEQ ID NO: 98548 - DNA, 30 bp, Homo sapiens
  chr8:119057219-119057249
  hypo
ttgccaacctctagtcgatactatataagc

SEQ ID NO: 98549 - DNA, 37 bp, Homo sapiens
  chr8:119571068-119571105
  hypo
tacaggcgtgagccaccgcgcccggccgacactgagc

SEQ ID NO: 98550 - DNA, 63 bp, Homo sapiens
  chr8:119964391-119964454
  hyper
ggctgaggaacaaggcggctgctgtctccgcggggctctgaggtttcccggccccttcccgcc

SEQ ID NO: 98551 - DNA, 300 bp, Homo sapiens
  chr8:1201984-1202284
  hypo
actgtggtgttgtcacgtgggtgtgttgtgttgtcctgagtcacaatgtcagagtcatgtcatgtcacacttgtcacactgtgttgtcgtgtgggtgtgttgtgttgtcctgggtcacggtgtcaaagtcatgtcatgtcacacttgccacactgtggtgttgtcacacgggtgtgttgtgttgtcctgggtcacggtgtcacagtcgtgtcatgtcacacttgtcacactgtggtgttgtcacatgggtgtgttgtgttgtcctgggtcgtggtgtcacagtcacgtcatgtcacactt

SEQ ID NO: 98552 - DNA, 45 bp, Homo sapiens
  chr8:120220486-120220531
  hyper
acctgtgcacgtgatcgcgagcggctcgggcgccagggcggagcg

SEQ ID NO: 98553 - DNA, 144 bp, Homo sapiens
  chr8:1202638-1202782
  hypo
aaagagtcatggtttcgtgctctgtgctgtgtgagaggtgctagcgaggccgccgggtgtcatggctgggcagtggccatggcggccaggcaggcctgctgtcatctagagctcctgttgaagcgcggccggatgtggtgcctc

SEQ ID NO: 98554 - DNA, 45 bp, Homo sapiens
  chr8:120319364-120319409
  hypo
tcccttgcctggctcggtgggtcccacacccgcagcacagcagtc

SEQ ID NO: 98555 - DNA, 30 bp, Homo sapiens
  chr8:1203228-1203258
  hypo
gggctgtgtccaccacgcagggctgcagcc

SEQ ID NO: 98556 - DNA, 231 bp, Homo sapiens
  chr8:120428491-120428722
  hyper
ccacacacaggcacacgcaggccccggcgccgcgccctaaggagagcagcacccacagccaattgccatggcaaccccggggttcgttccacttccccacccagccgatctcccccctcctccctgcactgcagccaaccggcttgtgcgcgtcccaggagcgcgctataaaacctgtgctgggcgtgatcggcaagcaccggaccagggggaaggcgagcagtgccaatc

SEQ ID NO: 98557 - DNA, 54 bp, Homo sapiens
  chr8:120429002-120429056
  hyper
gccctccccagtgcccgggccggtgccctgcgacgccgccgacctgcgcccccg

SEQ ID NO: 98558 - DNA, 30 bp, Homo sapiens
  chr8:120429286-120429316
  hyper
ccccttcccagagggcgataagcaaataat

SEQ ID NO: 98559 - DNA, 30 bp, Homo sapiens
  chr8:1204827-1204857
  hypo
tcctgacttttcctccgtgggcctcactcc

SEQ ID NO: 98560 - DNA, 30 bp, Homo sapiens
  chr8:120525191-120525221
  hypo
aaccactcttcatgtcggtggtttggttgt

SEQ ID NO: 98561 - DNA, 30 bp, Homo sapiens
  chr8:120591921-120591951
  hypo
ctgatttgattccttcggtgaatctctccc

SEQ ID NO: 98562 - DNA, 16 bp, Homo sapiens
  chr8:120695441-120695457
  hypo
gcgcccagcctttata

SEQ ID NO: 98563 - DNA, 31 bp, Homo sapiens
  chr8:120844095-120844126
  hypo
ttcattttaaaactacgaattggggcctggt

SEQ ID NO: 98564 - DNA, 39 bp, Homo sapiens
  chr8:120845542-120845581
  hypo
tatagattacaaggccgggcgcagtggctcactcctgta

SEQ ID NO: 98565 - DNA, 198 bp, Homo sapiens
  chr8:1209060-1209258
  hypo
taggactcagcagctcgtctctgaagaagaattggctttaccatcaaattgcaatattttctttatttttgtttgttctggattgacaaatttccatcagtttctgtgaggtaacagatgctgatacaggcttgttggctttaagtgcattcgcccaaggtgccaatgagccgcaggctgagtcggatctgggaagcc

SEQ ID NO: 98566 - DNA, 19 bp, Homo sapiens
  chr8:121002670-121002689
  hypo
caggcgtgagccaccatgc

SEQ ID NO: 98567 - DNA, 23 bp, Homo sapiens
  chr8:121135619-121135642
  hypo
accgcgcccggccaattttctgt

SEQ ID NO: 98568 - DNA, 89 bp, Homo sapiens
  chr8:121135998-121136087
  hyper
aaaggcgccttgctgcggccgcgccctgtggctgaacttaggccaattccgagcgagaccgagacgcagggcggcggtgggggctggaa

SEQ ID NO: 98569 - DNA, 956 bp, Homo sapiens
  chr8:121136826-121137782
  hyper
gcatcgctgctttggcgttttagagcccttggacttgttcacaagaggaagagggagaagaggaggctcgaagggggcctttatagtggatacctgtttcactcggagctcagggtctttgacgcgggaaggcaaagtctgtcttttggaaatggggaagtgggcacacagcacctgagaacaggagggctcgagacctcccaaagagagcagggggcctggtttgggagcttgcagtagcttctgccccagtggaagggaaagagcctggctcgctctcggcgcgccacatccggctgccgcgcgcacctggggggaccgccaggttcggggtaggcgagcgcgtgagcggcacggggctggcttctccacatctccggtagggcggggatgggggagaggaggaggagagaaagtgggggcgttatgggcttaggcctgcctcccacctccccacctcccgcctccgcggccaccctccgctctataattggctgccggcgggccttcctttcctcttatctgatcctgggctcccagctggagaggcggaggcagctccagggggctggaagtggaagcgcagcggcagaaggagagggagagagaaagagagagaggctaattaaaaaaggatactccgagggaagagagcaagggcggtgcgccgccaaggaccaactagcggcggagcttcgatcttgcctaggcgcggagagctcccaacctgggctggaaccttgcccagcacaggtcagttcgtctttctctgctcttctttggctcggcttcgaagtccattcatgagcaaggaaaagtggaggcagcgagccacctgcagacgcaatgcagttccatggactttcttttcacgcgcgcgcccagaatggactggggacctttgggacgggatgggacgggtacacctggatgccttttcgcggggttcacggtgt

SEQ ID NO: 98570 - DNA, 28 bp, Homo sapiens
  chr8:121206406-121206434
  hypo
agccattcctattcggccatcttggctg

SEQ ID NO: 98571 - DNA, 30 bp, Homo sapiens
  chr8:121289793-121289823
  hypo
cagcaagaaatactacgcagccataaaaaa

SEQ ID NO: 98572 - DNA, 30 bp, Homo sapiens; identical to SEQ ID NO: 41916
  chr8:121354745-121354775
  hypo

SEQ ID NO: 98573 - DNA, 32 bp, Homo sapiens
  chr8:121479576-121479608
  hypo
aggtgcagtgactcacgcctgtaatcccacca

SEQ ID NO: 98574 - DNA, 138 bp, Homo sapiens
  chr8:121545084-121545222
  hypo
ttagcacttaaagatcgaccattctttgtaacagttgcagaatattcaagcatacctctgtaccaggatttatttagctagtgatggtcacactgactttttcaatggtcttgttgcaagcaacgctgcagagatgat

SEQ ID NO: 98575 - DNA, 30 bp, Homo sapiens; identical to SEQ ID NO: 41917
  chr8:121566445-121566475
  hypo

SEQ ID NO: 98576 - DNA, 30 bp, Homo sapiens; identical to SEQ ID NO: 41918
  chr8:121573169-121573199
  hypo

SEQ ID NO: 98577 - DNA, 97 bp, Homo sapiens
  chr8:121629842-121629939
  hypo
ttccaaaggaacttacggtattgggcttcctcgtgcattttggatgaggtgttttgttggtcagccttggtgggcataatagcgtgtccaaccttgc

SEQ ID NO: 98578 - DNA, 108 bp, Homo sapiens
  chr8:121643554-121643662
  hypo
cagcattgtccctttcgttctttgaaatctttgagagataggacaataccaagcccaacaacccatttggtgttaaatttttaggctaagacccgcgcatgatctgct

SEQ ID NO: 98579 - DNA, 54 bp, Homo sapiens
  chr8:121705929-121705983
  hypo
acctgttctcagggtcggccaaggccatactccgagtgacgtagcacattttga

SEQ ID NO: 98580 - DNA, 75 bp, Homo sapiens; identical to SEQ ID NO: 41919
  chr8:121712263-121712338
  hypo

SEQ ID NO: 98581 - DNA, 205 bp, Homo sapiens
  chr8:121717222-121717427
  hypo
ctgatagaagtatgccgttcagaaaaggagagagaagtccttctctttgcctcctcgatcagcctatacctgaagttctaacaggttagacgatgtttaaatgagggtaaagcaaatgatcagcttgttgaaaggctcaggaaataattaaaccatacattaaatgacagacattagcacaaaagagtgacgtgcataaactttg

SEQ ID NO: 98582 - DNA, 183 bp, Homo sapiens; identical to SEQ ID NO: 41920
  chr8:121732132-121732315
  hypo

SEQ ID NO: 98583 - DNA, 233 bp, Homo sapiens
  chr8:121825604-121825837
  hypo
attgatgtgtatcatcgttgaaagttctctaagtcttttagaatgactcacacttttaatcaaggaggcttaaaggctcagatgactccctaaagagcggagtcccagccaggtcaaggaatgaaatgaaaacatttggacattttcttgagaaggcggagtcactgcaggtgagagggtgccctgggttaatgcttctgcttgtagctctcccttttcgtatatttttaact

SEQ ID NO: 98584 - DNA, 25 bp, Homo sapiens
  chr8:121855050-121855075
  hypo
cgcacccggccggaaaacatatttt

SEQ ID NO: 98585 - DNA, 30 bp, Homo sapiens
  chr8:1219311-1219341
  hypo
cagaggctcctggtacggggaggatgggac

SEQ ID NO: 98586 - DNA, 144 bp, Homo sapiens; identical to SEQ ID NO: 41922
  chr8:121982491-121982635
  hypo

SEQ ID NO: 98587 - DNA, 30 bp, Homo sapiens
  chr8:122402000-122402030
  hypo
cttgatccatcacttcgggtctgaattttc

SEQ ID NO: 98588 - DNA, 799 bp, Homo sapiens
  chr8:122651726-122652525
  hyper
agtccaagtattcagcgcggacgtttgggggacggagggagaggcgctaggggaactggcacctaagactgtgtaataggacacaggtcttgcaagtcctcctccccaggcaccgcccctgtgctcccagcgcctctttgcagctttaattatcctttcagcgccgttcccccgcggctgcgtttccgtggtcagaggaaaaaggctctttcgcctcccggttctcaccctcatacagaccctcctttcagacccgccctcctgttcacagggacccatttcggagccctggctcacgctgggcgggaactgccgtgacgaattccccccaaggtgttgattatccatcccaacccagcctctggcttccctcccacctccaccccagctcccacaggcccctcgccccgttcatcggctgggcgctcgagacggcgcccccagatctcccaccgggcagtgtccccagctgcagctgaggagagaagcgccggcgtgcgcggtgccacgtcggaattggctctggggacgccgcagctgccgaagcgcagcgcgcggtccccacgcacgccctgcctccgggcggccggcgggctggcccggcgaggagaggagggatgcgcgccctcctcccgctcctatctgcgggtgccaccgcctgcgtcagggacccctggcccgagtaagcccagactgacgagcctgacactttaatggggtgcgggaagtgcaaaggaggggaggcccgggaaaggggggagtggccgagaggggatggtagctgcgaggaggtagagaa

SEQ ID NO: 98589 - DNA, 30 bp, Homo sapiens
  chr8:122653102-122653132
  hyper
tcttggtcataaagtcgtcctcagcctgtc

SEQ ID NO: 98590 - DNA, 106 bp, Homo sapiens
  chr8:122654322-122654428
  hyper
tctgccgtgggtgggcggaaaacatagaaaagtaattatatgtatatttttgctcaatctggtcccctaacgtaaacatactcaaacagcgcgcattaaaaataaa

SEQ ID NO: 98591 - DNA, 258 bp, Homo sapiens
  chr8:123695489-123695747
  hypo
gagaaatttaaagggcgagagatggcggcaggccagttgcgccgaaggtggagtgagacgaggtgatcgcgttgagggagacttgcttttcccgagtctgtcagggcaaagcatgtgtgagtttcccatggagcagaactggcctgggaggtgcggcgccagatgctagggggtgagggagaagcagtggaggaacggtcagaagagatgcatgctcccagtcaggcaaaggcagataagaggcggttgctgcaaatt

SEQ ID NO: 98592 - DNA, 347 bp, Homo sapiens; identical to SEQ ID NO: 41924
  chr8:123966045-123966392
  hypo

SEQ ID NO: 98593 - DNA, 26 bp, Homo sapiens
  chr8:124001542-124001568
  hypo
ttggataacaagtcccgtggctgggc

SEQ ID NO: 98594 - DNA, 42 bp, Homo sapiens
  chr8:12403483-12403525
  hypo
actagaatcattccactgatttccctccgccaatcaggggga

SEQ ID NO: 98595 - DNA, 105 bp, Homo sapiens; identical to SEQ ID NO: 41925
  chr8:124055130-124055235
  hypo

SEQ ID NO: 98596 - DNA, 45 bp, Homo sapiens; identical to SEQ ID NO: 41926
  chr8:124055535-124055580
  hypo

SEQ ID NO: 98597 - DNA, 142 bp, Homo sapiens
  chr8:124168256-124168398
  hypo
atggcagactctcctcgttggcactaagacccattgagtaagagctattatcctagaaagattcaagtgaaagcccctggaatttcctccttaccaggatagtaaacctggttagtaaaaagttatcgcaattatccccagg

SEQ ID NO: 98598 - DNA, 30 bp, Homo sapiens
  chr8:124169134-124169164
  hyper
tggactgtgaccacccggactcctacccta

SEQ ID NO: 98599 - DNA, 656 bp, Homo sapiens
  chr8:124172796-124173452
  hyper
ctcccggcgacctcccggctcccagacctggctgagcccggcggccgccaggggacgctgtgcccaggggttgccgccgctgccccgcaggtttcggctttttccaaattagcctagggacacaccgcgccactagccggtacagggtaccaggcccgatccccacgccaaggtggccccatcacccagacctgcccagggaagggaggtagaacaggagttgggggtgggggcggtgcagatatttcgctccgtaaagtgtctccagcttttaaagatgtatgtccccaattttccaagaccttctgagccttcgagtggaatgaaactcgaacggcttcccagctgcggcgatgaggtcccgctcctgcagaatcccggcaggagcggagactcgggaggggaccgctggctgcaggcgccctgctggagtccggaacgagggtggtcagggtcgcctccccacggggtcgcagatgagggagtggggccgcgcagggaggctcctgcaggccgtgacccccaggcctggcccgtagagagtgactgatggcgaggacccgctggggacccgagggcctcagcctgcgcctgcgccggggctccccgaccaagaccttccggcccccaggcctttgcaccggcagctctaggcc

SEQ ID NO: 98600 - DNA, 33 bp, Homo sapiens
  chr8:124185498-124185531
  hypo
ttttttttcctgagacggagtcttgctctatcg

SEQ ID NO: 98601 - DNA, 16 bp, Homo sapiens
  chr8:124193486-124193502
  hypo
gcgccacactttaaaa

SEQ ID NO: 98602 - DNA, 28 bp, Homo sapiens
  chr8:124248750-124248778
  hypo
gggtgcagtggctcacgcctataatccc

SEQ ID NO: 98603 - DNA, 30 bp, Homo sapiens
  chr8:124255278-124255308
  hypo
gttgaccaggttcagcgttctttcttcaac

SEQ ID NO: 98604 - DNA, 17 bp, Homo sapiens
  chr8:124288888-124288905
  hypo
gccgatgactaggtttt

SEQ ID NO: 98605 - DNA, 41 bp, Homo sapiens
  chr8:124374923-124374964
  hypo
gggattaaggtgtgagtcatcacgcccggccaaaaatatca

SEQ ID NO: 98606 - DNA, 20 bp, Homo sapiens
  chr8:124428122-124428142
  hypo
gcacccggccctaaacacta

SEQ ID NO: 98607 - DNA, 211 bp, Homo sapiens
  chr8:124632114-124632325
  hypo
aattgtttgggtttacgcagcccaggtaactggataatcagccttcatggaggacacagaaagtcacgtctacatgcagggcagacaggaagcttgtaaacagagagtggtacccacggtcatgtccattagcagctaatcctctgcaaggccaagagagtttgtgaaatatgttttggttccaattttggaaatacgttctttcattagc

SEQ ID NO: 98608 - DNA, 447 bp, Homo sapiens
  chr8:1246426-1246873
  hypo
aacggagaaatgtggcgtgcatgaacggacaccacgcgagatagggaggattcaggatgtgatcttatttcagcatctttataagtgatcaagtaaaagtcatataattgaagttatctaaaccccccatacaccaaatgcgtccgcttcctggtctgtcgtcctgcagcctacagaggccgcgtccttccacatgatggccccgcacctggcactgtcgccgtccctcagtggagacaccaggaagccctggatcacagtgtgacacgttctgtactggggtataaatacggtttcatggggacacacaggagggagctgagtgtgctcctctggccccggagagtgctgagaggcagcgtaccctgcagaagagtggcagtcgctgagcgtgggggacggctcagtaggtacctcggccacagtcctgcccgtccacatgtcctg

SEQ ID NO: 98609 - DNA, 43 bp, Homo sapiens
  chr8:124934797-124934840
  hyper
ctcagagaccattagcgagagaaggcagcgcctcctgctggtg

SEQ ID NO: 98610 - DNA, 30 bp, Homo sapiens
  chr8:1251266-1251296
  hypo
gaggaaggggtggggcgcggtggctcacgc

SEQ ID NO: 98611 - DNA, 70 bp, Homo sapiens
  chr8:1251700-1251770
  hypo
ccattaggtttaatgcgttatttattttatttttaaaggtgtaactctctcttaacggagaatcagtaga

SEQ ID NO: 98612 - DNA, 209 bp, Homo sapiens
  chr8:125184265-125184474
  hypo
ggggggggggggtacctgaaagttgccaggtggaggtcgttaaggggaagctgttaactgaaaatgctatataaactacacgctgtttgcaggccgttgtgtttttcctgcccagcctgccaccactggcctggatataaggtggatatcttgtccagcccggtgccactggactctctcccctgtatgtaagccgctaataaaaccct

SEQ ID NO: 98613 - DNA, 97 bp, Homo sapiens; identical to SEQ ID NO: 41929
  chr8:125452302-125452399
  hypo

SEQ ID NO: 98614 - DNA, 36 bp, Homo sapiens; identical to SEQ ID NO: 41930
  chr8:125452639-125452675
  hypo

SEQ ID NO: 98615 - DNA, 30 bp, Homo sapiens; identical to SEQ ID NO: 41931
  chr8:125568984-125569014
  hypo

SEQ ID NO: 98616 - DNA, 30 bp, Homo sapiens
  chr8:125574006-125574036
  hypo
tagtgaagcacacagcggggaagaggagct

SEQ ID NO: 98617 - DNA, 30 bp, Homo sapiens
  chr8:125576743-125576773
  hyper
gcggcagttggggaccgacagtaaagctca

SEQ ID NO: 98618 - DNA, 51 bp, Homo sapiens
  chr8:125580647-125580698
  hypo
gtacagaatcggccacgttcttcaatcaaagccttccggacagcctgcttt

SEQ ID NO: 98619 - DNA, 30 bp, Homo sapiens
  chr8:125618670-125618700
  hypo
caagcccctgcaccccgccaaaagtaggta

SEQ ID NO: 98620 - DNA, 135 bp, Homo sapiens
  chr8:125672489-125672624
  hyper
aaaagcacaaacacccgtttgagtgatctggaataggctgtgccacagaaacaggggcccttcgaaagaagcagcactttatccaaaagaaagtaaacaagggagggtgggggcaaggaacgaatggcactagtt

SEQ ID NO: 98621 - DNA, 229 bp, Homo sapiens
  chr8:125680483-125680712
  hypo
gcacaatcagttccacgtgccctgtcttgttaggcatgttttgttcaggccctaaccctaccaatgtgtgttcatggagagtgatgctgtggacaggaggtgtcaccagatctgcttcatccaacagacagacaaagccaggtttccatacctcagctcacatctacggcaggaattcatcctgtcctagctccgtttgaaaacccgcctttctcgttcatgcccctac

SEQ ID NO: 98622 - DNA, 36 bp, Homo sapiens
  chr8:125682702-125682738
  hypo
gttagggactcctgacgtcgtcgtacttgcaaagga

SEQ ID NO: 98623 - DNA, 24 bp, Homo sapiens
  chr8:125739302-125739326
  hyper
cagggtgttgttccccgcccccac

SEQ ID NO: 98624 - DNA, 30 bp, Homo sapiens
  chr8:125740333-125740363
  hyper
cggggtgcaccagaccgactgttctctgcc

SEQ ID NO: 98625 - DNA, 161 bp, Homo sapiens
  chr8:126044592-126044753
  hypo
tggtggccaatcaaccgggtcggtcggttttcggcagaccattcctgcaagggaacaagttgcaacaccatatgaagtacttgccttcagcaacattcattaaataccaacgctgtgaaggtcaaaatgtttggggcccatattctcgctggcagatgata

SEQ ID NO: 98626 - DNA, 30 bp, Homo sapiens
  chr8:126079019-126079049
  hypo
cctcctcaccaaagacgacttgatattctt

SEQ ID NO: 98627 - DNA, 30 bp, Homo sapiens
  chr8:126156768-126156798
  hypo
gtgctacataaggaccgtattgctacaggc

SEQ ID NO: 98628 - DNA, 121 bp, Homo sapiens; identical to SEQ ID NO: 41932
  chr8:126267003-126267124
  hypo

SEQ ID NO: 98629 - DNA, 61 bp, Homo sapiens
  chr8:126284144-126284205
  hypo
tggggattattgctccgtttttcaggtgggaaaacccagagatattcggtgacttggccaa

SEQ ID NO: 98630 - DNA, 140 bp, Homo sapiens
  chr8:126400836-126400976
  hyper
acagtctttcccaaacgaatagtggacagaacaaggctttgggggctggagtcccagactggagctccgcccgctcccctccccccaccccttccccgagccctgagaccgtgagactatgagaacgtaggattccatct

SEQ ID NO: 98631 - DNA, 149 bp, Homo sapiens; identical to SEQ ID NO: 41711
  chr8:12671777-12671926
  hypo

SEQ ID NO: 98632 - DNA, 385 bp, Homo sapiens
  chr8:1269154-1269539
  hypo
atccgtgtgcctctgcgtgtgtgtgggcatccgtgtgcctctgtgcccaggcatccatgtgtctctaagtgtgcacatgcatctgtgtgcctctgtgtgtgcgcatgcatccatgtgcctctgtgtgtgtgtgcatccatgtgtctctgcatgtgtgcatgcatccgtgcccgtatgtgtctgcgtccatgtgtctctacgtgtgcacgtgcatccatgtgcctctgcatgtgtgtgtgcatctgtgtctctgcatgtgcacgtgcatctgtgccatgtgcgtgtgcgtgcatctgtgtgtctctgtgtgcatctgtgtgtctctgcgtgtgcgtgtgtgtctgtgtgtctctgcatgtgcttatgcatccgtaccatgtgcgtg

SEQ ID NO: 98633 - DNA, 27 bp, Homo sapiens
  chr8:127089268-127089295
  hypo
atcctgggcccggcacggtggctcaca

SEQ ID NO: 98634 - DNA, 99 bp, Homo sapiens
  chr8:127305215-127305314
  hypo
gcctagccgaggagcaggtgtccctaagaacccaaatattccagctgcaaacgtatcaacaaaaacagtctcattgcacacatacggtaggcaaaatgc

SEQ ID NO: 98635 - DNA, 233 bp, Homo sapiens
  chr8:127518583-127518816
  hypo
cttcttgtgcaggtccgccagtcaaatccagcagactgcaaaaatactagactttctccactgaagagtcaggtaatgccagaagagtattatggcacagcaatactcctcagagcaaacgttggcttttcagctaacttagaagttccctggaaaatgcttcttaagccttagagaagagagacagtctttttcatataacatagccaaaccaagggcgtgacactccgtca

SEQ ID NO: 98636 - DNA, 112 bp, Homo sapiens
  chr8:1276830-1276942
  hypo
cttaaatttagtgatcgtcattattcattctttttaaaaactcgtagtaaagacagaacaacaaccacagcaaaatgaactaagcttcccataataacgggagacggcggaa

SEQ ID NO: 98637 - DNA, 30 bp, Homo sapiens
  chr8:12777147-12777177
  hypo
cctcatgtccgtgtccgtcatgaaggatgc

SEQ ID NO: 98638 - DNA, 30 bp, Homo sapiens
  chr8:1279525-1279555
  hypo
ggctagtgggcaggtcgctggcctttccta

SEQ ID NO: 98639 - DNA, 68 bp, Homo sapiens
  chr8:12808843-12808911
  hyper
ttaagtgagaagagccgcgctaaagccaagcgtcgtcgtcacccaaggtactgcgctgatgcgctgcg

SEQ ID NO: 98640 - DNA, 152 bp, Homo sapiens
  chr8:12809647-12809799
  hyper
agcgctgtgactactcgcaacgggagagctgctgccagtcgccacaccgtgcggaaagcgccggcgaccggagcactgacaatggtctgcataggggagcggagagaagcttctgttgcgccctagatccgctgcctcggcgcccgcccgca

SEQ ID NO: 98641 - DNA, 42 bp, Homo sapiens; identical to SEQ ID NO: 41671
  chr8:1281668-1281710
  hypo

SEQ ID NO: 98642 - DNA, 30 bp, Homo sapiens
  chr8:12826740-12826770
  hypo
tactgaaaggcccaccgtctcttcattaca

SEQ ID NO: 98643 - DNA, 86 bp, Homo sapiens; identical to SEQ ID NO: 41712
  chr8:12831656-12831742
  hypo

SEQ ID NO: 98644 - DNA, 45 bp, Homo sapiens
  chr8:1284619-1284664
  hypo
cctcgtctttacagacgtccgttatgaggacgttccagtgtgcca

SEQ ID NO: 98645 - DNA, 80 bp, Homo sapiens; identical to SEQ ID NO: 41935
  chr8:128745542-128745622
  hypo

SEQ ID NO: 98646 - DNA, 29 bp, Homo sapiens
  chr8:12881832-12881861
  hypo
tgagccaccgcgcccggcctgttcctttt

SEQ ID NO: 98647 - DNA, 41 bp, Homo sapiens
  chr8:128861840-128861881
  hypo
aaaagagaaagactgcgtgcatgtgcatgggtgcacagcct

SEQ ID NO: 98648 - DNA, 39 bp, Homo sapiens; identical to SEQ ID NO: 41936
  chr8:128864120-128864159
  hypo

SEQ ID NO: 98649 - DNA, 176 bp, Homo sapiens
  chr8:128872283-128872459
  hypo
ggctgcggctgccagcggtgatgagaactgatgacactccagggctaccaggaacggtgtgtgtgcctctgggcagggccacttcctagaaccatggggctgctctgtgaagagaaccggctcccagtgagctccaggagacgaggagcaggtcctggtggcggaggtgctggcgc

SEQ ID NO: 98650 - DNA, 162 bp, Homo sapiens
  chr8:128882652-128882814
  hypo
tccccagaactgtgagagagtgcatctgctgatgtaagccacccagtttgtagcaatttgttatggctgccctcagaaactaagacagtagccaacacagaaccaaataccctttggggattgagggaagtggagcgggagaatgagcggcactccctccct

SEQ ID NO: 98651 - DNA, 488 bp, Homo sapiens
  chr8:128888909-128889397
  hypo
tgtcctctaagcaggcggaggagggaaccatgtcagctcctaggtgcccccagagcacctgctgccagttttccacaactcctgtcctccgtggcgcttgggtgacagcagagcagagccgatgtgcctgctcctggtcatgggctgttcgtgctgtcatcgctttcatttgccccatccccccaatttggacttacccagaatccttgggcaagctagatggctgccaaagtttacttagcgagatgtgcctgcgtgacttgagtagagacctgcttctgagaaagtcagaagtgcattccaaagtcaggagcgtgacctccccggaagcccagctaatccaggttttaaagaggagttggaacaaaggtggtgcttatgggatgtatggagctgtgggatgtgggagaggacaggtttagcagagtggcgtggtggaaagtttcctctcgccgaggaggacaactccccagcgcctgagacagcgg

SEQ ID NO: 98652 - DNA, 30 bp, Homo sapiens; identical to SEQ ID NO: 41939
  chr8:128931231-128931261
  hypo

SEQ ID NO: 98653 - DNA, 35 bp, Homo sapiens; identical to SEQ ID NO: 41940
  chr8:128962506-128962541
  hypo

SEQ ID NO: 98654 - DNA, 30 bp, Homo sapiens
  chr8:1290508-1290538
  hypo
gtcccacagatgatgcgtttaatttgtgat

SEQ ID NO: 98655 - DNA, 209 bp, Homo sapiens
  chr8:129069803-129070012
  hypo
cctggcactggctgacgtgggaggtacagaatgaggtgtccgtccctccaaggcacggtgacctagaatcccactgctcactgcctgtctctgttcagcctttcagttcataaacatgctttcctccctgcattttgacatccatcatcgtttaaattccaggtcgtcatccttgtagaacgaggttcggatctcggcattaaatctcc

SEQ ID NO: 98656 - DNA, 91 bp, Homo sapiens
  chr8:129355798-129355889
  hypo
aatgcctcagttgctcgtttgtaacacagaactaaaaaagccaacatttatagaagtattgtgagcatcaataataataagaatagttggg

SEQ ID NO: 98657 - DNA, 141 bp, Homo sapiens
  chr8:12949878-12950019
  hypo
ggaaaaggatcagttcgatggattttgtctgtgggggttaagtccagtgagactattttctcatgcacgccaacagaccagtctcaggtatgtctttattagcggtgtgagaatggactaatatagcggtctaaccttctt

SEQ ID NO: 98658 - DNA, 108 bp, Homo sapiens; identical to SEQ ID NO: 41714
  chr8:12952416-12952524
  hypo

SEQ ID NO: 98659 - DNA, 90 bp, Homo sapiens; identical to SEQ ID NO: 41715
  chr8:12956998-12957088
  hypo

SEQ ID NO: 98660 - DNA, 66 bp, Homo sapiens
  chr8:12957529-12957595
  hypo
cacccgcttgttgcacgcactgaggctccgggtcctcgtaacagggctgggcgtgctgaccgcgct

SEQ ID NO: 98661 - DNA, 330 bp, Homo sapiens
  chr8:12989381-12989711
  hyper
gccccaggggctgtgcgctgaaggacgctcgcggacgcagcaaactacacgcagcagggtgctgcagagaggaggggtgcacctccttcggagggatcaaaggctcgccccaggactctggaggtggggacagcgacatggagtgggggcaggcttccaagaagctgtcgccttgttacgaaaatagtcgggtcgggaggcgagcttccttcctctctccggcccaggaactcgctcctcggcctccttgtccgggtcaagggggtgggcatccccaagggggcatttcagggacacgattcagcgacccatctccgggaaaaaaaccaa

SEQ ID NO: 98662 - DNA, 113 bp, Homo sapiens
  chr8:12990035-12990148
  hyper
gacaggagatcagtacgagcgcagagcagtccccagaggaaaggaaggtagaaggcggtgtcgccgcgcccctcgagccagagccgcgagcccccgcccggctcaaggaggaa

SEQ ID NO: 98663 - DNA, 838 bp, Homo sapiens
  chr8:12990499-12991337
  hyper
aggcggcggcggaagcgctgtggggaagtcgaggcaggcggaggcggctcggcttccgcgtcgggacccacggcggcacccgagacgcgcgccctcgcggtcctcaacgcatccttgctcgccgctccctgcccctcgtcacggccccagaaagaaagcggggttttctaaagatcgaaacgagggagcgctcagggagttgggcgagaagtccgtgagccggcgctcctgatgcggagaggtgcggccatgtcctggctgggagcgaagcgccctcgctcgggcagtcggagcgaactgtctcccgcgcgctccgccagccgggccctcccgctgggcccaccccccgaggggcggggccagagcgggcggcaccgcctcctccccgctgtctgggtcgcaggccttagcgacgggctgttctccggccccgccccattcccaggctccgccccccgcccctcttcctcgtggccgcagcctcaggccgccctctagccccgccccgcccaggccccgcctctcctctgtcccgccccctcggttccctcctcccccccgccccgccccgcgcctcctccgccgaaggctggaatgtttcccccacgggcctccacgttcccagcgggaagcgccgaaaagtcgccaactattggccccgggtgcaaaggcaaaggtcacaaggcatttacttggcggaggtgtccggcctggaccctagtgtgccttgagcgtcccttctttttcttggtagctctgcgtactttttacctgtcttttatcctggcgggaaccacgtaaatttgcgggaacggaggggaagcggagaggaagggat

SEQ ID NO: 98664 - DNA, 88 bp, Homo sapiens
  chr8:13003417-13003505
  hypo
tctagttcttcattgcgtggtgggttaatggtgttgtattattgtgcctcataatgtatatatcatagtctcttaaaatatactgtag

SEQ ID NO: 98665 - DNA, 30 bp, Homo sapiens; identical to SEQ ID NO: 41942
  chr8:130080387-130080417
  hypo

SEQ ID NO: 98666 - DNA, 186 bp, Homo sapiens
  chr8:130116277-130116463
  hypo
tgcggtcagtgcacacgagaggcactaaagtgaggtggcagcccaaactcggaagagtttgaccagcccaaaccctgagggaattactcatgcctcatctatggtgcctctgtgagatccatgaggcctgcggccacttttctctaacttttcattctgtcttcggtgcctcgcacatttcttggc

SEQ ID NO: 98667 - DNA, 162 bp, Homo sapiens
  chr8:1302664-1302826
  hypo
cgagacactgtctcagaaaaaaagaaagaacgaaaagaaaataccttggaatgaaagactgtggggccattaagatgatgctgtgggtgaaggtggaaagtcacggatgatgctgcggatgaaggtggaaagtcacggatgatgctgcggatgaaggtggaa

SEQ ID NO: 98668 - DNA, 203 bp, Homo sapiens; identical to SEQ ID NO: 41944
  chr8:130288699-130288902
  hypo

SEQ ID NO: 98669 - DNA, 30 bp, Homo sapiens
  chr8:130305961-130305991
  hypo
ctggggtagggtggccgggagcagtggctc

SEQ ID NO: 98670 - DNA, 30 bp, Homo sapiens; identical to SEQ ID NO: 41673
  chr8:1303386-1303416
  hypo

SEQ ID NO: 98671 - DNA, 209 bp, Homo sapiens; identical to SEQ ID NO: 41945
  chr8:130368840-130369049
  hypo

SEQ ID NO: 98672 - DNA, 89 bp, Homo sapiens; identical to SEQ ID NO: 41946
  chr8:130369289-130369378
  hypo

SEQ ID NO: 98673 - DNA, 30 bp, Homo sapiens
  chr8:130381962-130381992
  hypo
gtgagccaccgcacccggccaacagagcct

SEQ ID NO: 98674 - DNA, 35 bp, Homo sapiens
  chr8:130461171-130461206
  hypo
caggcgtgagccaccgcgcccggccaggaatctgt

SEQ ID NO: 98675 - DNA, 30 bp, Homo sapiens
  chr8:1305031-1305061
  hypo
aatgaggaaacacctcgtcttcagggtgtg

SEQ ID NO: 98676 - DNA, 201 bp, Homo sapiens; identical to SEQ ID NO: 41948
  chr8:130583277-130583478
  hypo

SEQ ID NO: 98677 - DNA, 75 bp, Homo sapiens
  chr8:1306799-1306874
  hypo
gtgttgagggttggccgtggtgaagaaggcttctgatgggcaaagtgtctttaggagaaacgtgttatccccact

SEQ ID NO: 98678 - DNA, 142 bp, Homo sapiens
  chr8:1307773-1307915
  hypo
agaggctgatgctgtcggcggctgtccctgtgggtgatgcggtggcgctggcagatagccatcccctcccaatcccacggtagacgctggcctcagctcttataaaacccgcgcgttccctgcgcagcgtgggactgtggat

SEQ ID NO: 98679 - DNA, 47 bp, Homo sapiens
  chr8:1308321-1308368
  hypo
gtgcataagggttagcgactcctgctgcttcccgggtgtgctcaggg

SEQ ID NO: 98680 - DNA, 30 bp, Homo sapiens
  chr8:131046198-131046228
  hypo
gagtctctgttctgccgtgaatgtctccag

SEQ ID NO: 98681 - DNA, 30 bp, Homo sapiens
  chr8:131278061-131278091
  hypo
gaagagccaagactgcgccactgtactcaa

SEQ ID NO: 98682 - DNA, 568 bp, Homo sapiens
  chr8:13133827-13134395
  hyper
agtccctgatgtgatcgctaaaggacctccggagaggggctcgcagggggcgcgccatcacgtgggccttggggtcccccatccgctcgcagacgccttcagcgcagcccgggcgccgcgaccatgcctcggtactccgccccgcgctgtgctcccggccgcaggctgtcgcctgccttcaggaggccggcattgcggctggcactgcggccccgggaagcgccaactgcaggcggcctcctggcccgcggccaagcgcgcgcggcggccacatctggaaagacttaccctgcgccggcgacaccctcgcggggcgcgcgagctgcagcacagctatccggaggcgtctcgcttcctgtgcaacccaatgactcacctgggtccgcgccgggctgctcctgggtcacatagcaggtcttcccttcaggggcagtccaggtgacctcgcgttttcaaagggaaacgcagcgccgcaggcaagcacgcaggggaggtgggagggtggggctggcaggtggccttgtctttaactttcaaggttgattctcaagaacgtttgcattttagt

SEQ ID NO: 98683 - DNA, 1028 bp, Homo sapiens
  chr8:131455184-131456212
  hyper
cacccccttccctttcgtttctcttcttttgctttaggcaagtggcctggggcctgccaagcagcgccgggtccgggtaggggccgggggccgcggggaactttcctcggctgcaccagagacaatgccgggagggcgccccatcggcggggtccgggccgccaagcacgtcgtcccgggccctcccccggagggggacgcgaaaccccccagggcgggccccgtccccggccccactgcaggggccccctctcccgagctggaggcgaggagacctcccccccccaccgggcggcctcgcccggccccgcagagcctggccgcgcgtcccgcacacgccccagcccagggccggcgccctccccgcggagaaggacaccccgctgcgagaggagccgggagcccgccccgcgccccgtcccggcgcccttcttcgcgcgagagactgggcagggggcgcccgcgactgtgggcgactccgcccggccccgccgagcgcgcccgagcgccccgcaactcaccgggacctggcgggccgctgggcattattccatcgcgggttcggccgggcgctcgcggctctcgggtgggaaagcgaactgcgaccgggaagcgccggctgggcgggaggcgcgggcccggggctgcccagcgcacagtgctcgcccgcggcagcggccaggccaggcgaggcgcgggagccgagcgcggcgcaggaaggggcgggcgaccatgtgccgagggggaggaggccgcggcgacgcgagcggctcgcacgatcccgctcggcggcggagggcgcgggtttcaggaaatccaaacacttcgacaggaaatcggaatcctgactaagcattcccggccccgagccgctccgcgccgggggctcccgcctcgcttaacccttggcccgccggcagccacgaggggggcgtgggaggggccccagacctcggccggggtcgggcgtccttcgccttccgccccatgccccggccggccggcctcctccccgcctgaggtggaag

SEQ ID NO: 98684 - DNA, 18 bp, Homo sapiens
  chr8:131922190-131922208
  hypo
tttttttttttgagacgg

SEQ ID NO: 98685 - DNA, 397 bp, Homo sapiens
  chr8:132051903-132052300
  hyper
tcactacctcaatgccggtgaagaagcccagcaggatgcccttgagcgggtccatgggggccgaggccaggctcaagtgtaggaccaagagagtgagtttggtcagcacgtccagcacgttcatcaccacttccgatttgcgcctttggcccaagaaatagcgctggtagaggcgttccaaatcccgagatttgaaggagttgcgcagggtggggaaaatgacccctcggtagctatagcccccattaagaaagaaatccgagttgctaggggcacagtcaaggtgcaggaagcccaggtcgcccccgcctccgctgccgctggcactgccgctcccgctgcgttccgggaagactttggtgccgcaggtgctgtgcgctcgctctcccgggcccag

SEQ ID NO: 98686 - DNA, 118 bp, Homo sapiens; identical to SEQ ID NO: 3368
  chr8:132052398-132052516
  hyper

SEQ ID NO: 98687 - DNA, 1995 bp, Homo sapiens
  chr8:132052589-132054584
  hyper
cgcagggaaggaggcccagaaccttggggaggcagccggaggaggggttcctaaagactcaaaggcggcctggtaggagcttggcaaggatcctttttatcctaggctgccccgttgcaggagccctgcgctagggctccctgtaggtcgggtcatactgtgcccaggggcaaagggcacctggaagatcgcggcggacctcggcgtccttgcgtgctgctctcccgccagccggcgcagcttgggtacgcagcggcagtggctatttgtcctcaggagccgcagcgctgtgagccacgcagccccttcctgggctcaggctccttggttgattctaggctcagcgttttggcgcagcctttgctctccaagagacgcctaagcgcctgggcgccgtgcttctgctgcgcgtcgggcgggtcctggctgctgcactgggctttggacgcccactgctccgcggctgcagggggcctggccggcggtgaccggcggcagcgatgggtgcgaagttagcagatgtggctggaatcatcgcccttcggagaactccattgcgccgggatggggagcaggggcggagctgggggcgggggcaaagaaggaggaggagggggtcacggtgaggtggcggggcgccccgcgacagggttggagaggtggtagcctcggcgctaacaattcaccaaatagttaatttggaggaaggggtatgctgaggctccctcctaggctctttcctagttcgggagcaaggactgacagcgcagcgctggctctggccagaagcatccctcccggagggggtgtggggactctcgctccagggtcccagcctgagctataagacgaggtcaacgctttcagctgtgctttcgaagggtcgcagcacacagttctcatcccctttatttcgttctttggagtccatttggctcggagctaggaggatcaggagaggcgggggaaggaaaaagtggtgagggctccaaagccaagagctccgagaacgaagagaagccgccggtgcggatatctgaggctgagaaccgaagcttggcggatgaggcgaaggtttggaggagaagggaggcccgaggccgcgtggaagtcgacagagacgcctctggatctagggaagcgccgccgcgtgccaccctggagctctgaaacgcaccgcgggcgccaggcgactgggagaaatttggagacctgtcagagtggtcagacacccgcggtgacttaaacccgcccccgcgccaagccacgcccccggaaccgggccgggggtggcggagggacctgccatccagatctggccaggacgccccaggtcttgtaggcagaggcacgcgcgggccggcgtgggagaggaccactgagggctagggccggcgggcgcccccggccttccctgggcgcactgcgatccagcgttccagctggccgcgccagccggttcctccgctgttcttttttaggcattggctcttgtcctctgcaggtgcggagccaggactcgtaggccgctttgcgcacggactcggagagcccagcgcgacggaatacagggtttccttttcgcccttcctacccgtgcgtcttttggcaaagccaactttcgggctaaacgcaaaatcccccaagaggccgcaatcatagaggcagtcagtttcctacaggagcctctttactacctcgatccgaagggggtggagggtacgggacatcaaaatggggacgtcccctgcctgcctcgcacactaagtttctccgcttacaatagggtcgaggaggcggacgtggagaaaggcatgtccaggggccccgcctcgccctagcccaggtttcccgcccgcccagactcagccgagcgctagcggacaaagcctgcggcggagcttgcggcggaccaagtcgctgagcggtgggagcttagtgccggtgctaatgacagatgagccgcgtcccggggtgcagggtctgcagggcaaa

SEQ ID NO: 98688 - DNA, 205 bp, Homo sapiens; identical to SEQ ID NO: 32274
  chr8:132054593-132054798
  hyper

SEQ ID NO: 98689 - DNA, 30 bp, Homo sapiens; identical to SEQ ID NO: 41950
  chr8:132284091-132284121
  hypo

SEQ ID NO: 98690 - DNA, 192 bp, Homo sapiens
  chr8:132480519-132480711
  hypo
caaatcactccaaaacgtagtggctaaaaataccgatatattattatctgtcatattctgtggattgtctggaatacgatggatggctcttgcttctagtcttttgttttgctgtgacaagtggtagcttcagcttatctgtaaaataatgccaagtacctatgtcataggttgttgcgaagcttcatgagt

SEQ ID NO: 98691 - DNA, 30 bp, Homo sapiens
  chr8:1326091-1326121
  hypo
agctgatggagttcacgcacccctgtgcag

SEQ ID NO: 98692 - DNA, 52 bp, Homo sapiens
  chr8:1326776-1326828
  hypo
cacctgtctgtcctgcgcacacctggcctcatctgtccgtcctgcacacatg

SEQ ID NO: 98693 - DNA, 30 bp, Homo sapiens
  chr8:1327435-1327465
  hypo
cgagggccacatcttcgctaagtcaccagc

SEQ ID NO: 98694 - DNA, 30 bp, Homo sapiens; identical to SEQ ID NO: 41951
  chr8:132783128-132783158
  hypo

SEQ ID NO: 98695 - DNA, 212 bp, Homo sapiens
  chr8:132823274-132823486
  hypo
tctagggcaataccacgggacatttgttccactccagtttcacatttctacaaggaagcatccgactggctcagctttgattactgtatgcaatagactgaatgtttatgtccccaccccaaattcatctgctgaaatcgaatccccattgtaatggtatttggacacagggcctttgggaggtgactgggtcatgacggtagagtcctcat

SEQ ID NO: 98696 - DNA, 50 bp, Homo sapiens
  chr8:133062815-133062865
  hypo
cactttcctacatgccggctgtgagacttcgggcacgtgttctttcctcg

SEQ ID NO: 98697 - DNA, 24 bp, Homo sapiens
  chr8:13319913-13319937
  hypo
tttttttttttgagacggagtctg

SEQ ID NO: 98698 - DNA, 16 bp, Homo sapiens
  chr8:13320204-13320220
  hypo
gcgcccggcctactat

SEQ ID NO: 98699 - DNA, 199 bp, Homo sapiens
  chr8:133337370-133337569
  hypo
ataggctggctttctcgagccttgtcctggggtcctggcggtgtggatggggaaagacagttagtcagtcaataaaaggaaagaaaaccacctaatcatgagagctgcagatggacttcataaaatgttggactcacgggatgcaggagagagaagtgtgttgggggtcaagagagctgggttccgtccagggtctaat

SEQ ID NO: 98700 - DNA, 30 bp, Homo sapiens
  chr8:133412585-133412615
  hypo
gtggaaccccagggccggcttttcacacat

SEQ ID NO: 98701 - DNA, 371 bp, Homo sapiens
  chr8:133492260-133492631
  hyper
gacgggctggtctccccttcagcgggaaagcatccatgggtcttaaagccccagagacttctcagctccagccccgaccccaagtccccaagcgcgccgccgccgagggcgccccgagcggccgggtactcacaccaacgcgtggtaaagcagcgcccagccccgcggtctctccagggcgtcgtagatcaaagtttggatgcgccggtacttggcgttgtttctcttgactgggcggctcagcggggtcttggccaggagcccgatgccctgcggggtcctccgctgcccctcgtcgcggccgccgccctccagcagcagggtcccgtctttgtcggctccggccccgagcgccaaggtgacttgctcca

SEQ ID NO: 98702 - DNA, 473 bp, Homo sapiens
  chr8:133492712-133493185
  hyper
cgcctccgccgcccccgtcgccgccgccgccagccgcccccgccgccctgcgcgccttgagccccatctgcctcgcccccgccggccgcttcgccttctccgctgctgctctgggaagaaggggcgctcggggtgcgtgaacgaggcggcggcggcggctgcaagcccgggaactccaatgccatgatccgcgcgcccctccccacccccccccaaaagcaggcaaaggcgggccccctggggggcaggggaggccaggcagggggtcagggggtcacatcccgcgcgggtcagccgcaggaccccgagggtcgcgggccgggggctgcggagaagctgggagggcgcgcgaggctggcgcggaggcgctagggcgcgcggcggcgggagcctggaaccggcgctccggggcggcggcggcggcggcggcacccaggccggcgagcccaagacagcatcgcagtttatttaca

SEQ ID NO: 98703 - DNA, 257 bp, Homo sapiens
  chr8:133493495-133493752
  hyper
tgcaaccaggcagtgcgccaggcggctgcagagcccggctcctggagctcccgtgggcgttggggcttcccctggatggggcgtgacggcgggcagttgggggaagaagaggaagggaggagggactggggggttgtcgcccaccaaacattggctctgtggttgcagctttgtgaatttccctcaccccctacccctgctcctcggcttcagaggtaaaagccaagttgtcgggttggtcaaggccgggcgcaccg

SEQ ID NO: 98704 - DNA, 92 bp, Homo sapiens
  chr8:133686745-133686837
  hypo
tggggagctcaaaaacgttgtcgatatcaaaatggttcatacaatataaataacttacccgcatcaccttgcagtttgttagtatattctta

SEQ ID NO: 98705 - DNA, 31 bp, Homo sapiens
  chr8:133687137-133687168
  hypo
caaacaaacaaaaacacgtttataacactta

SEQ ID NO: 98706 - DNA, 30 bp, Homo sapiens
  chr8:133728335-133728365
  hypo
aggtgcagctgcagccgctcagccatggct

SEQ ID NO: 98707 - DNA, 132 bp, Homo sapiens; identical to SEQ ID NO: 15163
  chr8:133811037-133811169
  hypo

SEQ ID NO: 98708 - DNA, 30 bp, Homo sapiens; identical to SEQ ID NO: 41675
  chr8:1340176-1340206
  hypo

SEQ ID NO: 98709 - DNA, 30 bp, Homo sapiens
  chr8:134018690-134018720
  hypo
gagaactacgatggacgggtaagaatcatc

SEQ ID NO: 98710 - DNA, 30 bp, Homo sapiens
  chr8:134215121-134215151
  hypo
cagaggcacccgatgcgctttgaaacaagc

SEQ ID NO: 98711 - DNA, 85 bp, Homo sapiens; identical to SEQ ID NO: 31798
  chr8:13424168-13424253
  hyper

SEQ ID NO: 98712 - DNA, 52 bp, Homo sapiens
  chr8:13424344-13424396
  hyper
cgttgccaagacagctgggaaggcgtctcccggaagacgacctccgcagagc

SEQ ID NO: 98713 - DNA, 30 bp, Homo sapiens
  chr8:134262730-134262760
  hypo
ttcacaatgtgctggcggtaggtgtggacc

SEQ ID NO: 98714 - DNA, 179 bp, Homo sapiens; identical to SEQ ID NO: 41955
  chr8:134470121-134470300
  hypo

SEQ ID NO: 98715 - DNA, 110 bp, Homo sapiens
  chr8:134471909-134472019
  hypo
tgcccctccaagctccgggatggaacggctccagcaagatgctggggctggaaatgcagaggtgtgacagtgcgtccatcctcagcccttcactgcgtcatctccccttg

SEQ ID NO: 98716 - DNA, 67 bp, Homo sapiens
  chr8:134519862-134519929
  hypo
atgaagaaaagaagacgtattgtttctttcttctccaggccagcccaaaggacgagcaggaaacctg

SEQ ID NO: 98717 - DNA, 59 bp, Homo sapiens
  chr8:134521601-134521660
  hypo
ctagggccagacagacgtgggttccacccttgtgtttcacttgacgggagactctgagt

SEQ ID NO: 98718 - DNA, 30 bp, Homo sapiens
  chr8:134525332-134525362
  hypo
tgtcctcagagaacacggtcatcaatgtca

SEQ ID NO: 98719 - DNA, 63 bp, Homo sapiens
  chr8:134541589-134541652
  hypo
tgggagcttataggtcgaaggtgctgctaccgagcaaatgtacaaggtcgtaaaactcaggac

SEQ ID NO: 98720 - DNA, 250 bp, Homo sapiens
  chr8:134545088-134545338
  hypo
catgctcctccccagcgtggagggggtgatagtttggggacgagaagcatagctttggagggctaacttctgcttcactccttctctcactctttcccatattcattcgttgaaaccactaaggtactaattaagtgccgggctggagctgaaggagtaggtataaattaattagtctttcttgactacgtttccttcagaggaattactcaggggccatggttctctgaatttccgctggatgctggaa

SEQ ID NO: 98721 - DNA, 30 bp, Homo sapiens
  chr8:134566350-134566380
  hypo
tttagggaataggaccgctcctcattgttg

SEQ ID NO: 98722 - DNA, 30 bp, Homo sapiens
  chr8:134566647-134566677
  hypo
ccaaaatcctacactcgacagtgggatgta

SEQ ID NO: 98723 - DNA, 50 bp, Homo sapiens
  chr8:134581243-134581293
  hyper
tcagaaggcagtttccgcctgctgctgcagagcttcgaggaacagactcc

SEQ ID NO: 98724 - DNA, 120 bp, Homo sapiens
  chr8:134583173-134583293
  hyper
gcggattcagagtttcgagttgccactaacacgactccggccgtgctctccttggcccacccgcgtcccccactgtccgccacgccgcgttcagctctcttgtcccgggtgtcaacttca

SEQ ID NO: 98725 - DNA, 66 bp, Homo sapiens
  chr8:134585014-134585080
  hyper
acagggaagcgggggcggtggagacttcttttgctgaaaggcagagtgcagcgctttgatgctaaa

SEQ ID NO: 98726 - DNA, 21 bp, Homo sapiens
  chr8:134724787-134724808
  hypo
ccaccgcgcccgtcctctgaa

SEQ ID NO: 98727 - DNA, 34 bp, Homo sapiens; identical to SEQ ID NO: 41957
  chr8:135301251-135301285
  hypo

SEQ ID NO: 98728 - DNA, 30 bp, Homo sapiens
  chr8:135319421-135319451
  hypo
gcctgagtttttaaacggggaagacgaggc

SEQ ID NO: 98729 - DNA, 23 bp, Homo sapiens
  chr8:135477507-135477530
  hypo
ggagtactcgccctgcagtactt

SEQ ID NO: 98730 - DNA, 128 bp, Homo sapiens
  chr8:135732756-135732884
  hyper
aaagagaaacttggccgagatctgaagtgtgatgagaatttggaacacggaagacaagccaggaggcccttctgaaagtaggaagccacagaagcaaacggtgccaaggaggacgatccagggcgggc

SEQ ID NO: 98731 - DNA, 18 bp, Homo sapiens
  chr8:135950097-135950115
  hypo
aaccgaaaaaacaaataa

SEQ ID NO: 98732 - DNA, 89 bp, Homo sapiens
  chr8:1362767-1362856
  hypo
ctgagcggagctgcccggcagctgtctctgaggatcccgccatctacgcacgtccaggcgtcctctgccctcagcgtgtcttgccttta

SEQ ID NO: 98733 - DNA, 230 bp, Homo sapiens
  chr8:136469072-136469302
  hyper
acgcccagaagggcacgcgcttttatgtaaccgacctctgagctggcggatctcaggaggttggcgctctgagctcaggcgcggagaaaggacggcgcccctgccttactctcttataagtacgaggggacagcaacgcgacataacttagagaagtccaggaagctttagagagcagggcggtcccgctgctattcctcagagcgcgactggggcgaactggggcgccc

SEQ ID NO: 98734 - DNA, 158 bp, Homo sapiens
  chr8:136470155-136470313
  hyper
tggacccctccttcacgcacgccctgcgcctggtgaaccaaggtgaggcgccggccgttaactgccggccggcggcggttgggggccgggtggaaacgcgggggcccagggggcccctccgtgccctctgctgtcagcggacgcggcggagacggagg

SEQ ID NO: 98735 - DNA, 30 bp, Homo sapiens; identical to SEQ ID NO: 41718
  chr8:13654931-13654961
  hypo

SEQ ID NO: 98736 - DNA, 19 bp, Homo sapiens
  chr8:136858149-136858168
  hypo
gatggctgggagtggcggc

SEQ ID NO: 98737 - DNA, 23 bp, Homo sapiens
  chr8:136865750-136865773
  hypo
ttcctattcggccatctataatt

SEQ ID NO: 98738 - DNA, 30 bp, Homo sapiens
  chr8:137746178-137746208
  hypo
gtacatgcatatgcacgcacgcacattgaa

SEQ ID NO: 98739 - DNA, 160 bp, Homo sapiens
  chr8:1380012-1380172
  hypo
ccctgagaaccctgccggcacccagcaccccatgccagccagcaccgctacggctgccatccatcagggctgaaccctgccggcacccagcaccccatgccagccagcaccgctacggctgccatccatcggggctgaatcctgccggcacccagcaccc

SEQ ID NO: 98740 - DNA, 27 bp, Homo sapiens
  chr8:138625594-138625621
  hypo
tctttaaaactgatacgtggggctggg

SEQ ID NO: 98741 - DNA, 18 bp, Homo sapiens
  chr8:138909127-138909145
  hypo
ctacaaggactcattcgt

SEQ ID NO: 98742 - DNA, 154 bp, Homo sapiens; identical to SEQ ID NO: 41958
  chr8:138910227-138910381
  hypo

SEQ ID NO: 98743 - DNA, 99 bp, Homo sapiens
  chr8:139046831-139046930
  hypo
tgttcatttccctgccgtatgggaaggctattacaggctcttctgtgaggcatttgaaacctcttcaatagtctttctgaaagttccaaaatttgtccc

SEQ ID NO: 98744 - DNA, 30 bp, Homo sapiens
  chr8:139155605-139155635
  hypo
ccgactgccacaccacgtgcctggcgtgtc

SEQ ID NO: 98745 - DNA, 190 bp, Homo sapiens; identical to SEQ ID NO: 9765
  chr8:139508757-139508947
  hyper

SEQ ID NO: 98746 - DNA, 20 bp, Homo sapiens
  chr8:139509651-139509671
  hyper
ccctcccagactgaccggcg

SEQ ID NO: 98747 - DNA, 242 bp, Homo sapiens
  chr8:139509693-139509935
  hyper
cggggctcccctctcgagccaagaccccaggcctcgggcaggaaaagggtccctgcagatatccgggggcggggcgcggcggagaactggctgggaggggactgttgaacttggaagagaagcccaggcaacaagtagatgcctgagaaagggtaaaagcgctgagcaacccatacctccaatgcgaagtcagcagtggccttcaaccagccagccggcccgtcatccgatgggctcctcac

SEQ ID NO: 98748 - DNA, 220 bp, Homo sapiens
  chr8:139667039-139667259
  hypo
gtgccctatcttggccgagttatgttcaacctctcaggaccttttcctctcgtgggaaaagcaaatgtggttctagaaaccagtcaagtctgcactcacatctgagtttgtcctggataaaaggcccaacagcccacatcacctcactgaacctgcgctctggtcctggcccagcaggacccaggtccaggctgtttgactctgccgctggccctccttt

SEQ ID NO: 98749 - DNA, 30 bp, Homo sapiens
  chr8:139894041-139894071
  hypo
cacctgtctgtgtatcggggaccccagtgt

SEQ ID NO: 98750 - DNA, 37 bp, Homo sapiens
  chr8:139908925-139908962
  hypo
ccattcaaggccagacgcggtggcttatgcttgtaat

SEQ ID NO: 98751 - DNA, 40 bp, Homo sapiens
  chr8:139926210-139926250
  hyper
gaaacgccgcagcctcggccagccccgccactgcccagga

SEQ ID NO: 98752 - DNA, 275 bp, Homo sapiens
  chr8:139926455-139926730
  hyper
gaaaacgagagaggccgacgaggccccggacagtggcgaggggctgcggggaaaggtgggcagggacctcgggagggctgtgggggactggacagcgttagggtccaggcagtaacgaggtggccctgggaagcccaaaagaggggctgacaactttctgtccaattatagacttcactgatactctgctcccttttccagcgggtctgaaatagaccaccgactagtgccgcagctgcccgaaactttgggaagtttggcgccaccagggggcc

SEQ ID NO: 98753 - DNA, 30 bp, Homo sapiens
  chr8:1400681-1400711
  hypo
ttgtgggacactgggcgctccggggagagc

SEQ ID NO: 98754 - DNA, 207 bp, Homo sapiens
  chr8:140417247-140417454
  hypo
aagagggcagaaggccggcgctcactgactacttgctctgtgggtggcacagtgctaagcttttaaacatatatgattagcaagatttatcttattcaaactttacaacagtcttctgaggtaaatcttaaggaatcccgatattcagatgagaagcaagcattggtggttaagtgactttcctggagtcaccgggccatagtggaa

SEQ ID NO: 98755 - DNA, 30 bp, Homo sapiens
  chr8:140616896-140616926
  hypo
gaacacggaacaccccggagtaagtttttc

SEQ ID NO: 98756 - DNA, 114 bp, Homo sapiens
  chr8:140630523-140630637
  hypo
tcagcctctggtggtcggtaaagctgtgtaacccaggagagatggagctaataggcgatgggaagaggctgttttttaatgtgcttggtgagatctcctcgatcttgtaagaga

SEQ ID NO: 98757 - DNA, 30 bp, Homo sapiens; identical to SEQ ID NO: 41959
  chr8:140630956-140630986
  hypo

SEQ ID NO: 98758 - DNA, 106 bp, Homo sapiens
  chr8:140643342-140643448
  hyper
gccgcccacgttttccggtgactgcgtccagaacgcaggaatcatctgggaaaagtcgctaatctttctttctcatagatgagatgtcatgcgatgaatgttttct

SEQ ID NO: 98759 - DNA, 30 bp, Homo sapiens
  chr8:140657025-140657055
  hypo
cactcaggcactgaccgggcttcagggcca

SEQ ID NO: 98760 - DNA, 37 bp, Homo sapiens; identical to SEQ ID NO: 41960
  chr8:140691457-140691494
  hypo

SEQ ID NO: 98761 - DNA, 651 bp, Homo sapiens
  chr8:140714444-140715095
  hyper
ggggcccaggggctacggagggtcagtgcctctcacgccccaggcgcactcccctgccacctgagtccctctaggagccatgggtgccaggccagccctctccaactcccagagaggtagtaagtgtaaggctcagagccccgcgcagcccagcccgcgccggggcggtgggtgggtgggtgtctgctatgggattattcttagcgctccactctcttcgcaaaagtggcgcctccgccctcccggctcaggcacactcgctcggggctcgcacgcccggcccagacaccagcgcggtggagagcaccgggtggggtccccgaagggtgaggctcggaggcgccgcggagggggggctccctagagaggagggggcgctgcgggaaggcccccaagggaggctgcgtttaaccctcgacgccctgcacccagcccggcgcggcgcgctcagccgcctccccggactcctcccggggcgcgggagcccagcggcgcgcccagcccttacctatggtggtgatgaccgtgatcgcaaagtagaaggagccggcgaatttccactggacgccggcgcggtgcggttccgactgcaggatcaccagctccagctgccggtagtcctcgctgctgatgttgtacttccccttgatc

SEQ ID NO: 98762 - DNA, 369 bp, Homo sapiens; identical to SEQ ID NO: 9768
  chr8:140715219-140715588
  hyper

SEQ ID NO: 98763 - DNA, 323 bp, Homo sapiens; identical to SEQ ID NO: 32285
  chr8:140715699-140716022
  hyper

SEQ ID NO: 98764 - DNA, 9 bp, Homo sapiens
  chr8:140716339-140716348
  hyper
cgaatgtgt

SEQ ID NO: 98765 - DNA, 44 bp, Homo sapiens
  chr8:140716408-140716452
  hyper
ccggcgggagggcctcggggagcgggggccgggctacgccgagg

SEQ ID NO: 98766 - DNA, 511 bp, Homo sapiens
  chr8:140716655-140717166
  hyper
ggatgggaggataaacgcggcttcttgggtccttctagccccgctccccaagagcgcaagcagccctggcgggtggagagtttgagggactcggggttggaggaggaaaacgggattcagccagagatggcaggctgacagcttcaggcagattgggcagagagtggggagcagaaggggagggggccatgggcacacaggagagcggcagcagcggttcacgaagtcttccccaccccccaccccccacctagccacccggcgcgggagcgtgtcattggccagggacatggcctcgtggagtggtggggtcccgagggctgcctcggccccctcgcctcccagcggcacagcccgcttgggccagcacctgcagacccgagtcgtttccctggagagcgctaaggacagcatgggccgccacttttggagtcaggacagcggggaaagacatcgcaatcccccgacccagtaacctctctgttgctttactgaaggaaaaaaaaaaaat

SEQ ID NO: 98767 - DNA, 150 bp, Homo sapiens
  chr8:140717226-140717376
  hyper
atatatatataatcactctttgatatatataatcactctttggttccccacagctgggcgcaaggtgcgccgtggatgcagccctgagccacgcgatagccccctcgagaccacctggggtaggaacacgaggctcgggctggggcgcac

SEQ ID NO: 98768 - DNA, 196 bp, Homo sapiens
  chr8:140717664-140717860
  hyper
atcagacctaaccctcgggcagctcgcgggctccaggagaccagtcccttctgtgggtcgccccctggagcggtgctcgggctccctggcctcagggaccccgggcccagagggtctgggaccccagtgattcaccgaggcctcccagctgggacgctctgcaccccactttcagggatcacgggtgcccaccagg

SEQ ID NO: 98769 - DNA, 34 bp, Homo sapiens
  chr8:140751338-140751372
  hypo
gcaaccctgacatctcgaccgggcaccacggggt

SEQ ID NO: 98770 - DNA, 37 bp, Homo sapiens
  chr8:140788728-140788765
  hypo
gcatctcaacccattcggcaaacgggagcttcatcgc

SEQ ID NO: 98771 - DNA, 186 bp, Homo sapiens
  chr8:140818684-140818870
  hypo
ccactcggggctcagcggcagtgacaccaaggacccgtgaaaacaatatgtagcagcagcaacaggattaagagtggagcagaagtagcctcaggtcccagagcagctccccaagggtgtacctgaaccgggaggcatccaggtgtgacctcagctgggtccggcagtagccgagcctcctgaacc

SEQ ID NO: 98772 - DNA, 281 bp, Homo sapiens
  chr8:140834115-140834396
  hypo
tctccccatggagctcgacggagagaaaatgaatcgtagtgccatgctcggctattggctgggcctaaattgttccttactctgagaattcgttaagtggctgagcaataaagaagagagatttgagagttctttctcggcacaatggctttgacccctgccctttcagtcgtgatggctttattagggaccgtggggtgctgcaaacagccttgaggctctgggcagaccagttcatccagctcaattaaaaacccattacctggcgctgagctgggcca

SEQ ID NO: 98773 - DNA, 140 bp, Homo sapiens
  chr8:140834841-140834981
  hypo
ctgagagccaagagccgtaggatggcgggggggggctgccttgcctccatgggaaggacagcagaggggctgccatctgccagaggcctgctgagtgcatgcgtcctctcagacacgctgcctgccgctgacacatggag

SEQ ID NO: 98774 - DNA, 30 bp, Homo sapiens
  chr8:140869275-140869305
  hypo
ccctgggaatctgggcggggggagctggtt

SEQ ID NO: 98775 - DNA, 30 bp, Homo sapiens
  chr8:140869920-140869950
  hypo
tcctccctgcctgggcggcccgctgcttgt

SEQ ID NO: 98776 - DNA, 315 bp, Homo sapiens
  chr8:140963081-140963396
  hypo
caagagcagaaaaaacggactgatgtagtggttgcacaccaaccagtaagtgaacaccggctccgaaggcctctttggtatgcaccaaaacacatggcatgcggcaagaggaggcgcggcagggagggagccgcacccgccttacagccaaacaaatgaactataaaagggtgaggtgagtcaaccgaggacaatgccctgccaaacagagtgcctcacctgctcacggcttggagtcagccagacccaggcgcgcacatccccaccgccacctccccacctgtgacacaggcctggttacgccacctctctgag

SEQ ID NO: 98777 - DNA, 30 bp, Homo sapiens
  chr8:140971345-140971375
  hypo
gcattccgagtcacacgggggagccctgca

SEQ ID NO: 98778 - DNA, 30 bp, Homo sapiens; identical to SEQ ID NO: 41964
  chr8:141018127-141018157
  hypo

SEQ ID NO: 98779 - DNA, 30 bp, Homo sapiens; identical to SEQ ID NO: 41965
  chr8:141054547-141054577
  hypo

SEQ ID NO: 98780 - DNA, 41 bp, Homo sapiens; identical to SEQ ID NO: 41966
  chr8:141106960-141107001
  hypo

SEQ ID NO: 98781 - DNA, 323 bp, Homo sapiens
  chr8:141107540-141107863
  hypo
cctgagtcctggctgcgcagcctgtgttgccagtcgcagggtaatacactcgcctgcatcgtgggtgccccgccaccgccctgccacagtctacaaggcaagaacgcccgtctgggtccgtagtgtgcagccgcagctgtgctgctgtccacaccataaaaactcctggccacagacgtgccacagtcggcaggataagaatgcccagctggatcttggggtgcacagccccagctgtgccgctgtccacagggtaagaacgcctgtctgggtgggtccttggtgcacaaccacaggcgcgctgcagtcggcagagtgaggag

SEQ ID NO: 98782 - DNA, 30 bp, Homo sapiens
  chr8:141126859-141126889
  hypo
tcagtccaaaggtaccgtagaggttcccta

SEQ ID NO: 98783 - DNA, 30 bp, Homo sapiens
  chr8:141159257-141159287
  hypo
gtcaccctctgatctcgttccattgctctg

SEQ ID NO: 98784 - DNA, 203 bp, Homo sapiens
  chr8:141159746-141159949
  hypo
ccctgcgattagtgacggcttcaattcctcatttgtgaaatgaggataaaatctctaccacatggggctgctgtctgactcgaatgtacgtgagtcatcatccacggttccaggcaaatatttactaatccccttctcatctccttgaaaggtctgctcgccttgacgcagcacatgaagtacgagtgcgagcagtggagcct

SEQ ID NO: 98785 - DNA, 284 bp, Homo sapiens
  chr8:141202454-141202738
  hypo
gcatgatcacctcaacgtaggcaaaaggactctgttagaagaagtcactggctgacttctgcagtcaacaggcccaatcgtccacagagcaaggtgatctgcagaaacctcctggcacagtgcctggggcgtgttttctagcagtaaaaacaggcagcatggtgcaggggaggagcaagctgcccgcccacagccctcgcaccagctgtgcagtcagggcagccccattatgcagagcctcgcttcaatacctgcaaaacctgctccgacgaggtttaagaacc

SEQ ID NO: 98786 - DNA, 30 bp, Homo sapiens
  chr8:141219253-141219283
  hypo
cctctgcagacgatccgcctaaaacaacga

SEQ ID NO: 98787 - DNA, 70 bp, Homo sapiens
  chr8:141249551-141249621
  hypo
gatgcagccaccaggcgctaggaacaaaaaacaagtaagactccggccctgcccgcgagatgagggtggt

SEQ ID NO: 98788 - DNA, 113 bp, Homo sapiens
  chr8:141347719-141347832
  hypo
tgcagcacgtgggtgcgggtaccggatccacctgccctgaacctgctgcctcccccaccaaaatgggctgcctaggtgtcagatgggcacgtgatcagcggtgctgtgagagt

SEQ ID NO: 98789 - DNA, 196 bp, Homo sapiens; identical to SEQ ID NO: 41971
  chr8:141466557-141466753
  hypo

SEQ ID NO: 98790 - DNA, 30 bp, Homo sapiens
  chr8:141503865-141503895
  hypo
tttttactgtgatggcgaccagcagaggga

SEQ ID NO: 98791 - DNA, 30 bp, Homo sapiens
  chr8:141559694-141559724
  hypo
gcctcgcggctgtggcggccccagggcagt

SEQ ID NO: 98792 - DNA, 215 bp, Homo sapiens
  chr8:141566731-141566946
  hypo
cgtctacctgtgggacgaggtgctggagctgcccagccctacctgaatgacaggatctaaacaccaagggaagagttacagcacatggctcagggtcggaatttgatcctttcccaaggcaaggatttttcaaagagtcgtgatgttagaggagagtgaatgacgcaacggtgcagtgacggagcacctgcctcgcgctgcggggcctgctggac

SEQ ID NO: 98793 - DNA, 80 bp, Homo sapiens
  chr8:141577436-141577516
  hypo
ccaagggacaggcaccgtgtgcgtctgggctgccagcagcaggtggtccacacccgagacactgccgcctctcaacagcc

SEQ ID NO: 98794 - DNA, 171 bp, Homo sapiens
  chr8:141588008-141588179
  hypo
cctgcacacccagcacggcgtgcggcttgggctgggcggatctctcaagagaaggaggctgttcggtcatgccagtgaggcagtgccctgaggggctacaatgcacacccgtggagtcggctggcagacaatcctggccaccactcaggcctccgccgcccagagagagca

SEQ ID NO: 98795 - DNA, 30 bp, Homo sapiens
  chr8:141594621-141594651
  hypo
gaacttcaacaagaacgttcacagcagtct

SEQ ID NO: 98796 - DNA, 55 bp, Homo sapiens
  chr8:141594857-141594912
  hypo
cacacatcagaatgccgtgactttaggggctgggggtaaccggaagagggtatga

SEQ ID NO: 98797 - DNA, 368 bp, Homo sapiens
  chr8:141596819-141597187
  hypo
ctctctacgccacaccggagtagaacaaagcacttgccaacacgtggccctgttctcaggtggctccaaccacccagtgagacggctcccaggaaacgtctaggacagagcccgggaatctggccctgtggccaatctcgatttcagggtcgggcacgctcctctcggggaggagagtcactgtccttcggtgactcccagcttacaaggtgctcatgcagttacttaaccgagcctcacaaccataccacaaaggggcacaccgctggctgcaagaaggttttgggctggaacacgagctacttgcaggtgaagcaaagctgctgggccggctccaaaccaggcccctccaccgggcccccaagcag

SEQ ID NO: 98798 - DNA, 30 bp, Homo sapiens
  chr8:141598051-141598081
  hypo
cctgcatccaagactcgacctcacctcccc

SEQ ID NO: 98799 - DNA, 30 bp, Homo sapiens
  chr8:141599723-141599753
  hypo
gcatcagccagaaaacgtgcaggccaaaga

SEQ ID NO: 98800 - DNA, 109 bp, Homo sapiens
  chr8:141600175-141600284
  hypo
ctcccatgccaggcccgggccaccaatgagcccacggtgagccgaagtcaaagcctcacccagcccacgttcacagagacgcgtctggcccaggcgtcacagctgtgca

SEQ ID NO: 98801 - DNA, 52 bp, Homo sapiens
  chr8:141602350-141602402
  hypo
ctaccaagacagacccgcacgctggtccagggctgctcgaagcctgacacct

SEQ ID NO: 98802 - DNA, 38 bp, Homo sapiens
  chr8:141624393-141624431
  hypo
gcctaggagacagagtgagactccgtctcaaaacaaaa

SEQ ID NO: 98803 - DNA, 32 bp, Homo sapiens
  chr8:141629973-141630005
  hypo
ggtttttaacatgaacgcgggggataagcaca

SEQ ID NO: 98804 - DNA, 53 bp, Homo sapiens
  chr8:141632257-141632310
  hypo
tctatagaacatactcggaacaggtcaatccagtgagacggaacgcagatggg

SEQ ID NO: 98805 - DNA, 40 bp, Homo sapiens
  chr8:141633613-141633653
  hypo
cagcagtcaggcccccggctggacacgggtcacacctgga

SEQ ID NO: 98806 - DNA, 68 bp, Homo sapiens
  chr8:141634252-141634320
  hypo
tcctcaggccagctccgaagagcccccacccagcaggtctcgactgggtcacccggctctgccccctc

SEQ ID NO: 98807 - DNA, 30 bp, Homo sapiens
  chr8:141638210-141638240
  hypo
cttcagggcagagaccggaagaagctttca

SEQ ID NO: 98808 - DNA, 123 bp, Homo sapiens
  chr8:1420309-1420432
  hypo
catgcagagctcagacggggccgcactggggaggtgatgctggaggaaatccttgcagcaggagggatgcctgccgccatgttgggaggggaggggggttgagccatgcggtagagcggctgt

SEQ ID NO: 98809 - DNA, 30 bp, Homo sapiens
  chr8:142095370-142095400
  hypo
aacccggatctcagacgtcccaggtacgtc

SEQ ID NO: 98810 - DNA, 94 bp, Homo sapiens
  chr8:142119106-142119200
  hypo
aggctgtcctggcagcgcccgccagcaagaaggtggcagtgctgggaacatgggctgtctgggaccctaaaactccgctgggtcactgcaacct

SEQ ID NO: 98811 - DNA, 30 bp, Homo sapiens
  chr8:142168132-142168162
  hypo
acaggcgtgagccaccgcgcccagtcggag

SEQ ID NO: 98812 - DNA, 30 bp, Homo sapiens
  chr8:142190839-142190869
  hypo
tttcagtgcccatgacgcttccggagacaa

SEQ ID NO: 98813 - DNA, 54 bp, Homo sapiens
  chr8:142231648-142231702
  hypo
gacaccaggtgtggccgagaaacttaccgatggcagagccgttaaggaaaagtg

SEQ ID NO: 98814 - DNA, 176 bp, Homo sapiens
  chr8:142242938-142243114
  hypo
tggctcccgggtgaacgctcacgaccagcttgggctggactggcgtctcctttcagtggttgccactttccatggtgtagatgctaccaccccgcccaatctcaagctgctgaggtgacgtcgctgaacaggagtggagaggagcagcagccagcgctgagcggcacctctgcccc

SEQ ID NO: 98815 - DNA, 266 bp, Homo sapiens
  chr8:142243948-142244214
  hypo
ggtccagcaggtctgcggctggacctgactctgggctgagctgagcttcagaggccagcactagggccccatggttgagtggaggctgaattccgagtctgaatcccagctctaccatctactagctctgttgagtgtccgtttcctgatctgcagaaatctgtaaacatcatcaccaggcttttatgagaactgagtcatcctgaacagctcactgttggcataaaccattagcgaatcgtcgccaacatcggggcctgcatcgc

SEQ ID NO: 98816 - DNA, 30 bp, Homo sapiens
  chr8:142260889-142260919
  hypo
actgggacatacccccgttgcaagttgagg

SEQ ID NO: 98817 - DNA, 95 bp, Homo sapiens
  chr8:142290791-142290886
  hypo
atgggggtttttgttcgtgtaatgcgacagcgtgcagctccacacacacaggaagcaagctgtcaggacagagcctgactcgcacaggtaactgg

SEQ ID NO: 98818 - DNA, 151 bp, Homo sapiens
  chr8:142292552-142292703
  hypo
agcctctgtctccatcgctgccctccctccaggccgccgctcagggcacgccgcctccatcgctgccctctctccaggccaccactcagggcgcgctgcgctcagctcacaccaccccgtgcacagctcgtggatgcggtcctcccttttc

SEQ ID NO: 98819 - DNA, 30 bp, Homo sapiens
  chr8:142296602-142296632
  hypo
agggcaggtgcaaatcgaggaatttatact

SEQ ID NO: 98820 - DNA, 43 bp, Homo sapiens
  chr8:142297555-142297598
  hypo
ctccccaaagtccctcgttaacccttcacggcaagtctggagt

SEQ ID NO: 98821 - DNA, 245 bp, Homo sapiens
  chr8:142299062-142299307
  hypo
gcgctaatccttcggcgtgggtgggaaaagaggtccaggaaaggaacccagctcccaagagggaggcagaggcagagatgtggtcccagaggaataagcagggcctcagccggccatgaaaccagccaggtgcgcgatggagtcagggcctggggaagaggatgatcggagaaggcggtgccagggaacagtgggcacagaggccagggcgagagcagaaggggcagaggcggggatggcggggg

SEQ ID NO: 98822 - DNA, 26 bp, Homo sapiens
  chr8:142313508-142313534
  hypo
gattgcaggaacgagcctctgtgccc

SEQ ID NO: 98823 - DNA, 30 bp, Homo sapiens; identical to SEQ ID NO: 41984
  chr8:142323052-142323082
  hypo

SEQ ID NO: 98824 - DNA, 30 bp, Homo sapiens
  chr8:142356494-142356524
  hypo
agccccactgctcttcgctggggtgactcc

SEQ ID NO: 98825 - DNA, 162 bp, Homo sapiens
  chr8:142361169-142361331
  hypo
tgtgaggggcacctgcggtttggtgttaggctcccacctacaggggcaaagcccaggctcagaggtgacctggaatcagcgaatcaggggccgagctggactaggcaggagggtgtgtggttgcagcaggtgagctcatctgtaaaacgggggtgcgacacc

SEQ ID NO: 98826 - DNA, 188 bp, Homo sapiens
  chr8:1423661-1423849
  hypo
gctttggaggtgccccgctgattgttgcaggctgtttcgtgaggatcaatgagcggctgggagtaaacgtcttccatactgggtcaggtcaccaccctaaagccctacaaagtcgttgacccccataattcaggaacattgcttgtcatcccgggacccaccgcaaggccgagcggagaggaagacag

SEQ ID NO: 98827 - DNA, 64 bp, Homo sapiens
  chr8:142367760-142367824
  hypo
gagggtgtcttggcccgggtgcggcagcagaagacgtacagcgccagcccgttgagcaccagcc

SEQ ID NO: 98828 - DNA, 30 bp, Homo sapiens
  chr8:142368111-142368141
  hypo
agaactcagctggcccgtctgcccctgcac

SEQ ID NO: 98829 - DNA, 30 bp, Homo sapiens
  chr8:142369212-142369242
  hyper
cagggtggggaggctcgtgggccgtttctt

SEQ ID NO: 98830 - DNA, 30 bp, Homo sapiens
  chr8:142405274-142405304
  hypo
cgatggcccagtaggcgttcacctggcaga

SEQ ID NO: 98831 - DNA, 30 bp, Homo sapiens
  chr8:142405762-142405792
  hypo
tacctggggaaggtgcgtgggccacccctc

SEQ ID NO: 98832 - DNA, 30 bp, Homo sapiens
  chr8:142419859-142419889
  hypo
gtgcaggctgcccagcgtgcccagctccca

SEQ ID NO: 98833 - DNA, 30 bp, Homo sapiens
  chr8:142424065-142424095
  hypo
ggctctggtgggcgtcgtggggctggactg

SEQ ID NO: 98834 - DNA, 105 bp, Homo sapiens
  chr8:142427595-142427700
  hyper
atttccaaagctgggcgcgctctgtccaggcctccccaccaggagcgcggcccggcggctcctgccctccggacccccagcccacaggcccgtgcagccccatga

SEQ ID NO: 98835 - DNA, 47 bp, Homo sapiens
  chr8:142428027-142428074
  hyper
gcggcggaggggcggcgccccgacccagggccagcaccgtgggcacc

SEQ ID NO: 98836 - DNA, 155 bp, Homo sapiens
  chr8:142432225-142432380
  hypo
caagcacagggatctcgttctcctcattttttgggggtgtgtggggacttctcaggtcgtgtccccagccttctctgcagtcccttctgccctgccgggcccgtcgggaggcgccatggctcggatgaaccgcccggccccggtggaggtgagct

SEQ ID NO: 98837 - DNA, 116 bp, Homo sapiens
  chr8:142436166-142436282
  hypo
aagtagccgtgacaccggttgtctctaggagttgccctgcctggaggctggggaggggtgagatgcccccgagggctgtgtgtctgcctcagtgggcccagcgggctctccctggt

SEQ ID NO: 98838 - DNA, 149 bp, Homo sapiens
  chr8:142439200-142439349
  hypo
tcagaacagcacgggcgtttcttgcccctgttgcgtgtctgttggtgggggccctacccggaggcgtggctgagggctgcgccttccccagtgtgccggctgctgggcgaggaaacgagcacggtggagccacacggggcacctgcagc

SEQ ID NO: 98839 - DNA, 30 bp, Homo sapiens
  chr8:142444722-142444752
  hypo
ggcctgtgtaacagacgggcagctggtggc

SEQ ID NO: 98840 - DNA, 30 bp, Homo sapiens
  chr8:142445528-142445558
  hypo
ccaggctggtctgcccgcggccctggccct

SEQ ID NO: 98841 - DNA, 162 bp, Homo sapiens
  chr8:142452230-142452392
  hypo
tatggagggtagcagcgggcgagggcgtgggagactcagggcgtgtggcgtagcggagcccagagaagtgtccattctccactcctgagactcctgccctcagaggacatggagaaacccgcggcactggccctcgcttgtgagtgacggagaaacccgcgg

SEQ ID NO: 98842 - DNA, 30 bp, Homo sapiens
  chr8:142453296-142453326
  hypo
ccagcccaggacccccggcaatgctcaagg

SEQ ID NO: 98843 - DNA, 65 bp, Homo sapiens
  chr8:142461734-142461799
  hypo
ggactggggggtgggcgactggaagtgggcaagtcactgcaggtgagagccggtggtgtcctgga

SEQ ID NO: 98844 - DNA, 54 bp, Homo sapiens
  chr8:142501450-142501504
  hypo
tgaaactaaaggtgacgtggttttagaagtagttgagtccgtagatgtacctcc

SEQ ID NO: 98845 - DNA, 191 bp, Homo sapiens; identical to SEQ ID NO: 32290
  chr8:142528212-142528403
  hyper

SEQ ID NO: 98846 - DNA, 153 bp, Homo sapiens; identical to SEQ ID NO: 32291
  chr8:142528454-142528607
  hyper

SEQ ID NO: 98847 - DNA, 112 bp, Homo sapiens; identical to SEQ ID NO: 9773
  chr8:142528670-142528782
  hyper

SEQ ID NO: 98848 - DNA, 128 bp, Homo sapiens; identical to SEQ ID NO: 9774
  chr8:142528834-142528962
  hyper

SEQ ID NO: 98849 - DNA, 15 bp, Homo sapiens
  chr8:142529027-142529042
  hyper
cggaggcaggccctc

SEQ ID NO: 98850 - DNA, 200 bp, Homo sapiens
  chr8:142535307-142535507
  hypo
gggtagacacaaactcggagagagagagggtcaggacggcaaggctggggccggggcggcgggaagggtgaggtttctgtgcactgagatggggctgctggggctgtctggggagtccgaggtgcccaggggcaggcggtgggctcagtacacgaacgctgcgggcaaacaggccgggggaggagcgaggacctgcctgc

SEQ ID NO: 98851 - DNA, 55 bp, Homo sapiens
  chr8:142547012-142547067
  hypo
catgggggtgtcctgcgcagccacctgcctcccgcctgggcgggatcctggccct

SEQ ID NO: 98852 - DNA, 144 bp, Homo sapiens; identical to SEQ ID NO: 41991
  chr8:142553829-142553973
  hypo

SEQ ID NO: 98853 - DNA, 185 bp, Homo sapiens
  chr8:142558807-142558992
  hypo
gagcagcacgtcacccgcccccagactcccagggccccaggctggcaaggtggccttccagagtgcctggggctcctgtggttctgtgcccgccagcactgtcctcacaggcacaagcacctcatggatgctggtgggtcaggtgggctggcgtctcacaggacctcttccgccactgccctcga

SEQ ID NO: 98854 - DNA, 62 bp, Homo sapiens
  chr8:142560165-142560227
  hypo
taccctgtgagtccccggcaggcgtcactgcccccagggctccacgtcgtctctcctgcatg

SEQ ID NO: 98855 - DNA, 296 bp, Homo sapiens
  chr8:142568543-142568839
  hypo
gtactgttcccaacacgttttatacaaggggagaccagagctcagagaggtcaagccacctgcctgaggtcgcacagctggcctgtggagaagccggggctctgctacccaggtccgcctgatcttgccatcatccgatgctcttgccgacggcaccacatggctgcggaaagggtaagtgatgtgatgagcacaaatgcccttcaaagaccaacttctgggcgactatctgctgtcatgcctctctctggaccccaagccaggccaccccttagcccggtcgggttgacacataa

SEQ ID NO: 98856 - DNA, 172 bp, Homo sapiens
  chr8:142583056-142583228
  hypo
cagctgtgtgcagggcggggtggcggggggggacggggagggcggaggagccattggagtgattatgatggagctggcactggtcataaactttaatcaacttaaaacccgcttttggtattaaactttaccaaccatttaatacccctggacaggccgagtgtgggagcag

SEQ ID NO: 98857 - DNA, 171 bp, Homo sapiens
  chr8:142593564-142593735
  hypo
gtgggcctggggtcacggagcgctttctggaaagccgtggtgaagcatcacccggtaccagccgcctcgctagctcttgccatagcagcagcgtgaacaagcgtcccgccatttagtggctcaaaacaacaaggtgccgtggtttctcccgagcctcgggtgggtctaatc

SEQ ID NO: 98858 - DNA, 30 bp, Homo sapiens
  chr8:142603404-142603434
  hypo
tggagatcacagccacgcctggtcacgggg

SEQ ID NO: 98859 - DNA, 132 bp, Homo sapiens
  chr8:142622154-142622286
  hypo
gcgctggcctggctacgagagctgtggctcaccctgagggtcccacatccgccttggtgctgccccaggctccacgggcatctggccaccttcaagtgctgcctggggccatggcatcgctgctaccctccc

SEQ ID NO: 98860 - DNA, 41 bp, Homo sapiens
  chr8:142630247-142630288
  hypo
ggggccttcaggtgccgagggtggtgcgcaccccgggatgc

SEQ ID NO: 98861 - DNA, 30 bp, Homo sapiens
  chr8:142633631-142633661
  hypo
tgagctccttggtgacggtgcccaggtcat

SEQ ID NO: 98862 - DNA, 43 bp, Homo sapiens
  chr8:142659067-142659110
  hypo
agtctctgggagccccgcgggactcgcccgcctgccacacctg

SEQ ID NO: 98863 - DNA, 34 bp, Homo sapiens
  chr8:142680131-142680165
  hypo
ggtgactcctccagacggccgggagggcttcaca

SEQ ID NO: 98864 - DNA, 136 bp, Homo sapiens
  chr8:142694812-142694948
  hypo
gatggagaggtgctccgtccactctgcccagtgtctgccctctgcccagacgccccaaaagcagccgcagagagaaggcgaactttggcttcgggggcccagtgccaccacttccgatctgcgtggcggtggtcaa

SEQ ID NO: 98865 - DNA, 193 bp, Homo sapiens; identical to SEQ ID NO: 41998
  chr8:142706678-142706871
  hypo

SEQ ID NO: 98866 - DNA, 46 bp, Homo sapiens
  chr8:142738298-142738344
  hypo
gcctgaaccacagagcgggcttcttccagcccgggagtccgagagg

SEQ ID NO: 98867 - DNA, 196 bp, Homo sapiens
  chr8:142841690-142841886
  hypo
ctgctggtacagagccgcgctccttgggagaggtgaggaaggggcaggggtggtgttggtatgaggctgaggctgccacagggtggacaggagagaaggccagagttgggggtggcccctgagtaattctgggcttcgcaggccatggaaggtgtttggatatactcctcagtgccacagacgctcccagggacca

SEQ ID NO: 98868 - DNA, 202 bp, Homo sapiens
  chr8:142859982-142860184
  hypo
tgcccttggacttcccggcatccagaacccgagccaaaaaaagttcatttttaaaaaaattacccagtctcagggattctgttattgcaacagaaaatgaacttagacgtatgcttacaacacacagcatagtgcttgccatgaaggaacacctgttaaataaataatagtggttggtgggtgggtgcggttgtcatgagtg

SEQ ID NO: 98869 - DNA, 30 bp, Homo sapiens
  chr8:142881166-142881196
  hypo
gtgcgctgggcaggccgtggttctcactct

SEQ ID NO: 98870 - DNA, 42 bp, Homo sapiens
  chr8:142895890-142895932
  hypo
tgcagaccaaactcccgaccagcacagcgtctgtttgccacc

SEQ ID NO: 98871 - DNA, 159 bp, Homo sapiens
  chr8:142939132-142939291
  hypo
tattagcaccaccatcgtcatccccatccttgtcatcatcaccagtactatcatcatcatcatcgtcatcatcatagctattaccatcaacatcaatgccgttactgtcatcatcattgttaccatcaccatcatcgccattcccgtcatcatcatcac

SEQ ID NO: 98872 - DNA, 147 bp, Homo sapiens
  chr8:142984512-142984659
  hypo
gcagactgtcaccaccgcccatcgccaccctgggagagtgaaggccgtcgtaggcaggagacaaactgctggatgagctgagtgccagagaaccttgatgcgcaaacaaaggcgcggctgggtctggtccgccggccggcgctgctg

SEQ ID NO: 98873 - DNA, 30 bp, Homo sapiens
  chr8:143013191-143013221
  hypo
tcagacacccctcaccgcccaggccaggag

SEQ ID NO: 98874 - DNA, 102 bp, Homo sapiens
  chr8:143054769-143054871
  hypo
actgtacttgcctcacgtgtgcctgggctcacggtgcctgcgctcacgggtgcctgccctcacggtgcctgcgttcacgggtgcctgccctcacgggtgcct

SEQ ID NO: 98875 - DNA, 162 bp, Homo sapiens
  chr8:143054991-143055153
  hypo
cctgggctcacggtgcctgcgctcacgggtgcctgccctcacgagcctgcgctcacgggtgcctgtgcttacaggtgcgcaccaccccccacaccctctaggtggcttctcagcttttaatctcagagggtgatgcctgctggcacccgccttgttctgctc

SEQ ID NO: 98876 - DNA, 30 bp, Homo sapiens
  chr8:143055995-143056025
  hypo
ggatgatgctgttaccgttgccatcatcat

SEQ ID NO: 98877 - DNA, 280 bp, Homo sapiens
  chr8:143088493-143088773
  hypo
ccaccgcagcgtgtacgccgttttctacatttacggagagactcaggtgtgtgcacactgtgtgtccagaagggctgagggctacagagcagcctggaagaagcacatcgaaatgagcagagcccacacccatcctcccggggaccatggactgccaccacctccctgcggacagccctgggatgcagaccccagccaccaggccggctgcacggaccgcagggtgcaactgcctcctctctcagcccctttgtgcagtgaacaacgtgcgtagccatat

SEQ ID NO: 98878 - DNA, 68 bp, Homo sapiens; identical to SEQ ID NO: 42003
  chr8:143088999-143089067
  hypo

SEQ ID NO: 98879 - DNA, 85 bp, Homo sapiens
  chr8:143090651-143090736
  hypo
atgtgagggcacagccgacagacggccgcctgtggaccaggaggcagccctctccggacgccaaatctgccggcaccttgatctt

SEQ ID NO: 98880 - DNA, 33 bp, Homo sapiens; identical to SEQ ID NO: 15178
  chr8:143097424-143097457
  hypo

SEQ ID NO: 98881 - DNA, 399 bp, Homo sapiens
  chr8:143105067-143105466
  hypo
ccttggaggtgccctcgccacccctgggggcagagctgccgctgacaggagtgatggaaggagaggctgcgtggccgcgctgctgccgctcaaacacctcgaagcccacagcttcgaggacaggcgctggaaagccagtgccagctgcgccagctcagccgtctgtctcaggcaggcaccgtctgctgtggccggcgggtggtgtgtctgggccggctctgctctagatgccgctaaggtgcaggaggcatggctgctgccctctgggagctcgtcctggggtgtccgtgtgacacggacctgcccatgcaaggtgctcagaccccctccacctcagagttctcacctgaaaagtggggataataactgtctccacattacaaccgggaggaccaactc

SEQ ID NO: 98882 - DNA, 30 bp, Homo sapiens
  chr8:143105753-143105783
  hypo
ccttccagcgctgatcgctccttgaaatca

SEQ ID NO: 98883 - DNA, 57 bp, Homo sapiens
  chr8:143128744-143128801
  hypo
gggcacaatacacctcgctccagagctgcgtgatggcaaactcgagtccggccagaa

SEQ ID NO: 98884 - DNA, 30 bp, Homo sapiens; identical to SEQ ID NO: 42008
  chr8:143156215-143156245
  hypo

SEQ ID NO: 98885 - DNA, 30 bp, Homo sapiens
  chr8:143162428-143162458
  hypo
tcctctctgaaagcccgccctcctttaatg

SEQ ID NO: 98886 - DNA, 150 bp, Homo sapiens
  chr8:143171132-143171282
  hypo
cacacgacacccactcggaaactggagtcaacagagagccgcagctgctcgtaccgggcaagtctctgcggggtgggaccctgtcccaggacgcaggattggcgctgagctcgggatctctgtgtgcacctgcatcgctggtaggaggac

SEQ ID NO: 98887 - DNA, 30 bp, Homo sapiens
  chr8:143193094-143193124
  hypo
tacaagagtctcctgcgaatcaacgatgcc

SEQ ID NO: 98888 - DNA, 157 bp, Homo sapiens
  chr8:143198927-143199084
  hypo
aggccacagctactccgcagctcacggcagttgggacccaggcctgtaggcggagatgggacgggctgggccctctgctccagagcgcagcagcactcgcatctgtggacactcatcatcgggtctttaaagcacaaaagagcggttcacacaggag

SEQ ID NO: 98889 - DNA, 30 bp, Homo sapiens
  chr8:143199865-143199895
  hypo
cactgcctgctcagccggcacaatcactca

SEQ ID NO: 98890 - DNA, 30 bp, Homo sapiens
  chr8:143200728-143200758
  hypo
aaatgcaaacagggccgcatcccaagcccc

SEQ ID NO: 98891 - DNA, 175 bp, Homo sapiens
  chr8:143210674-143210849
  hypo
gccaagagaaaaacacggaatcccaaagtcggagggaacccggaacaggaaacaacgcacaggctcaggacaggggacaccggtgtgtgtgacccattgctgccacccaccagccgtgtggccctggggacccccatcgccctctgtgcctcggcgtcctcgtctgcagtagtga

SEQ ID NO: 98892 - DNA, 66 bp, Homo sapiens; identical to SEQ ID NO: 42012
  chr8:143217605-143217671
  hypo

SEQ ID NO: 98893 - DNA, 87 bp, Homo sapiens
  chr8:143223873-143223960
  hypo
cctagagatggtggccgcatagagagggctttctgatgggagctgtggcctccacagagggacacagctgagcgtgtcagagaggga

SEQ ID NO: 98894 - DNA, 30 bp, Homo sapiens
  chr8:143237748-143237778
  hypo
tcctttcatggccggcgcacctgcccgtgc

SEQ ID NO: 98895 - DNA, 181 bp, Homo sapiens
  chr8:143246191-143246372
  hypo
tccagtttccagctgcggtgacctgaaggagcttccaccagctccagcactcagccagaacttgcacccggtaggtgtcactgggggcgagttgccttctggacagaggcatccttgctcagtgcccagaggagctgatgggaaaacccttggggagcagccaggccgctgatccacgaat

SEQ ID NO: 98896 - DNA, 49 bp, Homo sapiens
  chr8:143251863-143251912
  hypo
ctctgaaggccaccacgccacccatgtctccccacggaagtctccatcg

SEQ ID NO: 98897 - DNA, 30 bp, Homo sapiens
  chr8:143258355-143258385
  hypo
agagccagactccaacgatgaaccagagca

SEQ ID NO: 98898 - DNA, 30 bp, Homo sapiens; identical to SEQ ID NO: 42013
  chr8:143265172-143265202
  hypo

SEQ ID NO: 98899 - DNA, 119 bp, Homo sapiens
  chr8:143314588-143314707
  hypo
tgggcaggacaggcccgtgaggcacgaagagctggcacagctttcctggggctcaggccccttttacagatgggagggcctaggacccaagcggggtttttggacgggtgatggtcaag

SEQ ID NO: 98900 - DNA, 389 bp, Homo sapiens
  chr8:143317093-143317482
  hypo
actttaggccaaaggcggcagcgggtgagagcacatggcgttgggtccactgtcctgaaagggaagcggccctgagcgtttcctctgtgccagggcctgccaggggcacgggagtcctgtcttttagggagggcttcatgcagggtgggggatggacaagttgaggagcatggcggggcaggaggaggtgggcacgcaggaggggcttcacctggcgaggtgggggcacagaaggctgcaagtcccccaggggagacgggctcacctctcccaattagccccaggctgtgcaggatgctggagcttcagggcaaggactccgcagccaggctccagccacagcctcaccgcgtggccatgaggctctgcccattcgaggcttcagtttc

SEQ ID NO: 98901 - DNA, 54 bp, Homo sapiens
  chr8:143319314-143319368
  hypo
ttccctgctggcccacgccacccgcctgcccacgccacccgcccaggtctccat

SEQ ID NO: 98902 - DNA, 50 bp, Homo sapiens
  chr8:143326089-143326139
  hypo
aactaagacagtgagcggggacgcagggagagagacgcttaccgcagccc

SEQ ID NO: 98903 - DNA, 47 bp, Homo sapiens
  chr8:143329464-143329511
  hypo
ccttacaaggcttcacgcagcatcctccacctcgccctctgccttct

SEQ ID NO: 98904 - DNA, 132 bp, Homo sapiens
  chr8:143332980-143333112
  hypo
tatgagaggagccttcgacacccttcactgagtgcctcttgccagggcctgggcaccatatacccaccgcccgcgttctctatctgcagggcccgggcaccatgtacccgccacccgcgatctctgtctgca

SEQ ID NO: 98905 - DNA, 346 bp, Homo sapiens
  chr8:143333322-143333668
  hypo
tctgtcttcagggcccgggcaccatgtacccgccactcgcgttctctatctgcagggcccgggcaccatgtacccgccgcccacgttctctatctgcagggcccgggcaccatgtacccaccgctcgcgttctctatctgcagggcccgggcaccatgtacccgccgcccgcgttctctgtctgcagggcacgcacgttgagagagagcttgtttgatatctgggcggtttgtttggtttaattttgttgttttccctttctgctgtcaagaggtaaacagacggctgcttcatcttcttaagcaggcctacattcgtaatgcatgggttgcgggtgggaggagga

SEQ ID NO: 98906 - DNA, 159 bp, Homo sapiens
  chr8:143334538-143334697
  hypo
cccaggctggcactacgggtacgggaggagggccggtagccgtggagtcacagcagtggtgacggcggtgcctgcagaagcagggccgctgggccacctcccgagcacaagcaacaagcgaggcacaggccagcgtgcgtgccgcgtctgcacagggtc

SEQ ID NO: 98907 - DNA, 142 bp, Homo sapiens
  chr8:143386798-143386940
  hypo
agtcacactgggatgcgagccgtgtggacacccaggaaggcggcagggctggggtgcgggccagaggagaccccgcaggtgctcggtctccctcacctccacagcgggaggatcgggggcctggtgccgctctccccagcag

SEQ ID NO: 98908 - DNA, 324 bp, Homo sapiens
  chr8:143405647-143405971
  hypo
gaaaggccaggcaggcggctacagggtccaggaaacctgacccaagcatccctctcccagcactcctgtgcgaggtctgcacagctgccagctcggcggctcctgtactaccagccaggtggtgccgttgctgccagcagtcaggtgactgaggagtctgcgaggcctgcctggggggtgtgtcacctgaggcccatttgccctagcgccctgccctagtctgccggggccagaaccgacctgagtacggaggctctcgcatttgcttgtcattacttaagatgccgtttagaagcacctcatgtcccgcgtatctcatacctg

SEQ ID NO: 98909 - DNA, 313 bp, Homo sapiens
  chr8:143436977-143437290
  hypo
gcaggggtccctgtgcgggcagcttctgactggcctacaccctaatgctatcactacggaacctgctggccaggccacaccttaagttctaaacacctcagggcaagggctccacccgcccacacaaacacctgaagtgcgaaggcaggtttcagagcaaagtgagcctcacgccagctgagtacagacccaagtccctagggccggggaaggcggtgtgaccccacgttccctctgagcaagacacccgcctgtgccatccagccctgcccagagcagggcagcaccaggacaccatcgacccagtgggccc

SEQ ID NO: 98910 - DNA, 52 bp, Homo sapiens; identical to SEQ ID NO: 42023
  chr8:143463629-143463681
  hypo

SEQ ID NO: 98911 - DNA, 456 bp, Homo sapiens
  chr8:143509151-143509607
  hypo
gctgggattggagcccgccctgcctcggggaagatcctcgctccctttctccacggcacctctgtgattctcgtcacctgccaacaccagcaccagggctgcccctcctgacggccccctcgccgtctttctgggcacactccatcggcacagcgtcttcactgtcctcctgacaaacctcgtgccacccccatcagcttcagcaccacctccacagcagccgtggccagcaccgacgtccttttccgtcaccgtcaagcctcaaaactgggaccgtgggtaatggcgtcaccccatccgccgtctctctctagctgccaacggcgccttcaccagacacgcccggcaccaccttccaggtcagcagtcccagccctgcgtatcggaggcctgctctcccacagcgtccacagtcactgggccaggctcgcacctgtgaggggccaggacccatac

SEQ ID NO: 98912 - DNA, 15 bp, Homo sapiens
  chr8:143509628-143509643
  hypo
cggccaccctctggg

SEQ ID NO: 98913 - DNA, 94 bp, Homo sapiens
  chr8:143511468-143511562
  hypo
aatgcccatccacaccgctgggcaggactggctaaaataacacgtgcgacgcatgcacctgctgatggagaatccacgccggtaaacctcaggc

SEQ ID NO: 98914 - DNA, 16 bp, Homo sapiens
  chr8:143518352-143518368
  hypo
gtagagttggagtcac

SEQ ID NO: 98915 - DNA, 1302 bp, Homo sapiens
  chr8:143530469-143531771
  hyper
ccgtccatccacccacgcacctgcattgcctaggcacaacccctcacttccttccctccattcatctgtgtgtccgtcctgccgtccaccatccatcatccagccagccagtggggccactcccctgctcctggagaaggccgagagcaggaacccaactcttggcttctctgctgcgcggggcaggcaccgggctctcctaggtgtgcgcgcgtgtgtgcattttatccgcccccccttatctcgctcccctccccccacacccccgccccccgctagcgctccccctctaatgtgtgatctggaagctctataaagcctgatgtaatccgtaatgcagtctctggctcccgattcgggatccagtttcagagagcgagagattggggagcgccggcagccgggtggggggaagcagctctcgcctctctcctcctccttctcctcgtcctcggcctcctcctcctccccgcgccgccccgcccccggctcggcttggctcgcccccccccccccctcgccaggaaggggaaaaaaggcgagaagagccgggcaggcgagaggagcggagcggcggcggcggccggagagggagcggcgggcgcaggcggcggcggcgggcgcggcgttggcggcggccccggcggagcgagcgcggagccggagagccgggagcacaggcggccgcgccgcgtcctggcccggcccgggcccgcgcgccagcatcgtccgcagcgcgggcatccggaccctccgggcgcccggggggctccagcaggcgcgggggaacgggagggggcctgcgtgcgccggcgggtgctctccagggggcgtcccggcgaggcccagagcgggccgggggcggcggcggctggaggagccccccccacctccggtcgggcgcccggctcagccgccggcgacgcgaggcgctcgcggggatttgcaactcgccggatcgagtcctcgccggcggggccgctgctgctggggaaggtaaggaaggctccggcggggggctgggggcgcggcgggtgggggcgcagcgagggtgggagggggtcgggggaggggcgggcgcccagacttcctaacttcgccgtttggggcttcgcagctccgaggttttgcgctcagagctcaggagtttggacccccaccccctaccccctcagccccctgccttctccagcggtggcgatggaatgtggcaggtccccgcgagcccgcattgggcaggctgaggagggggcgaccctggacgcaggagaggctcctcggcgccgccgcctcctccccatc

SEQ ID NO: 98916 - DNA, 532 bp, Homo sapiens
  chr8:143531978-143532510
  hyper
gacattgtaagggcccgagacgtcctccccccacgcacagagctcggggcaggcaggagaaaaccccagactccttctcgaagccctcgctcgtagaagccctcgcctgtagacctggcattggcagtggagactccctggaggtactctcccccacttcgggcggagggctatttttgcgccccccacccccacgcgaacgcctggctcttccctccttgtctacctttccactgggtcggacaggccgcgcggataagccgctctcaactttgggccggccctatgccgtctccgctccaagcgccgagcactcccgggcgccgagcactcccgggtccgcgtcgccggtgagcagaggccgccggccctccaccgtcgccgcgctagcttggagccgcgcggagctgcctcgaggaacgagcacggcccccgccccctcctggggaggctgggagctctggacccggccaggagccctctccctaggtccccgcggccccctgggcgaggtagagagctcctccggcct

SEQ ID NO: 98917 - DNA, 958 bp, Homo sapiens; identical to SEQ ID NO: 3374
  chr8:143532541-143533499
  hyper

SEQ ID NO: 98918 - DNA, 141 bp, Homo sapiens; identical to SEQ ID NO: 3375
  chr8:143533500-143533641
  hyper

SEQ ID NO: 98919 - DNA, 1049 bp, Homo sapiens
  chr8:143533708-143534757
  hyper
cgggcgcttgttcctgccggggtcccgcgcaggggcggatagagggcgattcgtcgcctcggcctcaggcagcactcatccggatcccgggctagggagggggcgcagccaagttgtggagccctcggaggcccttccctctcccgcaggctccggcccctctcggacctcggtggccgcgtccgtgaaatggggacgcgggctctgctctcggatcccttccagcccccgaccctccgcacttgtcccgagatccaacgtgcccggtccgcagcgtgctgggtctgcggcgtcagggtggcccgagtcccgagaccatctgcgcttgcggacacagccgcggggcctggcatgaagggccccagggagggcctagcaagcgcccggggtccgagcagcctcctgcggcgtcctccgcccccggtcggcccgaccccgcctccgggagtgggtcgtggggcgcggagcccgtcctccggggacgccgcggggctccaggcccaggcggccggcgcggggccgcagtggcggaaggcggagggccggcgcgctgccgctgactgccgggagagggcgcccgcaccgcgcccgcgcggccctgcccgccccttccgtctcctccgcgcctggcccgcggctccggccccatcttgggcagccccggccgccacctccctcccgcccgcccgcccgcccgctcgctcgctcgctcgccgtccgctcccgccgccgggtcccgtgacgcgcctcgcgtctcggccggagcccccctcgccggcccggcccggtccccgtgtgcggtgcgctggcgtgagcgcgcgtttgcgtgctggtgtccatgtgtggcgcgcatgcacgtgcgtgcccgtccgggaggctgggggcacgtgtgtgcaggcatgcagacttgcacatgtgtgtgcgtgacgggggcgggtctcgcgccggtgtggccccggatggcaggatttagtcaaaccccgttttaccgtcggctctggctctgggctgcccccgggtctgctctgtgtgcacgggatggacccctg

SEQ ID NO: 98920 - DNA, 77 bp, Homo sapiens
  chr8:143535787-143535864
  hypo
accgtgaggtgcacacgggtgcacacggcacccccgccccgcgatgtgtgcctgtctacacacgcagaggggaagga

SEQ ID NO: 98921 - DNA, 49 bp, Homo sapiens; identical to SEQ ID NO: 42027
  chr8:143538439-143538488
  hypo

SEQ ID NO: 98922 - DNA, 30 bp, Homo sapiens
  chr8:143539356-143539386
  hypo
ccccgcccctccccccgtgcagtcttttct

SEQ ID NO: 98923 - DNA, 163 bp, Homo sapiens
  chr8:143543201-143543364
  hypo
gaggagtcaaggccacgtgggttcagcaccaggtgggactggcactctgccaggctctgccgacactcagccaggactgggctcaccccgggactgtagcgcaaggtgaggctggggaggccttctggctgtgggacctgcccacagccgctccctctccatg

SEQ ID NO: 98924 - DNA, 157 bp, Homo sapiens
  chr8:143550641-143550798
  hypo
gtgaatgtgtgtgcacgcgtgcatgtgtgaatgtaaatgtgtgcacatgcatgtgtgtgaatgtgggagtgtctatgtgcacgtgcatgtgtgtgaatgtgggagtgtgtatgtgcacatgcagatgtgaatgtgagtgtgtgcacgtgtgaatgag

SEQ ID NO: 98925 - DNA, 93 bp, Homo sapiens
  chr8:143555636-143555729
  hypo
ctgggatcgagctgccggatccccagtgttccccagtggcagcggccccagctccatggtgggtcccctcgtggtggccgccagctgtctcct

SEQ ID NO: 98926 - DNA, 207 bp, Homo sapiens
  chr8:143556062-143556269
  hypo
caggtccatgaaggccgcggggactgtcggggcagggatggagaaagactcactagagaagctgaacagagcggccggggtcagggcaggggcgtggcggggaggcgcctgcaggcatttatcccaggctccctcctcgggtggccagctggccaggtccagggcaggctccgtcaggctgtgccctgggttcgaggccctggttgg

SEQ ID NO: 98927 - DNA, 357 bp, Homo sapiens; identical to SEQ ID NO: 42029
  chr8:143557723-143558080
  hypo

SEQ ID NO: 98928 - DNA, 254 bp, Homo sapiens
  chr8:143558389-143558643
  hypo
gcagccctcctgctgcggggtctggccccggtctgactgcagccccatgggcggcaggcctgtgacgctgtagtggggcctgcaggtgacccagcagccgaggagtggtccccgtggagcgtgtgctccagcacctgcggcgagggctggcagacccgcacgcgcttctgcgtgtcctcctcctacagcacgcagtgcagcggacccctgcgcgagcagcggctgtgcaacaactctgccgtgtgcccaggtgg

SEQ ID NO: 98929 - DNA, 499 bp, Homo sapiens
  chr8:143560990-143561489
  hypo
tccagagccagctgccggctctcagtaccccttcctgaacccctgtcccgggccccttggcagagccccatgagatctgtgatgaggacaactttggtgctgtgatctggaaggagaccccagcgggagaggtggctgctgtccggtgtccccgcaacgccacaggtgagggctggagagcacgtggtgtatgggggctcccgtcctgtcctcacggtgatgcccacgctgaggtgctgtcagcactgggaggcggcccagacacggagcccagacagcctgcgtgtgctggcgcggggtggtggggccgcgagcccagggcaccgtgtgagaactctgtggcagctgctgttctgagcactcgctaggggctggcacccatgctcagccctaacgcaagatgtccacggagtctaagcaacccaagaagccgccaccatttacagctgggaaactgaggcacagggaagtgaatgcccttgcccggggcttgcgggga

SEQ ID NO: 98930 - DNA, 154 bp, Homo sapiens
  chr8:143567944-143568098
  hypo
caggcggcattcagacgtgtctggtggaaaccatagcttcgtgcctattgtacttgaacaagtcccactaaaacatgtccaagacggatcgacattcttattataatgtctttgggaggctaactagcattaaccttttaaattaaagactgag

SEQ ID NO: 98931 - DNA, 152 bp, Homo sapiens
  chr8:143572706-143572858
  hypo
ctggagcaagttccacgccccatgtggggttccgcaaggagcagtcaggctgtggggtgccatctcggggccctggtgggtgtgccagagtggggccatcctcccagacagcaaggtgggggcagcgaagagaagctcgcccagtcacagga

SEQ ID NO: 98932 - DNA, 30 bp, Homo sapiens; identical to SEQ ID NO: 42033
  chr8:143573208-143573238
  hypo

SEQ ID NO: 98933 - DNA, 220 bp, Homo sapiens
  chr8:143587271-143587491
  hypo
gtgggggaggtgaagcggggacccaaggctccgggtgagcgatggcaggctggccgtgccctccccattcattcacgcgcaggcgtcctggctgtgcgccctaccttagtggcgcctgtgggcgcctgtgggactgtcatgcaccagaatgtgtccctggggccacatgtgtgagcagcgtgctgactgagcacctgggcgaccccgaggtggagtaaac

SEQ ID NO: 98934 - DNA, 384 bp, Homo sapiens
  chr8:143591423-143591807
  hyper
aggaggaagaggaggcggaggaggaagaggaggaggtggaggaggaagaacaggaggaggaggttgggggtggagaggaggaggaggggtttgcagagcaggtcagtccctggtgcaccaagtaacaagtcctgtgcttaaatgcgtgctcagatgaaaagcggggcagtcgcggcccgtagacagcgggcggctgggtcagaccgcagagggaagtttccagcggcaagcctccccgcggggaaggctgtgtctgtcccaggagatgagccgcaggcaccaggggtgatgaggcccgggggaggtggatgtgggggatggagcggtcccaaggtcgtcagctccagccggcgccctgggccgcggggccggagagctccggag

SEQ ID NO: 98935 - DNA, 156 bp, Homo sapiens; identical to SEQ ID NO: 32303
  chr8:143591888-143592044
  hyper

SEQ ID NO: 98936 - DNA, 178 bp, Homo sapiens; identical to SEQ ID NO: 32304
  chr8:143592101-143592279
  hyper

SEQ ID NO: 98937 - DNA, 221 bp, Homo sapiens; identical to SEQ ID NO: 32305
  chr8:143592358-143592579
  hyper

SEQ ID NO: 98938 - DNA, 24 bp, Homo sapiens
  chr8:143592663-143592687
  hyper
cgggacccccggaaagtggctgat

SEQ ID NO: 98939 - DNA, 306 bp, Homo sapiens
  chr8:143595515-143595821
  hypo
cagaggctgtggcttcgggggttcagagtggcctacaggggctgctgaccaggacaggggcctgagatggtggtagaggcgggtacgtgggcaccccgggagccagggtgggatgagatccgggcagggtggtagagcgaggggaggtgagacccacgagtcctcctctagagctggcctggagccagggtgtcggcgcagatgcgggctgcgcagatgccggctctgcggctgcagcaggcctacgacggccggaaggttgagtaaccgctctgagtcacacctgtgaggcggatgatgccacct

SEQ ID NO: 98940 - DNA, 171 bp, Homo sapiens
  chr8:143598967-143599138
  hypo
tgcaaggaagctggtcgggatgtgtccgggctgtggagggacaggtgggtgtggggtgtcagggcctggctggatggcatcttggatgggggtgggccggagtcaaagcggctgctgcccccggatttctcgaagcctgggcccaagaggactgtgcgtgtgggtgggcct

SEQ ID NO: 98941 - DNA, 30 bp, Homo sapiens; identical to SEQ ID NO: 42037
  chr8:143599572-143599602
  hypo

SEQ ID NO: 98942 - DNA, 30 bp, Homo sapiens
  chr8:143606129-143606159
  hypo
ttgggctttccttcccgctctcctcccacc

SEQ ID NO: 98943 - DNA, 35 bp, Homo sapiens
  chr8:143609580-143609615
  hypo
aaggggactggaaggcgcagcggcctccctctggg

SEQ ID NO: 98944 - DNA, 67 bp, Homo sapiens
  chr8:143616161-143616228
  hypo
gctcaccctggtgcacgccacatgggccaggccctggtcccagcaatgaactcgtgttagtgaatct

SEQ ID NO: 98945 - DNA, 47 bp, Homo sapiens; identical to SEQ ID NO: 42038
  chr8:143618365-143618412
  hypo

SEQ ID NO: 98946 - DNA, 88 bp, Homo sapiens
  chr8:143620736-143620824
  hypo
cgacttcgagaaggacgtggatctggcctgtagatcaggtgagcgcccgacaggtgagaggacagtgccagcccggccccctgcatgg

SEQ ID NO: 98947 - DNA, 161 bp, Homo sapiens; identical to SEQ ID NO: 15189
  chr8:143621956-143622117
  hypo

SEQ ID NO: 98948 - DNA, 541 bp, Homo sapiens
  chr8:143623394-143623935
  hypo
cccatgccaaggggccgcccaccaatttcaacagcctgccggccaacgtgtccaagctgcacctgcacggctcaccccgctatcccggcgggcccctgcccgacttccccaaccactcactgaccctcaagagggacaaggcgcccaagtcctccttcgtcggtgacggggacatcttcaagaagctggactcggagctgagccgggcccaggagaaggctctggacacgagctacgtgatcctgcccacggccacggccacgctgcggcccaagcccaaggaggagcccaagtacagcatccacattgaccagatgccgcagacccgcctcatccacctcagcacggcccccgaggccagcctccccgcccgcagcccgccctcccgccagccccccagcggcgggccccccgaggcaccccctgcccagcccccaccgcctccgcccccaccgccaccacctccccagcagcccctgcccccaccgcccaatctggagccggcaccccccagcctgggggatcccggggagcctgccgc

SEQ ID NO: 98949 - DNA, 30 bp, Homo sapiens; identical to SEQ ID NO: 42043
  chr8:143624997-143625027
  hypo

SEQ ID NO: 98950 - DNA, 34 bp, Homo sapiens; identical to SEQ ID NO: 42044
  chr8:143631480-143631514
  hypo

SEQ ID NO: 98951 - DNA, 45 bp, Homo sapiens
  chr8:143652467-143652512
  hypo
tgaggatggccacgacgctgtcccgctcctcggtgctctgaagag

SEQ ID NO: 98952 - DNA, 95 bp, Homo sapiens
  chr8:143656193-143656288
  hypo
catgttcccgggactcgtgccagtcccctcctccaggaagcccctctatttgtgggccctcggggaaccccgtgcatgcccgggcagcacctcct

SEQ ID NO: 98953 - DNA, 37 bp, Homo sapiens
  chr8:143660632-143660669
  hypo
gggacgtgtcactcacgcctgccggggccagagctcg

SEQ ID NO: 98954 - DNA, 40 bp, Homo sapiens
  chr8:143665380-143665420
  hypo
ctgccctggggaccccgaggccttacggggtgagcacctc

SEQ ID NO: 98955 - DNA, 33 bp, Homo sapiens
  chr8:143665824-143665857
  hypo
ccctggggcgcccctcggcgagggacagggccc

SEQ ID NO: 98956 - DNA, 30 bp, Homo sapiens
  chr8:143671868-143671898
  hypo
ggcctgggtttccatcgccacccttccagg

SEQ ID NO: 98957 - DNA, 30 bp, Homo sapiens
  chr8:143677149-143677179
  hypo
accccagcacccagacgccactgacaaggg

SEQ ID NO: 98958 - DNA, 30 bp, Homo sapiens
  chr8:143679642-143679672
  hypo
gaagaaagctcagcccggctggctggcatc

SEQ ID NO: 98959 - DNA, 353 bp, Homo sapiens
  chr8:143695463-143695816
  hyper
cctgcttggacacctcggccagcaggtgccggtgcgtccgccgcacgtgctccagcatctcggcccggcacttcccgatctgcaggatcacgttgggcttggccacctgcccgccccgcggcccggggtaggcgtggagcccgccgctggtccggtggtccagctccatctgtgcgcaggtgctccggcaggcggcaaactcctcggggcggacagagggtggtccggcgctggggtccggcggcctgggtcccgtgcggagctgcggggagcgcctgtctgtcgctgcgggccggcggcggggccggcggagcacgcccggggaggcaggtccggctcggctgctgcggagg

SEQ ID NO: 98960 - DNA, 30 bp, Homo sapiens; identical to SEQ ID NO: 42046
  chr8:143702052-143702082
  hypo

SEQ ID NO: 98961 - DNA, 30 bp, Homo sapiens
  chr8:143704046-143704076
  hypo
gcagagcctcctcctcgccaggtcccagca

SEQ ID NO: 98962 - DNA, 30 bp, Homo sapiens
  chr8:143704780-143704810
  hypo
gtcctaaggtgcatccggtggcagatctgg

SEQ ID NO: 98963 - DNA, 136 bp, Homo sapiens
  chr8:143819384-143819520
  hypo
tgagtgtatccagtgcgcatatggatgtgcgtgcctgtgtgcatttgtgtgtgtgtgtgtgtgtgtgcgcacgtgcacgcaggcaacgggcaagcttcaaggtggttgaatgggcagcacccgcaagcctctgggg

SEQ ID NO: 98964 - DNA, 30 bp, Homo sapiens; identical to SEQ ID NO: 42048
  chr8:143827179-143827209
  hypo

SEQ ID NO: 98965 - DNA, 45 bp, Homo sapiens
  chr8:143831792-143831837
  hypo
tattgcagcaggacacgggcagggtctggccgatgccatccacat

SEQ ID NO: 98966 - DNA, 61 bp, Homo sapiens; identical to SEQ ID NO: 42049
  chr8:143833212-143833273
  hypo

SEQ ID NO: 98967 - DNA, 30 bp, Homo sapiens
  chr8:143840647-143840677
  hypo
ggaggcttcatctgacgataaaaccctggt

SEQ ID NO: 98968 - DNA, 30 bp, Homo sapiens
  chr8:1438482-1438512
  hypo
gcggggttgaaaaggcgcctgtggagaagg

SEQ ID NO: 98969 - DNA, 30 bp, Homo sapiens
  chr8:143855362-143855392
  hypo
ctgggctacctgcatcggggatggattggt

SEQ ID NO: 98970 - DNA, 159 bp, Homo sapiens
  chr8:143855667-143855826
  hypo
aacccccagcctgtgcgcgcatcccccagtcctgcgtcttttgccttgctcggctgggtcctgctgtggttggggaccaggactcgggggaccacctgctctgcccctttccctccctgcccagaatagcgctggccgggtcagcgtccaggacccacc

SEQ ID NO: 98971 - DNA, 30 bp, Homo sapiens
  chr8:143857179-143857209
  hypo
atcaggcccccagcccgtcaccttccccgg

SEQ ID NO: 98972 - DNA, 217 bp, Homo sapiens
  chr8:143858535-143858752
  hyper
accgtgaggtaccgccgcgcctgggagtcacccgcggccgctcgccggtaggtgcctgcctgagtctaatcgtaggcgtgtctgtgtgtcccgcagcacccgtgccgcatcgcctgatgctcaccgcaggcccagcccagtcccgcccccggaacagcccgcccagcgcgagctcaccgcaggccccgccccaggcctgccccggccccacctcctg

SEQ ID NO: 98973 - DNA, 154 bp, Homo sapiens
  chr8:143859127-143859281
  hyper
acacagaggcagccacgcagtgattccctggcgaccctcagactcacgtgttcagcccggacactccgcaggctatcttcaccgcgtcccgcggcagcccagccttccccgcagccgcctccgcccactcgcccgcgccgcgtcgtttgtcggc

SEQ ID NO: 98974 - DNA, 24 bp, Homo sapiens
  chr8:143859337-143859361
  hyper
cggaactggcgccctttggcgcac

SEQ ID NO: 98975 - DNA, 124 bp, Homo sapiens
  chr8:143870853-143870977
  hypo
gctcagagagggaagcgcctggcttagggcggcacagcaccgtactccaggcttgcaccagcccagccctgggccctgtcctggctgaatgggtgcctggtggacaaggcggggccccgggctg

SEQ ID NO: 98976 - DNA, 74 bp, Homo sapiens
  chr8:143876922-143876996
  hypo
agtgcttctttagcacgggcacgggctcgggagaccagtggcaggctgggtgggggcagcggccccgggaggct

SEQ ID NO: 98977 - DNA, 33 bp, Homo sapiens; identical to SEQ ID NO: 42052
  chr8:143879185-143879218
  hypo

SEQ ID NO: 98978 - DNA, 182 bp, Homo sapiens
  chr8:143882149-143882331
  hypo
ctcccaggagggctgcgttttccaggcttccacatacacgccacctgctctctcctgctattttaaacgggcaccctttggtttaaactgtaaagccccttcttggccctattttggcaatactgctggggagctgcggggcttcctctaacactcgcagaaagatgcgatgatgaacgtag

SEQ ID NO: 98979 - DNA, 30 bp, Homo sapiens
  chr8:143921405-143921435
  hypo
agctgtgtgtgggagcgggaagcgcgtcag

SEQ ID NO: 98980 - DNA, 123 bp, Homo sapiens
  chr8:143956397-143956520
  hypo
gcctctgccaggcgccgcccaaggcactggcgcatgccaaagccaaagggcacgtggtagaagttcctgccggagcccctgatgtctagccagcgctgggggttatagcgctcaggcctcggg

SEQ ID NO: 98981 - DNA, 129 bp, Homo sapiens
  chr8:143956795-143956924
  hypo
tcctaccgaagaacccgcagaggtcccagatccatgggaagcccaggtcgtaggaagtgcttccttgcacctgctgagcccggccaaacctcccctaacttaagcagccccgagcgcagaaggacatgc

SEQ ID NO: 98982 - DNA, 173 bp, Homo sapiens
  chr8:143960027-143960200
  hypo
ccctgagggaggctgcggccccggcgaacaccaggctcagtactcagcctgtgacctgggccagtgggagtacccttctcagggcctcagttttctgacctatgggaaggacagtccccagaccgcaagagaaagcatcggccaaggttggtgcagagcgggttctcactaca

SEQ ID NO: 98983 - DNA, 247 bp, Homo sapiens
  chr8:143993967-143994214
  hypo
tctgcctctgccaggcgccgcccgaggcactggcgcatgccaaagccaaagggcacgtggtggaagttcctgccggagcccctgatgtctagccagcgctggggattataccgctcaggcctcgggaacaaggcggcattgcgacccagcgagtagaggaaaacctgtaccaatgtctgcggacggtgcagagcagggatcagggaatgactggggagggaggttctcagctcgaggggtgtggggc

SEQ ID NO: 98984 - DNA, 33 bp, Homo sapiens
  chr8:143994764-143994797
  hypo
cactgatgctggctgcggcggccaggctctcct

SEQ ID NO: 98985 - DNA, 159 bp, Homo sapiens
  chr8:143996499-143996658
  hypo
agggtcaggctcccccgggcgttctgcagcaccttcttcttcagggcctgggagaagtccctggccactgcatccaccatcgggaggaacctctgcacggccttgggcgacagcacatctgggttcagccgcaatcggttgaagcgccattcaggccca

SEQ ID NO: 98986 - DNA, 32 bp, Homo sapiens
  chr8:143998295-143998327
  hypo
aacccacagtgcagacgcgaccccacaggatg

SEQ ID NO: 98987 - DNA, 33 bp, Homo sapiens; identical to SEQ ID NO: 42057
  chr8:144015246-144015279
  hypo

SEQ ID NO: 98988 - DNA, 175 bp, Homo sapiens
  chr8:144027680-144027855
  hypo
cacgcctccccaccacggcaccaggggccggcagtgctgctgtctgcttctccctagggtgcatcaccctcagctcagccaccatcgcaaaggccacaggccaggtgccagaatggcagctgtgtgcgtctcacagctctggagctgggaagtccaagatcgaggtagcagcagg

SEQ ID NO: 98989 - DNA, 119 bp, Homo sapiens
  chr8:144058296-144058415
  hypo
aatccactggcacctcgatgaagcagaaagcaggacttagccagacactggatccaccggcacctcgatgaagcaggaagcaggacttagccagacacgggatccgccagcgcctcgat

SEQ ID NO: 98990 - DNA, 119 bp, Homo sapiens
  chr8:144069546-144069665
  hypo
cgccatgtggacttccgatgaaccctagttctgggtccttaggtcaaaacaaccttaatgttattgtaaacacaaaatcctgcccttaagcgagttacaggctgcggtgcaggtggcat

SEQ ID NO: 98991 - DNA, 151 bp, Homo sapiens; identical to SEQ ID NO: 42060
  chr8:144070508-144070659
  hypo

SEQ ID NO: 98992 - DNA, 61 bp, Homo sapiens
  chr8:144090641-144090702
  hypo
gttgtctctgcccctcggtggcagctgtttcacctggctacgttgtcggctgtcttccaac

SEQ ID NO: 98993 - DNA, 143 bp, Homo sapiens
  chr8:144099550-144099693
  hyper
gctcacacccaaacacgtctgctcacccgtgggcttcccaccccgaacacaacgaggactgtccaggtgtcagtgacggtcaccccgacctggtcccctgtccggcctcgccaggtcagcacccgccgcgcgcacagcagggc

SEQ ID NO: 98994 - DNA, 128 bp, Homo sapiens; identical to SEQ ID NO: 42062
  chr8:144164496-144164624
  hypo

SEQ ID NO: 98995 - DNA, 186 bp, Homo sapiens
  chr8:144190312-144190498
  hypo
aacacgacaaactagcgtccaagatggagcggcttcggcctccatgatccgcccgcgccgccccactaatccagctctgaccgtctcacctgccctcctcttccgcgatggtccctgagccttagggagggtgcttggggttgtctggcttcagcagcggtgccttggcgtcggaaaacaggtcgg

SEQ ID NO: 98996 - DNA, 264 bp, Homo sapiens
  chr8:144203678-144203942
  hypo
aaataaaggtgtgaccgggagaagagtggggaaggagccgactcaaggctgagtcccgcagccccgtgagggcggagtggaggttacggggcgggagcgggacgggaatctgagctcccagcagccgagccgagaggaaacccctgctcctgcccatgagcccagcagagcacatgccctggatgtcgagacgcggtccacagagagatgggctcctgtgactgtcctcggataggcctctggacgccacgccctagtgcagct

SEQ ID NO: 98997 - DNA, 30 bp, Homo sapiens
  chr8:144204525-144204555
  hypo
cccttacatgtaacacgctcacacatgcac

SEQ ID NO: 98998 - DNA, 134 bp, Homo sapiens
  chr8:144208693-144208827
  hypo
tgcaacgccccttcccggcagcacccacgggtattggaggagtggtaggggatgggggaaggaagcttgggtgggtgggtcattggaactcttgtgcatggaagagcgttagatgatcccgacaccagaaaagt

SEQ ID NO: 98999 - DNA, 42 bp, Homo sapiens
  chr8:144209468-144209510
  hypo
ggcccctgcatcaggcggtcccccagccggcagagcaggctg

SEQ ID NO: 99000 - DNA, 61 bp, Homo sapiens
  chr8:144216486-144216547
  hypo
aaacacactttctcacgtgcacagaaaacacagactgtcgctgacgcgggataggtaaggt

SEQ ID NO: 99001 - DNA, 42 bp, Homo sapiens
  chr8:144222920-144222962
  hypo
ggagtacaggcgtgaggcactgcgccccgcctccattttgca

SEQ ID NO: 99002 - DNA, 218 bp, Homo sapiens
  chr8:144226037-144226255
  hypo
gagtttcatgaagtccgtaaagctgtatttttcctgtcgcatttctataaagcattgtaaagtgacttatgtcagagcattggctcgatgtggtcttctgggacccccttgtgtacttggctcagcgctgcccgcacatgcccacgctgctccgtactgtggcttgctcaccgccgtgtgcaatgttcctttgcgtgtcacagcgcttccttaaccca

SEQ ID NO: 99003 - DNA, 41 bp, Homo sapiens
  chr8:144236655-144236696
  hypo
ggcatctcagatcaacgggcgaaaggcgggttgtttaataa

SEQ ID NO: 99004 - DNA, 249 bp, Homo sapiens
  chr8:144238806-144239055
  hypo
agacatgggcatgcacgtgtgggtgtgggcacgtgcactgggacacgccagtttgtgccagttatgtgcatgccccagcacgtgtgcgcggggcacctggggtgtgtgtgtgtgaaggagcagggcgggcacgggtgtgtgtgcacatgctggctgcgtgggcaccgtttgtatgcttgtctgggcatgagtgtgtgtgcacatgctggctgcgtgggcaccactgtttgtgggcgtgtctggtgtctg

SEQ ID NO: 99005 - DNA, 235 bp, Homo sapiens
  chr8:144241199-144241434
  hyper
cccggaatccaaggccggggtccgcccggagctcgcagagccccacccccagccccttctccagagcgtccgccgtcacagcatccccgccgggagacgtctggcctctggggcgaggtgacagctcgagacgcctccgccccgcgccggcacctgtgtgggggagcggatggggggcgtcctcttctccccggggagctgcaggtgcgtccggacaggaatgagcggcaggggc

SEQ ID NO: 99006 - DNA, 87 bp, Homo sapiens; identical to SEQ ID NO: 3378
  chr8:144241435-144241522
  hyper

SEQ ID NO: 99007 - DNA, 120 bp, Homo sapiens; identical to SEQ ID NO: 32313
  chr8:144241583-144241703
  hyper

SEQ ID NO: 99008 - DNA, 546 bp, Homo sapiens
  chr8:144241757-144242303
  hyper
cggggcggagccggggcgggggccgcgcggggggcgggggcggctgggagacgcgcggggcggggggcgcccggggctcgcggcccccacgcaggtagctggcccgggccctccgcgcccccttgctggcgcgcgcgctccctcgggttcccgctccctccctcgcggcgccccctgctcctccccagcctccgcggccccctacccaggcgtgggcaggatcccttccccctctgcttggctgagatccccttggaatttctcggaagaacgtttactgcgaaaggaagcaaaatgcacaaagacgcagagagggggaggtacccggcgcggcgccacgcgcaggtccgggttcgcagacccctggggtcagactcccgccctggggccccgccctccccctcctccccgcccctccccaacctcatacccgtttccccgtttccccgtttccagtggctccaggccgttctcctcccctgagcatccatgaagacccccaccagaagccgcagccccaggggcttctgtcgccaaatactccca

SEQ ID NO: 99009 - DNA, 30 bp, Homo sapiens
  chr8:144275059-144275089
  hypo
cccagagctcaaaatcgcccaaactagcca

SEQ ID NO: 99010 - DNA, 104 bp, Homo sapiens
  chr8:144291486-144291590
  hypo
ccaaacccaatctcacggcaggctgcctcccagagatggcagtgcacaggtctggatctgactcgagctggtgtcaacacgggggagggcgtacagagtaggac

SEQ ID NO: 99011 - DNA, 125 bp, Homo sapiens
  chr8:144292345-144292470
  hypo
acccactagcctttccggggcgggacagagggaacagcctctcagtggcgagcactaaatttaattcaatctgcgaatcaaatgtgctctgattgtccctaggtgattctcgcaataagcacttg

SEQ ID NO: 99012 - DNA, 317 bp, Homo sapiens
  chr8:144293576-144293893
  hypo
gtgggggaggcgggccgagggcgagagggcgcagggaggcgggtgggggtggggccacgcgcggaggggcagggaagggcggggcggggcggggcgggacggggctgggggggacaggcatcaggtatgaagagtttggggctggcggggcgtgtccggctgtggcgtgggcaccactatgggagaccctggcttggcaagtgaccttgcagccttggctggggaagggctagatgctgggtgggtgccggtagagtggaaagaatgacaggttcaggtgaattaaggaaggatggttgactcggtggctgggacat

SEQ ID NO: 99013 - DNA, 39 bp, Homo sapiens
  chr8:144303553-144303592
  hypo
atgggtacggggcaccgggggaggcggccagtgccttag

SEQ ID NO: 99014 - DNA, 147 bp, Homo sapiens; identical to SEQ ID NO: 42070
  chr8:144312859-144313006
  hypo

SEQ ID NO: 99015 - DNA, 30 bp, Homo sapiens
  chr8:144322593-144322623
  hypo
ctgtgcccaggatgccgggaggatctcagc

SEQ ID NO: 99016 - DNA, 214 bp, Homo sapiens; identical to SEQ ID NO: 42071
  chr8:144326825-144327039
  hypo

SEQ ID NO: 99017 - DNA, 434 bp, Homo sapiens
  chr8:144328173-144328607
  hyper
agtgagcacagccagcggctgggagcacatcccggaggggctgcctgcggcgggaggagcggcaggggccacgtggtgggggacggctcgccagggcgcgcacgcggtggcggcggcggtggaggcgttgcccgcctagctaggggcccgcggcctggagaggcgtcggttctccttccgcgctgaaggcggagacagcgacttcccgtggaggcaagccgtgggcgccgcggaggcgggggctgggggtcggcggaggcgggagctgggggtcggcgggggctgggggttggcggggagcgtcctcagggacaagtctcccagcacgcggccgcgacctccccgttgggggtctggagccaggagcccacgcgcgtcggatccggagagtctggtgggcgcagcctacgtgacagggtcggctcgggaccgag

SEQ ID NO: 99018 - DNA, 149 bp, Homo sapiens; identical to SEQ ID NO: 42072
  chr8:144330269-144330418
  hypo

SEQ ID NO: 99019 - DNA, 511 bp, Homo sapiens; identical to SEQ ID NO: 42073
  chr8:144343481-144343992
  hypo

SEQ ID NO: 99020 - DNA, 519 bp, Homo sapiens
  chr8:144344219-144344738
  hypo
ccggcagcccctgcccgcgcccgcacctctgcacctcccacgcccctctccggcagcccctgcccacacccgcacccctgcacctcccacgcccgtcttgccctggggcccaggtgcaggtctgtgaggagggcagccccgtgctcccgtggccaccgctcagccaaatggattcagcgagggtttttagtgtttgtgcctgtgtccccgtgtgcctgtttcctggtgaggctggatgcctggcatgtctgaacactcacattccccaggcatgcatgtgcagccgccgccgccacccatgtactgtggcgctgacccctcctgtaacagctgtggtcttggcctctcgtgttggtggcagatgtcccatttcccagttactttctgttgtccaaaagtttaactgtcctgccagccaaagctgctgagcattactctgatagaccatcagtccttggtaagtgtcctgtgcatctgggataagcatccgtttgttttcagctgcgctttctgtgactt

SEQ ID NO: 99021 - DNA, 37 bp, Homo sapiens
  chr8:144347022-144347059
  hypo
ggtgactcagcttcccgtgatgcgctggatgcacagg

SEQ ID NO: 99022 - DNA, 30 bp, Homo sapiens
  chr8:144350950-144350980
  hypo
gctgtgccgcccaggcggtggctgcttcct

SEQ ID NO: 99023 - DNA, 516 bp, Homo sapiens
  chr8:144360029-144360545
  hypo
ttccagaagagaacccggaggctccgaggtgacgtgtggcttgctcgagatcacacgatcagtgacggcaccagatgaatccctgagctccctgaccagccatccacccaggcccctgctgagacagcgggacctcgtttccaactcagaagcccccggaacgcggctgcccggcttgggagcctgcggcacagggccctgtgcagccccttggggaagacggccccaggctctgccagcccccgccaccctctccagaccatgctctgggggccctatggccaccagcgctctggacgccccactctgccaggtgagaacgagtttaggggtgcgggctggaggtcagtgtgtctgtccgaagtcagctgggaggcaggcgcctacttgaggcgtccttgctggtgtgcggtgggcctggggttcagactgtctgcctgaaaggtaagggtgaggacgcctgcattctccttgttcagtaacacgcgtgggcagccaggccgaggtgctggctct

SEQ ID NO: 99024 - DNA, 203 bp, Homo sapiens
  chr8:144361658-144361861
  hypo
cctctctctcctccccgaagtgaccagggatcttcctaaagatcccatggtatctgggagccaaggtttgggatctgccagccctgattccataacccacacttatccttcctcacggagcctgtttctgcctctgacaatggtggttagcgcagcccgctccgcaccgcacatggcggctgcaaggacggcatgggtggggt

SEQ ID NO: 99025 - DNA, 55 bp, Homo sapiens
  chr8:1443699-1443754
  hypo
ctggcccggcgaggtcggtgtgctgagaccacagtgtgctcgggtcacagtggtg

SEQ ID NO: 99026 - DNA, 15 bp, Homo sapiens
  chr8:144371132-144371147
  hypo
cggcctggactcggc

SEQ ID NO: 99027 - DNA, 40 bp, Homo sapiens
  chr8:144372463-144372503
  hypo
gctgggattacattcatgagcctctcgcccacccagtcta

SEQ ID NO: 99028 - DNA, 30 bp, Homo sapiens
  chr8:144380615-144380645
  hypo
ctcaggtaccagtagcggtcaaagcacctg

SEQ ID NO: 99029 - DNA, 92 bp, Homo sapiens
  chr8:144383315-144383407
  hypo
attttcccccagaaccgagaaacatgaatctccagagtaaaagcacctaccgatatctcgcacaaagatggaaggaacgacctacatccagg

SEQ ID NO: 99030 - DNA, 35 bp, Homo sapiens; identical to SEQ ID NO: 42080
  chr8:144386583-144386618
  hypo

SEQ ID NO: 99031 - DNA, 30 bp, Homo sapiens
  chr8:144400398-144400428
  hypo
catcctcccgtgacacggcccccaccctcc

SEQ ID NO: 99032 - DNA, 30 bp, Homo sapiens
  chr8:144413752-144413782
  hypo
ccaagcccagctaagcgggaaagggcaagc

SEQ ID NO: 99033 - DNA, 35 bp, Homo sapiens
  chr8:144414248-144414283
  hypo
gggggacacagccagcgtggcggctacagcccatc

SEQ ID NO: 99034 - DNA, 30 bp, Homo sapiens; identical to SEQ ID NO: 42081
  chr8:144452062-144452092
  hypo

SEQ ID NO: 99035 - DNA, 99 bp, Homo sapiens
  chr8:144457736-144457835
  hypo
gacgcagatccagtgcggccagctgcagagccgcagggcccagattcaccagcagattgacaaggagctgcagatgcggacgggcgctgagaacctcta

SEQ ID NO: 99036 - DNA, 30 bp, Homo sapiens
  chr8:144462244-144462274
  hypo
agagctccccacgcacgagcaggtcttcct

SEQ ID NO: 99037 - DNA, 30 bp, Homo sapiens
  chr8:144463829-144463859
  hypo
cgcttcggggagactcgcctgtcctcatcg

SEQ ID NO: 99038 - DNA, 30 bp, Homo sapiens
  chr8:144469769-144469799
  hypo
aggtgtgagccaccacgcccatcctccgag

SEQ ID NO: 99039 - DNA, 30 bp, Homo sapiens
  chr8:144470566-144470596
  hypo
cgctgcacctccaggcgagcatggtgtgga

SEQ ID NO: 99040 - DNA, 210 bp, Homo sapiens
  chr8:144471625-144471835
  hypo
cccccacacccccttcggcccctagaccgtgcgccagacatgcattaaggcaggagtgacttatcgagctgtcagggggagcgttttaagacagaattataggggagaggaaaaagatttttaccaaattaatgaaaaatcaatgtggcctcaaaaatccattagccttcataatgcgctggttccaggctgagccgcataatccgatgc

SEQ ID NO: 99041 - DNA, 30 bp, Homo sapiens
  chr8:144474879-144474909
  hypo
gggtgctcccacctgcgttgagttggggag

SEQ ID NO: 99042 - DNA, 502 bp, Homo sapiens
  chr8:144489693-144490195
  hyper
ccccaccctccaggtcggggcagccccgggcaccgacggtggcagtcggcgtgtcacctctcctgccatccgcagggcgcagcgggcacgtggcccctccagataagcagagcccggggccccaactcgcttcctcatggcgggcggggggcagccccaggcggcgccatctgacgcccccgccctgcgcgctcctaccccccacgtccgctgccgtctgtcggtcgtggagccgcgctaggccacggggtcccggccagacgggagcgccagcccctccccctgtcccgatgtccccaaacccaggctcagcccctccctccccgacccgatgacacccctgggtcctagaatgctgctgggggcgggagaccggagaagaagcaggtgcacggggaggtgggtgtcctgccctctgcgaggagcccaccccctggaccttctcctagcgctaagatcgggttcaagcaccaaacccgtcccgcctcgcccaggtccccgg

SEQ ID NO: 99043 - DNA, 346 bp, Homo sapiens
  chr8:144503380-144503726
  hyper
tgcaattcatcttcccgtctctcttcccatacctgagcctcgtgccgcccgggattgcggcgcccgcgccaccacgctggggtaatggtcccagcaccgctgccctgcgtcctgccgcgccccagcccgcgcgtctcacacaccgcgactgcgtgtctacaggtgccgcctcttgacgcctctgctgcaccgccagtgccccgctcggcaaagcacagcccctccccagcactgcagcaaatgggcaggagacccccgcccggccgggggagcaggggcaacggcagggccccagtagagagggtggagctggagccgaggccgggccaggcgcctgcggggccta

SEQ ID NO: 99044 - DNA, 30 bp, Homo sapiens
  chr8:144508721-144508751
  hyper
aagcagggggacagacgaaagagagaaaga

SEQ ID NO: 99045 - DNA, 3353 bp, Homo sapiens
  chr8:144509019-144512372
  hyper
acacagctccctgcccgccgctcccaccccaaaaaggccgcctctgatccaggctgccagaagtcgctgggtcctgtactttctcggccagggaaaggctctgtgcaaagggctcctgggggcggcgatggtgaaaactaaggtgtcccatgtcctctgctctttacaacttcggactatgaaaaacgagccagcagattcccgtccaagaatgtgcccaaggctccccgcccctccttggggagagatggcctgtgtaagcgaaggcccgggccgggcggctgagccacccgtggctgcctggaacccgcctgtccctgccggcgtagtcttttcaactccatcttccgccccacatttctgtaattcccaccagcattctcctccacagagatgccttcacggccagctcccctgctgggattctgcttgaactcccgcagagacccaaaagcaaagggggaggcggcagggactgacggaggactcgccttcctctcttcctccaggtctctccgcttgaaacgataaaacaaactcaggagactcactcacagaggattccgtcccgtccccagaaagaacctccgcttacccccgatggaaaagcagcacagccccctcccaagaaaggcgagtttggaagcccttgcaggccagaagccctctctccaaatttgcaaaccacggaccctcgcctgcctctcttccggcagtgaagggagggaaccatcaacgacgtgtcctgcagccgccctgggccctgtgaactgagatttctggggtactgcctcctcccctgtgctcccagtccatgcccagccagccgttcagaggagcaagggtaggctgcgccttcaggtgggagacgggcagactccgagggctggggacagttctggccaccaggatgcagcggtgtgtcccaccaaggacacctcctgccctgcacccccagcctgcctcagtgactctccccaaaagcccctcggccttctttgccgagggcagacgcagagggcacaggtctgcggggtgcaggccggctaacgctgcctcgctgctcagtttctccctggtcctgccgtcacccagggcccgtccgtcacccagggccagcacaaagcccaatgcagggccctcctcttccttcaattcagggagaaacacggcaaaactgaaagccaccgaccaaccagccaggctgcggtgacttggatctgaacagatttattttgtgtatttttttctttttctcagtttcgtagcaaatgaaaaaagaactcaacgaaaaccaactacacaacaaaactttcaacgagtcggcgcgccttccactccgagtgctcaggggaggggtgtggagcggctggaatcccactgatggcccctgagggcctccgaaaacgggcagatcccccaggcgcctggcccagcctacagggcctggagcacccgcctcctcgccctctctcccggctagtccaaagagcgacgaagcattaaagaaagattccacaaacaaaacgaaacacaatttaaattaaaataaaaacactttctccacccgccccatgccagaaggctctggcccaagcctcctcttaaaaaaaaaaattttctgctagaaatactgtgcattacttttttctttcacttctcttgaaggttaaaacaagatgtatttccccaggagttacagatatgttctggtgcatagagagacagcagctcgggatccgggccagcccccacccgactgagcacaggactcacccccctccccccacccccggttgagcatagtaggacagcaggcctggacacagcacgggtgacgtccctggcttcgacctccaaggaacgccggtagcagggtcgggggcaagcggggagggggcaggcaggggccgggcccctcctggcgagcgactcatgctgtgactcgcgactgagggcggaccccggctggggaaagaaggggcttcctccaaggttttcttttctaatcaccaagcataataattataaatacttcgaaaataagaccgattttaaaacggggaggggaagttaaaaaaggcaaggaaagggaggctgagaagagaacgaaggagggcgggggcaggcaggggccacccgggaagggacggcagcgcggtccctctaggctggcagggcgaaggtgggaacggagaaccacgttcaacgtatgtacaagcggacgcttggaaagaagttagacctggctcaagtttccttagaaatcaccgttctccgctcaacctcaggacggcgacccgggccgacgcgcgcgaacggggaccgggagcgaaggggcctccagccccgcgcccgcagacttggcaccggggccagcacggccgggccgggcctggtgtccacgtcctgtaccgcggagtccgagccgaggccccgagaggcctgcgcgaacttgtccccggcgacggcggcgcgggctcggggtccggcgcctacaggaagaagtcggccgtgcccttggccccgccgggaccggcctgcggcggcgaaggctcccgcgggaaaccggccccgcccgcgctcccggggccgccccggcccgccagcttctcgtatttctccttgtacaggtcccgctctttggccaggcgccccacctccagcttcagctgctccacctggctctggagttggcacttctcgctctccagaatgtgccgctgctgcacccgcttgaagcggcaggactgcgcgtagccgcggttcttgagcgtgcgccgcttctgcttgagccggatgacctcctccttgctgaagccgcggagctgccggttcagctcgcgcaccgacatggacaccagctggtcgtcggagaagcgctcctccaggcgcacgtggtggcccgcgccaccgccgtgtcccgcgccgccatggtggtggtggtggtggtggtggtggtgggcggcgtggtgatggtgggcggcgtggtgcgcgccgtggtggtggccggcgcccatgtcgtccgctccgccgccgcccgcgaagcccgggccgcggaaagcctcgtaggctgcggcggccgccgggtggtgcgcgccgtggtgcgcgccgtggtggccgctgccgatgagcgcctccaccgcgtcctcgggcgtcaggttgagcgcctcggggttgaggtgatgctggtagccgctcatccagtacagatcctccagcgccggcttccccgaggtgcccccgacggcgccggggcccccgctcggcggcccgggggcgcccccggcctgagacgagccgccgccgccccccgcgccgccgccgccgccggtgcccgggctgggcgcgca

SEQ ID NO: 99046 - DNA, 30 bp, Homo sapiens
  chr8:144516420-144516450
  hypo
tgtgccaccaggcatcgtcaggctgttggc

SEQ ID NO: 99047 - DNA, 30 bp, Homo sapiens
  chr8:144519943-144519973
  hypo
gttgccaatggcagtcggggacaggcctgg

SEQ ID NO: 99048 - DNA, 142 bp, Homo sapiens
  chr8:144521622-144521764
  hypo
gtttacagaaagggtcgtttgcagccataaaatcctcttttctctcctaaacaaggctgagtggagccatttaccaagccccaaatgctcatcgggggagagggaacatctgttctctccaggagtgcgtggtgatcttcca

SEQ ID NO: 99049 - DNA, 30 bp, Homo sapiens
  chr8:144523644-144523674
  hypo
agcacagagggagcccgggaaggtgggtgt

SEQ ID NO: 99050 - DNA, 77 bp, Homo sapiens
  chr8:144552565-144552642
  hypo
atgagggtcttggtgcggagggaccaacgcgggggtgctcagggcagcccccgttctcaggccgggacccttgtccc

SEQ ID NO: 99051 - DNA, 241 bp, Homo sapiens
  chr8:144573164-144573405
  hypo
gcacccaggtagcgccgggtgacaaggacattttatttcttcctgtcaggggtggtttttcagtttccaggaatgtccatgcttgcccctccctccagggagcccaggcaccaactggcagacacacacatatccacggctgggcagatggggcaggagggcccaggcacagggggctccgccctccccggcctgaggggaattccacggatcccacaggaacccccggggggcccttgag

SEQ ID NO: 99052 - DNA, 105 bp, Homo sapiens
  chr8:144589977-144590082
  hypo
gagaggcgaggccggcgtcttcttgacaatgcggtagcgggtcttgatcaccttgctggtgggtgcagtccgcacggcatgcaggctggacgctgtagagaaaac

SEQ ID NO: 99053 - DNA, 98 bp, Homo sapiens
  chr8:144591105-144591203
  hypo
ttccagagccctaaacgcaacggaccttgagcagccagggcccctccttgaggccgagcttctagcccatctctccacagactcgctcactctcctgc

SEQ ID NO: 99054 - DNA, 137 bp, Homo sapiens
  chr8:144636432-144636569
  hypo
atataaatgcagatgcgtgcctgcatcaacgagcgggagcacattgggcaaatgcacgtgtacatgccctacgtgaacacaaacccgtggacacaacacgcacgtgcatgcacccgcacacagacacgcgcacaaac

SEQ ID NO: 99055 - DNA, 197 bp, Homo sapiens
  chr8:144636689-144636886
  hypo
ctcacgtgcacaaacgcacacaacacgcacgtgcatacacgcgcgcaaacgcacacaacacgcacgtgcatacacgcgcacaacgcgcacacaacactcaggtgcataaacgcgcgcaaacgcacaacacacacgtgcatacacacgtgcacaaacacgctcaacacgcacgtgcaagcacccgcatacaaacaggc

SEQ ID NO: 99056 - DNA, 261 bp, Homo sapiens
  chr8:144650869-144651130
  hyper
gcgcggattgagtcccgtgtctgcgtgggagggcgcagtcagggcaggcggagacagagaggggctgcaagggtgggagggggcggccagcgcggagcgaggaagcggcgggtctagggaaggctgctgactcggtgtgatctggggacagggaacagggcctggagctggacctggttgggaagcctggagagcccctgcagggggtggggcttgaagggatggggtccggaaggaaaagtcgagcggggaggagcttgg

SEQ ID NO: 99057 - DNA, 65 bp, Homo sapiens
  chr8:144651594-144651659
  hyper
cggggcgtttgctcacgtcgtccagtagcggagggaggcgcggtcccagctccgcgctcaggagc

SEQ ID NO: 99058 - DNA, 293 bp, Homo sapiens
  chr8:144651706-144651999
  hyper
cgctgcacccacgagccgcgcgtcgccttcgcccagtgcgcccaggagcgccggcagcagcgtgctcacgtgccgcacctgctgggactcggggtcagcctcttgcagacctcgccgcgaccgggccaagcccctctccacccctccccttctctcacaccttcctgcgattcagcgcgaggtggcccaggcccagcaggcccaaccagcgcacagtgggttcggggtctccctgccaggtgaggagtcgctccaggatgacctcctcccgcaggagccgtgcggtgggccgg

SEQ ID NO: 99059 - DNA, 199 bp, Homo sapiens
  chr8:144653759-144653958
  hyper
ggggccagactccaccgccaagcgggaagagggaaggaagccgcgtggggaccgcagggccaggacggttgggttaccgatcggcgggcagagagcggggtagcagcgcacacaccacgtcccgcgcatgctccagggccagtgcgctcagcactcgcagggccgccctccagggcctcccctccgctaggctgggcac

SEQ ID NO: 99060 - DNA, 175 bp, Homo sapiens; identical to SEQ ID NO: 42087
  chr8:144656770-144656945
  hypo

SEQ ID NO: 99061 - DNA, 83 bp, Homo sapiens
  chr8:144658208-144658291
  hypo
cccccagccaccctccgcctacccactcatccaccccacctcctgggccagtcgggccagcgcctcctcgtcaatgttgttgc

SEQ ID NO: 99062 - DNA, 30 bp, Homo sapiens
  chr8:144661901-144661931
  hypo
gtctcagtctttaatcgtggcagggcctca

SEQ ID NO: 99063 - DNA, 378 bp, Homo sapiens
  chr8:144668612-144668990
  hypo
tgcctgaggctgtgacgacaggcaaaggcgcccatgtctgcgggggaaggagtgccaggcctggccccacaccaagtgcacaggcgccggcaggagggccctgagcagacccggcccgggggcccggccaaggccgcctgccccgagaccccactcccagcacccacagcagagccactgggccagggtgcctctgccttcctggcctggctgaatccgctttgtgtgccccggccactcctgtcgggcagcagagccgcccagccgccccacgtgcagctctcacctggcgggaggcacctgccacaggcccgttcatctgctcgtagaatctcctttctgcgtcgtcatatttgaacttgtcgaaccagatcttct

SEQ ID NO: 99064 - DNA, 119 bp, Homo sapiens
  chr8:144675999-144676118
  hypo
acctcctcatttccccgcttcccgcattcccaagcatgggaggacctgccggacgcagcgcaccatctctcctaacagagaccaagtctgagcttcaaagcttgcgcagacgacaggca

SEQ ID NO: 99065 - DNA, 191 bp, Homo sapiens
  chr8:144677837-144678028
  hypo
gccccgccccaaccacgtcttttcttaaatgccactgcaggccagctccatggccagccctgcttgaggggctctggccgacctgcctgcccggcgcagcccctgtgcctcctgggtgactccagcacggcacaggctttctggaaccccagacaatacccacgccacacctcacacggcacccttggctg

SEQ ID NO: 99066 - DNA, 231 bp, Homo sapiens
  chr8:144681590-144681821
  hypo
cagcagggtgctcagcgacctcacccacctggcggctctggcctacaagtgcctggctccggaggaggttgcggagtggctgcacctggacgatgatgggggtccgcccgagggctgcagggaggaggtgggcccagccctgccccctgcagcgcctccggccccagccagtctgccctctgccatggggggcggagaggacgaggaggaggccaccgactatggagggac

SEQ ID NO: 99067 - DNA, 30 bp, Homo sapiens
  chr8:144682361-144682391
  hypo
actcctgtctgctatcgagccctggtgcta

SEQ ID NO: 99068 - DNA, 126 bp, Homo sapiens
  chr8:144683678-144683804
  hypo
gagaagctgacttcacggccgcggtgccagtgagggctgcatagccaggccttgtctgtagtctgggcggcccgtggcgctgcccttcagcccaactactcattgccgctgcgtctttggcgaggc

SEQ ID NO: 99069 - DNA, 122 bp, Homo sapiens; identical to SEQ ID NO: 42092
  chr8:144685577-144685699
  hypo

SEQ ID NO: 99070 - DNA, 30 bp, Homo sapiens
  chr8:144688031-144688061
  hypo
cagcagcatcttggccgtcccctgaggaga

SEQ ID NO: 99071 - DNA, 80 bp, Homo sapiens
  chr8:145236678-145236758
  hypo
agggcggagacagaacggggccgctggggcgcctgtctctgtgctgcacgcacatcgccccttcccgccactcctctggg

SEQ ID NO: 99072 - DNA, 30 bp, Homo sapiens
  chr8:145697556-145697586
  hypo
ctgcagtcgctgttccgggagatgggggcc

SEQ ID NO: 99073 - DNA, 192 bp, Homo sapiens
  chr8:145697791-145697983
  hyper
cccagaaggccagggcgggatccaggtggctggcctcacccactgggacgtgcccaacctggagacattgcaccaggtagggctgcaccgctctccgagaccccgccccgtgcttccacttgggggcggggaccctgcacctgaccagcccttcgccccgccttccagatgctgaaactggggaggagcaac

SEQ ID NO: 99074 - DNA, 7 bp, Homo sapiens
  chr8:145698667-145698674
  hyper
gggaccc

SEQ ID NO: 99075 - DNA, 578 bp, Homo sapiens
  chr8:145700223-145700801
  hyper
ctcactgggtggtggcgggggactgggcggccggtatggccggccgtgcagcacgtaggggcccaggtccttggcgaaggctccacgcgcacctccgttctgccagcgccggcacagggcggtgttctgcagccggagcgcctcagctgggatcaggctcacgtcgaccgcccagaagttgcccttggcctggggctttgcagggtccttgggcacctgggtgtgggggtcagacatgggtggggctgcccaaccttggatgctcaggacttccgcgcgcgctccgcccccgggctccgaccctggcctgccccaccttgcggaagcatcggttggaggaaaggttgtggcgaatggagtctttccagccctcgtagtcttccctgaagaaggggaacacggcctggacctgacggatgatctgaaaccgccaggcggccggccggcgccgtgagcccagacggggagggggtagcgccctacccctcccccactaccgggctcaggggcgcgcggtgccggcccctgctgtccccgaagaaggacatttctgcgcggaagcgcggcagagagggcaa

SEQ ID NO: 99076 - DNA, 30 bp, Homo sapiens
  chr8:145702531-145702561
  hypo
atttttggtagggaccgggcctgcctatgt

SEQ ID NO: 99077 - DNA, 168 bp, Homo sapiens
  chr8:145728372-145728540
  hypo
tcccttgccagggggcgggcaggggctggctctgcctggggccaggcccatgttaacctgtgccccggcctgggggccagaggggcaggcctgcgcacggggaggctgttgtggcagcggaacagagacgtgcacggtgagaggcctgggggccggctgtccagggct

SEQ ID NO: 99078 - DNA, 185 bp, Homo sapiens; identical to SEQ ID NO: 42093
  chr8:145739768-145739953
  hypo

SEQ ID NO: 99079 - DNA, 86 bp, Homo sapiens
  chr8:145745121-145745207
  hypo
gtgttcttgagcacacggcaggtgctgcagtgccagccagctgcctgccaggccctgcccttgctgccacgcgaactcttccccct

SEQ ID NO: 99080 - DNA, 30 bp, Homo sapiens
  chr8:145751684-145751714
  hypo
ccaagaagttgggggcgttatctgggccct

SEQ ID NO: 99081 - DNA, 30 bp, Homo sapiens
  chr8:145751965-145751995
  hypo
gggcggggtgtcacacgcaggattccgcga

SEQ ID NO: 99082 - DNA, 521 bp, Homo sapiens
  chr8:145753251-145753772
  hypo
cgacggtaagaggttcgcctggcctcactcagcggggctcctgagcgcaggacgcccactccttggtgcgctgggcccgtcggcagagtcggggagcccatcaggggctgcccggaagggagaaagaaggggctggagagggaggcacagcattacctttgaagcaggtgatgaaattcttcattttggaatcatccaggaaaagctgcagatagagggccaggccgtgataagtcccagcgtgcaggtgggggcggggaagctcaggaggtcctgaagctcgggaggtcctgaaccggcccgagcccacttttcctgcttgtctgtgcacaccgcatgcagggaggcgcgtgaaaggtaaacctgggggccccgccgacttatccgcgtctatgcgcacctctgctccctggtcagccaattctttcccgcaccttttccctcttttcaagtttgtaatcagttgtaccacctcctccgcggagactacctggcctgctgcctcccggacatgcagctgc

SEQ ID NO: 99083 - DNA, 30 bp, Homo sapiens
  chr8:145755230-145755260
  hyper
ccccaccccacccaccgagagcctgccagg

SEQ ID NO: 99084 - DNA, 166 bp, Homo sapiens
  chr8:145758526-145758692
  hypo
ctggtcaccgttgagcgccagcacctcctcagagagccgtgtctgcacccagggcagctggcgctcggggtagcgctctctctgcatgcccatgacctcctgcagtgcgctgccgaacatggacgggctgaacacggcgttcttggcatgccggatctcctccacg

SEQ ID NO: 99085 - DNA, 86 bp, Homo sapiens
  chr8:145806186-145806272
  hyper
ccattcacctggccccgcccatagcagctgcccccgccctcacctgccgctgtcctccttcactgtcccaaacgccgcgggccgcc

SEQ ID NO: 99086 - DNA, 6 bp, Homo sapiens
  chr8:145806619-145806625
  hyper
cgctcg

SEQ ID NO: 99087 - DNA, 18 bp, Homo sapiens
  chr8:145919061-145919079
  hypo
ggccgtaaaattctttga

SEQ ID NO: 99088 - DNA, 131 bp, Homo sapiens; identical to SEQ ID NO: 32325
  chr8:145925298-145925429
  hyper

SEQ ID NO: 99089 - DNA, 264 bp, Homo sapiens
  chr8:145925458-145925722
  hyper
cgctccccgttccctgtccgtcacctcctcgttctcctacgaaggcgcgaacgttccagactctcgccggtcctcgacagcactcattcagtctcccccctggagatcccaggctgtactctgggacagaaaagaaggcgggtacgaccgcggtgtcgggtcctaccttagccgctccttctcctgagggagccaggcgggagagaggggaaccaccgaggcctcggtcttcccgcgtcccagagcggccgggcgagtctcact

SEQ ID NO: 99090 - DNA, 43 bp, Homo sapiens
  chr8:145925938-145925981
  hyper
tcaaggttgcgggggcgtggtcacggagcggagccaataaaag

SEQ ID NO: 99091 - DNA, 192 bp, Homo sapiens; identical to SEQ ID NO: 42098
  chr8:145979452-145979644
  hypo

SEQ ID NO: 99092 - DNA, 136 bp, Homo sapiens
  chr8:146013511-146013647
  hypo
ccagcctggcaatagcgagagcctgtctaaaataaacaggccctgctgggtcactgcctaggtgtggtgggcgcccaaagacaggtggggccataccagcaggatcaggaaagcaagatcacgaaatggggggtaa

SEQ ID NO: 99093 - DNA, 30 bp, Homo sapiens
  chr8:146015447-146015477
  hypo
ctccacagcatgtgccgctagacaacccca

SEQ ID NO: 99094 - DNA, 34 bp, Homo sapiens
  chr8:146036285-146036319
  hypo
gtgcagatcccatggcgagcgtgggatccagccc

SEQ ID NO: 99095 - DNA, 30 bp, Homo sapiens; identical to SEQ ID NO: 42100
  chr8:146050247-146050277
  hypo

SEQ ID NO: 99096 - DNA, 34 bp, Homo sapiens
  chr8:146055565-146055599
  hypo
ctctgctgcatcacacgcccgagagagtgcctgg

SEQ ID NO: 99097 - DNA, 98 bp, Homo sapiens; identical to SEQ ID NO: 5087
  chr8:146079215-146079313
  hypo

SEQ ID NO: 99098 - DNA, 30 bp, Homo sapiens
  chr8:1463086-1463116
  hypo
caagagcacagccagcgggcaggagcacgc

SEQ ID NO: 99099 - DNA, 183 bp, Homo sapiens
  chr8:1471481-1471664
  hypo
cagagaacagcgtcacggggtcaccgtcccacttcccaccccgcgcctcacagcacagacgggggatttgccggcctcacgccggccgagccactgctgacttcacgcagccccagccatgcccccacgcagacacacggagccccaaggcgggccagatctcagggccggatggggctgtgg

SEQ ID NO: 99100 - DNA, 101 bp, Homo sapiens
  chr8:14898126-14898227
  hypo
tctcaaaacaaaaaagtgatttcacttccaagtaaaatgaatatgattatatttagttgatcgtactgcttttatttgaaatactgcgcattattataaat

SEQ ID NO: 99101 - DNA, 84 bp, Homo sapiens
  chr8:1501600-1501684
  hypo
cagccctgttttattcggcgtgttcacggtcagcagccccgttgtgcttggcgtgttcacgggcagccccgttagactttgggt

SEQ ID NO: 99102 - DNA, 30 bp, Homo sapiens
  chr8:1507113-1507143
  hypo
gataatgtttttcctcggttccagtgcctc

SEQ ID NO: 99103 - DNA, 201 bp, Homo sapiens; identical to SEQ ID NO: 31800
  chr8:15094366-15094567
  hyper

SEQ ID NO: 99104 - DNA, 126 bp, Homo sapiens
  chr8:15094645-15094771
  hyper
cgtgccgggctggggcacaggcgggatcggagccgggaagaggaggcaaagtggcggcgcagctcggacaactttgctgggaaagcaggcgacagcgggcagagctggtgccgctgccccccccgg

SEQ ID NO: 99105 - DNA, 11 bp, Homo sapiens
  chr8:15095073-15095084
  hyper
ccgcccggacc

SEQ ID NO: 99106 - DNA, 51 bp, Homo sapiens; identical to SEQ ID NO: 31802
  chr8:15095356-15095407
  hyper

SEQ ID NO: 99107 - DNA, 33 bp, Homo sapiens
  chr8:15171865-15171898
  hypo
cacaacctccttccacgacgttttcgcatctgt

SEQ ID NO: 99108 - DNA, 130 bp, Homo sapiens
  chr8:15398217-15398347
  hyper
tgggaggccctggggcgtttccgggacgtggagttagcagggttctgacttgaaaaacgacggcaaagcgtgttcttgactgcttctgagcacctcacacctttcagacccagggcgcctttattcccag

SEQ ID NO: 99109 - DNA, 39 bp, Homo sapiens
  chr8:1569815-1569854
  hypo
agcggggtcacatctcggaggcaccgtcagcaccaggag

SEQ ID NO: 99110 - DNA, 30 bp, Homo sapiens
  chr8:1574119-1574149
  hypo
atctctggcctgtggcgggtgctcagcctc

SEQ ID NO: 99111 - DNA, 162 bp, Homo sapiens
  chr8:1574846-1575008
  hypo
acctctgccctgcagcgggtgctcacagaatgccttttctcctttcttctttcctgtagccagacctacctgcaagctgcaagcgatgtgcctgtgggacacagcctggaccccgctgcgaactacaactccccgaaattccgctcccggaaccagagctac

SEQ ID NO: 99112 - DNA, 39 bp, Homo sapiens
  chr8:1579143-1579182
  hypo
gaggtccgggtgtcccgagggtctcggcgggaggtccgg

SEQ ID NO: 99113 - DNA, 87 bp, Homo sapiens
  chr8:1581006-1581093
  hypo
gatcaatgggcaattcgagtccgtgtgcgagtccgtcttcagtgaagttgaatctcaggccatggatgccctcgacctcccgggatg

SEQ ID NO: 99114 - DNA, 301 bp, Homo sapiens
  chr8:1588688-1588989
  hypo
tgatccccattagaacgtctcagaaactgccaaccaccatggcttccatgaagccccaagaatccttcagcaaagctccatgttgcaaactaaagcccagggtgtgcatcatgaagacgccatccctgtgtcccgggttcagaggcttgtacccgggactcgggcatgagaccccattacgggcctgagcacagcaccaagaccgtcaaacgctaaaaacaggcacaggtggaagtctcacgtggcccgcccccccgcatctagacttgtgttttacagtaaatgacgaaatgcagtccag

SEQ ID NO: 99115 - DNA, 87 bp, Homo sapiens
  chr8:1592418-1592505
  hypo
gcctgaccctaagcccgcccgaccaagagcctcgtctcggctctgtgcaagagccagaggagtgaagactgccgtcctctgtggggt

SEQ ID NO: 99116 - DNA, 90 bp, Homo sapiens
  chr8:1613724-1613814
  hypo
tttaatctatattcccgcgtctctctgttgcctttgattttttactacccctattgctgggactcaaaacttcttcggaatcaatatttc

SEQ ID NO: 99117 - DNA, 51 bp, Homo sapiens
  chr8:1616193-1616244
  hypo
tgctgctggatttgtcggtatttttaaatgatgccacgcctgcgtgctgtc

SEQ ID NO: 99118 - DNA, 38 bp, Homo sapiens; identical to SEQ ID NO: 41686
  chr8:1645305-1645343
  hypo

SEQ ID NO: 99119 - DNA, 53 bp, Homo sapiens
  chr8:16460002-16460055
  hypo
acactcaaccctaaacgctgcagtggggttgaagcccgcgctccccacgacct

SEQ ID NO: 99120 - DNA, 30 bp, Homo sapiens
  chr8:16687802-16687832
  hypo
tttacattaaggaaccgccaaaaatccttg

SEQ ID NO: 99121 - DNA, 26 bp, Homo sapiens
  chr8:16760265-16760291
  hypo
tcgctgggtaaaccacgtgaaaagaa

SEQ ID NO: 99122 - DNA, 367 bp, Homo sapiens
  chr8:16858724-16859091
  hyper
tgcccagagcagccccgggtgcataatcagctgcataactgtggggcatgtttaaagaagcccggcgcttcctgttattaatttttgtaaagtggacggcatgggggaaaatgagaaaggaaatcggagagaaacatacagggattttttttaaaactgactgcgaggtaagcagtgcgagaaccgtgatgccgagtgcaccaggtcttggtgtccccggcagtgggaagggcaaggggaaggcaggaaggagcttgcgaagcgcccaccctttctcctcccgcccccagcatctggagctgctgccctgctagaggctgcggcgacaaaccagcaggaaaatttctccccgcggctgctctggcca

SEQ ID NO: 99123 - DNA, 135 bp, Homo sapiens
  chr8:16859352-16859487
  hyper
gatgccgtgcaggtgcgccagctgcgcagcccccggcccgccgcgcgcgctccgctccgccgcgctcctgcgctcgcccagcagcggcggccgctccccggcaggaggcaacaggaaatgcgaacccacctgctg

SEQ ID NO: 99124 - DNA, 41 bp, Homo sapiens; identical to SEQ ID NO: 31804
  chr8:16884323-16884364
  hyper

SEQ ID NO: 99125 - DNA, 987 bp, Homo sapiens
  chr8:16884365-16885352
  hyper
ggcgctgagcccagctcggagacccaccccgcccgtagcagcggcgcgggccccagagagccccgcactcggccgcgcctcagttacgctgactcggctgtgcccgcagtgtcgcgctgtcgcgtagccaggtgtcgccgggctggcgcggttatttatgactgcgtggttgggctgggggttcggggccggggagcagccgggatccgccgcctcttccatgatcttcccgggccgaaccacgggaccgctacgctgaaggtggcgtcgcgggtccccggggccgcgcgagtgtaggggtcgctctcggccggccgcgaagctcgcggcaccgacttctcgcgagatttcggcgacccccccccccgcccccgcccctccgttctctgccccctcccagctctggtgtgggcggcctccgctatggctgcgctgcgaaggctcttgtggccgccaccccgggtgtctcctccactctgcgctcaccagcccctccttgggccgtgggggcggcctgcggtgaccaccctgggccttcctggccggcccttctcctcccgagaggatgaggagagggctgtggcggaggcggcatggaggcggcggcggcgctggggggagctgagcgtggcggcggcggccggcggggggctggtcggcctggtatgctaccagctgtacggggaccccagggccggctcgccggcgaccgggcgaccctcaaagagcgcggccacggagcccgaggacccgccccgcggccgggggatgctgcccatcccagtggcggctgccaaggagacggtgagtgcgcgagcgcgcgtcacacctgcgcgggggatgtgaccttcgtgccgggtacgcaggaccctggaggctgtggggacggtgcaagcgctgtggccgcgggtgaggaacttcccgtgagcgaggctgacacctaggccggacagcctaggatccggtcacccacgtattgggaagacc

SEQ ID NO: 99126 - DNA, 30 bp, Homo sapiens
  chr8:17003919-17003949
  hypo
ggcatatgtagcctccgctgaagcagaaat

SEQ ID NO: 99127 - DNA, 29 bp, Homo sapiens
  chr8:17271090-17271119
  hyper
ggcggagcactatacggccactgttctcc

SEQ ID NO: 99128 - DNA, 149 bp, Homo sapiens
  chr8:17354451-17354600
  hyper
ccggggattggtcagcgcggccggggcccggcgggaggcgggctcggggtcgcgttccgggagcgcggaggaggcggtgccgcccggccccgcgccccgcccccgccccgggtggctacacagaggggcgcccacgtgcccagccctcc

SEQ ID NO: 99129 - DNA, 47 bp, Homo sapiens
  chr8:17659282-17659329
  hyper
tggccacctgcaggccgaggggcctcgcaccgcggggcgtatagaag

SEQ ID NO: 99130 - DNA, 30 bp, Homo sapiens
  chr8:1771721-1771751
  hyper
accctccccaaggggcgcagctctgagccg

SEQ ID NO: 99131 - DNA, 495 bp, Homo sapiens
  chr8:1772198-1772693
  hyper
gggaacagcgggggacggcggggaacagcgggggacggcggggaacagcaggggactgcgggtcgcgtcctggccgccgaggtgagtgcgggccccgcggaccgtgggtcccctcgcgggcttctggtttcctttgagagttgcacttctgcccggctcccccgaaatcgctgggtcccacccggaggtggctgcgcccccgaccccctgcgcagatgtttcagggaaggggctgagaccccctccccccgagcagctcccccttccgcggcgcccccggcccctcaggataacggcgcgggcctgggcggggggagcagggactggcagcagggacccctggccccaggggcaggagcgaactccgatcggcggaaggagcccgaggggcgagctggcttcgcctggggggtcgtgcagtaacttagattttccggtaaaggagaagaatgcggtccgcctcaggatgcagagaaggaccggtgtaaggaaagc

SEQ ID NO: 99132 - DNA, 139 bp, Homo sapiens
  chr8:1778994-1779133
  hypo
aggagccatggcaggcgaggcgccaagagaatggggtcattgcctgaaatgccactggagccgagagatgagctgagcccacgtccacagaagcccattcccagtgggaggaacagcgtctgcgcggccctgaggtggt

SEQ ID NO: 99133 - DNA, 38 bp, Homo sapiens
  chr8:1784057-1784095
  hypo
acaatccaggccaggcgccgtggctcacacctgtaatc

SEQ ID NO: 99134 - DNA, 84 bp, Homo sapiens
  chr8:17974435-17974519
  hypo
tgaaacactgtgcctcgggttacagacagtctaatgacataatgacatgtataaacacatctccaagagtgctctaagtgaggt

SEQ ID NO: 99135 - DNA, 30 bp, Homo sapiens
  chr8:18062915-18062945
  hypo
acaggagtggttgttcggggcaggtgagga

SEQ ID NO: 99136 - DNA, 30 bp, Homo sapiens
  chr8:1811759-1811789
  hypo
cgtggcccgcacccacgcagtacagccatc

SEQ ID NO: 99137 - DNA, 40 bp, Homo sapiens
  chr8:18244635-18244675
  hyper
ggtcctggacgggatcgtccccttgcgggcccagtgcagg

SEQ ID NO: 99138 - DNA, 32 bp, Homo sapiens
  chr8:1857610-1857642
  hypo
ggccgtggttgctaacgcgaaaccaagtaagt

SEQ ID NO: 99139 - DNA, 41 bp, Homo sapiens
  chr8:18806532-18806573
  hypo
gaatatagttatacacggtgaaaccccgtctctactaaaaa

SEQ ID NO: 99140 - DNA, 30 bp, Homo sapiens
  chr8:18870173-18870203
  hyper
tacttacctagctaccgggctttgcaaaat

SEQ ID NO: 99141 - DNA, 144 bp, Homo sapiens
  chr8:18871433-18871577
  hyper
caggggcggggcctccgggggaggctggaggcgatccagaccctcgcagtgcagccctcgagcggcccggaccgtccgctgcctcccgcagccgcgcgcccgccctgggcccagcctccagcccgcgagcgaaaacctgcctgt

SEQ ID NO: 99142 - DNA, 18 bp, Homo sapiens
  chr8:19016279-19016297
  hypo
aaggaagaagtgggccgg

SEQ ID NO: 99143 - DNA, 37 bp, Homo sapiens
  chr8:19170992-19171029
  hyper
cctaccccggactaccgcagctcggggacagcgcgcg

SEQ ID NO: 99144 - DNA, 30 bp, Homo sapiens
  chr8:1921312-1921342
  hyper
ccagcaggggtccagcgttaattagaaccc

SEQ ID NO: 99145 - DNA, 35 bp, Homo sapiens
  chr8:1921544-1921579
  hyper
taaatatgtcaacaacgcatcgcctctacttttac

SEQ ID NO: 99146 - DNA, 74 bp, Homo sapiens
  chr8:1922587-1922661
  hyper
ctcccggggttgctccgcttggctctcggcggtcgcggggatcggctgtccggagcgaacgggggtctctcctg

SEQ ID NO: 99147 - DNA, 774 bp, Homo sapiens
  chr8:19614007-19614781
  hyper
caggtgcaggaagtgcgacggaaacaaacaactttgcctccgcttcctacagctttcctctcctccccgcccttctagcccccatcccaccccaagatcatgccctcgaacagcttctgcccaccgatcgcacgtcccctgggcatgttcgggcagcggtgaccctcagccacatcccccactagcccggtcccgggcaggcgagcgcgctgcccaccggccaccctcgtcacgccccctccaccctctccatcccagccacaataatacaataaccgcagtcatcgcgcggcacgtggaaaggctacttttcagtgggttttgcagaaagcaatcagacagcggaaggccacgagaaacgctggtgaagccaaaccgaccccgggagcgcagcggccccggaccctccctggaagctccctccgcgtccccgcgcgcccacctggaggcgccgcgccctccgcctgccaagccggtccccggcccctgcccgtgccctgggcccccggcgggcagcggcggagggaggccaggcgcggcaccgtcctccgcagctgcacgagccaccccgaggtcgcggggtgggcgggcgcgagctaggcgcgcggggctgtggggatctgccggcgccactgacgcccccgcgcggcacaccgcgcccggctggcccgggaggggacccgactcacccgaagcgccctgctagctgcccggcccggctccggccgctgccgccgtcgctgaactttccctcctgcgcggccgccgcggact

SEQ ID NO: 99148 - DNA, 422 bp, Homo sapiens
  chr8:19614842-19615264
  hyper
cggcggcggcggcggctcgggcgggcgggcgcaacagcggccaagcctggcgccccgccgcagggtaggtccggcgggggcggccaaggccgggctggggtcgcggttggccgcgtacctccgcgtcacccacggcctctctgcagtgcgtccctgcgcccgtcggagcggcgccctggccgaagcctgtcactctcggaaggggccgcgctcggacaccaggggcggtttacgcgtgactggacaccaagagccggagaagtttagagactaggacactgtggcgtggcccgagttgcaggagagaggtgtccaatctccatggggtccttactcttgcaggacagagttccccatccccctgctccacccgctctgttcccttggctgccctccccgccgagcgccgacttccatgcaaa

SEQ ID NO: 99149 - DNA, 119 bp, Homo sapiens
  chr8:19797490-19797609
  hyper
ccccgcccggggactcgcgggccgactgtggccccttctggggaagccggggcgcggggaggcgttccgggcatctcagccgcacggggtacgctcgccctcggcggggcccctcgctc

SEQ ID NO: 99150 - DNA, 342 bp, Homo sapiens
  chr8:19797677-19798019
  hyper
cgtcccacccgctctggggagccccggactctctccagcttccaggctcgcatgcccctcttttcttagtgccctgagaacccagcgaggggctgaccctcccgaaaccgtggcgcagccaccagcaatctgtggtcgccgactcggggggttgccaggtctgcgtttggccaccctttctgtcctgggggctgaggtcagctccgggcgcccggccccgccgcgcggctgcgagcacgtggggttgacgggcgccgcgtggaggcagcgagcacaacggtggtcaccgccgccagggaaccgcccgctcgctggggtccaggcgttcggggccaaatgaga

SEQ ID NO: 99151 - DNA, 34 bp, Homo sapiens
  chr8:20110445-20110479
  hypo
gtgcaggacctgctgcgcgcgctggctcttctgc

SEQ ID NO: 99152 - DNA, 661 bp, Homo sapiens; identical to SEQ ID NO: 31812
  chr8:20160990-20161651
  hyper

SEQ ID NO: 99153 - DNA, 68 bp, Homo sapiens
  chr8:20161666-20161734
  hyper
cgcggggtcccgggtcccgtctctctgctctcacttccatcagccccattgggcgaccctgccccctc

SEQ ID NO: 99154 - DNA, 37 bp, Homo sapiens
  chr8:20317340-20317377
  hypo
ccagcagtggacacacgcggctatgcacatgcaaccc

SEQ ID NO: 99155 - DNA, 36 bp, Homo sapiens
  chr8:20317437-20317473
  hypo
ctagaaactcacagaaatttccgagcaaaaccctta

SEQ ID NO: 99156 - DNA, 130 bp, Homo sapiens
  chr8:20431789-20431919
  hypo
aaagggcgtttctttcgcaggtaggagagagactgtcttccctctccctgcctttctgggtatgaggaagggagcacattggctgcaggggctgcaggcagccatcttgacgccacgtgggaaacgaggt

SEQ ID NO: 99157 - DNA, 63 bp, Homo sapiens
  chr8:21302252-21302315
  hypo
tgtcacactcctgctcgccgtgcacctggagagcctttgtagctcatccgacaatggagcagc

SEQ ID NO: 99158 - DNA, 173 bp, Homo sapiens; identical to SEQ ID NO: 41723
  chr8:21393876-21394049
  hypo

SEQ ID NO: 99159 - DNA, 64 bp, Homo sapiens
  chr8:21546878-21546942
  hypo
gctaaaccagagacccggtgggctcctcagtgagcaggcgagtcatgggcgaaagtccagattg

SEQ ID NO: 99160 - DNA, 183 bp, Homo sapiens
  chr8:21563318-21563501
  hypo
tgatgcagagaaggccgggctcaggctgtctcccccagctggccctgagctgggctgcggcccctgccctgctgagatgggggcagcaaggacccacagagcccaggtgagcaggaagagcttaccaatcatgccagcataagagcccagacacgcctggtaattgtccgcagggcagctggt

SEQ ID NO: 99161 - DNA, 79 bp, Homo sapiens
  chr8:21585266-21585345
  hypo
tcctctccttaccaccgcggtctctccgcaatgacagcccatgtccagggactgtctggattcacggaaaatactttga

SEQ ID NO: 99162 - DNA, 170 bp, Homo sapiens
  chr8:21608043-21608213
  hypo
gcctggcaatgcaagcgccctcctgccagcaccaccggggctgccgcggcactcaccgacacaggtggtcagtccggcacacgccacgcaggtccaggcagttgggcttctccttgtcctcataggagcagctgggcaggatggtttgccggcggcgctcagcgcacgcc

SEQ ID NO: 99163 - DNA, 135 bp, Homo sapiens
  chr8:21842170-21842305
  hypo
atcccctggaggatacggggctggtccagcagcagttggaccagctgtccaccattgggcgttgtgaatatgagaagacgtgtgcactcctcgtgcagttgtttgaccagtcggcccagtcgtaccaggagctgc

SEQ ID NO: 99164 - DNA, 77 bp, Homo sapiens
  chr8:21868044-21868121
  hyper
agtgctaatcagcggcgctgttcccgggctgggtgcagctgctaaggacaaggcccctgctccgaagaacgcggtgg

SEQ ID NO: 99165 - DNA, 334 bp, Homo sapiens
  chr8:21881693-21882027
  hyper
cccaccccacctgcccgctgcggctctccgcgggagatctcaccgttctggagacagggctcgctcgctctcacggtaggctggaagaacgggctgtctgggccttaggaaaggcccatgctgtataaggcatggggaaaggaaaggaagaaaggcaacgaacaagaaggagggcttccaactgcagcttcctgccggctgcaggcctcccttcctaagctgagctgaggcttcctctccatgggctggggagggggcgccaggaggcctcggcgggtccgcaattggccgggacagcttctcacgaaaggtcctgggccggcatcatcagcct

SEQ ID NO: 99166 - DNA, 30 bp, Homo sapiens
  chr8:21927030-21927060
  hypo
taggtcttctcggcacgacctcattgtttc

SEQ ID NO: 99167 - DNA, 30 bp, Homo sapiens
  chr8:21959580-21959610
  hypo
tcccacccccacacacgttcacagtggcca

SEQ ID NO: 99168 - DNA, 44 bp, Homo sapiens
  chr8:21987424-21987468
  hyper
cgccctggcccccagcgggaagagcgcgccggcacaggggaggg

SEQ ID NO: 99169 - DNA, 214 bp, Homo sapiens
  chr8:21987861-21988075
  hyper
gctccgtacgggcaccgcaggctcggctcagaaatcccccgccacgagtgtccccagacggcgcgctcctggcgcttacctgggcttcaccggccggtcgcggcgcgggcggtggcggtcgtcgtggccggcaccgggcgcctgctccccatgggccagctccggggcctcccggccggcgggcgaggacgcgttctcccgctctgtctgctca

SEQ ID NO: 99170 - DNA, 56 bp, Homo sapiens
  chr8:21988412-21988468
  hyper
ccaggagagaggcaccggcgagggcgcagcaccgcgcagcgcggctaatggaggta

SEQ ID NO: 99171 - DNA, 37 bp, Homo sapiens
  chr8:22005505-22005542
  hypo
tcctgggccagtccacggggtgcgcctgtacacactg

SEQ ID NO: 99172 - DNA, 62 bp, Homo sapiens
  chr8:22013920-22013982
  hyper
gcaagagcagctgggcgggcaggggggcgtcttggggggcctcttagcgctgacttgcagca

SEQ ID NO: 99173 - DNA, 133 bp, Homo sapiens
  chr8:22089510-22089643
  hyper
ctgcccctggtgagacgatgttcccagctgagcagcgcaagaagagaggcaagagcgaaatcaaagcagcgtggaggagagagaggcagagaagggagaaagaacgagagagccagaccgaatctgcctccac

SEQ ID NO: 99174 - DNA, 17 bp, Homo sapiens
  chr8:22101764-22101781
  hypo
tacgacaactctgtgaa

SEQ ID NO: 99175 - DNA, 30 bp, Homo sapiens
  chr8:22297450-22297480
  hypo
agtcccctagaggaacgggattaatttaaa

SEQ ID NO: 99176 - DNA, 43 bp, Homo sapiens
  chr8:22549491-22549534
  hyper
gctttgtcctcggagcgtagaagggtgtcgccctcaaagggag

SEQ ID NO: 99177 - DNA, 203 bp, Homo sapiens
  chr8:22562486-22562689
  hyper
tagaccccaaacgaaagaaaaagtatgccgcaatggaaactcgaactaatcttcccctcttgccccacttccctcccgcggtcacacttccggcggccaccacagggtattttgggtttgaaaacaaagcgtcagatctatttgagcaacttttgttccattggagtagaagcccaggggcctgtggccgctctgggctcggc

SEQ ID NO: 99178 - DNA, 30 bp, Homo sapiens; identical to SEQ ID NO: 9416
  chr8:22613837-22613867
  hyper

SEQ ID NO: 99179 - DNA, 30 bp, Homo sapiens
  chr8:22694146-22694176
  hypo
ggggtgtgggccagccgggtggcgagttca

SEQ ID NO: 99180 - DNA, 30 bp, Homo sapiens
  chr8:22708858-22708888
  hypo
cagttccttctgagtcgattcttgagaagg

SEQ ID NO: 99181 - DNA, 235 bp, Homo sapiens
  chr8:22722223-22722458
  hyper
tgtgtagcaccttctcggcagagctcaggaaagggcggaaggggtgagaaaataggtagccagaggtggaagtagctgaccaagtcctagcgggtagtacgcaccacagtaaaacaccacgggggccgctgggcaccgccgagcgccaggctggtgaactgacccgcagcgcaccccatctgtgtgggaaggtcggggcaggggacccagggcgggatggcggtgctggaccccg

SEQ ID NO: 99182 - DNA, 69 bp, Homo sapiens
  chr8:22723292-22723361
  hyper
ggccactcccgggggcgcgagcggcggcgcctagagggacccccaccccgggctcgaactcccgacaag

SEQ ID NO: 99183 - DNA, 184 bp, Homo sapiens
  chr8:22760486-22760670
  hypo
cctttctcattacaccgtagggacctcataaataggagggccttgtaatagcctgacgggcctgaaaagatggcagtggtatttcaggtacaacctgaaacttggattccatctcgctctgatagccttctactcccatagcttaagcaagaagaatcaccccggaaaccgcgaaatgttgaga

SEQ ID NO: 99184 - DNA, 438 bp, Homo sapiens
  chr8:22960583-22961021
  hyper
ggccgaggcagggtgcgacccaggacccaggacggcgtcgggaaccataccatggcccggatccccaagaccctaaagttcgtcgtcgtcatcgtcgcggtcctgctgccagtgagtcccggccgcggtccctggctggggaagagcgcacctggcgccgggagggggcagggagacggggacacggcagggatgcctggccctggtcacctgcggccgggcatgtccgggcaggacgaactcgccgtcggagtcaggggaagaactgggtccccgggctgggcaggagggacccggccgcgagggagcagagaggcggtccccctggctgccccgagcccgcgaagggagggaagttccagaatcgagagagggagggagtcaaggtggaacccatagagtgagcctcctgaagacacagagcggttgcctctctca

SEQ ID NO: 99185 - DNA, 398 bp, Homo sapiens
  chr8:23021192-23021590
  hyper
cgcaggcgacccgggccaagcatccccaccgtgtccccctctctccctgcccactcccggcgccaggtgcgctcttccccagccagggaccgcggcggagactcaccggcagcagaaccgcgacgatgaagacgacgaacttaaggatcttggggtccaggagccatggtctggttcccgacgctgtcctggctcctggatagcgccctgctcgagcgctcgaggcggtcgggacgctttgtccccaaagtcccatgagaagggaggagggtggatcgaaagcgccaaaaatcaatcagaaatcgtccccgtagtttgtgcgcgtgcaaaggttctcgcagctacactgccagaatagaacgtgctcctccgcttttataccccggaaaaaaggcgtg

SEQ ID NO: 99186 - DNA, 579 bp, Homo sapiens
  chr8:23260467-23261046
  hyper
ctcacaccctcgccccgctccgccccgcactccggctgttttttgatggtcttagctcgggcacggagaggagggaacctcgcttgttctcccaatcatctctattccagcgctgattcctgggacacctcgagcaggcagccacacccagagggcttccaaatttgggctggtgagaaggggcgcggtgggcaaagcgcctgcgtaaaagttgtaggcacttcagaccaccggaccaacggctcaagattgggatcagctgtagccgtgggttcgctcgtgcccgttctttccaactccagggcttctaggtgatgaaggcgggagagggtccctggtccccggagaggcagggcgacttgggagtgcatacctggcgtgccgagagcgcctctgctcccgcaggactcacggcgctcccgcgctcccaacagcctttcgagcaggctgggggttgaaccgggttcaagcagtggacgctacagctcccgggcgcagcccccggggtccccgcccccactccgtcccagcccagcacgctctacatccccaaaaccacagccccgagggcagtcactg

SEQ ID NO: 99187 - DNA, 552 bp, Homo sapiens
  chr8:23261347-23261899
  hyper
acccccaggcactgtcgagaggcagccccgcgcaggacgaagcctggagaccccatagggacgctcccgctttctcgcgaaccgcttcggggagggggtggcgcgggaagcgctcttacttggtttcagggatccgcagtggccgggctgggaccgcgctctccacggtggtccccctccgcttccgccgccgctgagcccctttctcgagcagagggggcggctctggtctccgatggctggagaaagcaagcaccaagcgtaggtagccgcgcgctggagtcgcgcgtttactcttttcccccttacttttaactagaggaggatggcaaacccctccccggacccacccccttccccgaaggcggccgccgcagcaggcccggcctccggcctcttttgttgtaattcgagagcggccactcccagggccagagggagctccgcgggggaggccaaggcctgcggggcagcccttcccaggctcctcgcgcccgggtttccggagcctgagatgccgggaagggggcctttcctcgggagattcctcta

SEQ ID NO: 99188 - DNA, 254 bp, Homo sapiens
  chr8:23290404-23290658
  hypo
ttccttttgagtcttcgtggagctgtgagctggatcacaaggtccccggggcattctgggcgggaaggccctcctccatccagagggcggcggccgagctgctccggggagtgcgcctgtggatgcgccgcagccgcagcaggtacagcaggatggccagcagcaccaccaggaagcagccagagaacaggtagtggttgtagacaaaggaaacgccccgccagtgggtgtgactggctcggaaggcctcctgc

SEQ ID NO: 99189 - DNA, 30 bp, Homo sapiens; identical to SEQ ID NO: 41728
  chr8:23331189-23331219
  hypo

SEQ ID NO: 99190 - DNA, 30 bp, Homo sapiens; identical to SEQ ID NO: 41729
  chr8:23340639-23340669
  hypo

SEQ ID NO: 99191 - DNA, 30 bp, Homo sapiens
  chr8:23345865-23345895
  hypo
gccctgggagccctgcgagttgcggaagag

SEQ ID NO: 99192 - DNA, 136 bp, Homo sapiens
  chr8:23380707-23380843
  hypo
ttttaagtcacctagtttgtgtcattttgttagagcactcccaggacacaaatattttacgctttctgagctttaggtgcagcagaatattcaggtagagctgccgggaggcacatgaatacgtgggtgggactgg

SEQ ID NO: 99193 - DNA, 30 bp, Homo sapiens; identical to SEQ ID NO: 41731
  chr8:23395420-23395450
  hypo

SEQ ID NO: 99194 - DNA, 38 bp, Homo sapiens; identical to SEQ ID NO: 15103
  chr8:23399594-23399632
  hypo

SEQ ID NO: 99195 - DNA, 152 bp, Homo sapiens; identical to SEQ ID NO: 15104
  chr8:23423918-23424070
  hypo

SEQ ID NO: 99196 - DNA, 30 bp, Homo sapiens
  chr8:23424483-23424513
  hypo
tttgagggagagaggcggggtgggggggtg

SEQ ID NO: 99197 - DNA, 53 bp, Homo sapiens
  chr8:23430870-23430923
  hypo
gctctgccaggctgccgtgcaagggaataccgacgagacgagctgcactgtct

SEQ ID NO: 99198 - DNA, 264 bp, Homo sapiens
  chr8:23559338-23559602
  hyper
ttccaggagagcagtcgtggccagaaaagagtgctcctctggattaacggagtcccctggggcgcggccttatggggatgtttaagtcccaaaggaagaggctcaaagcaggttactcttcgtgaacttcccggatcctcaagttcccagctcttcagcccccttcccgccctcccgtcctcttctctttcttccccaacagctgtcattaattggaggatggtaggcccgctagatcaccatctccattcaccgccgatgccc

SEQ ID NO: 99199 - DNA, 1257 bp, Homo sapiens
  chr8:23559665-23560922
  hyper
cgcgccttagtactgctcccacaccccaaactgccagccagccttggtgttcttcagtccctgtgttgcttggtgggtgaccggtggaggggtcttcttttgggggaagaacgtcccaggcggggcctttaactgggtgactgtggtgcagatcgcagtttcagagatccctccggaaagaagcgccgttgggtagcagcttccttccagcgccgcgtcccctccttgtcacgacctgcgggcggaggggaagggaacgagcatctggccctggttggcagagtcaagccgaggagcctcaccaggccctgacaccctgcagcgtggctgccagatggccctgcggggtggcattctggccaccgtgtccgaagcccgcgctggccagtggtgtgtgtggcgcaggacccgagggcgcgcccgcgtagcaggtgccgtagcctgcgccgtagggtgctccgctgtagcctccgtagcaagagtagggcgacactgctgcactgtaggggctggggaaggcaggtgcgccgggcccggggcccaggcagggcttgccatcgcgcaccaggacgggcacagctactcggcgcggcgttagagggtggccagccagttccagcgacttgtcctggcgctgtctcttgcatttgtagcgtcggttctggaaccagatcttgacctgcgtggacgtgagctgcagcgcgctggccaggtgctcgcgctcgggcgctgacaggtaccgctgctgcttgaagcgccgctccagggccagcacctgcgcctgcgaaaagagcacgcgcggcttccgtcgttgccgcgccttgggctgctccgagcggccaccccgcacgctgtcgccgctgttgccaacgccgcgctctggcaccctggtcccgccgccgaggggcgaggccgcgttcaggccgggctctaaaagcacaggaagggacacatcagcgcccagcctaaggctcacctgagcggttcctacttagttttcaagactttcctctccctggcagccttcactctgcgcaggctcctcctccctcctactgcccccgaaccctgtcccaggacgaaccctgtcccaggactgtctccatgttttttccctccaagctctgtcacctttatatgttactgctggaacataaattgtgacaacctatggtccctcgtgtgtgcgtccttttcctaaaggtagactctagataaagagttaaggcagctccatttgcttcttagaatgtgtgt

SEQ ID NO: 99200 - DNA, 30 bp, Homo sapiens
  chr8:23562792-23562822
  hyper
gagttagtgagtagccggcctgcaggccgg

SEQ ID NO: 99201 - DNA, 233 bp, Homo sapiens
  chr8:23563791-23564024
  hyper
cccccacattccccccgtaggaggcaagacctgagcgcttactcacgtggctcccccatccgttccgcgtccatctccaagactgcctcacagggacccccaggaggctccgaaccatccagctttctgtcaccgccgccgccaccagcgttgtgaacctctgaccctcgcggctctgcgtccattctcaggtactgaaagttttccgggctcttccgcacccgcggatgtgg

SEQ ID NO: 99202 - DNA, 218 bp, Homo sapiens
  chr8:23564192-23564410
  hyper
cgcagacagacccaagctctgggacagacgcccagcgtcccagacagcgccttcctctgggccatgctggtaggcccgggtccagggccgggtgacgagaccgtagccccccattggttctcgcagaaaccacgtgctagctctgcaccttcctcccccagcgctttcttcccgcgcccgtcgaatcctctccagtccccagtcgccttcctgggagg

SEQ ID NO: 99203 - DNA, 490 bp, Homo sapiens
  chr8:23564781-23565271
  hyper
cagaatccaggtctgcggagtcccgacccgccacttcctaggagcagcttctcagccccaggaccgaggaatgggtgtgggggctacatgtggggagccctcgacctcttaaagggctccgcgaatggtgggggagactggaaggcaatctctgcggcccgcgcaaagtggtcagaggcgggagtgggggtgggggggggtgggcttccgtcgcccttggcgtccccacgttctttttcttcctctcctttatcctccttaaagcggattgcctggagcgtgccagcttgtgtgcgcgtataaatgcggcgcccgccgaagggctgggaagatttgactcgcattagatctccagaaaaggcccttggttacggcgggcaccgagtaaatggcgcagtgtggcacaaaggttaccaacacggagatagcgccaacagatccagcccctgctgttactactcctggatcagggaaacgtgatttggtgtca

SEQ ID NO: 99204 - DNA, 52 bp, Homo sapiens
  chr8:23566803-23566855
  hyper
gtttacaatcatcaccgggcacccacaagagaccctgaacttagaatatttc

SEQ ID NO: 99205 - DNA, 314 bp, Homo sapiens
  chr8:23566900-23567214
  hyper
cgctgggttctcgccttccaagtgctggaggggggaagtagggccacccggggtagaaacctaacgccagaaaccttccagcgccttatcagttggtggaattttcgtggcagacagtcgcgctctacctaagtcgtagaagaaaagacaccttgtgggggacttggcgtcggaagccttgagttcaaatcgtagccctaggtccccagccttgcccttcctggcttgctgcgaggatgaaatgagatttttgtacgtgaaaatgctttctaacccctctcgaggggtggaaacgtctccattcgaccagagtc

SEQ ID NO: 99206 - DNA, 272 bp, Homo sapiens
  chr8:23567311-23567583
  hyper
cgctcccggcgtagacctggggataggggtccctgtcgcgctcgccccacccctgcagggagcaaggccgtccttctgcagcaccgcgccacgcggcgggaatttgcagtgtcctgctttctggtttcagcttcttcgctcgcttgggtctctctcggtcacctctcggaggggcctggagtccctcctccctcctcctacttcagcgccagaagcattgaaagccgcccgcccgccgagagtggaaccggtacctcgaatctcgctcattc

SEQ ID NO: 99207 - DNA, 125 bp, Homo sapiens
  chr8:23567657-23567782
  hyper
cgctggcgcccaggaaagccggggaggaaactaggaagggaggcgacagcagaaaagccagagagtccagagactcctaggcaggcctccgtgcagccccaacagcgtggtgccgggaggtgtgt

SEQ ID NO: 99208 - DNA, 18 bp, Homo sapiens
  chr8:23567842-23567860
  hyper
catcgtgatcacctctgt

SEQ ID NO: 99209 - DNA, 386 bp, Homo sapiens
  chr8:23571643-23572029
  hyper
attaaggatctgatacgatcttttcctaaattgctatgctgaggcctttttgacggtttgtccgccatcactttcagaggcgctccgcgcgaaccccgaaaatctgtgcaaaattctcagggttaggggaagagcatgggtggagagtaaagtgaagcgggccgagagatttcttgcattaaatgtttagaagaaccaaccagttaaaggaaataaaaatctgccggtatgtaaccgctgggtgggcttctccatttctccgtgtcaccctcccccagccggcctcttagcttctcggctttgggtggcggagaccgtttagttctgggacagaccgtcgggggctgactccgggggtttgcgggcgccgagctgcctccgcgcgc

SEQ ID NO: 99210 - DNA, 243 bp, Homo sapiens
  chr8:23572030-23572273
  hyper
ttccactccttcagcgtggaaaagaaaaccctcagcggccagagaggcggcggggccttcccggatcgctgattcggggagccgcaggcggggacgctgctgggcgacgcttatctgcgccgcgctcgccagctccgtttcaattaacattccagtgccgccgcccgccgcgggagcggagtccccaccagcccctggaaaaataaactctaggcctagcggctgtgcgtgcgtgtgtgtgtg

SEQ ID NO: 99211 - DNA, 329 bp, Homo sapiens
  chr8:23572333-23572662
  hyper
agtcccagatcagtgcagtccagagctgcctatccccgggtcgcggttccctgcggggtcgagcctgcgccgggctgcagctctctgtcccactgcgcggcgggatggcagctgctcttttaataaactagcagtcggcggtctgagccctacaatatccccaaagcctggtgtgcgatggaacacatggctgcgtccccagaccccgagaggggagttgcacacacattgctgaccttgagggtcagacagaccctttctcgtctagtttttagcatcagatgtaacctcagcttgggcttctatgatctcatcgatgtccttttgag

SEQ ID NO: 99212 - DNA, 46 bp, Homo sapiens; identical to SEQ ID NO: 3213
  chr8:23583971-23584017
  hyper

SEQ ID NO: 99213 - DNA, 308 bp, Homo sapiens; identical to SEQ ID NO: 3214
  chr8:23584093-23584401
  hyper

SEQ ID NO: 99214 - DNA, 240 bp, Homo sapiens
  chr8:23584581-23584821
  hyper
cggcgccagggcgggtggtggagctccgcgcaggccggggggaaccgcaagaggagccggggcgggcggcggccccgggcgggtcaggggcggcgcgagcccacacagagcggtgaaactaccaggggccctcccactcttcccggactccggaggagctaagccggcagggatcgctcgcccaccctgagcactttacctgcatggtggccaagacccttcgtccggaccctactcctg

SEQ ID NO: 99215 - DNA, 49 bp, Homo sapiens
  chr8:23585236-23585285
  hyper
cagctgccccacacccggctgcgcgtgcctttctcgcttggatccctgg

SEQ ID NO: 99216 - DNA, 30 bp, Homo sapiens
  chr8:24272681-24272711
  hyper
acccgggaccttttacgccctcgtgtggcc

SEQ ID NO: 99217 - DNA, 128 bp, Homo sapiens; identical to SEQ ID NO: 41648
  chr8:245097-245225
  hypo

SEQ ID NO: 99218 - DNA, 69 bp, Homo sapiens; identical to SEQ ID NO: 9432
  chr8:24770293-24770362
  hyper

SEQ ID NO: 99219 - DNA, 168 bp, Homo sapiens; identical to SEQ ID NO: 31838
  chr8:24770413-24770581
  hyper

SEQ ID NO: 99220 - DNA, 232 bp, Homo sapiens; identical to SEQ ID NO: 31839
  chr8:24770893-24771125
  hyper

SEQ ID NO: 99221 - DNA, 226 bp, Homo sapiens; identical to SEQ ID NO: 31840
  chr8:24771349-24771575
  hyper

SEQ ID NO: 99222 - DNA, 137 bp, Homo sapiens
  chr8:24772604-24772741
  hyper
gacctttttcagaaacgtgcatcttttccagttctaattttgcacgcttgcacgtttaaagcaggagggatgaattcggtagtggataaatcagcaactttaggatagcttatgcagaaacgcgtgtattctctact

SEQ ID NO: 99223 - DNA, 41 bp, Homo sapiens; identical to SEQ ID NO: 31841
  chr8:24799514-24799555
  hyper

SEQ ID NO: 99224 - DNA, 68 bp, Homo sapiens
  chr8:24812768-24812836
  hyper
gccggtgcagcagcacggagcacactcccagactacagtggcgcccgcactcacgcccttcaagtgcc

SEQ ID NO: 99225 - DNA, 324 bp, Homo sapiens; identical to SEQ ID NO: 31842
  chr8:24813140-24813464
  hyper

SEQ ID NO: 99226 - DNA, 276 bp, Homo sapiens; identical to SEQ ID NO: 3219
  chr8:24813618-24813894
  hyper

SEQ ID NO: 99227 - DNA, 418 bp, Homo sapiens; identical to SEQ ID NO: 3220
  chr8:24814010-24814428
  hyper

SEQ ID NO: 99228 - DNA, 375 bp, Homo sapiens
  chr8:24815060-24815435
  hyper
cttgctaccaccaaccgcagcacatttaaagtccgctttcctctttttacacatgtgtagcacacgacctgatgatttcgataagccttgcagttggctgattttcagggaagccgctgcggccagccctgagcgctgggtgtggtctctggggaggagaactcggcacccaggcttcttcaggaacggatagaaaatagccatagccgcgtgactcttcccccgatacaatgtaataacccgaaaacagatgcagtcaggaatgcatggatttccttcaggaagcacccagatgcttgaaactggcgcacgcggtagcgcacgtggatacaaccctacggtttgcagggcattttcacacgcatgatgttagga

SEQ ID NO: 99229 - DNA, 215 bp, Homo sapiens
  chr8:24816391-24816606
  hyper
tgaagcctttgactgcagaggaggctgcccagaaaggagaggggcggcgggtgctgcagagggatgcttcagagagaagaaaccattggggcacctgctgcctgccgtcccctgggtagctggaaaaaagaggaacacaggagcaaagggtgagaatgggaccctttcctgtgctgaacccggcccacagagtgggggaaggggcagatccacag

SEQ ID NO: 99230 - DNA, 25 bp, Homo sapiens
  chr8:24816694-24816719
  hyper
cgaatccagccggggtctgagtttt

SEQ ID NO: 99231 - DNA, 2149 bp, Homo sapiens
  chr8:24857402-24859551
  hyper
gataagactttcagccgacaactaaataacgagaaacagctacacgtctccagggcctttcttctggaaaaacttttctggtcccctcttccctgaactggtgcaggcgtgcaaagaaagctccgtgccacgcccggcagcctccattctttggtagaacgcagcgcagcaatagccgccaagtcccctcctgggtacagtacagctccacagcgcccctgctggtggcttgggaagggcgcgcaagcagagaaagcaagtgtcagagccgggactggcctcccagggcatcgcctacagcttgtgctctgagagtcggggtcatcatagctgcgctcttcgatggacactaaatgcgggacatctgttttacactcaccctccctccccgcgtggcaggagacctacactctcccgctatgcgcgctccgcggcagctgccgctgcaccattcattctctcctgcagaagttcaatattgctgcaaatatcgagaaaaaaaaaaaaagcgctgagagggggagggagggagggaggaagggagggacagcgagccagcggccactgcaaaggggcgaagggcagtcccgcggtcagtaagggccactgaactttctgcccaccggtcatccggagctgaggactgggacatggtggggtgcgtcggcgagggtcccctgaccctgcacaaacccaggggtgtggtgtggatgacccgggaagccgcacccagagctggcggtatgtcaggccatagagaaaaagggatgttcctaggctaaaggagacatcggggctggggatgacatcccaaaactcccagcgccggggagctcaggctcgggcggtgcctggctcccctccccggttcccgccgcaggaggctgctgagtcactcccgcctgagccacggccgcccccagccagccacgcgattggcgggttagcccgggcgcagcgccctcttcccagctcccgcacccccagggcttcccgcaggcagagggtgggagccccggcgagcgaccagttggggcttggtaggaaccccctaaaaatgcgccccacttgtgcattcgtgcatgggcgcattttgggagtaaacaatacataaccttcttcgcattcaaagggtctggactcaaaagagggctcagccttgctcctcgggagcaacccctgttttaaatctgggaaatggtgatgccagtggggaaagggcttctccgggcccggggctcccgagctcctggtgccagccgtgttgctctggcttttgtattttaactccgtgggcttctgtccccatccccatgtaaggccagtgcccccttccgcgttttgccgaaagtatcttcaatgcccgtttaaaaaactatgtctgcgatttctccatctctgctctttcccagttcctctcttttctcttcttcaggccccctcctgtccttcctcatcctttcactgagcgggttcaggccctagttactaccgcaggcaccagccacacccggggagatgtgtgctgttttgtgcaagacgctgcggtcacccagtccggaattctgctggtctacaccgagtgccgcaacaccaccaccacctccgcacacatacgccctccttgaacctcttccccatgaatgctttggcttttaaggaactttgtggcgtttctgctctttcggaggcagctgcccgaggcagcttcccaaggcagaacagggactgactgctgaggttccgcggggtcggggaggtggagaagccagttcccaagtggctcgtcgcgggtgttagagtccctcgttactaaggacgccgccgcccgcgcgccaggcttggggaccagggtgactctgccctttctgggcggaatacgggtgaaggctgtctttggggatccacaggtgatctgtgccgttctcattgtattctcaactctcatcccttccaggttagcccgatccctttaatgcaaggatcggtgccgggaggaaagagagcgtgggccactctggaacggaggctggtgttttgggggagcggggagagcctgtagcccacacatctccacggctctggcccaatttctccactttttcacttcgatctaattggtcttcaaggttcccgaggctgcgcacca

SEQ ID NO: 99232 - DNA, 398 bp, Homo sapiens
  chr8:25041548-25041946
  hyper
ggatcccctagcaaacggtctgatacttctgaggagcccacctcccttgcaccagctctccggtgataaaagttctgctttccaggctctaagcggtggccccgggagattcagtctgccctgagtccggcttctcccgctcgcggcgcgggttcaagctccagggggtgaaggcagaagtcaactgctcattcattcaacaaatatttattgcgcgcccgcttagtgccaggcaccggaggtgccccgagcaagaagccgctctcgctgatccgtttccgctccccaagtgtccggcgcgcgccgtgggagcgcagcccgcatccctcgcccaccggccgcccggcctgggcgtgcccggctcctccagcgcagccctctgtcgggagccggacccc

SEQ ID NO: 99233 - DNA, 36 bp, Homo sapiens
  chr8:25042248-25042284
  hyper
gggcacgggcacgggcgcgggcggcgcggcgaggag

SEQ ID NO: 99234 - DNA, 96 bp, Homo sapiens
  chr8:25042737-25042833
  hyper
ccagggaaatgtcaacgcgaggggggcgcgcctgctgctcttttggggccgcagctctgtggctcgccccggtgcgcccagcgtgggtttcacctg

SEQ ID NO: 99235 - DNA, 41 bp, Homo sapiens; identical to SEQ ID NO: 41735
  chr8:25318815-25318856
  hypo

SEQ ID NO: 99236 - DNA, 44 bp, Homo sapiens
  chr8:2536006-2536050
  hypo
agaataaggatgcttcggttagaaattgtcgatggaagagcatt

SEQ ID NO: 99237 - DNA, 30 bp, Homo sapiens
  chr8:2537563-2537593
  hypo
ggcgcctgtccaatccgcccatttttttgt

SEQ ID NO: 99238 - DNA, 34 bp, Homo sapiens
  chr8:2538299-2538333
  hypo
aaactcgattgtgctcgagcgtccgtaaagacca

SEQ ID NO: 99239 - DNA, 216 bp, Homo sapiens; identical to SEQ ID NO: 41736
  chr8:25397045-25397261
  hypo

SEQ ID NO: 99240 - DNA, 138 bp, Homo sapiens
  chr8:25899282-25899420
  hyper
cccagagaaggggagcggcggccttgggtgtactttttaactagtccaaggggcgtttgctccgccgtcagtccataaccaggcgctactaaggcctccaggctcggtgcgcagagccgggagcgctcctccagctcc

SEQ ID NO: 99241 - DNA, 285 bp, Homo sapiens; identical to SEQ ID NO: 31853
  chr8:25900408-25900693
  hyper

SEQ ID NO: 99242 - DNA, 237 bp, Homo sapiens; identical to SEQ ID NO: 3223
  chr8:25900780-25901017
  hyper

SEQ ID NO: 99243 - DNA, 1167 bp, Homo sapiens
  chr8:25901018-25902185
  hyper
ggccagtcccgaagcgctgcggaaagccgcggccgccgcgctgtgcggtctgccggagggaaatccgcgctccccgggccacaggagggagggaaccgccgccggcccaagtcccggagcgataaaacttctgctttctccgctccaagggtagaggccggttcgctctacccgggacacctggccagtttgggaaagggatcatttctccgtgtgatgttggcacttaaatgtgggtggccaggagggcagcaggggaagcgagggtagtggaagaagttcatcggctctttgggggtagaagggctgcctctctcgcagacaaggacctggaggccacaaatcccaactcagtagtggtgatgagagagtgggaccgtaatgtcttcgtagggtggcaccccggacatggtatttactatcccagcacgcagacgcctaaacacaaagtcaacttcagggatccgcaaaaccagaggctggcgatccctgagccagtctagctgctggtggccttttctcgcctctttcttcttccgcaactctttctactgtgactcagtattttctcttcttttaaatctcttcttttctccagttccctagctccgttcgtctggctcactgttttatctttgagccgggaccctccagcctgtcccccctcccagagctcccggccgcctcgtcttcccgggcagccgctccggcttttcccgctcccctcgccgccgccaccctctggccgccggcctcccaggctccaggaatcgcccagcaagatgcgggaggtaggcgctcgcaggcggcgtggcgaagccaagagtggccaggaagccggctttcctcccgcgccgccactgccagcgccggtgttcacgctccgttcggggccaggccggctcggcttgcaggactaggggctgagctgggagatgttgggggctactttatttttccttgcaaagagtggactgtggtaaaggagagggagagaaacgcctacgacccaggcagttcaggaactcgagtgccggctgccgggtgagcgttcgcctgactgcagcgatctgcttgcccgagggcgagccccagcgcgcagggcctgggcgacagatggggggacagggagagagaaaggcacggggtgcgcggggggggtgcaca

SEQ ID NO: 99244 - DNA, 30 bp, Homo sapiens
  chr8:25902535-25902565
  hyper
cctttgcttcactggcgaggtgcggactga

SEQ ID NO: 99245 - DNA, 126 bp, Homo sapiens
  chr8:25902843-25902969
  hyper
ggagccgagaggaggcggtggctgcgagcgccacggagcccggctgcagccgcgcgcgggccccatgaatgggttactacggccctggctgcgggaggcggagctgcggcccgataaggagcctca

SEQ ID NO: 99246 - DNA, 899 bp, Homo sapiens
  chr8:25903468-25904367
  hyper
ggtggggcggacaagcgaggggcaagtgctgctcaaatacagtgctggggaaaacggtccaggacctaaggaaaacacccgcgggcgggcgggcgcgagcggcagtcgcacccgtgtggaggagaggttgctgacagatcgaggcgggctgagtgcgcgagcggccggggagtattcccgcgggtcctccggttccctccccacctctccgttcccgaagcccccggtagtgggcggggagggacgggggagtcgtggaaacttcgcccaccgcgcgcggtcgccgcggtgctggccgcgggctggtggccggcaggcggtggcagcagcctcaccgaacagctgaaaccctagacggttttttaactgcgcggggctgctcgcggtgcctattaaacatcctcctggctgggtgtcattttcttgcttctccttttgtattctgatctgcgcatagatctgctgctgctgaaatctagaacaccagcgcgaaaacagatttgaagacaatgaatgcaaatctgtgctcaaagaccatctgccgtggaggagacaatcagctgttcgtagttcgagcgattgcgccccagtctcccggtctcattacggggagggcatttgcgagcgcctggactgcgttcagggcactttctcccctcttgggtctcagatttgagagaccagatcccttaggtgtaggtgagcgctcgcaaatgaactgctagagtttgccgctagaggacacagcgccttgcaactggtttgcctaggctgacaggaagcttgcacttcaagaaaactcggctctctcgagaaagggaccggtgcgcgcctccacctccccaagggacaaaccgcggcaccacgctgcgtgcgcgggattgcgactaggaagtgct

SEQ ID NO: 99247 - DNA, 64 bp, Homo sapiens
  chr8:25904571-25904635
  hyper
ttggactggaaggggcgggagagccatacagggcgattgggaaatggatcgggtggctagtaaa

SEQ ID NO: 99248 - DNA, 731 bp, Homo sapiens
  chr8:25904898-25905629
  hyper
agagtgtggaacagccgtgagcccttcaagacatgcctatgagcccggtgatttttttttcaagggggctttgatcagctgtacctccacgttgccccggaaaggtgcgcagggcacccggagaggcctctggtcagcagtgggcctgggccaagccccaacagtttacccctcaggctcaggttggctggggttaaagggcaaagtcagggtcgagggcaccagcttttctcggcggtaacagctgccacccaaattatgccccctcaggaagcgaatgaattgttcctttctcccagctccctgctgcccgccccaaaacagacggggccgcgctcggcgggcgcccctcctcccagccaaccccccgagacgcgctcaggggcctcggtgccccgctgggaggcaatttgggggagccgtggtcccgaactttgacagagtggggcttccccactacttgccggctgcgctaagggcgccccccgcggcagtgctgctgggagctccagggatggctgtgtggctcgctgcgggcgttgaagttccctgttggccaggctgaagtgcctgcgcgagcgtgaggggacaaggactgccttgggcccagcgtggcggcgtttcggccaacccagttggggttaattgcgtctgtataggttttgggtaggaatgctcgcggagtccgccacccgcgcgaaacatgcgttggttgggggaatgagcagcgg

SEQ ID NO: 99249 - DNA, 143 bp, Homo sapiens
  chr8:25905695-25905838
  hyper
cgatctcgtgcaacacaaaacctgccccgagctgtgcgggggcctggcaagcgcagctgcggccccgggaagcccaatcccgcgggactgcggagcccacgcgctcctcaggctccggccaactagctcggttctgcctctag

SEQ ID NO: 99250 - DNA, 88 bp, Homo sapiens
  chr8:25906080-25906168
  hyper
cgccaagtctctcctcccgatcagaggttcggaaattttacttagaaactgctctcctggctgtgttcctgtccggcaggacactggg

SEQ ID NO: 99251 - DNA, 57 bp, Homo sapiens; identical to SEQ ID NO: 31863
  chr8:25907271-25907328
  hyper

SEQ ID NO: 99252 - DNA, 33 bp, Homo sapiens
  chr8:25908392-25908425
  hyper
ccccctcacctgccgcgagccgggcaatcattt

SEQ ID NO: 99253 - DNA, 15 bp, Homo sapiens
  chr8:25908502-25908517
  hyper
cgctctcctggccgg

SEQ ID NO: 99254 - DNA, 637 bp, Homo sapiens
  chr8:25908962-25909599
  hyper
gctttgcttgccttacggataagacagcttaggtgaaagtatctggcacgcagtaggtgttcaataaacgcttgctttccttcagcatctgcaggtgtaagatgaggatgatcacatctgcttatggaattcactgggtcctgagtctcctatggggatgggtttcctttcccccgacctatgcgctcctgaggcagggattctgactcgcttgtccttgcagctcctttgcctggcacagggactggatcgctcagtgggtgataagctttttgtttgttccgcatggaattgcatgtgagaaaagcgctttggaagctgtttggtgcacgcgggcgtcagagggcaccgtaggtcactgagcggggtctcacccagggagagaatgcgacttcattcctaggaggctgtgctgggggctccgcgctgcgcgcggcagtgagtagggcgcaccccgaatgcaagtgcggttcgctgcgtggccgcgtgctgggatggatcgcggaactcgctagataattgaagatctcgaggagctctgaaatggatcttcggtttctacgacaaacccccgtcgatgagtggttcacagagagcttggggagcccctccccgccctgcgccctcaggaagagac

SEQ ID NO: 99255 - DNA, 99 bp, Homo sapiens
  chr8:25909600-25909699
  hyper
cggctcgcctgacactactggtctctgtctcccgagagccagagccgagctccccgagtggtgctttccagagcccgcattaaacgaagctgggaggga

SEQ ID NO: 99256 - DNA, 30 bp, Homo sapiens
  chr8:26187766-26187796
  hypo
cacatttttgtctttcgtcttttatttctc

SEQ ID NO: 99257 - DNA, 124 bp, Homo sapiens
  chr8:26267081-26267205
  hypo
actgtgtgactgttgcgtgggggttgatgtggggcaggtgtaggagtttaatacattgctgcctatacagcagttcattgcccttaagcgattggtgtctataccttgccgtctctctttcagt

SEQ ID NO: 99258 - DNA, 30 bp, Homo sapiens
  chr8:26267880-26267910
  hypo
atctatattggaaagcgactgagcacaccc

SEQ ID NO: 99259 - DNA, 200 bp, Homo sapiens
  chr8:26306037-26306237
  hyper
ggccggggaatgcaccgagctgcgcgcttccagcgccgtcggtctggggtttctgccattctaactcccaaggcttttctattttgggcttaaaaagatgcagagtccccttttatcggtcaggcttgtagcagaaggttcaggtccaagaggaccttttggatttagtcctttctgtcggctcccgcagtcaaaacccc

SEQ ID NO: 99260 - DNA, 38 bp, Homo sapiens
  chr8:26370063-26370101
  hyper
ggatccctggttacacggccctacgcggtggccctgcg

SEQ ID NO: 99261 - DNA, 3 bp, Homo sapiens
  chr8:26370549-26370552
  hyper
ggc

SEQ ID NO: 99262 - DNA, 659 bp, Homo sapiens
  chr8:26370553-26371212
  hyper
ggggaaccaggcggggctctggggcgcaggggaaagctggagatttgggaagggggtttcagtttgttttttctctctttttttttttttttttttttttttggtggaggaagcagaataaaccaaatcgcgacacgttcctgcgcccttcttggcgcagtggcgcagacacggtccatggcgccttgcgcaatagagtcggtctgcaccccgtctttaagtcgtggccctgggctggaattcccgactgcactctttgctacacccccatagaccgcagacctgcgtctctctctatattcctctcccatctgctacgcccctctgaatttcttcccgccatgttgtgtgccccccccccactcccccgtcaccccaaccacaccaaagtggatgcacgaagcgggaaccttctcgtttcagtctctgctccctgcagcctgccaaggcgagtggacaaactgaagctggggtgtccagcgtcttggctgcccccctcctgtccaccctgcctgtgctatccttgctcatcttcagtgccatcccgcttcccacaccctgagtagcctggcgcccggcttgtccccttttcccatccatcagctcacacccagggtaacggggcgggacccctatccacagtgcgccctcgcccccgg

SEQ ID NO: 99263 - DNA, 480 bp, Homo sapiens
  chr8:26371670-26372150
  hyper
gggagggtgggtcgccggctcgccagccctccttcctttctgtgcaccttgcggtgggcggcgaacggcagccgcggcagcagctagggggcttgtgcacacagcgagggagacttagggactggcagacggacggacggacggcgaggaccctacccgagcccccgagccatggccgagagaaagcaatccgggaaggcggcagaggacgaagaggtccctgctttttttaaaaacctgggctccggcagccccaagccccggcagaaattctgtggcatgttctgcccggtggaagggtcctcggagaacaagaccatcgacttcgactcgctgtcggtgggccggggctcggggcaggtggtggctcagcagcgggacgtcgcccacttgggcccggacccgcagccgccgtactcgcggcagggccggcgcgccggcggagagccatctgttgaatcgggccggaaggtggagatc

SEQ ID NO: 99264 - DNA, 500 bp, Homo sapiens
  chr8:26372420-26372920
  hyper
gcttgagaggtggggcgtgggcatagggaatgggctgatcccctgctggggcgggcggtggtcgtctgggagggggttggccgcggttccattcttctgaaaccctcccgggcggcttccgattgcagctgcggctgggtgccccaccctttttttgagcggctcagagcgtgcggtggaggctttgcgtgaaggcccgcggctccccggtggtcgggaggggcgggggttcggacggccgctccctacagcctccgcccgcgccttctgcgctcacgtcccgagctccgaggccaggaccatggtcagcgccccccggaccccctccgagcaccgcaccgcccttgactcctgctcgcagcgtgagaagagccaggaaggctgtggagtcacccgaggaaaccgagacgctcctaaatagcctatgtggggaacaaagttccaataagtgtctcagccggggcttcacagagcgctccccaaaccgctatgtgggaggc

SEQ ID NO: 99265 - DNA, 56 bp, Homo sapiens; identical to SEQ ID NO: 41689
  chr8:2652772-2652828
  hypo

SEQ ID NO: 99266 - DNA, 135 bp, Homo sapiens
  chr8:26629344-26629479
  hypo
cctcattctgtataacgctgaggggatcatcacataggataaggtcaatgtcgtttctaaagcagctggggtaaatgatgacggcttttggcctggcttgtctgccaaggccctggccatcgtcaacttcgggag

SEQ ID NO: 99267 - DNA, 159 bp, Homo sapiens
  chr8:26637232-26637391
  hypo
tgctgtcatgcagtgcgtctgcataggggcccaggcaattctgattgcatgaagcgggaatggaattagctctattcctgcttggagcacagcacggtttgggctgctggtcgcgtcagaacttgtgagcttcttaataatacacgggccacacacctc

SEQ ID NO: 99268 - DNA, 64 bp, Homo sapiens
  chr8:26721627-26721691
  hyper
gcagccagcagaggacgaagcagccgaccacgatgcccagcgttttggccgctttcttctcccg

SEQ ID NO: 99269 - DNA, 30 bp, Homo sapiens
  chr8:26722735-26722765
  hyper
accctctccacctgccgggctggcctagcc

SEQ ID NO: 99270 - DNA, 598 bp, Homo sapiens
  chr8:26722986-26723584
  hyper
ccgatggttgggtagcgcagcgctacaggttgggcgctgctcctggcccgcagttacctacattttgagctgccccaccgaaggctcctgctctctccagcttctaggagcacaggtcaggggacgtaggtgtggaatatgtgctgagacccaggaggctgcggggcatcgtttgaccgcgtccacctgaaagagcgcaaagagaaaggcggctttgagctaggcgccccagggaaagaggctgtgctgagcttgacgggttgggggacaccagttgggagccgggttggttctgcggtccagaagctgcttcgcccggcagcggtggaggcgacttcggagctcatctcgcgcccccaccactgggaacctgcctagcgcactctactgagtcacctctgcccgagttcaggatccgaagcgaaaaacaaacaaaaaaacaaatccccaaaaccccaggctccagcgctcgaagtctggatttcgagcgcaggtaccacgaaattaaaatcctcgaagccccggaggggcgactgcggctggcgagtgtgtcgcacggatcctagccggggaattctggaggatgtactcggtttcc

SEQ ID NO: 99271 - DNA, 855 bp, Homo sapiens; identical to SEQ ID NO: 31872
  chr8:26723585-26724440
  hyper

SEQ ID NO: 99272 - DNA, 169 bp, Homo sapiens; identical to SEQ ID NO: 31873
  chr8:26724484-26724653
  hyper

SEQ ID NO: 99273 - DNA, 150 bp, Homo sapiens
  chr8:26852267-26852417
  hypo
atttttatcagactgcgaaaagcattgttgtcacaaaagagtttaagaaccggttctaggacttgaggacttttaccactgtttctgaaacctcactgtctttttttttttttaatcgcactccatcacccagactgaagtgcagtagtg

SEQ ID NO: 99274 - DNA, 38 bp, Homo sapiens
  chr8:273114-273152
  hypo
attcaccccagagggcgaggagccggatagatgtccgt

SEQ ID NO: 99275 - DNA, 30 bp, Homo sapiens
  chr8:27320956-27320986
  hypo
tgaacagcaggtactcgccgatgagcggga

SEQ ID NO: 99276 - DNA, 30 bp, Homo sapiens
  chr8:27449851-27449881
  hyper
cctcgtttctcccagcgctgccctccccat

SEQ ID NO: 99277 - DNA, 39 bp, Homo sapiens
  chr8:27472031-27472070
  hyper
tggcttcctgggctccgtcgaaagcgcaggggttgtgac

SEQ ID NO: 99278 - DNA, 440 bp, Homo sapiens
  chr8:27491124-27491564
  hyper
ccattgcggccgcagcgcgggcagggaggacgccgcgggagcccgggttcgaggctgggctgtggggctgcgggggcgcacgggcgaggtaggcggggcgcggggcccccgcggcggcacaaagaggccggccgcggcagttttgaaaataccaaggaagttgatctgggccggggcccaagaagtgacgaggagggagggaggcttgcgagcgagggaggaaaggagggagagggagaggagaaggcgggaaggagggagggaggaagggtgcgcggggcgaggggcggcggcagacctcgcggggccccagcgggaagcgcgggcggcggcgggatgcgcgctctgggcggcggggcgcggcgctaggcgcccggcggggcttccccaggctgcgaccccgcgggaccctccactcctcccgccgcctccgcagcccg

SEQ ID NO: 99279 - DNA, 30 bp, Homo sapiens
  chr8:27779779-27779809
  hypo
gggagacttgagcaccgctggggaggaagg

SEQ ID NO: 99280 - DNA, 100 bp, Homo sapiens
  chr8:27914736-27914836
  hypo
gtcatttcagatgtacgattcatcttgtaaacagatgaagtaaacttatgctattgataaatacggtgccgtattgtaaatgtattttctcttccttatg

SEQ ID NO: 99281 - DNA, 30 bp, Homo sapiens; identical to SEQ ID NO: 41739
  chr8:27931084-27931114
  hypo

SEQ ID NO: 99282 - DNA, 234 bp, Homo sapiens
  chr8:28209327-28209561
  hypo
tgtgggagggagatgcggtataatcaggggcaccctgcccccttcaaacccagcggggaccgcggtagggagggaagtgattgcttgaggccacccagcaagccagggacggagcccaagagaacacccaggtgcctcgctcctgacgggtgtcaccaggattatgtgttgcacatcaacgggaattatttttcctggcacctaaggctcattctctcccggaacatgtgccaa

SEQ ID NO: 99283 - DNA, 121 bp, Homo sapiens
  chr8:28221168-28221289
  hyper
ctaatggcctccccacgttctagagcaggaagtttggggtttctaccactgaaaatgaagaaagggtagtatttcccaaattcctgggctcccagtcttcagacggcgcctgaaatgtttg

SEQ ID NO: 99284 - DNA, 34 bp, Homo sapiens
  chr8:28515693-28515727
  hyper
gcatatgcttgacaccggacggtgggtggggggg

SEQ ID NO: 99285 - DNA, 30 bp, Homo sapiens
  chr8:28926240-28926270
  hypo
ccatagtgacaccagcggacccaaaaacaa

SEQ ID NO: 99286 - DNA, 30 bp, Homo sapiens; identical to SEQ ID NO: 41740
  chr8:28938557-28938587
  hypo

SEQ ID NO: 99287 - DNA, 30 bp, Homo sapiens; identical to SEQ ID NO: 41741
  chr8:29157762-29157792
  hypo

SEQ ID NO: 99288 - DNA, 218 bp, Homo sapiens
  chr8:29209258-29209476
  hyper
ggtccacatttgttgcggagctggaccctggaaaatgtacccgcaaagaatgaccttttgaaaggacttcagcagctctgggtccgattcatgtttctgggcatccctttttcctggtcacgtagcagccctccccatccccatttctcttttgcatttaatttcccagaggcggcttttggctgggggtttgtgcacgcacgcggtggggaccgtgc

SEQ ID NO: 99289 - DNA, 140 bp, Homo sapiens
  chr8:29209803-29209943
  hyper
tcccccactgggccccgaatgcctcgacccccgggccctactcggatgagctgtaggggcaccgcttgggcaaggtgatatttccttttgctccgggctccaaaatggcttacgatggcactgcacggatcctttctctt

SEQ ID NO: 99290 - DNA, 35 bp, Homo sapiens
  chr8:29387332-29387367
  hyper
ccaaacaacaaaccacgcggcgttctctggtggct

SEQ ID NO: 99291 - DNA, 77 bp, Homo sapiens
  chr8:29387636-29387713
  hyper
tcaatggtgtacccacgtggagttcattatttatctccgaaagccctgtctgtctctcattccgacccttaaacgaa

SEQ ID NO: 99292 - DNA, 28 bp, Homo sapiens
  chr8:29596408-29596436
  hypo
tttttaggctgggcacggtagttcatgc

SEQ ID NO: 99293 - DNA, 28 bp, Homo sapiens
  chr8:29596676-29596704
  hypo
cagaacaagactccgtctcaaaaaaaaa

SEQ ID NO: 99294 - DNA, 129 bp, Homo sapiens
  chr8:299672-299801
  hypo
cacctggagaggccacgagggacgttcctccggagcactgagccgggactgcgacaaggggtcctagcagggagccacgagggcaccggcccctccgtccacatcctccaggctcggaggcctctgccc

SEQ ID NO: 99295 - DNA, 111 bp, Homo sapiens
  chr8:30241501-30241612
  hyper
ctgtcctgaaaaagccggcccggagtgggctgtccccggtgtccctcgagttctcatgctgtcattcaagcagcagaggaagaaccgggtctggctcgggaagggtgggct

SEQ ID NO: 99296 - DNA, 67 bp, Homo sapiens
  chr8:30242630-30242697
  hyper
agaaggagaacaccccgagcgaggccaaccttcaggaggaggaggtactgggcggctcggtgtggtg

SEQ ID NO: 99297 - DNA, 117 bp, Homo sapiens
  chr8:30243058-30243175
  hyper
tttaaggaagaaactcgggggaaagttctcgttaaaagatacctctattccctgccccctccctttccgtgttaaaagttcttggtgaaatatctttctagccgaggttttttggat

SEQ ID NO: 99298 - DNA, 159 bp, Homo sapiens
  chr8:30243388-30243547
  hyper
aaagttttgtgactgcggagcgttccttcggtggaaacaaaattgagtagatgtggtcagaaggggagtcggactcaggaacaaacgtttcagaattcagtaggatatttgtggtatcctaccaaatgactctttttgcaggtacgttatctggagtcc

SEQ ID NO: 99299 - DNA, 87 bp, Homo sapiens
  chr8:3036403-3036490
  hypo
cctgataccatttgacgctaattgtagtaaggttaattctacaaatactttctataatctatatttctttttttttttttttttgag

SEQ ID NO: 99300 - DNA, 148 bp, Homo sapiens
  chr8:3040630-3040778
  hypo
ctatccctgaaacatcgagtaggtctctaacgcctaatctatctatccctgaaacatcgagtaggtctctaacgcctaatctatctatccctgaaatatcgagtaggtctctaacgtttcttaacgataccatcggcatccatccacg

SEQ ID NO: 99301 - DNA, 615 bp, Homo sapiens
  chr8:30769168-30769783
  hyper
aaacttgaagggaaccgtggtatcttcaaagtctccgagttgccagcgacctcagcctctccactttctcgaacatcatccctgggcactgtctcccgacacagccagcgcggtggccatgcgcctcaaaccgagcattccaaacgcggaaactcaaccccgagcgcggagaggatggaaactgcctgaaaggatctgtgcagggctgggcttgggacgcggctcacacgaaactgaggcaggagtctcttcctgcacccgcaccacgccgggacccgaggggtttcactcccttcactgagccgagccaggaagccaagagccaccagggcgaagcagccctgcaaaacctccactcagccttacaacagccacagcgccgggacacgcggcaccgcatcccgggcgcgccagtcctcctgcagtcgggggacgctcccctcaggcgcccgcgtcggagcccagctacccccgcgccgccctcacctaccgaggctcccccgcgtccaccggctcctgcagcgagacagccggcgcaggcgggcatggtccgagcgcgggctctgcaggggagaatgaggcgcgcggactgccagtcacccgggcggcgttccc

SEQ ID NO: 99302 - DNA, 288 bp, Homo sapiens
  chr8:30769822-30770110
  hyper
cgagttgcggtcccggggcggcggggctcccgccccctccccgcccccgcggatatccccacgcaccacgaagatccccacgcgccctgcgcaacgcggctgctccgcgctgccttctgctgactacaaactgcgcctccagggagccagggcgaggcggaggccaccaccaagttgtggcgctctctcctctcgctgcctcagagcagcgagtttctcctcagctgcaaacaaggacgcagggccagctccgtggggctcagcgggggcagagggagagcgaaagcg

SEQ ID NO: 99303 - DNA, 31 bp, Homo sapiens
  chr8:30770157-30770188
  hyper
cggctgccctggccctcggaggcccaccttt

SEQ ID NO: 99304 - DNA, 30 bp, Homo sapiens
  chr8:308732-308762
  hypo
tttatcattgtagttcgtcacattgtcaga

SEQ ID NO: 99305 - DNA, 435 bp, Homo sapiens
  chr8:30890092-30890527
  hyper
ttctggatgtccactcgtttggaggccagctcctggatttcggctgcgcccccggcctgattaggggtggctgaggccgcgtagtgggggtagtgggagtgctgggcctggggatagagtctactcttgcttaggccagagccccctacattcttgcctccgcggccgcggccgccgccgcctccccttcgcctggctctttccatcttcagctgcaagtaacaaacagacacacgggatggggtgggggaggggtgttgagaacaatcgcagacgcccctcggcctgaccgccccgccgccgcccgcgacccccacgccgggcccggctcccccggcgccgcagcgcggggctccagccactgccggccggttggcggccgccgctccggctctgcccgcgctccccgcatccctccgccgcccccggggccgc

SEQ ID NO: 99306 - DNA, 609 bp, Homo sapiens
  chr8:31496433-31497042
  hyper
cagtaaaagaaaaggcgggggtcatgaagaccgaaggatcaaaggagcatggagtagaggaggcgtcacatctgaagtgcacactgtgtgtgcgcgctgcaaggagagagagcgttataaagttgttgttttaatcgctgcttgtcgcctgcgaacatgttgctcccttttaagtgtcaagcaacgggttcacccaaaacttttctgcaccgaggacccgcacgcccggggtcccacctgcccctctctgcctgcctcccaccggcgcctgggcatcctgcgccggctacaggtccttgctcactgaagcgtcacctctcactccccagtaagcctccgcagcccactcggactgcagcctgtttgccgcccgtcctcccattgcagcactcggggcgacagagagggaggaggcgcgcggggacggggacgcccaggaggacccactcgcgggtcccgctccgctccggcagcagcatggggaaaggacgcgcgggccgagttggcaccacaggtaaacaggctggcgaggcgcaggacgctgtcgccgccgcggccacccagcgatttccaggcacgcaactccgcctccagggctctctccctcgc

SEQ ID NO: 99307 - DNA, 35 bp, Homo sapiens
  chr8:31497043-31497078
  hyper
ctctctcccagccgcttgctcgcagccccagcagc

SEQ ID NO: 99308 - DNA, 535 bp, Homo sapiens
  chr8:31497426-31497961
  hyper
ggaaaagggaggcagcgcgagagagccgggcagagtccgaaccgacagccagaagcccgcacgcacctcgcaccatgagatggcgacgcgccccgcgccgctccgggcgtcccggcccccgggcccagcgccccggctccgccgcccgctcgtcgccgccgctgccgctgctgccactactgctgctgctggggaccgcggccctggcgccgggggcggcggccggcaacgaggcggctcccgcgggggcctcggtgtgctactcgtccccgcccagcgtgggatcggtgcaggagctagctcagcgcgccgcggtggtgatcgagggaaaggtgcacccgcagcggcggcagcagggggcactcgacaggaaggcggcggcggcggcgggcgaggcaggggcgtggggcggcgatcgcgagccgccagccgcgggcccacgggcgctggggccgcccgccgaggagccgctgctcgccgccaacgggaccgtgccctcttggcccaccgccccggtgcccagcgccggcgagcc

SEQ ID NO: 99309 - DNA, 36 bp, Homo sapiens
  chr8:31498297-31498333
  hyper
gggcgcgcgggcagcggggctcgacggccgcccgag

SEQ ID NO: 99310 - DNA, 30 bp, Homo sapiens
  chr8:31728987-31729017
  hypo
gcattaaacttttctcggtgttctctaatt

SEQ ID NO: 99311 - DNA, 208 bp, Homo sapiens
  chr8:32277303-32277511
  hypo
ttgactagaatacctcgtcataacacaagtacatcttcttttacatttatgcaaagtgaaacattgtctgtctctctccatagtccagaaaaatctgtggggtaattgctcattgtcccttcacaccctgtttatattgcgcgtcttctattttaatagtcccaataaacagatggaaccacaaaaacacagccgggatggctcagtt

SEQ ID NO: 99312 - DNA, 158 bp, Homo sapiens; identical to SEQ ID NO: 31883
  chr8:32404798-32404956
  hyper

SEQ ID NO: 99313 - DNA, 339 bp, Homo sapiens
  chr8:32405453-32405792
  hyper
agcagccctcccaggcgctgcctggctgcggaggggagcgggcagcgagagcctcgggtctccgcctgggttcccgggtctccggggcgctggcctcggtctccgcgcagcgtccagcgacccctgtcgggggttcccggcagccgcgccgccaccccccgcccggccagcgcgggaggaaaaggggctgcgcccgggagcgccgagcccaggctcctcccggtggcgtgtccgcgcctcggggtgggggtgtggtggggaagagggagggggcgaggccaggggagggtgcgaaggaggcgcctgcctccaacctgcgggcgggaggtgggtggctgc

SEQ ID NO: 99314 - DNA, 444 bp, Homo sapiens
  chr8:32405793-32406237
  hyper
gggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggtgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccgagagccgtccgcgtagagcgctccgtctc

SEQ ID NO: 99315 - DNA, 577 bp, Homo sapiens
  chr8:32406351-32406928
  hyper
cgcagcgcggcccgggccccacgatcctcctcctgctcctcctactcctcctcctcctcggatgccgtggcctctccctccccctctccctcgcccgtcctcttcgccctgcgctctgagcgcccgttgagtcgcgcggtgcttcccctcctgggggccgccgctcacctgggcgccgagtcctaccgggcgcctacgcccagagctcagggcaagggacagcagtcccggccgcaccctcccagagtcccgggagcgcttcgctccctggcacggcccctccccagcgccttagcggctgagcccagcccgggagtgggacctgggctataggagtcgaggctgcgtgcgcgcgtgccccgcgccataagcgctttgcacgggggccgtgtgccctctagcgggaaacgctggaatgggccgcctggagggagagccggtcccctcggtgtgcctggcagcgcagaagtgggtggtcgagcaagaggccgcgtgggaagttagcttcggcgttttggggcacagggcaagcgatgtagagtgcgcgccggttcatcttgattcagtcctgtgctac

SEQ ID NO: 99316 - DNA, 53 bp, Homo sapiens; identical to SEQ ID NO: 9466
  chr8:32406929-32406982
  hyper

SEQ ID NO: 99317 - DNA, 30 bp, Homo sapiens
  chr8:3245048-3245078
  hypo
ggttcctctcacagacgaggggctcgtcgt

SEQ ID NO: 99318 - DNA, 148 bp, Homo sapiens; identical to SEQ ID NO: 41744
  chr8:32987430-32987578
  hypo

SEQ ID NO: 99319 - DNA, 439 bp, Homo sapiens
  chr8:33371767-33372206
  hyper
tgcaatactttagctggtttctggagctagcgttttaaagcctgtagccacaagcgtttgaaaattcaaattctagcgtcaaggtagaagcccccagctggcgtctggggcagccctgagggaggtgggtcgtcgggttggcggatccggcttgggcccgccccgccagtgtcggcgccgggtgcgcagggacagcagagcgctgtcttgggcatgggtcgcaggcggcgcccggaacgggccaggggagctggaggctgcagactcgggctcggcgggtgtaggaaccagtggtgtttgcttgggttttgagaaggcgcgagaagggtcgcgcctgtgcgaccgccctgtgttgggtcccccacgccgcgtcggcattgcttgttccctcttcctgcgctttcctggagggtagaattgcgtccgattggccttcagt

SEQ ID NO: 99320 - DNA, 450 bp, Homo sapiens
  chr8:33456975-33457425
  hyper
caggtccatggctgtcgccccagtcctcgccagcctggcagccgggccccgcgcgcggagggagggcgcccgggagagagaggctggctcgctgggctcgggtgcccgcttcccggtcccctccctcccccgtcgcccctagctgggcgcctctccccagcgtggagagccagctgaaaaggcgaaggcccgccgcagcccctctacctctttgcaagcgctgcgctgggcctcagtccgaaaggcggatcgccggcgcagacagcgccacggccatgacgctcctgctgctgtcgccgccgctgtttctgcccaagacaggttgacagattagcagctatttttaagccatgacacacacgtcgaagcagggttcaaatcagcgtgtgcgctggtgacataaagggactcggtctcacattcggtggcccgagtcgccaggcagcgtgg

SEQ ID NO: 99321 - DNA, 30 bp, Homo sapiens
  chr8:33578771-33578801
  hypo
acggccacaggaccacgcttttgttcctgt

SEQ ID NO: 99322 - DNA, 89 bp, Homo sapiens
  chr8:35092605-35092694
  hyper
agtagatgaacaaaacggaggtctcctggaagcaggtgactgagttaggcaaccgagatgcccacatatctgtgcggcgttcgccccaa

SEQ ID NO: 99323 - DNA, 124 bp, Homo sapiens; identical to SEQ ID NO: 31892
  chr8:35093036-35093160
  hyper

SEQ ID NO: 99324 - DNA, 318 bp, Homo sapiens
  chr8:35093225-35093543
  hyper
cgggaccctcatcgccgaccctttcccgggctcccggagcgtgaagaagagccgccctccggaacgcggcgaggagcatggggagagcggcggccaccgcaggcggcggcggaggggcgcgccgctggctcccgtggctggggctgtgcttctgggcggcagggaccgcggctgcccgaggtaagcgctgggcggagcgggcagctgggggcgagggcgcaggggcgccagcctgacggagcgggacctgcaccgatggcgttggcttcccaacttgcgccctgcacctcggcgctccaagcccaaccggatgggagc

SEQ ID NO: 99325 - DNA, 7 bp, Homo sapiens
  chr8:35093597-35093604
  hyper
cgcaatc

SEQ ID NO: 99326 - DNA, 23 bp, Homo sapiens
  chr8:35093951-35093974
  hyper
gccagccctggagctcgggagag

SEQ ID NO: 99327 - DNA, 32 bp, Homo sapiens
  chr8:35094035-35094067
  hyper
cgaggctgctcaccaggcgcctcctctccctt

SEQ ID NO: 99328 - DNA, 26 bp, Homo sapiens
  chr8:36179048-36179074
  hypo
ggccgagacctgcagcggaacctagg

SEQ ID NO: 99329 - DNA, 204 bp, Homo sapiens
  chr8:36852809-36853013
  hypo
ttgatcctgacctaacgggtcagtgagcgctcagagtgaagcagacttaccctgctgccctgtgtgtgtatggcagatagggcatagaatttgactcaacactttcattccctctctgactcattttgctattaattgtcacctccttcacaagactgccccatcaaagatcctgtggaaattatttaccgagagatttctcag

SEQ ID NO: 99330 - DNA, 34 bp, Homo sapiens
  chr8:37552075-37552109
  hyper
gcctccactggccgccgagcgcacggagaagtgg

SEQ ID NO: 99331 - DNA, 494 bp, Homo sapiens
  chr8:37552317-37552811
  hyper
aagtgctttttcccccggagtgagaaggatgggggggcggaggggttgtgttgccgagcagcgcttagagagagatccccctccagggacacccgcctcgcccgtgatctcggtctctcctcgtagcagctgggcgcggtacagtgaggaacttcacgcccctcagcaggacacggtaagaagcctgtaacacaccagacaccgagcctctaacgcagggcgcaggcacagcgcgcacagcctggggtcccgcgcttggtcgccgaccatgtcactccagaagggagacaaacttgcaggcttcagacaagacgggctcaaagtagttggagctgcctacgccgcgtcccgagaacagtgggtgcctccgaggctcgggcgcttccaagtgaacacaccaaggggaggccaagtaggggaaggagagcggggccgaggagagccggagcagctctggagaaggacccgggctcccgaggcgaggcctgccccca

SEQ ID NO: 99332 - DNA, 30 bp, Homo sapiens
  chr8:37595317-37595347
  hyper
tggatatgagtcactcgcagggagctcagc

SEQ ID NO: 99333 - DNA, 63 bp, Homo sapiens; identical to SEQ ID NO: 31896
  chr8:37655313-37655376
  hyper

SEQ ID NO: 99334 - DNA, 516 bp, Homo sapiens; identical to SEQ ID NO: 31897
  chr8:37655475-37655991
  hyper

SEQ ID NO: 99335 - DNA, 165 bp, Homo sapiens; identical to SEQ ID NO: 31898
  chr8:37656049-37656214
  hyper

SEQ ID NO: 99336 - DNA, 44 bp, Homo sapiens
  chr8:3769055-3769099
  hypo
aaaaaaaaaaaaaaagaagaagaagaaaacgaaggctatataac

SEQ ID NO: 99337 - DNA, 47 bp, Homo sapiens
  chr8:37706125-37706172
  hypo
tgcgactaacttgttcgttttcccctgtgcttcgggaatatgttacc

SEQ ID NO: 99338 - DNA, 30 bp, Homo sapiens
  chr8:37708497-37708527
  hypo
cacaataatacccaacggtcctttctcttc

SEQ ID NO: 99339 - DNA, 30 bp, Homo sapiens
  chr8:37721639-37721669
  hypo
tgccccgtcctcacccgtggccgtctaggc

SEQ ID NO: 99340 - DNA, 59 bp, Homo sapiens
  chr8:37762770-37762829
  hypo
aagatccataaatgacgtgcaagccttcagcatggacagaaaaccggacagaaaatgat

SEQ ID NO: 99341 - DNA, 783 bp, Homo sapiens
  chr8:37822626-37823409
  hyper
ggtcccattttggttcgctactcctcgttcccttttctctccaagcaaagccatcccaccttctcttaataaactccacactcaaaaagttgacccacggacacatcgcatgcttcccgaccctgagccgccggtccctctgccccggttacctacccgtcgagccgttggcaaagcctgggctgcgctgggctgctccgggccgcaggaacgcccgaggggaagagggccgggcgggcggcggcgcagggctccggaggcaggcgacggccgcagcggcacagaagacggcggaaggcgctgcgaaagtccgggctgcggcagtagatgagcgggttgaaggcagaattggcataacctagccagttcagggcaaggaaagccgggcccgggactagagaggggccccccagggcgcgcagcacgttggccagaaagaagggcaaccagcagagagtgaaggtgcccatgatgagacccaaggtgcacagggcccggtgttcccggagaggcaggaggcgcgcgggccgccggccgcaggcgggcaccccttcgggcggagcgcacgtccccaccggggccggggccagagagcgcgacggcgccggcggagactcctcgggcggaaagcggcccagctccccgcgcagcaagcgcagctggcgcgtagccaccacgaaaacccgcgcgtagacgaagagcatcacgagaagaggaaggtagaaggagacggaggaggacagcagcacgtagggcatgttggaggcgaaggcacagcagcgc

SEQ ID NO: 99342 - DNA, 65 bp, Homo sapiens; identical to SEQ ID NO: 31900
  chr8:37823410-37823475
  hyper

SEQ ID NO: 99343 - DNA, 56 bp, Homo sapiens; identical to SEQ ID NO: 31901
  chr8:37823476-37823532
  hyper

SEQ ID NO: 99344 - DNA, 30 bp, Homo sapiens
  chr8:37891941-37891971
  hypo
agataatttaattgccgaagggagtgtcat

SEQ ID NO: 99345 - DNA, 30 bp, Homo sapiens
  chr8:37935813-37935843
  hypo
ggttctaggtgcctacgatacatcagtaaa

SEQ ID NO: 99346 - DNA, 99 bp, Homo sapiens
  chr8:37961833-37961932
  hypo
gacagagcgagactctgtctcaaacaaacaacaacaagaaaacacaaaattctgcgaccatatgttaaaactgctacaatactacgtatttgggaggag

SEQ ID NO: 99347 - DNA, 30 bp, Homo sapiens; identical to SEQ ID NO: 41747
  chr8:38005823-38005853
  hypo

SEQ ID NO: 99348 - DNA, 415 bp, Homo sapiens
  chr8:38008209-38008624
  hyper
ggcctgagcctcatccgctgagagctggccaacccctcatcgcctccttcccgcagcgctcacccttcatgttgcgcatgtgtctgtaggagctcccagcgcacagcttgaatgtcgctagcagcattgtttcctggcaaatgtggcagtggtggggtcgctgccgctgctgctgccgccgctgctgctgcctcttctctcaagggtggttcttcgtccttcctgagcccctcaagcttcgcctctgagtcccgcagctgcagcctggacctggtgttctgcgtcttaaatgtcccccgctgaaggctgtgcatcatcatcaggagataaaaacgccatcactcactgtgcaaaggaaggggtcaaggatagagcgattgcctcacactgctgctttggccgtttgtggggagct

SEQ ID NO: 99349 - DNA, 30 bp, Homo sapiens
  chr8:38257005-38257035
  hypo
tcattcttgtctgggcgctgtggctcaagc

SEQ ID NO: 99350 - DNA, 579 bp, Homo sapiens
  chr8:38323156-38323735
  hyper
gaggctgctgaacctcggtcaccgagaggaaggtggatgacccgggcgtgggggtgattacccagaccaaggcgcgtcccacggggccctgctacttcgcttttaaacaagcctcagggaggaaaccgggagcccgggccaagggaggaaaatggccactttctgctaaacagtctcaaggctagatagtattccaaaaaaagcgctggtccggaggtgcaaagggtagggcacatctgcggaggaaacagtcaccttaattaccacgtctagagaaagtgcgatttcattacagcctccaaaactaccgcccaaagaaggaaaccagagaagtgttttcaatttgaaagaggctggaaagaagcgggtaagacaccgactctccccaccctcccggcaactttggaccacaaggcgctttcctgcctcaaagactattaccaaacacaactcgaaaatccaaccccgctttcaaacctgtagccgttatttaaacggtaaaacaccccactttagtttccgggggatgcggcccaaatcagtccttaaaaacacacagagagcgcctctggcagcagc

SEQ ID NO: 99351 - DNA, 540 bp, Homo sapiens
  chr8:38323755-38324295
  hyper
cgcaccgggcttgctccgggaggggcgcgtgacgccaccgcggggcagccgagaggggaccgcgggctccgggcagggcaggcgctcccgcagctccagctataacacaagggagagaaagcaacgctttggttccagaaacttccatcgtcaaggccagttctggccagacgcacagccaaagagcccccctagtctagcggatgaaccgttcgcgagtggcaccccctaaaaccttggccccatctcccaagatgcctctttactgcgcaatccagaaagcacccggaccgccgccacccaccagcggcggcgaataacttggtgagatcttaaataactcgggatccaagggaactttcttttctcccccgaatctcaacgccgcatctccaagtctccagaaatgttaaggagggaggtggtcaagacaggctgaagaatctgagttttaatttgggggagggggaggggaggaagagggaagttaataatgcggctgcggtgtacccgtgtggggtgaaacggaaccagatgcgg

SEQ ID NO: 99352 - DNA, 88 bp, Homo sapiens
  chr8:38324661-38324749
  hyper
gaaccagattgggaccgaacggtccttccgcccccatcccacacctcggcttaacgaccgtgggttgtcctcccgttccccaaacttc

SEQ ID NO: 99353 - DNA, 50 bp, Homo sapiens
  chr8:38324811-38324861
  hyper
cgctctcagctcaagcagattcagccatttggtgacgacacctccttaaa

SEQ ID NO: 99354 - DNA, 974 bp, Homo sapiens
  chr8:38325076-38326050
  hyper
acataacacacacaacgcatcccacctcgccgcccactcccgccctcctccccagtccaggaaaccgcgggcctcgccgccttcgccccgggcctgtccctcccgggactcactgaggagccgccgccgcctcgccagctcccgagcgcgagttggaggaaaagttgggcggcgggaagagcggcgggacgagcgcagggagggggcgcaggagacgcggacggagggaagggaggggagacccaaggggcgcggatcgcccgggagggagccaggaggtgaaaggggcgggcggcgagcggagggaggcgccggccccggctgggctgcggcgggcaaagcgcgcagccgggaggctccggcgccgggggccgctcgggacgccaagcccgccccagatccgggggcgccgcggctcttacctcgctcggcgtggaggttccgcctcgggagagtccgccgtggcttgtgcgagcgggcgtgtgcccgcgtccccggctccggcccgccgcccccgggctctgttcgggtcctggcggggtcgcaagagctccgcggccggcgctcgactcccggcggcgctcggtgctcggcgcctccagcccgggcgggaacaatggagccggagctggtgccccggaggcggggcggggggagggctcccgtccgccacccggggtctccagaccttgtgcccccctcctccagaacgcagcggcggcgcctcactttccttgcagaccgggctccatcgccctgcggaggccccggcgccgcggcgtgcccgactgcagcacgggtaccgtgcgccctgcggggcgccccgagctcggaccggagaaaagtccttgggttccgcggcttttcaagcagcggcgcgctcgcggccggggaaggcgaggtcgccgcaatgcgctacgaggggtctcggtcccgtccggacgtggccgcccagctcccggcacacccgggtt

SEQ ID NO: 99355 - DNA, 218 bp, Homo sapiens
  chr8:38326276-38326494
  hyper
gcgggccgagctgtccggcgctctgcccttctcttcctacagcctggtctcctttggcgtttgcgcccctgcatctgagcacgtcccagagggcgccggaatgtcaggccctagacatagcagcggtttgggggctagggggcaggtgaagagacgccgcagccttgaggttgtacctggtagcgtgggctttggagtctgtgcgccttggggaaatg

SEQ ID NO: 99356 - DNA, 76 bp, Homo sapiens
  chr8:38400221-38400297
  hypo
aacatgccgggattacggactagagccaccccacccagccacttagcatgttttaaaagttcgtcaattttggcat

SEQ ID NO: 99357 - DNA, 94 bp, Homo sapiens
  chr8:38614414-38614508
  hyper
cggggcctcttcccgcggcttcccttccagccccggacccagcgggcggagagggcgacgtccgcggatcgcggagtcccgggggcgcccgcag

SEQ ID NO: 99358 - DNA, 272 bp, Homo sapiens
  chr8:38614788-38615060
  hyper
ctgggcacagccgcccgccgcccagcacaggagggtgcagccccggccccaagttctgcgccatgggaggctcccactctcagaccccgaggggccgggaacccgccggggagaggcacccgagacccacggagaccgcgtgagtcccagagccctctccaagggccgcctttgggggtttgcgtgccagcccgggatggagcgcgctggggcccgtcccagaaaggctgggaaggtggggttcccgctggcggcagcggggcacgagcgct

SEQ ID NO: 99359 - DNA, 31 bp, Homo sapiens; identical to SEQ ID NO: 41748
  chr8:38786050-38786081
  hypo

SEQ ID NO: 99360 - DNA, 23 bp, Homo sapiens
  chr8:38857793-38857816
  hypo
agccaccgcgccccagcctctct

SEQ ID NO: 99361 - DNA, 30 bp, Homo sapiens
  chr8:38965524-38965554
  hypo
cagcaccagggctcacgcctgtaatcccag

SEQ ID NO: 99362 - DNA, 46 bp, Homo sapiens
  chr8:39695645-39695691
  hypo
ttactactgtccatccgcagcccgccgagcccgctgagcagaaaca

SEQ ID NO: 99363 - DNA, 77 bp, Homo sapiens
  chr8:39756231-39756308
  hypo
taatgttagtattttgaggaacccccatattgctttccacagttgctgtactaatttacatccgcaccaacagcgca

SEQ ID NO: 99364 - DNA, 177 bp, Homo sapiens
  chr8:40630277-40630454
  hypo
ccagctaaaataagccgaggacctcaataaaacaggaaaacctggaacaaagagtgattctcacatgccaccacatttgaggtcattccggggagaagaggagccaatagggaagggacagcaaacaccaaacatctagaacacgggttcctgcaaaacaaccggctgatgcgagat

SEQ ID NO: 99365 - DNA, 30 bp, Homo sapiens
  chr8:40707573-40707603
  hypo
ctgacagtatgttaccgtcctcaggcagca

SEQ ID NO: 99366 - DNA, 53 bp, Homo sapiens
  chr8:40782590-40782643
  hypo
gggcctccatgaatgcgaccactcaggcgccctaccctcgtcttcctgggtcc

SEQ ID NO: 99367 - DNA, 30 bp, Homo sapiens
  chr8:41137920-41137950
  hypo
ctattttctggaattcgcactccctgccct

SEQ ID NO: 99368 - DNA, 171 bp, Homo sapiens
  chr8:41146864-41147035
  hypo
acagttcagtagcagcgcagaaattagatgccaggactccagaatctgtgttatttttttcttactccatattttatcttctaacgcagaagtctttgtttttgtttcttaacaggtgggtaaactgagccaccgagtgcttcagtgacttgcaggcgctgacacagtagg

SEQ ID NO: 99369 - DNA, 210 bp, Homo sapiens
  chr8:41165709-41165919
  hyper
tttgttttttcctcccgtctcagaggttaaaaacttcgatagggactcggagtcctcctagaggagagggaagctcccctgttatttaaagcgcaaggctttgtttcaggtatgggaaaggcgaagttggatcccaggaagagcggctccggggaccacagcgagtccctgcgaggccaaggcgcagagctgccgctcccgggccagccc

SEQ ID NO: 99370 - DNA, 152 bp, Homo sapiens; identical to SEQ ID NO: 3231
  chr8:41166000-41166152
  hyper

SEQ ID NO: 99371 - DNA, 414 bp, Homo sapiens; identical to SEQ ID NO: 3232
  chr8:41166266-41166680
  hyper

SEQ ID NO: 99372 - DNA, 244 bp, Homo sapiens; identical to SEQ ID NO: 3233
  chr8:41166745-41166989
  hyper

SEQ ID NO: 99373 - DNA, 346 bp, Homo sapiens
  chr8:41167025-41167371
  hyper
cgcgcagccaatcagctcccggcggggcgagccgcactcgttaccacgtccgtcaccggcgcgggagccaatcgcctccctcgcgagcgggttcggtttactagaaccagacgcggctcaacaccccttaaaaaacaaaaccaaaaatacataaataaaagggggaggaggaaagagacaaggggagaaaaagaaggggaatggatcacggcgtggggtggagagagaccagggcggacgctgtaattaactcgcattggcttgcagagaagcggggagcctggatcatacttgcaaacccatgaaattatgaagactttttttttttgagacagtttcgctcttg

SEQ ID NO: 99374 - DNA, 226 bp, Homo sapiens
  chr8:41424669-41424895
  hyper
ctacctctgctgcagcgtacctcttccgcagccctagcggcctccccgaggggcgccgcggcctcggctgtccctcccctgcctggcacgaccacctgacccccagcgacccaagaagcaagttgtgtttgcagacgcaaaggggctgtcgttggtatcggtgcactggtttgaagccactgcgggcacagcctgaagagggccggtgtcccgcgtgcagcctccc

SEQ ID NO: 99375 - DNA, 37 bp, Homo sapiens
  chr8:41488146-41488183
  hypo
ggagggcgtgggcctcgggggccggcacagccagccc

SEQ ID NO: 99376 - DNA, 564 bp, Homo sapiens
  chr8:41503824-41504388
  hyper
gctgctcctcctccacgcgcccctcatccaaagaaagactcagtccctgcgcccccaggagcgtggggaaggggaggggaaggtaggctcctcggcgtccccccgcaggctgcagccaggatcccgggcctggacggcgggcgtcagacgctgtgcgctcccaggctgagcaccgagaaggcggcgcggtgcttgcgcagcagcaggcggatcttctcgtcgtccgagtcggggtccagcggcttgttgtactcgtcgtcctcgttctccgagggtgcgcggtccccgcctgcgcctgcacccgcgccgcccggggcccggggcgtggaggacgagggctccagggcgctcttcttccgccacttggtcctgcggttctggaaccacacctgcgatgagaaagaatgtgaagggcacaggggcacagcgcgcacgggacgcgagaacagccatcctgcttttacagctaaacaaatggctcaacaacggagtgactgtcacattcacgtttctgttggggaaggacaataaaatttaaaaacgtgagcgcggcagccctcccct

SEQ ID NO: 99377 - DNA, 30 bp, Homo sapiens; identical to SEQ ID NO: 41750
  chr8:41510183-41510213
  hypo

SEQ ID NO: 99378 - DNA, 62 bp, Homo sapiens
  chr8:41511045-41511107
  hyper
cggagtctggagctgcggggtccgcgggggcgctaagggggctactgggttggctgcagcag

SEQ ID NO: 99379 - DNA, 93 bp, Homo sapiens
  chr8:41511147-41511240
  hyper
cgagccctgagcccagcttccttgggccgtcaccgaatcggtcccagccgcgctgtgcggcccccctgccgtggcccccgggatgggggagga

SEQ ID NO: 99380 - DNA, 109 bp, Homo sapiens
  chr8:41511443-41511552
  hyper
cggggcctgcctggccgggggtgcaccggggcggatttgtgtgggaagcagggcccctctccgctcacaggccccgcggccagggggcctctgacgtggagggggcttc

SEQ ID NO: 99381 - DNA, 120 bp, Homo sapiens
  chr8:41523651-41523771
  hypo
ctcatctgtgaagcacggattaaagtgctctccccaccctttctcaaggctgctgggacaatcatgccgcttatgaatgctaacactatgaatgataatggcaaacgcttgtgatagtgc

SEQ ID NO: 99382 - DNA, 147 bp, Homo sapiens
  chr8:41530122-41530269
  hypo
caactcggggccccgcggttcctctgagagtgccccctccaacttccactcgtgacctgtggcatcagagtcctcagccttgctacactccagagaggagtcctcagcagtgaccagagaaggcgtgaggcccgcagaccacacctg

SEQ ID NO: 99383 - DNA, 203 bp, Homo sapiens
  chr8:41531574-41531777
  hypo
acatgcaactgcccccgggctgtgctttgattcaagccaggcgggctcctttcttgccccctcagcctccgctcggggcctcagcctccgctcggggcctcagctcctgatcacctgctcccctgcttttacatcactagctccatttattctcatccactcactgttcaaccaaaataagagaggtccgattacatgccagg

SEQ ID NO: 99384 - DNA, 29 bp, Homo sapiens
  chr8:41535372-41535401
  hypo
gccaggattacaagcgtgaaccactgcac

SEQ ID NO: 99385 - DNA, 136 bp, Homo sapiens
  chr8:41539808-41539944
  hypo
tctctggcaagtcctcgagtgccacccgcttcccttgcaccatgagtccccctggccccgactccggtctgtttctcctgcaccatgcacgttaactgctggtgtgtgatacaattccccgcgtggctctcctcac

SEQ ID NO: 99386 - DNA, 79 bp, Homo sapiens
  chr8:41540907-41540986
  hypo
acagggagggctcagcgagcagggtcccctggtaggggctccgtgcccaggcccacctgggactcgccctcagccgcgc

SEQ ID NO: 99387 - DNA, 62 bp, Homo sapiens
  chr8:41546283-41546345
  hypo
gggaagctgaagaagcgcacatgcgttattaatcacagtcgtaataacggcaagcccacgtc

SEQ ID NO: 99388 - DNA, 99 bp, Homo sapiens
  chr8:41552691-41552790
  hypo
taccttcgtccatcccgttgaggatctgatccaggtagctctctccatagcggctcctgtgctccttccacacggagccgttttcgctcctcagaacca

SEQ ID NO: 99389 - DNA, 381 bp, Homo sapiens
  chr8:41553990-41554371
  hypo
ggtgatgcgggtgggcgctgcgcacgtccgtggcgggatcaccactcgcaggccgttgtggcgacttcctctcatggaaccaccccgggcgtcaaccatgaagctcaccagaaacctaggagtggggcagatgcacgttgggcttctgcatcccctctcggagatggagacaggagtccccgagccctgcgcccgccactcaccctgtatgcaccgggctggccaccgggctgatgttgtctgaggtctcggtggccgggctgctggggatgagggagtcctcatcatactctttagatgcctgaggagagagaaagggtcctcctgtcccacctcctcccgggccagctggatgccgtgccagggcgtggaggcttggaa

SEQ ID NO: 99390 - DNA, 107 bp, Homo sapiens
  chr8:41566310-41566417
  hypo
gccattggcttgtttcgagagcagcagagccaccatctctgcgtggccctcctgggcggccaggtgaaggggcgtcacaccttgcaccgactcggcgtttgctgagc

SEQ ID NO: 99391 - DNA, 30 bp, Homo sapiens
  chr8:41582836-41582866
  hypo
agtgcctccgaacaccggagagcgtgccca

SEQ ID NO: 99392 - DNA, 52 bp, Homo sapiens; identical to SEQ ID NO: 41754
  chr8:41594902-41594954
  hypo

SEQ ID NO: 99393 - DNA, 30 bp, Homo sapiens
  chr8:41599293-41599323
  hypo
gctttttgtcattgtcggggtaggagccat

SEQ ID NO: 99394 - DNA, 117 bp, Homo sapiens
  chr8:41611241-41611358
  hypo
ctgttcccatctttacgtccctgtctctgtcgctgagtgttgtgactctcgcccctacctgtaagctccagcacaatcccagctccaccttgcctggcttctcgtgctgtctgcact

SEQ ID NO: 99395 - DNA, 15 bp, Homo sapiens
  chr8:41624546-41624561
  hyper
gcggctccacgctcc

SEQ ID NO: 99396 - DNA, 708 bp, Homo sapiens
  chr8:41624633-41625341
  hyper
cgcagccttcaggccagaggaattttcctctggatcctgctagaagcctcggcagcagaagggcagccccagcgcgcgcacccgcacccgccggggaaagttggcgccgggcagccgggcgcggagccacaacccgcaggacggacgcagagccccggccccggccccggccccgatccccgcgccccggccccggccgggcaaccgcgacagctcgtgcactcaccgcagggtctggcccggacctgccctgtcgcgctgccatcgtccggcgcccgcgctgaaatccgagcccggctcccgctccccctcccggttatctgctgggcggcgcggggagcgccagcaagttacgcggcatctggctaaaaatacaggcgccctccactcgccccggcccggccctggccctgcgctctcccgcccgccagcctgccgctaatgggatctcttcattttctctccatgattatgtcagatgggaaagttaatgcgaagcgctctccggagagcaggcacctgctgccaagccctgcgaagggggtgcgcgcgggggcgcgggcgggggtgcagccccagctgcaggtgccggccggcgggctcggggcgggcgtcctgcccctgcggaggggaggcacacacgtccagtggaggtgaggagctccaagctgcatggcctccctccctgcctcccgcctccccgaatgc

SEQ ID NO: 99397 - DNA, 30 bp, Homo sapiens
  chr8:41632351-41632381
  hypo
tgtggactggggagccgagactagagtgga

SEQ ID NO: 99398 - DNA, 25 bp, Homo sapiens
  chr8:41638209-41638234
  hypo
atgcctgtgtgtgcacgtgtgcctg

SEQ ID NO: 99399 - DNA, 218 bp, Homo sapiens
  chr8:41643385-41643603
  hypo
ggtccacttggtagccgagggtccgagctgacctcatgctttccgcactgtcgggcagcgttgtcatcagcggtactctccgcctgggaaccctcccgcgtctcttctccctgtactctggagtgccccttacagccaacttaaaggcacctccctgcagatcgtcccttgattccctccgatgcagttttctctcctcctcccgagtttccaaagca

SEQ ID NO: 99400 - DNA, 15 bp, Homo sapiens
  chr8:41655043-41655058
  hyper
cagaatagggcatgc

SEQ ID NO: 99401 - DNA, 193 bp, Homo sapiens
  chr8:41655301-41655494
  hyper
cgctccccaggcctcggccggcgcggacccctggttgccccggggtcgagagcagccggggagagctgagttcagagcccagagttggacatcaggccacacgctgagagggtagtaaatgaaagggagtccggtttagtcgcgggcagggcatctcctcttctgcttgtctaaaagtcgctgggtgcagggg

SEQ ID NO: 99402 - DNA, 141 bp, Homo sapiens
  chr8:41668167-41668308
  hypo
ggccttccagagcaacgtgccgccgaagcgtaatagcccgatgggttcatcttgcccgctgcccagaaagccaaaagcgcggagaacaggcactgccccaaagtaagggcctcatgaccacagggccgggagagccaggag

SEQ ID NO: 99403 - DNA, 34 bp, Homo sapiens
  chr8:41685657-41685691
  hyper
aaatgatggagttcccggtcggtcctccagtgct

SEQ ID NO: 99404 - DNA, 313 bp, Homo sapiens
  chr8:41686308-41686621
  hyper
cctgaagattttccacgcgaaagtgctggggagagagttgggcctgggaggctgcgccttcttcccgcgaatcccgaaaactgcgcggcaaaggcgggttccgcagaagtcgcgcgtgacccggggcgccgccctcctcggggcccattcggatctgccgcccgtcctctccagagcgccccctggcgccctctaggccatcttgattccaccgccgcagttgaaagaattaataaataaatcctagtctcgcgtctagaccggtccgtgagggtcccctgctcaccggacaccctgccgcaatctctgctgt

SEQ ID NO: 99405 - DNA, 64 bp, Homo sapiens
  chr8:41689272-41689336
  hypo
atttttatttatcaccgccccagactggagtcaacccacacgtcctcagcgtgtgaatgaatag

SEQ ID NO: 99406 - DNA, 81 bp, Homo sapiens
  chr8:41695929-41696010
  hypo
atagtaagcacttaccgtgtgccccagactgctgtattatgttttaaagtgattgttaaagatgtaacaatgggctgggca

SEQ ID NO: 99407 - DNA, 30 bp, Homo sapiens
  chr8:41707500-41707530
  hypo
tcagagccctggcagcggctctcagacagt

SEQ ID NO: 99408 - DNA, 239 bp, Homo sapiens; identical to SEQ ID NO: 31924
  chr8:41733415-41733654
  hyper

SEQ ID NO: 99409 - DNA, 92 bp, Homo sapiens; identical to SEQ ID NO: 9490
  chr8:41733684-41733776
  hyper

SEQ ID NO: 99410 - DNA, 30 bp, Homo sapiens
  chr8:41752415-41752445
  hypo
aaaaaggccccttttcggtcctctaaaggg

SEQ ID NO: 99411 - DNA, 480 bp, Homo sapiens
  chr8:41753273-41753753
  hyper
ttctgctaccagatccggagggtcaggaaaggtgctccctgagaagggtcaaggaagggcaggagcccgactctcgttcagagacacctgggaaagacgctctcttcgtcagagtgggtcacctagggagaagccgggcagagctgcccccccccggcccgctccccggagcctgcagccgcgtttacccaaaccagctctcctggaaagccagcgggtgcggcgcgcccgagcagggcagcccaccacccgcagccggcagccaaggccgggaaagttggtcctagagcagcgcgggcctgccgggtgctgtccaaggtgctgaaaggtctctgcgggcagctggcgggaggattctgcgcgccctcagcctcccggccacccgctctgcccttccagcctgccgccctgtccccttcccggccgcgcagaagcctccgtccctcctctacgcccaccgagccttccccgctcgggtgc

SEQ ID NO: 99412 - DNA, 411 bp, Homo sapiens; identical to SEQ ID NO: 3236
  chr8:41753770-41754181
  hyper

SEQ ID NO: 99413 - DNA, 1035 bp, Homo sapiens
  chr8:41754182-41755217
  hyper
aggggcggctgcccgcggcccgggatggcgctgccgccgcggccggagctcgcttgccggcgcccgggacgggctctgggcagggcccgccgcctccctccctccgcctccctccctctcctgcggcggcggcggcggcgaagcgggggggcgggggcggggaggcggctcgtactgcggcggcggcgggcggtgagcggccgcggaaggggcggattcgggcgctcagcgcgggaaggcccgggggcccggccggcgcggcgaggctgggcgcactgggcgtccgcacggggtcatggcgagcgccgagcttccgcctttgcagagccccgcgccgtcgggcggcgggaacaaagcggccgctctaccccggaccccgctgcgggccgcagggccaagccgggggaagaggggaggctgcggcgggcggcgcgccccgcgcccgggcgacccggcggaccagcgcgcctggcggcggcgagcgcggcgacatcgcgggagcggaggctcggcctagagggcgggcggcagagggcaaggaccgggcttggggagcccccgggcggtggccgctgagggcccggacgcgctactcccgagcccggggtgcggttcctccccgggcgccctcggcgtggggcgcgcgcctccggggctccctggggaagagccggttccccgcgccgcacgctgggagcttgatttgcccctttcagaccatgtgggcctttcatttgcatatttccgaattatagatgaaaacgtatccaggatcaagtgaattgttttcctttgagtcctcttgggacagaaaaggaagtaggtccccgctccagccccgcccgtcccccatccccggcgctcccgcgcacgcctccctggggacgccgcctgcgcccgtgccccgcggggaagagctgcacttgggtccgcagcgccagcccagcctgcggcaggcggagggggcctagggctcagccaaccaccccgtcacgccgcacaggagccagccggggtccccggctcgggagctgc

SEQ ID NO: 99414 - DNA, 33 bp, Homo sapiens
  chr8:41755524-41755557
  hyper
cacaggacctccccccgccgccccccccaaccc

SEQ ID NO: 99415 - DNA, 96 bp, Homo sapiens
  chr8:41773327-41773423
  hypo
tttaatttggtattgcgctggtattatactcaaaatataaccagagccctgaccttcctttcacctccgtcatggcttccccgtcccagccaccat

SEQ ID NO: 99416 - DNA, 69 bp, Homo sapiens
  chr8:41910270-41910339
  hypo
tccacagacctgggtcgtgtgacttggacaaggtcacacagctagtatgtggcgcgcacctgagcctgg

SEQ ID NO: 99417 - DNA, 211 bp, Homo sapiens
  chr8:42009840-42010051
  hyper
ctgacttccactccacgccttcgtggatcaggacgactgggaccactcaaaagcgtatccaagtcctgaggtctccaaagcggtggagagacccgcccagcccctcactccccggctgggaactgagattgtggagggtgggcgccctgccgcggcccagtggggctgggggcttccagagtcggggtccagggctcggtgtccgagactc

SEQ ID NO: 99418 - DNA, 59 bp, Homo sapiens
  chr8:42036381-42036440
  hypo
tgtgcccagcatgggcgcgccactcctggttacctggcaggcgtcgtgcaagtttgcct

SEQ ID NO: 99419 - DNA, 157 bp, Homo sapiens
  chr8:42044825-42044982
  hypo
ttgggagaaccctgacggatctgacagaatctttccccagctgtagcagcttctcacagggggaatccctccttggggatgtgccctcacctgcagtagttgtggttccccaggcccagcctgatggcgtctggcctccgcccgctgtagggcttct

SEQ ID NO: 99420 - DNA, 30 bp, Homo sapiens
  chr8:42050976-42051006
  hypo
atattgctgtgcggccggccgtcaccaccg

SEQ ID NO: 99421 - DNA, 179 bp, Homo sapiens
  chr8:42137798-42137977
  hyper
gtggttctcctgccacgcgggcctcaccattccacattgtgtcgggactccctaagacctccagcccaggggtcagcacaaaccacttcccagtaccgtttagataggctgatattttcaatgagacctttgttaaatacaaaggaagaggaggaggagataaccgagtgctcccacct

SEQ ID NO: 99422 - DNA, 176 bp, Homo sapiens
  chr8:42144632-42144808
  hypo
ggcagctggagtgcccgaggccagagccgctttccctgctgcccgtgccacagcctcagggcctgcccgtctccagtgtccccactcatgcaccagggagaagaggggaggccgccaggagccagtggctcagctcatgattcaccaggtggaggagccaccgctgaggatgctgc

SEQ ID NO: 99423 - DNA, 30 bp, Homo sapiens
  chr8:42147491-42147521
  hypo
gtggggctgggtgagcgccactgacccagg

SEQ ID NO: 99424 - DNA, 41 bp, Homo sapiens
  chr8:42333549-42333590
  hypo
gtctgaccacaggtgcgcttttgattgggtgaagtagccgg

SEQ ID NO: 99425 - DNA, 160 bp, Homo sapiens
  chr8:42333890-42334050
  hypo
gattacaggcttgagccaccgtgcccggccggtttactgtgtctcaatggaggactcccttgctgtgcaccttgaatatggcagtggctgtactactgtacatgctgtcaaaactcatgaaattcacacaggtgaaccacaggagcgccctgggtgggaa

SEQ ID NO: 99426 - DNA, 25 bp, Homo sapiens
  chr8:42399256-42399281
  hypo
caatatgtcaaataccggccgggcg

SEQ ID NO: 99427 - DNA, 30 bp, Homo sapiens
  chr8:42600848-42600878
  hypo
gtccctctccctactcgccccacccccacc

SEQ ID NO: 99428 - DNA, 82 bp, Homo sapiens
  chr8:42661169-42661251
  hypo
attaatgaagtttgaaatctcctgcatactcctccctaattgcatctccctcctactcaaaagtatccggtactttgaatta

SEQ ID NO: 99429 - DNA, 30 bp, Homo sapiens; identical to SEQ ID NO: 15108
  chr8:42699267-42699297
  hypo

SEQ ID NO: 99430 - DNA, 77 bp, Homo sapiens
  chr8:42749678-42749755
  hypo
ggaaccaaacacaggcgagacacacatgtgtaattttttttttcttttgagacagattctcgttctgtcgtcaggat

SEQ ID NO: 99431 - DNA, 17 bp, Homo sapiens
  chr8:42749995-42750012
  hypo
cacgtatgtgtaatttc

SEQ ID NO: 99432 - DNA, 30 bp, Homo sapiens
  chr8:43102377-43102407
  hyper
ctgctccatcgaccacgagtacccggatcc

SEQ ID NO: 99433 - DNA, 110 bp, Homo sapiens
  chr8:43102486-43102596
  hyper
cgccgcagaggtcgagcgccgccagatgcgcagaagccgggacttgtacgcccgcgacaggaaagacaggcagcggggcctcagctccaggtgggagggggccctaggcc

SEQ ID NO: 99434 - DNA, 48 bp, Homo sapiens
  chr8:43400747-43400795
  hypo
cccctgcaagcctggcgtactgaccccatcacccggggggacttattg

SEQ ID NO: 99435 - DNA, 60 bp, Homo sapiens
  chr8:43401723-43401783
  hypo
tctgccaagatctggcgcagggcctgacgggaaggcactggcctccgagggaccacccca

SEQ ID NO: 99436 - DNA, 48 bp, Homo sapiens
  chr8:43404086-43404134
  hypo
tttgggtgcccaccacggaccgcggggtcagagcgaggaactccaagg

SEQ ID NO: 99437 - DNA, 192 bp, Homo sapiens
  chr8:43416667-43416859
  hypo
ccgtggagtcccccccgtcacctccgggagagagacatgcaccctggggtgaaagccagggactccacagcctgcccatgtttagcgcagggcctgccgggaaggcactggcctcgggggggatgaacccagcctcctcttctgcctcgctgctttttttcccccagcctgccacaacgtccccttgagagc

SEQ ID NO: 99438 - DNA, 37 bp, Homo sapiens
  chr8:4671648-4671685
  hypo
tcttggaatatataacgaattccgtgaaaactgcaag

SEQ ID NO: 99439 - DNA, 177 bp, Homo sapiens
  chr8:46935227-46935404
  hypo
aggggctgctgggaacgcctgggcctccgtgtaaggccttcaggttctcccatggcctggctgctttatttccttggctgcctcaacatcccctttcaaccctaatgtgctgtccccttttcccaggggccttcttgagagtttgtggtgccccccggtgtgcgagacacgcaccct

SEQ ID NO: 99440 - DNA, 30 bp, Homo sapiens
  chr8:47015663-47015693
  hypo
acgcacgccaccctgcggccctgttttcgc

SEQ ID NO: 99441 - DNA, 30 bp, Homo sapiens
  chr8:47015813-47015843
  hypo
cattttgtgttgtctcgccattcttctcta

SEQ ID NO: 99442 - DNA, 48 bp, Homo sapiens
  chr8:47016307-47016355
  hypo
gaccacgctaccctgcggctctgctttcacttgcgaaggccttccgcc

SEQ ID NO: 99443 - DNA, 30 bp, Homo sapiens
  chr8:47021923-47021953
  hypo
cctttttgggagacacgcagcattccctgc

SEQ ID NO: 99444 - DNA, 179 bp, Homo sapiens
  chr8:47093235-47093414
  hypo
cttgcgtaggacggtcgtcggggcttcggggatgggagaggcctctttggaagtctcccaccattccctgcggcctcgctgctacccccatctgccagcctcaacatccccatgagtccctatgtcctgtccacaccgcaccgaggccaagttttcgctagtggcggccttctgctaga

SEQ ID NO: 99445 - DNA, 41 bp, Homo sapiens
  chr8:47122214-47122255
  hypo
agggtggctgggtggcgtgggctggccgcaggcctgaggga

SEQ ID NO: 99446 - DNA, 183 bp, Homo sapiens
  chr8:47138568-47138751
  hypo
acagggtggcgtgggcgggccacagggactcaaggttatgttgaggcaggcagcggggagaagcggcaagactgcagagaattctgggagtgacccaaagaggcctcttccaacccagaaaccgccaggggtgtctgggggcaggctgtaaagccccagggctcggagcggggtgcctgtgtc

SEQ ID NO: 99447 - DNA, 183 bp, Homo sapiens; identical to SEQ ID NO: 41768
  chr8:47155037-47155220
  hypo

SEQ ID NO: 99448 - DNA, 86 bp, Homo sapiens
  chr8:47159728-47159814
  hypo
tcccctggctttggccgggagaggtggctcacacctgtaatcccttggctcagcactttgggaggctgaggcgggcggattaagag

SEQ ID NO: 99449 - DNA, 30 bp, Homo sapiens
  chr8:47161038-47161068
  hypo
aagaagcgacaagaccgtcgggaatgctgg

SEQ ID NO: 99450 - DNA, 108 bp, Homo sapiens; identical to SEQ ID NO: 41769
  chr8:47334490-47334598
  hypo

SEQ ID NO: 99451 - DNA, 49 bp, Homo sapiens
  chr8:47355877-47355926
  hypo
cttgtgggggctttccgtgacagatacaggcactcggctccaaagcctg

SEQ ID NO: 99452 - DNA, 177 bp, Homo sapiens
  chr8:47357885-47358062
  hypo
gccatcctttgggcccgtttctgcttgtgggggctttcaccgagagacccagggacactgctccaaatcctgggactttaaagcccaccccggacagccttgggggattctcaaatgggagagtcctccctgataggctcccagcatcccctgtggtctcgccggttctcccttctg

SEQ ID NO: 99453 - DNA, 162 bp, Homo sapiens
  chr8:47829382-47829544
  hyper
caggaagccgcgaggcgggattcccagggagaagccaggagcctgaagcgggcgtgcggcgctgcggggccagcagggggcgcgccaggcgcggggagcaggaggccggggcggtggtttccgactctgccagccgcggttggagttcgtcccatgagactg

SEQ ID NO: 99454 - DNA, 255 bp, Homo sapiens
  chr8:48021889-48022144
  hypo
ctcagtctactttaacgttaaacatatttctgagataagcaacactataacacgttagtgctctatggtgcaacgctaagcaatgtgtgcaaatattactgtaggatacataaaaagtcattctacttatgcaatggtcctaccgttaaaatccattttgatttgttcagtgagcaacataaaagtctcataattagggtaaggcaaatcgtaatcctctgaggctatttcagatggccacgttatgtcatcaag

SEQ ID NO: 99455 - DNA, 130 bp, Homo sapiens
  chr8:48044980-48045110
  hypo
agccccgaagacactcgtggcggtgctgtgcccaggtggccgcggctgcaggggaggggcagcctggcggaactcgctgcaaatggcctcaaaatcgtggaacataagccgcccacggtctccaggccct

SEQ ID NO: 99456 - DNA, 527 bp, Homo sapiens; identical to SEQ ID NO: 31932
  chr8:48100170-48100697
  hyper

SEQ ID NO: 99457 - DNA, 191 bp, Homo sapiens
  chr8:48294168-48294359
  hypo
tcagaagatcctattcgggcaggtctgggcctggtcagtaattgggtgggaggcctcagagagcagaaaccagcgattggcaggaagtggcatgggcagctcacctggcctgcgagtctgggctcagctggacctgccccacgtggcaccaggcgcacaaggtgtcctcacagagccgccccgtggcacgc

SEQ ID NO: 99458 - DNA, 211 bp, Homo sapiens
  chr8:4849052-4849263
  hyper
gcgggagccgccacccgggcgcgcgcggcgcagctgcccacggcagtggccgggcgccctcctgccggagcgctcctccccgggaaagccctgctgcttgcaagcgcctccggtgggccctggagcgcgctgccgagccccggggcccagcgccgacgcccccggggggaggcccgaccttggtcacccgggctttgctaggcaaggggaa

SEQ ID NO: 99459 - DNA, 539 bp, Homo sapiens
  chr8:4849296-4849835
  hyper
cggcgactccggcgctggcgtcaccagcccccttcctgcctgcagccccttcccaggccggtacaggagctcgcacttgaccccgcaggcgtggaggagacacggtccctggtccctgtggggttaatgaaggagctccacggacccactgcctcgtgggccagacaatagcgcagtgagagctacgtccgagcgtcctggaccccctccgcgcgcacacacttgcgcacagcacctctccagctccatgcacgccaggggcctgggaccctgggctccacttctcggcttctacagccaggttctgggacctgcagcgcgcaagaggagctctcttccacggggctgccccgcagggcccgaggcgcccaggactttgcaacccctgccctgttcgccccagaatcatccagagcagcccccgcccactacctggccctccacaccctccctcccgcctccgcctcagcctcatcctagcgctgcagcccacccgcgtgggggcggaatccgcccggcacacacgtgtgcggattatt

SEQ ID NO: 99460 - DNA, 91 bp, Homo sapiens; identical to SEQ ID NO: 31745
  chr8:4850232-4850323
  hyper

SEQ ID NO: 99461 - DNA, 281 bp, Homo sapiens; identical to SEQ ID NO: 31746
  chr8:4850418-4850699
  hyper

SEQ ID NO: 99462 - DNA, 33 bp, Homo sapiens; identical to SEQ ID NO: 31747
  chr8:4851342-4851375
  hyper

SEQ ID NO: 99463 - DNA, 30 bp, Homo sapiens; identical to SEQ ID NO: 31748
  chr8:4851581-4851611
  hyper

SEQ ID NO: 99464 - DNA, 774 bp, Homo sapiens
  chr8:4851814-4852588
  hyper
gctctaccgcctccccggccaggagcaagtccgtcttacccttcgctgcagtgaggagcctcgcgcacagcaccagcagcccgagaagcaggagcagcgactggaatctcctccacgcagtcatgtctgcagatactccacacgcacgcgacaccgatggctcctccgaggaaggcagggctatgagcggagccaaataatcacccgagggcaaggcgagccggagagagagcccggtcccaagacccgccgcgcatccgacgcctcctgaaggtctgggcgcccggctcgcttccctctcatagcatcgggtcccgagccactgcagggctgagctgctccgagcgcggagacccgggctggcggggccggggccggggacgagcgccggccgagccgggcaggaaggcaccaaggcggcgaggctgcgggagggggagaagcggggagaggagcgcgcgcagccaggagagacctggagaggaggcagctggagagagagccagcgagtgggagatgcggggaggggggcgcgggggggaggagagatccagtctagagagaaaaggcggagagcgcagaagaagggctgctagtggcacaaggagccgctgccgtggaggctggactcaaccatccttacccacagagaggggaccgaggctgggcacggcgcagtcccagacagacagagcccagcctcggggcctcgggctgcccgcaccgtgctgcgcttcattcggcctcagcgcagcagcgcgcaggctggagaaa

SEQ ID NO: 99465 - DNA, 30 bp, Homo sapiens
  chr8:48601821-48601851
  hypo
gacccatagctctcccgggttggttggctt

SEQ ID NO: 99466 - DNA, 26 bp, Homo sapiens
  chr8:48675264-48675290
  hypo
ttttctttctccgtggcacataaagt

SEQ ID NO: 99467 - DNA, 147 bp, Homo sapiens
  chr8:48676735-48676882
  hypo
ggtgtggttgtgtatcgtttgtgtggtgtgtgatggggtgtgtgtggtgtggttgtgtgtgcccctctcccttaccgctgcctgctctgggcctagcccctgacgctctgcagcgttgaaaacgttgtgtctcgccctccaggccgg

SEQ ID NO: 99468 - DNA, 45 bp, Homo sapiens; identical to SEQ ID NO: 41774
  chr8:48796372-48796417
  hypo

SEQ ID NO: 99469 - DNA, 30 bp, Homo sapiens
  chr8:49058263-49058293
  hypo
aattctgggactcagcgagcacattcacac

SEQ ID NO: 99470 - DNA, 30 bp, Homo sapiens
  chr8:49172784-49172814
  hypo
ccagagcccagccaacggtaaataggactg

SEQ ID NO: 99471 - DNA, 30 bp, Homo sapiens
  chr8:49195117-49195147
  hypo
tctctgtggaccagacgctcatggggtgtc

SEQ ID NO: 99472 - DNA, 659 bp, Homo sapiens; identical to SEQ ID NO: 31933
  chr8:49292866-49293525
  hyper

SEQ ID NO: 99473 - DNA, 37 bp, Homo sapiens; identical to SEQ ID NO: 3239
  chr8:49293580-49293617
  hyper

SEQ ID NO: 99474 - DNA, 332 bp, Homo sapiens
  chr8:49309314-49309646
  hyper
tccctgcctgagtcccggggcacgtccccggcacaccatcccctctcttgggtgagagtctccgggtgactccccgcagctccccctgctctcacctccaccggcctccccccgccgtggttcccgcggtgcgccctccccaagtcccttcctcccactgccctgggtcccagagcacatccgccggcggcccccacatccctctgcctggagtcccggtccccgcgcacccccgcccccgccctgccttcacctgccgcaggccgcccgccagccccgctgaccgccgcccccgcgcttcgctggcgccagcctctcgatgggtcttgcac

SEQ ID NO: 99475 - DNA, 306 bp, Homo sapiens
  chr8:49334982-49335288
  hypo
cagctgtgtgggctgcgctgccttcgggggcacgtgacgccacgtgggaagtgctgtgaggctggtgcggagagcaaacctcctgcaactcttagcgagtaaatgggcacatccacactggagttgaacacaggggcgccggccacgggttcaggctagcccgggcgtctggcttccctgccaggatggctgcctcgttactgagatggaacacacaacacagccgcgtgggcagtgggaggctgcgaggttagcctggcaaagctgtgtccaaggaggcaaagattggtccgcagctcagaggag

SEQ ID NO: 99476 - DNA, 90 bp, Homo sapiens
  chr8:49382293-49382383
  hypo
gggcagagagagcaccgtccaggcagaagggagagcgtgagcaaggggcccgtgggactgagtgctgcgtgtcgccgcagaggggcatga

SEQ ID NO: 99477 - DNA, 326 bp, Homo sapiens
  chr8:49390299-49390625
  hypo
ggttcagtcgggagacgctcaggcgctgacaacagcctccaggtgccgttccctgcgcatggccccatctttgcgggcagtgtccagtgggcttgtgctcacacctgcgctgggggctccacactagacggccctggactactgaaatagtggacagaagggtctcccgagaatgtccagggtgggcaggcagtgctggggagccagcgggaagggaagggagcctgaggcggagaaacgcccacgcgggagctgctagtgcagccgcaagagcaaggcctgggctgcagtaggggggctgggcagtggcccgcagtgtgcagcag

SEQ ID NO: 99478 - DNA, 30 bp, Homo sapiens
  chr8:49418760-49418790
  hypo
cagtgtgcagagctgcgcctataggctcct

SEQ ID NO: 99479 - DNA, 160 bp, Homo sapiens; identical to SEQ ID NO: 770
  chr8:49468668-49468828
  hyper

SEQ ID NO: 99480 - DNA, 362 bp, Homo sapiens; identical to SEQ ID NO: 771
  chr8:49468829-49469191
  hyper

SEQ ID NO: 99481 - DNA, 17 bp, Homo sapiens
  chr8:494853-494870
  hyper
cgcgggcccagtgggcc

SEQ ID NO: 99482 - DNA, 67 bp, Homo sapiens
  chr8:49496353-49496420
  hypo
taagaagaattaatccgtggaaagcggtgccatcaaccgacactcgtcctcccgcccttccctgccc

SEQ ID NO: 99483 - DNA, 30 bp, Homo sapiens
  chr8:49527456-49527486
  hypo
atgtttatgctaacccgtattagcaatggg

SEQ ID NO: 99484 - DNA, 45 bp, Homo sapiens
  chr8:49547039-49547084
  hypo
tactccaatgttattcgttgctccgggttccgtttgtaaagagca

SEQ ID NO: 99485 - DNA, 175 bp, Homo sapiens
  chr8:495703-495878
  hyper
gccgggaggaagcctcgcccagccctggtgggcggtggggccgctggggcctggggcgccgcgggctcggcccggactgacggcggtggggggcggggatggggccgtggtgccgggccgcgcagaacccttgggacccccgcggcgcccaggttggggctcagggcccggagaa

SEQ ID NO: 99486 - DNA, 268 bp, Homo sapiens
  chr8:49571915-49572183
  hypo
ctccaagaaatgaggcgtgggctgtggaacccattgcggctaatcgtaaacaggtgcatcttaaacataggatgccaacctgctccaacatgctgggcaccgggcttagctgcagctaattacgcgtgcgctctgaccgggcggcccacagcggctctgcaggctcagcggggcgagcgcaggaggcgcgggcccgacacgcgtgtttagacctgcgaggctgtcgggggtgcgcctgggactgagctgggctcgtcttcatttccct

SEQ ID NO: 99487 - DNA, 49 bp, Homo sapiens
  chr8:495952-496001
  hyper
cgcctggttcccaggccgaaaggagccggcgaggcgacccccgatcccg

SEQ ID NO: 99488 - DNA, 267 bp, Homo sapiens; identical to SEQ ID NO: 41778
  chr8:49608941-49609208
  hypo

SEQ ID NO: 99489 - DNA, 36 bp, Homo sapiens; identical to SEQ ID NO: 31938
  chr8:49647817-49647853
  hyper

SEQ ID NO: 99490 - DNA, 30 bp, Homo sapiens
  chr8:49747114-49747144
  hypo
cacggtgtgcaagtgcgtctggaacagggc

SEQ ID NO: 99491 - DNA, 30 bp, Homo sapiens; identical to SEQ ID NO: 41779
  chr8:49773216-49773246
  hypo

SEQ ID NO: 99492 - DNA, 214 bp, Homo sapiens
  chr8:49782672-49782886
  hyper
ggaatgcccaagcttcgcccccggctaaacacccccttggcgtccgcctgggggtccccatgaaagtccccgcacgccctccccggccccgccctcctcagagcgtgggccccgcgcgccgccaccgcccggccgggaggcgcggggctccctagaaggctcgggcatgtcggagggagccgcggtgcagagacttgccacgcggctgcccggg

SEQ ID NO: 99493 - DNA, 215 bp, Homo sapiens
  chr8:49782922-49783137
  hyper
cgacgggcatcctgccctgcggaacacccacccgagccctgcgcgggaggggcggccgggaggcgcgcgggcatgcggaggggaaacagggctgcagcttcaagcccaggcaggacgcccttagtcaccttatcggaaagtgggcagcgccgcgtctccggttagtcagagccccaggtaaataaagagctcggtgtctgcggggctctggcctc

SEQ ID NO: 99494 - DNA, 288 bp, Homo sapiens
  chr8:49808681-49808969
  hypo
tgggagtgacccctgcggagctgacaagccaatgctggagaagtgcacgggcaggctcaggcgcagccactcaatgggcctgtctgtgtcgggggcaggggcacagagaggggcaggtgagtcgaagctgattgggtgaagaaaagacagtgaaaagacggtgagaccaaaggcacagagcgggtttcccgccccagctaccacgctggtctgcagagcggtaagtctaaactggggagaggtcagaggcagcacaggggcctgtggggcaaccgcaggatccgcgac

SEQ ID NO: 99495 - DNA, 260 bp, Homo sapiens
  chr8:49833748-49834008
  hyper
tatgtgtgtccagttcgctgtagtttggctttttggaggcgttgaaatgcttcttgaccaggaaggagcgcggcatcttgccagcgggtctggcgggcgcccggcgcggataacggtccggcgggaggacacggcggtccctacagcatcgcggcgggccaggctcgggcaggggccgtgctcaggtgcggcagacggacgggccggcgcctctgaagtcacccggctcctttacgaactgagcccgttttggctgggag

SEQ ID NO: 99496 - DNA, 396 bp, Homo sapiens
  chr8:49834319-49834715
  hyper
cggggacacagtgtccgccaggagaaggaagggccgccctgcaccacaccaggccagcctctggtgttaatgagagcctatatttggaagtggcatctggagaggtttgccttgcacaaagaccaaataattacctcttggcttttgaaaaaggaagggggaagcgggaagacaaaggcgcctgtgagcgcggaggacgctctcctgggactctggcctggagcgggactgcagccttgcgtgcggcgagggcgctgcgctactcagggcttccgcgaagccaggggcagcgcggccgcgtgcaaattaagtactcatgtcaccgtgttagctatggtggcttgaaagaaatgctttgtagccctctaaaggcaggctgatcggaagaactggaag

SEQ ID NO: 99497 - DNA, 222 bp, Homo sapiens; identical to SEQ ID NO: 41781
  chr8:49959230-49959452
  hypo

SEQ ID NO: 99498 - DNA, 120 bp, Homo sapiens
  chr8:50015571-50015691
  hypo
ccttgggtggtctatgggaccgggcgtcttggagcagggggctttgctcctcggggaggctcaggctgtgcaagagcccatggcctgggtggggcgcgggaaggctcaggcatggggcac

SEQ ID NO: 99499 - DNA, 99 bp, Homo sapiens
  chr8:50101810-50101909
  hypo
ataccagctacccgggaggctgaggctgaagaattgcttcagcaggcggagcaatgctgaacccggcattcggaggcttgaacccggcaggtagaggtt

SEQ ID NO: 99500 - DNA, 156 bp, Homo sapiens; identical to SEQ ID NO: 41783
  chr8:50314445-50314601
  hypo

SEQ ID NO: 99501 - DNA, 58 bp, Homo sapiens; identical to SEQ ID NO: 41784
  chr8:50377787-50377845
  hypo

SEQ ID NO: 99502 - DNA, 18 bp, Homo sapiens
  chr8:50378196-50378214
  hypo
aaccgcctgtagacggca

SEQ ID NO: 99503 - DNA, 23 bp, Homo sapiens
  chr8:50482465-50482488
  hypo
accgtgcccggccatgttgttca

SEQ ID NO: 99504 - DNA, 292 bp, Homo sapiens
  chr8:50822066-50822358
  hyper
cataaccttaagcaacgttttcacatggactgaaaagcaaaagacccccttaaaaattagcctcaagcagcagatactctctttttaggtttgtgtgtctccgtgaggtcagatggattccccaaacacggttttagagagaatcacaacctttaatagatcctctgttaaaaaagactgttagagaaagttgaccaagggcttcgttccacggcgaccgtttcctgcgtgtgcagctccacacagcgaccgcggcctgcaatgtgcggagcacagcgcggccccttccagc

SEQ ID NO: 99505 - DNA, 1389 bp, Homo sapiens
  chr8:50822494-50823883
  hyper
cgtcccgagtgattcccggctcagtaacgtttctcctccagggagcccactggaactccactggctgtgccgcctcctcgcccgtcccccgcgcgcgccgcaggccggtgcttggagagcgcaatgtccccgggagggaagatcccctacctggaatggatggttccagaccagcgggaacgcgctctaatccttgatggaagcaagcgtgggaggaaagcacaacgtctaggacttccctgtagtgtcagaacaggaagaagaacctgagaagtcgccggggaagggaggccaggagcaggcgtccggccccttcccacagcccgggagaaattagtgttgcgccccgcccctcccggacccccgtccccaccacacacaccagcgcccctcaccagtctttctcgaatttcctctcatgtctatcaataacctccttgtgcagaaatctacactgcacaagttaggagtctgcaagggcgggcggtgttacagtctcgctctttccattttccccttttactccacatagtttcaaaggtccacatggccctggttttgaccagttttccaacagtttcaacgttatgtatttcaacttcccgtctcagttcactggcgtctgcacccgttgccgagtgtgggtggctgagccctgggtgacagcactcgggaccacgcacccatacccttctttatgctcgttgtcagccagttgccaagagcgggagtgaagagcctgcaaggcccgggagagcgcggattccggagtagggaggcgagggggcagcgtgggagaccagagggaaaatgggctgaaaagccaacaaaaaaaacaacgtaaattgggctttgctctggctttacaaaggcagagattgtcgagccctctgactgtctttgtgccttctttatcccgtcctttgtgaaataagccgttttctgcccccactgcaggagcctaggctgtgggcgactcgctagcactgccctgggcctccaagctgcctgctcgctgagctcagcgctgacactcacaggagctgcgttcgccggatcctctgagaggctctgcaacgatcccgatccaattcagcagcgttttaaaaggtagccgagtgcagatgctttttcctgtctttttcattctttcattctctgtcttttaaaattttaacaataacctatcgtttccgcgtggagggtctaagaatcttcactgggtttaatttaggaatttcaaattgggtttctcaaaatttgaatgtggtccccttaattggtaatcaagattgcggagttttccaaaatattccttttcatcttatgtaattaaagatccacgagctttccaaagaagctctggattttccacggtacaaatctata

SEQ ID NO: 99506 - DNA, 174 bp, Homo sapiens; identical to SEQ ID NO: 31948
  chr8:50824134-50824308
  hyper

SEQ ID NO: 99507 - DNA, 57 bp, Homo sapiens
  chr8:50824352-50824409
  hyper
cgccacgggcagctgggctacttgctcctcgcagctaaaaggcggtgcctcctatta

SEQ ID NO: 99508 - DNA, 44 bp, Homo sapiens
  chr8:52183842-52183886
  hypo
ggccagaacaagttccgggtgggcatgggctcagtgggccctgc

SEQ ID NO: 99509 - DNA, 18 bp, Homo sapiens
  chr8:52230574-52230592
  hypo
gcccggccagtaattgtc

SEQ ID NO: 99510 - DNA, 34 bp, Homo sapiens; identical to SEQ ID NO: 15119
  chr8:52432891-52432925
  hypo

SEQ ID NO: 99511 - DNA, 143 bp, Homo sapiens
  chr8:53352268-53352411
  hypo
ggatcccggtacgttcgaaggccgcagggtcgaggccaggaggtttggatgctgaggtttgcgtgcagaggacagagaccagtaacacccagatcctaggcctgagaaactggagaatgaaattaccacgtactgacacagta

SEQ ID NO: 99512 - DNA, 157 bp, Homo sapiens
  chr8:53416425-53416582
  hypo
tggaatcttggcatacggttgaattgagggtgacctccagcctcaggctatgagaaagagaccttggtgccggagtttgtaaaaggcaaatctcctgcagcggacaagattctagtgccaccaggtgattttccagtgagcacgggcttctcagaga

SEQ ID NO: 99513 - DNA, 49 bp, Homo sapiens; identical to SEQ ID NO: 9511
  chr8:53477121-53477170
  hyper

SEQ ID NO: 99514 - DNA, 329 bp, Homo sapiens
  chr8:53477408-53477737
  hyper
gatcccattgccagccggatttctttacttaactctcaaccgtggtaaatctaattcgcttacgacctctttccgagagctgggaatctgcagagatgctctgttttctgctgtactaatctcaggcttcccaaagcgagtgcctcgcccagctcctaggggaatccacggagccccaggcgcagggcaaaggatggggcgggatggggacatcgtacctgcgctccgggagccgctgggagtccggccggccccggccgcggggaggaaaagcaacggcttgggctccttatccgtgacgcgcgctcccctgcgcccccggggcctcc

SEQ ID NO: 99515 - DNA, 30 bp, Homo sapiens
  chr8:5347789-5347819
  hypo
ataaaagtattaaatcgattaaagattgtg

SEQ ID NO: 99516 - DNA, 510 bp, Homo sapiens
  chr8:53477944-53478454
  hyper
cgcgcctgcccttgtctacgtcccgggggtcggctggagctgcactgggactcggtcctcagtgtgccgaagcctaagcgctgcggggcgcggggcgggaacgggaggcggtgcctggggccacggggtcgtcccccaggatgagggcgtgtcccagcgcgcgggaccctcggaagtccgcgctgggccgggcgggcaccagcctcggactcagcgggtctcagggctccctgcgcaacgcctgcctcggatccggaccccgggctcgctctctggtcgccgtccccgggaggacccagtagggtaactgccgcgtcgccccggcggttctccctgggctctgtctcccgccgcctccaccccccgagcctcggggtccgtcacggcttcccctggctggcggggtcagtagaacccgcggcgcctaggtccggacggaaaaaagcagggccggggtgcggcctggatgagcggagatctccgcgccttgggctcaaaggtgcggggtgc

SEQ ID NO: 99517 - DNA, 185 bp, Homo sapiens; identical to SEQ ID NO: 31954
  chr8:53478455-53478640
  hyper

SEQ ID NO: 99518 - DNA, 30 bp, Homo sapiens
  chr8:53756040-53756070
  hypo
tcccacagtggttaccgatggaggtcttcc

SEQ ID NO: 99519 - DNA, 30 bp, Homo sapiens; identical to SEQ ID NO: 41787
  chr8:53805607-53805637
  hypo

SEQ ID NO: 99520 - DNA, 20 bp, Homo sapiens
  chr8:53843008-53843028
  hypo
acatgcgagttttaaaatca

SEQ ID NO: 99521 - DNA, 48 bp, Homo sapiens; identical to SEQ ID NO: 31955
  chr8:53852136-53852184
  hyper

SEQ ID NO: 99522 - DNA, 880 bp, Homo sapiens
  chr8:53853579-53854459
  hyper
cgacctagcagatcggaagcgctgcgactgtgcccgcaggttgaccttgccaagccctccaggtgatgcgcggccatgccgggtgaggagaactgaggctgagatcgccacactgagggctccctaaagccgaggtggaggaagaggagggtagaggaggagggcggtattgctgggaaccgccccctccctgccctgctccctgctgccccacccgagccctggcagtctggaacctggctggagtcggaactctccgcgccttcgaagggaggcccgaggacgctgccggcgcccccaggcgtcggctccgcgcggcccctgctgtagctggcgcacagccccggcgggtccccttgtcctccgcgcgctctgggaagacggtcaggcgcgcgcgtttggcgcccacccctgtgagacccgcttggcctggcgccgcgggcggggaccgctgccgaggccgccagcgcctcttcaactggggaaaacacaacaactcgggatgccccatcggagtgtgtatacacctgtgtgtgtgtgtgtgtggtgtgcgcgcgtttgcggaggcatgaaatgcggggaaagaggctggcgcttggcagtgactgcctagaatatgatacgaatagtgatccttctttctgtctgcccctactccttttctttgccttttccctttcctatccgtgatctcccctgaaaatgtcagactcccggagcaaggaacccggagtagcccgggcgcgcggttccggcgccccctggaggagccagcggccgagtgcttagcgtcggaggatcgcggggctttgtggtggagcactccggctgagcgcgcttcacagcgctgtggcacactggtcatcgttgcttatagagg

SEQ ID NO: 99523 - DNA, 34 bp, Homo sapiens
  chr8:54163316-54163350
  hyper
gcgctgcgctgtccccgcgctcaccggatgatca

SEQ ID NO: 99524 - DNA, 454 bp, Homo sapiens
  chr8:54163673-54164127
  hyper
cggagaggcaaactttgcccgcgccctggccagcggcgctggggacccggagcctgcggactcccacccgggccgcaagtcgccgggggcaggacagggagaacggacttctcgctgcctttccggccagcaggcgcgccgctgggtgccagagaggggcgaagagcgctcgctccttctcccccagcccctgaggtgcctccctcaccaattctaggcaccggcccctggtggaactgtccccagactgcctgagtccccagggtcaagcccccttcccacctcccagcacggagctctacctagaactgcacctcgaaagcccaaagcttacctatggttcccagagacaggcgaaggcgaggttttttacgggacgccctggtaggtgctgaaccgcgcgctcacgagtcccgctcagctcttggcatcacctgctctcggaccccggccc

SEQ ID NO: 99525 - DNA, 212 bp, Homo sapiens
  chr8:54164390-54164602
  hyper
cgcaggctcgcccggcccactaactgcccgagcggcacaccgcctggtccccggccatgcagccttccccaagacctgagactgagccatttagatttagtaaaaaggaggagcatgcctatttagtgcaagtatgcacctggattttcatattgtgtctagaacttcttatctgcatagttcgcagtcaggaactacgcttattagaatgg

SEQ ID NO: 99526 - DNA, 39 bp, Homo sapiens; identical to SEQ ID NO: 31961
  chr8:54570523-54570562
  hyper

SEQ ID NO: 99527 - DNA, 214 bp, Homo sapiens
  chr8:54582655-54582869
  hypo
gacagtatctcagatcgttcctttgttttgtaaagtggaagaaaggctgtccttaaaggggcagggagaatgaagaagagctgtgactctcaaagcaggacccgtgggaagggtgctgtcctgaaggacgcaggtagatgccaagacacctgctggttcctcctccccagggaactatttgctctttcacctgttgctgcgctggctcagtctg

SEQ ID NO: 99528 - DNA, 707 bp, Homo sapiens
  chr8:54789099-54789806
  hyper
tgaagtgcagcccttcgggcagctgaaggtctttctgcagataacttttctcagatcgaattttttggctacattgatactcttcggctctgtccttgccagaagttcggaaggattccagcgccccacaccttgcttgattcaccctcatcccctcccctaactggagaagccgctgggtcccgcgccaggctcgcggtggcttcagagtagcaggggagcaggcggctgatccggaggccagtgtggggccggcaagcggtgactgtctccagaggagcaaaggagccgagtcttgtttttcttggatcaggtttgggacttttattctgtctgaccatttccaccacttgcctcacaagagtctctgtctcgaagcacaggaccgaagcaaaatgcctaatgaagcgtgcctgaggaaggggcaggggcttgcaagtgacttgggaagaaggactggggcgaagggagaaaggaggttacgagttcgcacgttctcacaaaaccatttgaaaacatgagctggagacgccaaattctgggacccacgaaaggctttggagctcgctcgggctcctcgaagttgggcgtgcgtcgcagaacagtgctgggcgctctctttcagcattttcggcttttttcaagcccttgcgtagggtcgggaaggccgtgggtgggctcagtcaggctttaggtcgccaggaacc

SEQ ID NO: 99529 - DNA, 785 bp, Homo sapiens; identical to SEQ ID NO: 31964
  chr8:54790022-54790807
  hyper

SEQ ID NO: 99530 - DNA, 15 bp, Homo sapiens
  chr8:54791767-54791782
  hyper
ggacaccacagtaac

SEQ ID NO: 99531 - DNA, 49 bp, Homo sapiens; identical to SEQ ID NO: 774
  chr8:54791897-54791946
  hyper

SEQ ID NO: 99532 - DNA, 487 bp, Homo sapiens; identical to SEQ ID NO: 775
  chr8:54792184-54792671
  hyper

SEQ ID NO: 99533 - DNA, 2080 bp, Homo sapiens
  chr8:54792701-54794781
  hyper
cggtgctgcgagtccggagagctgggcggctgggttccccctcccgctgccccctggtctactcctttccccggactccggagtccctggagaaggggacgcggagggcgactgccgagggtctcagcgggatctggagtcaggggttagttcccccccttatcccccgctcggttgctgggtggggcctccgcgctctggctagctgggagggggcgagggccgctttccagggcgggaagaccggaggcctaggctgcgccggggtggggcggggacagagctcagagaggcgccccgggccggggagaaggtagggggctgccctccagagacgcgcagtccacagacgcgaagctctggggaccaagcgccccctccatgcctgccgcccacccccgctccttcctcccgctcccttcattcacgaggtccgagcacgcagtccagcacactctagtctcgctcggccccgcgcgccgaggggaggcgatgacacagagggcttcgcggacgccctctacgcgcgcctggcttcgcatccacactcttgggacttgctaatgcggggctggagcagtggggctgcggccggggtggaggtcgcgccccgcgtggggcctcgggggtacccctagcacccgcggcggtggagtgcgccgccgctggagggaggcgagacgtgggattgcccggccgggtaaaaggagtgagggggcggggaggaggcagagcaaggggaggaagaggccgggagaagagggctagagcaaagaccgagagccggagaaaggcgaaaggcgcggtgagcaatcgccgacgtagagagggcagccctccgcgctgcaatattgagaaggcacccgcgggacgcatgcgcacggcggacggaggcgagccggccggggcttcctccccggccggcagggtggacggtgggctcgtgagtatcccagttcctcgaactctctttcttcgtctcgggctcgccctgaggcttcgtgctggaaagtggccgaggctgggaggggcgcgccgctcgtccggacctcagggtgtcgccgttgctgcggggcgggagccggtgcgagtcgggggttccttcccgcagtgcgagtttgggggagtggggctgcgagtgcgtccgcgtgcgaagaggggcatcgcgccaccaggatcaatatgtcccgggcctgccagggcgtccgcgattccacctctgcggcttcgcgtcggtgtcttggtggggaacgcgggagtctagtctttagaccctagaaatcgcattgaccacccgaagcgtatttcggaaagaccaggcgggtggaagcgtcggctttctcacgggatagggagaggacaaggaaggggttgggcgcccggggctggtggtttgagcgccgctgggaagggtaaggagacagagcctcctggaatcgtagcgcctccttttaggagaagtgcaaccagggcaggggcaccgaggggcagggtgaggaagtggacgccccacgcgtggaccctagaagaccgactaggtatgggcgttcactcggagcctctgttcacgctcttgaaaaccgaatgaacagagaagtgccctccacccttcgcctgcgccagggcagttaacgtgcaggcgccgccgggattttcctggaacaaacccgggcacttgatcttccgcaccctcggagctgccctgggaagtcgaaacaagtctgggcgcccggactgcggagactggaaagcagggggcggagggcgggagactgggggcgggaagtggaggtgcaggctgcagctggggaccgcggtgggcgttggaggggagggtctgtgtgcgcggctgtcctccagcgctgggggagcggacgggccaggggcctctagggaagcggcgctccgggaccggggtggctttcccgtctctgtgtgcgcggcgatccccacacccagctcgggcggaggagccctgagagaagcggctagctgagagtggggtgggcgttttggggaaaggtttgcgtgcgctgcggccctaccgctgctagagaagtggaagagagagagtgggcgc

SEQ ID NO: 99534 - DNA, 124 bp, Homo sapiens; identical to SEQ ID NO: 9528
  chr8:54794826-54794950
  hyper

SEQ ID NO: 99535 - DNA, 31 bp, Homo sapiens
  chr8:54795139-54795170
  hyper
cgtaacttggcaaaagctcgcgccactgccc

SEQ ID NO: 99536 - DNA, 207 bp, Homo sapiens
  chr8:55122423-55122630
  hypo
aacagtacctggggccgcactgagagtgagatgatggtcctcatccccgcgcagatgggaatctttgtttagattaacagaggactgtacatacaccctcaaaacagattagatattttccctgggaacttgctgtaattcttactccccttgcccctcttttccatgaaagcatgaggttacactgatgaacgctcctcccttcct

SEQ ID NO: 99537 - DNA, 40 bp, Homo sapiens; identical to SEQ ID NO: 41788
  chr8:55191496-55191536
  hypo

SEQ ID NO: 99538 - DNA, 30 bp, Homo sapiens; identical to SEQ ID NO: 41789
  chr8:55285908-55285938
  hypo

SEQ ID NO: 99539 - DNA, 274 bp, Homo sapiens
  chr8:55366094-55366368
  hyper
ccacacacctcaacccggggccacagttggaggtggggagatctaagaaacactccacggatgagtttctgaagagggaagtggaccgggaacagcgcatttcctgcttcgcctgtgcaaatcccaggcggggccaagcgggaacggggacacggtctaagagtcgcccgctgccagggaggggttggggggcagcctcgaggggacaccgcggaaccagggagggatgcgcatggagggagtgggagaaggcgtccaagtaaaatgcatgctc

SEQ ID NO: 99540 - DNA, 690 bp, Homo sapiens; identical to SEQ ID NO: 31973
  chr8:55366951-55367641
  hyper

SEQ ID NO: 99541 - DNA, 223 bp, Homo sapiens; identical to SEQ ID NO: 777
  chr8:55370113-55370336
  hyper

SEQ ID NO: 99542 - DNA, 86 bp, Homo sapiens; identical to SEQ ID NO: 778
  chr8:55370337-55370423
  hyper

SEQ ID NO: 99543 - DNA, 9 bp, Homo sapiens
  chr8:55370424-55370433
  hyper
ggaccggcc

SEQ ID NO: 99544 - DNA, 147 bp, Homo sapiens; identical to SEQ ID NO: 31977
  chr8:55370567-55370714
  hyper

SEQ ID NO: 99545 - DNA, 198 bp, Homo sapiens; identical to SEQ ID NO: 31978
  chr8:55370835-55371033
  hyper

SEQ ID NO: 99546 - DNA, 204 bp, Homo sapiens; identical to SEQ ID NO: 781
  chr8:55371172-55371376
  hyper

SEQ ID NO: 99547 - DNA, 286 bp, Homo sapiens; identical to SEQ ID NO: 782
  chr8:55371439-55371725
  hyper

SEQ ID NO: 99548 - DNA, 75 bp, Homo sapiens; identical to SEQ ID NO: 783
  chr8:55371993-55372068
  hyper

SEQ ID NO: 99549 - DNA, 147 bp, Homo sapiens
  chr8:55372416-55372563
  hyper
cgtgtgcaagcctgagatgggcctcccctaccaggggcatgactccggtgtgaatctccccgacagccacggggccatttcctcggtggtgtccgacgccagctccgcggtatattactgcaactatcctgacgtgtgacaggtccc

SEQ ID NO: 99550 - DNA, 67 bp, Homo sapiens
  chr8:55379164-55379231
  hyper
gaccgcgacgtcgcgcgcccgcttcgaggagttttgagctcttagcttggtgccggggcccgcccgg

SEQ ID NO: 99551 - DNA, 162 bp, Homo sapiens; identical to SEQ ID NO: 3261
  chr8:55379295-55379457
  hyper

SEQ ID NO: 99552 - DNA, 108 bp, Homo sapiens; identical to SEQ ID NO: 3262
  chr8:55380036-55380144
  hyper

SEQ ID NO: 99553 - DNA, 64 bp, Homo sapiens
  chr8:55380175-55380239
  hyper
cgtgtttagcgattctcatatttagtgtttccctttagggagacttgaccggcaattgcagact

SEQ ID NO: 99554 - DNA, 8 bp, Homo sapiens
  chr8:55382665-55382673
  hyper
ccttcctc

SEQ ID NO: 99555 - DNA, 55 bp, Homo sapiens
  chr8:55383182-55383237
  hyper
ggtgccgacttcaacctctctgctcaggcctcttgagttgcgttaccagcttacc

SEQ ID NO: 99556 - DNA, 103 bp, Homo sapiens
  chr8:55394094-55394197
  hypo
aaaattgatattgccagattactttctagttgcactctaccagtagttcacaacagtgttggcttttccatactcccaccaacatcaacgtactggttaattt

SEQ ID NO: 99557 - DNA, 30 bp, Homo sapiens; identical to SEQ ID NO: 15120
  chr8:55689465-55689495
  hypo

SEQ ID NO: 99558 - DNA, 133 bp, Homo sapiens
  chr8:55787730-55787863
  hypo
ctctctggggctggccgaggccggagccggctccctctgctcgctgggaggtgtggagggagaggcgccggcgggagcccgccgggcgctcgcaggcggtggcggttccgggtgggcgcgggctgggcaggcc

SEQ ID NO: 99559 - DNA, 30 bp, Homo sapiens
  chr8:55987089-55987119
  hypo
tggctgaatttcccccgtgaaatactgggg

SEQ ID NO: 99560 - DNA, 373 bp, Homo sapiens
  chr8:56013520-56013893
  hyper
ctccttgaatcactccgatcacagatttaatttttcgagtcatttctggagttgtgggaccacacagctagtttgcaatccctatagctttaagagaaggtatttctagttttggagtaaggagtaagggaggtggcgcctgctccgggctccgccactccccgcccgcgggccgggggtggggtggcactcggtttcccgcggctgccggccgcgccccgcgccgccgccaggggtgctgcgcttcccacctgccgcaggacgcctcgagggccggtgcggtgcccactgggctgccgctcctcccggctcagagctttccagccgccgagaacgtgcgagggaccccggcgtcgggcaggggcctgggccg

SEQ ID NO: 99561 - DNA, 58 bp, Homo sapiens; identical to SEQ ID NO: 31989
  chr8:56014127-56014185
  hyper

SEQ ID NO: 99562 - DNA, 368 bp, Homo sapiens; identical to SEQ ID NO: 3264
  chr8:56014376-56014744
  hyper

SEQ ID NO: 99563 - DNA, 19 bp, Homo sapiens
  chr8:56015034-56015053
  hyper
ggtgtggaggcatcatggc

SEQ ID NO: 99564 - DNA, 477 bp, Homo sapiens
  chr8:56015185-56015662
  hyper
cgaggaggcggccgggggcggctgctgcccggacggcggcggctgctcgcgctgctgctgctgctgcgccgggagtggcggctccgcgggctcgggcggctccggcggcgtcgccggcccgggcggcggcggggcgggctcggctgcgctgtgcctgcgcctgggcagggagcagcggcgctactcactgtgggactgcctctggatcctggccgccgtggccgtgtacttcgcggacgtgggcacagacgtctggctcgccgtggactactacctgcgcggccagcgctggtggttcgggctcacgctcttcttcgtggtgctcggctctctgtcggtgcaagtgttcagcttccgctggtttgtgcacgatttcagcaccgaggacagcgccacggccgctgctgcctccagctgcccgcagcctggagccgattgcaagacggtggtcggcggtgggtctgcagccggggaagg

SEQ ID NO: 99565 - DNA, 50 bp, Homo sapiens; identical to SEQ ID NO: 31994
  chr8:56015749-56015799
  hyper

SEQ ID NO: 99566 - DNA, 234 bp, Homo sapiens
  chr8:56361841-56362075
  hypo
actttggccacctcccggcacggtgctcagctgtgacgccgaaataagttagggctggccgggcggtgcggggcagggactagggctgtacacacaagtgctgggggctcggggcctcactactgccgagggccgggccggggctgtaaacatggccagggctgccctgcccacccctagtggtcggtaacgactggaagcagagcagccaggcaaggtcgggaggctcaggcg

SEQ ID NO: 99567 - DNA, 96 bp, Homo sapiens
  chr8:56364237-56364333
  hypo
agccccgggtacctgcggtagatggcatgcatgcggttgaccagagaaatgcggaaggattcagacttggcccggctcaggcggctgctcaggggg

SEQ ID NO: 99568 - DNA, 174 bp, Homo sapiens
  chr8:56364850-56365024
  hypo
tttctccttggtcagcgcggccaccgggaaggagcggaacaccaccttctcccccaccagggggtctgtgagcatccccgtgaagatgacccggtacgtagtgaggaagagggcgccctcagctgggagcagtgctggccaccccgcactgcccgccctcgcaccctcctcacg

SEQ ID NO: 99569 - DNA, 30 bp, Homo sapiens
  chr8:56367284-56367314
  hypo
gttcctgaacacctccgcatggtcaagtcg

SEQ ID NO: 99570 - DNA, 30 bp, Homo sapiens
  chr8:56367761-56367791
  hypo
ggcctggccctggaccgcacacccgggaca

SEQ ID NO: 99571 - DNA, 95 bp, Homo sapiens; identical to SEQ ID NO: 41794
  chr8:56539998-56540093
  hypo

SEQ ID NO: 99572 - DNA, 62 bp, Homo sapiens
  chr8:56602218-56602280
  hypo
agccttgacagggggcgggctccaggtccagccttgtcggagttgaccgagggcttaggcca

SEQ ID NO: 99573 - DNA, 22 bp, Homo sapiens
  chr8:56613576-56613598
  hypo
gccgcggtggcttcacgcctgt

SEQ ID NO: 99574 - DNA, 39 bp, Homo sapiens
  chr8:566435-566474
  hypo
gctctcctggctaagcggattcagcgctggccaacaaac

SEQ ID NO: 99575 - DNA, 80 bp, Homo sapiens
  chr8:56688545-56688625
  hypo
ctaaatcccttggatcgattgactgtagcaggaagaaccgcagacaaaacccctcagacaccaggttaaagaaggaaggg

SEQ ID NO: 99576 - DNA, 41 bp, Homo sapiens
  chr8:56792024-56792065
  hyper
tggaagggatcagagcgcacctcctccgctcctgggagcac

SEQ ID NO: 99577 - DNA, 30 bp, Homo sapiens; identical to SEQ ID NO: 41796
  chr8:56883198-56883228
  hypo

SEQ ID NO: 99578 - DNA, 109 bp, Homo sapiens
  chr8:56929738-56929847
  hypo
aacctggtaaggcagcgtgaggccacgccttggagagaaggtactgtcccaggtgagcgtgagcttctcataccgtgctggtggcagcactccacggtggaggacggcc

SEQ ID NO: 99579 - DNA, 29 bp, Homo sapiens
  chr8:57025591-57025620
  hyper
atgacgtccccaaggcgctgcccggggag

SEQ ID NO: 99580 - DNA, 547 bp, Homo sapiens; identical to SEQ ID NO: 31997
  chr8:57025775-57026322
  hyper

SEQ ID NO: 99581 - DNA, 55 bp, Homo sapiens; identical to SEQ ID NO: 3269
  chr8:57026501-57026556
  hyper

SEQ ID NO: 99582 - DNA, 185 bp, Homo sapiens; identical to SEQ ID NO: 31999
  chr8:57069553-57069738
  hyper

SEQ ID NO: 99583 - DNA, 163 bp, Homo sapiens; identical to SEQ ID NO: 789
  chr8:57069850-57070013
  hyper

SEQ ID NO: 99584 - DNA, 143 bp, Homo sapiens; identical to SEQ ID NO: 790
  chr8:57070014-57070157
  hyper

SEQ ID NO: 99585 - DNA, 30 bp, Homo sapiens
  chr8:57108924-57108954
  hypo
ctcagaggatagaaccggatatatgagtgt

SEQ ID NO: 99586 - DNA, 359 bp, Homo sapiens
  chr8:57232533-57232892
  hyper
cccaaagggcggcctcgcccgacccccgccagcgcgacctcctccgggagccagcacccaggaccgacgacctcggcaacttacccaggacactctccctagctgtccgcggagaagccggcctcgtctgccccaggcacccgagtccctggctcggagctcagtcaggttcaggtgtttatccaggcgccgcccaagtccaagggcgggactgccgcggcagcgccaggggtggggccggccgtagccccagtgcgcgacgtgggcagcactcccatcttctttttctggacctgcagatttaagaagctggaaattcggtggtggaaactggatgcgtgcgccggatttctcttagg

SEQ ID NO: 99587 - DNA, 193 bp, Homo sapiens
  chr8:57357954-57358147
  hyper
atgggaagatgactgcgtgtggaggggcccttagctgggatatgttaggagttgtggtgacagccatcttccttctgacagcccaggagagaacccagtgctatccgaggtgctgaacagaggacttctcggggttcccgaattcccagggttaaaacaaacttggtttgtgcggcgacaccgctacccttac

SEQ ID NO: 99588 - DNA, 198 bp, Homo sapiens; identical to SEQ ID NO: 32004
  chr8:57358464-57358662
  hyper

SEQ ID NO: 99589 - DNA, 286 bp, Homo sapiens; identical to SEQ ID NO: 791
  chr8:57358806-57359092
  hyper

SEQ ID NO: 99590 - DNA, 408 bp, Homo sapiens; identical to SEQ ID NO: 32006
  chr8:57359259-57359667
  hyper

SEQ ID NO: 99591 - DNA, 86 bp, Homo sapiens; identical to SEQ ID NO: 793
  chr8:57360540-57360626
  hyper

SEQ ID NO: 99592 - DNA, 153 bp, Homo sapiens
  chr8:57360769-57360922
  hyper
cgagcaccgcctgcctcccggccggggcatcacggtagcaaggtcgggaaagcagagccctggagtggggctggagaaccccggacatagccctagggagccagcattaccctctgagcaggaaaacacaatgtttcccgctttaggttcttt

SEQ ID NO: 99593 - DNA, 30 bp, Homo sapiens
  chr8:57427547-57427577
  hypo
tacagagcacagctccggagatgcccctca

SEQ ID NO: 99594 - DNA, 30 bp, Homo sapiens
  chr8:57565771-57565801
  hypo
ttttccatacacacccgctaaccatcagac

SEQ ID NO: 99595 - DNA, 39 bp, Homo sapiens; identical to SEQ ID NO: 41798
  chr8:57566358-57566397
  hypo

SEQ ID NO: 99596 - DNA, 28 bp, Homo sapiens
  chr8:57696848-57696876
  hypo
ttctttctggccaggcgcggtggctcac

SEQ ID NO: 99597 - DNA, 120 bp, Homo sapiens
  chr8:57984827-57984947
  hypo
aatgagactctgtctcaaaaacaaatcattaataaataaaataaaataaaatatttaaaaactgttatggcgtgtacaacaaacatgcaggtggacactagctgtaaagagctggtaatg

SEQ ID NO: 99598 - DNA, 30 bp, Homo sapiens; identical to SEQ ID NO: 41799
  chr8:57995953-57995983
  hypo

SEQ ID NO: 99599 - DNA, 20 bp, Homo sapiens
  chr8:58009302-58009322
  hypo
caccgcgcccggccgctcct

SEQ ID NO: 99600 - DNA, 281 bp, Homo sapiens
  chr8:58105899-58106180
  hypo
agtgccaggatccctcgctttgggcgcttgtccaggaggaagaagggggtggtgcagtcaagcgggccctggggcaggcctggcccagcgctccgttcttgggagccctgccagcccacaggcccatctgcggcaggcacgtggtgccgcgagaacttggctcagggacggtttttccgccatgcgcagattctcgcctctcgcgggggcgccagggggcagctggttgaggtgcgcatgcgcactggcacctaacggctcttcttcgagtcttctcagag

SEQ ID NO: 99601 - DNA, 113 bp, Homo sapiens
  chr8:58106596-58106709
  hypo
gcgggaggaggtgggcgggtggggagaagcacccccttcagagttggggcttggggagtgggggcgaggggaggcatggaaagaatgggtgtgcggagcgggccgttctggtg

SEQ ID NO: 99602 - DNA, 129 bp, Homo sapiens; identical to SEQ ID NO: 41802
  chr8:58116950-58117079
  hypo

SEQ ID NO: 99603 - DNA, 165 bp, Homo sapiens
  chr8:58127855-58128020
  hypo
catctgggaggattgcggggtgtgcgggaggatgagctgggaaggattcaaggccttgggaggcaacatgtgaagatgattaaatatgtggcagaagaaacacctgagaagatgggatgcttgccagggggaacaagggacagagtggagcgtttgggagaaggg

SEQ ID NO: 99604 - DNA, 527 bp, Homo sapiens
  chr8:58130301-58130828
  hypo
ggaagacacatctgacgagatcgaatgttttgcagaagagccatgtgaccagatccctggtttggcagaggagacatgcgagaagacggaacgttttggccgaggagacatctggcagggtggaacggagggaacaggtgtggcagagagaatatctgagaagctcgcaggattcccagaaggagcactgggagtagattgcctgttttcccgaaggaacggcaagttccaaaggtcagaggctcatgtgaactctgtcgggttcaggagcagctcagtgttgctggtggcaagagtgtggtacgagagtggttgggcgtggtttgaatatctagaaaaggcgagctgagggtagatttttgaacagtccggagtaggaggggtagagacatattctatgggccacagccacattctcaggatgctcgtggctgtaaatagtagatgacccaagtaagagcggctgaagccataggcaccagaattgtgttggcatcgtcgtgtcacgctcacgttttcccttccag

SEQ ID NO: 99605 - DNA, 30 bp, Homo sapiens
  chr8:58132758-58132788
  hypo
gtgtggcagaaagaacgtctgagaagctca

SEQ ID NO: 99606 - DNA, 288 bp, Homo sapiens
  chr8:58171442-58171730
  hypo
agggccagaggaggccgctgagcctaaatcaggcagtccgcccagcagctgcaggaaggaggtaacaggcctctcagccccatccaggcggctgctgcacagtgcccagcgcccactacctagctctgtaagcgcaggccaaggcagagtggaccctagggaggagggagggcagtacgctcggcgacccttgggtgcacttgactgtactcggggacaagcccggccagccactatggtgggctcagctgcagctgccacctgcacatggtgcgctccagccgcagt

SEQ ID NO: 99607 - DNA, 32 bp, Homo sapiens
  chr8:58172070-58172102
  hypo
ccagcacggggaccccgcggccaggcagccac

SEQ ID NO: 99608 - DNA, 30 bp, Homo sapiens
  chr8:58174512-58174542
  hypo
gagagaattttaaagcggtataacaaaatt

SEQ ID NO: 99609 - DNA, 30 bp, Homo sapiens
  chr8:58245377-58245407
  hypo
aataacattatttaccgtatctgggccaga

SEQ ID NO: 99610 - DNA, 27 bp, Homo sapiens
  chr8:58276371-58276398
  hypo
ggcgtgagccaccgcacctggctcaat

SEQ ID NO: 99611 - DNA, 38 bp, Homo sapiens; identical to SEQ ID NO: 41804
  chr8:58716351-58716389
  hypo

SEQ ID NO: 99612 - DNA, 163 bp, Homo sapiens
  chr8:58906952-58907115
  hyper
agaagggtggggacccggaaggtggggtgggggcgggatggaggcggggcggggtgtacgaggggcgtgtacactggctcagggacacgcgctctcggccacagcaactggctccaagttccctccctcactctccggcgaagcctgcctgagccctcccact

SEQ ID NO: 99613 - DNA, 284 bp, Homo sapiens
  chr8:58907135-58907419
  hyper
cggccgccgccagccgggcccttcgcggccgcgcgtcctgggcccgttccgccagccccgtctgctctctacccgcggccccgcggcggcgaccgtgaacactcggcggcccctacagcccgctctcggcccttcgtccctcgcgggccccgactctccctccttgcagtcccccggagcctggctcccggctcgggccgcaccgccagggactggggtgagcggcccaggtaagactgggccgtgggggccgggagagagactgctgggcgggggttgggatt

SEQ ID NO: 99614 - DNA, 338 bp, Homo sapiens; identical to SEQ ID NO: 9561
  chr8:58907483-58907821
  hyper

SEQ ID NO: 99615 - DNA, 119 bp, Homo sapiens; identical to SEQ ID NO: 9562
  chr8:58907822-58907941
  hyper

SEQ ID NO: 99616 - DNA, 100 bp, Homo sapiens
  chr8:59059033-59059133
  hypo
agcccccggtgtgcccggctgccaagcgcgcactgggcagccccacgctcaaagtgttcggcaaccacgccaagaccgagagcggcgtgcagagggagaa

SEQ ID NO: 99617 - DNA, 178 bp, Homo sapiens
  chr8:591505-591683
  hypo
gttaatagcctgtatcgtaatgtatttcctcaaaggtgtctctcattccacatcgaaagaccttttcacacagattattcaaattatagcttaatatttcttgattaattgtactgggaggaggtagtgtgtctgagcgtgatctaatcagtggagaacgcagcggccgtcacgcctg

SEQ ID NO: 99618 - DNA, 36 bp, Homo sapiens
  chr8:592946-592982
  hypo
tgtgcaggtgggagacgccgccgagtcacttgttgg

SEQ ID NO: 99619 - DNA, 96 bp, Homo sapiens
  chr8:593203-593299
  hypo
tgcatgcgattcctgcgagttctctggcatgagacgatgacctagtaatggggtcgcagcagggacgggaagctggccaggcgcaggctgtgctcg

SEQ ID NO: 99620 - DNA, 28 bp, Homo sapiens
  chr8:5949415-5949443
  hypo
gatcggcaaactccgtcttttctatccg

SEQ ID NO: 99621 - DNA, 30 bp, Homo sapiens
  chr8:59747348-59747378
  hypo
caggcctgcatccaacgtgtgtcctacacc

SEQ ID NO: 99622 - DNA, 43 bp, Homo sapiens
  chr8:59960049-59960092
  hypo
tgctgggacaggcgtgagccaccgcgcccggctgaattgttct

SEQ ID NO: 99623 - DNA, 594 bp, Homo sapiens
  chr8:60030169-60030763
  hyper
gggctgagaaggcagcgcactaaatatctctgtatcaggtaaaaaagccgtttggtgatgactcgccaccaggcaaatgttgggagtcccaacgatttttcccgtggaatgcaccgagggtcgccatggatgtgcctgcaggggctgtgagtatcaggcagatttatcaccaagcgagagttgggcgtctaaaaggcccgcccagcgttttagagaactcaattctctctgccaacgttcatccaacgggactgcttagacacgtccaactagccctaggcgtgggcagtcgtgcccctgcgaccactctgggggaccggtccctgcgtgtcctccctctctgggatgagagagttcgagaagccgggagagtaaccccctccctcgtaccccctgactgtcctataggtggacccagccgaactccgcagcagcccaggccagcgccccacctccgggtcaccggcatgatccgcctctccccgggcccccgcggccctggcacccgaggtcagcgggccgtgggtacagctcagccgcggaccctgctccgcgagtgcgggagctttggacttgaacgcgacgtgctcgccc

SEQ ID NO: 99624 - DNA, 144 bp, Homo sapiens; identical to SEQ ID NO: 32013
  chr8:60030764-60030908
  hyper

SEQ ID NO: 99625 - DNA, 645 bp, Homo sapiens
  chr8:60031146-60031791
  hyper
tattatttttttaaacgccccccggcaaacctaggcagggatccttagccgcgaacagcaggaaggaaagaatccgagcaaatcgtgtcactttccgcacaatcgcggtgtttggcaagcccccggagctactccacaatatttactacccaagcgcacgcaggctgcagcgggctgcgagccgagcgcgcccgggaccggcctccgccaagccggccccgccgcggcccggccaccgccgctcccctcccaggatcaagcagcaagaacacggtggaaacaaaagcagagcgttcaccttgttgcaatagtaggggtccaggcagggagaaggtcccagacagggagcgtcgggcgcagcggcgggctgggctggaggtggataaaatcttacgtccatttcactctcacatcaagcaactccttttctttttccttttttaaaaaaaagtgttcagcaaaacaagcttagacggaacagagtgaggtgtctgggctcaggagtaaaagaaacaccttccttccctcacatccgtttgtggtttgtttaagaagaagaggaaaaaaaaaaaaaagaggggggaaaagcgctcaactctcccccaagccgcggcgcgcacccgtcggcgccgagcgcgcagcctg

SEQ ID NO: 99626 - DNA, 148 bp, Homo sapiens
  chr8:60032140-60032288
  hyper
ccagaggccggggaccggagaaaggaggagcggagaaggagaaggaggagagcacggcctggctgggacagaagcggtgggaccctgggaggcctccgctgtgcccgtgccgcgctcctcgggaccagcgcgtcgcacacaaaggggc

SEQ ID NO: 99627 - DNA, 269 bp, Homo sapiens; identical to SEQ ID NO: 32016
  chr8:60032490-60032759
  hyper

SEQ ID NO: 99628 - DNA, 30 bp, Homo sapiens
  chr8:60250268-60250298
  hypo
tggccatctcgactccgggtgggggatggg

SEQ ID NO: 99629 - DNA, 155 bp, Homo sapiens
  chr8:60265545-60265700
  hypo
actacaggcgtgagccaccgtgcctggccacaatccatttttttatgcataaatagttcattgactttttgaaggatcagcccattgtcttttagaatattttacctttgatttgtctgacagtttcctcatggttttaacgcaagcttgtccaa

SEQ ID NO: 99630 - DNA, 18 bp, Homo sapiens
  chr8:60270884-60270902
  hypo
ttcttttttttgagacgg

SEQ ID NO: 99631 - DNA, 30 bp, Homo sapiens
  chr8:60506155-60506185
  hypo
gatgaaatcttgggccgtcaggttccgtcc

SEQ ID NO: 99632 - DNA, 25 bp, Homo sapiens
  chr8:6063181-6063206
  hypo
aaaaataagacgatgaacaaggatc

SEQ ID NO: 99633 - DNA, 30 bp, Homo sapiens
  chr8:6072853-6072883
  hypo
aaaaaaaaaagtaaacgataaaaaagctaa

SEQ ID NO: 99634 - DNA, 121 bp, Homo sapiens
  chr8:6118678-6118799
  hypo
gggccatatgtcctgcgccgtaaagaaaggtagacctatagtttctctgctgtctctccttgcttccccctgctcctgccagcctgacgttttccccagttagaaccgcacacgtgggatc

SEQ ID NO: 99635 - DNA, 512 bp, Homo sapiens; identical to SEQ ID NO: 32017
  chr8:61193203-61193715
  hyper

SEQ ID NO: 99636 - DNA, 49 bp, Homo sapiens; identical to SEQ ID NO: 32018
  chr8:61193716-61193765
  hyper

SEQ ID NO: 99637 - DNA, 42 bp, Homo sapiens
  chr8:61194083-61194125
  hyper
actagtcccaagtcacggaaacctcggcgcatccccgcccgc

SEQ ID NO: 99638 - DNA, 30 bp, Homo sapiens
  chr8:61196626-61196656
  hypo
ccaaagtactaaggtcgcttcccagagtcc

SEQ ID NO: 99639 - DNA, 17 bp, Homo sapiens
  chr8:61205300-61205317
  hypo
gccgacactgtcctaaa

SEQ ID NO: 99640 - DNA, 30 bp, Homo sapiens; identical to SEQ ID NO: 41806
  chr8:61272270-61272300
  hypo

SEQ ID NO: 99641 - DNA, 82 bp, Homo sapiens
  chr8:61288499-61288581
  hypo
ctcaatccctcttaccgcttcaaaagatggagctgcactctcttttgggttttttgtttgtttgtttttcgttttttgtttt

SEQ ID NO: 99642 - DNA, 39 bp, Homo sapiens
  chr8:61325744-61325783
  hypo
tccatattgaccttccgctgcactcgcagagcgttttct

SEQ ID NO: 99643 - DNA, 86 bp, Homo sapiens
  chr8:61573279-61573365
  hyper
cccggtgtcagttgacgcccttctccaatcgcccaagagaagatggcttcaaaggccacaaacaatctccacggcaggacagagtg

SEQ ID NO: 99644 - DNA, 30 bp, Homo sapiens
  chr8:61627523-61627553
  hypo
gagggaatattctgccggcagccacaagaa

SEQ ID NO: 99645 - DNA, 30 bp, Homo sapiens; identical to SEQ ID NO: 41807
  chr8:61777517-61777547
  hypo

SEQ ID NO: 99646 - DNA, 119 bp, Homo sapiens
  chr8:61789866-61789985
  hypo
ccccagatggctggtcgcaataatgacgacgaggcggatggcggcggggaggctagagcccatttcagaagcctgcagtgaggattccaccagttcacatgcatcgggcactgagccct

SEQ ID NO: 99647 - DNA, 505 bp, Homo sapiens
  chr8:61822378-61822883
  hyper
ttggcgggctgggggcggcgtgcgccgagctgggcgcgagtggaggggccggcggctttgtgcgcccccgccagtgcccgcccgcagccccgccgcagcgtttaaccttgacttctccctcctcgcttctggcacgggaggaaagcctgtccagatgggcgtcctgagtgtgacgacgtcccctcccgcccccgcgctctcgcgcagatgtcgcacgctgccctgggtcccgccacaccgcccaccaaggccgcgggccctgcgcgcccggggcaggcgggcacatcccgcaccctctccgcccgcccgcccccggcgcccttcgcattcccttcttcggccctggcccctcggaccggagcgcccaggccagctcagggtgttcccgtgggggtctccggaaacaatggtgagcctgtgctctgctggctggggggcgtcgtccccgcagctggcgcgtccctccaggctgagcgcccagcgccccccgcggccctaagttggg

SEQ ID NO: 99648 - DNA, 22 bp, Homo sapiens
  chr8:62186531-62186553
  hypo
tgtagaccggagctgttcctat

SEQ ID NO: 99649 - DNA, 482 bp, Homo sapiens
  chr8:62200502-62200984
  hyper
agaaggacagagaatcgggcgcacacgcctcctaccaaaatcacagccccttgtggagcccgagctctcattcacagctttctagagaaatctgagcccgaacctgccagaataggggatctcacccacccagttcagcagcgaggacacctgcagaaatacattcccaaagcaaggctgggcggccgtgtgaaggtatttgttaccttttttctcccctctgtatttgccgagcctccccgcctttcccccgctctttcgatgccatggctgcggcgtttcagcacttcggtatgtggacagctcccatctgcaatccctctgcactccatccctcccgcaccgcaccccgctccccgccgcctccgcggtccatcctcctcccggcgcccgctcagcctgcgcccccttacacatcagcacccccatctccaccatcaccgtcatcatagccaccatcaccagcgcggtaactatagtca

SEQ ID NO: 99650 - DNA, 30 bp, Homo sapiens
  chr8:62212751-62212781
  hypo
gatcgatgggttccccggggtgctggaaaa

SEQ ID NO: 99651 - DNA, 108 bp, Homo sapiens
  chr8:62221730-62221838
  hypo
ggcctattcagtcctcgatgtgagtgggaagaaagaaagtggagagggacttgttggttcagtttgaaagtgaaaggggtgctgaccaattgacgaggcttgttacgc

SEQ ID NO: 99652 - DNA, 49 bp, Homo sapiens
  chr8:63056935-63056984
  hypo
aggagagacctccggcggcagggctccaacaccacgaacacaaagtcgt

SEQ ID NO: 99653 - DNA, 1811 bp, Homo sapiens
  chr8:63160266-63162077
  hyper
caggtacaacaaatgcgcccataaaatctgtctttgagccctgatgaaatttcatcctctgcagaacgcctccgctctgttttattaggtgggagagagcaggagagtttccacaggattcagagagagtttgtccgtatcttaactatccgagatcttctttccaaatccttctcaatttatttctgtgaagatatatttatacctattccggaaaccttctccatttctagaaaaagctacgcatcttcttcttcctcgacttctcttttctccctcccggtgaggatttcaaagggtatgtgagaaaagaaccttaagccaggtctccccgcggcgtcctggctagtcccggcgccctgggcgggtgcatcgctccgccgcagcgccccttgccacccaactctgtccaactttccctttcagactccagcaggggcgccctccaggcaaccggctgtggcgggcagaagcaagctcggatgggagacccccgagctgcgtgcccagcgccggctcaacagacttgcccgcgcagcgcccgcgggccccctcgcatccgggcaggttccggagctgggccttgcgctccccggcgcccgcccaccctgggtgtctcgcgtcccggcccttcctccccggaacccaagctaacccaactcccatcctcgccacctctggggcagctcaactaagccgtgtcccctcccttgcaaacgcgtccgaccaccctcccaacccccagcacaaccctcagcaagaaagcccagctgggtctacccagttacaccggtcaacgagggtctccatcgccgccggccgccctaattcacgctcattcatattcattctcttttctctctgtccctcttcctttctccccaaagactcttaactagacaggccgatcctccccagcggcactccctttcattcttcccttcccaccacacacacacacacacacacacacccggacccagacagcccactccactttccagacgcccacctcctacatactcccctcccctaaacagacattcacccactcgccatctgtagcctccttccaaccccccgccccgcccgcctggctccccctccccaagaaacagacctgcacagtgggacgcagggacccccgccagacgctcgggtcgtgcgcaccgcactgacctcggcccgccccgccgggaaactaacaaaggcgggcgcgagccccgagccctggagccgcgagcggcggccgcggggccgaggagcctgggccgggccgggcggggactactccggagtcaggaggcagcagcggcggaggacgaggatctctggcagtcagcgccgctcggacgccgccggcaccatgggctgctgcaccggacgctgctcgctcatctgcctctgcgcgctgcagttggtgagtgccccgagggcccctgccccaggacaggtccctgctccaggaccggcctctgcgactccctctgcggttccgcagctcccggcaaggggcgaacgggtgaacagggcgctccgcccgcctcccaccctccccaccgcctggctgggctcgcactgctctccagccgcgggcactcgccaggtcgcccctgccctgcaggagggcgcggtctcacccccggtcccatgcgctggggttcgccgcgctcccgccgggcgtcgccacgcggtccaggggccaggagccggcggagtgagggattttcccgccccttgatccgatacctggtttagcaccctccgcgttcgtgctgaagttacacggggacttgcgggctctttcttct

SEQ ID NO: 99654 - DNA, 168 bp, Homo sapiens
  chr8:636372-636540
  hypo
agtaactatgttttacgaaaataaatggcaataagaacaaatgcattcttttcttttgtttcttcctaggcaagctaaaaaaaaaaaaaaaaacaaaaacaaaaaccatgtagatcccacaggtgagttatttcaaagttcatgcctgacacccggcacccacagtct

SEQ ID NO: 99655 - DNA, 233 bp, Homo sapiens
  chr8:63998335-63998568
  hyper
tgaggtgcgcactgccgagcgccctgggcacgcacgcttacccgccaggccaggtccagatcgaaatcccgggcgcgcaggaaccgcagcaggaaggagtcggtgagcggcagcggcgcgagcgggacgccagcttcccgggcccggcgccgcagcgccgccaggcccggctgcagcaacggagagtggtccggtagcgcgttgagctgcggccccgccgagggctgggatcg

SEQ ID NO: 99656 - DNA, 24 bp, Homo sapiens
  chr8:64023520-64023544
  hypo
caccgcgcccggccttaagtgttt

SEQ ID NO: 99657 - DNA, 30 bp, Homo sapiens
  chr8:64039936-64039966
  hypo
tgtcatctgtcccttcggtcactgagatat

SEQ ID NO: 99658 - DNA, 191 bp, Homo sapiens
  chr8:64224292-64224483
  hypo
tcagagcctaaacaacgaaagctggtaacttaacatctcagaaggtgcaaatggaaataccctctgcgggtagttacgcagtaacacacagattaatggagagtgggagtgtctagtgaactgcagagcacacactcagtctaaataggtaggtgttacttgtattctgccgatctcgttggtaataaatg

SEQ ID NO: 99659 - DNA, 210 bp, Homo sapiens
  chr8:6434302-6434512
  hypo
aggtgatccgtccgcaggtgagccacccgcctcggcctcctaaagtgctgggagaggcacaggcgtcagccacagtgcctggcctactgtcttctctaaaatggcatctgtgcattcatctcagccgcccctgctcagataaaagcaatggcgcctcctttgaaatctgagagacgcagggccctgcccattctgcggaattccttctcc

SEQ ID NO: 99660 - DNA, 167 bp, Homo sapiens
  chr8:644635-644802
  hypo
cagacaggagcaccacgaggggcctcacggcttgctcgtctgtgaatcacggtgaccatgtaacccataataccttctggttctaactttttatattcttttgggtaatgtatggtttactgtgaggacacttacgccttgcacaagttgaacgttacatgtcttga

SEQ ID NO: 99661 - DNA, 22 bp, Homo sapiens
  chr8:64511304-64511326
  hypo
aatagaacgaagaaaggaggac

SEQ ID NO: 99662 - DNA, 30 bp, Homo sapiens
  chr8:64557179-64557209
  hypo
ctcctggttcttcgacgctgacatttttaa

SEQ ID NO: 99663 - DNA, 47 bp, Homo sapiens
  chr8:64617631-64617678
  hypo
tgtcagtctgttctccggggcgcgggtgggggcgggaggaagattag

SEQ ID NO: 99664 - DNA, 41 bp, Homo sapiens
  chr8:647337-647378
  hypo
gagaagccggtgcaacgccgaccccacgagcaactgaatcg

SEQ ID NO: 99665 - DNA, 30 bp, Homo sapiens
  chr8:6526266-6526296
  hypo
cccctgggccaccaacggatatgttaggaa

SEQ ID NO: 99666 - DNA, 463 bp, Homo sapiens
  chr8:65281329-65281792
  hyper
ggggcctctggtcagcgctgattaataagtgttttttgttgtgaagtgttgaataatagaggatggccggtgacccagtaaggactaaaccttgcgctggtttattgtggcaagctgagaaaggggctttaggcccgggaccccaggcactgacccgcacacatcccgcggatcgcctattcattcgcacagccctccagtcgcccaggctcccattgtttgctgagcaacaatggagatttcgcagggaaagtaaagctcttttcagattcctctctgatgttttgcatttagggaaacaccgacctccactttttcccccgacattttccctcctggcatttaaagctgttcgttttcggggaaacttctgtgagtttcgcgcttgttcgaccaacaccagtgttaggaggaggcgagaccggtggaaaaaggagagccccagagatttcccgtgtgtgtg

SEQ ID NO: 99667 - DNA, 153 bp, Homo sapiens
  chr8:65281852-65282005
  hyper
ctgcctctagggagaaaggggaggggggaggggagaagaaaaaggaaagagcgcgtttcctcgccggggttaccggggtggcgcgggcttcgcggccgaggggctgccggcccggcccgcagctcctcgcggccggctgggaagtggcgggtc

SEQ ID NO: 99668 - DNA, 109 bp, Homo sapiens; identical to SEQ ID NO: 3277
  chr8:65282332-65282441
  hyper

SEQ ID NO: 99669 - DNA, 332 bp, Homo sapiens
  chr8:65283762-65284094
  hyper
tagcattgccagagtcgggggagaggggaggatgctgggtaaagtgcccacccggggtggtctaaagtcgtcaccccacagagcagattctgctgctaaccagagcagagagccgcaccttcccagcggcgggccccagtgcgcacagcgtgactttgcctcccccaggctcagcaagtcgttgacgatctttagcagtcccgcatcccaggtcaataaactggaaacggatagaatgagaatcatggatgagagataaagggcagcggggtgatgcgcatttcttgtagtgcctccaaaaaaccgtggtctctcgccgctaataaaacacc

SEQ ID NO: 99670 - DNA, 4 bp, Homo sapiens
  chr8:65286063-65286067
  hyper
ccac

SEQ ID NO: 99671 - DNA, 765 bp, Homo sapiens; identical to SEQ ID NO: 32029
  chr8:65286370-65287135
  hyper

SEQ ID NO: 99672 - DNA, 1302 bp, Homo sapiens
  chr8:65289049-65290351
  hyper
tttagttttagacaacgtattcaaagtacttgagaagaatatgcaatgacattttttccgtgtcctaatcaggaccatggtgaggtccccgtggttcaccgagtggtggtccagggctctggttgggacgctgagttaggttggcaaagcgtcattgttttgaaaggcacattcgtccggaatggcattcgtgataagattaaacataaacctaaaccttggcctcgggggaaggcaggctgcggggttgagaagaggagatgcagattagctctgcttttgctgcttgcgcacataattaagaggcggtccctcagctggagcgtgggctgtgtccggcctaaggtgcttattttcctgttacttggccaaccgagtgtgagtgaacaggagcccgagagcttaaatgtgggatctagataaggtgtcgactgggttgtgggcgtttgtctccatgttagggagaggcaactgagaacggtgactttggcttgttttgagagagcctgggttttgacagcaggacggcgaagggagcgcttggagaggctggaagctcgacgtcttagggagctgcctgcgggcactgggttgacgccaagaggttgtcggcaagggcagggctcttgccctctgctgtacctaggctctgcaactgggggctgcgagccttctgcggctctttggtttcaaggacacagcgagctgctcaggactttgggagccaacatctgtctgactggtgacgtcagcagcccgtgtaatcctcttgtgctgaaggcagatgccttatttgtttggctggagcgagccattaatccctaattctggatcagcaagcgagggggaaagaccggaccgctccgacccaccccctccctacccccacctcccaccttaaagcaccttataccacggaaggctctcagcctcttctttcctctgcgaacgcgctgagcagcgattgaaaacgttttggtcctctgcaggtttgaacagggctagcaggtctctctccggatttctagggctatgggtatatgtaattctttctctcatcgatcgtttcgattctcttgccggtcttgcagtttgcagggtcctaaacgaagaggggtggagattcgagagtgcgggtctggcgtgtggtccaagggagggggtgaggctgggaaagggggtgcagaatgcgggaacggctgggactgcacagaaggaccatctgcggactcgttttcactgctccagctcccgaaatcgtttctctggacgcggcagtatccgcagcgcatgcaccctcct

SEQ ID NO: 99673 - DNA, 27 bp, Homo sapiens
  chr8:65290655-65290682
  hyper
tctctctcctttcctcggactctggag

SEQ ID NO: 99674 - DNA, 546 bp, Homo sapiens
  chr8:65290897-65291443
  hyper
cgctgccctgagcctaatccctcttccgggcccagacccgaggtccgcgctcctgggcagtggggaagctttagtgagcaggcttttctctccgcagcaaacttgtagccagaccagatgggccgcccagctctctcgggactaggcaggtgcggatgagttaatttttccgcattacaaagaaagatgacccagcccgcccttggactctcttttcccaaaatctcccaaccaaacccgcggtaacgttatcaaaggacacagagcccaggcatatctgtgtgtttatcttacaggcacacacgcatggttttctcttttatatgctagatttcatccctgacagcagaaaatgattggcaatggttatgacggagaacatgcaatagcgtggtccttaaaaacctgccattccttacaagtgccttagaaaggattcagggcgaaccaactgggttaattgcattcagtaaaataacacgattacaaaattagatctgtaccagaggggtaattaacttggatccacgccgtcatttgaaaact

SEQ ID NO: 99675 - DNA, 268 bp, Homo sapiens
  chr8:65291758-65292026
  hyper
catacaattaaggcacgcggtgaatgccaagagcggagcctacggctgcacttgaaggacaccaaagcatctcagggtcagaaaggggaaaaagcaattgcagggaatttagggggtagtaaaaggaacccatctcttgccgcataaatgccccccacccccacccaggactgattctggaagcaacctagtgttcgaaagggaaaggctcctacttttccattacagccgcggaaatccgcaggcaaatctccgaggagaattttag

SEQ ID NO: 99676 - DNA, 305 bp, Homo sapiens
  chr8:65292571-65292876
  hyper
ctgcaggggttgggaacaaaggagaggagctaagaggatgcaccaaagtagccgcgccctccctgcctggcgctgtccgcggtgctgaccgtggcccttttctctctccgtaatcaaactggaaaagcaataggaccgtcccgtccctactcaaaagaagagtaggatattaggtaatttgaaaaataacatttaaaaagagaaaaaggtcacatacagcaaaacaatattttactgaaatcgttccctcaagctggttgctacccttgcctgacactttttggtcttcacgtaggaatgcacac

SEQ ID NO: 99677 - DNA, 33 bp, Homo sapiens
  chr8:65293161-65293194
  hyper
gcagcttgccaccttcggccaggccttgcagcc

SEQ ID NO: 99678 - DNA, 111 bp, Homo sapiens
  chr8:65293265-65293376
  hyper
cgcatcccagccggcgggaggcactggagggccaggaggcctgaaacccgcactgcggaaaaaccgacctcagccacatcctcatagctcacgcgacggaaagaggcaggg

SEQ ID NO: 99679 - DNA, 17 bp, Homo sapiens
  chr8:65385219-65385236
  hypo
tccgtctcaaaaaaaaa

SEQ ID NO: 99680 - DNA, 30 bp, Homo sapiens; identical to SEQ ID NO: 41694
  chr8:6542607-6542637
  hypo

SEQ ID NO: 99681 - DNA, 152 bp, Homo sapiens; identical to SEQ ID NO: 32039
  chr8:65488217-65488369
  hyper

SEQ ID NO: 99682 - DNA, 361 bp, Homo sapiens
  chr8:65488704-65489065
  hyper
taatctctctgcctccgagtagatcccgcgctcccaaatccggcgggggcgcagtatggtgaaccccacacctagctccctcagctgcgtgggtttcaagctgacccaggcgccaccaggcagccccgagtgggcgagtcaagtgcaacttcaaggtcaatgtgcctctgactggggcctggagagctgccaagaatgctgggcttggagcgctggggtcgcgccccgctactgcgccttggaccccgcagtggagggcgctgagaccgcacccccctccccgggcagttttcaggagagggtccagctggggtctccgcggtggggtccagaaacgatattccgggttggattcttcctc

SEQ ID NO: 99683 - DNA, 63 bp, Homo sapiens; identical to SEQ ID NO: 32042
  chr8:65489066-65489129
  hyper

SEQ ID NO: 99684 - DNA, 115 bp, Homo sapiens
  chr8:65489468-65489583
  hyper
gcactaatttcaatgcggtgctgtctgctgaatattttaaactcctttcaaagcagtaggtgtattccctcccgcagtaacaaaacgatattcatctttacacaaggtgctctgg

SEQ ID NO: 99685 - DNA, 317 bp, Homo sapiens
  chr8:65489865-65490182
  hyper
agttttcattctaagcggtcatctgtgagtcagaagatttcgccgtggcctgatttcccaccctttctgcccgcgcaagccgaaagcgctcatgttggcttttcctttgccacttttccaacttgccagttccatcaggagcccggatccttgcccagcttcttggcggagccaagttcgagcgcacagatttcccgagctccagcggccagggggcactgtgtgagcggctgacgtcacccctccgcccggccgaaaccaggcggcgggatcccacacagttgaggagagggagccgaggccgtgacttagggctg

SEQ ID NO: 99686 - DNA, 30 bp, Homo sapiens; identical to SEQ ID NO: 32043
  chr8:65490463-65490493
  hyper

SEQ ID NO: 99687 - DNA, 30 bp, Homo sapiens
  chr8:65492377-65492407
  hyper
agaccagtcatcctacgaacaggggtggag

SEQ ID NO: 99688 - DNA, 912 bp, Homo sapiens
  chr8:65492667-65493579
  hyper
ccttgcaaacatatgcgctaagctgtgtatacagatggcaggcagaataatggagcaggcgccttttataaagctctagctgctgcctgtcttcagacctgggaaatgaaactattcagacttgcggccagatagcgcctgcgattgtttgttaccgttttaatcctattaattaaaacgttaacctgattgggtagaaagcgctgtcccaacaggcgagtcttcttcataataacctactcagagataatgatgtaaaagactcccccgtctgtggcggcggctgtttgatgggtccggaaatctcttgaaggtgaatccaagcaagataaacggtgcggagaggaggcgcggggctgggctcagagcggcggcggcggcggctccactccctccgcgcccaccctcccaccatgcggggccgcggcccatggtgagccccagcagccagcaccatcggctggagacgaagaagaagaagaagaggaggcggcgagcgcgggggaaggcgaaaaagaaaaagaaagaaggggagagggctcccggcagcaccaggaccgacgcgcgcaccagctccggagcccagctcgcgcgcgtctgtggggccgcctgactccggggccgaggcggcggcggcggcagcgggcgcggcggcccgggctgcgcgccggcgcgggaccatggagcgcgggatgcacctcggtgcagcggccgccggcgaggacgacctcttcctgcacaagagcctgagcgcctccacctccaagcgcttggaagcggctttccgctccacgcccccgggcatggacctgtccctggcgccgccgcctcgggaacgcccggcgtcctcctcctcgtcgcccctgggctgcttcgagccggctgaccccgagggggcagggctgctgttgc

SEQ ID NO: 99689 - DNA, 149 bp, Homo sapiens; identical to SEQ ID NO: 3283
  chr8:65493806-65493955
  hyper

SEQ ID NO: 99690 - DNA, 25 bp, Homo sapiens
  chr8:65494076-65494101
  hyper
cggcttaacatcaatgcccgagagc

SEQ ID NO: 99691 - DNA, 209 bp, Homo sapiens
  chr8:65494102-65494311
  hyper
ccggcggatgcacgacctgaacgacgcgctggacgagctgcgcgcggtgatcccctacgcgcacagcccctcggtgcgaaagctctccaagatcgccacgctgctgctcgccaagaactacatcctcatgcaggcgcaggccctggaggagatgcggcgcctagtcgcctacctcaaccagggccaggccatctcggctgcctccctgc

SEQ ID NO: 99692 - DNA, 85 bp, Homo sapiens
  chr8:65498465-65498550
  hyper
gaagggttagctttgcgtgtacgactgcaggaccagcaaatgatcatcttcgatagagctctctagttacccgtgcttctccctc

SEQ ID NO: 99693 - DNA, 204 bp, Homo sapiens
  chr8:65498610-65498814
  hyper
gcgcacccgcacgcagtctgcaatgccctcaccagtccccgcagctgggcaacccctccaagaccctgtgttacgcttaaattcctctccctcctatcgtacccaccatccatccttacagcagggaggccgagactcacagaattcccttctccaccaactcgcactcttggtctagcacgcggaaaccgaacctttctacgc

SEQ ID NO: 99694 - DNA, 45 bp, Homo sapiens
  chr8:65499022-65499067
  hyper
gttcacttcccggctcgcagcacatcgtggcggccctgccgggag

SEQ ID NO: 99695 - DNA, 357 bp, Homo sapiens
  chr8:65499733-65500090
  hyper
aaacacaccaaatgacgtccacgcagcactcgcgcccaccgcgctgtttttgcttgcgcagtgctcccgaagggattcgggatccgcatccggagggattcgggatccgcatccgaagagcaccccttctctcaggacttcccctgggaccgacgtttccagtcacccctgcgggcgcaattgtccttcaaccgccaagctccttgggacaaaaagagaacttcaggggctctgcctcaaactgtccttcgagggtggctcgaggatcgggttgtcccctgtatggcagcaggcatgtgggttcacacgcagctgccaggcttgtaagaggcaccccgcagccgcaccaaacccgaa

SEQ ID NO: 99696 - DNA, 50 bp, Homo sapiens
  chr8:65519445-65519495
  hypo
ccaccagccccagtacgaatgcaggcagagctatacgttgagaagaatga

SEQ ID NO: 99697 - DNA, 30 bp, Homo sapiens
  chr8:65615338-65615368
  hypo
gtacggcaataatatcgggcatgcagaacc

SEQ ID NO: 99698 - DNA, 134 bp, Homo sapiens
  chr8:65710950-65711084
  hyper
cctcgccatctgggtcgcgcgcggcccgcggggcccagggcgcatgcgtggcctggcggccgaggcgcttacctggtgcgccggacaagcaagcagagggccaggagcagcagggccgcggcgagggccaggcc

SEQ ID NO: 99699 - DNA, 148 bp, Homo sapiens
  chr8:65711221-65711369
  hyper
cggcttctctcggcggcgccccctagtccagggccggagaggctggcctgcccgcagcgcagacaggaatgtcaccgtggtctcccaggctgaatgacaaaagttcgtggactgccccctccccgcctatcctccacccacgcgtacc

SEQ ID NO: 99700 - DNA, 13 bp, Homo sapiens
  chr8:65711370-65711383
  hyper
ccccgttccccca

SEQ ID NO: 99701 - DNA, 30 bp, Homo sapiens
  chr8:65738006-65738036
  hypo
acagttatgctttaacgttttttcttctgt

SEQ ID NO: 99702 - DNA, 90 bp, Homo sapiens; identical to SEQ ID NO: 15127
  chr8:65749819-65749909
  hypo

SEQ ID NO: 99703 - DNA, 33 bp, Homo sapiens; identical to SEQ ID NO: 41815
  chr8:66055590-66055623
  hypo

SEQ ID NO: 99704 - DNA, 24 bp, Homo sapiens
  chr8:66216965-66216989
  hypo
gcgagactccgtctcaaaaacata

SEQ ID NO: 99705 - DNA, 30 bp, Homo sapiens
  chr8:6637553-6637583
  hypo
agacttcaccactatcgaagatatccctgt

SEQ ID NO: 99706 - DNA, 29 bp, Homo sapiens
  chr8:66500568-66500597
  hypo
caacaggaaacctcacgctattttctttt

SEQ ID NO: 99707 - DNA, 23 bp, Homo sapiens
  chr8:66545046-66545069
  hypo
cgatactccgtctcaaaaaaaaa

SEQ ID NO: 99708 - DNA, 32 bp, Homo sapiens
  chr8:66548717-66548749
  hypo
atgtctaaacttggccgggcgtggtggctcaa

SEQ ID NO: 99709 - DNA, 92 bp, Homo sapiens
  chr8:66560181-66560273
  hypo
taaaatgcctactgacgtactatgcctatttttccattgggcttttgatcatttgtttgtttgtttgtttgtttgtttgttttgagatggag

SEQ ID NO: 99710 - DNA, 79 bp, Homo sapiens
  chr8:6663499-6663578
  hypo
agctgccgcagcagacggaggatcagtgctctgaggggaaatgccattgtgaagctgtgggtgacggccacctcctgag

SEQ ID NO: 99711 - DNA, 411 bp, Homo sapiens
  chr8:6692051-6692462
  hyper
ccttccagtccggggcgcggagccagggcgcttgcgcgtcctccgtgtgcgtcctgctcggcgcgcctcggaagcagcgggacctgcggggacgcccgcgaactcagggaaaagtcccaaggcggcgttcccagggtaccccctcttccaccccagggactctgcccgggaaaaagcttccgcagggagcccggcggaagtgggcggagacgctcctcccggcactgaaggagttacgcgttcaaaccagaagggcgcgaaaaatggggccatcttgctccgccgcggctggcgggctctgggttccccctgcgacggaggtggcctcgaagggccgcgtcccgccccgtcctaaaccccgaagcggagtcgccgtcctacagggccgcgtggatgcggagccctgtcccc

SEQ ID NO: 99712 - DNA, 484 bp, Homo sapiens
  chr8:6692686-6693170
  hyper
aagtcaagcaccagtcgggaggggggggaaccgagcatgggtggaggaaaatcatgcatccttggggggatggtgcatgcgtgggcatctactaaggacgggaggacgtgctctgcaggtgggatggccaccaccgtgcgtcaccggcgcgcagtgctgggcgcaggctggggcagtgcccgcccgggcataggcagcctgtgcggctcccggcgccggggtggggttaggggctgcaggggtgagcacagcctcgggctgccgcactcacgcgcgctctgctcggccgcctgcagcagggccgagagccccaggagcctcgcgtgcatcttccgtgccgaccccgcagcctgcgcccgccccttcccctgcacgcggccccgcgtcggggaggtttccggcccggggcccgactgcgggtggcatttctggctaagccgttaggcgcgaattgtatgtctggtttattcgtagtggccagcag

SEQ ID NO: 99713 - DNA, 380 bp, Homo sapiens
  chr8:67024905-67025285
  hyper
atgtcttagtagatgcggtggaaccagctctgtctacagaaccccgggcttcagtggcgtcttcctaacccggcttgcctgccgggggcgttccgagaccctcggggccttcccttcaccccgcgggagttggaccggtggcgctggtaaggcctcccgggctcaaagtgcaacggacactgcagaaatccaaactgctggcattcgcggtttggggacgccagaggaggtaatgatttctggtttgttaacctcaagtgacaataatgccgagccaggcaggagctggacctacaatcttctgatgcgtggtcagacacgttatcccttgcgccactggcctaccacgctactccttcagtcgccgttggattactgtg

SEQ ID NO: 99714 - DNA, 23 bp, Homo sapiens
  chr8:67028548-67028571
  hypo
agactagaaacaggtcggcatgg

SEQ ID NO: 99715 - DNA, 615 bp, Homo sapiens
  chr8:67089421-67090036
  hyper
gcctccggcgaggagcgaggaggcgggcgaaaggggagcggccgggctcttgttgaggttccccaggcggaggaagtactcctctcccatgcggagcaggaccggccgagcctgcggctgctggggctgctcggactgcggcggcggctggaagaaatccaagggctgagggtgctgcggcgcctgccgagctcccgggaccggcccgcggctcaggagcgccctgcatggcgggcagggcaggagagccaccagcaggactcccgcggacacaagcagcggcagccgcatgttaggggcactcgctgcggcacagaggtgggcggagggcggaatgagagaggggaagagagaaagaaagagttggttagagttcgctcagctgggaggtgcacacggggtcttcctacgggactgccttagacgtgctgggctttggcctcagtgattcggatgggcgctgtccgcggtgctgaagcgcctggggagcggggaaagggggcgcctgcagggctccgcacctaagctcatgcgctcaccggccaggagtgacccttctttctagactctgaaaggacggtccctgcgtcctcttcctaacgatcctcaaaacta

SEQ ID NO: 99716 - DNA, 201 bp, Homo sapiens
  chr8:67117726-67117927
  hypo
aaaggaagcttccaacggcagatggttcacctggagaaggttcactactctagccgtgacaaattctctcttcacattgggcacgctgtatcaattatcttgtcaactgttatattgtctatcgtgtcatcaatgggtatttccttcttttggctgtagatttgtgggggataagatgaagacttccgtgcattaagaacc

SEQ ID NO: 99717 - DNA, 156 bp, Homo sapiens; identical to SEQ ID NO: 32053
  chr8:67344509-67344665
  hyper

SEQ ID NO: 99718 - DNA, 36 bp, Homo sapiens
  chr8:67344666-67344702
  hyper
aggggcgggaggcgggcagcctccgtgattggccgg

SEQ ID NO: 99719 - DNA, 61 bp, Homo sapiens
  chr8:67344809-67344870
  hyper
cgtgagtgcggggccggcgggcgggcaggggaccgcagggtgcccacgcagccccctgggt

SEQ ID NO: 99720 - DNA, 30 bp, Homo sapiens
  chr8:67345235-67345265
  hyper
aatgggatgaggggacgaggctaaaaccgg

SEQ ID NO: 99721 - DNA, 30 bp, Homo sapiens
  chr8:67371236-67371266
  hypo
tctcccagccagccccgtatctggttctat

SEQ ID NO: 99722 - DNA, 24 bp, Homo sapiens
  chr8:67580710-67580734
  hypo
gggcgcggtggctcacgcctgtag

SEQ ID NO: 99723 - DNA, 23 bp, Homo sapiens
  chr8:67580974-67580997
  hypo
caagactccgtctcaaaaaaaaa

SEQ ID NO: 99724 - DNA, 30 bp, Homo sapiens
  chr8:67638459-67638489
  hypo
aaatactcataataacgctgtgggatgggt

SEQ ID NO: 99725 - DNA, 21 bp, Homo sapiens
  chr8:6774704-6774725
  hypo
ttcattttggctgggcgcggt

SEQ ID NO: 99726 - DNA, 95 bp, Homo sapiens; identical to SEQ ID NO: 795
  chr8:67873327-67873422
  hyper

SEQ ID NO: 99727 - DNA, 1 bp, Homo sapiens
  chr8:67873798-67873799
  hyper
c

SEQ ID NO: 99728 - DNA, 251 bp, Homo sapiens; identical to SEQ ID NO: 797
  chr8:67873800-67874051
  hyper

SEQ ID NO: 99729 - DNA, 509 bp, Homo sapiens; identical to SEQ ID NO: 798
  chr8:67874164-67874673
  hyper

SEQ ID NO: 99730 - DNA, 103 bp, Homo sapiens; identical to SEQ ID NO: 799
  chr8:67874755-67874858
  hyper

SEQ ID NO: 99731 - DNA, 402 bp, Homo sapiens; identical to SEQ ID NO: 800
  chr8:67874859-67875261
  hyper

SEQ ID NO: 99732 - DNA, 179 bp, Homo sapiens; identical to SEQ ID NO: 801
  chr8:67875262-67875441
  hyper

SEQ ID NO: 99733 - DNA, 255 bp, Homo sapiens; identical to SEQ ID NO: 32062
  chr8:67875442-67875697
  hyper

SEQ ID NO: 99734 - DNA, 386 bp, Homo sapiens
  chr8:67940624-67941010
  hyper
ttttaacaaatgtcccggaaagtcttactggcaggcaagtttgagaaacatggttctagggtttcctcggtccccacgcttattccccgcgggcagctcaccgctcgcgggacagtccggtagctaactccagtttggtcggtttcatcggcgccgggtccctacgcagaccagcggcggttgctgggcgaccagacgcgctgtccaagcgccgctcacgagaaatctcgcgacatcgcaggctgctccctccccggtgggtccttcccctgtgaggcggcggccgggcgctgatgggcactgacggtggtcactaggccgactccgactagagtcctgttagcttgaagaggccgtgaggcatcggtcaccgcattgttttagtg

SEQ ID NO: 99735 - DNA, 30 bp, Homo sapiens
  chr8:68107540-68107570
  hypo
actacaagagacctgcgcttatgtctcctg

SEQ ID NO: 99736 - DNA, 105 bp, Homo sapiens
  chr8:68347722-68347827
  hypo
gtgatggggaggagacggcaggtgcggggaggctccggccttccttggtgccccgccctttgtttgcactattggacttaggagtgccgagggtggggagatgga

SEQ ID NO: 99737 - DNA, 171 bp, Homo sapiens; identical to SEQ ID NO: 31737
  chr8:686714-686885
  hyper

SEQ ID NO: 99738 - DNA, 56 bp, Homo sapiens; identical to SEQ ID NO: 3192
  chr8:687162-687218
  hyper

SEQ ID NO: 99739 - DNA, 129 bp, Homo sapiens; identical to SEQ ID NO: 3193
  chr8:687513-687642
  hyper

SEQ ID NO: 99740 - DNA, 29 bp, Homo sapiens
  chr8:68780039-68780068
  hypo
gtattcataaggatacgattttttttttt

SEQ ID NO: 99741 - DNA, 139 bp, Homo sapiens; identical to SEQ ID NO: 3194
  chr8:687837-687976
  hyper

SEQ ID NO: 99742 - DNA, 242 bp, Homo sapiens
  chr8:688498-688740
  hyper
cgaggcgctacccagcgcagggttttgtaactaagcctcccccggcagcggctgttgctgtctccggctccttcgctaacgattgcaggagaaataatgaggatgtaattattacagccctgcgcggagggctggggggcggcggacgcgggctcctctgcctgcgcgcccaggtggggctgggctgggctgggctgggctgggctggactggacgcctctccccgcccggccctccctcag

SEQ ID NO: 99743 - DNA, 76 bp, Homo sapiens
  chr8:68864043-68864119
  hyper
cttaggagtaaccctcgagctgcgccttggagtgtgtgtccctgggattgggaacctcctgtgagttccatatcaa

SEQ ID NO: 99744 - DNA, 16 bp, Homo sapiens
  chr8:68864179-68864195
  hyper
gcgtgtgtgtgattag

SEQ ID NO: 99745 - DNA, 351 bp, Homo sapiens
  chr8:68864545-68864896
  hyper
cgccgccgggggccgggcagcagcgggcgcgcgggtcagcgctcagcacggcgggcagcgccgcgctgcgcaccgccgccgaccatgagcgaggacagccgcggagacagccgcgccgagagcgccaaggacctggagaagcagcttcgcctgcgcgtgtgcgtgctcagcgagctccagaagaccgagcgggactatgtgggcacgctggagttcctggtgtcggtgagtgtccccggcagacgcagggggacgtccgggcggcgcggggcgcgggtcccggagtggctgcgggaaggacgcgcggcattgtctgtgcggggacccgggacgggtcggggcatcacaggc

SEQ ID NO: 99746 - DNA, 126 bp, Homo sapiens
  chr8:68865314-68865440
  hyper
gtacagagagagcagcggggtgatgatctctagcagctgttggatattaaagccacatgtggcgctcaccctgtcctagtcttacaattccctcccccccgccccccgccccggcttaaatctgtc

SEQ ID NO: 99747 - DNA, 111 bp, Homo sapiens
  chr8:689295-689406
  hyper
ggtcccagagcctggcggagcccgacaatccgccctgtcaggaggaatctcatcaacagcccgtgaattaattgtccttgcagttgggaaataacccggtacctcggcgta

SEQ ID NO: 99748 - DNA, 208 bp, Homo sapiens
  chr8:69242803-69243011
  hyper
aaggggcggtggggacgatcccctttcgaactgcatttgtagctgccaaggagtagccaacaagcaccagatttatgtgcactttgaaagaagcaccttcaccattggctttttaagcggcgctgtcgctagggagcggctggtagggcgagcagcctcggggagcagcccgggctgtttgttccgtcaccggggaaaggaggtacac

SEQ ID NO: 99749 - DNA, 202 bp, Homo sapiens; identical to SEQ ID NO: 3297
  chr8:69243284-69243486
  hyper

SEQ ID NO: 99750 - DNA, 416 bp, Homo sapiens
  chr8:69243487-69243903
  hyper
cggtcccatctgttccccatggcgtctcatccgcaaacccggatccaggcttacctggagaagaacaagatcggtcccctgtttgaggtaaggcgctgtggaggagggcagtcccgttgtctttaggggaaggggtgcagtaatgaaaacagaacactcccaatcccacccctcccagggaaggagggctagagaaccaacgcgcgggagagggcgccctgggattcactggcattcgctctgtcccggccaggtgtcctggaacgcggccgggcgggcacttagccagttacctgaacgcggacaggtgagctcgggagggcccagcctcagcctggcaggggaagttttggccctctgactgtcctgcacctctcagctacatgttcaggacccgggcaggctgaggcaggcga

SEQ ID NO: 99751 - DNA, 8 bp, Homo sapiens
  chr8:69243963-69243971
  hyper
cgctatct

SEQ ID NO: 99752 - DNA, 479 bp, Homo sapiens
  chr8:69244031-69244510
  hyper
ttttttttttttttttaatgagggcggtaatagaacccgaaaaggtggaggaggtgcttagcagttaatacaattaactggaagacagctgaactggtgaggagtaggcttcagtcggtgcgggcgtgatgaatgaaattggcaaactgagagactgccatttggtcactggacgaaaggagagtcctttgcactgcagaccccacatgtgttagcaggagaaagggacggagaaaggttctgaaaagcacacacgtatttgtggaagaagactatagctctgagctggttttgtttttttttctctctctcgccattaaagaatttaagacaaaaatacagtagaaggaagagcgcgaggacacgagaaaatgagaacaagagattgaagcctggcaccagcaaagcgtcccgcgggttgccagggtgctgagcaggggtggggcgtgcggaccgtagtcagaagtggaggcccttgc

SEQ ID NO: 99753 - DNA, 268 bp, Homo sapiens
  chr8:69244511-69244779
  hyper
gagggactcccttggtcccatccagttcagggggcactgaccggcggcgagagttcgcgggagggtcgaggtgctcccgccttgcccccgccttgcccccgccttgcccccgccccccacgtctcccagaagcagttgtagctgttcttaacagcttggtttggggtgagggcttggtatggggaggaggttacgtgtcagtgtctgagagaggcagaatcgcggcaagtggaaggggctgcactggagatcgcggaaaacctagcaa

SEQ ID NO: 99754 - DNA, 87 bp, Homo sapiens
  chr8:6932550-6932637
  hypo
gttgtacaccacctgcgatatttggagtcatatgattctttgcccacctggatattaggaaaaacatcacggcgcgggggtcgtgga

SEQ ID NO: 99755 - DNA, 151 bp, Homo sapiens
  chr8:6940557-6940708
  hypo
tgagggggaggctcacggagcgtcggtggaaggcgcacagaatggtaaagctttactaaggcctctcggaaggggaggcagcgggactccccgcggggcccgacctcctggaccgcactgatctgaacagggcgcacttcgacccggaagt

SEQ ID NO: 99756 - DNA, 30 bp, Homo sapiens; identical to SEQ ID NO: 41650
  chr8:700159-700189
  hypo

SEQ ID NO: 99757 - DNA, 414 bp, Homo sapiens
  chr8:70404780-70405194
  hyper
gggtgctcagggagccggaaccacatgcctggaaaccctgagcccctgcccgccgccgtccaagccggccggctgcagcgcagtttgtttgccgaggtttgcatgcacatattcagttgcccttttttttcccccagtcctttcagccgtgtcccgaaattcacccttagtgtaacttctgcctctgctcctcctcttcttggaactgccttttgtttgtctggcagcgttggttctatgggggtgtgtgatgataataatacgcgggcttatataaccgtcttcatcttgcgagcacttcgcagaccgtcgctaatgaatcttggggccggtgtcgggccggggcggcttgatcggcaactaggaaaccccaggcgcagaggccaggagcgagggcagcgaggatcagaggcc

SEQ ID NO: 99758 - DNA, 143 bp, Homo sapiens
  chr8:70412954-70413097
  hypo
agaagcacagtgaagcgagtgatctagaggcctaatgggtgaggtgggccacattgcagagggtggcataaaactagcggcggcggagtttcactgctgtttggagtggaaagaggggtgatgagagtcgtgtgggaggaaag

SEQ ID NO: 99759 - DNA, 30 bp, Homo sapiens
  chr8:70571296-70571326
  hypo
aggctgcagcccattcgcaggcacccgaaa

SEQ ID NO: 99760 - DNA, 521 bp, Homo sapiens
  chr8:70744803-70745324
  hyper
agacctgagggtctccggctcgcacctctcttggacagcttctgcagtggccggcgcctccagctgctctcccgccccgggctgcagtccagtgccttcgtccatggcgcttagaattcagatttgatagctgatggcacccaagcactccggcacgtttcatccaccggcacgaggggccgaagccgggcccagtcagtcttgcccacctgggactggggctgggggcgcagggccgcgcagcagggcatcctcaccagctgcgaggcgcccagtgcatcctgatcacagacacggcttcaaggctccgcagccgcgtgccacagggggcaggggtccgcgcggtactgcgatgagccctactcggcgtccctctccgggcggtagcttgaggcaggcgcctcgcgcgtcccgggctcatcccctccgccgccgccgccgccgccgccgctgggcccgcggccaggagcgagtgcaccctgcgccgggggtgggggggcacttagcgctgctgtccgtac

SEQ ID NO: 99761 - DNA, 57 bp, Homo sapiens
  chr8:70785966-70786023
  hypo
aacgctaacctcctccgctaccaggagaaaaattagattagacgcaatttaaacact

SEQ ID NO: 99762 - DNA, 23 bp, Homo sapiens
  chr8:70842992-70843015
  hypo
aatactactcttggccgggcgca

SEQ ID NO: 99763 - DNA, 80 bp, Homo sapiens
  chr8:70847246-70847326
  hypo
agagtccaactacaccgaggccagcatgctggtggtaggaagccaggctacatggaaaagccacaggtaggggcttcaga

SEQ ID NO: 99764 - DNA, 184 bp, Homo sapiens
  chr8:70945287-70945471
  hyper
ggtcccactcatctgcgccaggtggaggggaaggggaggaggtctaaaggtgtggagtaagggagggagaggagaaaggaggaagggagagactgggcacttcaagggtcagaggaggaccacctgtggtcacagccatcgtcacgaccccctgccgcgcccacgcacgcgtggatggggccag

SEQ ID NO: 99765 - DNA, 229 bp, Homo sapiens; identical to SEQ ID NO: 32075
  chr8:70946686-70946915
  hyper

SEQ ID NO: 99766 - DNA, 568 bp, Homo sapiens; identical to SEQ ID NO: 3300
  chr8:70947090-70947658
  hyper

SEQ ID NO: 99767 - DNA, 166 bp, Homo sapiens; identical to SEQ ID NO: 32077
  chr8:70981714-70981880
  hyper

SEQ ID NO: 99768 - DNA, 23 bp, Homo sapiens
  chr8:70982262-70982285
  hyper
cgctcccacaattaagacaaaac

SEQ ID NO: 99769 - DNA, 281 bp, Homo sapiens; identical to SEQ ID NO: 804
  chr8:70982286-70982567
  hyper

SEQ ID NO: 99770 - DNA, 1020 bp, Homo sapiens; identical to SEQ ID NO: 32080
  chr8:70982850-70983870
  hyper

SEQ ID NO: 99771 - DNA, 277 bp, Homo sapiens; identical to SEQ ID NO: 807
  chr8:70984016-70984293
  hyper

SEQ ID NO: 99772 - DNA, 319 bp, Homo sapiens; identical to SEQ ID NO: 808
  chr8:70984343-70984662
  hyper

SEQ ID NO: 99773 - DNA, 250 bp, Homo sapiens; identical to SEQ ID NO: 809
  chr8:70984744-70984994
  hyper

SEQ ID NO: 99774 - DNA, 240 bp, Homo sapiens
  chr8:71017239-71017479
  hypo
cttaatcacgcatccagaggtgctggctggctcctgagccgggagacatctgtgggaaacttcgcttgcttcttgacgttactcactgcttgccattcagctttccaggggctacaaaatgagtcaccacccttttatcagctttcaacttacattttgttgctgttgtttcatctcctattatccttgtccttgtgggtttatgcctttataaaaaggcatttgggccaggcgcggtgg

SEQ ID NO: 99775 - DNA, 45 bp, Homo sapiens
  chr8:71115137-71115182
  hypo
gttgcaagggctgggcgcggtagcttatgcctataatcccaggac

SEQ ID NO: 99776 - DNA, 30 bp, Homo sapiens
  chr8:71240462-71240492
  hypo
gattatgtaaaccatcgaatgaatacaatt

SEQ ID NO: 99777 - DNA, 213 bp, Homo sapiens; identical to SEQ ID NO: 41821
  chr8:71368455-71368668
  hypo

SEQ ID NO: 99778 - DNA, 37 bp, Homo sapiens
  chr8:71448087-71448124
  hypo
gcgcgggtggggcatcgctggccggaggtcccggttt

SEQ ID NO: 99779 - DNA, 30 bp, Homo sapiens
  chr8:71522730-71522760
  hypo
tacacatgacctcttcgaaagcttcactga

SEQ ID NO: 99780 - DNA, 30 bp, Homo sapiens
  chr8:71582179-71582209
  hypo
cgtgagctaccacgccgggccagcctgttc

SEQ ID NO: 99781 - DNA, 402 bp, Homo sapiens
  chr8:72273868-72274270
  hyper
agcttgtacttacagcgcttacatctgctgcatccaccagtttaatgtgttccttcgaattttctgggttagcaaacctccattcctgacatagttttgctcctggatgggtacgcgcgggggctctcaggcgctctggtgcagccgcggcgcttctgggagtggagcgcctctgcaggggaaagctcggcgcagggggcaggcgcctggccgctgccgcaggctcgggctgccgagcgactgagcgaaaacgtgttccccaggaagaaacccgccacagtggacggcaacaggaaggcttaaagtcggaagtggcactggagagtttctacctcgccccaaactcggagccatcagctcccaccgttctgtttggtaacagctttgcgcccagcgctcctt

SEQ ID NO: 99782 - DNA, 103 bp, Homo sapiens; identical to SEQ ID NO: 32085
  chr8:72460433-72460536
  hyper

SEQ ID NO: 99783 - DNA, 30 bp, Homo sapiens
  chr8:72466268-72466298
  hyper
ctgtgctgttggaagcggattgccagtgag

SEQ ID NO: 99784 - DNA, 1020 bp, Homo sapiens
  chr8:72468554-72469574
  hyper
ggcctgcgggtggagcgggcgcctaagctgcggatcactcctgcgggcgctcgctctctccacgccgccgcccgcgcgcccgcggcagccacgagcgtcccgggcggggaaacgcgttgcctcccggcggcgcctattactagcagctgcttctgcttagcccttcgaggatcggtttgccccaacccacggcctctcccagggttcggtcttctcccgcccctccctcccttccccgcctctcccccaagctcctcagtggccgcggcccgtcaacactgtcgcgcagtcactggcgcaggttcccagctctcagctgggggtttcggggggagggagcagaaggaatgagacagaaggaacgggaggctttaagcccaccgagggaggttagaggaaggcgctgtggctgtgggattaggaggccacagacgggaaccgcgccgagctagactagctgtagaaggctgtctctccaccccgccacagcgctccgagaaggagcgggaggcctgggcaggggagaggcgctcctgcccccacccgcgccctgctggccacctgtggcgtcggggagaccacctgcggagagggtgcagggatgctgctgccctgacgaggggcctcccggggactagcgaaacgtttcgcctcgccggtgccgggggagagcgcatggtgacaccagggcagagtagccatggcggtcctctccctctttctggcactccactgtcagcgtcggctagaagcaaacgcccaggaagcactaaccgatgcacacaaggtttcgatggacagggacaggaaaatcggctctgcagcgcgggggagcgcaggctggaggccgggccactgaggtggccccggctgagcgactggcgtcggtttctcctcctagcgctaggcgggagtgggaccccgggccacagcaagagtcgccgggtgaggacgggcccggcccgtggcgcctagctgtaaagggccctaatgctgcgcgtttgtcgcaaagggaggcct

SEQ ID NO: 99785 - DNA, 499 bp, Homo sapiens
  chr8:72470336-72470835
  hyper
ccttactatcaaaaacggccgcgggcagaaaattacgataagtaaagcatagtctcttctcgcctttatggacatccccgcattttttggcggtcttagcctcggccaagtgcaagccgtccgtttcaaggcaggggtggagcctttaaagggtcgcttgggccagcgttagcattcctccccctgccgcccgccgggaacatccaatctaagtggtaaaaatgctagtgtgcagtggagctcagcttgaagacaagaccccccacctccagccgtaagacccaaaccaattcttgcccttagcggaggcctcctagaatttctggggccgccactgctctgggggaatcgtgggacacagtccggggaaagaacaaagctaggcgccaggaagggccgaccagcccggacgggtcagccgggtcctagccgtctcgggttctttccaagaaatcaggaaggtgactgtgcaggaggcaaaggacgcccagttaccgtt

SEQ ID NO: 99786 - DNA, 79 bp, Homo sapiens
  chr8:72471116-72471195
  hyper
gccattgaatgaatgcgggaccgtttgcgttaataccggcaacgttctttctccggtgacactacgcagctgtcgtttt

SEQ ID NO: 99787 - DNA, 51 bp, Homo sapiens
  chr8:72754310-72754361
  hyper
cagcggccttcctcccgcccgttagaagggcgctgtgctggagtacgaacc

SEQ ID NO: 99788 - DNA, 750 bp, Homo sapiens
  chr8:72754490-72755240
  hyper
cgcgaaaggccggggctgtgtggaaccgtcccgcacgtgtgcgatgaatctggctccgctgagaacggatccgtgggctgtctggcgcgggctggggcagcagccgagagttagtctacagagctagggcccgagggtggacctgcgtccgcgtctcgtcacgaaaggaagctctttttggagaggcaaaacgtggtcgcccagatccggcgcagctgtagccgtgggcgctgtgcagtgacagccacacccgccacctgtcacgatcacagttccagggaaaggggaagggtcaaggagaatccagcggaaacttcttcccatctcacgagctctcccttctctccgtggcccccaaacactcgcatttaacgaataatcccatcaagtgagttccagtccgatttaagcggtggttccacatagtctgttggctgcggaaacttctttggtgtcagagtccggtcttcccgagaccacgaatggccatgtctgtaaatcaaaaagaacgtgagatattagagagaaacgattgtctcaaaccgaaacagctctcctacgcgaaccccagatattcctgacttggagtagctaagattttatcagcattctgggaatttgcatgtcctctctctgaactaagattttcattttactggaggttgataatccgagacttgccatatccgttcacgcttcttcctggactttgcccgcaggataatttggtgaaactcatctgactttgag

SEQ ID NO: 99789 - DNA, 515 bp, Homo sapiens
  chr8:72755300-72755815
  hyper
acacacacacacacacagtcatccactccaagctccaagtaggaactgggcttggacaggatttttcccaagccgggagagctggcagatcagagagggactttccagataaatcccatctggggaaacgttactatcttccacaagcaatttttctaaaaatgcaaatgctcttttatagagctcggccttccctcctttaagaaagggcttgccgattcaaacctgcccgactcagctggattaagttgggcaagggagatttgccgtcagtctgcaacctggtggcagatggagatggaaccaagatttaccctggaagtaggatattagtcaatggctgtcactggggtacaatgttcagaacgatgcaaacagacacggagggttgattcttcttcagggaaatggctggccactcccttgatttgggagaaactaaactggccttctcgttcccagtcccagaacctccacccctttcgaattcttcccaacgggctgaccctgcccgg

SEQ ID NO: 99790 - DNA, 157 bp, Homo sapiens; identical to SEQ ID NO: 812
  chr8:72756655-72756812
  hyper

SEQ ID NO: 99791 - DNA, 136 bp, Homo sapiens
  chr8:72756813-72756949
  hyper
ggggaaggggacgtctctgcagagccgagatttgggctctgaagcccgacggcccttcaacatgtctgcgcaggataagtgagctttcggggagtgaaggggcacatcttgttcctaccgacggtgcttctacccc

SEQ ID NO: 99792 - DNA, 30 bp, Homo sapiens
  chr8:72782820-72782850
  hypo
tgtggattgctggatcgtatgatagttctg

SEQ ID NO: 99793 - DNA, 30 bp, Homo sapiens
  chr8:72855159-72855189
  hypo
cttccttcccctggccgcaataagttttca

SEQ ID NO: 99794 - DNA, 60 bp, Homo sapiens
  chr8:72917369-72917429
  hyper
tcaaggcttgcaggtcgtctccaggagtcagagaggtccggactccggggattcctgctc

SEQ ID NO: 99795 - DNA, 30 bp, Homo sapiens
  chr8:72917679-72917709
  hyper
tcagtgtaggactggcgacactcctttctt

SEQ ID NO: 99796 - DNA, 374 bp, Homo sapiens
  chr8:72987542-72987916
  hyper
ttccttgaaatcctccgtgtcgtccggcacatcctcatagacaacgccctggggctccttcttttctccagggcgccacatcttcctcaggctgcgcttcattgaccccaccccggacgccacctggtgcagctgctcaccacgcgcgcgggcacctggggcgagagagcgctgtcagcctgccaggcgctggggtccgcgcgagcccgagctctcccgcgctgcagctcacaggcagcgaaaaagtcgctctgcggaagccctggagaacttctggaaggagttctcaggcccgcgctacttttgtagtgcaggaagcaggcggggcgcggagaggaggtagaaacgcggagctccttcgcaaagagggcggc

SEQ ID NO: 99797 - DNA, 119 bp, Homo sapiens; identical to SEQ ID NO: 3314
  chr8:72987917-72988036
  hyper

SEQ ID NO: 99798 - DNA, 164 bp, Homo sapiens; identical to SEQ ID NO: 32097
  chr8:73163497-73163661
  hyper

SEQ ID NO: 99799 - DNA, 385 bp, Homo sapiens
  chr8:73163859-73164244
  hyper
cgagagagcgctgtcagccggccaggcgctggggtccgcgcgagcccgagctctccctcgctgcagctcacaggcagcgaaaatctcgctccgcgagagccctggagaacttctggaaggagttctcaggcccgcgctacttacagtgcaggaagcaagcggggcgtgaagaggaggtagaaacacagacctccctagcaaagagggaggcggcgcagcgtctgccgaggactcgccccttcaggaacaaagtgactcccccgtcccgctgtcctgcagctgcagcagcgcactcccagagtcaagcgtgtcaggtcggtgtggatgcagcgaatttgttgtaatctacacattaagagcccccttgcctcgccctgccccctcc

SEQ ID NO: 99800 - DNA, 46 bp, Homo sapiens; identical to SEQ ID NO: 9640
  chr8:73448786-73448832
  hyper

SEQ ID NO: 99801 - DNA, 30 bp, Homo sapiens; identical to SEQ ID NO: 32100
  chr8:73449084-73449114
  hyper

SEQ ID NO: 99802 - DNA, 55 bp, Homo sapiens
  chr8:73449377-73449432
  hyper
aggaggaagagaaggcggcggccgctccagcccgcgggtgcgcggagcgcgggag

SEQ ID NO: 99803 - DNA, 316 bp, Homo sapiens
  chr8:73449639-73449955
  hyper
ctcgggcagccccagcgagcggcaactcccgggctggcgcggctcgctttctggctccttccgcgcggcgagctcagccccgctcgatttttcctcttctgttccagccctctcttgtctgggtggctgtggcggcggcagggggatggggaccccgtgtggggaaggggttgaagatcgatgaagattattgttcttttaaaggatgccttagcttcctcccgccgcctttcctctgagccttcctactagagaccgtgaaccagagtcagggatgtaaagacagggggaaagcacgccgggagctccagccagc

SEQ ID NO: 99804 - DNA, 136 bp, Homo sapiens; identical to SEQ ID NO: 32103
  chr8:73450026-73450162
  hyper

SEQ ID NO: 99805 - DNA, 119 bp, Homo sapiens
  chr8:73450471-73450590
  hyper
tctctgatgtatgaacgatcctcagaacacagagacatgcgtgcattttattcttcaagcggtgcgcggtctccgttctgtagcacgattcctgagagggagaacgggtctctaaggaa

SEQ ID NO: 99806 - DNA, 218 bp, Homo sapiens
  chr8:73802558-73802776
  hypo
agggtgtggcagaggcggagattgaactctgctgctttgcagacacaatacaagtaagtctcagccccgaacaaaacaacattagccccttgttcctcagtaatagaggcttatactatgccgtcttagtaagactatggcacatcagctgcagctgccttcagacagtgctcttcagacctgtgaggctcaggtcccttccccggtcccatcacact

SEQ ID NO: 99807 - DNA, 18 bp, Homo sapiens
  chr8:73966731-73966749
  hypo
aagcgttgagtcaccgcg

SEQ ID NO: 99808 - DNA, 113 bp, Homo sapiens
  chr8:74005057-74005170
  hyper
ccggcgccccactctcggcctgaccacccacctgggcacgccctgtcgtagtcgaagcagcagtccccggtgaagcgacaggcttggtcgcagaaacacgtcccgtagaccct

SEQ ID NO: 99809 - DNA, 30 bp, Homo sapiens
  chr8:74005509-74005539
  hyper
cccaggtggggagggcgctgcagttcccgg

SEQ ID NO: 99810 - DNA, 34 bp, Homo sapiens
  chr8:74086196-74086230
  hypo
agtggcattgctggccgggcgcggtggctcccgc

SEQ ID NO: 99811 - DNA, 46 bp, Homo sapiens
  chr8:74332799-74332845
  hypo
agtggctacaacacacggatgggggtgggcgcgattcccacaacag

SEQ ID NO: 99812 - DNA, 54 bp, Homo sapiens
  chr8:74674435-74674489
  hypo
ctactcgttgtccaccgaaattcattctcctgacttccacgacaattgagttgt

SEQ ID NO: 99813 - DNA, 101 bp, Homo sapiens; identical to SEQ ID NO: 41825
  chr8:74759410-74759511
  hypo

SEQ ID NO: 99814 - DNA, 44 bp, Homo sapiens; identical to SEQ ID NO: 41826
  chr8:74759819-74759863
  hypo

SEQ ID NO: 99815 - DNA, 30 bp, Homo sapiens
  chr8:74848031-74848061
  hypo
atttaaccccataaacgtttactgaatgct

SEQ ID NO: 99816 - DNA, 157 bp, Homo sapiens
  chr8:74962845-74963002
  hypo
tttaacatttcttaacgttgttttcatattgttgctaattaaatgaaattatagcactattaccatcaccaaaacataattaccaccaccaatcctgttagcaatgctcttttaaacgttatctaagactcagctgggcacgggggctcatgcctgt

SEQ ID NO: 99817 - DNA, 30 bp, Homo sapiens
  chr8:751817-751847
  hypo
ctcactgcccttgctcgccacccaggtggc

SEQ ID NO: 99818 - DNA, 37 bp, Homo sapiens
  chr8:75232634-75232671
  hyper
ctggaggaccagaagcgaaatacgactccacgtgaaa

SEQ ID NO: 99819 - DNA, 160 bp, Homo sapiens
  chr8:75232938-75233098
  hyper
gtcagatccagccctcgcgccccagtccggtcccagcgccctctctgggaaaggcgggcgcgggcgcgggggtgggaggcgcccccaggtgttttggcgggtttccggacacgtgcgcccggcgtcctccccgcttccccgcagccggggcagagcccac

SEQ ID NO: 99820 - DNA, 57 bp, Homo sapiens
  chr8:75233984-75234041
  hyper
cgcgcagtgggatgccggtgggagggcgagtgtacccggggacgcacgagaatccct

SEQ ID NO: 99821 - DNA, 34 bp, Homo sapiens
  chr8:75733579-75733613
  hypo
gattacaggagtgagccaccgtgcccagcccatt

SEQ ID NO: 99822 - DNA, 282 bp, Homo sapiens
  chr8:75896554-75896836
  hyper
cacgcccacaaaggccgagcgccctggcttcgctgcgttccggagaagcagggcgggctgcttctcccggatctggcgggcctctggccacggctggttggaggtgggggtgggcgaggaggggcgctcaagtcacgtgcccgcgctggggccgcaataaatgctcgcgaacgcgagagagcgacggaagcgctaggcgcctggttctgcgcgtactggctgtacggagcaggagcaagaggtcgccgccagcctccgccgccgagcctcgttcgtgtcccc

SEQ ID NO: 99823 - DNA, 460 bp, Homo sapiens; identical to SEQ ID NO: 32107
  chr8:75896837-75897297
  hyper

SEQ ID NO: 99824 - DNA, 96 bp, Homo sapiens
  chr8:75897298-75897394
  hyper
gaaagcagcgacgatagaaattagcgggagctctagttcttgtaagtgactttgttggtttcacctactttctctgtcgcgcgctttccatttgag

SEQ ID NO: 99825 - DNA, 87 bp, Homo sapiens
  chr8:76008456-76008543
  hypo
aggtgttgggaaagacgaataattaaatatgcatttttagggacacacccgtgacgatattcttattttactatttttttaactttt

SEQ ID NO: 99826 - DNA, 253 bp, Homo sapiens
  chr8:76316303-76316556
  hyper
gtcccagttgcagtccgctattgctccaggcccagcgggggcggacctcgttggaggctacggtgcaggtcggagaagatgaaatggcctagcatcccccttcccaggggctcgagtcggcagctttagagctccgacaatctgtgccctcgctttgggctgcgccagggagcaaaaaacctctgcttttttgaaagaggccggggcaacaaggtagagagccgcggccagaagcagccccgggccataaacc

SEQ ID NO: 99827 - DNA, 381 bp, Homo sapiens
  chr8:76316614-76316995
  hyper
cgagccctcccccctcctagccacagtgaccggaatcccagacttcccttctgatgcataaaacattcagtggcctccagggagtttttgaaattctggcggaggctgctttatccgttgtttcgccccctgggtcaaacactggtccactgggtgagttggaggagcgagtagctcagctatagattaaatttaacctgagccccggtggccgcgtcccgcccgcggtcctttctatacgagtagctttgaaggtgtcaccgagctgtgcccaaatctagaaaagaatgggaggagaactgcatgagcttttaattttcttccctttttccccccttcctgcgtgtaaactggggtaagggtgggcggtaatccccactg

SEQ ID NO: 99828 - DNA, 64 bp, Homo sapiens
  chr8:76319856-76319920
  hyper
gtttgtttagtaaatcgataggactgtgagagtcaggccgctgccctgtcgccattgagcaaag

SEQ ID NO: 99829 - DNA, 56 bp, Homo sapiens
  chr8:76320236-76320292
  hyper
cgcagcgcaccgccccggcggctgccgggcaggaggagcctcggttcccctcgggc

SEQ ID NO: 99830 - DNA, 30 bp, Homo sapiens
  chr8:76836378-76836408
  hypo
cagccaccatcattgcggctccggttggcc

SEQ ID NO: 99831 - DNA, 23 bp, Homo sapiens
  chr8:76861290-76861313
  hypo
ccagacgcggtggttcgcaccta

SEQ ID NO: 99832 - DNA, 1618 bp, Homo sapiens
  chr8:77585073-77586691
  hyper
gccactctgctcttccgcccagcccactcctgcctgcagtgttgctgctgtcacgccagccggtgatttgataggcttgtcgggttgccatggtgttgacttcttgcctctgaggagctgcccaatgactggaggtctgggattaaagcgggaagaggcagcggccacagcgaatttcagcggcagctgcagcagctagaaacaagaagcaagagtacgaggtctttaggctgcgtccccctcccgcagtcagggctgccagtgagggaaagagaagaaagggtggacggttgaaatggtgatcactcgaagtcagaagatacaagtgagggctttgagacccgctcaggaataactcatgagcaatcagcacgcgctgagaggaaacgtcttccagaattcgttattattcacattagacattactggagtgggtggtgggactgagagtaaaaaggtgttaaaagggacctaaatggttgatacatttccccccacaccctactgttcatttgggcaacgaaataatttcacagatgcaaaggcgctgtacggtgaactttatatcgtggaaactaacttaactccgagaagagaaagtgcaattagacggcaaccgagtataagaaaatagttgccttggacggaggctggcggggcggggggagcgggggcggggaagtcagagagtgcatgtgcaatgcacaaccccagacggaaattgtaaactaggaaatgaaagggaaagaaaccgcttctgttataaattagtaggtaggtgaaggttatgcaaagaagaaaagggaaagtaaagctgttaaaagaatagaataaaacccctgggagttcaactcgaaatccccctttactccccaatccaaagggagtaggaggaggagaaaaaaaagtgcattctggtgtgatgagaactctctggaatgtctggaggagaggatagaagtgcgagggtaagaagacccgggtgctaaataaatggcaggagagagaaatgggggaggggcaaggtaggaaagaaatagtccgcgattcacccaagggactgggagattcagagagattccaggagaaggaaaggaacataagttcaggctcccagcgtaaggaaaggaggaaacgacaagaatccctaagagaaaaagaggaaaaagctgtgtgctgctgaggcggggcgtgggaagacaaccacagtcaattggaaggagcccgagtcagggagcaattgctaggacttcggacagagagggcagaagattgtgtagacaggcggtcaaccagagcagcgcggggcaggacccacgagcgcgaagccaggtgccgcgcggtccgcgccccggctccgggcgacgcagggactttgctggcaatgagaaggctgctcgaccagcctgccggagtcacgattccccgcgagtcccaaacacacgcttcactaactactttacagccacttccattgattttctttaacaaataaacataatacccgttacagcaacacttcctcttgccgccacagctagaatgccataagctctaatggctgcatttctccggacagcagttttcacatctccaaataaatcgttttccttcactt

SEQ ID NO: 99833 - DNA, 30 bp, Homo sapiens
  chr8:77586986-77587016
  hyper
cccccttcaaacacccgtttctgctgaggt

SEQ ID NO: 99834 - DNA, 606 bp, Homo sapiens
  chr8:77590098-77590704
  hyper
tctagggaaagttctcggagcggcagggaaacctctactcctttcactttgaaataaaaagtggcccaacgttccgtgagggcggcggcgggttcgcgcagagtttagggacagtggaatgggggtggggcagggagtgggagtcagggtcaaaggcgtccgcggagacccgagaggagcagctgggtttcctggcgctgggagcccagaagtagggcgcaagcggccgcggcacagcggagcagccaggtccagccgctcggatcgcgctcgcgccccatagcggcccgcgggctgggctcgggctcgcccgcctccccgctcccctgccagcggcgccgcgctccgcgccccggggcccaccccacgcagtcccgccgccgcttcagcccaacagccctcctcacgctggcgcgctccgaggccaagccctggaggaaactcttgactctgcgctagaacctctctgccccttccctcagcccattaacccccgaccctcacctccagcctctcttcttagggaaaaggtgaaagaaaacgagaaagagatggtaaacaacaacaacaacaacaacaacaacacacacacgttaggagaattct

SEQ ID NO: 99835 - DNA, 59 bp, Homo sapiens
  chr8:77593174-77593233
  hyper
gtttgtgtgtaagagcgcgtgtgtgtctaatgaagtttgggagtcgcgcgcaggggcgc

SEQ ID NO: 99836 - DNA, 1361 bp, Homo sapiens
  chr8:77593234-77594595
  hyper
tagggtgcgagacccggaggtccccatcccctgtcctctccgcggtcgccgcatccggggctccagccgcagcgctgggagctttggaagccgtgaggctccggagctgctctgagtccgggctgcgcgtcatttgcagtctggggaatgttgatcacctcactaattacacctctctctcccccctctccctctccctctccctcgctctcctctctcattcccagagtgcatatcgggaatagacacacaaagacatgcgcactcaacttaatcagccatttttttaaacagggctaaaacgataataattagcagaataaagacatatcggattttcatttcctttcctccttttcccaaccccttcacaaccaaacagcgagaccgcggtcggcacatgctttaactcctcccggacccccgaggaccgctccatgccccccactttctgctccagcgtttttattttcacccaataaagttcgaggattattttttattttttttgtttttttaatgaaccctctcgttttacttggatgtgatcagctgtaagtaaaataaaagcaaaacaaaaaagaggcgaagatcgagtaggaactgcaggggaaatggaaagtaagttttttctttaacttttattgagtagtttctgttaaatttaggtcgagtatcgattatctttccagcctgatcttgcacaatctttgatatttcgctccctctctctccctctccgcctctcttcctctctacccctacctcgctcgctcctgctcgctgtcgcacacatcccctcatcccgaccatctcttccgctctgccccccttttctatctctttccccttttttttggctcaaggttttgctccgctgagggagggagggggcactgagggacctgattttccactttctttaggggggctgcgtttttccggatttaacttttggattaagtggcggaggatcatctacgtttgcttgggcagttttctctccttttccctgtcttttcgggttttgccttccccgcgagccccgggcattctagtggctgggggaagctgtcagctccgcaacggcgcgggcactgccaggggtctccgctcgccccgcgcccctgcaccccgatcgggatgactggtcctccgcactcatcctctgaaagtttggacgttggtcggtggggctgggagcccctctctccctgctctttccctgctttaccctccaccccccaccccaccttattcagcctcgtttttcttcctccttttaccacccgcccctcttccccttctcaagttccccgaaggtcgcttagtgtgcggggctggcggaggcccgggggttc

SEQ ID NO: 99837 - DNA, 79 bp, Homo sapiens; identical to SEQ ID NO: 32117
  chr8:77594596-77594675
  hyper

SEQ ID NO: 99838 - DNA, 737 bp, Homo sapiens
  chr8:77594757-77595494
  hyper
cgggatcgcccggcctctgggccagggacccgcgaggcggcggctgcttgctccgaacggaacgccgccgggtgtgcgttagaccagcggatagacgcccgcggcttggggtcaagaatcttttcctttttagcaaagggcaaggggtgtgtgcgtgtgcgtgtgcgtgtgtgtgtgtgtattgagtggctgtgttcggctgtgagaaccgattcattcttcggcccccctaaaagggttccatgcctacaaatgaacttcacctccttcgtttctccaagcatcaagtgcgccttctggctgggagcagctaagggaaaagggactggaatgcgccgggtctctccttccttctacttctatccacccccaacccccttctcgctcctcttttctatcagaaaaaaataataaaatctctcatggaattgtataaagtttctctgccgatgtccaagttacagaaggttccctattctaatccccttcccctagaagacggtgcactggtttctatttcttttgttacctgtgatccgggcggggggctcctttcggccgctcgggctggggtccggcccagagaggaggcttctgcgggcgcctttggccgcgacttctcacttccgcgcggttctggtgaggttttagctaccgttcggtgagacaccctccttgtaggtaccaaaggttcagatcgcaaacacggaccccccccacctcgacccctacacaca

SEQ ID NO: 99839 - DNA, 30 bp, Homo sapiens
  chr8:77595977-77596007
  hyper
cttgatccctataaacgtggagtggttaaa

SEQ ID NO: 99840 - DNA, 415 bp, Homo sapiens
  chr8:78532894-78533309
  hypo
gatacaggattctttcggtgccacttcaccagctgaaaatcgccagtgggctcgttccacccactcggcggcaggctgcgctcagctcacactactggcctggatcctatgcccattgcagctctgccctcagcctgcagctggtccagccatgccgcaactggcttcctccttgggtgccgacatctagacgagggggatgcgatggcgtccgaaaacatggagaagccagcaaacgcagagccccaaggagtgttacagcttttgcttggagagtccagaggtctgagcccccaggaagtgttacagttcttgtttgttcctgccacccttagctcagcaaacgggggcctgtggtgtccagcggttttttcactcctgttgctccccagcagaaacgcgtgttacagctctt

SEQ ID NO: 99841 - DNA, 30 bp, Homo sapiens
  chr8:787176-787206
  hypo
gatgcgctcaggcctcgggatctcgcgggc

SEQ ID NO: 99842 - DNA, 93 bp, Homo sapiens
  chr8:790385-790478
  hypo
tctggattctgcgagcgcgtccacatggtgcacgcctgcacttttccccacactctggattctgggagcgcgtctacacggtacatgcctgca

SEQ ID NO: 99843 - DNA, 759 bp, Homo sapiens
  chr8:79428289-79429048
  hyper
aacagtccatgcagccggggtgacgggggagcgctcggaggaaggacgctatgcagagaaagcccccctggctcttctctctcaatccataatccagcgatgctgcagctgtaaaagcattaatagaaaatcaatccacaacctcgcggggcagcgatcgtcgagcgccgtttccaggctgccttccctggggtcgggagcggccccgctccccccgtggctggcgcggaatgtggtgatccgtcccggggcggggatgacttcatgcagccggagctccgcggcgggagcggaggctgctgctggcaggtggggcgcgggccggcgcgagctgaccgagcactcggcgggcgcggcgggactgcggcccgtggcggcgtgcgcggggacctgcgctgactaggtccggggaaggtaagcagcccggcaccggtgcgccctggccgcactgcgtggagctttccgcttggttaataatggggtttgcagcacggagggaagaaggggagaaccccgctgcattctgcaatgagaaaaggagcaacaactaggatggaaatgttgggcggccaagtgcagaggttggaggagcagtgttactgggcaaacaaagaaggcgttcttgcctctatactcttttgaacgtgatctaccatttcagtgccagattcgcgtagacagtgaagaggactcaaaatttaaaataatttgagttactcttttgctttctgtgccttttaccttcgcttgagtattttg

SEQ ID NO: 99844 - DNA, 30 bp, Homo sapiens
  chr8:79674707-79674737
  hyper
ctcctcagggcagtccgcccgcccgtcggg

SEQ ID NO: 99845 - DNA, 30 bp, Homo sapiens
  chr8:79844975-79845005
  hypo
ccataccaaacatggcggctcttctccctg

SEQ ID NO: 99846 - DNA, 30 bp, Homo sapiens
  chr8:80086720-80086750
  hypo
ttgtcttgctacccacgttgggaataaaca

SEQ ID NO: 99847 - DNA, 162 bp, Homo sapiens; identical to SEQ ID NO: 41828
  chr8:80483857-80484019
  hypo

SEQ ID NO: 99848 - DNA, 578 bp, Homo sapiens; identical to SEQ ID NO: 32121
  chr8:80523889-80524467
  hyper

SEQ ID NO: 99849 - DNA, 85 bp, Homo sapiens
  chr8:80524468-80524553
  hyper
ccctccccacgctggcctcattgttctgcttttaagagagatgggaaaagtgggttaacatttttcttttcggaagcaaattaca

SEQ ID NO: 99850 - DNA, 928 bp, Homo sapiens; identical to SEQ ID NO: 32123
  chr8:80524845-80525773
  hyper

SEQ ID NO: 99851 - DNA, 38 bp, Homo sapiens
  chr8:80677743-80677781
  hyper
ctggggcagcaacagcgggtgcgcgatgtgcgggtgat

SEQ ID NO: 99852 - DNA, 30 bp, Homo sapiens
  chr8:80695916-80695946
  hyper
ccggctcttggccctcgctgtcctgcccgc

SEQ ID NO: 99853 - DNA, 30 bp, Homo sapiens
  chr8:80696233-80696263
  hyper
gagattccctcaacacgctttccccctatt

SEQ ID NO: 99854 - DNA, 352 bp, Homo sapiens
  chr8:80803548-80803900
  hyper
gacagaaaaccgagccctatttgttattagtatttttttttttatactctcaaatgccaccggcacattcttttaaaaaaaaatgaaaggaaagaaagaaagaaaaagaaaataagagaggaaaaggtcctgagaaatgacggacgcttgaacctcgggcccgggaagaccagcgccctttggcggctaggcctcgggggcgtgcggagggcgggcccccgcgcggccgccgctttcccaggccgccaggggtgaggaggtgacgctgcgggcttggtggcggctggtttttcacacaggaatcctcctcgccaccgctccctcgaaggccgccccccgctccacccccagc

SEQ ID NO: 99855 - DNA, 30 bp, Homo sapiens
  chr8:80804344-80804374
  hypo
catcagagggtcttgcggtttcctggtttg

SEQ ID NO: 99856 - DNA, 96 bp, Homo sapiens
  chr8:81051849-81051945
  hypo
acaagtagcaataaacggggggtgggggtgagggcggggaaggggttgcatttggatagcgcctcccaatgcacttgaacactatagctaacaata

SEQ ID NO: 99857 - DNA, 35 bp, Homo sapiens
  chr8:81052005-81052040
  hypo
aatcaaataaaatacaacggcgtttttcaatcctc

SEQ ID NO: 99858 - DNA, 30 bp, Homo sapiens
  chr8:81084313-81084343
  hypo
cttttccatagaatgcggattttttaggtg

SEQ ID NO: 99859 - DNA, 20 bp, Homo sapiens
  chr8:81085073-81085093
  hypo
aaaacaggcctggcacggtg

SEQ ID NO: 99860 - DNA, 38 bp, Homo sapiens
  chr8:81213318-81213356
  hypo
cttactccatgatgacgcacggccgcaacaaccgcaag

SEQ ID NO: 99861 - DNA, 38 bp, Homo sapiens
  chr8:81309040-81309078
  hypo
attgctaatgtaggccgggcgcggtggctcacgcctgt

SEQ ID NO: 99862 - DNA, 101 bp, Homo sapiens; identical to SEQ ID NO: 32125
  chr8:81400332-81400433
  hyper

SEQ ID NO: 99863 - DNA, 398 bp, Homo sapiens
  chr8:81478129-81478527
  hyper
gttgaccttggcctgcgtgggtgttctcgtctttcctcctatcgtatgttacggttacctgcagaggctggcgtcgaaggagaggtgctatgcgaggatggccccaagttaaacagtgacagcctctgccctcccagaccccaggcgcgcgggggcgggcgcggaacaccggttccaccgccaccttcaggcctcccggtgtggcgcggttcgggacgtcacacaaataccagggcacccatgtttctgccctgggaaactctcacgtcagccggccccccaattctgctaaaggagaaaacaaaatttccctcccatggacgcagctgggcactttgagaactggtcgggcagaaggctgatcgcgcagagcctggtgcaaacgggaagcaattccc

SEQ ID NO: 99864 - DNA, 70 bp, Homo sapiens
  chr8:81786854-81786924
  hyper
gggcaaacgcttaaccgcagcccattcttccctccggagggaggggagtagacttcgctggaagtaaggt

SEQ ID NO: 99865 - DNA, 1074 bp, Homo sapiens
  chr8:82192624-82193698
  hyper
ctggttagcacctcccgaccccgagaaggcccagggggcgcccggcgggcggggcggggaccgggcgaggcccgcctcccattggccgcatagcgccgcccagcgcgggccgccgttataaagcagccgccggcgccgggtgcctcacagcacgctgccacgccgacgcagacccctctctgcacgccagcccgcccgcacccaccatggccacagttcagcagctggaaggaagatggcgcctggtggacagcaaaggctttgatgaatacatgaaggagctaggtgaggcacccggcctggcagcgcctgcaacgtggcgtgttgtgcggtcgtctgtccctaggtccccgtcagcgtgccagattctggggcaggagatgctcggcggcctacccccatcccctcccatcttccccaccacgcggccgttgggtgcagcgcgcgcagcaccacgcgggcaggcggcgaggagcagggagcgtgcgcgcctcttgcccgcccgcgggccgcaagattccggaggtggtccaccccgtggtccacctacctctgcttctttcccttcgcccaaacggcagcccttccgcattgcttcctgtcctttagcgcgcgcacccgtcacctcacgctgcacttctttcgaccccctccaggcgaccctgtatttcccttttttccccctttactcatccttccccttcctgccaccattctgtctctcccatttaccccatcgtggcagcacccactcccctttccctccctgtcgcatcttttgttccctgtggcgcgcaggtcaccctccgttttcttcatggggacgcggtgctggcgcgcagtttcccgcagaaatcctgtggaggggtctgagtggcgctacagcttcagcttgcattcctctgtcagccccgtctcccccaggtcctctgctcgcccttaccagttgagccgaaccctttggattggtaccccatggaacaccagggcccccgagaagcgtggcgctggcggtgccgacctgctgctggcactgccgggccggggcgccgcagtgggcgggtggcctgtggg

SEQ ID NO: 99866 - DNA, 193 bp, Homo sapiens
  chr8:82543083-82543276
  hyper
ggcagctccagataacgtggcaggcaagagtcacccagatgcggccttcgccccaggggctgaccgcacaccgcagaccgccctcgcccccaccccagcagagagaagcgccgaacccggagagggtggcgaggggggcggggaaaacaggagcctcacctcgagtcggcgagcggggcggggaaaacagggg

SEQ ID NO: 99867 - DNA, 219 bp, Homo sapiens
  chr8:82556628-82556847
  hypo
gtcttttctgtatgacgagttttgaaagataaatttgccaattgattccttgcagttcttccttcgtgtcacctgattgttttctccatagtcaaattgtgctcttaattgataaccaacatcttaggtcaagatatcagttcctggtgggtttaaatgctttcagtcacttttattttttattttttatttttttatgatggagtctctgttgcccag

SEQ ID NO: 99868 - DNA, 30 bp, Homo sapiens
  chr8:82687586-82687616
  hypo
tttttatttgccttccggggtacatgtgag

SEQ ID NO: 99869 - DNA, 90 bp, Homo sapiens
  chr8:82903043-82903133
  hypo
cgctcctccctcagccaggcttgcagcctcaccgttggatctcagactagcagtgagcaaggctcactgggcgtgcgacccacgggcatg

SEQ ID NO: 99870 - DNA, 52 bp, Homo sapiens
  chr8:83104515-83104567
  hypo
tgaggctggacactgcggagaagggggtggcaccagtcggggaggctcgggc

SEQ ID NO: 99871 - DNA, 91 bp, Homo sapiens
  chr8:83281998-83282089
  hypo
tgcgatattgggaatgttatcatccactttccccgtgcatattgcgaacagtattacaggggctgtacagcccctgcgataggaagtaata

SEQ ID NO: 99872 - DNA, 38 bp, Homo sapiens
  chr8:84342394-84342432
  hypo
gtaaccttgggaggccgaggcgggcggatcacgaggtc

SEQ ID NO: 99873 - DNA, 325 bp, Homo sapiens
  chr8:85094516-85094841
  hyper
ggctcccgcggggtgcgccaccgcctcactgctggtacacgtctccccctctcgaccgccaagtgcttgctccctccaggcgagcactcacacaatggactcacttgtttcccatgcccctctcctttgacttccagcctcagcgaacaacttgagcaagagtcaaacaggagtctctgccatggagcatagacccttggagctttccagaccagctcagaagcacgggcgcacacacagacaaaacaatgccttgtccacgaatgaataaaggacacccatgcccccacccaccgctccgcaacccgcagaaagaaacccggga

SEQ ID NO: 99874 - DNA, 239 bp, Homo sapiens
  chr8:85095259-85095498
  hyper
cacctcctctcaaggcgctggatcagcacccctgagctgcccccacagcacacactcccaatgcgaggcggcggcggcagcaacagaggcagcagcagcaatcgcggcagcagcggcagaggcggcggcagctgcgcgcctcgggcccaaccccgctcggctccccctctcgccggcgccctgcctgtcttgcgtgtgcgtgtgcgtgtgctcagcctcagcgtgaggggcacctgctc

SEQ ID NO: 99875 - DNA, 212 bp, Homo sapiens
  chr8:85095499-85095711
  hyper
tctgggctcacagcgaaggcagcctcgccgcgagctgccgctgccgctgctgccgccactggtgttgccgctctcaggcgccaggctccccgtcgccgccgccgccgcctcgccagccagagttgggctccgtgggcttcccccctcgcagcctcggtccttccccgctgcctgcaagtcagcctggctccgagtcacgtgtcagtgcctga

SEQ ID NO: 99876 - DNA, 133 bp, Homo sapiens
  chr8:85095983-85096116
  hyper
tttctagcatgcgatcgttctgtagacaaggcgctgtgtctcggagtccgcggcgaccgtgcccgctgggagcgtctcccaagtccagcaaaatgtgcaactggttttatggaaaaagcgatgtgaagtatgg

SEQ ID NO: 99877 - DNA, 199 bp, Homo sapiens
  chr8:85096522-85096721
  hyper
tcccccttccctccccgtaaatcaattttcaaatgatggcagtggaaggtttttctggaaaaaaaaaaatgaagtgcggtttggtttccttgtcaacggaggatgaagtgaacagctgagcagctcgcagagagcaggtacttggtccccttggaggcgtttcccgggtgtgcagtggcaacactggtcctagcaaaga

SEQ ID NO: 99878 - DNA, 151 bp, Homo sapiens; identical to SEQ ID NO: 32134
  chr8:85096852-85097003
  hyper

SEQ ID NO: 99879 - DNA, 158 bp, Homo sapiens; identical to SEQ ID NO: 32135
  chr8:85097062-85097220
  hyper

SEQ ID NO: 99880 - DNA, 145 bp, Homo sapiens
  chr8:852161-852306
  hypo
gcacagatccaagcccggccgctcccctcctcgggcgcccagccacgttcatttattcctctcgggctctgatcattcctactggataggagtcctcgctgagcccccatggtatctggcacagagcggacgtgtgttctgggac

SEQ ID NO: 99881 - DNA, 134 bp, Homo sapiens
  chr8:853984-854118
  hypo
gcctgggcctctggacgcaggggacacacgcggtccaggccctgagtggacagagaggacgctggtggggtgtcgggaaccctagctggggccgagtttcttcagctgaaaatcagtcacgtgtctgacatcca

SEQ ID NO: 99882 - DNA, 105 bp, Homo sapiens
  chr8:854712-854817
  hypo
acacctcggggtgaccgctgagtatattttgtggccccagcacccgtggcaggcagaactcacgcctcctgatctttctcagctgctaaacgctgctgtagaaca

SEQ ID NO: 99883 - DNA, 236 bp, Homo sapiens
  chr8:8560796-8561032
  hypo
gagcctggggggcgccgggtggcaaaggactcacccccgcacaggcccgcctggcttcgagttggaacccggacacttgcccctcactggtgtggatggaaatctgcctttcgtgggaccaaacaggactccttggacgattagttcaggttgggtttggttttcttcttaaagagtttagttttcctctccagagggatcagggtcctcttagggagtgacgggcttttcatata

SEQ ID NO: 99884 - DNA, 19 bp, Homo sapiens
  chr8:85844268-85844287
  hypo
tttgagacaaagtctcgct

SEQ ID NO: 99885 - DNA, 30 bp, Homo sapiens
  chr8:86034879-86034909
  hypo
acatcactattggatcgctattttaaagtt

SEQ ID NO: 99886 - DNA, 103 bp, Homo sapiens
  chr8:86301028-86301131
  hypo
aaaaaaacaacaaaaaaaaaaaaaaaagaaaagatatccattaattttgggtaagatgactcaatcataaagatgtcatttctctctacggtagtttataact

SEQ ID NO: 99887 - DNA, 30 bp, Homo sapiens
  chr8:86350528-86350558
  hyper
gggcaggcaaacaaacgagttctttccagc

SEQ ID NO: 99888 - DNA, 114 bp, Homo sapiens; identical to SEQ ID NO: 41831
  chr8:86370822-86370936
  hypo

SEQ ID NO: 99889 - DNA, 199 bp, Homo sapiens
  chr8:86389517-86389716
  hypo
tgacaggtctgtttacgggtggagcatttagtcaaggcagaagaccttggcctccagagtgagagagaactgagatttaatccttctcctgctacttcttgctatggaaatagtgcctttgatggtgcctagcaaataaacagcgttcagtaaatctttgttgttattaactataaacttagttcgtttagtctctaaa

SEQ ID NO: 99890 - DNA, 360 bp, Homo sapiens
  chr8:8639440-8639800
  hypo
gggccagcacgctgtcacctctcagcgggatgcagccgtagggccagccacacctctcccacgtgggacgcacctcttgtgacacttcttttggaaattctagttgcctcctgctttcctctgttctgttggcaaaagtggctttgaattctgcacaccccacggttctacctgccttgtcaggagtcttgcagtgaggccctcctggtctgaagcgatcccttcttccctgtattgcgctgtcttcagggcagggctcctcttgttacagtaggtagtcaggcacacataagcagggcagaagaacgccccccagcaaccatcaggtgagatggtcaggtggttgttacactgtctctc

SEQ ID NO: 99891 - DNA, 120 bp, Homo sapiens
  chr8:8639860-8639980
  hypo
ctgaagctggtgatcagcagctttcggataagagctcaggatttgggtgcgtgggctgaagcatgcgcattaagaggcaaaaggacggcgcttgactggtataggaccttctaggaacat

SEQ ID NO: 99892 - DNA, 29 bp, Homo sapiens
  chr8:86405563-86405592
  hypo
tgcacgggggatgggcgcggtgcctcaag

SEQ ID NO: 99893 - DNA, 36 bp, Homo sapiens; identical to SEQ ID NO: 41834
  chr8:86406813-86406849
  hypo

SEQ ID NO: 99894 - DNA, 26 bp, Homo sapiens
  chr8:86417676-86417702
  hypo
agaatcacaagcgtgagccactgtgc

SEQ ID NO: 99895 - DNA, 30 bp, Homo sapiens
  chr8:86428565-86428595
  hypo
agccactgcacctggcgattataagttcct

SEQ ID NO: 99896 - DNA, 30 bp, Homo sapiens
  chr8:86432229-86432259
  hypo
tgaagaataaatagacggtgtgattagttt

SEQ ID NO: 99897 - DNA, 123 bp, Homo sapiens
  chr8:86436621-86436744
  hypo
gcatccaacctgactcggcccgcgtggcagcctgtggtctgggtgggcgtcgcccctcgtcacgccctgtggggagctgtgattgggtcacgcctgtcagggcagccccgccccatgggtaag

SEQ ID NO: 99898 - DNA, 42 bp, Homo sapiens
  chr8:86437022-86437064
  hypo
ttgttactgttcaagcgagtttggaaacgttgtcagagaccc

SEQ ID NO: 99899 - DNA, 128 bp, Homo sapiens
  chr8:86468333-86468461
  hypo
aaatcttcccactgtcgagacttatctgccagtggatgttgaagcagagcaccactgcctttccttaatcccaaagcttattaccggaggctaccgtactcagcaattaaaaccgaacaaaaatgtgc

SEQ ID NO: 99900 - DNA, 76 bp, Homo sapiens
  chr8:86495755-86495831
  hypo
taacttcttttcagtcgatgagatagattctactattggcccatttaactaatgagaaaaccgagacacaggggtt

SEQ ID NO: 99901 - DNA, 120 bp, Homo sapiens
  chr8:86544680-86544800
  hypo
aaaaaaaaaaaaaaacaacaaaaaaaactcccacgggcacctccatgttaattagcaatagaagttagaaaaattcacaagaatttatggccgggtgcggtgactcacgcctataatcct

SEQ ID NO: 99902 - DNA, 63 bp, Homo sapiens
  chr8:86556050-86556113
  hypo
acttgagacactcttcggtgaacagttggagatagcctcggcggaggacggtggggacttggc

SEQ ID NO: 99903 - DNA, 30 bp, Homo sapiens
  chr8:865633-865663
  hypo
aattcccgaatcacacggctggtcatgcgt

SEQ ID NO: 99904 - DNA, 75 bp, Homo sapiens
  chr8:8666327-8666402
  hypo
ttggaaagcatcccccgcaaataagggttggaggaatgactctatagcaagggtgcccaacgccagggccatgga

SEQ ID NO: 99905 - DNA, 74 bp, Homo sapiens
  chr8:86849567-86849641
  hypo
ctttaagatttagctcgtgtttgattcaagattaagttttacagtgtttgtcacaccagcgtatagaaaaatca

SEQ ID NO: 99906 - DNA, 19 bp, Homo sapiens
  chr8:86926063-86926082
  hypo
accacgcctggctaatttt

SEQ ID NO: 99907 - DNA, 30 bp, Homo sapiens
  chr8:86953049-86953079
  hypo
tcagcctcctctttccgcaatatcacctga

SEQ ID NO: 99908 - DNA, 221 bp, Homo sapiens
  chr8:86976079-86976300
  hypo
cactgagcaaggcagcgggcacgtgattcaagaacatgctgtttctaaccaaacaacaagcctcattttttaataccttcagtaaccagagagatgagttgtcttcgattcattttcccttcttatgcttaatggcatctgcagacattatattttcctttttattgactgcttatttttgcagtaaaagaacttgcggcagcattcgtttgacttaagta

SEQ ID NO: 99909 - DNA, 189 bp, Homo sapiens
  chr8:87081763-87081952
  hyper
cgacgccggcttggttttgaccttcgtgcttggcccaagccagcgctggtggccccgggaccaccttcctgctggcgccgcaccccatacccgcaacacgcccgccgctcgcgggacctggggactcgggaagcagccagccccgttcctccgccctttatcaaagagcagctgcgaggggcgggaccc

SEQ ID NO: 99910 - DNA, 197 bp, Homo sapiens
  chr8:87083708-87083905
  hypo
tgtttgcataaggatcgcacagcaaataggaagcatctgctataaaacctaaacctgggcagcagtgaaggcgccagacacttccacgaggcaggcagtccctctgcctgtccaccttctcccagcagtgagggccttcatagtaggctgcagaaacctcttctgtcctgtctgcagctggccgcacagcagagaaa

SEQ ID NO: 99911 - DNA, 30 bp, Homo sapiens
  chr8:8709733-8709763
  hypo
tcacatttgggaagccgaggcgggcagatc

SEQ ID NO: 99912 - DNA, 738 bp, Homo sapiens
  chr8:8748350-8749088
  hypo
agacattgaggatgtcgatgaggcgggtgaggttgtggaagacgtgctccttgagagccggactgtcctcaaagtagagtagcttgccgctctcatgcaggtaggagagggcactctgcagtcggtcctcggtcagacccgcctgcaggcccaagcgcgccgagtcccaccagcttagccacagtcgctgggcctgaggtggctggaaatgcagttcctccagcacctgccaggatcgaggcagtactctgtgtaagttggggaagatctctcggtgctcagcaactgacagcaacttgtcccgaaggcgtcgtaagtggcgcgggtccctgcagctaacaggcaacacgggggagaggatctgcagccggtggttgagcaggtattgaaaatgggccttgcgccgtcgaaggttcttgtccgaaacgccatagtaggctgcgtgggggctggcagagcgcagctcgaagtcccgggccagtgcctcgtccaccaccttggccaagcggctcagtccctccgcgtcgtgcttctcctgcagggcgatctggcggtgaatgtccagacatttctcctccagctcacgctctccgcacaggtctgcgtgggtgcccacgatgcacaccaccgcgtggggcactctcgccccgacccgatgcaagaaggagcccacggtggtaggaaagtggcgaggctcataggtggccaagttgaccaccagcacgtatagggcccctg

SEQ ID NO: 99913 - DNA, 32 bp, Homo sapiens
  chr8:88037278-88037310
  hypo
gtgaagccagctgggcgtctgggtagggtggg

SEQ ID NO: 99914 - DNA, 498 bp, Homo sapiens; identical to SEQ ID NO: 41839
  chr8:88885698-88886196
  hypo

SEQ ID NO: 99915 - DNA, 30 bp, Homo sapiens; identical to SEQ ID NO: 41699
  chr8:8898369-8898399
  hypo

SEQ ID NO: 99916 - DNA, 30 bp, Homo sapiens; identical to SEQ ID NO: 41700
  chr8:8898687-8898717
  hypo

SEQ ID NO: 99917 - DNA, 46 bp, Homo sapiens
  chr8:889984-890030
  hypo
gcccatgagagaatccgggaatagaaggagccgggatctccgtctt

SEQ ID NO: 99918 - DNA, 941 bp, Homo sapiens; identical to SEQ ID NO: 32137
  chr8:89339042-89339983
  hyper

SEQ ID NO: 99919 - DNA, 10 bp, Homo sapiens
  chr8:89340043-89340053
  hyper
cacacacgcg

SEQ ID NO: 99920 - DNA, 156 bp, Homo sapiens; identical to SEQ ID NO: 32139
  chr8:89340081-89340237
  hyper

SEQ ID NO: 99921 - DNA, 711 bp, Homo sapiens; identical to SEQ ID NO: 32140
  chr8:89340273-89340984
  hyper

SEQ ID NO: 99922 - DNA, 79 bp, Homo sapiens
  chr8:89687899-89687978
  hypo
agaggtccataatgacgcatttgtatcccttggaatttaggaagttctagtgccaccagataagcccacgtgtctaatc

SEQ ID NO: 99923 - DNA, 32 bp, Homo sapiens
  chr8:898037-898069
  hypo
gcgtcatgaccccaccgcgtgtgcgccatggc

SEQ ID NO: 99924 - DNA, 17 bp, Homo sapiens
  chr8:89830498-89830515
  hypo
gccggaaaacatatgtc

SEQ ID NO: 99925 - DNA, 99 bp, Homo sapiens
  chr8:90768479-90768578
  hypo
gtctcttcacactgacgcgcgttaacagaatgaatggatagaaaagtcttctgagtactttttaagaaaaaagcttattggccgggcgcggtggctcac

SEQ ID NO: 99926 - DNA, 39 bp, Homo sapiens
  chr8:90768818-90768857
  hypo
gggtgacagagcacgactccctctcgaaaagaaaaaaaa

SEQ ID NO: 99927 - DNA, 137 bp, Homo sapiens; identical to SEQ ID NO: 1578
  chr8:90913516-90913653
  hypo

SEQ ID NO: 99928 - DNA, 32 bp, Homo sapiens; identical to SEQ ID NO: 9668
  chr8:91094254-91094286
  hyper

SEQ ID NO: 99929 - DNA, 450 bp, Homo sapiens
  chr8:91094634-91095084
  hyper
aaggttttgggattacggtggaaacaatataaactttcaggttgacagtttggcggccagtcggggagataagaagataagattaggcagaagggggaagaagtaaagaatagaaaggagggataatgggatcaggaggctcagaaaagggcaaagaatgggaaggggcatggaaacgggtcttgaaacagttaaaaagagaagataatcaccgtcagcgtcgaaatggagccagatctcgaaaaactgtgaggctgtgatgagggatgactgcaggtgggattctgccattgtacagcggggtgtgtgtctgggtgtgtgaatatgcgtgtgtctgtgtccgcgcgagggggagtgagcaaaagctcagcgtgtgcgcgagtcagggctgcggagggagacctgggcgcgggcgctgccgggcgctgtcctcggtgctgctcagctcag

SEQ ID NO: 99930 - DNA, 64 bp, Homo sapiens
  chr8:91095141-91095205
  hyper
cggccccaagccgggccacgcctcctccagcctcccattcctcactccccgcctcttgctctca

SEQ ID NO: 99931 - DNA, 26 bp, Homo sapiens
  chr8:91118371-91118397
  hypo
cttattattgccaggcgcgttggctc

SEQ ID NO: 99932 - DNA, 102 bp, Homo sapiens
  chr8:91130026-91130128
  hypo
agagcgagactctgcctcaaaaaaaaaaaatcctttttgggtgaatcctttgataacagcttcaattatctttattccaaataatagcgggaattcaaattt

SEQ ID NO: 99933 - DNA, 22 bp, Homo sapiens
  chr8:91163928-91163950
  hypo
gtaatccctgcacttcggcagg

SEQ ID NO: 99934 - DNA, 187 bp, Homo sapiens
  chr8:91179163-91179350
  hypo
tggtatctgccacagcgttagagctgaggacatgcttcttttgggagctcacgaccaatgaccaagctcagtggagcacacagtctgaccattctgcccagctcaggactcctctacaggtaactttgtgctgatgttccattgtgctgtcccaggctgttgagagctgcaccgcagtttcctacta

SEQ ID NO: 99935 - DNA, 30 bp, Homo sapiens
  chr8:913030-913060
  hypo
tgtgcccctctcatccgggactgtgtgggc

SEQ ID NO: 99936 - DNA, 25 bp, Homo sapiens
  chr8:91359129-91359154
  hypo
tgagccaccacgcctggccttcctt

SEQ ID NO: 99937 - DNA, 36 bp, Homo sapiens
  chr8:91375278-91375314
  hypo
ataggcgtgagctaccgcgcccgacctgttgttgct

SEQ ID NO: 99938 - DNA, 30 bp, Homo sapiens
  chr8:914330-914360
  hypo
gtggcgctgtactgtcgtggactctgctgc

SEQ ID NO: 99939 - DNA, 27 bp, Homo sapiens
  chr8:91434639-91434666
  hypo
atggatcaggccgggcgcagtggctca

SEQ ID NO: 99940 - DNA, 29 bp, Homo sapiens
  chr8:914936-914965
  hypo
tcgccaccgcacacacggctcctgagccc

SEQ ID NO: 99941 - DNA, 30 bp, Homo sapiens
  chr8:91657391-91657421
  hyper
ccaccactttcaggccgcttcctccctcca

SEQ ID NO: 99942 - DNA, 44 bp, Homo sapiens
  chr8:91803676-91803720
  hyper
gctgctcaggacaaacgccctgccattcgtcccttctctctgtc

SEQ ID NO: 99943 - DNA, 189 bp, Homo sapiens; identical to SEQ ID NO: 32144
  chr8:91804064-91804253
  hyper

SEQ ID NO: 99944 - DNA, 195 bp, Homo sapiens; identical to SEQ ID NO: 41846
  chr8:91865364-91865559
  hypo

SEQ ID NO: 99945 - DNA, 38 bp, Homo sapiens
  chr8:91887415-91887453
  hypo
atagatagttgaggccgggcgcggtggctcacgcctgt

SEQ ID NO: 99946 - DNA, 524 bp, Homo sapiens
  chr8:91996985-91997509
  hyper
ttgaaagcctcccaccgcctggcaccaggtgctggggcagagccaaggggagctgtgtacttagctccttttttggcgatggctttggtctcggccacttgcccctccgtcgggctcccctggccccctacactttctttcccctcatccgacgctctcgctcccatcccactcccattcagggtccacagggtactgaaggggccctgagagatttcccgacccacctcagagcttctcttcctcgcctcaactttcccggggtcgggcctgggagacggcgcccacccgcctcctccacaccacggggcccgacttccgtcccccagtgtcgctcatcctccctagccacttaccgactcaaaatccacggggatttcggggcagcagcgtcgccgcgctcagcccacacgcggaggccgagcgccctgctgcccgtcggggaacggctcctgccgctggtccgctggctgaccgcggtggcggcggcggggggcgaggggcggggggcgaggggcgggggg

SEQ ID NO: 99947 - DNA, 479 bp, Homo sapiens; identical to SEQ ID NO: 815
  chr8:91997527-91998006
  hyper

SEQ ID NO: 99948 - DNA, 99 bp, Homo sapiens; identical to SEQ ID NO: 5080
  chr8:92083523-92083622
  hypo

SEQ ID NO: 99949 - DNA, 30 bp, Homo sapiens
  chr8:92982980-92983010
  hypo
ctgttgtgatcatgtcgtgggctttccgct

SEQ ID NO: 99950 - DNA, 204 bp, Homo sapiens
  chr8:93113946-93114150
  hyper
tttccaagggttgaccgcccttacaaaaaataaaaaatagcacgtttcaaaaaatggatctgagcgccttgtgctgacctagccgtatttgctcaaagcaccccagtcagcgccaggtcccccccgggaaagaggtctgggtgcgccaaccaacccggtcctttcaggttcgcaaagagggcggtgagcggcgggccctggagc

SEQ ID NO: 99951 - DNA, 91 bp, Homo sapiens
  chr8:93114151-93114242
  hyper
cgtctccactggcccgggggcttcaccagaggggtttctggaaaacgaaaggaattatccggacgtggctccaagtctggaccccttcggg

SEQ ID NO: 99952 - DNA, 834 bp, Homo sapiens
  chr8:93114306-93115140
  hyper
cgacgggaacacccaggagggccggggcggctgagtccagagcgcgcagaggtcgggcggggacgactctccccatcggcccctgactgcgaagcccgggaccagcctcgggcgggagccgccgtccgcccgctcacccaggagcttcccagtccagcaccccaaacggccaggagtaacaaggaaagttcgcaggcaggcgcagagcgcctgggtacctctaagcaaacccccaccctagttgcagccgggtcccaaagttaagatcccgcctctttactccttagggctaagttttccaccatcaaaacaagtctttgcttccagtttacagaaaaagaaaagaaaaaaaaaaaaaagaaaggaaaagaaaaaaacccacgatgcgggcatagggccacctgccaaatgcactgtgggcacctcgatcggttgttttgtcgggggagaaacccactcgtcatcttcctgctcgcataccgtgactatggagagggaagaaaaattatttttaaaagacactgtggggaatataatagtaaaaactgcatcctcggctgacccgcgaagttcagtgtcatcgcagaccggagtcacccgcgatgttcctctttgccctggtgcgtagtcctaccctaattgagcgacaagtacagcctggagcctcgcggtcgaataatccaaacgaagatgacggtcatcggaacagtaattaataacagtcaggggcccgaccccgccgcccgcccgccggccaagccctaccgcggacacttacactgcacagggccggagagtcccaccatccgccacaggctccgagctgcaaataaa

SEQ ID NO: 99953 - DNA, 535 bp, Homo sapiens
  chr8:93115382-93115917
  hyper
ctgctcccctcctcccgcctccctccctccctccgcttttctgttgttgctgctgtggcagacaaatgtgatgtggggcgcagggaattgccactgtcacaggcggcgtctgcgtctccctcgcccgccctcgctcactctcgaggaaggcgacgcatttatctgcagggcggccgggcgtccgccggggagcaggagcgccgcgcgctgtgcgccgagagcgcccgcatcaggccggctccggcgcacgctcgcgccaggggcgccgcggccggtcgggagggaggcggctgcgcggccgctaccaggtgcaggggggaggacccgcggcggggcgtgggggaggtggaggtgggagacatctgtgttgtgcgggggtcacggaggtcaagtatatgttaacaatgggcaggcccggcacgctagggcgcgcgggctggcgggcggcctccctcccggcctcgccctctcccatgcaggctggacgtggggttggctccctaatgatgccttcccgggccgccagctctcaggc

SEQ ID NO: 99954 - DNA, 30 bp, Homo sapiens; identical to SEQ ID NO: 41848
  chr8:93449207-93449237
  hypo

SEQ ID NO: 99955 - DNA, 30 bp, Homo sapiens
  chr8:93509730-93509760
  hypo
caggaggaattaactcgttgagcatattct

SEQ ID NO: 99956 - DNA, 226 bp, Homo sapiens; identical to SEQ ID NO: 41849
  chr8:93848232-93848458
  hypo

SEQ ID NO: 99957 - DNA, 69 bp, Homo sapiens
  chr8:93978166-93978235
  hyper
ttcattcccggaccccgagcttcccgggcagggtctccccaatcccctcgcactcgccggacacacacc

SEQ ID NO: 99958 - DNA, 30 bp, Homo sapiens
  chr8:94237541-94237571
  hypo
gttttccccagtttgcgattaaacttaatg

SEQ ID NO: 99959 - DNA, 120 bp, Homo sapiens
  chr8:94684333-94684453
  hypo
tatcacagtgtgtaaacactgcacataattacaaatatcagcgatatgttgtcaatatcacagcgcgtaaacactgtgcgtaattacaaatatcagagtgatatattgtcaatatcacag

SEQ ID NO: 99960 - DNA, 463 bp, Homo sapiens
  chr8:94712418-94712881
  hyper
gggcctctggtttcacgtctccctcctggtccccggcggaccggcgtcttttctcccctgctcggagtagcctagcagcgctggaggctggctgtctggtaagcgcggctgttagagaggatggaggcgccgtagccccgcggtgcttctcacagccttcgccggcagggacgcgcgggacaaccgcgcaggcggctctgcaggggtgggcgcgccatcacccctctcggtccctgcctgcttggcgctttccgagccccagccgcgctcaggctgcctcgggcattgaccgcgggggcgcgcgccccgtttccatagaaacgcccggcctgccgcggcggcgcgaggggcgggctttcaggctcccggcggctgcttgcgccccagcgcgcgcccaggcgccttggaatccccgtccttgggcccccgcaaggtccccggccgtgcgcgaggcagcatgatg

SEQ ID NO: 99961 - DNA, 300 bp, Homo sapiens; identical to SEQ ID NO: 32151
  chr8:94713129-94713429
  hyper

SEQ ID NO: 99962 - DNA, 174 bp, Homo sapiens; identical to SEQ ID NO: 41850
  chr8:95211968-95212142
  hypo

SEQ ID NO: 99963 - DNA, 194 bp, Homo sapiens
  chr8:95212445-95212639
  hypo
tggggtaccctgggtcgcaatggtgctgatgggaagccatccttcatcactgaaattgcccgaaaccaccaagccagacacctaggtttcctcaaaaacactacttggaaaagaattgaaatagatttccagaggattctgtggcattttatctgaactacctgtaataattggccaaccgtctgcgtggaatt

SEQ ID NO: 99964 - DNA, 320 bp, Homo sapiens
  chr8:95246683-95247003
  hyper
aagccagtgtgcagccgcctgtgggtgaggagcttttatgacaatgaatcccgtgttttatgggagggcagtgtggagacagcgcgggccgagtccctgggttccggggcaagactgtgggcgtctcccgcggtgactcagagatgctgccctgcctcacaccatctcgcaccatctctgtggaggccgtgaccttcattcactgccgtctgtcactggggggtgacctcgcagttgtcagagccccctctcctggggctcaggactgggatcacccccgcaacccggcgcttccagcttcatctcggggcgctctgttt

SEQ ID NO: 99965 - DNA, 77 bp, Homo sapiens; identical to SEQ ID NO: 15137
  chr8:95416054-95416131
  hypo

SEQ ID NO: 99966 - DNA, 30 bp, Homo sapiens; identical to SEQ ID NO: 41852
  chr8:95622883-95622913
  hypo

SEQ ID NO: 99967 - DNA, 78 bp, Homo sapiens
  chr8:956346-956424
  hypo
ctgcgtctcaagtctcgcgaggtggtcctttatcacgtcggggacaccatgtgtctgaagtctcgggatgtggtcctt

SEQ ID NO: 99968 - DNA, 26 bp, Homo sapiens
  chr8:95650766-95650792
  hypo
gccaccgcgcccggcccagaaagatt

SEQ ID NO: 99969 - DNA, 183 bp, Homo sapiens
  chr8:95651327-95651510
  hyper
gcaccgagagccccacggggaggtggttagggggaaccggctcctccaggcggcctcgcccactgcaatgcaatctgggtggtttttccaggtccctccctgcctcgttccgcgcccagtccctgcccccgcgacgcccgagggcctggacgggtagctcggagttaccggggctggggagga

SEQ ID NO: 99970 - DNA, 119 bp, Homo sapiens
  chr8:95651726-95651845
  hyper
tctcctaccaggaaacgagacggcgcgggcctcgggctcctctcccccctcccgggagctgaacccccactgggaaagccaggtctccagcttcccttgacacgcgtcttgaaaggtta

SEQ ID NO: 99971 - DNA, 172 bp, Homo sapiens
  chr8:95652419-95652591
  hyper
gcctgagtttccttgcggggtcccccagctgctttgcgcgcgataactgcgtcctggggagtgactaggtggttgggcgtccagcccctggcgtccggctctgccgcgcgcggggttcctctccggaaggtgggcagcgcggcgggtttgggacgagcgtgcacccgggctc

SEQ ID NO: 99972 - DNA, 49 bp, Homo sapiens
  chr8:95652814-95652863
  hyper
gccttttcgcttgaccgttcagaaccttcggcttcgttccctgcagccg

SEQ ID NO: 99973 - DNA, 109 bp, Homo sapiens
  chr8:95653342-95653451
  hyper
ccttcctgccctgggcgtggagcaccgaccaggtgtgggcttgggtggttggttaccgccttttgcactagcagtagcaaggaaggggggtgggcgctctttctttttc

SEQ ID NO: 99974 - DNA, 321 bp, Homo sapiens
  chr8:95654016-95654337
  hyper
ggcggggggcaggaacgcaccggaaccgatggcgagtcgagagctttgattctgcgtccggaccccaagagaggcgcgggccgccccagcaggggagcgagggaggagggtgcagaaagaggctccgaaattgggggaaactgacccgtgcttctctaccttcggaggtgggacagttgcacgaagtgctagttagaccggatcagttggaactgacggaggactgcaaagaagaaactaaaatagacgtcgaaagcctgtcctcggcgtcgcagctggaccaagccctccgacaggtgacaaccccgggtcacgccaccc

SEQ ID NO: 99975 - DNA, 33 bp, Homo sapiens
  chr8:957089-957122
  hypo
ttatcatgtcggggacgccgtgtgtctgaagtc

SEQ ID NO: 99976 - DNA, 27 bp, Homo sapiens
  chr8:95816428-95816455
  hypo
tcaaaaaattaaatgcgggccgggcgc

SEQ ID NO: 99977 - DNA, 21 bp, Homo sapiens
  chr8:95837385-95837406
  hypo
aaattacgtgctgggcgccgt

SEQ ID NO: 99978 - DNA, 21 bp, Homo sapiens
  chr8:95837646-95837667
  hypo
aagactcggaaaaaaaaaaaa

SEQ ID NO: 99979 - DNA, 30 bp, Homo sapiens
  chr8:95960767-95960797
  hyper
ccggtggccgggtcacggagcaggttcccc

SEQ ID NO: 99980 - DNA, 28 bp, Homo sapiens
  chr8:96083320-96083348
  hypo
aaagcataaggcaaccggccgggcgcgg

SEQ ID NO: 99981 - DNA, 30 bp, Homo sapiens
  chr8:96125751-96125781
  hypo
gaggtgagaacttggcgggatttcttaagc

SEQ ID NO: 99982 - DNA, 172 bp, Homo sapiens; identical to SEQ ID NO: 41856
  chr8:96208663-96208835
  hypo

SEQ ID NO: 99983 - DNA, 141 bp, Homo sapiens
  chr8:96219910-96220051
  hypo
tatagaattccaggagtcagaaattgagtcatccatccaggaatctttattatgcacctgctttgtgtcacacctgctgggaatacagttataattagaccagaatcagctttgggcctcaaagaacgagtggaaagggct

SEQ ID NO: 99984 - DNA, 137 bp, Homo sapiens
  chr8:962438-962575
  hypo
gtgtggctgcctctgcgggaacttccagcggcagtgtggacaccgtctgaccagccccccacttcagcggcagtgtggacaacgtccgaccagcccccccacttcagcggcagtgtagacaccgtccaaccagcccc

SEQ ID NO: 99985 - DNA, 30 bp, Homo sapiens
  chr8:96314006-96314036
  hypo
cgggttggtgacttacggattccctatctc

SEQ ID NO: 99986 - DNA, 30 bp, Homo sapiens
  chr8:9638573-9638603
  hypo
tttatatactttgcacgaccaaatatggtc

SEQ ID NO: 99987 - DNA, 77 bp, Homo sapiens
  chr8:96837358-96837435
  hypo
actattaccccatgttatatagtaaatttgaagaaaatgaggcttggaaaggcaatgtgactcgaacaaagactgag

SEQ ID NO: 99988 - DNA, 100 bp, Homo sapiens
  chr8:96849941-96850041
  hypo
tatttggcaagtttttgtagatctaactaagataggaatgtgcagccaaatggaaaaacttattttcaaaagacttggggatgagcgcaacctgaagata

SEQ ID NO: 99989 - DNA, 165 bp, Homo sapiens
  chr8:9686554-9686719
  hypo
atacaccttcgtctacggatctagccaattgctgctgcctatttaggttttgcctgaatcttgatcaagaatatctgataacctttcctgctttgttttatttgaaaacattgtaaactcaaaagggctttttaagtcacctctggcctccgccctccgagcggc

SEQ ID NO: 99990 - DNA, 98 bp, Homo sapiens
  chr8:97039387-97039485
  hypo
aaatatttcaatcatcgaagagtcaattgatgtgaccaacttcattgttattgtattttaagaaacaaggctaggcacggtggctcacgcctgttatc

SEQ ID NO: 99991 - DNA, 23 bp, Homo sapiens
  chr8:97095168-97095191
  hypo
gctgggcgtggagggcgtggtgg

SEQ ID NO: 99992 - DNA, 38 bp, Homo sapiens
  chr8:97145516-97145554
  hyper
tgaaaaggaaggagacggcagttcgggtcattagaagg

SEQ ID NO: 99993 - DNA, 246 bp, Homo sapiens
  chr8:97156964-97157210
  hyper
ggtgggctccaggtgcgagcgcagcgggaagtcgcatacaccctcgcagtgataggcctcgtactccaggggcgcgataatccagtcgtcccagcccagctccttgaagttcacgtgcaggggcttcttgctgcagcgtagcctggacttcttgccgtgccgcttgccatggcgactggcgaaggccgtgcgccgccgccggcggccgggcgagggcagccaaggcctggcatccggggcgcccga

SEQ ID NO: 99994 - DNA, 232 bp, Homo sapiens; identical to SEQ ID NO: 817
  chr8:97157666-97157898
  hyper

SEQ ID NO: 99995 - DNA, 134 bp, Homo sapiens; identical to SEQ ID NO: 32156
  chr8:97158021-97158155
  hyper

SEQ ID NO: 99996 - DNA, 511 bp, Homo sapiens
  chr8:97165624-97166135
  hyper
agatgaaacccaaaccgaagctctcgtactgttcccgcgctgagccctccctccccatctcactgaggcgcgcacgcggcctgcccttcccctggggccgggacctggggggttggctaggggcggccttccctgcactgtcgaccggtaagtcacccgggagcccaggggagcaaccaggtcctccacgaaggctaggggagcggaaagggaggaatcctcaaactgccatcggagctggaatatgatcgggctgcatggcttcagttttgagatcaaaagtagaaggaagggtgttcattttatgtgacttccgctccctgaccagttctgagcttgcaggtgggggcgagggttcaaactggcttgtagtcgcggggaggatattggactcagcacccaggggtcctgcgcaggagaaaccgctgtgctgtgctctttaaggtgctgggccgtgtgcagtctgggaggaagggagagccgcaatctctgtctgcggtgttcatttagg

SEQ ID NO: 99997 - DNA, 91 bp, Homo sapiens
  chr8:97166425-97166516
  hyper
ccctggcctctttcacgcccactctcgggtccctaaaccatgccccgcccccaggcgccggggccactagcgccgccgcgcgcgcttccct

SEQ ID NO: 99998 - DNA, 30 bp, Homo sapiens
  chr8:97166873-97166903
  hyper
tacccgaggggttatcgaactaatggcttt

SEQ ID NO: 99999 - DNA, 45 bp, Homo sapiens; identical to SEQ ID NO: 32159
  chr8:97167178-97167223
  hyper

SEQ ID NO: 100000 - DNA, 212 bp, Homo sapiens; identical to SEQ ID NO: 32160
  chr8:97169708-97169920
  hyper

SEQ ID NO: 100001 - DNA, 35 bp, Homo sapiens; identical to SEQ ID NO: 32161
  chr8:97169921-97169956
  hyper

SEQ ID NO: 100002 - DNA, 285 bp, Homo sapiens; identical to SEQ ID NO: 32162
  chr8:97170053-97170338
  hyper

SEQ ID NO: 100003 - DNA, 888 bp, Homo sapiens
  chr8:97170377-97171265
  hyper
cgcatccccagccctccaccgcattccggggttgtagcggtacttgtggatctcggtcctgctagtctggaggccttggctcgggaacagaggcctccccagactgggtgcacatgcaatccctcctctatctccaggatcgggggcatacagcgcagtggcggggatgggggtggggaggctacagggcaaaccagggtaaagtgatttcgcgtctacgccggattggggcccccaagacttttccccaacccttgtctgaatgccacaggcttccggagacacctccgaacagcccgcagggtcttttggtcctgtgccaaattcacagggcgcagcgaaccagttatggtgcccacttgggggaggggcagagattcttgccacttcattcccgggcaaagaaaatccgcgcccaaccgccggccagcctaggcctctgggacttcttctcttgaggaagggcctcttgagcagtcttctctgagcttccttagcctccttccgcaattgtagtagagaaagtgcacgattaacagaggactttgagggacagaaacaactgtagcaaggcgtgcgtcgtggggagggttggcgagctgcacgggcagcacggaggccagggactcagttgcactactacgaagaagccacatgtctttgcaaaggtgactttagtagccctaaaatcatcataaaatacctggcgttaatttgccctctggacctttcagcagctcatgaacctcgctgacctcgggctgcagcggcgagaccctcgagcaaggaacgcgactatgagtgagaggcggggactggagccggggaagagctcggggctgggggcgggggggccgttagcctgctctaaaaagcttaagagatgtg

SEQ ID NO: 100004 - DNA, 642 bp, Homo sapiens
  chr8:97171317-97171959
  hyper
cgctgcaaggtttccgggcaaccccacttaactgggagcaggtcaaagtcatggagctaagtctagggaggatggaggagtggatatctgcctaaatcgcttttatcccgtcattttcttccttccttctctttactcttcctttcctttttctcccttcctttcctgtctccttccacattattgtctctctcctttaggagcttagtttccgatgcctgtggatccttccctgatttctgggaccagaggtggtgcgaggttttcttgagggcactggccacgctgcagatcaacgccggtggcaagaaggggccgcaagggtttccgcagacacccacacatgcaggcgttcccacagagggtaccagggatttcccagacccccaccagccctcaggaatagcgtagagagaggaacgtcgcctggctgagaaaggtggatgggcatacccatgtacctttgtgtattaagtacccacaacctccgaacttagccgtccctgtcccggcccgcccaactgctgccgccgcatctgcagaaaccactcgtgttgaggcctcggagcagccgggagcaccacgctggagcaaaaaagccggagggcgcagggctccagcccggctgaccatcccacccag

SEQ ID NO: 100005 - DNA, 722 bp, Homo sapiens; identical to SEQ ID NO: 824
  chr8:97172018-97172740
  hyper

SEQ ID NO: 100006 - DNA, 140 bp, Homo sapiens; identical to SEQ ID NO: 32166
  chr8:97172821-97172961
  hyper

SEQ ID NO: 100007 - DNA, 564 bp, Homo sapiens; identical to SEQ ID NO: 32167
  chr8:97172962-97173526
  hyper

SEQ ID NO: 100008 - DNA, 337 bp, Homo sapiens
  chr8:97173527-97173864
  hyper
gtggtaccctccctcctcggccccaaccgccaggcctgccgtttgcgcccctcaggggccagcccggagccagagaagcctcgccctgggccaggcgcagggcccagctcggaacagccccattttctcggttgggtatcgctctccacaaagacaggcgtctattcccgaccctcgaggtcaggcaaaggccacgagtctttagagtttggatcgatgctaaaagctgctgcgctcccctgcaggccccagcctctcctctcgcagtccccaacctcttctgacgcagactttagctgctccacttcttcgtctgctcccgggatcctctccctct

SEQ ID NO: 100009 - DNA, 30 bp, Homo sapiens
  chr8:972233-972263
  hypo
ggtagacactccagccgccacccatcctcc

SEQ ID NO: 100010 - DNA, 46 bp, Homo sapiens
  chr8:9722850-9722896
  hypo
cataatagccccaaacggcaaataacccaaacgctcaacaacagaa

SEQ ID NO: 100011 - DNA, 145 bp, Homo sapiens; identical to SEQ ID NO: 41655
  chr8:972705-972850
  hypo

SEQ ID NO: 100012 - DNA, 29 bp, Homo sapiens
  chr8:97272421-97272450
  hypo
ctcggcccattctgcgatgattttagaaa

SEQ ID NO: 100013 - DNA, 497 bp, Homo sapiens
  chr8:97339742-97340239
  hypo
actcaggagtagaggcgaacattattcaataagagagcttcaagttacaccatgccttctgccccactcagaaaagcaaagcccctaattactcccctggcctggtaagagagcgcacacggagcttgagattaatgcagaagcaaagatcccgggtgctggttaataagcttttccaggagcgtggttgtctgctcggccgtcattaatttgaatgctcattaccataatgtagaagccaagctggggtcctgcgccctccttgccgccagccccgtggtcctggacagcctggctctcatcccacgtagtttcttctcgcccccccgccctttctttaaacgaagtgtgcaattgctattttaaatctgagccttgacattttcagtgggtacgtgcctagatttccacaggtgtgattgcaaacctgtaaattaccggcttccgtttgctgggacaagtgtaaaatgggcctctttgtacgcaggtgaagtaga

SEQ ID NO: 100014 - DNA, 118 bp, Homo sapiens
  chr8:97505645-97505763
  hyper
aaagagaaaagacaacggggaagaaaagagcatagaggagagaggaaaagtggggagagaaaggaagaaaaggactgagaaaacgcaggagccctggcttgccggtgagcagagccgg

SEQ ID NO: 100015 - DNA, 248 bp, Homo sapiens
  chr8:97505801-97506049
  hyper
cggagctgccaatcggcgtgtaatcctgtaggaatttctcccgggtttatctgggagtcacactgccgcctcctctccccagtcgcccaggggagcccggagaagcaggctcaggagggagggagccagaggaaaagaagaggaggagaaggaggaggacccggggagggaggcgcggcgcgggaggaggaggggcgcagccgcggagccagtggccccgcttggacgcgctgctctccagatacccc

SEQ ID NO: 100016 - DNA, 231 bp, Homo sapiens; identical to SEQ ID NO: 3340
  chr8:97506177-97506408
  hyper

SEQ ID NO: 100017 - DNA, 1281 bp, Homo sapiens
  chr8:97506447-97507728
  hyper
cgttttgccctggttgcaagcagcggctgggagcagccggtccctggggaatatgcggcgcgcgtggatcctgctcaccttgggcttggtggcctgcgtgtcggcggagtcggtgagtgggccaggcggaggatgcgcgcgccgtttagggtgtttgaagctacgagaggagcccgcagggaataggggagcgccacctggggaacccccagtccccaagtatacaccggagatccgctgggacaaatgcgctcgtccggtcaccctttccccctcttcccttcctcagaaaagcgctgctcgctggcgttaccccgcggtccgcgggaatgggggcaccgagaattgcggtttggtctagccgcagaggcccctgaagtcactcccaacttcttcgccctcggcgggtcttgctgcgtggtctgggaaggacggaggggaaagggtggcaggaggggggagcctgggtcgggcccgcgagggaacggctccactccgcgcgctcctcgagaccagggatgacctggaaacttcggggtcccttcctccgcacaccatcccccccgcgccagctttcctgtttgactgcatgcaagttctggggagatgggggccagatttaagagacccgcgagtgtccagagagaaaagtttgcaaaagttcttttgtttgatgctccctgcggctagggcgaggtaaccgacactacgtggaatcgcagtaggcgatccctcaaggggatactgggggaggcacggaacgcgtccgaaaatgctgggacgccggccactggattcccagtcctgcggcgaccccctcctcgttgaggggtggaggttgcaccgcggggcgtcagggacgggaggacattttcataggagttacacgggagtgccgcaagcagggcgaggcggggtacgtgtgacacggcgctcggcttcgggtcgcctggccgctgggggacagaggcttccctcccgccacgctcgccctctctggccctggcggggcgcttctggggccgggaggagtctcgtctccggcggagcgcctgccggcacccagcttccctcccccgccctggcggtgggaacttgatttctccttttggtcgcgcttcgggggctggagcttgtttccccacgtcgcccaatgagcgccctctaaagggaactgcctccttggcctcctctcgtccgcagctgcctccacctgggcgccaggagctctgtcgggccaggtggaagcttgagcaccccagatttcgtctgcagcctcag

SEQ ID NO: 100018 - DNA, 30 bp, Homo sapiens
  chr8:9751525-9751555
  hypo
aaaaaaaaaaataagcgaggctaccaacct

SEQ ID NO: 100019 - DNA, 30 bp, Homo sapiens
  chr8:975257-975287
  hypo
tctttcacactcccccgacctggatccccg

SEQ ID NO: 100020 - DNA, 312 bp, Homo sapiens
  chr8:9755972-9756284
  hyper
cgctccctggccgggtcactgggggtatccgggagaggaggctggatgtatgggcggggcgtcctaatggggaatccaggaggatgcactgagacggaccccccactccagcaaataaaacccaacccccaagcgctttcgcggcggggtcctcttcccaggctgcacctgccagcccctctttcttgcaagttctgaggctttccgggatgcacggtggggtcctcgaggccgcaggtactgaagtggatcagagagaggcccggagccgcactgcgggcgccgggcgcacaggctgaccggctgcacggc

SEQ ID NO: 100021 - DNA, 29 bp, Homo sapiens
  chr8:9756486-9756515
  hyper
cgctagagtgaaatcgatgtgcatggaaa

SEQ ID NO: 100022 - DNA, 420 bp, Homo sapiens
  chr8:9760735-9761155
  hyper
cacctccccaccccacgggctccggtgcgggacaggcagccggagggagctccagacccctcccctcgcgcccgcggccgctgcgcggaggtctgcggagggcgcctggctcggtcggtcgctccttccttggcgggccctcgccgacccacggtgctcagccagccccattcttggcattcaccgcgtgccttaattgtatggacatttaaatcaaggtccgctgtgaacacggagagagaggcctttctcctgaggaaggaaaggaggaaggaaggaaggaaaggtgaaagaaaggaagaggggtgggtagaagatggaataagaaaaccaggaaaaagaaataaaaagcggcgcgtgtgcgtgcgcactgacagcggggagagggatgggggtggggaacgccggaggaagggacca

SEQ ID NO: 100023 - DNA, 324 bp, Homo sapiens
  chr8:9761415-9761739
  hyper
cccacctcgccccagcgcagcaacccacccacccatgtcgccctctgcttcgcccaggaaactgaaggggactaggaggaggaagaagagagcgaaggacaaggagagcagcggggactcggcagcggcagccggggcagggcgcgcggccgccgcctctttacctccatcgctgagtgggggcgcagccgggccgggcgtgccgcaggggcgagttgccgcggtccggggctgggacctggggattcagccttccggaactcgcctgctgcagtcctctcgctcaggtcccaagtggtggaggggggaaaggaagagagacga

SEQ ID NO: 100024 - DNA, 504 bp, Homo sapiens
  chr8:9761799-9762303
  hyper
accataagagcgaggcccatctggcccctcatcagctttgtcaagtcttgcatacgctaaaatgctaatgacctagatagctcatgcaaaatgcagcagggagggcgggagcgagggaggtgggagggaggaagagagaggagtgcaggggggagggagggaggagaggcggagggagggagagagggagagagcacccctacactctccccaccccacccccaactgtcagcgggctttaccaggtaaagggtggacgtagatttaaaaggtcactcgtgtataatgcggctggatccccgggtcaaaaaaagggggcgagacagaggatgagagtccctaaagccaaaaggacaataagacatcattttaagcccccacccccatgccctcctccacctctccacactgtttacacacaaatcctgtcgccgcctcatgcatgtgcacggacatgtcaatttctcatcaatttctcagcgctcctatcgacagacacccgaa

SEQ ID NO: 100025 - DNA, 104 bp, Homo sapiens; identical to SEQ ID NO: 3195
  chr8:9762586-9762690
  hyper

SEQ ID NO: 100026 - DNA, 126 bp, Homo sapiens; identical to SEQ ID NO: 41656
  chr8:976259-976385
  hypo

SEQ ID NO: 100027 - DNA, 1011 bp, Homo sapiens
  chr8:9762751-9763762
  hyper
cgccgaacccaaggtgctttgtcccggcggccacacaaggtcttcggctttttgttctccttttttaagagactggccgcagtccccagcgattcagccggcccaaccaaaggcagtggatctactgaaatgaaaaggatcgagataatacacaggcagatgaataaggggggggatgctggaggtgcaggaagcatcctgggagcggccgccacggccaagcccgaactgcttgctgccttcgctggggaaggcgcaggaggcgagccggcgctggtggtcgctccacctggcaggaggaaatgataaccatgataaggaacgtgatgatgatgatgatgatgatgatgatgatgatgagcatgatttaaaaaaaatcagtctccctcttggtgaaccagagcatgcgtgccggagggactgcactgctggcggcggcggccgggggaaggagagcggcgcaggaggcaaaggttgaggaggcagcaccctcggatgaataataacaccgcgccgcgcaagttgcggagccgcctggaaatccagcccttcgcgtgaactcgcgtcgagcgcggattgcaggggatgaggaagaagggggaggggaggggagggtggaggagggagggggaggggtagaggggaaggcagagagggacagagagaattgggagccttttaatttttccttaccaagccctaatctcgtgcgccgtcctctttggctgaggtcgagctcctttttaaaaattattactcctttaaaggattattcaggtaaaggaagccgcatctgctgacggttccgaaaacaagaggattaggagcccgtccacagatccaggcccgcagacccccaccccctctgcaccagcacacgtcattctcactgcccccgggtacctccctctccttcgtgctcggggagagctgtgccaaggaaaatgcggatttggggaaagtgagaagtgggagagctcggaagagcgggaaagccaaggccggaggtgg

SEQ ID NO: 100028 - DNA, 263 bp, Homo sapiens; identical to SEQ ID NO: 3198
  chr8:9763787-9764050
  hyper

SEQ ID NO: 100029 - DNA, 891 bp, Homo sapiens
  chr8:9764195-9765086
  hyper
gggccgctgcggcgacctgagcgccggtgcagcctcccccaccccgcctgggcgggcgtctgggcaggacagctgcggggggttgggagaggagtcggggagagggggacgatcgccccatcccccgcccccccgcagtcaaggtgaacatgaaggagagccggcgcgcgtgcccgcgcctgggaggcgcgcggccccgcccctcccggagccctccagcgcgcccgggccagatggacgcccgagattagaggcgcagaagtgcgctccacgacgggcccacccgtcccgcggacatcagacctacttcggggaggcgccttttgttgtggtggccgtggcggtgtttgtgtctttccgggagcacagggtgagcttggccttcaggaatgactcagaatgaatccgcctataagagccaaactaaagacgaccccccgccccagccccccaaccataacccaacgcctgccatgagaaaccttcggactttccaaggggtcagtgcctcagccacgaggggcagccctgacccgcgcggttcacgcacacgcagggcccatctgcttcccctactccggcttttcttctctgatgacttaaaagagagtgagtgagggagagagggagagagagagagaggtctaagtgtttcttgggcactgctggattcagggcaactagagatggggagaacaagccccgccagctaaaagcagccctgctgaaaccacacagcccgcgagggtcgcagcagaggcgcccacccagcaggagtggctgcacgaagggtgacccgggcgaggcccttctcgcttcgaggccatttcggctcttgtcaattattgggtgtttgtcccaatataagtagaatggcgatctcaaaccctt

SEQ ID NO: 100030 - DNA, 321 bp, Homo sapiens
  chr8:97657790-97658111
  hyper
ctggctggggagcggcgggttgggagcctgtggctgccccttcggtgacagtggagtcaccgagcctagaaatggggaagctgtgacgtgggggtggtggagggtgctgcgggacagcagcgagcacggccctcagccgtccttcccaacacggtttcacttcccctcagctccagggctcagccccaagccgcccccttcatcccccatctgcaaacaatcctggtccccctgagcctccaatatgccttatgcagttcttttggggttcctttcgcattttaccgtgtactttcgcttttgatgcgtctagtttctgct

SEQ ID NO: 100031 - DNA, 180 bp, Homo sapiens
  chr8:977877-978057
  hypo
tccaggtggggtgccaggcgcccgttattctccaggtggggtgctcggtgcctgttattctccaggtgcggtgccaggcgctcgttattctctaggtggggtgtcaggcgcccattattctccaggagcagtgccaggtgccggttactctccaggtagggtgctcggtgcccattattc

SEQ ID NO: 100032 - DNA, 32 bp, Homo sapiens
  chr8:97819738-97819770
  hypo
gcttgagccaccgcgcccggctgaaaactact

SEQ ID NO: 100033 - DNA, 163 bp, Homo sapiens
  chr8:97982654-97982817
  hypo
aagcagtaggtaactcgtgttatattcattttacagaagaggaaaccaaagcagagaaaagctaagtaccttgcccaagatcaccagctattatgtgaaaaatttaaatctaggcagcctgacgccatgcccaacactcttttttttttttttttgagacgga

SEQ ID NO: 100034 - DNA, 43 bp, Homo sapiens
  chr8:97983057-97983100
  hypo
tgggattacaggcgtgagccaccgcgcccggccactcttaagt

SEQ ID NO: 100035 - DNA, 50 bp, Homo sapiens; identical to SEQ ID NO: 828
  chr8:98289818-98289868
  hyper

SEQ ID NO: 100036 - DNA, 464 bp, Homo sapiens
  chr8:98289922-98290386
  hyper
cgcctgggtgtcttccccgagactctggtactgtgaagggtccgggtcgcgcggggcgtcgtccggagcagggcggactcgggctttggcgcggcctttgccccggtttttggcgcgggaggactttcgaccccgacttcggccgctcatggtggcggcggaggcagcttcaaagacacgctgtgaccctgcggctcctgacgccagctctcggtcgggaccgagcgggtctctccacggcaaccgccgacgtcacgaacgtacaactgtaccgtcgcgagaggacgtgatgcgcccggtgattggcgccgccgctgcggctgcgcaggagacgacccccgcgggcgctcccacccccatctcgcgcggactcgctttaggtctcggcgagtttctctgatatgcgctcgcgggggtgctgccatttcatctcttccgcgcgggctcatcgtgctctcagggtc

SEQ ID NO: 100037 - DNA, 30 bp, Homo sapiens
  chr8:98307773-98307803
  hypo
ccaggaatgtttcaccgatggctggcactt

SEQ ID NO: 100038 - DNA, 34 bp, Homo sapiens
  chr8:98404798-98404832
  hypo
aggtgtgatccaccacgcccggccacctctaacc

SEQ ID NO: 100039 - DNA, 30 bp, Homo sapiens
  chr8:987146-987176
  hypo
ttcagtccttcctgccgcctgcacccaggg

SEQ ID NO: 100040 - DNA, 30 bp, Homo sapiens; identical to SEQ ID NO: 15140
  chr8:98738336-98738366
  hypo

SEQ ID NO: 100041 - DNA, 39 bp, Homo sapiens
  chr8:98748495-98748534
  hypo
agactgggcgacagagcgagactccgtctcaaaagagga

SEQ ID NO: 100042 - DNA, 28 bp, Homo sapiens
  chr8:98787775-98787803
  hyper
aagggaagaaaatcgcaaggaactagac

SEQ ID NO: 100043 - DNA, 152 bp, Homo sapiens
  chr8:98788285-98788437
  hyper
ttgtgctgccatgtccgcaccggcaccatcctgctcggcgtctggtatctggtgagcgcggcgcgcccggcccgggaccctgcgttgcttccgcgcccctagctgggcttctggcccggcctcgcggtggggtgaggcgtgcgctcatccgc

SEQ ID NO: 100044 - DNA, 213 bp, Homo sapiens
  chr8:98788792-98789005
  hyper
ggatttgtcaatgctcgttctccctggccgcgtctccgctagggtggcctgcgctttcacgccgtcgcacgttcggatcccgagttgaagtggttgggagttcttggcatcctcttgtgaatgggtcccccccccgatgttttaaagcccttactccaggaagggatgtgagtgtgatttactgcgtttccatctgcccggggaagccatttt

SEQ ID NO: 100045 - DNA, 30 bp, Homo sapiens
  chr8:98881022-98881052
  hyper
aagctgcctgtgttccgtgcctgcggctcc

SEQ ID NO: 100046 - DNA, 67 bp, Homo sapiens
  chr8:98881817-98881884
  hyper
gggacgcccagaccccggccaccgcgacccagggaaagggagacctgttgagcgggtatgcagggtg

SEQ ID NO: 100047 - DNA, 94 bp, Homo sapiens; identical to SEQ ID NO: 9694
  chr8:99076589-99076683
  hyper

SEQ ID NO: 100048 - DNA, 535 bp, Homo sapiens
  chr8:99076759-99077294
  hyper
cgcgcttgcgctctacgcccaagggagccgggctgcagagctggagaaacttccgcggctacgggtgcagttgccttcggttcccggttccgggccgacacccgcgcagggctgagacaggtgtctgcgctccccgcaatgggctgctccagcagcgccctcaacaaggccggcgacagcagcaggttccccagcggtgagcagggtaccggcgccgcccgcgcccgggctggggactcgggtgggctaactccccaggaggtccaaagggtgtgtcccgtggccaccccgcctggcaggagccgggccttgtcccggaggatgcgagcagaacccgggacaaagcgcgatttccttccaaatctggagcggcgctgctgtgaccgcgggtgcggcggccctggtgcgctccgcggcgctcgctgcgagacgcgcggggcccgaggccgggcgctggattcaccctgtccgctgatgggatctcggggagttggtgttgaggccctaaggcggttagcctcggcattgccttaaa

SEQ ID NO: 100049 - DNA, 78 bp, Homo sapiens
  chr8:99130933-99131011
  hypo
gtaaccattatgcccggcctcattttttttctttcccttgtcctgtttcctattgtgctgtaccgcataatttagtat

SEQ ID NO: 100050 - DNA, 1564 bp, Homo sapiens
  chr8:99438813-99440377
  hyper
caacaaccccacccccgggcttcgggaaacttttcttcaggtccctaaaaggggacacctggagttcctccggtcccgccctgtccccggacacgcgcaagccgccctttatttcccagcccagctcccgccagacccagcggggaaaggtcaccgtaggcagccccctgcctgcgccctgggggtggtgataataacagctgtcaccgggggatggtcggggggaagggagaggtgtcggccccgcgccgagccgggggcgcaaggtggtcgcggtgacgcgccggggaagcgcagagaagcagcggcggcggcggctgcgccttccgagcccgggcggcggccgaggcacgcggagctgtccgttcagcaccaccgcgccgcgccccgcgcagggcgggcgccccgtcacacccgctctgctcccgccccggctcacggggcgaatgcggcgcgggttcctgcctctctgggtgggtgaggggcgcgcggatccggagagggggctccgggagcggcgggaccacgcagccacctgtgagccttcggcagctgcgggcggcggcggcgtacccggcccgagacgggaggagacgctcggcggcccccgcccgccggcccgccgggcgcacacactcgcacccgcgcacgcaccgccagcaggcagcggccaccgccgcgatgctcgcccgcgggttggggaagtttcccgccggcctcggccgcgggcacccgtgctcccaggtaagcgcttccagaacgcgcagggcgagcccgggcagccccgctgggtgaggcgcagcgcacgcggccccggggcatagcgccaggccggcagggagacctgggccggggacgcgggggctgcaggcgtgggatctggacccaggggaggccgggccgcccccctcattcccgcggcccgggtttccagactccagcgcatcccccccaccccaccaaagctacgcgccccccgtgtcggcccggccctgcccgtgcgtatctcagctccggtcccgcctgtctgcggcgagcgggcgggggcgtctcccgggcctgcccatggacaaggtcagcatgcagccccctgggcgctcagagccgcggggacgcgaccccgcacgcgcaaagcgcccaccgagacccctggggtggagctgtgctaatagaaacatacccacccccagcctttcctgggaggggatcagacccctcaaactcttgccccagcccagcccttcagcacccaagacccaccaggaggcctgggcccgccagtaatgggtagggagagggggccccgccagggcgcacggcgctctcgccgacgctgttccctccgcttccaggtgtagcgcccccgcgcggcgcgggcggccggcgcctccagcatgaccggccagagcctgtgggacgtgtcggaggctaacgtcgaggacggggagatccgcatcaatgtgggcggcttcaagaggaggctgcgctcgcacacgctgctgcgcttccccgagacgcgcctgggccgcttgctgctctgccactcgcgcgaggccattctgga

SEQ ID NO: 100051 - DNA, 30 bp, Homo sapiens
  chr8:9993158-9993188
  hypo
cattctgtgcattcgcgtgcccctatgcta

SEQ ID NO: 100052 - DNA, 224 bp, Homo sapiens
  chr8:99950717-99950941
  hyper
ggtgacaaatcaggacgccaatgctggatgcacttgaaggtggagagctaggcagattgaggcagcaggaagcagggtgggagccagtgtgcaccaagtgggtgaggggaacatgtgagtcagttccagctgtcctcagaccctcctgcccagcctcagggtaatccaggggcacagagactctgagccctggcccacccgtggtccctcggattttgacactc

SEQ ID NO: 100053 - DNA, 110 bp, Homo sapiens
  chr8:99951392-99951502
  hyper
gcagatgcgtttatgcgtgcattctctcgagtgaaggaagaaggaagaggtagggacggaggaggagagagagcacgcgcgggaaagataaatcgcgcccgcccgcgatg

SEQ ID NO: 100054 - DNA, 347 bp, Homo sapiens
  chr8:99951797-99952144
  hyper
aaacaagtctggagacgggagggtagcgctgctcagctccagccaactcactgccgcgtaggaacggaggtcatcggaaatcaagatttccgtttgaattttcccaaagtttaagcgttggcaagtgcgttgaaaaacacacacaatatgaaagcctaataaaaatataggtttgcagaccgtgccctagtcttttccgaggatgttcttttctgtcatccatcgtctacccacgttgagcacgacagccgggccagtcccgccctgggcggttggggccttcccagaggggcccggtgcggagagcccccctctccccggatgtgtctggggcctgtccttcactg

SEQ ID NO: 100055 - DNA, 106 bp, Homo sapiens; identical to SEQ ID NO: 832
  chr8:99952198-99952304
  hyper

SEQ ID NO: 100056 - DNA, 401 bp, Homo sapiens; identical to SEQ ID NO: 32188
  chr8:99952532-99952933
  hyper

SEQ ID NO: 100057 - DNA, 169 bp, Homo sapiens
  chr8:99952968-99953137
  hyper
cgctggggtcagaactggtatctttctcctcctctggggaagtcagggcagcccggagtggcgtcgtgggtccgaaaaatccgtctcagaaacccaccaggagaaaaggctctggggtgggggacaccatgtggggctcccacaaaggacccgacggtgggtgtggaga

SEQ ID NO: 100058 - DNA, 407 bp, Homo sapiens
  chr8:99954156-99954563
  hyper
gcggcaggaatggaacggctccgcggagacagcctcgggggcacagccgggccactgcagactccgggacttccctctccgcacacccgaaacccacaactcgcccgtgggccgcgtggcctttctgcgccgagggctgctgggggcgggcggcgagcctggcgggtgacctgctcttgggtgggccccgcaatgcctgcgccctagacgccggccgggacgaggggctggctgggtctgagcctggagaaacacaagggtcagcccccagtgggcgcagaggtggcccaggagggcccgcggacggtgctgcgctgcgctcagcctccgggccgctccccgcgttcggcgcgcacctgcccatcgaggcggcagggccagcaggcggcctaggcgcggccgggcca

SEQ ID NO: 100059 - DNA, 84 bp, Homo sapiens; identical to SEQ ID NO: 32191
  chr8:99954678-99954762
  hyper

SEQ ID NO: 100060 - DNA, 128 bp, Homo sapiens
  chr8:99955180-99955308
  hyper
aggatattaaacactcgaatctccgtttcaagctcactttttaatctttgcgaacttaaaattggaaagacagaaaaaaaatctgcgacccctgttatgttttaccaaaggaacgaaaaattctctcc

SEQ ID NO: 100061 - DNA, 50 bp, Homo sapiens
  chr8:99955973-99956023
  hyper
caagttggtttactgcgtatgaaatgaacatttgccgattaaagcttaaa

SEQ ID NO: 100062 - DNA, 423 bp, Homo sapiens
  chr8:99957286-99957709
  hyper
gatatttaatctaagcggtcagcaagacttcttataaaagctggtctacgtacactgagatcaaaccccacaatcccatggtgtttctgctcctgccctagcaagcctgggtcgacttgtcccggggcagccgcggcagcgcagcgtggacgggcccggacacccggtgcctgcccagccagcgacgctgaaggcacatttcaagagggaaatagttcagtcctcggtaatttgtcaacctcgtgctggctttaaaattctcctcccaccttctagtcctgactgagggggcccaaaagcaaactccccgggggcttaaacgctcggattcctgagaaacggcaagtgagaaaggagttgcagttgtacgaagaaggagcgaggaaaaggtgtttgtggagggagccccggatctgtcttcct

SEQ ID NO: 100063 - DNA, 450 bp, Homo sapiens; identical to SEQ ID NO: 32196
  chr8:99960048-99960498
  hyper

SEQ ID NO: 100064 - DNA, 253 bp, Homo sapiens
  chr8:99960921-99961174
  hyper
gcagtcccctcacggctttcggggggtcttggagtcgggtggggagggagacttaggtgtggtaacctgcgcaggtgccaaagggcagaaggagcagccttggattatagtcacggtctctccctctcttccctgccatttttagggctttctctacgtgctgttgtctcactgggtttttgtcggagccccacgccctccggcctctgattcctggaagaaagggttggtcccctcagcacccccagcatcc

SEQ ID NO: 100065 - DNA, 649 bp, Homo sapiens
  chr8:99961568-99962217
  hyper
cgcctaagatgggagacctgagcaagctgagcccaggactgggtagccccatctcgggcctcagtaaattgactccggacagaaagccctctcgaggaaggttgccctccaaaacgaaaaaagagtttatctgcaagttttgcggcagacactttaccaaatcctacaatttgctcatccatgagaggacccacacggacgagaggccgtacacgtgtgacatctgccacaaggccttccggaggcaagatcacctgcgggatcacaggtgaggcgggcaaggaggatggctgggagagggaaagcgaatttgtcctggacacaccgagtcctgatagacattcccagtgtcattataatcccctgtgatctaaaatacaccctcagtcacgctcctcagcccggttcagctaattcccaacatctaccctttctttcccccagcggctcttgctacgttcttgtttggaatgagggagggcctttcctcagtcttggacaggaacaatctgttggccttagtcctgggatggttatcctgtctcctcccggtgctgtggggagtggtgcaggcagaacccaggtaccctggggtgccggtcctggctgcagtcgggctacttctgttgggtttcgtccctccccccac

SEQ ID NO: 100066 - DNA, 274 bp, Homo sapiens
  chr8:99963588-99963862
  hyper
ggaagattaggagcacggatttgttcctgcaagtctcctcttttgttgtcatgagagtgttatgttaacgcttgtgataacgataagacagaaactattgaaaagggtgcagtggtggtgtgaaggattaatcctttgcttgcttcacatctgaacaggaatctccacacaaatgtcccacatgtggaagaacctttaatcagagaagtaatctgaaaactcaccttctcacccatacagacatcaagccctacagctgcgagcagtgcggcaa

SEQ ID NO: 100067 - DNA, 199 bp, Homo sapiens; identical to SEQ ID NO: 32200
  chr8:99985845-99986044
  hyper

SEQ ID NO: 100068 - DNA, 302 bp, Homo sapiens; identical to SEQ ID NO: 835
  chr8:99986225-99986527
  hyper

SEQ ID NO: 100069 - DNA, 229 bp, Homo sapiens
  chr8:99986791-99987020
  hyper
cgagcaacccaggggccctgcgggaggaggagagggtcccgggagtccgcccttccctgcgccttcgggaccggcaggaggcgctgcgcgggcgaattaaaagaaaaggaaaagctcgtagtggaggtgttaccgcatcctgcctttggacgctactcttagttgagtgacccgattcggaccttaggggcgttagggtctcctccaccgcctccctcccctgttaaaa

SEQ ID NO: 100070 - DNA, 94 bp, Homo sapiens
  chr8:99987080-99987174
  hyper
attttagatatgctgacataggcacttaaaggaagggtgtaaggcagacattctaatccttgactatctgtgaagggctcgcctatgattgcca

SEQ ID NO: 100071 - DNA, 132 bp, Homo sapiens
  chr9:100000368-100000500
  hyper
taaaagacatgcaaacgcccttaaccgctaagctcctgaggggtaacggtatgctacaaaagtgcttctgagctactactcctggaggcttggtccgagtgaccgcagcagtgggcgcggtggaagagaagg

SEQ ID NO: 100072 - DNA, 355 bp, Homo sapiens
  chr9:100000739-100001094
  hyper
ccccttgggcggtggcggagctgataagcgcgctagtagcagctctggcagaagcaacggtggcttcgagggatggcggcggctgcaacaggacctgcagcatcccagaggtgcgtgtttttccttccctttgctatttattttatcccctttccttggctagtgggtcctgctgaagtcgttgttttcctgagaggttttttccagagcttctcagatgctctaatccactgcggcgttagaggtgagagagccttttctgcttcctccacccctggctgacgcgcctcctcccagcagcacctgattgggacccagggtcctgtggttactgcgtgtccgccccagtattgag

SEQ ID NO: 100073 - DNA, 172 bp, Homo sapiens
  chr9:100264699-100264871
  hyper
gaaagagcttggaggcgggagccccaggttgtcgccggctctcggcatggccttggcaatccccctcttgtttctggatctcagtctcccatttgtaggggcgaggtttggtagccgcgatggagctgggagcccaagccctgagagctgcagggcgcgctcttggccgcct

SEQ ID NO: 100074 - DNA, 39 bp, Homo sapiens
  chr9:100267685-100267724
  hypo
tggtgaccccagggccgtttctagcgatgattctggagg

SEQ ID NO: 100075 - DNA, 30 bp, Homo sapiens
  chr9:100278507-100278537
  hypo
caggcaggggctgggcgctgagatgtgcag

SEQ ID NO: 100076 - DNA, 77 bp, Homo sapiens
  chr9:100349303-100349380
  hypo
gctcctccccaccacttggcataattctatggagattcatccaagttgttgcatgtaccaatcgtttgctctttttc

SEQ ID NO: 100077 - DNA, 317 bp, Homo sapiens; identical to SEQ ID NO: 42169
  chr9:100397395-100397712
  hypo

SEQ ID NO: 100078 - DNA, 151 bp, Homo sapiens
  chr9:100457244-100457395
  hypo
tcagatactatgttgcgcaaaaaaagccagatactgtatgactcaatgtacatgaagtttggaaataggtaataccaatcaaatggtcagaagagtattacttctgagagtagagagtggacaccgactaggaaggcgcaataggaaaact

SEQ ID NO: 100079 - DNA, 527 bp, Homo sapiens
  chr9:100503433-100503960
  hyper
gtcctgggagaagggcggaaggttccaggagggcgcctgcctgcctagagtccccttgccggtctcaccctggaaaggtaggcggaactagaacaggcgggccccactgcctgcagcctgcgaggagacgccagggctgcaagcccccccgccctcctccgcccctgccgggacagtcagccgctaggggattaggaacgggcccagcgcccattcaagccattcagcgagacaggaagccaagcgcgctcctgcccgcccgcctctgccgggcaggtctgcgggatgacgcgcattgtgctggggactcgcccaaagggaggcccagccgtggggaaaaccgcgtcccgcgggaatccgacgcccggtgacgggggcacctgcaaggcttcagggcgaatccctgactcccagcccggggctgagtcctcgtggggccgcctccgcgctgcccagtgctgccggttatctgctcacagcgggtggctccgggccttcaggagcgcgacgggcgccatcccttccag

SEQ ID NO: 100080 - DNA, 77 bp, Homo sapiens
  chr9:100610058-100610135
  hyper
tgggcaactggaacccggctggagtgtgcagctggccccctcacttccagcccgcaggctgccgcgggggtgactcc

SEQ ID NO: 100081 - DNA, 280 bp, Homo sapiens
  chr9:100610200-100610480
  hyper
cggcgaaacctagagagacttgcactccaggcccggggggtgggggggcgggggagaagccttagggagagtggggaggaggccagaggagagctggctgctctctcgtgttgaggttcaagtgtcttccagctccccgcgccccctcctcaccgtgccaccgcccacctcatgctttgggcgccaagcagccaagcaaccgggttgcgttgtagggggaggcaatcagccctgttacccctcctcaggcggccggactgagctgcgggatgggatccct

SEQ ID NO: 100082 - DNA, 136 bp, Homo sapiens
  chr9:100610681-100610817
  hyper
caagtgttccaaagccgcgcacaaatttcggaaccagaccaagaatcctggactctagacgttgcctgggggccgatcctgcgcccagggtcccagaatctaactgaaatgcgcctgcgggccgccaccttcgccc

SEQ ID NO: 100083 - DNA, 539 bp, Homo sapiens
  chr9:100611124-100611663
  hyper
gggcccgcgcagactgggttgggagagggctctgtgggagggcttgcggggagcggggtaagaaaggctaggtgcttcttacctacgtaagaaacgttggtggcgggatctaagcaaacggggaggtgggaagcagaaggttccccttcctgggccccagttcctccatcctgtcccctgggtgacagtgattcgctgttcatagtgtttaagtggaccaacttaaagggagagagcgcttgccgagctctgggaaaccgaaagggtccacgcccgcgggagcctcggagactcaaaatcccccgctagaccgcagaaaatgttacactttaatcaaccgctacttcttccgtggagaggggcggtgggtgggggtgtgcgcatctcatcgcggcctgtgagtggaacaggctagaattatccccagcgtcttttttccatgtccaagtttcgccttaaaacaatttaaaagaggaagaagaggaccgcgcgtctgtaaggcgctccactttatcaccttgactcggtggaagagaaag

SEQ ID NO: 100084 - DNA, 313 bp, Homo sapiens; identical to SEQ ID NO: 32597
  chr9:100613687-100614000
  hyper

SEQ ID NO: 100085 - DNA, 230 bp, Homo sapiens; identical to SEQ ID NO: 32598
  chr9:100614192-100614422
  hyper

SEQ ID NO: 100086 - DNA, 760 bp, Homo sapiens; identical to SEQ ID NO: 32599
  chr9:100614441-100615201
  hyper

SEQ ID NO: 100087 - DNA, 834 bp, Homo sapiens; identical to SEQ ID NO: 3451
  chr9:100615202-100616036
  hyper

SEQ ID NO: 100088 - DNA, 199 bp, Homo sapiens; identical to SEQ ID NO: 3452
  chr9:100616270-100616469
  hyper

SEQ ID NO: 100089 - DNA, 770 bp, Homo sapiens; identical to SEQ ID NO: 32602
  chr9:100617285-100618055
  hyper

SEQ ID NO: 100090 - DNA, 1163 bp, Homo sapiens; identical to SEQ ID NO: 32603
  chr9:100619620-100620783
  hyper

SEQ ID NO: 100091 - DNA, 17 bp, Homo sapiens
  chr9:100735117-100735134
  hypo
tgcggcactgcactcca

SEQ ID NO: 100092 - DNA, 30 bp, Homo sapiens
  chr9:100797208-100797238
  hyper
tttcacaggggaggacgttgagaagttcct

SEQ ID NO: 100093 - DNA, 52 bp, Homo sapiens
  chr9:100817046-100817098
  hypo
ggcctctggatccatcgccagagggggtctacagaaccggggcaggtagcac

SEQ ID NO: 100094 - DNA, 143 bp, Homo sapiens
  chr9:100818294-100818437
  hypo
tacaggtgtgagccaccgcgcccgcccaggtgattgtattttaagagcctggggctgggaggtccgggtactagtcccatctctgctttggctttctggatggctttggacaagccagtgcaacttctcgaacctgttgcctc

SEQ ID NO: 100095 - DNA, 21 bp, Homo sapiens
  chr9:100835849-100835870
  hypo
ccaccgcgcctggcctgggct

SEQ ID NO: 100096 - DNA, 124 bp, Homo sapiens
  chr9:100843289-100843413
  hypo
gtgcgtcttgtggagcgtgccctgggctccccaaccaagcagctgctgccctgtgagatggcctgcaatgagaaggtgtgtcctgccggactctactcggttctgctgccgtgtgtggaaaaag

SEQ ID NO: 100097 - DNA, 176 bp, Homo sapiens
  chr9:100935510-100935686
  hypo
cttccaccaagttcccggtgactaggaagccgctggcccaggggccactctttgagaatcgctgctctacagcccagctctatgattcacaactatcgctcagtttacccctcacaaccatctgggggcgcggaggattatctccacttcgtgagtgtggccggggcactctgcag

SEQ ID NO: 100098 - DNA, 30 bp, Homo sapiens; identical to SEQ ID NO: 42172
  chr9:100981193-100981223
  hypo

SEQ ID NO: 100099 - DNA, 94 bp, Homo sapiens; identical to SEQ ID NO: 42173
  chr9:100981840-100981934
  hypo

SEQ ID NO: 100100 - DNA, 30 bp, Homo sapiens
  chr9:101016284-101016314
  hypo
ggaaccacatgacctcgaaaatgccttccc

SEQ ID NO: 100101 - DNA, 38 bp, Homo sapiens
  chr9:101216438-101216476
  hypo
acttgctgggccccacgcctgaccgcttgttgttgtac

SEQ ID NO: 100102 - DNA, 1179 bp, Homo sapiens
  chr9:101469181-101470360
  hyper
atgctcaggcaaagacgagggcgataggaatgtcattcggaaatgatttcacaccgggttagccctgcacagccagccagcttgcatcctctggggcagaggacgcctctccgcctgcagcagcctgcgcgtaccgctgccaactgccaccggttccttcaccttttatttacagcgcagagcaagctggttcaccggtgaagcgggggaggcagggaataagatacaatctagattctgctctttctctggggacataaagagggtccgaccaaggaggaggggaagcccagattgcaccaccagagcagtagcgcgaccctcctcccaaaagggttctgcacctggactccagcagaagcgcccggagagtcccaggaagccaggatcaagcccagcgcctcggccccgttccgcgcgatggaagaggcgccaaccgagcgtactgcacaggaaatcactgcccccttcaggccgcgtctcagacgctgcggtcggagcacaggggctcgctcggtccggaaaaactcgcaaacccgaccttgcgcggccagcgatcgctcctccagacccgctccgcgcgctccagccccggcctggcggtgaaggtccgctctggggcttcaggcagaacccaaaccgagggcgtggggaggggtcttgggatggaaagcccttggctctctggctccgctccggactgctctccaagtctgtgctccggctgctaggtcggatgcttcaagcctgagccgtgagaaactgcctgcagccgcccggccaacagcagcggcgcggccggacaccactgcacgtccgggacgagaactgccagggcactttctgagcaactaacccgaggcaggggtctcctgaaatcgctctggccacaggcagcgccgggcacgtccaggcagaagcgctgcagagccggtggccccacacttgcccgcgcggagcgggctcagagctgctggcgcgcaccaggcgcccagccacgctgcacgctcaagccccttgggttccggagccttccggacctcaaagcgcggctcggcttccctgggggcctgtgagcaggcccgcggcccctccggccctgggtggcccagtttgcagtcaatgcgcctgttcctcccactcggtacctcgcagccccatgagcgggacctggacagg

SEQ ID NO: 100103 - DNA, 946 bp, Homo sapiens
  chr9:101470607-101471553
  hyper
gatctgaccaaaggccggaggttgcctgtgtccaaaccacccaccccaatgccccccgaagccccgacggcaggggcagccggacactcacctccgtgtcatagagccgcaggtcgaggaagtaggggcgcaggagtgactcgttgcggatctgctcgatggccagttccacggcggggagcacaccgcgcccgatgctgcccttggccacctccttggtgagcggcatgaggcccatgatggagagcggcgggctgctgggcggcggccggggggcgccccgcgcccagccccaggccccgggcgccagaggcagcagcagcggcagcagcagtagcagtagcaggcgcgcgggcggcggtggcggcggcggcggcggcccgggctgcccggagctccgcggggaagccatgccgcgccgcgggctgcgggcgccggctcactcggcccgcatggcctggcccggcccgccgccccgcgccaaggtcttcccgcggcgcccgcgcaatggcgccggcccgggccccggctccgtctcgggctagggttccggctcggctcagaacggccgcggcggcggcggcggcagcggcggcgcccgtgacggatcaatcacgccgggaaggggtgggagcgagcggagtgcgggaggcggggagcaagcgagcaaacgcggagaggggggccggcgtctccgcgcgcgcctctctccagcgcggccgccccgcaccgggccgcctccgcccgcccccgtgcgcgctctgaaccgctctcccgccgggagctgctaggcggcagcccctggagctcggccgggggagggcggacggcaggaaacgcgggaggcgaaggcgaggctgctcaggggcggctcgggccgcctccagggacggggacgagccgtgcgcgccgggggagggggaggcgctggcgctgcggcggccgc

SEQ ID NO: 100104 - DNA, 399 bp, Homo sapiens
  chr9:101471554-101471953
  hyper
gggagggccaccttcccagcacacgcacacacgcgcccccggccctccgctgcgccagctgccgctgcccgccgaccgctgacctccaggcaccagagcgcccggggacagcgatctgggaaccgggaccgcgcgctggcacacgcagtggccgccgccgctccgccgagcgctgcctgtagcacctgcacggtggtttggaaccgcttctcggaggtctggccgggaaggtctgggcaggagaatgttccacgaaggcgtcccagaggcatctgcagcctacgctctcccgttcttttctggcgcccacgagcccctgaccgagtcccgggggtcgctgaagacgcccacgggtgctcgaacgcccgttggtgccaggctgcccggcctttagggcct

SEQ ID NO: 100105 - DNA, 30 bp, Homo sapiens; identical to SEQ ID NO: 42174
  chr9:101557939-101557969
  hypo

SEQ ID NO: 100106 - DNA, 49 bp, Homo sapiens
  chr9:101559178-101559227
  hyper
ccttgactttactagcgggctccgctgaccccaccgcagcccctggcac

SEQ ID NO: 100107 - DNA, 173 bp, Homo sapiens
  chr9:101705868-101706041
  hyper
agaggattccctcagcggctgtgaaagagtgctttcttgcgggtcagccccgacaggacagacttaagggcgggagggagcccatcccgcttgccccaacgaacgcgggcgcggggctttcctcgcaggttacataaggcagccgcgggtggaggcagcagaggcgagcgcac

SEQ ID NO: 100108 - DNA, 154 bp, Homo sapiens; identical to SEQ ID NO: 32611
  chr9:101706042-101706196
  hyper

SEQ ID NO: 100109 - DNA, 584 bp, Homo sapiens
  chr9:101706312-101706896
  hyper
cgcgccttccggggctccgcagacccgcgagatggcaccaaggtaagacccgcttctctgcttcctcgcgtcccgggcccctccaatactcttgcccgcctcaccttttctccctcgggcacatcttgcaggaggaacaacgggcagtgctggtgtctgctgatgctgctctcggtctccacgcccctccctgctgtcacccagacccgcggtgcgacaggtaagcaacccggtcggagggtggcaccggctgcctccgcgcccgtgggggaagtcggttttggcggcggacgcggctgcgatgcgtgcctcattcctggacataaaagggagtcttgccactcagtgcgcactggcggtcccgcgggcggctacctcctggcagtgcaggggttatagctgtgaatgggatccctgggcagctggggcggttggagcgttgtctgggcacccgagatgtctgagctgggtgcggagcctccaatcttaggcagagagggacttcagaaacagcgccagcgccagcgccaacagcctcagcgcacccagcgccagcagcttaggttgtgcgtgctggctggctt

SEQ ID NO: 100110 - DNA, 30 bp, Homo sapiens
  chr9:101734127-101734157
  hypo
gggggagccaccccacgctctctctctctg

SEQ ID NO: 100111 - DNA, 30 bp, Homo sapiens
  chr9:101924520-101924550
  hypo
tttgatacagacattcggtgcttgccaaat

SEQ ID NO: 100112 - DNA, 19 bp, Homo sapiens
  chr9:101982656-101982675
  hypo
tacataagaatgtcccggc

SEQ ID NO: 100113 - DNA, 40 bp, Homo sapiens
  chr9:102107331-102107371
  hypo
acacactcacacacccgagggggcacgcttccagtcccat

SEQ ID NO: 100114 - DNA, 30 bp, Homo sapiens
  chr9:102186087-102186117
  hypo
ggcacaggttttctccgtggatgctcctgt

SEQ ID NO: 100115 - DNA, 28 bp, Homo sapiens
  chr9:102203901-102203929
  hypo
gcatgagccactgcgcccagcctattcc

SEQ ID NO: 100116 - DNA, 341 bp, Homo sapiens
  chr9:102586644-102586985
  hyper
cacccactgaaggggcgggtgggggattgctggagacccccattgaagatgcggggagacgggaagcacgtgctacagccgtgggaagatccgcttctacccgcgctacatcgagcgcaagctttccgtccgagcagctccagctggggctgggggtggcaagggaatcccccatttcctggtcgtcgagggtttcctggacctgggagccccgagtccctttctctcttcctgcaggcaagccccgggctcaggggcgccaggagatgaccctcgtggccccgcgcacctcggaggtttttggtttggtttgatttggggtttttcggtccctgttccca

SEQ ID NO: 100117 - DNA, 37 bp, Homo sapiens; identical to SEQ ID NO: 15233
  chr9:103174717-103174754
  hypo

SEQ ID NO: 100118 - DNA, 87 bp, Homo sapiens
  chr9:103176794-103176881
  hypo
tgatgtatgaaataacgaaggctatagcgggtcacatcctcgagttaatgaaatacagtgttcttttttttttttttgagaccgagt

SEQ ID NO: 100119 - DNA, 50 bp, Homo sapiens
  chr9:103235208-103235258
  hyper
caaacaagtctgctacggtgcagcctaccgccgaggggtggccccaaccc

SEQ ID NO: 100120 - DNA, 623 bp, Homo sapiens
  chr9:103235307-103235930
  hyper
cggcgccggccgcggccgggggcggagctgtcggcgcgggagctgggggtgtgcgcggggcggggtcgcagccacccctcccgccggcggctccgtcacgcgcccctcaccgggcgggccggggtctttgtgacgcggtggcaacggccacggacacaaagggaaggcgaggaggcgagcaagaggctgggcctgcctccggcccgcgacccccgcccgccgcgcgcgcgcccgcccgctcccctcgccgcggtgtcccccacgccggctcgcaccctcgcgcgcacccttgcgcgcccgcgaccctcgcacgcgcccggacccgccgactccgtcccgagcgccgcgggcccgggcctggcggacgctgcgggtggggcggggatgctgacgggctgctccccggctcagcggcgcggctgctaggaggcaccgaggcagcggcggggctctgggcgcgcggctggatgcccccggcctgcggctccctgcgcttcccgccgtccaggggcaccagtcatgggcgccgcagccgctgaggcgccgctccggctgcctgccgcgcctccgctcgccttctgctgctacacgtcggtgcttctgctcttcgccttctctctgcc

SEQ ID NO: 100121 - DNA, 42 bp, Homo sapiens
  chr9:103236598-103236640
  hyper
gtgactgtgtgtgtgcgcgcgcgcgcgcgtgtgtgttctttg

SEQ ID NO: 100122 - DNA, 137 bp, Homo sapiens; identical to SEQ ID NO: 32616
  chr9:103790552-103790689
  hyper

SEQ ID NO: 100123 - DNA, 55 bp, Homo sapiens
  chr9:103790962-103791017
  hyper
gcccggcaccctccccgcctctcccctcctccgccccctccgcgccagccttttg

SEQ ID NO: 100124 - DNA, 484 bp, Homo sapiens
  chr9:103791220-103791704
  hyper
acactcgtacacgcccgcgccgctcgctcgccggcttgctctcccacgcaagcggaatgcagcagcgcctggagagcgtgtctcggaccgccgcctgaatgtacctcgctcccgggagccggacggcccagtagggcgcactggaggacgctccgctgcgggaggtgagtgcggcgcccgcagccgggccgctggggaagtctctgcaccggggcagtagggcagcgcggggcaagctcctggccggacccggcggcgcaggtgtcccatgccttgcttgtgggtgtcgaggtgcagatgaaggcggcgctggggctgtgcagaggagaggacgaacccagggagggtcgcctcctgcgaggtgtcagattgacccagcagaaagctaccacctccctgctcataaactttccttccatgtcatctgggaaacgtggagacaaagggggcgtggaggctccctccgtcccgttccaccctcctg

SEQ ID NO: 100125 - DNA, 151 bp, Homo sapiens
  chr9:103791929-103792080
  hyper
ggaaaattggaggggcggccttcggctttctcatcgagctccggtgccaaaggcgccggggtgaggctcgggtcagtgcggggataaatgatgagttactgacaggcttgccataatcacctcctagaacggaggacgctaggatctctcc

SEQ ID NO: 100126 - DNA, 175 bp, Homo sapiens; identical to SEQ ID NO: 3388
  chr9:1042326-1042501
  hyper

SEQ ID NO: 100127 - DNA, 332 bp, Homo sapiens
  chr9:104248291-104248623
  hyper
gatcatcattggagccgccctgcggtcccccggagagagcctgggccgagcagaggatgcgggtcacaacgaccctgcaggagctcacgccccaagacaccgcgagcgcagtgcgacactagcgacgccggagccaagggccagaaagagggcgagacacacccaggtggatctaattaaccctccctcttggaaaaagaatgggggacgatgtccagggccctggatctagtgtctgtcgctgaccttgggcagtccctgccacgcttgagcctcagtttcccacccgtaggccgagctgaccgtctccatcgctgcgctccttcccttct

SEQ ID NO: 100128 - DNA, 130 bp, Homo sapiens
  chr9:104248845-104248975
  hyper
ttacccagactggcacgcgccccgctcgcgtccttctattgacctgtcagcgcagctggcgcaggcaagggccagggaggcgcccccgagacactcaaccatccccgcactgatgcgggcccctgctgcc

SEQ ID NO: 100129 - DNA, 75 bp, Homo sapiens
  chr9:104249474-104249549
  hyper
cttggggaaaaaggacggcaaaaggcgccaactgatgggcagccagggaaaagcaggagtcgcccccaagtcacg

SEQ ID NO: 100130 - DNA, 371 bp, Homo sapiens; identical to SEQ ID NO: 32356
  chr9:1042615-1042986
  hyper

SEQ ID NO: 100131 - DNA, 260 bp, Homo sapiens
  chr9:104499922-104500182
  hyper
gggcttacgggagcccggcggcccccggccatgcagggtgctccccaaccagcgtgcgcccggcgagggcgccggggaccgcctagtccctggctccggctcatccctctgggctcctgctcggctgtcgtccggagcgcggctggccgcgcggggggcggtggtccagggctgcaagtgcaccgcgcccaccctcaccgcgtgcccgatgcgcttgaggatctggcagggctgcgggtgcgaggaggagctgggcaccc

SEQ ID NO: 100132 - DNA, 823 bp, Homo sapiens
  chr9:104500207-104501030
  hyper
cggcaacagcagacagaccctgctcagcagccaccacaaactcagtctcctcattactgagacccgcagggagaaagcgcgccccctcctgcgcccggctcgcccctctgcagccgctgcctgaggtctccgcctccaggtcccgcgcgcagcttcactccactcggtgaagcggtcccaggagctggagcggtctctaggccatgcaagttggagcgtagcgcgcctccggcagtctcagatcccgctcccaggtccctccgcctggcatcctctgcccgcccggtcactgcgctgagcaggcaggcgggcgggccggcgcctgtcacccgcagctggagcgcccgttccctgcccgccccatctgcagggcgcctcgggcactgcgtccggccccgcgaggcggccgggatgagaagcagccggagttcctcgggggcagcagtgacagaggagcgacgcgctctcgcctggattcttttccttttctgcccaggcgagacccacttatttcctggggtcgcgttggagagggctttcacgcccggggtgcggaaaagaagccaaatccaccttcctccactgttggccaccctcctgcaggctcccccagcgccgacttcattttctctcttctctcgctacttcctctctgcctttctttcgttatttttccaccgagtcgccaccgccgcttgcttcctcggaggagcaacgcgactggccagcaaagggtggctctgctccgagcgccaaagttctccccgcctcagccggcgcctccctgttgctgagccctggcgcctgcctgtcgcttggctgc

SEQ ID NO: 100133 - DNA, 193 bp, Homo sapiens; identical to SEQ ID NO: 10016
  chr9:104501031-104501224
  hyper

SEQ ID NO: 100134 - DNA, 126 bp, Homo sapiens
  chr9:1051513-1051639
  hyper
agggatggtccctgacggcggccggtgggtctttggatttctttgtgtttccccagagtgagggccgccaggctcaggccccagcgaagccccgagcgccatggccgacccgcaggctggctccgc

SEQ ID NO: 100135 - DNA, 414 bp, Homo sapiens; identical to SEQ ID NO: 32358
  chr9:1051904-1052318
  hyper

SEQ ID NO: 100136 - DNA, 19 bp, Homo sapiens
  chr9:105418502-105418521
  hypo
ttatttattttgagacgga

SEQ ID NO: 100137 - DNA, 307 bp, Homo sapiens
  chr9:10612684-10612991
  hyper
tacctgcactctccccgccgaggctggctggcggcgccgcgccggaggggaggaggctcgggaggaggaggagaaagagcagcgggaggactcgggctgggaggggagcgcagggttggggaggccgatgagcggctcccggctcctcggagaagcagccgagacggcaaggaggaggcgaggctctgtcggggcgaggcgctgcccccacgcgctccggccgccggctgcgggcgcggctgggcggggagccgaggcggccgctcccgcactcgctcgctcgctcgctggcgctccctcctcgtct

SEQ ID NO: 100138 - DNA, 253 bp, Homo sapiens
  chr9:10613046-10613299
  hyper
cgcactcacctgcatttccttaacgagccacttgatggctgccagcggcgtgggccccgctccggcgggcgggggccggggcggggagaacgcggcgcgggatgctccgagcgcccgctggggagagaagcggcggcggcggcggcgctgcgggcgcgccagatggggcgggaggaggggagacccggcacccaccggcccagagctgcctgacgcggcctgggcggaccccgccgcccgggtgcctaggcac

SEQ ID NO: 100139 - DNA, 196 bp, Homo sapiens; identical to SEQ ID NO: 42179
  chr9:107221358-107221554
  hypo

SEQ ID NO: 100140 - DNA, 108 bp, Homo sapiens
  chr9:107396386-107396494
  hypo
cgccctgagctctgccgggggcctcactcgggtcctccggactcgctccgcccgctcggcccggaaggctgtgttcaactagtgccaccagcccggatcccacaccag

SEQ ID NO: 100141 - DNA, 30 bp, Homo sapiens
  chr9:107526267-107526297
  hyper
ttctgtcacctctaacgtctggggcaagaa

SEQ ID NO: 100142 - DNA, 332 bp, Homo sapiens
  chr9:107730465-107730797
  hyper
acagaaagatgccaccgctctctccaccctcccagcgccggatcacagagcgcagaccatgcacccagccttccacacacgtcgcgatctcgccgctttaagctgctgggtaccctcggcccgcccacaagaaggcggggcggcgcggggtctgctgggagttgtagtttcgggccgggcccgagagcttcttgactcgtttccttctacccccaccgccgcacagctgcctatggactctggagttgctgtgtattgagcatggggcacagccgggggtaaaaggggagaaggctcctttaatctgcggatcggggcgccgttgatgagtg

SEQ ID NO: 100143 - DNA, 476 bp, Homo sapiens; identical to SEQ ID NO: 32627
  chr9:108418471-108418947
  hyper

SEQ ID NO: 100144 - DNA, 30 bp, Homo sapiens
  chr9:109012750-109012780
  hypo
ataaagctaccagtacgactcctatgataa

SEQ ID NO: 100145 - DNA, 607 bp, Homo sapiens
  chr9:109622609-109623216
  hyper
tgaggcgtgttggggcgcgctcacgttctcgcaaaaggctcctccccagggctcaattccccgactgcgggaagccctttggtgccccaggagccttggaaacccaaggtttcctctgacctcgtcgctcctttctccctccccaccgcctggttccctacgtccctgcccccagggaaggacggcccccatcttaggacttacgacccaagccaacccagaaggtaccttcacgtcgatgaagattttatcgcagcctccaaaacccagcagtaataggagctttcaacctgaaatacgattgttattttcccggtgcagagcttgacagaaaaagtcagctttttattaaagacaaagaggtaaattatcagccgggacagtggagggacggcggagacctggcgcgcttcctccggttgccacgaggaatttatggggtggcggcggccagcgctcagacaccccccgggtcccggtggggaggagctcggggcaggaggacttccctaggtccctccgggcactcggaagggggagtcctcccaaagccgcacaaagccgggatcatttcaatccggaacagcctcagcgtcctcctcctctc

SEQ ID NO: 100146 - DNA, 194 bp, Homo sapiens
  chr9:109623464-109623658
  hyper
ggaagtgggtgaaatcgtgcctcggggtgagagattctgctcaggaatatagggtcgggaaaatcttggaaaatgaggatttagatctgtttatgaagccccgctatcggatgggaaccaactccgcgcgcgtctcctcctcttcctttattgtatggatttataggtatatatcttctcggactgttgcttgg

SEQ ID NO: 100147 - DNA, 102 bp, Homo sapiens
  chr9:109624462-109624564
  hyper
tggaaatactcacaccgcaagctggaaagggattaaaaagccccacgtggttgatctgggtttatacttgcaacctccagttccccacgtatgttctttgca

SEQ ID NO: 100148 - DNA, 30 bp, Homo sapiens
  chr9:110126233-110126263
  hypo
ggtgagcagaaagcccggcagagcaggcct

SEQ ID NO: 100149 - DNA, 847 bp, Homo sapiens
  chr9:110227815-110228662
  hyper
tcccgtctattttcacgttagccaaagggaagcctagaagtccacagtccccgggagctggaagccaggcagtgacagcgccagcgtattctccttgacttgattgtaaatttcacaactttggtagcttcaacagggaggaagaggaggggcgccggctccctccagcaaaggcggcgcggagcgggtagccaggtccggagccgtcctgtgccgggccgtccggtggggggcactgcagaccgcgcgggcgctgcgcccgcctctagctccgggcgcagaggggtggccacgctctcctgagtccctcgcgcccctagccgcgcctgggagagcggactggcctcccagagaggatgcgggggaagccgcacaggggcccactgggactgggtaagggcgcgggatgggatcggctctggatatgggtgccccccgagccgcgccccaccccgcgagcgctcccatttgcacctccacttgagcacggagcttcaagaacgagctattctggggtgcgggttccgacactaggccccacacggatctggggactggtttggctacgacctggcggaaggggggaaacctggcctgagaacggaaactgcgggacgatccggcggcgcacttaaatctggctccgctgcttcctcgccccgcccccgctgtcaccttcctctgcttctgcgcagcgattccacaccccactccaccccatcccacccagaccgctcacccgattctgactttgaacccaaaagcgatcaggcgtgttctgggcccggccacagccagcgggcgctctggccctcgcagaagccgccgcaagcgggcatcgctgtcc

SEQ ID NO: 100150 - DNA, 30 bp, Homo sapiens
  chr9:110251099-110251129
  hyper
gccgctccttaccctcgttcagtggctctt

SEQ ID NO: 100151 - DNA, 616 bp, Homo sapiens
  chr9:110251462-110252078
  hyper
ggcccagaaggtcctcggcagcccgaagcagctggggcacctgaaccccaaagtcaacgaagagaagaaacgaagccaaaacccaaaaccccaaattggccgagatccttcttctttggattaaatataacttggaagcgtcttttttaaaaagttcctttgtatacaaaagttcttagaaaagttgtaaacgcaaaaatagacaatcagcaaggcgagtaagtaggtccggtggccgggctgcgctctcttccactcagcagcgtcccccaccactgtcgcggtcgcctcgagtgctgccgtgggcgcaggggctgtggccggggcggtgggcgggcggtgccgccaggtgagactggctgccgtggcgcggagctgcgaactggtcggcggcgcaaggcgcggactccggtgagttgtgtggagcgcgcgcggccatgggcgcgggccacgggcgggtgggagggtggggggccagaggggcgggggagggtcactcggcggctcccggtgccgccgccgcccgccaccgcctctgctccccgcgcgcccgcagacacgttcgttctctctggtcgggaaactgccggccgccggcgcgcgttccttacttata

SEQ ID NO: 100152 - DNA, 74 bp, Homo sapiens
  chr9:110252298-110252372
  hyper
cggcggcagtggtgtcggcggcggcggcggcgtccgccccagcgcggggcgcgaggaaccgggcgcaggttcgg

SEQ ID NO: 100153 - DNA, 67 bp, Homo sapiens
  chr9:110252633-110252700
  hyper
cggcctgacctcgcacggttcctcgcgggcccttctgctgaggggtggggggcgctaggggtgtgga

SEQ ID NO: 100154 - DNA, 223 bp, Homo sapiens
  chr9:110253522-110253745
  hyper
tcaaaaagtgcacaccgagcccgccgcaggcgtccttgcccaccgggaagggaataggaaacggcgatctttacttcaatcttataacgctgcctcccccacccccactctccccttggtttgtgatcagtaattttccagctgggaaatgttttgctctcatcttcttagcaaacagtatttttttttaaaacgtgaatgtggtgttcggtatcactttcta

SEQ ID NO: 100155 - DNA, 627 bp, Homo sapiens
  chr9:110399878-110400505
  hyper
gtcagggtcggggtccggtcgtacgccctagcactgcctgcggtggggcgcgcacagtcgagcgcggggcctccccgcaggctgcgctgcctgccgggcggcctcgggaactgaccaggccgcgtgtgagcgccgggattcctgatcctgccttaaatatgccggttatttttatctccctacgtcaggcagcgaaggccatcccaccggtggcccaggcggctgctacacaatgtttccctttagtcgggaggggaaatggagggaggccagacttcctgatcacatggtgctgaagtcaatgaaaaaaaattaagggggacccctccctttttcttcaatgcctgatccagattcccccctccccgctcccccgacccaccccctctgggctccgcgcgtcggagggaagcgcagcctcccaggcggagggccagcgaggcaggagagcgcgcgcaaacataaacacgagactgttgcagtaattggtggctctgaaaacactgaggaaatgagaggcttgtacgaaacatcagccgacaagaaacggggtgatgtcagacagccttccaggattagaaacccttaaaagctccgagcccgcggccgctgcggaaaactcggctc

SEQ ID NO: 100156 - DNA, 182 bp, Homo sapiens; identical to SEQ ID NO: 32636
  chr9:111929136-111929318
  hyper

SEQ ID NO: 100157 - DNA, 189 bp, Homo sapiens; identical to SEQ ID NO: 32637
  chr9:111929339-111929528
  hyper

SEQ ID NO: 100158 - DNA, 15 bp, Homo sapiens
  chr9:111929585-111929600
  hyper
cgcagcctccccctt

SEQ ID NO: 100159 - DNA, 18 bp, Homo sapiens
  chr9:11196695-11196713
  hypo
agtgagaggtgacagcgt

SEQ ID NO: 100160 - DNA, 80 bp, Homo sapiens; identical to SEQ ID NO: 32639
  chr9:112081693-112081773
  hyper

SEQ ID NO: 100161 - DNA, 427 bp, Homo sapiens
  chr9:112259825-112260252
  hyper
aatttttaaggcaaccgcaacttctcagtaagtttaggtagctgaaaatgggaatttcgggggggctgggcactctcacatacactcccccatctgcagctgtctcaccgcaggtacctgataaatcattccatatcgtccgcggaacggggaggatttattggctctggagtttcgtgccaggcccaggaaatgccatctttgaaagccgagaggcggattcgccctgggagccgagcgctggcagccgctctcggctagctccccgcgggctgtgtgccccctcggagccccgagccggggtcgcggcggcacggggtcctccggaggtgccggacgcacgggctccgcgggttgcgcccgcccctgcccggctggagcgcacgcccacgctccggcgccgcgtcccggccgccagcccgccccg

SEQ ID NO: 100162 - DNA, 55 bp, Homo sapiens
  chr9:112260468-112260523
  hyper
ccggcccgctggggtcgcacgggcccgtacctgcagcatccgggggcgcggagcg

SEQ ID NO: 100163 - DNA, 54 bp, Homo sapiens
  chr9:112261948-112262002
  hyper
ggtcctgggggcagtcgttccagggatagactgaggcctcggcagcccctggaa

SEQ ID NO: 100164 - DNA, 802 bp, Homo sapiens
  chr9:112402499-112403301
  hyper
aacgccgcattaaggcgcttcaagatagctggagttttgcttgggaaactcagagggatctcgcccggccggcacaatggcgtttctgaacccatgcccagcccactgggggcagtccttgctgcttgcagaggccagacgcttcttgcaacttctaagcggcgagagctgccaccttgccaatgactcaaccgtttgcctatgccctctgggctgtgccaccagccgcagccgccctgctcccccacccacccttctccccaggctccgcgccgcgccgccagtcccaggggagccgccggcgcacctggcgcctagggcgcacggcactgcgcgctggtgggcacctcacccgacgccagctgccagcgcgctccctccccgaaaccctgaagtggggtgtcttgtctagcgcccagcgaacaacattatccaattgcttcccgttttattcgcaggctgggagctgagagagcctgagcattcactttcaaccctccaggggaggagggggtgcgggtggggaggggagacggctcccagctccacctcgcgcgcggcgcggccagtgcactcggctccgggagaggcgagcagcgccggtgagccccgcagcagcgcacccggccgcggagccccgcgatggagtgagtatccccgagccgcgccgccagctgctctcctctcggcatgttgccatggtgaccgcggcggcaggcagatcccgctcgggtccgcgtccaggatgggtgtttaatttcagccccgtgtgtacgcctggtgtttctatagcagccgccgc

SEQ ID NO: 100165 - DNA, 185 bp, Homo sapiens
  chr9:112403302-112403487
  hyper
gcggcaggaggcaaggggtgggagccccgggtggcgtggtttttgcggctgccccttggctagcagggcctggggggcgagtgaggggagtagatgatgttgctaaggacggaggcatattctaggctttcctatctctgccccaagcttccgcttatcggggagttggccgcaatagccatgac

SEQ ID NO: 100166 - DNA, 688 bp, Homo sapiens
  chr9:112542235-112542923
  hyper
gtgtccacgcgggcgcgccacgccagccgtgcgccccagcggctcgccgtgcgcccgcgccccaggtgcccactggctcgcgcgccctccgtctgcgccttggagacccgcggcggcgatcgctcggagccgccttggaccgcggcctcgggtccatcacactccaggggcggagcgaggcaccgagacgtcagggcggagaactagcgccgggctagcgcgccctcccggcggctgccggcgtcccacgtcctcggctggcgcggccggcggcggcggcgaccgggagatgcagtgagcggcggcgctggggcgcagccaggcggccgggagggcgggggccagaggctgagcccgggcgagcccgccgtgcgcacagctctgcccgccgcccctggagcggatccccagccgtccctgggcgttctcccgggttctagcaaagccccccggggtgcccatcagtttccttgggtgactacagcgtgtgttttttctttcctctttcccctgcctgtgtgcccttctccaggatggcagaggcggaattgcacaaggaaaggctgcaagccatagcagtaagtccactttcattttattttcttgctctattgtctggggtggaagggggcccccgagggtttcggggcaagcggcatgccagcacagtagccgcaggtcatatgtt

SEQ ID NO: 100167 - DNA, 30 bp, Homo sapiens
  chr9:112806909-112806939
  hypo
gcgtgccaccacacccggccttccctcttt

SEQ ID NO: 100168 - DNA, 547 bp, Homo sapiens
  chr9:113341075-113341622
  hyper
tgacatccctctaagcgttttaaaatccattatcccattggaacctccacaacaataataggcgggtagcgatgactctggttttgtggatggggacgcttgacttggggtggttatgccttgcccaggactgaaccccgggatagagacgggcaggcagcggtgggtcgaagggcccggggactagggcccgggtcgggaggggcgggcgccttaccgcggcttgctggaaggcgcccttggtgtaggtgccgccacctcggtaggagatggcagggatctcttggaggagcagcgcgcacttgtgctggcgcgcgcggcgggtggagatgtaatcgacgcgcggcaccacgtagttcttggacgagaaggtcacgatggccacgcgcgtggccgtgggcaccacggggaagtcggacagcagcttgcggacgaacatgagctcgctgcggaagttgacttcgcccacgctggacgaatcatccaccaggaagacaagctccaggcgctcgctgagctcccgcagcagccgcacgcgtcgccggaa

SEQ ID NO: 100169 - DNA, 169 bp, Homo sapiens; identical to SEQ ID NO: 32645
  chr9:113341679-113341848
  hyper

SEQ ID NO: 100170 - DNA, 414 bp, Homo sapiens; identical to SEQ ID NO: 32646
  chr9:113341926-113342340
  hyper

SEQ ID NO: 100171 - DNA, 18 bp, Homo sapiens
  chr9:113366336-113366354
  hypo
gcccggtcataattccct

SEQ ID NO: 100172 - DNA, 121 bp, Homo sapiens
  chr9:113392-113513
  hyper
cgccccttggaccttcgccccaggccggcgcagcccagcttcccgggcaggctccacgctaccggggtccagtgcgcggcgacgaagcggagagctgtgtccagactccggagagaaactc

SEQ ID NO: 100173 - DNA, 778 bp, Homo sapiens
  chr9:113549-114327
  hyper
ggagctgcccaactccgccgcctcgggaaggcggcttcgggcccgcagggagccccggggagggttcccggttccgccggcagcggcgtcgaggggtgcctgggctcctggggaccgcgagaggaaaaagaacggaaatcgcaccggggaggaaggacgcgcagaacgcccccgtgaagcggggtgctccggtcaggcgtgcgcgggagcgcggtccgggggagtccggcggcgccgtcgcgcgcactcggcagaggcttcgcgggagaacgcgcagcccggggcgtggggcggggaactgcccgcgcgaggctttcggcgcgtctgggtctcggcgagagcaaagcgcgtcctggcaccgggggcggcggcgcagaggccgggaggaagaaatccgggccctggcccaggtcgggcttccacccctgcgacccgcgagaggcccaggcgggaaaggcggcgagtggcgtcagcggttccgaaagcaaacctggcccggtgctactgcccgagggtcgccgggcgcgtttcctaattcccccgagtctggaaaacggagacttccgtagcgtcttcttcagtgcgtgctgcgagtgctgaaggaggacccggtgcctggacgacccggagcaggggaagcactcggccgacgctgtcgctgtcatcggcgtcattggcgggcaggacagtggggcgggtaaggggcctccccgcgcctcccggcccttcgcgctcggcgccagctctttggctcccttccctgcgcagctctaggctt

SEQ ID NO: 100174 - DNA, 30 bp, Homo sapiens
  chr9:113689346-113689376
  hypo
gaaacactgacgtagcgaagtccttcgtgg

SEQ ID NO: 100175 - DNA, 397 bp, Homo sapiens
  chr9:113800084-113800481
  hyper
ctacgtgtcactgggcgggccccggggcgcactgacctggcgcgggacaggagggccggcggcccgggcggctgcggcaacttccctccaggggctcggtccgccgctgggtgcgggaggccaggggagcctcgcctcctgcaggccggctcgcaagaacgcacggccacccacccgcgccgcggcccacagcgcgcacccacactctcactggcactcgcacgcgcgcccccaaccacaaagcccgtccgcggcgggacagtgtgagcccagcgcgccgtgtggcgggccgagcagtcgccgcggcctctggcttcgcgcccagggggcgccgtccccacacgccgcgccggcccccttacctgcgctcgctgccgccgcgcgtccctctcctgcc

SEQ ID NO: 100176 - DNA, 30 bp, Homo sapiens
  chr9:113800768-113800798
  hyper
ggcaggaggagggggcgcagagggagggcc

SEQ ID NO: 100177 - DNA, 334 bp, Homo sapiens
  chr9:113801080-113801414
  hyper
tcgacacacccgcagcgggagacccgtggccgccagctcgggtcccacccccgcccctcctgcgcttaccccagcgccggacagctggcaggactccggtggacgccccggcacggggcattttcacgttgtcgctctcctcttcccactcgaaaagctctggaaaacatcgcggggcccgcaaaaccccggaaatgtggcctctctttcgtggctcactttctaaactttccagaaggcgcaaagtttctcccagcgccgccctgcactggaggctgcgaagaacgcagaagcggctttgctgctaggaaggtgcatacgtttctagttctga

SEQ ID NO: 100178 - DNA, 199 bp, Homo sapiens
  chr9:114287440-114287639
  hyper
aggcgcagtggttcccgcaggcttgcgcgcgcactcgctgcgggacaagcttctggaagctctttgcggtggcgttggtgctgtttgcggatgctgatgcaggtactggtcgtcccgggccccgagtttcggggccgtggccgggtcgccggctccgagggcgcacttggggcgggatgggggccgggagcagcctacc

SEQ ID NO: 100179 - DNA, 138 bp, Homo sapiens; identical to SEQ ID NO: 32651
  chr9:114287962-114288100
  hyper

SEQ ID NO: 100180 - DNA, 261 bp, Homo sapiens
  chr9:114361183-114361444
  hyper
ctcgtctctgaacttcgtaccctttggccaacaagcccccattcccccccgaacccgctcccagcctctggcaaccatcattctagtcgttatttctatgagttcaacttctttagagttcacacatctttgtccctttccccaaaaaagcaaccgctgggcttccaaactcgctacaagtccagaagccctcctggaaagggtctggccgcagaggggccaggtcccgggaaagtctcgcccgcccgaggagggggcctg

SEQ ID NO: 100181 - DNA, 30 bp, Homo sapiens; identical to SEQ ID NO: 32652
  chr9:114361785-114361815
  hyper

SEQ ID NO: 100182 - DNA, 41 bp, Homo sapiens
  chr9:114362053-114362094
  hyper
cgggaaatctgagtgcgtttgtgtgtgtgtgtgcgcgtatc

SEQ ID NO: 100183 - DNA, 87 bp, Homo sapiens
  chr9:114631024-114631111
  hypo
cctcctgcccttcaccgcagaccagaagacctgcttgggacccccccatctctgcaggagagagcttttctctttcttttgcctatt

SEQ ID NO: 100184 - DNA, 26 bp, Homo sapiens
  chr9:114631171-114631197
  hypo
acaatgaatcgcgggtatttatccca

SEQ ID NO: 100185 - DNA, 88 bp, Homo sapiens
  chr9:114710299-114710387
  hypo
ttctgtgcagctctgcggcattcagagccttcaaagtccagttccagaatgtgggctttgtcgtgaaggcagtaggaagtaattgaaa

SEQ ID NO: 100186 - DNA, 213 bp, Homo sapiens
  chr9:114717-114930
  hyper
gcaaggcaacccctgcgggtcgcgcccgaaggccggacccctccaagccgcctgggagcttccaaacaggtggacccgaagctcctgtttgatcggagaataacgttcaatttactccgccgctgaactgatggtttaaatattcatctttggatatggtttcacattaggcaaaagttaggagcttggaggcggttccgggaaggggcctga

SEQ ID NO: 100187 - DNA, 32 bp, Homo sapiens
  chr9:114784817-114784849
  hypo
acagggaggccccctcgttagtaaattttatt

SEQ ID NO: 100188 - DNA, 146 bp, Homo sapiens
  chr9:114931839-114931985
  hypo
agtgccattcatttacgccacaccctacggttcacgtcaggcagtcactcacttaacccctaccggttcttttcacacctgtctcatacctgattcattctccagaagggtgtaccttttttttttttttttgagatggagtttca

SEQ ID NO: 100189 - DNA, 19 bp, Homo sapiens
  chr9:115067926-115067945
  hypo
ataagagctttcagccggg

SEQ ID NO: 100190 - DNA, 79 bp, Homo sapiens
  chr9:115068245-115068324
  hypo
aataaaaagctttcagtgacttctgtgagtctttctagcaaattattgaacctgtgggtagcttcgggaatcccctaca

SEQ ID NO: 100191 - DNA, 30 bp, Homo sapiens; identical to SEQ ID NO: 42183
  chr9:115087309-115087339
  hypo

SEQ ID NO: 100192 - DNA, 120 bp, Homo sapiens
  chr9:115087595-115087715
  hypo
gggcccgtctgcacactgggggaagggggtggagccaccaggaattcacgccttaggctagggagtgtggtggcctggtattcaacctgaggtggaagccagctggcgggacccctctct

SEQ ID NO: 100193 - DNA, 146 bp, Homo sapiens; identical to SEQ ID NO: 42185
  chr9:115172301-115172447
  hypo

SEQ ID NO: 100194 - DNA, 30 bp, Homo sapiens
  chr9:115202051-115202081
  hypo
tagtgattaagaacacgaaatttgggagaa

SEQ ID NO: 100195 - DNA, 39 bp, Homo sapiens
  chr9:115478932-115478971
  hypo
aagatacatttgtgccgggcgcggtggctcacgcctgta

SEQ ID NO: 100196 - DNA, 30 bp, Homo sapiens; identical to SEQ ID NO: 42187
  chr9:115599305-115599335
  hypo

SEQ ID NO: 100197 - DNA, 635 bp, Homo sapiens
  chr9:115652922-115653557
  hyper
caggtggcccctccgcgggcaggtgacctcggggctcatgtgacctctctgatggggatcgaagggctttctggctgcagtgacaaggatatgctcccaaattcggctgctacggctgctcaggtttcagtcccggagcgcgagtgtgctccgtgcgccgggagcgcgagtgtgctccgtgcgccgggagcgcgccggccagtggcgagcagagccagggcacgcagcgcctgtgacagcagcccgcccagcagccgagtgacctcccgagtgactcctcctcaggccagaaaaggccgcgctccaccctgccctcgccacctcaggcagagtaggactggcgacagtccagggaagccaggcgcgggggagcgcaccgcgagtgctggctcctggcgccagcacccccggggccgacgggtcacgctgctcctgtgagcgcggccgcctgacggggccgaatttccccacagccaggcgtgcgtgcccggacctcccgcggatctctgcggaccccccaccaccggggcaggggctggaaggaagctccccaggactggctcagggagcgtttccaaattctcccatcccaggaaggcaggtttgcgcgaggggtgggacgcctaggattctgc

SEQ ID NO: 100198 - DNA, 30 bp, Homo sapiens; identical to SEQ ID NO: 42188
  chr9:115773781-115773811
  hypo

SEQ ID NO: 100199 - DNA, 37 bp, Homo sapiens
  chr9:115774571-115774608
  hyper
ctttctaatgctttgcgggttgcgaacgtgcgtcgtt

SEQ ID NO: 100200 - DNA, 53 bp, Homo sapiens
  chr9:115818864-115818917
  hyper
gccatctccagtggtcgcccggcctctttggtcgtttccgcacttctcctccg

SEQ ID NO: 100201 - DNA, 63 bp, Homo sapiens
  chr9:115913757-115913820
  hyper
cggcgcatttcagcccgcagccccgcgcgcacaccgagcgcacatccccggccctgctcttgt

SEQ ID NO: 100202 - DNA, 40 bp, Homo sapiens
  chr9:116028536-116028576
  hypo
ccaccacacctgtccctctccccctcgtattactcagact

SEQ ID NO: 100203 - DNA, 30 bp, Homo sapiens
  chr9:116060098-116060128
  hypo
ggggccaaggtccagcgtgtagacttgagg

SEQ ID NO: 100204 - DNA, 37 bp, Homo sapiens
  chr9:116065790-116065827
  hypo
cagcagaaaaatagtcgggagacggttgagcgtctgc

SEQ ID NO: 100205 - DNA, 87 bp, Homo sapiens
  chr9:116128876-116128963
  hypo
ctagcccgggtggttcgctgtagacttcactatgttcagcctcacatttgccctgggatgacagcttagcaccgctgacatcagctc

SEQ ID NO: 100206 - DNA, 30 bp, Homo sapiens
  chr9:116270970-116271000
  hypo
ggtcacttagcctatcgacacagactctct

SEQ ID NO: 100207 - DNA, 109 bp, Homo sapiens
  chr9:116331277-116331386
  hypo
gcctaagtcatcactcgagatgtgtggatagctgccaggtatgctccagatggcccagggcttctcccctctccctgccctccatgggccagcccgcttgcacctggta

SEQ ID NO: 100208 - DNA, 140 bp, Homo sapiens
  chr9:116450327-116450467
  hyper
cgatctcaccctgcagcccgcacactcaggcctacactccccggtttggagcccagataaccccttcccgtcctcccctcacccgcgggaaccctggagagccggtaggggaggttcgcaccctgcgttgcagctgcctt

SEQ ID NO: 100209 - DNA, 137 bp, Homo sapiens
  chr9:116542589-116542726
  hypo
ggagggacacaattgcgcccatagcaactgtgtcttaaggcccttcgtaggctgagcccgcactctccaccctggaacaatccctgtgccttcacaattctggctccaacatcatcaggcatcgttatttatgtttg

SEQ ID NO: 100210 - DNA, 80 bp, Homo sapiens
  chr9:116633829-116633909
  hypo
gaggccaggatcacccgggtagtgagggcaccggaaattccacctgccgacgtgtgcgctttctctacacgagacacttt

SEQ ID NO: 100211 - DNA, 19 bp, Homo sapiens
  chr9:116634089-116634108
  hypo
tcaccgtgttagccaggat

SEQ ID NO: 100212 - DNA, 186 bp, Homo sapiens
  chr9:116756509-116756695
  hyper
attcagacacagccacgtgggtttcagcctgtgacagacccaggcagcgtaggtgccaggtcctgcttcatcgtgccagctgatagttcgtttcctgtttcaataggttgttggcagggcctcacacaagagcctgccagaaccaacactcagctctttgctgcagccactcggaaaggaggagtt

SEQ ID NO: 100213 - DNA, 41 bp, Homo sapiens
  chr9:116800689-116800730
  hypo
cagagaatgcctggccggccatccagcgcaaagccaggctg

SEQ ID NO: 100214 - DNA, 221 bp, Homo sapiens
  chr9:116916349-116916570
  hyper
aaaaggcccggcgggcgccgccgccccagcacctatgagccgcccccagctctcggagcccgcgccggagcccgtggacgcagagctgccgaagttcgagcgcaggcggaccgggtcggcggcgcagtcccgcgcgcccatgcccctcccggtgccgctgcgctccgcgcgcccgcgccccgtttagggaaggggacctcgccccccgcccccgcgcccac

SEQ ID NO: 100215 - DNA, 86 bp, Homo sapiens
  chr9:116916917-116917003
  hyper
agtgtagagtatcagcgtgcgcctgagcccagatatctgaggatgcgtttcgtgtgaacctaggaagggtgcgtggctgtcccaga

SEQ ID NO: 100216 - DNA, 30 bp, Homo sapiens
  chr9:116917360-116917390
  hyper
ctccgagtctgggagcgcaaacttttggtg

SEQ ID NO: 100217 - DNA, 126 bp, Homo sapiens
  chr9:116918762-116918888
  hyper
ttctgctcctgtctccgtgtctgtgtggctctgcacgtccccgcgtttctggaaatctccgcgtgtttgtgttagtcggcctgggtctgtgtgtctgtgtttcctgcttctcggttcctgtccctt

SEQ ID NO: 100218 - DNA, 49 bp, Homo sapiens
  chr9:117050981-117051030
  hypo
ggccctgtgggtgatcgaggagaccgcggggaaccgggagaccctgggt

SEQ ID NO: 100219 - DNA, 141 bp, Homo sapiens
  chr9:117267155-117267296
  hyper
cgacagctggatccccgggagcgcggagacgacggctggagcctgggtttggggagcacgggtacagtggctggatcctagggggtcgcggagaccgctgctagagtcccggaggcgcgaagacggcgggggtcgcgaacc

SEQ ID NO: 100220 - DNA, 32 bp, Homo sapiens
  chr9:11733761-11733793
  hypo
agcactttgggaggccgaggcgggcggatcac

SEQ ID NO: 100221 - DNA, 88 bp, Homo sapiens; identical to SEQ ID NO: 32331
  chr9:117872-117960
  hyper

SEQ ID NO: 100222 - DNA, 82 bp, Homo sapiens
  chr9:117880343-117880425
  hyper
cgagttccccagcagcgctgcctttgtgcccacggaggcgggggcgtgtatctgcgcgcgggagaggcgggtgacagtaggc

SEQ ID NO: 100223 - DNA, 753 bp, Homo sapiens
  chr9:118916326-118917079
  hyper
gtggaaaggggggctcgcccaagaagggtgaagaagcgaagaaagtcgaggcgccgaggctcccaaagctggcagctccgggtggcggtgcaggggcgaagggggggcggggggaaccgtcggacatgcggctctggagttgggtgctgcacctggggctgctgagcgccgcgctgggctgcgggctggccgagcgtccccgccgggcccggagagacccgcgggccggccgacccccgcgccccgccgccggcccggccacctgcgccacccgggcggcccgcggccgccgcgcctcgccgccgccgccgccgccgccgggcggtgcctgggaagccgtgcgcgtcccccggcggcggcagcagcgggaggcgaggggcgccaccgaggagccgagcccgccgagccgggcgctctatttcagcgggcgaggcgagcagctgcgcctccgggccgacctcgagctgccccgggacgcgttcacgctgcaagtgtggctgcgagcggaggggggccagaggtctccggcagtgatcacaggtaggtgagggcgcctcggcgggcgctgcaccgtccctgcggccccagaggctcgcgggtgtctgggcgcgggtggcgggcgggtcgggggcttgcgggcgtgtctgtgcgagagctgccccgcgagcggcgcagagacatccgggcgagctgagagcctcactttgctccatcggtggaatgggcacactcggaaggcgtagctgctccatc

SEQ ID NO: 100224 - DNA, 472 bp, Homo sapiens
  chr9:118917306-118917778
  hyper
cattcccctgaaagccggcaagggcaaggttgttgtaatggccaggacttagaagtcctcgaagtgccccaaagttgctcactgattgaagcctgcctctgggactcaccctcaccccctccacgccatcccatgtcctagcttttaaagcccattgcctgtcactcggggctgggacgagaccttcctaacgcataccccgccagcgttccccagacgcggctgcgaaacggggcgcttttctcatatgggactttatgagcccgtaatgaatttgagttctccctcctcaacctccctctctctccccttcgctgttccacagcaaagcctatagtgaaatcggacactttgcgaggattgcaaaccttagaaatgctccagcatccattttcccccctctaaatgaatctgtggaaatgcctttaataaaactggggagcggaggtgggggcggcgctggaagagagga

SEQ ID NO: 100225 - DNA, 198 bp, Homo sapiens
  chr9:118919150-118919348
  hyper
tgggagagccaggaccgaggtgggcagcaaggatcgggtgcgaaggctcaccctctcgcggcgacctcaggtgcccagtttgctgcctgacctctgctggctttctctggctgggcgttgccactttcctaggaatccctggtcacctatcttgagagagcagtcatcgctcagcagggaccgcgctgctatttcagg

SEQ ID NO: 100226 - DNA, 30 bp, Homo sapiens
  chr9:118950279-118950309
  hypo
tgagaactgtgaccccgagtgcaaccacac

SEQ ID NO: 100227 - DNA, 1085 bp, Homo sapiens
  chr9:120175273-120176358
  hyper
gccgcggggagtccccgaggaacctgcaggacgctccgctgcctctcctcccggaacgctcggcacgctcaggttacagcctgcgagggtgggtacaggggctcgacccccgaggttcaagctcagagcgggagaaccactggcactcgctcaaatccccagaggtggtagcatgaaaggatggggagtgggtcacaaaaatacttttaacaatatcagggctaccaggagagtggagcgtagtccgctgattattctgtgggtcttttcaggcgagcaaggagttaacctcggaagttcagggatcgtaaaggttctcacctggaaggcccctcacctgcggtgcccgaggcggatcccgccgaggaaaagacccggggaagaagagctccgggtctgggcgagcccctggcgcctcacgggcgctgttgttggccagactccgacaaccaataaggccccgcgcccccaagaggggaggggagagcgagcaagcagcgagcgcgggagagctaaggggaacaacatttttgtaaacgctctccgagataattaagctatcaattacccgggtgggaaatcagctgcgcttcccacagctccactgaagggccgactcctccgggattcgcgcagggaaccagcaggcagcaagctgctggcgaacttttctgattaacttttccgttggagccccccacccacacccatctcctctcctctcctttttcttgcctttaagtaattattattagcccagggagtgagctgcaaggacaaaccggctctctgcctggaggtgggtagaaagggaaggcggtaacgggggtagagggaggctctaaacgtggagacctcggagtcggaatcccagttctcagcaaccactcaagtctctccagccctatttcacagatggccagaactgaggctcagagaagggaagcgacttggccaaggtcactcagcccatgcggaagccacgcttttgcgggttgagcgattccacacggaactactccattcctactctcatgaaaatccatctggaagggcagaacccgcaactccgaggcgagagcgag

SEQ ID NO: 100228 - DNA, 863 bp, Homo sapiens
  chr9:120176694-120177557
  hyper
cagggcgcccccacccgtccggcatgacgcaggggctcggggttccttgggatctagcgcgtgccggcgcccagccttacccagggtgaagaagggcagctcggtgttgtccaggtcgtcctgcaccgcgatgcgccccggcagctcgttacgcacaaagagcaggaggcgcgactcggcggcggtgccggcagagccaggagagcccggggacgcggcggcggcggcggctccggccccggtcccagccccggccccggcgcgggcgccgctccagccgatgtcgctctcccgcagggcgggcagtgtggacaccgtgacggtcttcagccggcacgggctgtcgggctcccgcgaggcagcggcggtggcgccggccagcagcggcggcggcggcagcaggagcaggaacagcagcagcagcggcagcagtggcggcggccccgggtggaagcagagcctcggccgcccccggagccccgagccggggccggggctgagccgggcgccggcggcggccatggcgggaggggctgcggtgctgcgggcggcggcggcggtggcggcggtggcgaaggaggaagaggaggcagctgcggagacggcggacgccgaagcgaaccaggacgcccgagctaaggagcggagagagccgctcgccagcagcccccagctccgggctccgcctcccgatcggccctggaccgcccccccgcgccgcctcccggggcccagccgcccgtccccgatctccggctccccccgcagaccccgagcgtttcggaggctccgcccggcctcgtgcaagtcccagtggctccctcccctttcccaagatcccccaattccgccctcacagcatt

SEQ ID NO: 100229 - DNA, 140 bp, Homo sapiens; identical to SEQ ID NO: 32665
  chr9:120177898-120178038
  hyper

SEQ ID NO: 100230 - DNA, 34 bp, Homo sapiens
  chr9:120315798-120315832
  hypo
taaaagtaaacaccccgtctctactaaaaataca

SEQ ID NO: 100231 - DNA, 3 bp, Homo sapiens
  chr9:120507292-120507295
  hyper
gag

SEQ ID NO: 100232 - DNA, 37 bp, Homo sapiens
  chr9:121930100-121930137
  hypo
aagaaggtgtcgaggcggatctcgttgctgatgaagg

SEQ ID NO: 100233 - DNA, 30 bp, Homo sapiens
  chr9:122130678-122130708
  hyper
gtagcaggattccaccgtttggaggaattt

SEQ ID NO: 100234 - DNA, 466 bp, Homo sapiens
  chr9:122130973-122131439
  hyper
cctcccttacacacacggacacacacacacaccacgaacacacgcatcaaacgcaaacgacgccgcacacgcaaacacactagcaccacatcaagttcccaccatggtgcacacgtcgggagcgcgcggggacacacacgccactcactcaaacccgcaattagccctttgagccccaggcacaggaaccccctccctagaactggagaagacttggaggcggcggggcggccaggtgaagagcggacaagggtgccggtagggggaggggcagaggagcgcggggacgccccgaatgcggcccggggccgggtccaagggcagcggggctgcggggcgctgcacccggcgccgccttacctggagtcaatgtccgtctttggcggagagctgcgggaggacgctttttattcggctcggtgggaacttgggagagccctgcgtgcagctcgcattccgggcacgg

SEQ ID NO: 100235 - DNA, 530 bp, Homo sapiens
  chr9:122131496-122132026
  hyper
cgtaaagtccccttcgctggtcccgaggacaggcatgaatcccggctccggaaggcggtcactactccctctgcctcccggctctctcgctctcgctctcgctgttgctcgctcgctctctccctctctcgcgggttcgctcgcctgcgctctcctcctccccgcgcgccagatcagtttgcagccgtggggtccgggagcgaggcggctggcgaatggagagggaagtccaagtgcgccgcggtctccgggcggggagcggcggaggccgggctacgccgggggagggacttagccggcgacggccgaaaatgaatgggggagcggcggccggggggcggggagggaggagctgaacgccggggttgcttccgaggagtgttttgtacatctttaggcggaggaggaggagaagcgagaggaggagagacgggaggccgcctcgagggaagggcggcccgggtgggctggggctgagccgtagggagtttcgtgggtctggggcgtgtagggtgttgtgtctatgcgca

SEQ ID NO: 100236 - DNA, 176 bp, Homo sapiens
  chr9:122132051-122132227
  hyper
cgcgcaaacccggaatcctggtgcccttaagcgtgactgtactgtgtgtgtcgcgagtacctgagtgtttctggggcggcaggtgtttccacggccgcgtggatccatcgagtgtgggttttgtctcgggagttgcccgtgtgggtccgtttgtgtctgcgcgtctctctgtgagt

SEQ ID NO: 100237 - DNA, 232 bp, Homo sapiens
  chr9:123150500-123150732
  hypo
gtggtgtgggggctgcgggagcagaggtggggcatttcacctagtatcgggtcaggagaggcttccccaagggcagaaaaaatatttctaaaggaccattcaaagctaactagaaaaagaaagggtgggaggagcatgtccaagagggcgcagcctgggttagactggggagaacactgttccgtttgcctggaacacagagtggagcgggaggaggcgagatgggcaagga

SEQ ID NO: 100238 - DNA, 30 bp, Homo sapiens; identical to SEQ ID NO: 42195
  chr9:123272513-123272543
  hypo

SEQ ID NO: 100239 - DNA, 79 bp, Homo sapiens
  chr9:123287834-123287913
  hypo
cacactgaagggctccgatctcggttggacctagaactcccccacatgtgatacaatgttgactttttttttttccttt

SEQ ID NO: 100240 - DNA, 30 bp, Homo sapiens; identical to SEQ ID NO: 42197
  chr9:123294978-123295008
  hypo

SEQ ID NO: 100241 - DNA, 53 bp, Homo sapiens
  chr9:123295496-123295549
  hypo
atagaagcaggacaacgttcagccctgcattcccagcacgcattcccaaggcc

SEQ ID NO: 100242 - DNA, 30 bp, Homo sapiens
  chr9:123642193-123642223
  hypo
tggccacgtgagagacgcaaatgaagagaa

SEQ ID NO: 100243 - DNA, 35 bp, Homo sapiens
  chr9:123690879-123690914
  hyper
cgaggagtctctctgcgccgcgtgtccccatctcc

SEQ ID NO: 100244 - DNA, 40 bp, Homo sapiens
  chr9:124061944-124061984
  hyper
gggtgcaggggctgccgcgccctgtcgggtcgatccgggt

SEQ ID NO: 100245 - DNA, 71 bp, Homo sapiens
  chr9:124261319-124261390
  hyper
gtgctgcaggcaccccggatgccaaagttagtgtcggaaactttccccatgctgggcgtctgactgagtcc

SEQ ID NO: 100246 - DNA, 137 bp, Homo sapiens
  chr9:124262375-124262512
  hyper
tgctgggaggggctgcgctgcgctggcgcacggccaaactctgggaaactcagagccttggagatctgatccaccgtttgtttcccgaggaaggaagagcgcgaatgtagacagcggcaggccggggctggagtcgc

SEQ ID NO: 100247 - DNA, 541 bp, Homo sapiens
  chr9:124361389-124361930
  hyper
aggggtcagcggatgcgggaagattctagcgggaaggggagctgtagggtggaagagggataagtaaagcaaagtcgcggcccactcctcggtcccgtaccctcatagcgccgaaacggaagcagaggttatctctggactcctggaggcctggggactccgggaggggagggggcgtgtggtcccgccggcatctcgggccggcaccaggctggggagcgtgtgctcggagcggagggcctcggctctgcccagtccggcctgggcggggcggtggtggggaggtcgattgaccaaacaggtgcgcccccgcccctctgctccccgcccgcgctgggtcccgggcctggcgggcggagctgtgggcggctgggcctgcgattggcagggctgggcaggccgggtggccgcgggagcccgggagccgtagagcggcggcgccgggggaggcgcggagccggccgtagcgcgctcctgcctggccagccgcctactccgcccgccccgctccactcggcccagctggcgcgaaggaaacttt

SEQ ID NO: 100248 - DNA, 141 bp, Homo sapiens
  chr9:124362183-124362324
  hyper
ttgctttatttaccccgcttttcccctacagtcccctctcccgcaaggaaatctgcgcgatgcattgagcctttaaactttcctgtgcgccctgcccagatctcgaccgccgggacccagggctggcgctgggttcttggg

SEQ ID NO: 100249 - DNA, 159 bp, Homo sapiens
  chr9:124461151-124461310
  hyper
tggggggtgtgacctcgcacggggaggacaagctcggaggcggcagggaggtgagcggggcggccggccctggcggtccccgggggtctccgcccctccgcagccccgccccctcgtcccggtactccccctcgccccggcgcccggggggctcgggca

SEQ ID NO: 100250 - DNA, 30 bp, Homo sapiens
  chr9:124499696-124499726
  hypo
tcagcacgtgcctttcgggaaggggaagcc

SEQ ID NO: 100251 - DNA, 30 bp, Homo sapiens
  chr9:124500396-124500426
  hypo
aaggtgggtgtccagcggcctggctgctga

SEQ ID NO: 100252 - DNA, 30 bp, Homo sapiens
  chr9:124580756-124580786
  hypo
cctgctctgtgccaacgtggacccagcaca

SEQ ID NO: 100253 - DNA, 125 bp, Homo sapiens
  chr9:124751390-124751515
  hypo
atcactcatcctacacgaagccagagagccctcttgaggccggtcaaggctggaaacgcaggctgggaactggcaatggttacctggaagcacgtggggcccggcctccccgtggggatgtctga

SEQ ID NO: 100254 - DNA, 266 bp, Homo sapiens
  chr9:124990520-124990786
  hyper
aagagaaaagagaggcgctcaaggggaggaaaaagcaccctccagcccctcggcgcgccgggtaccggccccgcgtcgggattctcagcgctgcgccggcacaacccccggcgcatcggcgctatcagcgcctattcagacggacaataccggcctcgcctcctcttgattcgcctgtgtctttactaaatcgctttttgagaaattcctccaacatttgcataatgtgttcccgctttccgcgaccccccccccccgctcgcgcg

SEQ ID NO: 100255 - DNA, 184 bp, Homo sapiens
  chr9:124990828-124991012
  hyper
cgtacccctccttcctgcaaccgcccgccaccctgctcggcccggctgggtcccggaccctgcccgaccccggcccgggccgctcacccagtcgttcgccggctcacctggtcggtggcggggccgccctcggccggcagccggcagccctcgggcaacgccggggcggcgttctcatgcttcc

SEQ ID NO: 100256 - DNA, 67 bp, Homo sapiens
  chr9:125551770-125551837
  hypo
cactgctggccatctcgtgcagtgacaccagtctcaatgaactccttctcttcgccatctgtggctt

SEQ ID NO: 100257 - DNA, 39 bp, Homo sapiens; identical to SEQ ID NO: 42200
  chr9:125623471-125623510
  hypo

SEQ ID NO: 100258 - DNA, 29 bp, Homo sapiens
  chr9:125676678-125676707
  hypo
gctgggattacaggcgtgagccaccgagc

SEQ ID NO: 100259 - DNA, 30 bp, Homo sapiens
  chr9:126090073-126090103
  hypo
ggtttgtaaaagtatcggactccagctaac

SEQ ID NO: 100260 - DNA, 30 bp, Homo sapiens
  chr9:126090387-126090417
  hypo
acactctaggctgcacgtccatattctagt

SEQ ID NO: 100261 - DNA, 67 bp, Homo sapiens
  chr9:126110108-126110175
  hypo
catgtagtgtgtgtgcgttgtgatgtatgtgtgtgacgtgtgggggtgtggacgggcatgacgtgta

SEQ ID NO: 100262 - DNA, 30 bp, Homo sapiens
  chr9:126111852-126111882
  hypo
cccaggattctggggcggggggtggctcac

SEQ ID NO: 100263 - DNA, 54 bp, Homo sapiens
  chr9:126125543-126125597
  hypo
ttcagctttgcctttcgtgtagggacgcccccaggcatccgggcagctctaggg

SEQ ID NO: 100264 - DNA, 331 bp, Homo sapiens
  chr9:126132902-126133233
  hypo
ttgtgctccatctagcgaccctggagctacggctctggcatgagggctgccctgcccggctctgtgtggcctctggtcctgtggccctggcttccacggcttcggcaactccgctgcctgccgggatctcctctgcccagctgggggacgcgacctttgcaggctgcctccaggacgtgcgtgtggatggccacctcctgctgcctgaggatctcggtgagaacgtcctcctgggctgtgagcgccgagagcagtgccggcctctgccttgtgtccacggagggtcctgtgtggatctgtggactcatttccgttgcgactgtgcccggcc

SEQ ID NO: 100265 - DNA, 303 bp, Homo sapiens
  chr9:126133637-126133940
  hypo
ggacctggggcagcacgtgcacgtgggtgggaggctccttgctgccgacagccagccctggggtgggcccttccgaggctgcctccaggacctgcgactcgatggctgccacctccccttctttcctctgccactggataactcaagccagcccagcgagctcggcggcaggcagtcctggaacctcactgcgggctgcgtctccgaggacatgtgcagtgtaagtgtctggtggcggtggtggtggtggggtggggagtccttttcccaggatctgtcctgtgtcaccggggcttagtgtgt

SEQ ID NO: 100266 - DNA, 305 bp, Homo sapiens
  chr9:126138009-126138314
  hyper
ctgagtaggaagacacggaggggcagggggcctgggagtccgcactggagcaggctcggcccgctgtgcaggctggccccaaccccgggtggctcagcccaggaggagcctggacagacgaaggcagcaggcgctggagctgtgaacctccccgccacaccccttcctggggcggggtggggggagtgggtgctggcgaggagaggcttggaagggaagtctggggagcagccttgatctctacaggcttctggcagcctgggtcataaaccacaaatcccctccgcttacggggaatgtttcct

SEQ ID NO: 100267 - DNA, 36 bp, Homo sapiens
  chr9:126139212-126139248
  hypo
gggatcctggcagcccgaaagcgccgccagtctgag

SEQ ID NO: 100268 - DNA, 176 bp, Homo sapiens
  chr9:126140319-126140495
  hypo
ctggttctccagctccggtccttcctagcagcctggtgagctcactccttcccctgatgactggctgcctctacacagactcggcgagaggacttgaaggaagccctctgggttgtctgctgagtacaggggctcagtgaacactggcgctgcctctgagtcggggctgggcctgc

SEQ ID NO: 100269 - DNA, 36 bp, Homo sapiens; identical to SEQ ID NO: 42206
  chr9:126141357-126141393
  hypo

SEQ ID NO: 100270 - DNA, 69 bp, Homo sapiens
  chr9:126145324-126145393
  hypo
cacttgcaagccacacggcccgggtgccagtccctttctcctggcccaggtcctcgttcccagcaggga

SEQ ID NO: 100271 - DNA, 148 bp, Homo sapiens
  chr9:126152955-126153103
  hypo
gtgaagaggtgaccacgtggccaagaagtggagaacagggactgcagcccggatggtccacccccaggggcctcaccctctcctgtgagcggggctcggagtagatgcacacgaggggacaccagccccggctcgggccaaatggagg

SEQ ID NO: 100272 - DNA, 340 bp, Homo sapiens
  chr9:126154211-126154551
  hypo
agaagaaaggctggccgtccgtcatggatcagaccccatcatcccccacggctgctcccgcctctgcccaccttgtctccgcgtggagttcccatgcagatgacttcccgaaccccttctaatgtttggtttaacgtgtcgccggttagcgcgcgcgtgtgacagtggtgacaggcgaggctgttcctttttaaataccatgtcagagacacggcgtcaggaagcagggacgtgctccatgctctctgccgcgccgggatcgcaccggcttattttttaatgaggaagatctgcatctcgggagtttttttcatgtgtcacatcgcgtggacaaatcagc

SEQ ID NO: 100273 - DNA, 105 bp, Homo sapiens
  chr9:126158010-126158115
  hypo
actggcagcttcatacgcacgtcctaatcacacctggcacacagtaggtgctctttacctgtttgtggttgttaccggacgcccctaccccgcctcccaggtgct

SEQ ID NO: 100274 - DNA, 119 bp, Homo sapiens
  chr9:126169372-126169491
  hypo
ggcaatcagcgggatcggtggaggagactgcttcattagggatgataaaacagacagagcagggggggaggggcgggggggtggggagcacggagctggagcctcggaggctggggagg

SEQ ID NO: 100275 - DNA, 30 bp, Homo sapiens
  chr9:126283294-126283324
  hypo
aagaaatttcaaacacggttctaccatgta

SEQ ID NO: 100276 - DNA, 30 bp, Homo sapiens
  chr9:126314151-126314181
  hypo
ctgggcctcagcaagcggtccccttccttc

SEQ ID NO: 100277 - DNA, 30 bp, Homo sapiens
  chr9:126349144-126349174
  hypo
ggaaccaagtgggggcgcagagaggtcaaa

SEQ ID NO: 100278 - DNA, 30 bp, Homo sapiens
  chr9:126357733-126357763
  hypo
actcaaggggctccccgcctctccttgtgg

SEQ ID NO: 100279 - DNA, 52 bp, Homo sapiens
  chr9:126405898-126405950
  hypo
gagttacagaagatacgccccagggctccaccaaggccgcactcatggtagg

SEQ ID NO: 100280 - DNA, 141 bp, Homo sapiens
  chr9:126569628-126569769
  hypo
atccatccctgactacgtcagcccacatttgactggtctcctccctaagcttctgtaatattcgctactttggcagcataataaatgactaagcacctgattatgcacctaatcatttctcgtcttcgactgttaattctt

SEQ ID NO: 100281 - DNA, 30 bp, Homo sapiens
  chr9:126729042-126729072
  hypo
gtgaggcaccgcacccggcctctgatctca

SEQ ID NO: 100282 - DNA, 30 bp, Homo sapiens
  chr9:126759039-126759069
  hyper
ccctagggcaagtctcgcagtgtgatcgcc

SEQ ID NO: 100283 - DNA, 206 bp, Homo sapiens
  chr9:126760259-126760465
  hyper
cagaaaaggggaaatcgggactcatgtggttgagggttcatgagagcagtttctgtgcgctgaggccgggacttcccagcacagcctacaagacactgcctgcccacgcctggccccgcccacctctgcagcctcatcccgctccccaccccacaccggccactccggctttcgcgctggccttgctccctcgtgccaggaacgct

SEQ ID NO: 100284 - DNA, 165 bp, Homo sapiens
  chr9:126761476-126761641
  hyper
ggggagtgacttgtccgaggtctcagagcagggaaatggcttcagttgcattttgggggccgctgttccaaggagagacagagaaagagatagcgagtccccctgagcaaggcgagaaaggggggagagtgaggggaggtagaaggaagccggagagggagggag

SEQ ID NO: 100285 - DNA, 76 bp, Homo sapiens
  chr9:126762530-126762606
  hyper
aaggaagcgcctcggcgcgccccgggggcctggagggctgcgcgtggtgcggggagggccacggcaggcacccgcg

SEQ ID NO: 100286 - DNA, 1618 bp, Homo sapiens
  chr9:126770190-126771808
  hyper
tggggccaaggagggcggctcccctgcgcggatccttccctggtggctcccaaatccggcgttttctctgccgcctctccctcgggggagactcggaaaggctgcaaaaatctgggcgcccgttcgctcgcttgtcaagaagcaaactgtcttcacattctccaagagcaacatccctgcctaggaagaggaaggaagaggcaaaataaataaaaccagttaatgttgtagttaacttgcaaatcaagtaaatctgttggtgccgtatttgagaaataaaccatcacagcgtcacagcaaacacacacttctgaacgtcttcattttgatttaatggtatatcagcgtcaactatcgcttcctctgctggtacacacggcctgatgccgcgggaggagggtgcccatgtttatcaccgagtgagatgactaattacaccttgtcaatcaccggctatgaagacataaaaccagcgcgcacaatgaagtagttgcctgcagcgtcaattagttggcgattctgaggttattgcgtggccctgctttggccgcctctaataacgggacagagcgccgggcaccgcgcactgatcaatcaccctccttccgcggccgcccggctccctcccctctcccccgccgggtctggcctcactttctccgggcggcttgcgcttcctccctccgcggccccggctccgtggcgccggcagccccgggagccccgggaagtttgcgcgcggcagctccgcagccggcagccgggagccccgcagccttcggggagcgccggggctggtggcccctttgttggaggaggcgtggagggagcgcttttgttctgagttagtcacggtggccggctggaggctgctacctcattatgcgccgggtctgcttgtctgcgaggaagcagatggtggggaggtaggcagcggcgagagtggccagacctgaattccgttcacctgtcacctcccacaaaaggcaggttcgggggacttaggcattcgttgccactttctgggggagggggaggtcgaggggccgccgtttccggcgcctgcgaaggttccgtacctgtcggtgcccgctccccccaccccttgcctttcccttggctgcagcttctcgcaccgcgtaaatgtcactcacgtgtcaggatgtgtgtttacagcctgttcctctgcttgtttagtctcggcggacagggctcagcggttgcgcgacgttccccgccgctgggggagattagcaaagttacccgcctctggaccccggggcctgggcccctagatcccgccccgcggcgggagatgcgtttgagccttttacagacggagcgcgtcccagcctgacgcagagggatgaatagacaagcgcaccgggcgggaatcccgactgcctgtgtatctggggtcggcccagcgttggacgtgggctgctggtccgagaggtggcgacggaatcgcgtgcctatatgtatgggggagtggaaagtcgcagggtgtgtttccacgtttcttgagcagcccgcggcaagagttgctgagtaccccaccccccgcccccagatcctaaggcagcccctcgagctttccaaacgtattgtatccagc

SEQ ID NO: 100287 - DNA, 549 bp, Homo sapiens
  chr9:126773231-126773780
  hyper
aggctggggagagaccgggaagagcgagaagctacacgctgggctgcagattgggccctagcgggcttggagcgtggatatgctggctggcccccctccccgggagtcacagctctcgccggtctcgccactcaggctctgccgggtacccaggaggcttgcacggccgcctgcagcccgctgtgcagagcccgggccgaaggcggagctcgatgggaaacggccggccgaaggctcttgcaactctgccacaggcctgccttcccgggcctcccaggcgggtgcctgaggccgcggctccaggccgaggggagaccgcagtgagacgagcatccccttgctgcgccttcttaggatagagggtttaattttcctttctgaagatatcgcaggaagctgttcgtatcttaaaaactccaaaccccgcgctctccctcctccctgcctcccccccacccccgccctccagcctcgcccaccagctcccaccatctcgactctcctctgctcctcttgcctctcccctccctcttgggtctcccgccttcc

SEQ ID NO: 100288 - DNA, 39 bp, Homo sapiens
  chr9:126773939-126773978
  hyper
ggctgggcccgcggccggcggctcctcctcccactctgc

SEQ ID NO: 100289 - DNA, 240 bp, Homo sapiens
  chr9:126774038-126774278
  hyper
tcctcttcaattctcccggtggctcgactcggctcgcaggcttcggagaaacccctactccagtcgccgactcagcgcccaagagggtcgccttgggctgggggcgcaccccagggaggggaggggtccaggcagctgggccgccgcggacacctagcggcttcagggtgaaccccgaccgcagccgtcgccgcctcgggcagagtttgcgcccttgctttgcgccccgggcgctgaagc

SEQ ID NO: 100290 - DNA, 161 bp, Homo sapiens
  chr9:126774459-126774620
  hyper
cgcccggggcccggagcccggcctgggggctcagccgagctcgggcggggccggggccgcggtggcgatgcaccgggcccgttagcgccaggagcgccaggcagctgaggcggggggcaagccctccctcggaggagccgcgcccccggccccgccggtcc

SEQ ID NO: 100291 - DNA, 116 bp, Homo sapiens
  chr9:126775412-126775528
  hyper
tccctgggggccagacgagcagacactgcccgaccagcgggcccagaagtgacctttaggaggccgcggaggtggggagcacgggagaagcttctctgctccgggagcaggagcag

SEQ ID NO: 100292 - DNA, 55 bp, Homo sapiens
  chr9:126776044-126776099
  hyper
gcctgggttctgaaccgcccagaaatggaaatgggccttttggggtggggggaag

SEQ ID NO: 100293 - DNA, 66 bp, Homo sapiens
  chr9:126776270-126776336
  hyper
cgctgtgcgccggctgcgggggcaagatctcggaccgctactacctgctggcggtggacaagcagt

SEQ ID NO: 100294 - DNA, 161 bp, Homo sapiens
  chr9:126777586-126777747
  hyper
ggcgctgctgcagggcgagtaccccgcacacttcaaccatgccgacgtggcagcggcggccgctgcagccgcggcggccaagagcgcggggctgggcgcagcaggggccaaccctctgggtcttccctactacaatggcgtgggcactgtgcagaaggggc

SEQ ID NO: 100295 - DNA, 15 bp, Homo sapiens
  chr9:126777973-126777988
  hyper
cggctggagcgggag

SEQ ID NO: 100296 - DNA, 137 bp, Homo sapiens
  chr9:126778381-126778518
  hyper
aggtctcagttttcccggactttttcctccgagtttcctggcgcctgctggggtgagggccgtgaccctcggaagcgagccccccgggcggggacgagaccggagcaggcctggcctcgcgccggggtggggtgggg

SEQ ID NO: 100297 - DNA, 15 bp, Homo sapiens
  chr9:126779147-126779162
  hyper
aaaccgagttcagac

SEQ ID NO: 100298 - DNA, 568 bp, Homo sapiens
  chr9:126779476-126780044
  hyper
tctttttttcctttccgttctctccgtcctttctctctatctctgtctctgtgtgtgtcgtgtttgttcccgtgccctcctctccgaccttggccggggctcctagtcctgagagaaacggcgttcggtgcgccggcggtggctatgcggctggctctttcggggctcccgggactaggttggggaaagagggcatctccccggcctctcggggcccagcccagtcttcctagatctggcgtccgcccttccctcccctcccgcactggcaggagagaaatggccgcagtgtgggccgcggggcagctaggactggaaagcggggaccctggagggtgcgatcgcggacggggtgtgcgggcgcgggtcgtgtgcgtgtgcgtgcagggttccgaccacggggacacgagcttgtttgtggcagtgtcccacatcctgtggcccagccacgacgaccccttgcaaagcctcttgctctggggacagtccctccgaggcgcggcggcaccttactgaagggcggcgagctgggggccgagtggggagggggcgccgtcggggcgccggg

SEQ ID NO: 100299 - DNA, 31 bp, Homo sapiens; identical to SEQ ID NO: 3461
  chr9:126780284-126780315
  hyper

SEQ ID NO: 100300 - DNA, 390 bp, Homo sapiens
  chr9:126780564-126780954
  hyper
aggagagagaaagcccgggtcctccccctcccctcggcccctcgctcctccccggatccgatcctggggaatctcgacccgcccccgggcactgggggcgggagtgagggggttcggggcgccggccaaacctgggccccacggctgcctcccccgccgccgccccctgcccttgcctctggccggcctcggcctcgctacttagggccggctcctttccctttttctccactccccttctttccccttttctctactcccccgccaataacggcttcggaaaaggcctcccccgcagggaccgggtctcccggagccccgggattcagctcggccaccggaccctcgccacaagctgcgcctgtttccgggactcgctttcccctccgc

SEQ ID NO: 100301 - DNA, 213 bp, Homo sapiens
  chr9:126781161-126781374
  hyper
actaccccacctaggcggcactcagggcaggtcccttgggcccatgggggcgccggggtccccacggagctcattaacagcagccaggcccaggcgggggctcggtggagggatgggcccaaagataccccgtagggaggctgccccacccccagtggagctggggactgggggaaagaaaagggttgctcacctcagcgggttccaagcagt

SEQ ID NO: 100302 - DNA, 30 bp, Homo sapiens; identical to SEQ ID NO: 32689
  chr9:126782415-126782445
  hyper

SEQ ID NO: 100303 - DNA, 140 bp, Homo sapiens
  chr9:126783400-126783540
  hyper
gcagagcacctggaccgtgaccagccatacccgagcagccagaagaccaagcgcatgcgcacgtccttcaagcaccaccagcttcggaccatgaagtcttactttgccattaaccacaaccccgacgccaaggacttgaa

SEQ ID NO: 100304 - DNA, 294 bp, Homo sapiens; identical to SEQ ID NO: 32691
  chr9:126785057-126785351
  hyper

SEQ ID NO: 100305 - DNA, 30 bp, Homo sapiens
  chr9:126794671-126794701
  hyper
ccagcccttccctgtcgtcccccgcaggtc

SEQ ID NO: 100306 - DNA, 66 bp, Homo sapiens
  chr9:126807864-126807930
  hyper
aacacatgggacccccggagttcagcccgagcccccggggagctgtcgggacgggtcctctctggg

SEQ ID NO: 100307 - DNA, 75 bp, Homo sapiens
  chr9:126872665-126872740
  hyper
caccccccttgatctcggagacgtctgagaacgtcacagaggccgatgaacttggagacacggggaagaatggta

SEQ ID NO: 100308 - DNA, 170 bp, Homo sapiens
  chr9:126930838-126931008
  hypo
tattcttatatattacggaaaagtttgcatataattggtgttagttcttccttaaatattagatataattctccaataaagccaactgggcttgaagttatctttgctgtaagttttaacattgtaactatgaattcgattttcttaatagatatcggactaatcaggtt

SEQ ID NO: 100309 - DNA, 54 bp, Homo sapiens
  chr9:127106240-127106294
  hypo
gtccaaaatcagtctcgctgggctaagtcaaggtgtcagcgggcaggtgccttc

SEQ ID NO: 100310 - DNA, 410 bp, Homo sapiens
  chr9:127212654-127213064
  hyper
aggggcggggtctcccgggccgaggggcgggatctcctggtatctgccagagcccgccgctgcctccccgacttcagtccccgcagatgcctcgcagacggtgaacggccacaggcgccaggccagccatagcgggtgaggaactggagctgggaacaggggagggaccagcggatgaaggggaggcccctgactcaggcccattggcgcctcgcggaggagggacgcgcagtggtgggcaaacttcgcatctccctctcgggcctcaacgagtgtttggagagcaagaaaagtgggcgccagggggcttgagggcgcgaatccaggcagacgtgaacgagggagtgcttttcagaatccaaaacgcgggagcctcccagtcctccggtgaggggcgtgttggattttcg

SEQ ID NO: 100311 - DNA, 171 bp, Homo sapiens
  chr9:127215802-127215973
  hyper
acctgtgggcgcgggcgctgagccccgctcagctgcaccgggcacgggcctgcgcgccgccctcagagggcctgctcttccgctgggacccgggcgccctggacgtcacgccctcgctgctgcccactgtgtgggtgcgccttctctgtcccggtacgacccgccccgccc

SEQ ID NO: 100312 - DNA, 196 bp, Homo sapiens
  chr9:127239774-127239970
  hyper
tttctccacccattgcgcggatgaggaagttgaggcacagaaaggcgcagccgctagccagagcccgcacagagccagagccaggtccccactggcgcagatgggggactgcaggcacagcagtagccacgcgggtgtaaacgtagagccgcgtgaacccgggttgtgggatcccaggccccgaccagcccccatc

SEQ ID NO: 100313 - DNA, 15 bp, Homo sapiens
  chr9:127265595-127265610
  hyper
gtccgtagtggtagc

SEQ ID NO: 100314 - DNA, 401 bp, Homo sapiens
  chr9:127265875-127266276
  hyper
cggccttcccctgccaggccccacgctcccgccccgtccggggggctcctcccgcgcggaccccgtcgcgcccgatctggggccctcgggttcgatgcgcttcgattgggattcgtttgtctgagaacaaaaccccgattctgagaaaaagagatgggctcagccgcggggaagacgccaggggacccaggagcgctggggcgcccggcccgggtgttctgggaacccgacagagacgaaggaggcagagacagagtccgggggagccagagatgggaagaaactctggcgagagacaacgaccgacgccaccgggcgcagacacgaggccagtccgagagtgccagagacacagacactgagacgcccagctagagagaacccggcggggacgagacaca

SEQ ID NO: 100315 - DNA, 252 bp, Homo sapiens
  chr9:127266336-127266588
  hyper
agagagagagagagagaaacgaggggtgggggattggatcagagactcggagagacagcggaggcccgaagagaaaacccaagagagactgacgcagagccagagacacaacgatagacgacagacagagacgccgagacgagaggagccccggagagacgaggccggggagctacagaaacacggagagaaaacctggaggcggaagcgcccagcccgagggtcggggacaggggacgcgcggaaacctgc

SEQ ID NO: 100316 - DNA, 219 bp, Homo sapiens; identical to SEQ ID NO: 10058
  chr9:127266628-127266847
  hyper

SEQ ID NO: 100317 - DNA, 631 bp, Homo sapiens
  chr9:127266865-127267496
  hyper
cggagaggcgaagtccggaggagggaagcgcgaagagccagggcccgggacgcgagagggggcgcgacggcggctgcggtcggcccggcgcccacctggtcgctcctgcgagcagcgccccgcgtcccgcccgcgcggagcccgcacctctcggccgcgccgccgccgccggcgaggagccgcacccgggcgcagcgccgcccgcccgcgatgacggccgctcgggccggggacggggaggcgggggcgcggggctggcggcgcgggggcctcggctcccccctcccgcctccccgccccccatcctgcctccctgttcccccccgcaccgccgccggggccgctccgaggcgcacctgggacccgggcccctcagccgccaccccgccctgcgccaacccgccgcgccggggccgggggccggcccctctatatcggcgcgtgcggtatccgggggcggaggcccggtcgtgtcctccccccaagcccggcccgcgccggcaccctctccgcagtccagctcgagtcttcgccctcatcctccaggccccccagccgcagcccggctccccggaccccgagcgcggccagagagctgcggagcccgagtgccccgcgatctgggcaggta

SEQ ID NO: 100318 - DNA, 127 bp, Homo sapiens
  chr9:127421402-127421529
  hyper
gccaaacacttgtgccgcctggggcggtgggggtagaggcaagcatagacagagaggaactaagccagacatggacaaaggcacgagccaaaaccagacagtcctggccgttcgataggccagcagt

SEQ ID NO: 100319 - DNA, 142 bp, Homo sapiens
  chr9:127539774-127539916
  hyper
tctcagcactgaagccgcaggggcaggggccccgagagaggggcgcgtggaggaacaagcgctggagatgtagggatgctagggacccggggcctgaggaaggggcgctgggaccgggtccgattcccggaggggtcggggg

SEQ ID NO: 100320 - DNA, 133 bp, Homo sapiens
  chr9:127597207-127597340
  hypo
gggagaagctacttacggagccacctgactgcacctgagacagagtcccaggcagtgccagagggcaggggacctcctgagcctggcatcttggccttccctcctgagctccctccgacgcagagcagaccca

SEQ ID NO: 100321 - DNA, 162 bp, Homo sapiens
  chr9:12775664-12775826
  hyper
gcctttcatctgctgcgttttattactattatcgccgttccggaaaagtcatggaagacagcccgctgccagacctcagagacatcgagctgaagctggggcgcaaagtacccgagagtctagtgcgctctctccgtggggaggagccggttcccagggaaa

SEQ ID NO: 100322 - DNA, 53 bp, Homo sapiens
  chr9:12776163-12776216
  hyper
ggaatgagcagggggcgctcatccggaggcagctgctgcgaggcttgtttacc

SEQ ID NO: 100323 - DNA, 82 bp, Homo sapiens
  chr9:127950686-127950768
  hypo
ggttaaatactagcacgagctgataagcactgctagaaacctaagctctgatttcagcaaatgcatagaaacacttttcaaa

SEQ ID NO: 100324 - DNA, 30 bp, Homo sapiens
  chr9:128104149-128104179
  hypo
ggagagctgctttcacgccatactcaagcg

SEQ ID NO: 100325 - DNA, 40 bp, Homo sapiens
  chr9:128118055-128118095
  hypo
ggccattgagcgaagcgtgatgaaccggattttcaagctc

SEQ ID NO: 100326 - DNA, 46 bp, Homo sapiens
  chr9:128190094-128190140
  hypo
ctcccgaaacagcatcgcccataccgagtcccgagctaccccagct

SEQ ID NO: 100327 - DNA, 30 bp, Homo sapiens
  chr9:128191341-128191371
  hypo
ccagctgctgggctgcgggggaggggctgc

SEQ ID NO: 100328 - DNA, 513 bp, Homo sapiens
  chr9:128651901-128652414
  hyper
ttcctgtgtaagtgtcgcacaaaagtaaacccaaagagcccgcacatgacacggaggctgctccatttacattaattatgcagtcagggcggtgagaattcgctgtcagccagcagggcgggggcgcgccgcggcggggagcggggccgggccgcggggcctcccggcgcgaacgcgggagggggagccggatcgccgtccgccgctccgcggctccgcgctgcgagaacaatgggcgcgcccgacgcccgcccgcgctcgcgctgcccggcgcgccccgaaagccgcggggcagagcgccctgagcggtcccccgcgccggcggccccggctgcgccccgctgtagcagctgaccttagccggctgcggccgagagaacgcgcgttgcccgccgaccttgtgccctggggtcagcacccactgcaagtcagaacctctccgtggtcccaaagttagtgcttttccaatccaaaccagaaacttgatttgaggcctggcgatggtagaggatg

SEQ ID NO: 100329 - DNA, 30 bp, Homo sapiens; identical to SEQ ID NO: 42214
  chr9:128750886-128750916
  hypo

SEQ ID NO: 100330 - DNA, 122 bp, Homo sapiens; identical to SEQ ID NO: 42215
  chr9:128759852-128759974
  hypo

SEQ ID NO: 100331 - DNA, 111 bp, Homo sapiens
  chr9:128777807-128777918
  hypo
tgcccagcggaggtgcgtgcaggagtgggcggtgtccgtccagccccgatgggggcctgtgctgagtcaggttcctgtccttgcttggtgactctccggactccagctcca

SEQ ID NO: 100332 - DNA, 176 bp, Homo sapiens
  chr9:128824558-128824734
  hypo
ggcactagcactacgcggcacacaacggacccagtccctgccctcggggctctcgcctgcagacctgggaggcagaattcatgcaggtgttcagtagctagtgagtcatggttgtgctaagagcacaaaagaggggaggctgtgtgctgtaagaggctgaacgggcctcacctggc

SEQ ID NO: 100333 - DNA, 30 bp, Homo sapiens
  chr9:128874699-128874729
  hypo
aagttataaacaccgcggcttccatctctg

SEQ ID NO: 100334 - DNA, 229 bp, Homo sapiens
  chr9:128984848-128985077
  hyper
aggagattccagtgccgccgcagggcccagaaggggtgtaggaggcgtggccgcagccccaccctagaccccagggccgggcaggaagatgcgtctgcgcgtgcgggcaggtgtagggggcgaggaggtggggagcggtaggaaggggaagcagcgaggggagaggctgccgagccgagcctccgcggacccgctcgcccctaaatcacgcagccgcatgaataataaa

SEQ ID NO: 100335 - DNA, 30 bp, Homo sapiens
  chr9:129269531-129269561
  hypo
tctggtggcagccctcggggtgctcctgga

SEQ ID NO: 100336 - DNA, 326 bp, Homo sapiens
  chr9:129276607-129276933
  hyper
cgggaccccgccctgcgctccgcccccaaacacgggttctcacgcggtccggccgcgcgggggcgcccggctccccggccctcgctgggccctgcgggaacgccccggccgcgcactggggatgctcggaccccagcacacacgaggcggagctccgcggactggaggcaaatcaatccctcggcaccgcgctacggacgtgtgtttggaaggaggctagcccgccgcgcaagtccccgcagcgccccgccggcctcccaccccctgcggcgtccggacctcgtggacctggggtggctcccatagactgcggggccgggcccagc

SEQ ID NO: 100337 - DNA, 10 bp, Homo sapiens
  chr9:129276961-129276971
  hyper
cgactggaga

SEQ ID NO: 100338 - DNA, 316 bp, Homo sapiens; identical to SEQ ID NO: 32705
  chr9:129372722-129373038
  hyper

SEQ ID NO: 100339 - DNA, 51 bp, Homo sapiens; identical to SEQ ID NO: 32706
  chr9:129373250-129373301
  hyper

SEQ ID NO: 100340 - DNA, 30 bp, Homo sapiens
  chr9:129373610-129373640
  hyper
gaatgcatgcgcacccggacagaccagacg

SEQ ID NO: 100341 - DNA, 30 bp, Homo sapiens
  chr9:129374281-129374311
  hyper
ctagccacacaaaggcgcctagaaatacac

SEQ ID NO: 100342 - DNA, 165 bp, Homo sapiens
  chr9:129374814-129374979
  hyper
tctgaccaagcctcccgcaggttccaaatccgatccgccctttcgcctccagcgaggtcaggggacccgccccccatgccctccgcccccgcccggctccgcgccgctgcctcgctccgggaggggccggggccgccccgcagcggatcgcggggggtcagcccg

SEQ ID NO: 100343 - DNA, 88 bp, Homo sapiens
  chr9:129375295-129375383
  hyper
accactccctcctagcgcccctcactgcaaaccctaggaggcccgggtcttgcccactgctcctgcccctgcccggggaccccttttc

SEQ ID NO: 100344 - DNA, 1073 bp, Homo sapiens
  chr9:129375725-129376798
  hyper
acctcggccgacagtcgggggttcccaagcggccactcccggccggcgccgtcccctggcggagccgccgcgctccctgccgtccgcgcagtctggcctcgctcggggccactcctcgtagcgctggagctttacaaaatattaataataaagaaggcagaggagaaaaaagaaagccttcgctccccaactcccaaatcaatttttcaagggggtggagcagagggatttgtttcgaagacgatcaaaacttctgcgaggggcccgcggggcggccgggccggggagccggggcctgagctcggggccaggcgcggcgcggggcgcgggccaggggcgcggagccccggggcgcgcgggggggcgggacggcactatttgacgtggagccggcggcgcatcccggcgcagggataccggccgcggggttcaaatgtcaggaagtttcgggaggtgaggcggcccgtatccctccgccgccagccccagctctaaacccggcggctcagcgggcgcaccatggcactggagtagcgcggggagcgcgcccggagccccgcggcccgctgcgccccgcccgggaccccgctgcgccgcgcgccccccccgcggcccgcggggccgcccctgcacccccaccccctcccccgcctgccgccgccgccaccgccaccgccgccgccgcctcctccccgcggctccgtctgcagcagccgccgccgccgggttccgggactgacaagcaggtgacagaggagccggcgcgcgtggctgcaagtgtccgggagagcgcggcgcgggctgcagccgccccggcccgcccgcacgacgccggggcccggggccagcgcgtcgccgctccacgatcgccgggggccggcgcaacccctgccctgcgggggccgcgcctccccggttccagggccgcggcggcggagagcgggtggacgggccggcgggcgagcagcccggccggcggggtccgcagcgcgccccgcgtcccatggatatagcaacaggtcccgagtcgctggagaggtgcttccctcgcgggcagacggactgcgccaaga

SEQ ID NO: 100345 - DNA, 335 bp, Homo sapiens
  chr9:129377017-129377352
  hyper
agagggccgcaagtacgcctccggcaggcgtcctgaggggacaggacagctccagtcgccacccaccatcctttccaggcttaggttctagagctgccactccgatgtggtaggtggcgggtggcaggggtgatggaggacctagcaatcaccttggcgagcttgggagaggcgcaaggtcacctggggtgggggagattctaagagaaaaacgtctccctggtcactcaaaccacagattttggggagatcggggatagaagaccacgaacgccaccgtggggcgtgtcagccagcgagcgccccagcctcacctcgcctgtcttggtcccagc

SEQ ID NO: 100346 - DNA, 44 bp, Homo sapiens; identical to SEQ ID NO: 10066
  chr9:129377592-129377636
  hyper

SEQ ID NO: 100347 - DNA, 188 bp, Homo sapiens; identical to SEQ ID NO: 10067
  chr9:129377772-129377960
  hyper

SEQ ID NO: 100348 - DNA, 140 bp, Homo sapiens
  chr9:129378024-129378164
  hyper
cgggcactgatggggtcctgggagcctccggacggcccccagttgccatccgttgtcccggaatcctgcgctgggccggccgagggatttggtgcctgggtcctgggatatagggtctggcgctacggaggcctgaattg

SEQ ID NO: 100349 - DNA, 30 bp, Homo sapiens; identical to SEQ ID NO: 32714
  chr9:129380664-129380694
  hyper

SEQ ID NO: 100350 - DNA, 30 bp, Homo sapiens
  chr9:129381473-129381503
  hyper
ctccagtggcccaaccgctctgccctgcgc

SEQ ID NO: 100351 - DNA, 30 bp, Homo sapiens
  chr9:129384076-129384106
  hyper
ggaaggtgtaactgacggggcagtgaaggg

SEQ ID NO: 100352 - DNA, 325 bp, Homo sapiens
  chr9:129385872-129386197
  hyper
tccaactcccaaagccggatgggttctctaagtcctcctataccgaccttccggaaggtgcgggctctacattgttgctaatctcccccagaacgcccagcctgggaggggtggggagggggagtcgctacccgagggctgggagcagggtgtcactgacctcctctgcgcggattgccccctgtagggccagccctggccagcggaagaaaaaggttagaataattgccttcccctgggcgggagagcttccttcgacgtccggacacgcggatggggcggctttcagcggcctccacccgcgcacccctccaggcccacctct

SEQ ID NO: 100353 - DNA, 353 bp, Homo sapiens
  chr9:129386429-129386782
  hyper
cgcgctaggctgaagcccggagtccagggccctgcagcagctttcgggcttctcagcgtttcggggacccttggtggctcgggggctctcttgggctggggtcggggtgccccgccaggtggggccttacgcggtccagaaagagccagtgattctccttggagccactgcaggctcccgctggagggagtaagactggcggggagagctggcattttcattccttgttgagcacagccctcgcccctccccaagccctcctgccgaccccctcgggctggccaaaagcagcaagttcgggaggtttgtttattgagagaacagaaaattaggggttgcgggggagaatctaa

SEQ ID NO: 100354 - DNA, 234 bp, Homo sapiens
  chr9:129387515-129387749
  hyper
ttgggcctcaggagccggagcgttgccgtgggggcgggggaaggggtggttttgcgggtgccttaattggcagcgtctggaaaatggggacagtgaccccacgactagaggatgaatggggggagggttagtgggatgtgtttgcctcctctgaccgagagcacgggtcctgctctgtcccctcttcccaggaaaggtggcactccgggtgcacacccaccacccccattaaag

SEQ ID NO: 100355 - DNA, 907 bp, Homo sapiens
  chr9:129387847-129388754
  hyper
cgcactcctgcaggtctccagggttggccattcccggctgcatgctcggcccctttcttccgagggtgaattcctttgttccacccccacggaaaccctcttctccgccaggcccgtggcgcctttctcgccacctccgccgccgccgccgccaccctcgtcccaccgtttgcagggctttcctgcggcgctctggccgcagagacccagccctgtctgccgactggcccttcgacgtcgccgccgtgcctgagccccgctgcctgctcggacaagcagaactccggcaggcgcagcgggcgccgaggcttgggctttagccgtggcgctcgcctcggcgcagtggggagccgcgggcgtcggagaagcggccgcgctgttccgggtcactgcaccggctgaaaaaaccaaaagcaaaaccaacacccagaaacgaagcctgcgtgcccccgggggctccgttttgctcccctcatggacatgggggtggggagctcgtggggtttcagcccaaaggctccagtcagtggaaccggagggggacttcggaggaatttgtctctgatgtcccggctccctggcctcctattagaactcgtagaggatccgctctggagtccccgtgcgccctggcagaggtcggggacgccagagtgcacgcagtctcctgcgcgccgagcccaggctccgggcgcagggaggatcgggctgagagcagggtgtcacctcgtaaaagcgacaggcaaggactgttttatggggagggagaaggagcaggaagtgatgcttccatctctgacagcatagggaccgggagctccgatggaggaaaccctttccgggcaggacgagtagagggacaggacatggccggggaccatgggattcgctgccattaagtatggga

SEQ ID NO: 100356 - DNA, 428 bp, Homo sapiens
  chr9:129388816-129389244
  hyper
cgtcctctcctggagccccctctgcaatcccggctcagtcggcaaccggcccttccttccaggtcaggggtgggggagagactttctccctcgaaacacttgataccaactttgtttttttggcaagaaaaataagccttgtttggaaaggggtgggtggggggcgtcgagcgagcgagggaaggagcaaggaggcggcggcggagcaaactctgcggattaggtttcagcgcctccgccccacccccagccccgcggcggtgatttgtgtgcgggggtctgtgaccctgcaagcatcaaacggcccgcgggaaccggccgagttcagagggacagtgggccgaagggcggcctaagacaacgcagatggttcctatcagcccggccgggcccgcagcgtccgccggtccgtccgggctcctctgcag

SEQ ID NO: 100357 - DNA, 411 bp, Homo sapiens
  chr9:129400848-129401259
  hyper
agtgattgccaggcccgcttggcagtttttaatcattttatctctgttctcggctctcgggggagacagccagtgcttagcagtctgctcagaaagacctcggggcgcgtggcgcagcggcggctcggagctcccattattagctgtgctcttcggagcgcgctccgatctctcccgggggagccggtgaaaaattaacacgggccggcggcgcgggcgcccgatgtaactgtaattactccattgatattcctcacacaatagcgctgtcatcagtcatttacataaactttctctccccaggacgggcggaggtgcctaatcctattgggcgcttccactgcatgcattatacatggcagctcctaggtgcggactgagggaggggcggatagccgggctctaggtgag

SEQ ID NO: 100358 - DNA, 109 bp, Homo sapiens
  chr9:129414414-129414523
  hyper
aggctgcagctctcccgattgaaacccaaaccggaggagctgcctgtcacggtgcctgtgatcctgtgatccgaggcatgattgagagggggcgcggcaggagggggct

SEQ ID NO: 100359 - DNA, 215 bp, Homo sapiens
  chr9:129438508-129438723
  hyper
cctgcctggcctctccgtcacctcccatccttgcctggctgatcgccctcctctccccgtctcagcccaaatctctgtcttccgaaaagtggccttctctgacttgctccccaccacagtccccaggatgggctgtctcccagtggcttgttcgctgctgtccccagcacccagcaccgcacctggcacacaataagcaccgcatcagtatttgg

SEQ ID NO: 100360 - DNA, 678 bp, Homo sapiens
  chr9:129445222-129445900
  hyper
aaatgtgcatgtgggcctccctggccaggctggcctgggatggctccccgggctcccggctgtgcccgtccctccctgtccctggcccgtgacctccagccccggctgggggctcccgacagcgcccctggcgcggatcaaagggccgaggggccggcggccccgcacagctgcgggccgcaggaagcgcaggggcagccctcgctgcaggcccggccccgacgcggcgaggaggccgggggaggccgggaggctgggagaggccccgcgaggcccgcagagcgcgcccgtctcgccgcgcattccagccgcgtgattgacgcgcgtaccggggcccccgcccgcggctcccgccgccgcccgcccggcccgcggccgccgcatcaaagcagatgtttgcagctggtttgagttggatccccatcaacaggcccttttttgtctcaaaataaaaaacagctacgcccggaatgataaggacgcggcaggcacgtgggggagatgtcagcgagtccggcagggaggaggccgggcggctccctctctaagtgacaggctgactctagcagcagcagccgtgacccccagagtgtctagggtcctgtcgcctagctcctgtgaactgcagctcatccttcagccggcatcatcagagccccgtcccgcccacaaccataa

SEQ ID NO: 100361 - DNA, 92 bp, Homo sapiens; identical to SEQ ID NO: 32722
  chr9:129485680-129485772
  hyper

SEQ ID NO: 100362 - DNA, 3 bp, Homo sapiens
  chr9:129486023-129486026
  hyper
cgc

SEQ ID NO: 100363 - DNA, 38 bp, Homo sapiens
  chr9:129627928-129627966
  hypo
cagcttaacagaatacgtggtgcagaattttacttaaa

SEQ ID NO: 100364 - DNA, 412 bp, Homo sapiens
  chr9:130179969-130180381
  hypo
gggagctgtgctaggcgggtgggaggccctggggggggttcataaagggacatttgagatcttcaatcatttttctccttatattctatttcctacctcgccctcttggcaacccccacccacaccacctgctgttgctaccagtacccacttacccgtgccaataatgtgattcatactcttcagaggtccctttgtttccctttaagtcttcccatcagagcacagaatgcttcgcggacccagagccagcccccattgaccatcctgtaggggccccagaagcccagcctggcgccatcagtaaaggattatggagaggagcactggatagaacagccccaggggacaggtgcagcataagcttgctttacccagcccagggccgaaatctgcacggcccacggacgcc

SEQ ID NO: 100365 - DNA, 103 bp, Homo sapiens
  chr9:130248346-130248449
  hypo
tgtgtggcaggcactcggctaagcgatgaaccacattcgctgattgattctaggagggactgtattgttattagcccgatttcacaatcgcaactcaggttct

SEQ ID NO: 100366 - DNA, 30 bp, Homo sapiens
  chr9:130256609-130256639
  hypo
ctcactgaacagctccgttgttctgagcac

SEQ ID NO: 100367 - DNA, 20 bp, Homo sapiens
  chr9:130262351-130262371
  hypo
cttagcagccgggcacgttg

SEQ ID NO: 100368 - DNA, 35 bp, Homo sapiens
  chr9:130326063-130326098
  hypo
attacaagcgtgagtcaccgcgcccagcagagagg

SEQ ID NO: 100369 - DNA, 50 bp, Homo sapiens
  chr9:130362069-130362119
  hypo
ctactaatcaaaacccgagtcttgcggttacttaccgggtgaacaaacac

SEQ ID NO: 100370 - DNA, 245 bp, Homo sapiens; identical to SEQ ID NO: 32723
  chr9:130461686-130461931
  hyper

SEQ ID NO: 100371 - DNA, 27 bp, Homo sapiens
  chr9:130505479-130505506
  hypo
ttaaatattcagttacggtcggccggg

SEQ ID NO: 100372 - DNA, 30 bp, Homo sapiens; identical to SEQ ID NO: 42222
  chr9:130534900-130534930
  hypo

SEQ ID NO: 100373 - DNA, 30 bp, Homo sapiens
  chr9:130587535-130587565
  hypo
cgatgagccaggacacgtaggggggaccct

SEQ ID NO: 100374 - DNA, 34 bp, Homo sapiens
  chr9:130639978-130640012
  hyper
ttataaggctgtcagcgcgcggcatgccgggagc

SEQ ID NO: 100375 - DNA, 93 bp, Homo sapiens
  chr9:130676150-130676243
  hypo
caccaggatgtaccccggcctgcaggtgtacaccttcaccgagcgcatgatggcctactgtgaccagatcttccaggacgagacaggcaagaa

SEQ ID NO: 100376 - DNA, 30 bp, Homo sapiens; identical to SEQ ID NO: 32724
  chr9:130689420-130689450
  hyper

SEQ ID NO: 100377 - DNA, 14 bp, Homo sapiens
  chr9:130689630-130689644
  hyper
ggatgaggatcccc

SEQ ID NO: 100378 - DNA, 125 bp, Homo sapiens
  chr9:130828878-130829003
  hypo
gggtgaccgtggctgcggctgcggtggccgagggtccgagggccacagggtggatctctgtggtgctgggcaggctgatgatggtggcctcgcccagcaggttgcagatacgttgttgcatgggg

SEQ ID NO: 100379 - DNA, 30 bp, Homo sapiens; identical to SEQ ID NO: 42224
  chr9:130857460-130857490
  hypo

SEQ ID NO: 100380 - DNA, 30 bp, Homo sapiens
  chr9:130870626-130870656
  hypo
agccggacaaatgagcgacttctgtgcttc

SEQ ID NO: 100381 - DNA, 30 bp, Homo sapiens
  chr9:130908223-130908253
  hypo
gcacccactcttgggcgtggagagtgggga

SEQ ID NO: 100382 - DNA, 30 bp, Homo sapiens
  chr9:130980679-130980709
  hypo
tgtgactgtgggcctcgttccccttaggga

SEQ ID NO: 100383 - DNA, 21 bp, Homo sapiens
  chr9:131060946-131060967
  hypo
ccaccgcgcctggccccttgg

SEQ ID NO: 100384 - DNA, 30 bp, Homo sapiens
  chr9:131083970-131084000
  hypo
cacgctgtttaggagcgggaggcttcctgg

SEQ ID NO: 100385 - DNA, 109 bp, Homo sapiens
  chr9:131095776-131095885
  hypo
gttgatcccatgggccgttcagaacgggcgcagagccccatgtgtcctcaacctgtactatgagcggcgctgggagcagtccctgagggctctgcgggaggagctgggc

SEQ ID NO: 100386 - DNA, 115 bp, Homo sapiens; identical to SEQ ID NO: 32725
  chr9:131127226-131127341
  hyper

SEQ ID NO: 100387 - DNA, 210 bp, Homo sapiens
  chr9:131159439-131159649
  hyper
ggagttaggtgaaggcgggcactgtcccaggcggagggaacagcgtgctctaaagaagtacttggcgagctcagagaaggaaggaaatttggtgtggctggagcgcagtgaggaaggggaagttccacataaagctgaggtcgaccttgccaggctcttaggctattgggaggatttgcgattatatcctaaacgcggtggggatcctga

SEQ ID NO: 100388 - DNA, 167 bp, Homo sapiens
  chr9:131217228-131217395
  hypo
agtatactgtgaaagcgaggcggaaaagcaggttttgtttgcgagtctgactttaggattgcaggtgaaacacttgtgtgaccctggagctgtgtggctaaggtgctgcggggtcactggagaaaggtcaagggactgtggcccagttggcccggaggtggttcagg

SEQ ID NO: 100389 - DNA, 42 bp, Homo sapiens
  chr9:131399249-131399291
  hypo
cacatgcagaccctgcgcttgggctggcgggtagcccagggt

SEQ ID NO: 100390 - DNA, 24 bp, Homo sapiens
  chr9:131417485-131417509
  hypo
aaagttagcctgggccggcgcggt

SEQ ID NO: 100391 - DNA, 278 bp, Homo sapiens; identical to SEQ ID NO: 42228
  chr9:131504870-131505148
  hypo

SEQ ID NO: 100392 - DNA, 105 bp, Homo sapiens; identical to SEQ ID NO: 42229
  chr9:131579999-131580104
  hypo

SEQ ID NO: 100393 - DNA, 30 bp, Homo sapiens
  chr9:131607517-131607547
  hypo
tggcagtctgtgtaccgccaccatctggag

SEQ ID NO: 100394 - DNA, 30 bp, Homo sapiens
  chr9:131607770-131607800
  hypo
gctttcaggccacagcgccatcctgtctgc

SEQ ID NO: 100395 - DNA, 30 bp, Homo sapiens
  chr9:131652716-131652746
  hypo
cacgtgccacctggacgccgtcagagtgcc

SEQ ID NO: 100396 - DNA, 24 bp, Homo sapiens
  chr9:131693810-131693834
  hypo
cttttttttttgagacggagtctc

SEQ ID NO: 100397 - DNA, 17 bp, Homo sapiens
  chr9:131814818-131814835
  hypo
gccgaggcaggaggacc

SEQ ID NO: 100398 - DNA, 35 bp, Homo sapiens
  chr9:131821609-131821644
  hypo
agaagttgcgagaaccgggtcgtggttctctcagt

SEQ ID NO: 100399 - DNA, 162 bp, Homo sapiens
  chr9:131822028-131822190
  hypo
agccactgtcctcttcggacccctgcagtgaatgacaccctggcccctccctgtgcactcaaccctgtgggaccctcagactcctgagggtccagctgcctggctctgccagtggagacacagaaccggagtgggtcggccgagccacgcaccctgccctgg

SEQ ID NO: 100400 - DNA, 69 bp, Homo sapiens
  chr9:131842877-131842946
  hyper
taactgaaagtgggtcggttcaaaccccctggagctgaggttgcctctcctcttcgagcacgcgctatc

SEQ ID NO: 100401 - DNA, 420 bp, Homo sapiens
  chr9:131854046-131854466
  hypo
tgctccagtttgggtgatagagtgagactccctctcaaaaaaataaataaatggcaatatctgcagggaacaggaaactataaggcgagccctggcctcgaatcatagctaaaaaacaaggatccgagaggtagatttaacagcagatgagagagagttaaaaaggaaaagcaaactggagggtgtgtcagaagacatcccggctgcagtgtggagtgggaaagctaccgggagcagcttcaggcgcacccgcccccgctaactcatcgccttcacttcatccacactcacctgcttaccctgaccccgctccaacctgcccaaggtgcggtgctgggcagaagcccaactcttcaagccctcagaagcctctttgaaatatccacttttcgcggctgggcgcggtggctcacgcctgta

SEQ ID NO: 100402 - DNA, 91 bp, Homo sapiens
  chr9:131868867-131868958
  hypo
ccaccagcccccagacgctctaaggacctttcgggggaagcatcttggttctggagtccaaagtcctgacctgacgcgtctcagcaaatgt

SEQ ID NO: 100403 - DNA, 118 bp, Homo sapiens
  chr9:131870288-131870406
  hypo
tggtgtgccttgaagcggctggaagccttcatcaaggagaagggcttcaggaagcccagaggcttcacctgcaggtagcagaacatcctgttcattccctccccggctctggagccct

SEQ ID NO: 100404 - DNA, 387 bp, Homo sapiens
  chr9:131872458-131872845
  hyper
gtctctctcccctaccggcctgtctctgggtctaagggtgggggtgctaactgaagccggggtcccccttgtctttcctgggtcgttggaactgaatgctccaggacgtgggtttaatcccgcttctgaccttgcgccccaatctcctgctctgccaaacctgggacgcccgcctgaccccaccccatcagctggaggccgggtcgaacagcggccgcaggacgcggtctccgttcccggacgcaaccgcacggcccgcccaggccgtccagggccctcaggcccgggatccgccgcactcaccacggtcctggcagcgaaggctaacatcttcgctgcccgtccgcggacacgcagtccgctccgccccacacaccgggcaaagtc

SEQ ID NO: 100405 - DNA, 64 bp, Homo sapiens; identical to SEQ ID NO: 32728
  chr9:131872856-131872920
  hyper

SEQ ID NO: 100406 - DNA, 26 bp, Homo sapiens
  chr9:132000549-132000575
  hypo
atcctctcccatgtgcgccttctctt

SEQ ID NO: 100407 - DNA, 193 bp, Homo sapiens
  chr9:132020917-132021110
  hyper
acaggggaccatgtgcgcggcagcgcgggagcgagacaaaggaccgggggaggcggggaacgaagccgggcggaggggtccgcgtggcccgggcggggatgggccccgcgcttctcctgcgagcagggcaccccctcttcctttttattttgaaggaaagggaaaaaaggaattgctacggaaagagaggtgg

SEQ ID NO: 100408 - DNA, 144 bp, Homo sapiens; identical to SEQ ID NO: 42233
  chr9:132040507-132040651
  hypo

SEQ ID NO: 100409 - DNA, 35 bp, Homo sapiens
  chr9:132114141-132114176
  hyper
tctctctggggccctcggggcgcaggtccctcctc

SEQ ID NO: 100410 - DNA, 30 bp, Homo sapiens
  chr9:132114392-132114422
  hyper
ccatctctccatctgcgtcctcccacttgc

SEQ ID NO: 100411 - DNA, 75 bp, Homo sapiens
  chr9:132197706-132197781
  hypo
gttcaatctggcaaccccgccgtcggagtcagcctcggaactgaaacagctgaactgaaccgctgtgcagagagt

SEQ ID NO: 100412 - DNA, 30 bp, Homo sapiens
  chr9:132200261-132200291
  hyper
gcaggggccaaggaccggggtctctggaca

SEQ ID NO: 100413 - DNA, 42 bp, Homo sapiens
  chr9:132244699-132244741
  hyper
ataactgattggggtcgcgcacgcgcccggtgtccctaggac

SEQ ID NO: 100414 - DNA, 50 bp, Homo sapiens
  chr9:132245295-132245345
  hyper
gggggagcagggaggcggccccagccggtcgccggcgcccccaggcgctg

SEQ ID NO: 100415 - DNA, 18 bp, Homo sapiens
  chr9:132257308-132257326
  hypo
acccggcaacagaacata

SEQ ID NO: 100416 - DNA, 23 bp, Homo sapiens
  chr9:132268469-132268492
  hypo
ttggcctgcgataaaattgcaca

SEQ ID NO: 100417 - DNA, 105 bp, Homo sapiens
  chr9:132331231-132331336
  hyper
gtctgcagccctcagcgccaagcgcggccccgcggccccaccgagggatcgataactaatttcaccgcggcagccgccccagttttttcccgataattgcgcgcc

SEQ ID NO: 100418 - DNA, 456 bp, Homo sapiens
  chr9:132359682-132360138
  hyper
ccgggaaggctggaccggcccgcggcttgccctttcaagtcggcctcccggagtctccggagccgtccgagcgctggggccgctggcgcggacttcaaagcccgccgcccccagccagatccggttgcgggtggggcgggcgagctgggagggaggcgggtttcggtggattcccctttcatcccgcggctgcagccgggcgcagacctcggggaggcccggcgcgtccccgctgggcaagtccctgcagggcagcgaccgggaacggagggctggggacgccacgaggccgcgccgcagggcgggggaggcctgaacccagactgggggcttcggacccgcctgcgctgtgggacctcaggccagcgcctacctgtcgctgggcctcagctttcctgaatgccctactccctgcccaggactcctctggggaggggcattcgggaacattcagtg

SEQ ID NO: 100419 - DNA, 160 bp, Homo sapiens
  chr9:132382195-132382355
  hyper
ctcaaggacgggttgcgagggctctgagatactcagctaacattagcatccttctagcctgggtggtggggtggtgggtgcggggacacaagggaccaccccccaccggaaatgactcgggcccgccccccgggccccgcggggcctcactcagtggctc

SEQ ID NO: 100420 - DNA, 383 bp, Homo sapiens; identical to SEQ ID NO: 32731
  chr9:132382634-132383017
  hyper

SEQ ID NO: 100421 - DNA, 235 bp, Homo sapiens
  chr9:132402075-132402310
  hypo
acacagcagctctggcggctctgctttgtaggcctggtggtaacagccaggttctccaagctggtctccaagtcactggcttcagaaccggccctcccgtctcagctccttgaccctccaggagcccagcagactccaagcccgtcttcggatggggaaaggagacgtgcctggctgtctcaggcccctattaggtcacaaggcagccctgcctgtctgccgactaaccctgccc

SEQ ID NO: 100422 - DNA, 485 bp, Homo sapiens
  chr9:132402755-132403240
  hypo
tgggcgcccacccagcgtcgggccgcgtttaagccacctgcccacccccggggctctcgctgaccttcaaagttgagattggccccatgccgcaagagaacgtcggccgcccgcgtcagccccagctcagccatcttgagcagggcgttgctcacgccttcctggtaaaagggagagtgggctttcctctccagcagctcagtgagaacaaggattcggctctcctcgctggcgacataactgggcctgggacaggagagaggctgagggtaggcacagctgtgggaccgggtgaccgcgcagcctgtgggttggtgggctttagtcctgctatcatcatcagcaagcagggccctggctctgtgggtcacaggggcttgggggaagctctgaagtagagagagggccacgctgcatctcttaatacgggagcagactgggatttgcggagaatgggctgggtctgtctgcgctctcctcccgcg

SEQ ID NO: 100423 - DNA, 19 bp, Homo sapiens
  chr9:132427621-132427640
  hyper
tgggagtggggggctcgtc

SEQ ID NO: 100424 - DNA, 51 bp, Homo sapiens
  chr9:132427641-132427692
  hyper
ccttcgtctctgggccgccccctccacctgcggaggcgattgtaaagggaa

SEQ ID NO: 100425 - DNA, 71 bp, Homo sapiens; identical to SEQ ID NO: 32732
  chr9:132428052-132428123
  hyper

SEQ ID NO: 100426 - DNA, 277 bp, Homo sapiens
  chr9:132428401-132428678
  hyper
gatggtgagtacggccggccagggacgggggtggcggggccggggccggggccggggccggggcgcggggtccggggagccggcgcggggcgggcgaagatgcagggcgcgtggtcggcggcaggacttctgggggcgcgtgtaagtgacggtggacggcggttgaccagcactctgggctgggggagggggaccctcttcgggtcttggggtgcgtccccacggggaagtgcgctgccttcgctccccagtattcggctcccgaacagcctgggaa

SEQ ID NO: 100427 - DNA, 392 bp, Homo sapiens
  chr9:132459541-132459933
  hyper
gagctggaaggaaggcgaggagggagctggctgggctgcaggggagcgctgcgtcccgctccccctcccctaggccgtgccccctcccgcccggccggggcgcgcaccctcggagcagctgggcggcggcggcgcgggcagcgcggggctgggcgcgggatctattaacgtctgtgtgtctgggccgcgggactgcggcgaggcaggcgccaggggctcgtctggaaccagatgtgccgcggcgccgctctggccgccaccagcgcggcgcgctcgcacgcactggctggcgcgcacatggccgggctgggcggcggcggctggcgcgccggccctggcatcccctggatttcggaccgaccccagacccgcgcgtgcggaggggagacccc

SEQ ID NO: 100428 - DNA, 93 bp, Homo sapiens; identical to SEQ ID NO: 42235
  chr9:132491528-132491621
  hypo

SEQ ID NO: 100429 - DNA, 37 bp, Homo sapiens
  chr9:132513020-132513057
  hypo
ctggcgctgctgtcacgacccccgtttacaggtgagg

SEQ ID NO: 100430 - DNA, 30 bp, Homo sapiens
  chr9:132523662-132523692
  hypo
aatgactgcttcatgcgtataaagttttct

SEQ ID NO: 100431 - DNA, 120 bp, Homo sapiens
  chr9:132559293-132559413
  hypo
tgctgggattacaggcgtgagtcacctcgccctgcccattgtgagtttaaatggtcacaaaagacataatttttgcactttaagataacactgtagggccgggcgcggtggctcacacct

SEQ ID NO: 100432 - DNA, 30 bp, Homo sapiens
  chr9:132643791-132643821
  hypo
ccccccacactactgcgtctttgtttctat

SEQ ID NO: 100433 - DNA, 161 bp, Homo sapiens
  chr9:132691954-132692115
  hypo
atttgagcttgttgtcgggccttagggcaaaaacaagaatactcctacgtttatacaccatagataaaagcctgggtgcaatcaataaaagcctagaactgcacactgggatgcctaggggccagatttacctcaaatgtattccgcgggtgctttttaat

SEQ ID NO: 100434 - DNA, 30 bp, Homo sapiens
  chr9:13278312-13278342
  hyper
cggggtcttcccaagcggagcacctcaaaa

SEQ ID NO: 100435 - DNA, 221 bp, Homo sapiens
  chr9:13278735-13278956
  hyper
tgagggacggggcaccggtaccaattagcggctcgcctcggggtccccgcggctaaggcgagaacgcaggaccaggagcattgctgcccactctctaccgcaacccgcacatcccgggaccacgtaacggcggatggggcgtccgggagcggcccctgcaggggagagcaacaggctcccgcgccctggaggcctggtctgcgctccgggcccccaggcta

SEQ ID NO: 100436 - DNA, 103 bp, Homo sapiens
  chr9:13279303-13279406
  hyper
cgagcccagggcgcccgcgcaccttccccgccggcgcgcgcgcagggcgcgggggcgcgcctcggcctctgggccggggctcaagcgccgcttacccggctcg

SEQ ID NO: 100437 - DNA, 116 bp, Homo sapiens; identical to SEQ ID NO: 32380
  chr9:13279633-13279749
  hyper

SEQ ID NO: 100438 - DNA, 30 bp, Homo sapiens
  chr9:132805344-132805374
  hyper
cgacggcggaaagcccggagtccgcgcggc

SEQ ID NO: 100439 - DNA, 48 bp, Homo sapiens
  chr9:132805845-132805893
  hyper
cctggcagccatgcgcgccgagcagagtcagcccgggaggctcttttc

SEQ ID NO: 100440 - DNA, 120 bp, Homo sapiens
  chr9:132815000-132815120
  hypo
ccaccctgccaggcctcatttcgtttttagtacagtattatattcaaatttaaaaccagagattttcaaagatgccacttaactttaaaagataaaaagtactccaaagcaggttgggcg

SEQ ID NO: 100441 - DNA, 100 bp, Homo sapiens
  chr9:132881395-132881495
  hypo
aacaatggagggagtcgtgggaccccaggctgcgacctgctgcctggctgctcactgcatcatgctggtttcaccctgctcagagcgggctccacccctg

SEQ ID NO: 100442 - DNA, 30 bp, Homo sapiens
  chr9:133267430-133267460
  hypo
gagctggctcaaggacggcctgcccctccc

SEQ ID NO: 100443 - DNA, 30 bp, Homo sapiens
  chr9:133270785-133270815
  hypo
cagacctgacctggccggatccaagatcca

SEQ ID NO: 100444 - DNA, 216 bp, Homo sapiens
  chr9:133308836-133309052
  hyper
cgtggcccgcctcaccgccttctccgaggtcggcgtccccgccaaccgcaccgagctcagcatgctggagcccgacccccgcagccccttcgcgctgcgtccgctgcgcgcgggccttggcgcggtctacacccgtcgcgcgctcacccgcgccggcctctaccggctcaccgtgcgtgctgcggcaccgcgccaccaaagcgtcttcgtcttgct

SEQ ID NO: 100445 - DNA, 36 bp, Homo sapiens
  chr9:133319966-133320002
  hyper
aagtctctcgaaggacggctgcggccaccctccgcc

SEQ ID NO: 100446 - DNA, 367 bp, Homo sapiens
  chr9:133320407-133320774
  hyper
tgcccactccctagccgagagcacccgcttcccgggcccagaggaggaggcgtagaagacgcccgccccggggcccgcggaggcagagggcggaccccgatcgccactcgccggggactgggaccgaggcaggagggaaggggctcccgatgctcaaacgcctggcaccggattccaggtttctggagcgtgggggacgcggcgggggcgcgagtccccgggggcgcgagtccccgggtccgaagagcggctcgggttatttgttccctgcgcagccgggtcctttctggactccttgtcggatccggcttcctctgtgtcgtgaagcccccacatggagacctggggagtccggagcgtgtggggg

SEQ ID NO: 100447 - DNA, 30 bp, Homo sapiens
  chr9:133366620-133366650
  hypo
agcccggcgggattgcgaccccgaaaggag

SEQ ID NO: 100448 - DNA, 23 bp, Homo sapiens
  chr9:133409075-133409098
  hypo
ttttttttttttagacggagtct

SEQ ID NO: 100449 - DNA, 86 bp, Homo sapiens
  chr9:133506386-133506472
  hypo
aggactcaccaaggccgcagcagccgaggccccagagccgttcccctgcgggcttagatgagcggctggggcggcagcctcccccc

SEQ ID NO: 100450 - DNA, 30 bp, Homo sapiens; identical to SEQ ID NO: 42237
  chr9:133510031-133510061
  hypo

SEQ ID NO: 100451 - DNA, 161 bp, Homo sapiens
  chr9:133518349-133518510
  hypo
ttactcacacaggcacggaggggccagttccatggcaagttcgtgctccactctgctggggtttcagtggagagctacactcttgctgaggcctcctcaaaccttagcctggctgcgataccggcctgccttgccacacccacacacgagcagagccaggc

SEQ ID NO: 100452 - DNA, 981 bp, Homo sapiens
  chr9:133534580-133535561
  hyper
cgagtctttgtacccctgcgtctccgactcggcctttcatctgctccctccacctcggcatcgccttgcctcagtctcccccgacccctgtctcgccccctctgcttccagaagcctgcgcctctgtctctcccaccgcccggtctcctggtgtccccggcgtctctcccgtcgttcccgccgccttgatcagcctgggctgtggcgctggcatcgctggcctggggaccggggtgtgggcgatggaagggggttcgagaggcgcaggggaggggcttcccctcctccgcccctgggcgcctggggagactcgcgtgccagtcacctgccggtcggggcgccgacttcgcgcctacgcactccacgtgggcgccccggggcgcgcctttgtctctcccgagccttgaaagctaattacattgggaggggacaggggtggggtgggagagggggccgctgtccccattcactgagccgaggccgccactccgccggcagccccgcgcaggcctggccccgagtcacgtctgttgaaaccgtttttttcggcctcgcccccacccgccttggcagccagccgcgcctttgtacgcgccggcgggggcgccctggaaccctgaaccgtcttacggggaacgggggtggggggaggggagcggcgcgggccccacgcgaggaaggaatttcctgggccactgcgaaagattgaggctcagaaagccagagagagacgtgcgaggaggaagcggagagggtgtgcgaagctggagagggagtcggagcgccagcgaaagaggggagcgctggggaaggaggaagagaaggagagggggagaagagagacgcggatgctgggcgcgcgacggcagcgggcggaggaggggagcggccgggaacctgcgcgcaggggaagccaggacggagcgcagcaccggcaggggagggttgccgaggggctgtgccgaggagcccgggtggggg

SEQ ID NO: 100453 - DNA, 228 bp, Homo sapiens
  chr9:133535706-133535934
  hyper
cgggctcattccggccgatcgatacctgcgcgggacctgcccccgccgctaatatctttttaatgagttcgccaggcttaaagcgagcgcgatctgccctccagggtggattttcccccggcagatgtttcgggaggaggaggcgcgcggagctcccgggaggggggacaaatctctccctccgaggggcgagaacaggagactttcttctaaagttcaaaagaaaga

SEQ ID NO: 100454 - DNA, 149 bp, Homo sapiens; identical to SEQ ID NO: 3472
  chr9:133535971-133536120
  hyper

SEQ ID NO: 100455 - DNA, 196 bp, Homo sapiens; identical to SEQ ID NO: 3473
  chr9:133536149-133536345
  hyper

SEQ ID NO: 100456 - DNA, 2874 bp, Homo sapiens
  chr9:133536346-133539220
  hyper
gcgctccgccctgagcggggcaacaactagaaattagccaaccccgggcggctgccgggccctgagactgtcttgcccgccccggcccagccacccctccgggtcgcccctgctcttctcctccacttccccttcaatgtccctccgtggggccgtcggcctgccgcggcggccctctctccactcccgtgggctcaggggaagagggcacccgggcggcgaggatgacctccgaagagccgcggcaaattgattcgttccgcccggagccggggccgcgtgaatgggggcccgggcggcggcggcagcggagaagaggataaagatgttctccctgaaagggggagggggcgcggagcgggaagcggggccattcactcctggcccggcccctcgggaagccgcgccgaagaaagggggccgaggcctattcaagtcctacgagccgcccacaatggaccgatatactgagggcctctctattaacgcccatgaatattaaagagatcgccaagtggcggccagcgggcgaggggggcgacggagcctgagagctccggcccggccgaggggagggggcttttgcgcgagcacattccgcgcctgggccccgcggaaaatgacaaaataacacgggtcatccgctgggaaagcccggaatgtttcccctcgaaatctcctcccggggagatgtgagcacagggtcttgctccctatttcaatgcaccttgagactgggcgctacctacgggctcctttttccccgggcgggggtccaggtgggttttgccgctagactagaagcacaaaatgtgagcgcggtggagatttgggcgcaccagctgggaggacgttctgcgctccgcttctgcccggctcccagtactgctctccgggcttgcgggtccggaggagaggaatgggactccctggccgcagtccgagcccgtggtcactgcgccagcggaatccaagcctctaactctaagccggggttcaggacccaaacgctgcaccccagcacggaggatgcacagacctgagggcttcccgcagtgggacgtggccctggagagggcaaaatcctcggggttgtcgtggggtaaagtgatcttacccaaagagagaccaagcaaagaaacctcagttcacaaagtccaactcaaaccattgcacagacagggacaccgaggcccagagaggaaaggggcagtccacaggacacacagcagtccttatccccctttggtgtcctggaggaactgaggtcgctttcggggcttgggagctgccgcagcgcttggctcctggcagcgctccccgacgtcgtctccctcgctcctagcactttgtcctctccacctaggtcttcccagaagccaagaagtaggccccggtgaggctcccctgcaggagccatcggactccatacgccccctcagactcgagctctggccagggagccgatgcgacccacaagctgcgtcgaaaaatgagtggagggttcggcgaccctaacccacctccctcctcagcagcgctgccctctgctggcgccctgcccaacggtcctgccttctgccaggtgtgcccttccttgggctccagcctcgggcggacccggacgcagggtctgaaggccagctaccgccgccttcctccctttgcgtcccaacggggacgggggatgccggagactactggcaggaactggggaccaggggtctggagtctggacgccaggtgtgagaccctcttagccaaggcgcgtccgggtggtggaggggcgtctatgccaacaggcgtttggacagggtctcgctcatgggaggtcagctcgctgttcttccacccaagtcctccgcgctgaggagaaggtctagggagtccacacagtccagcggagactaatccgtgagcctgacccacgccgagagggtccaggcacctctgttagcggcatctgaaattgtaggctggtgatgggagccagaagtgcggcaggtggggtgagctccctcacccagcatgtcagggcctggggtccgaggcttgaggctgacactggggagccgcgaagcctgcaggaagcggggccttccgctgggctcagcagctacctgcttcgggagaggggatcgctgggctccgaggtgcctcgaaaccgccgcaaagcaagtctgctcctgggatgatgggcaggaggaatagaggagaggaagggaaagaagagagaggcagaggagaaagaaagaactaggaggcaagaaggaaggggcgccgcaacgccaccggcttcccgaggttgcagctcagcaaggagccggaaagccgggccgcaagccgaacccgcactgaggcctctcgcggagctgcctgcagtttctgagggacttcgctctcaggcacgcctgctcccacctaggaagggtctcgggacccctttcaatccccctatatcccgtaggaaattcttttcccagagacaggctgccagggcgattcctgtccgcccatctcgacccccgacctggccccgcaagggccgggagcctggccttccatgaagctgtctcaggccgggaccagccccagccccgacggccgctgcggccccgcctcggcagccccgtgagcccgcggaggagtttcgcacccgaccgtgcacagcgaccgagttggcgcggcccgtatgaagcgaagcgccggcttcagcagcgcagtctgagcaggggatccgcgtggcaactagggctgcgcgcgagctcggggcgactgtggcggcccggggagtgcagggccggagagggaagaggacgcgggctctggccggggagggagagcggtgcagggctgggccggccagccggggca

SEQ ID NO: 100457 - DNA, 722 bp, Homo sapiens
  chr9:133539510-133540232
  hyper
cgcccccgcccctcgcgctctcgcgacgaaggctcctcgagcccagccgggtacaacaagtctgtcctccgacgtcagggggtcattaataaccaattaggagggtcactgcggctcctataaaggcgctgagattttgccaaggggaagacggccccggccgagtgtgcgagaggctagcgcgcgcctgagccccttgctgccgcttccctgcaaccacccgcctctcacccaccctgcaccccccgcacccgcctccgcctccacccgcgtctctccaccctccgcgccgcctttgccatctctacagatttcaccatctctcttcccctctccccctcgttcgctttcctcccagtcgccccctcacctcccgctccctcctgcgtcctcctcctctccgtcctccccctgctctggttccttctccatcgcagcgctctcctctcgccccttgggctcccctctcgcccgcccacctcccccgtcggcccggccgtcccccggcgccggggagctccgggccgcccatgatgggctccgtgctcccggctgaggccctggtgctcaagaccgggctgaaggcgccgggactggcgctggccgaggttatcacctccgacatcctgcacagcttcctgtacggccgctggcgcaacgtgctcggggagcagctcttcgaggacaagagccaccacgccagccccaagacagccttcacc

SEQ ID NO: 100458 - DNA, 43 bp, Homo sapiens
  chr9:133540453-133540496
  hyper
gcagcccacccggctcaaggaccgaccccggcgaccccgtcgc

SEQ ID NO: 100459 - DNA, 1363 bp, Homo sapiens
  chr9:133541059-133542422
  hyper
attagcaatttctttcgaatggagccgaatgaatgcgatcactttaacagcgtgacaaattgcccgccgcgccgcaatggacaccgtttaacccccccctttcagccggcccgctcgccgggtattttcccaggtagcttagaggggaaccttgtaagacatggaggccgcccttgtgcgcctcgccgcttccagccctgccgcagatgcccgacaggggaaccctcggggagctgggggccgccgcggctcctccccgcccagagagatgacatcggggtttgtctgagcccgggcgccgccctccctggcaccccagggcctgggagcagagagggactcgggcgcgcccggggtcacacagcgagcgcagagcctggccagctgctgccggtgcttctttggcacctccaacacctgccagcccgaggtctgtccccagcgctgatcacggcccggctcctctgccagtgcccagagcctggacacacagtgggctcccggaagccgactaggcgaaagagtctccggttggccttcacctccttgcaggacctggcctcagtttccctgtgcataaaaccgctcgctgccgttggctcattaattcttaaacttatccggggcagaggatggaagaagttgcgaatgctttgagaattcgcggagagactaaaaacccacttctaaaaatgatccccaacgcaccactcgctttccagggcacggagggtctccaggttgcaaacagaggagaggtcgttgagcctccgcacatccgacttcctccacacccgggtggcttctctggatttggggccgacttgggtttggctggtctgggcaggaccgaagccggggtcccggcggggaaggaagggccgggcctcggctgcctcgggctctgaccggttttcctggccccgccgccgcagaagtgcagaagctgtccagcctggtgctgcctgcggaggtgatcatcgctcagagctccatccctggcgagggcctcggcatcttctccaagacgtggatcaaggcgggaaccgagatgggccccttcaccggccgcgtgatcgccccggagcacgtggacatctgcaagaacaacaacctcatgtgggaggtacgcgcgggctggggcagaggggcgcaagggccggcgaggggcgctggtcgcgggtaggactcgggcgtccggccgtcgccgcttccacccgggctgagagcggcggacactcctggcctggacgccccctgagccgggactctaagccgcccgagcctggagctcaccccgcctctaggctcctcccaacccgtgccgaaaatccgaccctccttcccccggacaccctggcag

SEQ ID NO: 100460 - DNA, 90 bp, Homo sapiens
  chr9:133550849-133550939
  hypo
accctgggcttccaccgaaccagcggcctctgcagctctgctggctcagtgagcactcctgcagggacctggatgcgccagaaaccgctg

SEQ ID NO: 100461 - DNA, 16 bp, Homo sapiens
  chr9:133585587-133585603
  hypo
gcgactgagcgagact

SEQ ID NO: 100462 - DNA, 24 bp, Homo sapiens
  chr9:133604058-133604082
  hypo
gagccactgcgcccagcctgtttt

SEQ ID NO: 100463 - DNA, 69 bp, Homo sapiens
  chr9:133767809-133767878
  hypo
tgctttgcctggccccgggcctgcagccactcccggctgagcgtgggctctccccggggcagagaagtt

SEQ ID NO: 100464 - DNA, 30 bp, Homo sapiens
  chr9:133772234-133772264
  hypo
gcacacgtgcgtacacgtgtgtgtgctcgt

SEQ ID NO: 100465 - DNA, 30 bp, Homo sapiens
  chr9:133772670-133772700
  hypo
tgcacccctgtgccccgcaggcacccctgt

SEQ ID NO: 100466 - DNA, 367 bp, Homo sapiens
  chr9:133773692-133774059
  hypo
catgacagcagtgcccgtgtggtggggtggggttgtcggggtggcatggtgcccgcttaggcagtgttcactgctgctgctagggagggcgcagggtggtggcccccatctaagcccgggtcccctgggctgttggcaactgccgctccggttctgctggccgaacccctcctgccctgggaagccgcttcccatgctgttgggcaccatttctcgcggaattgcatgagcccttgtctgaggacctctgtgactgagtccttgaacctttccaggagctgcctcaggctggtctggtggttgcgggaaaagggttgagttgggcacacctgcacctggcatgggtgtggcacgtggggaggcaggt

SEQ ID NO: 100467 - DNA, 38 bp, Homo sapiens
  chr9:133777251-133777289
  hypo
acctgcacctgcccccggcccctcgccaggccccagcc

SEQ ID NO: 100468 - DNA, 611 bp, Homo sapiens
  chr9:133779336-133779947
  hypo
actggagagtgggtccgccaggcacaggtgggtggagaacattcacgaaagagtgaggtggggtcggggatggggcgacagggaccagcagggccaaggacaaggtgcaccagtctagcggtcctcccggaccggccggatcttcatctcagagaacttgagtgagtactgccagccggtccaggaggaccactccacgccgtcggcataggaggcgtgcgcaccgcgcaggtactgcccattgaggttggacgtgtggcagttgcggtaccaccaggcaccgcggtagaaggcggcacagttgttctctgaatggtcgctgtcacggtccttggtggtgaacctcatgccgctgtgcttcaggagggagtcgcctgcgcaggggtgcacacaggtgtgggcacggggggcacgggtacacccactggtgttgcatgtgtgagcagacaccgagacactgcacgtgcacctggacgtgagtgcatacacgtacgcacgtgctctcacacatactgctgtgcacgcgtgcaagcgcacctgcccctccacacccgggtgtgtccatgcagctcacacgcacgcagtcccttctcgggcgtgcctggggctgc

SEQ ID NO: 100469 - DNA, 44 bp, Homo sapiens
  chr9:133782143-133782187
  hypo
gcaagggcccagcaccgttctcagcccttcgtgcagatgagtga

SEQ ID NO: 100470 - DNA, 72 bp, Homo sapiens
  chr9:133787196-133787268
  hypo
tgagcctgccaaagccgtctcggtacgcatcccagccccggaagaagttcacggagccgtcctcccggcgct

SEQ ID NO: 100471 - DNA, 48 bp, Homo sapiens
  chr9:133788368-133788416
  hypo
aaaccggagtccaggcgatggctcaggggaggacgaggagcccacagt

SEQ ID NO: 100472 - DNA, 30 bp, Homo sapiens
  chr9:133794635-133794665
  hypo
gttgtccccggtcaccggtcacctcgccat

SEQ ID NO: 100473 - DNA, 81 bp, Homo sapiens
  chr9:133799115-133799196
  hypo
gcctgggacactcaccgtccagccgccgccgtccgtgcgcatgtcacagtacacctggaagccggccgggtagtgggtggg

SEQ ID NO: 100474 - DNA, 30 bp, Homo sapiens
  chr9:133808587-133808617
  hyper
agatgaagtactgttcgcttttatgggctg

SEQ ID NO: 100475 - DNA, 34 bp, Homo sapiens
  chr9:133814201-133814235
  hyper
aagccgccagcccaacgcccgccgctcgcgctgc

SEQ ID NO: 100476 - DNA, 70 bp, Homo sapiens
  chr9:133814841-133814911
  hyper
ccctgcgccggaccccgacgcgtgagcctggccggtgggcgtcccagtccgcgtccgcagacccgtgccc

SEQ ID NO: 100477 - DNA, 70 bp, Homo sapiens
  chr9:133815217-133815287
  hyper
aaagtccttaatctgcgcggcgaacgagctgctattgtggcttctgaccgggaggcgcccacactgcccg

SEQ ID NO: 100478 - DNA, 30 bp, Homo sapiens
  chr9:133819170-133819200
  hypo
aagcctggtcggggtcgggggggagtccaa

SEQ ID NO: 100479 - DNA, 33 bp, Homo sapiens
  chr9:133857774-133857807
  hypo
gagagtgtgtggggccgggcacggtggctcatg

SEQ ID NO: 100480 - DNA, 64 bp, Homo sapiens; identical to SEQ ID NO: 42243
  chr9:133864850-133864914
  hypo

SEQ ID NO: 100481 - DNA, 189 bp, Homo sapiens; identical to SEQ ID NO: 42244
  chr9:133865355-133865544
  hypo

SEQ ID NO: 100482 - DNA, 577 bp, Homo sapiens
  chr9:133884368-133884945
  hyper
tctggggcagactcccgagccgcgcactgccgggcacgtccagcaggtgggagtgggcgcccggggacggcgcggtccctggtatttttagtggggtggggccgccgccgcccgcccctccctccagcctccccgccccgcaggggaaggcgggtcctggcggccagcgcgcggtccgcgcccaccctagccgagcggggccggcagagcgcgcggcgtcggtgcccttgaccatggcggcggctgcgcttctgctggggctggcgctgctggcaccgcgggcggccggcgcgggcatgggcgcgtgctatgacggcgcagggcgcccgcagcgctgcctgccggtgttcgagaacgcggcgtttgggcggctcgcccaggcctcgcacacgtgcggcagcccgcccgaggacttctgtccccacgtgggcgccgcgggcgcgggggctcattgccagcgctgcgacgccgccgacccccagcgccaccacaacgcctcctacctcaccgacttccacagccaggacgagagcacctggtggcagagcccgtccatggccttcggcgtgcagtaccc

SEQ ID NO: 100483 - DNA, 90 bp, Homo sapiens
  chr9:133901867-133901957
  hypo
cacctctgagttcagcgacatctccccgctgagtggcggcaacgtggccttctccaccctggagggccggcccagcgcctacaacttcga

SEQ ID NO: 100484 - DNA, 65 bp, Homo sapiens
  chr9:133911658-133911723
  hypo
cccttcttccaggaccgcccgtgggcccggggcaccgccgaggctgcccacgagtgtctgcgtga

SEQ ID NO: 100485 - DNA, 134 bp, Homo sapiens
  chr9:133927347-133927481
  hypo
ctagtgccttctttccgagttcagggcaagttctgattggaagggaaagcatggcccggggcccagagcacctctgctcactcagccagctcacttaccttgctgtcacctggaggtcccgctaaactcctgct

SEQ ID NO: 100486 - DNA, 66 bp, Homo sapiens
  chr9:133928206-133928272
  hypo
ggatctcactttgaccgcttctctcgccagcctgcaggagacctccgaggacgtggcccctccact

SEQ ID NO: 100487 - DNA, 241 bp, Homo sapiens
  chr9:133936538-133936779
  hypo
gccagtcggcctgtacgaccatcccagagagccgggaggtggtgtgtacccactgccccccgggccagagaggtaagtgactcctgccccggagccctgccccgcagagggccaagccccggcactgtgactatgccctgggctccagggttagggccctgggtttagggtgtggcaggtgagggagagcccagcttacgggcagcaggcatgacctctgaggacacggaatccctcagcc

SEQ ID NO: 100488 - DNA, 30 bp, Homo sapiens
  chr9:133948389-133948419
  hypo
gatgtttgcaaagggcgaggcatgttccga

SEQ ID NO: 100489 - DNA, 30 bp, Homo sapiens
  chr9:133971630-133971660
  hyper
ggacttgctgaggtccggggaggggcagag

SEQ ID NO: 100490 - DNA, 190 bp, Homo sapiens
  chr9:133971948-133972138
  hyper
cctgtgcctcctcctcgtccctcgccgcgtccgcgaagcctggagccggcgggagccccgcgctcgccatgtcgggcgagctcagcaacaggttccaaggtaggcgccgccgtccccgagcagccacctgtgcgcgccgggcggaccgcggggtccaccgcgcgcgggaagcgggcggggacgggggcgc

SEQ ID NO: 100491 - DNA, 31 bp, Homo sapiens; identical to SEQ ID NO: 42247
  chr9:134119973-134120004
  hypo

SEQ ID NO: 100492 - DNA, 28 bp, Homo sapiens
  chr9:134120951-134120979
  hypo
gggagagacccaccgatcctgtggggct

SEQ ID NO: 100493 - DNA, 30 bp, Homo sapiens
  chr9:134131898-134131928
  hyper
aacccacagaagacccgaattctgatgccc

SEQ ID NO: 100494 - DNA, 126 bp, Homo sapiens; identical to SEQ ID NO: 42248
  chr9:134135879-134136005
  hypo

SEQ ID NO: 100495 - DNA, 94 bp, Homo sapiens
  chr9:134136231-134136325
  hypo
ccaccagcggctgcccgtacttgggccgccacatgaggacctgggcatcgttggcattgggcttgaccagggcgctgggcgggatgggctcatt

SEQ ID NO: 100496 - DNA, 753 bp, Homo sapiens
  chr9:134151929-134152682
  hyper
ggaaggctctgtccccgcgcggccgcgccaccctcgcggcagaagcctgacttcctgccctccggccttccgcacgcgctccctccgggccccgcacccgcacccgcccggcgcggtcgaatcaattgcagagcagtttgtgttcacccggccgaggtcccggcgccctcggggcgagcgccgacccgcggcttccaggaggcgagctcagggctccggccgctcgccggtgacgggggagcgcggcgcgggtccccgtcggcgcccactcgcgggcgcgggccggacgtccccacgcaggggcgccgcgtcccttcgccgctgtcgctgccggccgccgtgcagggtcccggggctgcgctccggccgccgccgcctgcttcgccgcggccgccgaggacctggtgggaggtggaagggacagcgcgtcaaggccagcctcaaagttaagccgaactttgctgcggggggcgcgcgggggcggcgacgcgtgtgcgctgggcgcgggctgcggagctgacggcgcagctctgggcggtctccccggaggcggtggcccccgccccccgcgcccgccccgtcagtggcggccgcacgaccgcgcgcaccagcgaataatagccgcccgtgacatctccgctgataccgtcccggacgggcggggtggggggcgagcggctgccgctgcagggggcggcgagcacttgccctgctctgtccccaccgccgcgccgccagcgccaggtgcccctt

SEQ ID NO: 100497 - DNA, 225 bp, Homo sapiens; identical to SEQ ID NO: 32753
  chr9:134158243-134158468
  hyper

SEQ ID NO: 100498 - DNA, 142 bp, Homo sapiens
  chr9:134171926-134172068
  hypo
cacggtgcccagcctacacattcttgtagtaagaaaaaatgcaatgattacaaggctagatcaagaagaaagtgagcctctcccttaaaccctctcccaggaagagcctctgccgcagcttgggtcacgtgcccctggattt

SEQ ID NO: 100499 - DNA, 25 bp, Homo sapiens
  chr9:134176645-134176670
  hypo
gcgctggcctcgaaaggcagatttt

SEQ ID NO: 100500 - DNA, 739 bp, Homo sapiens
  chr9:134191006-134191745
  hypo
gtgtggaggaatctccgttcctgcccctgtgagcctggcttttctgggaagctctcataagagtgtccaaggtataagcacctctcaggggtggcgagggtgttgcgttgcctccttctacagacgcaaatgccacctaatcacacagctccctctgcaaacccgctcccatctccatagcaactacagggcttcggcgctcttgggctcctggtcactgtggttcaactcctaagagagggagggaccccgggtttgtccccatccagctccaggaaagagacgttggctcgaggaatccgtctcaaggtcaaagagggcgaggtgagggcagggcggggacaggcaggctgcaaacagatccgctctctgctgctctggtcaggaggattctgggaagagaggacggagggacagagatgcagctctgggtgggagggccacagagctcagcgtccactcatcctgtgtgcggctcccacccgccccatccaaaaagtctcagggaggcagcggcacaagggctggctctgggcagtttcctcatctgtaagatgcgtcgatgctctgcgccagcgtatggagaggcagccgctgcagtctgtgccccccacagtctgtacattgaaatcccaaccaaaacacgagggtatgaagaggtgggcgtttggggtcattaggtcatgagggtgggcccacacgacgggattagtgcccttacaaaaaaggctccggatgc

SEQ ID NO: 100501 - DNA, 81 bp, Homo sapiens
  chr9:134207916-134207997
  hypo
gtggctttgacttaccgtgtaagactccatttcctcatctgtaaaatgaggagaaccggccagccgggcgcagtgactcac

SEQ ID NO: 100502 - DNA, 35 bp, Homo sapiens
  chr9:134421523-134421558
  hyper
ggcagctcagctcaccgccccggccaggctgaagt

SEQ ID NO: 100503 - DNA, 61 bp, Homo sapiens
  chr9:134421906-134421967
  hyper
cccctcatcccccagcgcgactgatcttgagagcccggggatggggcgcaccagtcccatc

SEQ ID NO: 100504 - DNA, 33 bp, Homo sapiens
  chr9:134648075-134648108
  hypo
agccatgtcaggagccgccgccgacatgcgggc

SEQ ID NO: 100505 - DNA, 122 bp, Homo sapiens
  chr9:134717223-134717345
  hypo
caacagccccagagccgggtgagcccgagtaatggacatacattgagggaagagaaaaagccgagaaaaaagcggtttgaacggggggtgatgtcaccggttacacgcgtggtttctgatgg

SEQ ID NO: 100506 - DNA, 30 bp, Homo sapiens
  chr9:134717710-134717740
  hypo
gcaggagggtggggacgggctctgggccac

SEQ ID NO: 100507 - DNA, 30 bp, Homo sapiens
  chr9:134718796-134718826
  hypo
gtttaaagctgagtccgtgaacctcacata

SEQ ID NO: 100508 - DNA, 29 bp, Homo sapiens
  chr9:134723620-134723649
  hypo
gtgggtggctctgacgctaagactggcct

SEQ ID NO: 100509 - DNA, 30 bp, Homo sapiens; identical to SEQ ID NO: 42254
  chr9:134724244-134724274
  hypo

SEQ ID NO: 100510 - DNA, 416 bp, Homo sapiens
  chr9:134818649-134819065
  hypo
aacagacccaaccttcgaaacacaaatcaaccactagtgacttgacagaaataaggaaagcttggaagctcaaattaaaaatctagagacaaaaatgacactctttcttgttgagggagggggtgttggtatgggaggtggtctctggcagtactctctgagtgctgcctcccgagacggtgagcacggctagcgtctgcagcgggctctgcagtgcggcgccccactttgagagcagggctaaggacaggtaggaacagtgtgctcccctcctacacttccaccatatgttacactctgttctgtggcagaatcaaattactttaatttttacctttggaatataggcaaacaagcagtaacacagcagtggtgactagtttacacttgagcagacgcggcgcggaaagacatta

SEQ ID NO: 100511 - DNA, 341 bp, Homo sapiens
  chr9:134913048-134913389
  hypo
gcaatgacagaaaaccggagctaccctgctggtgatgggaaatgacaatggcattgcaaagaggctctggaaacatcaccaaatgaaagtgggcaaaacagtcaggctttcaccgggcagctgtagactgggaaaagtgctgtgtttctgacacatgagctttggctgacacacaacatgtcccgaccccagacaggagctgcacctagatctctagatctagcaatgcaggatatgtcatctgcctccccaacaccagctgaattctgcctgccccacgaatctcacatcctagggtgcgtgagggtggatttgtgatgcattgacgcaaccaatatgca

SEQ ID NO: 100512 - DNA, 30 bp, Homo sapiens
  chr9:134915848-134915878
  hypo
gaaggcatcacctgacgagagactgcccgt

SEQ ID NO: 100513 - DNA, 30 bp, Homo sapiens
  chr9:135012697-135012727
  hypo
cctttcccgtgacaccggggctgcagttcc

SEQ ID NO: 100514 - DNA, 30 bp, Homo sapiens; identical to SEQ ID NO: 42257
  chr9:135027845-135027875
  hypo

SEQ ID NO: 100515 - DNA, 708 bp, Homo sapiens
  chr9:135036580-135037288
  hyper
tccacccacccaccccggtacccactgcttggggccttctgggtggcagcacttcacagagagagaccgaggagcagccctgagcccttggctgtggggggtgggggaactgactcacttggcccccctccctcgtgccgatggggcagcccccacacccatgggcgctggcaccccggcaggcccccgggttttggaagaggaagctgcagcccggctgcgcctgaccggagccggctgaggatgcgctctgggcgcagggacccgctggcccccgggccgggaggcgatgtttaggcagcgaccccccagaggctgccggggccaccctggccacgggcccgccgggacgcccctgctcgccgcgcccctccccgggccgtggcgcgtcccccgagccgcgcaatatttccttcctgcacctttaagaagaccgttgctccgtggtgggatggtgtgttaaagccacacagaggaagttacgcagcccggatcagaccgagagataaaagccccgatggtgatcgtgagtgatggcaagaggatttagcctcggcattaacttggagcggagtgcaggggggcagtgaagcgcccgccatctggcccgcgccgcgccggggggatgccccggctccccgacgagacgccgcgaagcccacccgggccgggggctgcccggcgcccgagcgcgggtcctccccgggc

SEQ ID NO: 100516 - DNA, 107 bp, Homo sapiens
  chr9:135037333-135037440
  hyper
cgctcagcccgggcgggcgatgcgggcggcgcgggcggccccctcccccggcccgcgtctccgggacggctgcgggcggcccccccggcggccggagggctccctgg

SEQ ID NO: 100517 - DNA, 26 bp, Homo sapiens
  chr9:135038238-135038264
  hyper
gcactggtttggggccggcgtggagt

SEQ ID NO: 100518 - DNA, 111 bp, Homo sapiens; identical to SEQ ID NO: 32758
  chr9:135038352-135038463
  hyper

SEQ ID NO: 100519 - DNA, 30 bp, Homo sapiens; identical to SEQ ID NO: 42258
  chr9:135054774-135054804
  hypo

SEQ ID NO: 100520 - DNA, 17 bp, Homo sapiens
  chr9:135067234-135067251
  hypo
ggcgtgagccaccgcgc

SEQ ID NO: 100521 - DNA, 114 bp, Homo sapiens
  chr9:135091410-135091524
  hypo
agggttacaggacaccgactgattccccaaggctggtcaccttcctgcctttgcctagcttgaggggtcagaggtttgaacccgactgtctggccaccgcgctacctggtgctg

SEQ ID NO: 100522 - DNA, 175 bp, Homo sapiens
  chr9:135102332-135102507
  hypo
tgcaagaagaatttccgcacccggtcctggcgggccggctcctacctgccgctgccccatggctctcccaacgcctgtacgtgccatgccccggggccacgagcccacatggctataatcttccctgcccgtcaatcccaggagctgtggatcatacacacgcacacaaacctgc

SEQ ID NO: 100523 - DNA, 165 bp, Homo sapiens
  chr9:135116306-135116471
  hyper
caaccagataggctccgtgcacgaccggtgcaacgagaccggcttctgcgagtgccgcgagggcgcggcgggccccaagtgcgacgactgcctccccacgcactactggcgccagggctgctaccgtgagtgcgcgccgtcccccgtgggcggggcctgcggaaa

SEQ ID NO: 100524 - DNA, 40 bp, Homo sapiens
  chr9:135118020-135118060
  hyper
gaggcccggtgaccacggaactcaccgtctgggggaggag

SEQ ID NO: 100525 - DNA, 30 bp, Homo sapiens
  chr9:135121068-135121098
  hypo
gggctgccctgtgcacgtgggatgtgcagc

SEQ ID NO: 100526 - DNA, 92 bp, Homo sapiens
  chr9:135129056-135129148
  hypo
cctccagtgtggcagcggattcaggcaggctcatagacagatgctcaaggcactggtgaaggacctgtgggccacagcgcactcccacggcc

SEQ ID NO: 100527 - DNA, 23 bp, Homo sapiens
  chr9:135135287-135135310
  hypo
caaaactccgtctcaaaaaaaca

SEQ ID NO: 100528 - DNA, 38 bp, Homo sapiens
  chr9:135230930-135230968
  hypo
gcagagtaaatccctcgctggtgcggtggctcccgctt

SEQ ID NO: 100529 - DNA, 30 bp, Homo sapiens
  chr9:135239643-135239673
  hypo
tgtgtgtgtacaaaacgctcttcttgattc

SEQ ID NO: 100530 - DNA, 533 bp, Homo sapiens
  chr9:135285332-135285865
  hyper
ccgtcgccaaggagacgggccgttgcattcgtcctccaggggtggtcttggttttctttcctctcccagtctgcaacgcggggcccaggagacgccctgaggatcccgcggggctcctgcattgctccggggctctttgcgatgaggggccggcgcgagcggggcgcgcctggctccggaggggtcctggcatctgagtttccccctcaggatcccggtggtgcggcccgggccgcccggcaggcccttcggagctccaggctgtgcccgacgtggggaagcgcgcccaaaccagcccgcgggccggctccccggcgacctcaaggatgccagaggccaggagctccggcccggacctcacgcgatggaggaagcagcagcagcctgtgcgccgcacggtcagccaggtctgcccgcccccgcggcggcccctgaccgtggcggacatccgttccggcatggagaacgagcggctgggggtcgtgcgggactccatgtttcagaaccctctcatcgtcaaggtgagcacccca

SEQ ID NO: 100531 - DNA, 444 bp, Homo sapiens
  chr9:135285880-135286324
  hyper
cgctgtcgccggctccgggcacctgcgccgccgggggtccccacccgcagcgccctggccccgcggcccggggtccgagcgcagcgtgggaagctccagctctggtccagacaggcctggacccccatgcaggtcgcgtcgcctctctcagcctcggtttccccatcctcacagtgggatgataatggcaccactaaagggactgattgggaagattgaatagggtaatttctgcgggacctcgggacagcgcctgacatggggtaaggctgcaatgggtgctgctgtggtttcccacagagtgaacccacagggtgacagataggtcgcacacgcccagtctaagtcgtggctgccagccctcccagggtaaaggccgcctctccggttccgctgcacgcctggggtacgtctatgcagcggtggctccgtgtctgtcctgga

SEQ ID NO: 100532 - DNA, 68 bp, Homo sapiens
  chr9:135287745-135287813
  hyper
ccttcgtgggttcttcggggtctttaaggtactttctggagcagttaagatgacgtccacttttcagt

SEQ ID NO: 100533 - DNA, 39 bp, Homo sapiens
  chr9:135426974-135427013
  hypo
gcccggcccaagcctgggtgctttcgtgagttatcccat

SEQ ID NO: 100534 - DNA, 259 bp, Homo sapiens
  chr9:135454985-135455244
  hyper
tggagctgggaatcccgaaatcggaataaaacgatgttattgagagagggctaaatcccagagtaaatttcaaacgaaataaatcgcacagcacattttagatgataatagacggcggtaactcaatactaatgatagtgtactgacaacccgctaatagtcttgggctccaagaagcccggcaaaaccggctggggcggcaggaggtccggctttggtgttctttcccaccgggagaggttggagccaccctcactcc

SEQ ID NO: 100535 - DNA, 737 bp, Homo sapiens; identical to SEQ ID NO: 32767
  chr9:135455287-135456024
  hyper

SEQ ID NO: 100536 - DNA, 126 bp, Homo sapiens; identical to SEQ ID NO: 32768
  chr9:135456079-135456205
  hyper

SEQ ID NO: 100537 - DNA, 702 bp, Homo sapiens
  chr9:135456234-135456936
  hyper
cgccctttccgccgcagacccgggttgcgatccctggggctgtgcagagaggatccaggcccgggacacagttcggatctgcccgcggtcctgggccccaacgccgggggctgaccctagaaaggcgctggactggagcccgtgacggggtgggaagggcgagggggcgcatgattcacaatgaaaaggccacgtttccagagttgccttgaaaatgcatccctggacgagctctggctctgcgtggaataagaagccgttagcaggcgtctacactcgcactcggaagctcttgcgtgggtcctgttcagaggtacaacagcaccggccccccaagaggtgcccatgggagaggccataagtggggggtgggcgggttactgccttctttgtcccttgagctgcctcccttgagccacacggatttctcgaggtctccctaacgcccctgacaagatcttcccaagtcctccaacctcgccctgaagtgaagccatcggtctcgtcacttcccaggaagacacctggctttccccactcccgccaggcccacagggtcccaagaggccagagagacaggactgcaaattgtcctacatgggaaacaccgagagcccaacagaaatgccgcaaacaacataacttgaattttcttccccacactagaaaaggggttctcgacgcgcgcgcgcacacacacac

SEQ ID NO: 100538 - DNA, 1444 bp, Homo sapiens
  chr9:135456996-135458440
  hyper
tccctttctgctgctggaggaagaaaaacgggggaaggaaaaaggatctacaatagacctgccgacgaataatttgaataactgtgggaaagggtcggggaacgctaaaaaaaaaaaaaaaaagcccagcgcacatcccagcccaccgcagcgcagtcggctcggccccctcccctccagccgtaccccccttggctaatcaccctcattaggagcttcgtcaccggcctaatgaaagcaaaccgtgtggaaatcgccggtaaacagttgggtctgtgctgtaattaattcggtgtctcttttaatcaaactgaaagggaatcgggcagcggcttgcggagccgtgacatcacccccaaaatcggccagagccaatcagcgtcatcactccggggacacgtgggcgagtccccttaaaaaaacacacacaacacaacgaaaaaaaagaaacaacaaaaaaaaacccagacccaaagtaaaagtgacacaagttcattttttaaaggaagggggggaggagaaggcgcgcgcggaccggcagagagctgccgccgaggagcagggaggcgctgtccacggtgctgacgggcccccggagcggcgagggcgcggagagaggacctccccggccaggtggagagtcatgagccgcgggcagccgccgccgctctccgcggtgctgatgccgccaggtgcgctcctttccgcccgctgctagcgcggcccgggcccgcagctatctgcggtgctgacctggccaccctcagccaccacttgcctggaagaagcgtgcggtttggatttttaaaacgccattctttatttagattccaacatcctcgcgtttcttctgtgccaagggggccctcgggccgtccgtctccccctttgctctccccaacttggcgcgccctccctcccattcctccctgacactcccaccaccccccctcggctcggcggctcggcgcgatgctgcagaagacgcactgagcccttttggatctaatgcgcagaggaggttggcccagagctcccgggctcccccaaggctgaactccgtccaaggtgcccgcaggctccctgcccgccttccccatgccagcccgcagctaggggcaggggcagcggcggctggggttgggggtgggtggggagcttttggggaggacaggtcgcagcttggctatggaaggctccaatggctttgggatcgactccattctctcccaccgcgcgggcagccccgcccttcccaagggggaccccttgctcggggactgccgttcgcccctggagctgagtccacgctcagagagcagcagcgactgctcttcgccagcctctccaggaagggactgtttggagacggggaccccacggcctggcggggcatccggcccaggtttggactcccacctgcagcccgggcagctctcagccc

SEQ ID NO: 100539 - DNA, 191 bp, Homo sapiens; identical to SEQ ID NO: 32774
  chr9:135458456-135458647
  hyper

SEQ ID NO: 100540 - DNA, 746 bp, Homo sapiens
  chr9:135459996-135460742
  hyper
caaaccgaaattcatcggtccgactgcacatcccattttcttgatttcccccacacaaatggccgagcctccttcagccaggctgtgccgaccatgcctggaaagtaggcaggtttaacggagcggccaggaggagatccagaggcatgcgggtgtccccaggcccgggcccagtggtccttgctcctcccccggggggcctgcttagagaggcaaagaaaacttgcgctggagagagactggcatggagaagggggaggaggaaggagggggaagtcaatgtaaatatatattcataacatcatggttattatttaccatttgcaacaagaacggccccgctttagttagagcaaagagcacgaatcttccaccgcccatgctaatggctggaactggagatagtgaggcccttgcctccttttatttatttgcccccaggaaggattttgaggacaggtttcgtttaagataattagaatatcaattttcttctcctgtctctgaggatatctgatcgggaggtgacgagggccggctgtctacatatcgcttaaataggtttggagcgaagggggtagaaggtcttgcccaacccccaccccaggtgttgctgcctttgcccctagtgaaaaaaggagcagggtcaggcagcgaggccttgtctggagcgtttctcaaacgtggaggggaccttttcagagctgagaaacagacaccctgagccagtccgtggagcatttaag

SEQ ID NO: 100541 - DNA, 30 bp, Homo sapiens; identical to SEQ ID NO: 32776
  chr9:135461292-135461322
  hyper

SEQ ID NO: 100542 - DNA, 537 bp, Homo sapiens; identical to SEQ ID NO: 32777
  chr9:135461541-135462078
  hyper

SEQ ID NO: 100543 - DNA, 519 bp, Homo sapiens
  chr9:135462647-135463166
  hyper
cgggcaggagcgggagggcaccggcggcggctgcgaggccgggccctgacatgccgctgtgtccgcagtgaaggaggagggcgaccgcgagatctccagctccagggacagtcccccggtgcgcctgaaaaagccacgcaaggcgcgcacggccttcaccgaccatcagctggcgcagctggagcgcagcttcgagcggcagaagtacctgagcgtgcaggaccgcatggagctcgccgcctcgctcaacctcaccgacacgcaggtcaagacctggtaccagaaccgcaggtgaggcctggctgcgggggtagaggcagaaagggaacttcccctttcctcacagctcctggaggggaccaggagtctacaggttggtgctaagggagggccccagagcctcccccattctgtaaaagtgggaaactgagtccctaaggggacaaggccttgcccaaagtccccacagcgagggacagagatgagactagacttggtgtccagcgtccagtcagccct

SEQ ID NO: 100544 - DNA, 34 bp, Homo sapiens
  chr9:135463680-135463714
  hyper
agccccacagtcactcgcacgctcttagcagagg

SEQ ID NO: 100545 - DNA, 262 bp, Homo sapiens
  chr9:135463992-135464254
  hyper
tggggccagacagtgcgcagggctcgcagtgcgagccctggaggatggcaggtgcagcctgctccagccggcagggcgtgcgagccgggagcgggtcctctccggttgccatttcaggcctgctcgcttctgctagcttgcagcccggccagcctgcagaggaatcaatcgcattcccttccctgaagagcacccccccatcccctcaggcctctccagggtgatcctaccttcataaagaggcacgcgcagggaggagcac

SEQ ID NO: 100546 - DNA, 275 bp, Homo sapiens
  chr9:135464664-135464939
  hyper
caggcaattactcagcgctccagcggatgttcccgtcgccttatttctacccgcagagtctggtttccaacctggaccccggcgcggcgctctacctgtaccgcggccccagcgcgccgccgcctgctctccagagacctctggtgccccgcatcctcatccacggactccagggcgccagcgagccgcccccgccgctgccccccctggccggcgtcctcccacgcgccgcgcagcctcggtgaggcgcccgtcggctccggggcctcctcccg

SEQ ID NO: 100547 - DNA, 874 bp, Homo sapiens
  chr9:135465191-135466065
  hyper
acccccagcctctgccggctcccctaggcaacccctttctccccaggagcgggtgcggctgattcccaggcttcgctctctcccacgccccttctacgctccaggtggagaacagcccctctccccgcgcccccgccagggagagaaggggagtgcggagccccgtctccctacccctcgagcacctgggccagcggctgagctgtacataccgtgtgcaaagtgtatatgaagttatttattcgtgacccatgagcccgtgaccgtgtccgtggattagtgagtctgtggcctgtgccctccccactcccaggcggggcaggaaggggccaagggggcttgcccacccaccccgaccccagcccccagcctcagccccggtccgggggcagccaggcctctcgggttctctcttttttaaatgtcgaaataaacttcttacaaatgaccaggcgcctgtccgcgctcgcgtcgctgggtccgcactcaacccctctcccatccctctcctggggactcggtttccttccatcctcaataacgaaacatttttgtcccccttctcttccccggtgctgtggacatgcgcgggggccccgacgggactcgctggggcccgggtctcccctccctggcctcagtcttcccatctctacagcgaggccagctcgttgttcccctcctcctcctctgtctccatctggttcctagcggctcccagacggtcccgagggccggggcgggggtccgtgccggaacaggcgggggtcagcgcggggcctcggtcggctgcgggccgggctgcggggccctcgccgagccgactcatctggccgcgacaagggccccggcagctggtgaccggcccgccggg

SEQ ID NO: 100548 - DNA, 576 bp, Homo sapiens
  chr9:135466117-135466693
  hyper
cgcccagcgtccggccgcgctcgggctcccgacgctcgcgggcgccaaggcggcccgggcctcccggcctcccgcaccaggcaggactccgcgcgccttcgctgcgaaccagacgccacatcgggtaaacccccactcccacatcttctcacctcccctttaccccgggaggaggttggaaatgagacccagaggggagccaaatcccagcgtctgccccatctcttctggctgccccagaccgcagctctagcatctcaggggagaggggtttaagtcccgagtcagactcgaggcttccagttcacgtccaaagggccacggtcacctgagactgctccctctctggggaggtgggcgcaggtgctcccttcccacacaccacctgcagctcgctaaccctcagcgctgggaagttttgggggccggcaagccgtggcccctctagtttgggggcagggtttctctgaagacgggggctgtgttcagactataacccctctcgaaaaccatacccacagccaggtccgctactgtttcctccctgccccgaaacaccctcgcacagcagctttc

SEQ ID NO: 100549 - DNA, 204 bp, Homo sapiens; identical to SEQ ID NO: 42260
  chr9:135512910-135513114
  hypo

SEQ ID NO: 100550 - DNA, 86 bp, Homo sapiens
  chr9:135548179-135548265
  hypo
agggggataatgaagcgttgtttaggttttttggaagattaaacacacataatcacttggcccagttcttggcacgctgtaaatgc

SEQ ID NO: 100551 - DNA, 85 bp, Homo sapiens
  chr9:135548565-135548650
  hypo
tctcaaaaaaaaagaaagaaaatataatgcagttatacaggtatgaaggagtaggagtctggattaatgtcgtggttgtggacat

SEQ ID NO: 100552 - DNA, 38 bp, Homo sapiens
  chr9:135645212-135645250
  hyper
catcaccgccttgtccgcccctccgcttgccagcaatt

SEQ ID NO: 100553 - DNA, 280 bp, Homo sapiens; identical to SEQ ID NO: 32783
  chr9:135645863-135646143
  hyper

SEQ ID NO: 100554 - DNA, 70 bp, Homo sapiens
  chr9:13568991-13569061
  hyper
aggccctggttgtgtcgaagtgggactttctgaagagggggcactctgggagagacgggagcaaaggggc

SEQ ID NO: 100555 - DNA, 74 bp, Homo sapiens; identical to SEQ ID NO: 42262
  chr9:135768018-135768092
  hypo

SEQ ID NO: 100556 - DNA, 30 bp, Homo sapiens; identical to SEQ ID NO: 42263
  chr9:135833429-135833459
  hypo

SEQ ID NO: 100557 - DNA, 188 bp, Homo sapiens
  chr9:135865042-135865230
  hypo
tggagtgtcctgttccgcaggggatcccggccgggtccagtcctgagcctgcacctgaccccccggggcctcatttcctccggcaggagcgcagcttcgagtgccgcatgtgcggcaaggccttcaagcgctcgtccacgctgtccacccacctgctcatccactcagacacgcggccctacccctgc

SEQ ID NO: 100558 - DNA, 246 bp, Homo sapiens; identical to SEQ ID NO: 42265
  chr9:135898878-135899124
  hypo

SEQ ID NO: 100559 - DNA, 56 bp, Homo sapiens; identical to SEQ ID NO: 42266
  chr9:135908143-135908199
  hypo

SEQ ID NO: 100560 - DNA, 30 bp, Homo sapiens
  chr9:135909759-135909789
  hypo
ttgttcgtatctgcacggggtaagaacaag

SEQ ID NO: 100561 - DNA, 107 bp, Homo sapiens
  chr9:136029028-136029135
  hypo
gctggggcttcctgtcgtcccagaggtactcgggggacagcaccttggacggcttgtttgagatgaagtgacggttcaggtggctttcctcccgccaggcagccatg

SEQ ID NO: 100562 - DNA, 675 bp, Homo sapiens
  chr9:136038772-136039447
  hyper
cccggggggaggacacgcgggaacggctgtaaaacgctgggcgcagcccgggccacagtgagcggagagccggggtcctggggattaggccgctgccactcgggagtgtccggcaagccctctccctctctcttcctctggggcctcagtttccccactcgggcctccaagccccgtctcgcccccgcctcccgcgaacgcagagcccagccccgagcgccgccggccccagtccgtggtcgggacccgggaccctgggtccgagatgcgcacctcctgggctcagggccctcctccttggccccttgcgtggcagggactgggtggggccaagggagcgcgactgtccctacggggtgcagacttactccttgctgccggcccggcgttaggacggttggaggggcgccaccccggcgcggaaaacggactcagctggcctgggcccccgcgatacccgggcgatcggcggcgcaggtggagcctggagcagggcaggcagcggggccgcgggccagacagaaaagaggaagacagacaggaaagaggacagaaaagagaagccagacgggaaagagggcgccgcagccccgcccacctaccgcaggccccgcccctgcggtcccagagccccttccctgcggcctgggagcaggatcccgggggaccgagcgc

SEQ ID NO: 100563 - DNA, 30 bp, Homo sapiens
  chr9:136151457-136151487
  hyper
accctgatcccgtcccgccctcccggggca

SEQ ID NO: 100564 - DNA, 160 bp, Homo sapiens
  chr9:136375573-136375733
  hypo
aaagtgcttggattacaggcgtgaacctccgcacctggccggacccatgtgactattcgaacttaaattatttaaaatgaggataacatttaaagatccaggtttggggttgtaccagctacgttgcagatgcccaggcaccaggcgtgttgggcagccc

SEQ ID NO: 100565 - DNA, 90 bp, Homo sapiens
  chr9:136378429-136378519
  hypo
agatgggcctggaatcgctgggtgccgggggacgcaggttgtgaggtgatgtctgggacctgctgccaccacccccgcagtccttcacag

SEQ ID NO: 100566 - DNA, 86 bp, Homo sapiens
  chr9:136383935-136384021
  hypo
acaggggagaggtgacgggcctcctgggtccccgttcatcgaggctcgcgcagtacgcacccactttgccgcgatgatgaggatgg

SEQ ID NO: 100567 - DNA, 30 bp, Homo sapiens
  chr9:136395929-136395959
  hypo
agaagcttctgccctcgcccaaagtcaccc

SEQ ID NO: 100568 - DNA, 127 bp, Homo sapiens
  chr9:136399516-136399643
  hyper
ctggggctttgccaccgccagcctccccggtaacctcaggccagcggctgctccgtctggacacccgacatgtggcccccagttctggacccgggaagaaggcctccctgctcgccgctcctgggcc

SEQ ID NO: 100569 - DNA, 94 bp, Homo sapiens
  chr9:136400112-136400206
  hyper
ggggtaggagcaccccgcgccctctggagccgttacataacgtggggaggcttgtggggaggggtcgggccgcagagcacggggcagggtggcc

SEQ ID NO: 100570 - DNA, 131 bp, Homo sapiens; identical to SEQ ID NO: 32786
  chr9:136474260-136474391
  hyper

SEQ ID NO: 100571 - DNA, 161 bp, Homo sapiens; identical to SEQ ID NO: 32787
  chr9:136474431-136474592
  hyper

SEQ ID NO: 100572 - DNA, 58 bp, Homo sapiens
  chr9:136474724-136474782
  hyper
cggggcgttccggcttccacaacgttgggatctggagtcaggccgaagctgctgctta

SEQ ID NO: 100573 - DNA, 30 bp, Homo sapiens
  chr9:136477280-136477310
  hypo
aggatcctagttacacgcagttcttttagg

SEQ ID NO: 100574 - DNA, 59 bp, Homo sapiens
  chr9:136521608-136521667
  hypo
atggcccggggctgacgggtctcctccaacttgcaggggggcttcgggatcctggagga

SEQ ID NO: 100575 - DNA, 42 bp, Homo sapiens
  chr9:136527279-136527321
  hypo
tgggttctctctcctcgggacagggagcgcagccaggttctc

SEQ ID NO: 100576 - DNA, 123 bp, Homo sapiens
  chr9:136553113-136553236
  hypo
cggccgcccccgggccgcaccttgatcggtccatctgccacctcctccctccacggcccacctgcctcccccacactaaaaatatccccactccctgtccaaggctggcgtggcaatgaagcc

SEQ ID NO: 100577 - DNA, 30 bp, Homo sapiens; identical to SEQ ID NO: 42270
  chr9:136559282-136559312
  hypo

SEQ ID NO: 100578 - DNA, 188 bp, Homo sapiens
  chr9:136573297-136573485
  hypo
accgcacctgacctgcggttggggtacaccttgcatttctgtcactccgctgccctgaggacgtcccagaccctcgctgccagtccccagcaggagctgtaggggcgttacctcgtgcagcgggtctctcctcatgttgcgcccggccagcggctcatcgtgggggaagacgacggagtagttcttgg

SEQ ID NO: 100579 - DNA, 110 bp, Homo sapiens
  chr9:136603522-136603632
  hyper
aggatctgggcggagcgtaccgcccaccactgcggcttctaggccagcttagttggggcttctaggccagccctgtgggcagctccctctgagggcggcagagcagggtt

SEQ ID NO: 100580 - DNA, 112 bp, Homo sapiens
  chr9:136658252-136658364
  hyper
ccggcgcctgcctgccgtgctgcaatcctcgtgctggccaccagagagcagtgcccacttcagtccagaaaacgcagtgtccagacctggcccacagcggaacccaagggag

SEQ ID NO: 100581 - DNA, 39 bp, Homo sapiens
  chr9:136708022-136708061
  hypo
gcagcgtggagggcccgccagacccgtttaattattgag

SEQ ID NO: 100582 - DNA, 30 bp, Homo sapiens
  chr9:136727495-136727525
  hypo
agctgtcacaactcacggggtgaatggagc

SEQ ID NO: 100583 - DNA, 97 bp, Homo sapiens
  chr9:136728397-136728494
  hypo
gctgatcaatccctccgaggagccgggcgcaggcccagagccctcctccgtggagtctaaggaggcaccagcattcggtcagcgctgacacacaaga

SEQ ID NO: 100584 - DNA, 53 bp, Homo sapiens
  chr9:136837620-136837673
  hypo
tttgccgctggctcccgcagacacatgtagccgaggggcggcccgcctcctgc

SEQ ID NO: 100585 - DNA, 42 bp, Homo sapiens
  chr9:136860951-136860993
  hypo
tggaagccacagatgcgttaaactgatccaaagacagcttat

SEQ ID NO: 100586 - DNA, 178 bp, Homo sapiens
  chr9:136931060-136931238
  hyper
tgggtatgactacttcggagtgtagggcaggcactgtttgcaagtcccgtccttcattcaaagctcactcacttccgaagcaggcgcgagctgttgtcaaaggaaagtaattactctactttctaaaaacaaaacaaaaataaaaatggagtgactgcccactcggagaaagcttttg

SEQ ID NO: 100587 - DNA, 145 bp, Homo sapiens
  chr9:136990501-136990646
  hypo
cacaggagatggggacgaggcccatgctgtagaaggggcagatctgggatctcaccctagacagaccatccaatgggaagggtccgggattgcgggacagaaagaggagacaagagagccaggctagcagcgcccagatggacag

SEQ ID NO: 100588 - DNA, 30 bp, Homo sapiens; identical to SEQ ID NO: 15265
  chr9:136999528-136999558
  hypo

SEQ ID NO: 100589 - DNA, 32 bp, Homo sapiens
  chr9:137024169-137024201
  hypo
gggttgggtgctaagcgcgagcctcgccgtcc

SEQ ID NO: 100590 - DNA, 151 bp, Homo sapiens
  chr9:137248217-137248368
  hypo
ttgtttagctcccaccgggaacacacctgggatggccttgggctggggattgcatgctggccgggccggggagccaggagttgctgcctgtgctcctgcaatgcccaccagggctttcggggtatatagagcagcacggtctgcgggatgg

SEQ ID NO: 100591 - DNA, 126 bp, Homo sapiens
  chr9:137281012-137281138
  hypo
atggcacagactgcacgttgttgccatttcacggaacccgttttcccggatttgtcaggaggggagagaatggtggaaatgcagttttgctgggttccctgcacacgtgggcgctggctttggtca

SEQ ID NO: 100592 - DNA, 39 bp, Homo sapiens; identical to SEQ ID NO: 32791
  chr9:137295661-137295700
  hyper

SEQ ID NO: 100593 - DNA, 456 bp, Homo sapiens
  chr9:137299119-137299575
  hyper
gaggggagcttcctgcgcacaagcggcggcaggggtttgcagaagtggaggctgggggctgcctggccaagcgcttaccgccctgcgcagccaggctggctggcaggctgcagcgggaagcgcctgtgggtcctcggcgctgactgcagagctgggtggaggcagcggaaccaaaactgctgtgtcactgcacgctgcagctgttgccagggtgaccgggtgagtttcccacgcttgcccgggcggcagcgtgcgggccggcgggtggggcggaggggtgtgcagagaggccagtggtgtcgtgccacccgatgcccgggggtgtccactcccctctcctgggtcacgtgaccagggcccctgccctgcggtgttgtggggtgtatgtgtggttcttgggggggtccccagccctcctccgtcctgggaactgggcttcggcgtcctcatgtgtgg

SEQ ID NO: 100594 - DNA, 30 bp, Homo sapiens
  chr9:137306458-137306488
  hypo
gctcactgtcttgagcgctcagccctgccc

SEQ ID NO: 100595 - DNA, 30 bp, Homo sapiens
  chr9:137312093-137312123
  hypo
cctttcagcccccagcgtgacagaaggaga

SEQ ID NO: 100596 - DNA, 42 bp, Homo sapiens
  chr9:137312331-137312373
  hypo
tgccctgccctcttccgagggtcctggcgagtctctgtgcca

SEQ ID NO: 100597 - DNA, 33 bp, Homo sapiens
  chr9:137312923-137312956
  hypo
ccagtttcgtcagctcgccgcacctgccttcca

SEQ ID NO: 100598 - DNA, 30 bp, Homo sapiens
  chr9:137328381-137328411
  hypo
cttcttcaagctcatcggggacacacccat

SEQ ID NO: 100599 - DNA, 48 bp, Homo sapiens
  chr9:137386151-137386199
  hypo
tggggtggtggatggcgctggtatggtgaatggcgctggggtggtgga

SEQ ID NO: 100600 - DNA, 46 bp, Homo sapiens
  chr9:137427038-137427084
  hypo
gctgccgtaacaaatcgccgtgaatttaaaacgtgtagtttaaaac

SEQ ID NO: 100601 - DNA, 30 bp, Homo sapiens
  chr9:137439116-137439146
  hypo
agcccgtcctgtggacggctctggagctgg

SEQ ID NO: 100602 - DNA, 195 bp, Homo sapiens
  chr9:137457365-137457560
  hypo
aaaaggagtgaagtacggatacacaccgcaacacggatacaacttgaaaaggtgccaagcaaaagaagccagtcacagaagaccacacagcccatgatcccatttatcccatgttcacgacagggatctgcagagacagagctgtggtctctcaggaatgaggggctgcggggtagcgggcgatggctaaagggc

SEQ ID NO: 100603 - DNA, 87 bp, Homo sapiens
  chr9:137489165-137489252
  hypo
ttttcactgtggactcgcctcagagcctcggttttgtccacctgtaaactgaggacagcaaggtctacctgacgggccagcagagag

SEQ ID NO: 100604 - DNA, 195 bp, Homo sapiens
  chr9:137519751-137519946
  hypo
ccaccagcttcaaagcggggaaaattcctcatcgggcaggggctttggcggggcgccctggtgaatggaagtgcctctccagggggcagcagccaggagatgcccaggcccatggtctcattaacggtgcacaacattctgcctcattttccttggcgcgaggcgtgggttttcctaagccgagaggtgagacgt

SEQ ID NO: 100605 - DNA, 30 bp, Homo sapiens; identical to SEQ ID NO: 32793
  chr9:137533003-137533033
  hyper

SEQ ID NO: 100606 - DNA, 471 bp, Homo sapiens
  chr9:137533496-137533967
  hyper
gcgcccagtgggaggcgggggctggcctcgccgagcccagcgccgggctctgatttgctgcgggcgttggggatcgacagcctccgcggctgccttccaggagagagggagggaggaaaagggggaaaaaagtgctccgcgccgaaggcgaggtccgcactctccgtccccgcggctggcgcaggacctcactcgagcggagcgcccacggggagcgggtcgcggggcggcggcggcgaggaggaggcgagaaggagttggaggaggaggaggaggaggcgagggcgagctagcccagcggggtcccggccgccccgcgggccaaagtcgagccctcccgcccgtgggcgagcgcgccagccgccccttccagaacagccgccgccacaaagaagaacggggggtgccgaggtccccatgacctcctaaagtggtgcggtccctgctgagtgcgctgcccgggccgtgacc

SEQ ID NO: 100607 - DNA, 493 bp, Homo sapiens; identical to SEQ ID NO: 32796
  chr9:137534065-137534558
  hyper

SEQ ID NO: 100608 - DNA, 90 bp, Homo sapiens
  chr9:137539456-137539546
  hypo
ccggccccagctggacgggagaggaggagatggcacgtggaacctgccggttgagcgtgaggctgtgggttctgccgcagggcaagccgg

SEQ ID NO: 100609 - DNA, 180 bp, Homo sapiens
  chr9:137580727-137580907
  hypo
catgaatgagaaatgcggcttcgatttccctccaccctggtctccttcagagccctgcccaggctgctgtcttccctgcactgtcagctggtcatggcgggggtgggggtggcacaggttcctgtctgtacctccttgtggcctgcgcaccaagcacagtgcccgcgctgagtcccctgg

SEQ ID NO: 100610 - DNA, 30 bp, Homo sapiens
  chr9:137601900-137601930
  hypo
ggcatctgagggagccgcagtcaagcccca

SEQ ID NO: 100611 - DNA, 35 bp, Homo sapiens; identical to SEQ ID NO: 42278
  chr9:137602268-137602303
  hypo

SEQ ID NO: 100612 - DNA, 34 bp, Homo sapiens
  chr9:137602975-137603009
  hypo
tgggcatgaattgttcggtcggtggtttggtgcc

SEQ ID NO: 100613 - DNA, 48 bp, Homo sapiens
  chr9:137609353-137609401
  hypo
agctccagaccctagcgctgcccgtggctctcccggcctccgtccctc

SEQ ID NO: 100614 - DNA, 36 bp, Homo sapiens
  chr9:137616322-137616358
  hypo
tccctccgccccgcccgtgtgcgcagtggttgtgat

SEQ ID NO: 100615 - DNA, 33 bp, Homo sapiens
  chr9:137616641-137616674
  hypo
cccagagaggggcctcggcgggggaggtggtgc

SEQ ID NO: 100616 - DNA, 192 bp, Homo sapiens
  chr9:137623351-137623543
  hypo
ctccaggggaaggtgcggatgacttggagggggagttcactgaggaaacgatccggaaccttgacgagaactactacgacccctactacgaccccaccagctccccgtcggagatcgggccgggaatgccggcgaaccaggataccatctatgaaggggtgagagggtgcaggcccccgttccgggtggggt

SEQ ID NO: 100617 - DNA, 184 bp, Homo sapiens
  chr9:137624178-137624362
  hypo
ctgtgatggagggggcgggataggtgctgatcaaagccggtcctgcacccaagctctgggcatctcagtgctggtcagtttcacctgggatgaaaagcagctcagagctatcgaggcggaggcggagtcccctttgaggggtggaggagaggatgtaaatggcccattccgtgtaaaagatgcg

SEQ ID NO: 100618 - DNA, 30 bp, Homo sapiens; identical to SEQ ID NO: 42280
  chr9:137631987-137632017
  hypo

SEQ ID NO: 100619 - DNA, 51 bp, Homo sapiens
  chr9:137638944-137638995
  hypo
caaatttgaacacttcggaagggttcatgggggtggcgacattctttcctt

SEQ ID NO: 100620 - DNA, 30 bp, Homo sapiens
  chr9:137650802-137650832
  hypo
ttctttcaataacaacgtgatagaaagcct

SEQ ID NO: 100621 - DNA, 30 bp, Homo sapiens
  chr9:137652857-137652887
  hypo
acacacgcatacacacgtgcacaggctcca

SEQ ID NO: 100622 - DNA, 233 bp, Homo sapiens
  chr9:137656918-137657151
  hypo
gttctgcacgagcctcgccgaccggagagggcgtgccagctcttgcccagagtagcgtcctggaaaagatctgtaccccacgcctccttctgcacattcagtcttggggttcccaccagggactagtttcacctggtgctctcctgcccgcaccctctgaccctgtgatatcataaaaacaatcgtatgtcgctgcggaggggaattcaggagcgagccggtaatgaggatag

SEQ ID NO: 100623 - DNA, 125 bp, Homo sapiens
  chr9:137667232-137667357
  hypo
atctgggtgggccagcgctgtcgcaaggcggagttcatgggagctgtccatttattcacaatcattcgtgtttctgccatgacgggctctgacaacctcgttacatggggcgcacagctccagag

SEQ ID NO: 100624 - DNA, 30 bp, Homo sapiens
  chr9:137674975-137675005
  hypo
gctgcccaggccacacggccggcgcccaca

SEQ ID NO: 100625 - DNA, 35 bp, Homo sapiens; identical to SEQ ID NO: 42284
  chr9:137685677-137685712
  hypo

SEQ ID NO: 100626 - DNA, 165 bp, Homo sapiens
  chr9:137687742-137687907
  hypo
cgtccctcggctgaccggaatgcacccacaggccaccctgaactcctccaggacaagctctggggcacttctcgtgtgccccgtgacctgacctgaggctcacctatgagaactcagagcagcagctgtcacatgggggtggccctagagcgggtccctgcgttc

SEQ ID NO: 100627 - DNA, 381 bp, Homo sapiens
  chr9:137694270-137694651
  hypo
cttagagctgcagaacggggaggggtcaccttgtgtcctagaaagcgcacacctcatgtagcggtgagtaagacgtagacctgctgcagccacagaactgaagggcatgtgggctctgcccctggtgtggcttttctcccatccttggcctgtcctgtggctgaatcagcctccctcagggcacatcccaggaaggcaggcttggccgtgcctcctgaaggcgccaggtgggggaagagggccacgcggggcccagcagatgccaggcagtgagcagcgtaccaacacccaccctctagatttttgccgggaagagaaggcttgcaaaggcacttggaggtttggtgtgcccgcagcagacctttgcgtccatgaccaggg

SEQ ID NO: 100628 - DNA, 30 bp, Homo sapiens
  chr9:137696349-137696379
  hypo
tatggaaaagatagacgtgccctcagctcc

SEQ ID NO: 100629 - DNA, 30 bp, Homo sapiens
  chr9:137698436-137698466
  hypo
ggtgttccccacatgcgtggacagaggaag

SEQ ID NO: 100630 - DNA, 30 bp, Homo sapiens
  chr9:137701048-137701078
  hypo
cccagctggccgagacggtctccaggggcc

SEQ ID NO: 100631 - DNA, 30 bp, Homo sapiens
  chr9:137703099-137703129
  hypo
cccgggctcaggatgcggtccacccctccc

SEQ ID NO: 100632 - DNA, 397 bp, Homo sapiens
  chr9:137710195-137710592
  hypo
ctgttgttaaggagacgggaggttgtgcggttccatccctgctcgggcagtggcgctgtgacacccggtctgtggtcggcgcagtcagcggagacgggatccctgctggcctgggagatgatcgggatggagacttgaccagggcagcttccacaggcaatgaaatgtggagaattagggcaaccccggatatggggtcacctgggactcctccagaggtgcccagggtttccgagcagtggtcctgggccagggtgcctggagcctagagctccggacctcattctgccctccgccgtcctgcagggagaagccggcttggaaggccctcctgggaagactggccccatcggcccccagggggcccctgggaagcccggaccggatggccttcgag

SEQ ID NO: 100633 - DNA, 40 bp, Homo sapiens
  chr9:137711094-137711134
  hypo
gggtcctgagcagctcgggagatcccggaggcccctgcgg

SEQ ID NO: 100634 - DNA, 198 bp, Homo sapiens
  chr9:137716801-137716999
  hypo
gacaggacgggcagccgcagcctccccatctgtggggccggggtgcgcaagagcctcccctcttgaactttatggaggcatctcagggtgaggccgggtgcagaggccaaggctttgaggtcagactctccaggttctcatctggtcttaggcattttctggcggggtgacctgcttgaacctcgtgttcctgacctg

SEQ ID NO: 100635 - DNA, 264 bp, Homo sapiens
  chr9:137718850-137719114
  hypo
caagcctgcagctctcgtgcccctgcatcagcttgaacggcctctccttcatgagctcgcagttgtcgcgtggccccaggcaaaggccgcccatttctggggccgcagcggtttgctgtgcaggtccagacctgtgcgcccctgcagcctctgcttcctaacaacctcagtgccccagaagcagtttcctgccaggggaagagcagctacgttctccccagggaccgccatccccttacccctcaatcacgccctgaccgtgct

SEQ ID NO: 100636 - DNA, 300 bp, Homo sapiens
  chr9:137719318-137719618
  hypo
tctggccagaggccccgcgtggaattcccttagaaaagaggtttctcggccctccttcgcggcctgcctctgcaaatgggtggccttgccgctgtggaaatcacgggccagactcctccaaactcagaggtttcctgggaagccgcggctggtgttcacggcacagcagcgtggggctgctgagcgaccccaggctcccccagtgttgaccagccaggcgtccacaggctgcagcctcgggcctgggctacagctgcttggccaagggcaagtggagacgctttccgaggtggccccctt

SEQ ID NO: 100637 - DNA, 30 bp, Homo sapiens
  chr9:137720183-137720213
  hypo
agtgccccatggcagcgtgagctggctgca

SEQ ID NO: 100638 - DNA, 63 bp, Homo sapiens
  chr9:137721214-137721277
  hypo
ggcctccggtctccccgagggcccaggtcaggctcctcacgcagcctccggtctccctgaggg

SEQ ID NO: 100639 - DNA, 161 bp, Homo sapiens
  chr9:137721661-137721822
  hypo
aggctgcactgaaggcgctcggtgggtcctccctgcagcccccccggcgtgaggatgcaggcgcgggggccgggaaagcctggggccttgctctggaggccggagaagtaacccttttgttctgtttctctccctccccacctccccgctgcatgtttagg

SEQ ID NO: 100640 - DNA, 41 bp, Homo sapiens
  chr9:137722056-137722097
  hypo
tgcctgcttgcggcacggctggctcgcggctctgcatggca

SEQ ID NO: 100641 - DNA, 156 bp, Homo sapiens
  chr9:137724524-137724680
  hypo
ccctcccagaaggagcgccggacggcccagcctgtcggttggtattcacttttcctcctcaaggtttgcccgtaaggttctcgtggctgcgtctgaaagcgtggagttcgccgatagccctgggactgcagcgtgttccctcgcccctgggaaggc

SEQ ID NO: 100642 - DNA, 69 bp, Homo sapiens
  chr9:137726887-137726956
  hypo
ctctgcccaccagaacgtcacctaccactgctaccagtcagtggcctggcaggacgcagccacgggcag

SEQ ID NO: 100643 - DNA, 45 bp, Homo sapiens
  chr9:137730826-137730871
  hypo
ttgaaaagtcacaaccgtctcatttaattacggaggctgctgcag

SEQ ID NO: 100644 - DNA, 33 bp, Homo sapiens
  chr9:137731553-137731586
  hypo
tggtctctggctcctcgccggtggggagggtga

SEQ ID NO: 100645 - DNA, 30 bp, Homo sapiens
  chr9:137731848-137731878
  hypo
ttttgctgtcaagtccgggggtgccccatg

SEQ ID NO: 100646 - DNA, 60 bp, Homo sapiens; identical to SEQ ID NO: 42294
  chr9:137734084-137734144
  hypo

SEQ ID NO: 100647 - DNA, 30 bp, Homo sapiens
  chr9:137747704-137747734
  hypo
gccaggcatgggagtcgattagatcagtgc

SEQ ID NO: 100648 - DNA, 30 bp, Homo sapiens
  chr9:137771562-137771592
  hypo
cattgaaggaaaatccgatgggattttgtt

SEQ ID NO: 100649 - DNA, 30 bp, Homo sapiens
  chr9:137771832-137771862
  hypo
ctcttctccaaaaggcgaacacaaccactg

SEQ ID NO: 100650 - DNA, 30 bp, Homo sapiens
  chr9:137774917-137774947
  hypo
tggatttccagctcccggcccctgagtgaa

SEQ ID NO: 100651 - DNA, 30 bp, Homo sapiens
  chr9:137777607-137777637
  hypo
ccacaggttttccagcggagggtggatggc

SEQ ID NO: 100652 - DNA, 30 bp, Homo sapiens
  chr9:137804943-137804973
  hypo
ctcaggaaatacccccggtctagcaggtcc

SEQ ID NO: 100653 - DNA, 33 bp, Homo sapiens
  chr9:137805825-137805858
  hypo
ttgggactcaggtatcggcggaccctcagcccc

SEQ ID NO: 100654 - DNA, 30 bp, Homo sapiens
  chr9:137832202-137832232
  hypo
gcaccaatcaggcaccggcttccatggctg

SEQ ID NO: 100655 - DNA, 30 bp, Homo sapiens
  chr9:137840749-137840779
  hypo
gttcctggagtgtggcgcgcccagcaagga

SEQ ID NO: 100656 - DNA, 30 bp, Homo sapiens; identical to SEQ ID NO: 42295
  chr9:137851369-137851399
  hypo

SEQ ID NO: 100657 - DNA, 576 bp, Homo sapiens
  chr9:137854764-137855340
  hypo
attgttgagctcccctttcctcctctgcgtaattagtaagatctcttccacctgcctcatgggctgactgagggaacaacccagacagggatgatcatgacggtgctgttggctgactgtggggctcgacactgtgctcatcactttatgcatctgagatggaaatggtctcagccacaggcacagatggggaacccaaggcaaagagaggttaagtaacttacccttggtcatgcagacagtggctgagcccgaattcagccccagtgtctttaactccaggtgtgagggcagcggctccagcacgcgaggccccaggagccaggcactgctcacagcaccaggcgtgaccgcagcggctccagcacgcggggccccgggagccaggcactgctcgcagcgcgggtcgctcacgtgttctttggaggcaaatccatgcggcgttcacacacacggaccttgcagttgcttgcgcctttttttctctccaactcatcacagggcatgacttctctccaagctgcctgaaataaaatgaataactttttatgtgaagttcttcgtgctgaagagaac

SEQ ID NO: 100658 - DNA, 163 bp, Homo sapiens
  chr9:137865081-137865244
  hypo
cccgacatcaccgggcgtcaagtgcacacgcaggggactgtggtggtgtaaggagagttagccctagactcaattctgctgttttcacttaagaaagcctaaaagcaagatccaagaggacaaattgtttccatgtaacttaactgtgtttcagaatgaactc

SEQ ID NO: 100659 - DNA, 30 bp, Homo sapiens
  chr9:137901149-137901179
  hypo
attcactggcacccccgtattacccatgct

SEQ ID NO: 100660 - DNA, 30 bp, Homo sapiens
  chr9:137937191-137937221
  hypo
cgcggcgggacaaaacgcatggaaccattg

SEQ ID NO: 100661 - DNA, 30 bp, Homo sapiens
  chr9:137937533-137937563
  hypo
agggaccggagatgccgtcacagcagttcc

SEQ ID NO: 100662 - DNA, 170 bp, Homo sapiens; identical to SEQ ID NO: 32797
  chr9:137967194-137967364
  hyper

SEQ ID NO: 100663 - DNA, 179 bp, Homo sapiens; identical to SEQ ID NO: 32798
  chr9:137967472-137967651
  hyper

SEQ ID NO: 100664 - DNA, 243 bp, Homo sapiens; identical to SEQ ID NO: 32799
  chr9:137967688-137967931
  hyper

SEQ ID NO: 100665 - DNA, 30 bp, Homo sapiens
  chr9:137977952-137977982
  hyper
cttgtggccttgaatcggtgttaaacatgc

SEQ ID NO: 100666 - DNA, 126 bp, Homo sapiens
  chr9:137978937-137979063
  hyper
aaggccttagggcaccgcggctgccctgggatcgcaggggcgcctttagctctccaccgatgccccgacgcccccctggcgctggaggccctcgcgagtctggctgcttttcggagcctgccctgc

SEQ ID NO: 100667 - DNA, 669 bp, Homo sapiens
  chr9:137979475-137980144
  hyper
cccggccgcggcccccgcgcgcagcccgcgcagcgctcagagccggacggcgcttcccggtggcggcggaggagcccggagggacgcagccgggcaaggcagggcgcagggcgggcggcgcgaggcgcagggcgcggcgggcagaggccacctggccaccttccctggcgcccggggaaggcgcggcgatggccggggcgcgcggggcggcggcggcggcgggcgggcggcggcgggccgagggggcgcggggacacagccaggcgcccctgcccgccgcggtgcccgccgcctgaaggccgcctgggcgcgggagccggtgccagctcggagcgggcgctggaggcagctcgaggcgcgatgtcggtgccgctgctcaagatcggggtcgtgctgagcaccatggccatgatcactaactggatgtcccagacgctgccctcgctggtgggcctcaacaccaccaagctctcggcggccggcggcgggacgctggaccgcagcaccggcgtaagtgcgcccgccggccgccttggcgcggctcctcctcctcctcctcctccccctcctcggtccggagccccgggctgggcgggcgccgcgcgggacccgagtcgcccagggaggcggcggggagcagggcgggcaagggcaggcgtcgcgggccgg

SEQ ID NO: 100668 - DNA, 792 bp, Homo sapiens
  chr9:137980216-137981008
  hyper
cggcgtttccttcgtctgggcccctcgccgcggggccgggggagcttggtgggttctcggaggcttggagtcctgggtcagtaatcatgagccccccattgaaaaggttaggaaactaaggctggggacttggggacttgtccaaggtcacactcagcgagtgaggggtggagccgccgctagaccctagtctgggctcggtccagcggggactgagcccgccctagtttgtaaaagccagactggccggaccgggctgggagtggggccccagccggtgggctccggagctcctgcccgcgcctgcattcccaaagtcccaaggcgccctttcctccccagtccataggagggtttgttccttctcctccgaggacggtgccgaggggcttgggtggggcccctgggagcctgcccttgggcgctcaccccctcgcctttgccttcgtcttctgcgcgcacccctccctcctggcctctgaaattgaaatcgcgtctccctctcgagcctagcgggaggggaaccgtggccggggctgcttctgggcagagctgacttagatggctgagcgaggctgagctgaaaccgccacccggagggccgcgcggggaaggggccgctgccgggaaggcgcgccccagaccactggccctttaggctgaaaggagaggtgaaggacgtgagtctccctccctctctctttttgctgccaggggtttagtgccctgcgaagagggctccgtggtgtggctccctcctaagacccctcttgaggccgccctccctgctcc

SEQ ID NO: 100669 - DNA, 30 bp, Homo sapiens
  chr9:138054641-138054671
  hypo
ctcatgagatcacagcggtaacaccaagga

SEQ ID NO: 100670 - DNA, 30 bp, Homo sapiens
  chr9:138080405-138080435
  hypo
ccatgacacacttgccgcatgcccactatg

SEQ ID NO: 100671 - DNA, 30 bp, Homo sapiens
  chr9:138131370-138131400
  hypo
cccagagctcaggcacgtgactgttcagca

SEQ ID NO: 100672 - DNA, 30 bp, Homo sapiens
  chr9:138133678-138133708
  hypo
aggtttgagatacgccgggatggttcccct

SEQ ID NO: 100673 - DNA, 173 bp, Homo sapiens
  chr9:138218634-138218807
  hypo
ggctggcctcggcatcgcaggaggtcacacccctgtcagggaatcacagctccttccgggtgcttctgccttcagatctgttgggctactgcgtcatcagcctggagtcctcctcgtcttagagaggagagactgtgccgaaaggtctcagggagctgcgctggaccacacag

SEQ ID NO: 100674 - DNA, 155 bp, Homo sapiens
  chr9:138265117-138265272
  hypo
aggctctgccagccacgagggcggggaaggtgaagtggagtcagcgtcctctgccagtgcctggaatcctgcaacctggaggcagccttgcgatgagctctgctgcaggcctgtggacgcgagccccactgcttcatggtcgcccactccctctg

SEQ ID NO: 100675 - DNA, 142 bp, Homo sapiens
  chr9:138270882-138271024
  hypo
ccggccaagccttcacgcagtccacacatccctagcccgggagcccctgctcagaagtctctttacctcctcgggggaaggcagagggaggggagctgaggacactcagcacccagggctttcgcaccgctaacacgtgtcc

SEQ ID NO: 100676 - DNA, 30 bp, Homo sapiens
  chr9:138275014-138275044
  hypo
taaaaaataggcaaccgacaccagatgtag

SEQ ID NO: 100677 - DNA, 64 bp, Homo sapiens
  chr9:138288949-138289013
  hypo
tttgtgggaaaggaccgtgagatgcagccagcagatgatttctgtgcttcgtgacccagtttct

SEQ ID NO: 100678 - DNA, 438 bp, Homo sapiens
  chr9:138289352-138289790
  hypo
gagcccacaacccagcgaggacctggcacagttggcaatgtgagtggtggcccacgacgcaacttgtgattgtggttgtggtggagtaacaacacctcgtccacacctgcccgtggaatgctgcaggccaggcgctgggtcacactcttcacgcggattatctcgtgtgacacctggcccacacccgtccgtggaatgctgcaggccaggcgctcggttacactcttcacgcggattatctcgtgtgacacctggcccacacccgcctgtggaatgctccaagccaggcgctgggttacactcttcacatggatcatctcgtgtgacacctggcccccacccgcctgttgaatgctgcaggccatgcgctgggttacactcttcatgcggattatctcatgtgacacctggcccacacccgtccgtggaatgctgcag

SEQ ID NO: 100679 - DNA, 30 bp, Homo sapiens; identical to SEQ ID NO: 42299
  chr9:138290031-138290061
  hypo

SEQ ID NO: 100680 - DNA, 30 bp, Homo sapiens
  chr9:138339327-138339357
  hypo
tacaggtgtcagaatcgcttcagtcacaag

SEQ ID NO: 100681 - DNA, 30 bp, Homo sapiens
  chr9:138354047-138354077
  hypo
tagacggctccaaaccgtttccagggttcg

SEQ ID NO: 100682 - DNA, 30 bp, Homo sapiens
  chr9:138388283-138388313
  hypo
atattttaccccatacgggtgacctgtcct

SEQ ID NO: 100683 - DNA, 242 bp, Homo sapiens
  chr9:138393554-138393796
  hypo
gggctgctgggctcccggctccccacctcggtgtcacagaaggcacttgggagcaggggtgggcgggaactgcgctctgcctgtctctgctgccaccggtgggagacgcagcgtcgctcctcctccctgccgtagatttcaacgacaagattttgaatgagcccctcaagcactctgacttcttcaatgtcaaggaactgttttccgtgagaagcctcttcgatgcccgagtccatctggga

SEQ ID NO: 100684 - DNA, 146 bp, Homo sapiens
  chr9:138416374-138416520
  hypo
ccccaaggggagaggcgcttcctccagggtgggcctgtcgtgccgtccatcctcactccgggagatgctcagggatggatggagagcccttcccgttctcccggttctgctgccacaggagccttctcagccgtgcacggcaccct

SEQ ID NO: 100685 - DNA, 48 bp, Homo sapiens
  chr9:138444796-138444844
  hypo
accacacccaccccacgcctctgcctcccactccgcctcccggacccg

SEQ ID NO: 100686 - DNA, 237 bp, Homo sapiens
  chr9:138506017-138506254
  hypo
ggtggcaggtgggtccgggcagcgcagaggagggagctggctagggacgctcccccttccccggagccatggccctggagaaaggcccgctcctgctgctggcccttggcctgggcctggcgggtgcccagaaggctctggaagaggtaccggtacagccgggcttcaatgcgcagaaggtacgtgtcatgggtccagtccccagactcaggcctggaacaacggcttgagtgtcac

SEQ ID NO: 100687 - DNA, 30 bp, Homo sapiens
  chr9:138508740-138508770
  hypo
ggggtctccaacagtcgagggcggcagcat

SEQ ID NO: 100688 - DNA, 176 bp, Homo sapiens
  chr9:138557647-138557823
  hypo
tgggaggtgtgcctgcggggtccctgtccctgcgctgagagccccctctgtccttccagatccctgctactccaagcattacaggagcccgcccaggcctcccatgcgtgagctgcgactcgggacgggcagggggctggatggggagagcttggggccaacgtcagaggctgcgg

SEQ ID NO: 100689 - DNA, 586 bp, Homo sapiens
  chr9:138562694-138563280
  hypo
cctgcagtgtggactcggccacccacctgcctctgccagccatgcccggcttgtgtggcccctcaccatagcccgcccagggtctctcgggcatcgaaaggacaagcttaagggtcgtgcaaatgcaccgcgtgtacaggacggctgtgtgcacacgtgcaccggggcgaggggctgtcgatgccacttcccttcgcagtgttctcttagttaccgacagcgtggcagcctgcagttaccagggaagccggagctaggagcagaggcaggcgaagccccaggaggggaggcatgtccactccccacagcccctcccataccagaggcccttgacaatgcgcctgcaggtcaggcgaccagctaggtgtggggtgagcccccgcctctgtttccccaaatgactggtatgttcctgggcacacatccgatggctgccagcctgcacgtcacgcccagctgccggagctactgcgggattccagaacaaggaacgtgacatgctcggcctggagcggaacaaggcacctggctcccgcaccctcgacggggccctgcccagtggacacgaccacgtggaagcctcttc

SEQ ID NO: 100690 - DNA, 78 bp, Homo sapiens
  chr9:138577356-138577434
  hypo
aggggtagggtgagccggagatgaggtgagcctggggtgagttgagccagggatgcgatgagccgggggtggggtgac

SEQ ID NO: 100691 - DNA, 235 bp, Homo sapiens
  chr9:138577643-138577878
  hypo
agaaggtcagcagggcggtgagggggtaggaatcggagctgctcagtgggcccagctaccaggagccccggagggtcctcgacggatttgtgcatgagaaaccagatcgcttctacctggggtgggcagctctgctcccgggtggccttggcgctccttggctggctccctggaactggaaagggcagccctggggctcctggtcactgcagggggagtgcgtgggcccctgcac

SEQ ID NO: 100692 - DNA, 30 bp, Homo sapiens; identical to SEQ ID NO: 42308
  chr9:138587151-138587181
  hypo

SEQ ID NO: 100693 - DNA, 30 bp, Homo sapiens
  chr9:138590884-138590914
  hypo
gggaccctcggccaccgtaggggccttggg

SEQ ID NO: 100694 - DNA, 36 bp, Homo sapiens
  chr9:138591435-138591471
  hypo
aatccgcccccatagcgcatgcgctctagccctccc

SEQ ID NO: 100695 - DNA, 30 bp, Homo sapiens; identical to SEQ ID NO: 42310
  chr9:138598276-138598306
  hypo

SEQ ID NO: 100696 - DNA, 95 bp, Homo sapiens; identical to SEQ ID NO: 3486
  chr9:138606154-138606249
  hyper

SEQ ID NO: 100697 - DNA, 242 bp, Homo sapiens
  chr9:138606523-138606765
  hyper
gggacctgctgctgggcgacccgtccttccagaacgacgacaggtagggaccgggcgcggggtgggggctggggtcgccgtcccggcgccgccgcacgcccggagctgtccgcggtgctgacggccggtcccgcgcgcccccgcagccgccggcgcccttcaacttttcccggcttctggggacgcagaagtttcggagggggtgcgggcagggggaagcatcttctcgggagggggtctcc

SEQ ID NO: 100698 - DNA, 46 bp, Homo sapiens
  chr9:138607023-138607069
  hyper
cctggtcacttattccgagtcaccgtgtccccgtcccctcaacatc

SEQ ID NO: 100699 - DNA, 30 bp, Homo sapiens
  chr9:138610744-138610774
  hypo
gcaggccgctcccagcggggatgacccagc

SEQ ID NO: 100700 - DNA, 30 bp, Homo sapiens
  chr9:138617193-138617223
  hypo
gaggccattctggaccgaggggctcagatc

SEQ ID NO: 100701 - DNA, 45 bp, Homo sapiens
  chr9:138627005-138627050
  hypo
gacaggcagccagggcgacatgcataggagcgtgtgctcagacca

SEQ ID NO: 100702 - DNA, 234 bp, Homo sapiens
  chr9:138627598-138627832
  hypo
gagcgtggacaagtccggagggctctgccacccggcactgctgaggacaggggcgcatctgacagcctcctgcctctaccgagctggcttcggggcagctgggcctcccggtgccaataccccccggctgttacctgcctgtcacctgggcgagtcacctggagccgcgtctgtgacatggaagggaacggttacaaaagccacatcatgtgagatgtgcgggcccagccaggc

SEQ ID NO: 100703 - DNA, 676 bp, Homo sapiens
  chr9:138628067-138628743
  hyper
gcaggccatcctgagcgccaggcctggtccgcaggccggctggagggccctgccctgccaagcgggactccggctcctctccagcatctgccgcccggggtgggcgcccagggccaccagccctcgcggctcctcccctccccccgtgcgcgactgtcattgttaccattgcttggcttctgccaaagcagccgcagggccaccgggtgcttgaaccttctccatggggcgtcctggcggtggtttgagccgggcagtcctccccgccctccccagccccccagccccggcacccggccgttccactgcgcggcggcgtggggagggcgcggcgcgagctgagatggttccgcccggcgccgcccccgctgcccgccgcccgccgcccgccgcgccgagcgctcccgcaggatggcgcgggccaagctgccgcgctcgccgtccgagggcaaggcgggcccggggggcgccccagccggcgccgcagcccccgaggagcctcacgggctcagcccgctgctgccggcccgcggcgggggctccgtgggcagcgacgtgggccagaggtaggggcgcgcgggcctgggaccccgcttgtcaaatcgcgcttgcatcctgctcgggctgcgctggctgggctgcacctgcgttgcctgcagcccggggaaggggggag

SEQ ID NO: 100704 - DNA, 189 bp, Homo sapiens
  chr9:138634034-138634223
  hypo
ttggggcagggctggcgggtgcctcacccgctggtctgggtgtagggcaggggagtggagacaaggggacagcctcgcagacctcggcatgaggtggagctcaccgcgctcgcttctggatgctggggaccacacatggggcctgggctggcttcgtgctgagcagggccagggcgagtgcccaaagca

SEQ ID NO: 100705 - DNA, 41 bp, Homo sapiens
  chr9:138636443-138636484
  hypo
ctcggggggctacagcgggcttcagccgtgtagggacgggg

SEQ ID NO: 100706 - DNA, 46 bp, Homo sapiens
  chr9:138637140-138637186
  hypo
tcccacctctcagggcgttccaccgagcccacgcccagctcctggg

SEQ ID NO: 100707 - DNA, 168 bp, Homo sapiens
  chr9:138637881-138638049
  hypo
ctcgtgaagacagatcgcaccagtcacctgaaatacactgcaggggaaaatggatcgttttcatctcctttttgtggtggtgctcggagaagtgggcggccacagttcattaaaaattaaaagcagaggaggcttcattaatgtctctggcatcgcaggctccagttt

SEQ ID NO: 100708 - DNA, 92 bp, Homo sapiens
  chr9:138642834-138642926
  hypo
ctgctctacattgtgcgcgtcctgctcgatgacccggccctgggcatcggatggtgggccacgtgcgcggccgggcgcggggtcccgggtcc

SEQ ID NO: 100709 - DNA, 144 bp, Homo sapiens
  chr9:138650083-138650227
  hypo
cccatgggcctcagccgagacacaggtgtggccaggtacaggctgccccgtgggcctcagccgagacgcaggtgtggccgggccgtctgctttccactgtccttctagtctctattcattggctcctggcggggtccacagtcc

SEQ ID NO: 100710 - DNA, 30 bp, Homo sapiens; identical to SEQ ID NO: 42316
  chr9:138651295-138651325
  hypo

SEQ ID NO: 100711 - DNA, 167 bp, Homo sapiens
  chr9:138651534-138651701
  hypo
atccagcacctggagcgggcgggcgagaacctgtccctcctgacctccttctacttctgcatcgtcaccttctccaccgtgggctacggtgacgtcacgcccaagatctggccatcgcagctgctggtggtcatcatgatctgcgtggccctcgtggtgctcccact

SEQ ID NO: 100712 - DNA, 30 bp, Homo sapiens
  chr9:138653799-138653829
  hypo
caaataaagcaggagcgaagcgctctctcc

SEQ ID NO: 100713 - DNA, 169 bp, Homo sapiens
  chr9:138655771-138655940
  hypo
tgacagcagagcccccgccagcaccatccgcggggaagcctctgttccggtcgccctggagtcttgagcacctcccagctgtggaaactgttttgtgtggcaaggcagtggagcctcgtcaccggaacaaagcaggcgctggataagtgcaatgcgatggtcccattta

SEQ ID NO: 100714 - DNA, 240 bp, Homo sapiens; identical to SEQ ID NO: 42319
  chr9:138659727-138659967
  hypo

SEQ ID NO: 100715 - DNA, 1191 bp, Homo sapiens
  chr9:138660771-138661962
  hypo
tcaagtttgctggtgcgtctggggcacacgtgggtgatggtgtatctggggcagggcacgtgtgcacacgtgggtgatggtgcatctggggcagggcgcatgtgcacatgtgtgacggtgcgtctggggcaggacgcgtgtgcacacgtgggtgacggtgcgtctggggcaggatgcgtgtgcacacgtgggtgtcggtgcgtctggggcagggcgcatgtgcacacgtgggtgacggtgcgtctggggcagggcgcgtgtgcacacgtgggtgacagtgcatctggggcagggcacgtgtgcacgtgtgtgtcggtgtgtctggggcagggcgcgtgtgcatgctgttgggtgatggtgcgtctggggcagggcgcgtgtgcacacgtgggtgacggtgtgtctggggcagggcgcatgtgcacgcagttaggcgagctgtgtggggcagcgggaggggctggccctggagctcctcacacaagcacaccaggaggtgctggaggggacggcagacccccatcctcaccgcatccgagaagggacctagggggtccaaactcttcagatgaagtcttatgctgggatcctggggtcagtgaaggcagggtcagaggtcaggtgggggcaggagcaccgtctgatgagcacctctatgggcagggaccatgccgggtgcccggggaacggggggcaggccccatgccaggtgcccaggggacaggggtcagggcccacatggagtgcccaaggcacaggggccagggcctgccccgccctggaactcctcgctgagctgggagagaagcacaggagcgatggaaggtccaccgaggctcagaccaagtagggggttgaggtccacagactctcggggcagagatgctgaagccggacagcagacacgggggtgccaggcaagggtgcatctgcatagcaccttcaggaagtgagcaggtactgtgggggaggagagagccggcagagcggcaggtggaccggcctcccccactgcccgcagaccacgtggtgtgtgaggaggagtgcaagtacgccatgctggcgctgaactgcatctgcccggcgacctccaccctcatcaccctgctggtgcacacgtcccgcggccagtgagtgccccgtgccccgggggaccgacctccatggcggggccggcgcagggagacaacg

SEQ ID NO: 100716 - DNA, 41 bp, Homo sapiens
  chr9:138662644-138662685
  hypo
gggagcgggacagggcgggtgagcggcggtacctgaagttg

SEQ ID NO: 100717 - DNA, 222 bp, Homo sapiens
  chr9:138666427-138666649
  hypo
tgtccatgtgtggtacgtgttgtgtgttgtgtatgttgtgtgtcgatgtgtgtgttgtgtgtctgggtgtgtggtgtgtatgttatgtgtccgtgcacgtggtgcacgtgtgcatacgcctgcatgtgttcatttctgtgcgcatgtgttgtgtgtgtgtccgggtgtgtccatttccgtgtgcctgtatggggccatgtgttatgccgagggctgaccatg

SEQ ID NO: 100718 - DNA, 127 bp, Homo sapiens
  chr9:138670651-138670778
  hypo
gtgcagaccatgttccggtgcgtccagtgtccggggctcggctctaaaccaccccacagccacgaccacgggccctcgccctgagacccccacagccacgaccacgggccctcgccctgagaccccc

SEQ ID NO: 100719 - DNA, 125 bp, Homo sapiens
  chr9:138671163-138671288
  hypo
aaccaccatgggccccgccctgagccgcctgcctcccccaggctcttccccagcctcagcatcaccacggagctcacccacccttccaacatgcgcttcatgcagttccgcgccaaggacagcta

SEQ ID NO: 100720 - DNA, 84 bp, Homo sapiens
  chr9:138675763-138675847
  hypo
tcatgcacacatgtacggtgcacacacagtgccctcgaccccgtggctgccgtgccactggagggacctcggcaccagcccatc

SEQ ID NO: 100721 - DNA, 60 bp, Homo sapiens
  chr9:138678104-138678164
  hypo
ctcccgcgctggcaccggaggcagctcccagggccgccacacgggcggcggtgaccccgc

SEQ ID NO: 100722 - DNA, 89 bp, Homo sapiens
  chr9:138678379-138678468
  hypo
ggcgcgggtgggggccggacggacggactgggccagggtcgggccacagccaagaacagtcggccacggcgtcccggggcccgggccgt

SEQ ID NO: 100723 - DNA, 30 bp, Homo sapiens
  chr9:138679557-138679587
  hypo
gtgtccccctgtccccgccttgaagcttcc

SEQ ID NO: 100724 - DNA, 97 bp, Homo sapiens
  chr9:138680008-138680105
  hypo
gtaattctgccctggcgggtgccgaccaccgcacaacggggctcgccaacccttcaccgccggcagccttgctgcgccatcccggccaggcaggtgg

SEQ ID NO: 100725 - DNA, 156 bp, Homo sapiens
  chr9:138688832-138688988
  hypo
tgctcagagagcagccggcccagcccctgcacctgcccggagcctcgctgctccacttgccctggcattcccgaaagcaggctgcaggggagccacagggcacccggggcagagtctcacggagcccccaactcacacattcgatctactgctgcg

SEQ ID NO: 100726 - DNA, 182 bp, Homo sapiens
  chr9:138743697-138743879
  hypo
ctatgcgtgtacagacgggtgttgcccaggcatactctgagaggggactcgctgggccacgagctaggcacgccctcctgtgtcacctggcaacgcccttctgcctggttgtgcctcgctccagtcccacccacagcactccacagcttgctccttcccacctgcaccgcagcatgaccgac

SEQ ID NO: 100727 - DNA, 284 bp, Homo sapiens; identical to SEQ ID NO: 42327
  chr9:138780586-138780870
  hypo

SEQ ID NO: 100728 - DNA, 30 bp, Homo sapiens; identical to SEQ ID NO: 42328
  chr9:138781904-138781934
  hypo

SEQ ID NO: 100729 - DNA, 17 bp, Homo sapiens
  chr9:138812042-138812059
  hypo
ggcgggaggattgcttt

SEQ ID NO: 100730 - DNA, 58 bp, Homo sapiens
  chr9:138813127-138813185
  hypo
ctctctcacactgctcggccagccatccggctcctgggacgggcgagcccaggacacc

SEQ ID NO: 100731 - DNA, 32 bp, Homo sapiens
  chr9:138825931-138825963
  hypo
cactgtgaaggagcacgcgttctgccagcccc

SEQ ID NO: 100732 - DNA, 323 bp, Homo sapiens
  chr9:138831815-138832138
  hypo
tgtagttagcagagccggggggcagtgcagctcccaggcttgtcttcagggagccacaggttgtgacaggtagaaacgcatcgcttatgtggacacgaggcagtcaggccaacttcagaccctttcaggtttgtcccgatgactgtgtggataagactgtctcggcagccaccgcaggtttaccccagagggccttgttacccaaagagaagtggcattagggaaaggccacgtcagtaagtgcaatctcaacggaaacaaaaatgccattgtaacctgtgaaaaaaggttttattcagattttatcttagaaaaaaaaaaat

SEQ ID NO: 100733 - DNA, 139 bp, Homo sapiens
  chr9:138851512-138851651
  hypo
ccggcccagagaagttttttaaaatacacacaactagacaagcaacaccacctggctcaaacagcctggatgcccacggagttaccggcgctggagcttagtgatgccccgatggttgttcagacggcaaaatcatgca

SEQ ID NO: 100734 - DNA, 124 bp, Homo sapiens
  chr9:138873414-138873538
  hypo
ggcgtagccctgccacgaagcctccccatgtcttgcctccagcatcacctggccgagacggacctagggcgtccttctccagcatcatctggccgagacggacctagggcgtccttctccagca

SEQ ID NO: 100735 - DNA, 30 bp, Homo sapiens
  chr9:138880956-138880986
  hypo
cggagctcagagactcggctgggcactgga

SEQ ID NO: 100736 - DNA, 51 bp, Homo sapiens
  chr9:138970797-138970848
  hypo
tcgccggcatgatgccgcgccgccgccgcccctctccgattccctaacggt

SEQ ID NO: 100737 - DNA, 30 bp, Homo sapiens
  chr9:138986039-138986069
  hyper
acgggcccaccagcacgtgggtgaaacacc

SEQ ID NO: 100738 - DNA, 61 bp, Homo sapiens
  chr9:138986272-138986333
  hyper
agaagcaggaaactccgtcggaaggcctcggtccgccctggccgtgcggggtgcgcggcgg

SEQ ID NO: 100739 - DNA, 76 bp, Homo sapiens
  chr9:138991914-138991990
  hypo
ttttaccagcggcgccgcctccataccctgcacgaggccccctttctgttttctgagtgctcgctcctttcttcca

SEQ ID NO: 100740 - DNA, 87 bp, Homo sapiens; identical to SEQ ID NO: 42332
  chr9:138994353-138994440
  hypo

SEQ ID NO: 100741 - DNA, 275 bp, Homo sapiens
  chr9:139000396-139000671
  hypo
aggcctgtcccatcccgagggaggcagatcctggctggagctggcggagacttacggccacaccctgccaaggtgtgcccactgggacccgggcccagcctgtcacggcgcctctccctgtgccatccgccagcccaggcttgattgagctccatatgaatattcatacagcattctgctgggaccgtcgttaatattctgaggaagcggcaagaatgcccgtccccatgtcgtgagccatggtcaacgtgctgctgacacgatggtggctgtgg

SEQ ID NO: 100742 - DNA, 234 bp, Homo sapiens
  chr9:139012272-139012506
  hypo
ccctcccatgtggctcgtgctgggacgccggcaccgtgagatggcgcccgtggccagatagagggtggcgtgtaaagcaggtggtcacccgtcactcgacttttcgcgtgctggtgagggtggtcgcatgtccatggatcagggctcacacctggcccatctggtggctgtgccatgggaggagcagagccacagccccgctccttgctgtgggtttcccgtgtcctccctgcc

SEQ ID NO: 100743 - DNA, 162 bp, Homo sapiens
  chr9:139024359-139024521
  hyper
ctccccttcccactgcgcccccgcgtccctgcagccaggggtgcgcgccccgccgcccagtcctgggatggagctgggaaacgcccgctgcggggtgcctgggacccccgaaggcgtcgggagttgggggcaaacggccgccgccggcccgcgtcaggcgcc

SEQ ID NO: 100744 - DNA, 186 bp, Homo sapiens
  chr9:139024749-139024935
  hyper
gctgcagagcgcggagcccgggagctcgcaccgcctgttcgtggggtccctggggtgcaggggtggaggacataggagtgtgggggtcgtgggcagacccaggcgggacgctgtgccagtgccgccccgaaggcccagtgcgcagggtcccccgcgccccagagcctgccccgcccctacgccggt

SEQ ID NO: 100745 - DNA, 175 bp, Homo sapiens
  chr9:139025288-139025463
  hyper
accgcccggcagcaccgcccccagccccgcgcccggactcctgtgccccttcccttcctcctgagacgggaagagcggccccgcggcctgggcgcgggcttttcttgcaggagcacaggcggggggtgggggacccaggccagggcgcgtgcgtgctcggcgcccactccagacg

SEQ ID NO: 100746 - DNA, 62 bp, Homo sapiens
  chr9:139025663-139025725
  hyper
gagccaggctggcaccggacgcctcccgtggagacagcgcggggtcccggttccaccaggat

SEQ ID NO: 100747 - DNA, 113 bp, Homo sapiens
  chr9:139030628-139030741
  hyper
cctgtctcccaggaacgccagcgccctctgcaggacatgtgagcctccaagtcacctcgagattaaagccccccaagcatctggaacagcagctccggcgacagcccttcatt

SEQ ID NO: 100748 - DNA, 241 bp, Homo sapiens
  chr9:139045484-139045725
  hypo
aaggggctgccagggcggggcaggctctgccacctgcgggcttcaggacctcacctctcctcctgcagtctgctcatcggtgaaatggacggaacagcagcccctgcccgaggtgtggcggtgaagcaagcagtcccatgtcggaggcttagagcggagcccagcacacaaggaagggcctgcacgggtggctaggtctggtgaggaatgaggtctccatgcaccacgtgtgttaggagag

SEQ ID NO: 100749 - DNA, 173 bp, Homo sapiens
  chr9:139047509-139047682
  hypo
agcccaggtgtcctccggcagacgggtggattaacaagcggtctaactgcgccatggggtataatttaggcttaaaaaggacgcagcgctgacacacgggaaaacacggcgagcctgggagcgtcaggccgagggcaagaagccaggcacaaagaccacgttatgggattcca

SEQ ID NO: 100750 - DNA, 30 bp, Homo sapiens
  chr9:139068966-139068996
  hypo
aggcagccccacaggcggggcctggatagt

SEQ ID NO: 100751 - DNA, 39 bp, Homo sapiens
  chr9:139069965-139070004
  hypo
gggaactgggatcagcgtggccttcgtgggcttcacaat

SEQ ID NO: 100752 - DNA, 147 bp, Homo sapiens
  chr9:139077555-139077702
  hypo
agggcctgccttcttcgcagtggccggccacgtccctgggccacccaggcggcacctgcccctcaggtgactgagccccacctccggagccagctccccaggcccactgggtgccctccctggcccgctgcccgagggtgccacagg

SEQ ID NO: 100753 - DNA, 156 bp, Homo sapiens
  chr9:139078945-139079101
  hypo
gcaggtgaacatccccgggcctgtggccttcggtaatgataaaatcaaaacagctttggctaaaattcagaacactgcattccaactaaccgttcatttcagtgacaagaaggctccttcctccgtcaaccgtgtcattgccgcacccaagaagtc

SEQ ID NO: 100754 - DNA, 805 bp, Homo sapiens
  chr9:139084546-139085351
  hyper
tgccacccccagccccgcccccgctgcaagggggatggggtcctgggcaagggtcggtcctctctggtcagcgaccccgctgcctctcgggtcgggaccccaacgagcgggaaaaaaaaaaaaagacagaacgcgtgccggggagtatgaccccggccccggctccctgcaccccgggctgcgcagagccctcgccctccgggttccctctgccagcgacgccagcagagccgggcaggtcccatctcggggtctccccgcgcccggacgacccctctcccactgcggccccggccctgcctcacccgccgccccaccagggtccgagaccgggagaccccagccgcggggggggggggacatcagccttcgacctgcccccgcacctcccgctccgcggggagactgggcgccaggaaccccgaattcggggctgacaacccgcaggcgcgcggctaaagcttccaccgtccgcgagaaggcgtctccaccctggaaggaagggggctcggacccagggaggatgaggggtccgccttctccttcccctcacctcgctgcagcccagagcccgcagacagccccgcggcccaaggtctctctccgcccgaggtctgcagctctggctgggcgtcccccggcctggcgggggtccgggtgggggccgcggcccgaagtctgattctgggttcgccctcgcgggtacggagcaggagccggaggaggtcggagcccgcgtttctgtccctggggcgcggggaggtcacagggctccccccaggcccgcgcggggcggaaccgggta

SEQ ID NO: 100755 - DNA, 456 bp, Homo sapiens
  chr9:139085372-139085828
  hyper
cgctccgatcgggaaccggaggccggcgaggtcacgcagacgcgctctccagggcaccgcgggtctcccatcgccgaggccgcctccgcaggccccgctcccctccccgcggcggccagggcggtgtcgggggcggccacgggctccgggattatcgacgcgccgccagctggagcgggcgcgggcggggtccccgcgggaacagtcggcactttattaacctgtcagcgcctaaaaggtcccgggcggcctgggggaggggccggaggccggggcggggtgggggcgcggctgggggatttgcgccccctcctcggggctgccccccgccagcccgcgctgcaccccggcggccgcgccccctccctaaattccgccttcgacctgggcccggagccgctttccccgcgggctgcccgttgcccccggagagttcggggtcgtccctccagcgcc

SEQ ID NO: 100756 - DNA, 174 bp, Homo sapiens; identical to SEQ ID NO: 32814
  chr9:139085985-139086159
  hyper

SEQ ID NO: 100757 - DNA, 531 bp, Homo sapiens
  chr9:139089100-139089631
  hyper
ccagcagccccgagccgcccacccaggggcagctccctcgtgtgaggtgcagggtggagccgggcctgggtcagaactgagcgtggtctacctcatccagccaggaggcggggctggcagggaagtcggggtaacccccgctgctccccgtggataggtcagaactgggtccgttccctgccagcaccctcatgggtgggggcccgccgggggctcccgagggcacaaggcccaagctggtgtctgggtacaccaggctggagaggaggggctgggggccagggaggctctgcggggcggcgggggatggggggacaccgtaggggctgccgggacgcagctctcggtactgctctgggcctgccaggcctccatgctccagggagaagttgcccagggctcccgagggccggcccaaggcctgggtgggttcccccaagctcccgtagaggccattggccgggcccatttccgccaaggaaggctcatctgcaacagaagcagaggctcagtcagcgcctgccctccacc

SEQ ID NO: 100758 - DNA, 147 bp, Homo sapiens; identical to SEQ ID NO: 32816
  chr9:139090405-139090552
  hyper

SEQ ID NO: 100759 - DNA, 156 bp, Homo sapiens; identical to SEQ ID NO: 10130
  chr9:139090586-139090742
  hyper

SEQ ID NO: 100760 - DNA, 454 bp, Homo sapiens; identical to SEQ ID NO: 10131
  chr9:139091071-139091525
  hyper

SEQ ID NO: 100761 - DNA, 151 bp, Homo sapiens; identical to SEQ ID NO: 32819
  chr9:139093772-139093923
  hyper

SEQ ID NO: 100762 - DNA, 178 bp, Homo sapiens; identical to SEQ ID NO: 32820
  chr9:139094021-139094199
  hyper

SEQ ID NO: 100763 - DNA, 98 bp, Homo sapiens; identical to SEQ ID NO: 32821
  chr9:139094635-139094733
  hyper

SEQ ID NO: 100764 - DNA, 117 bp, Homo sapiens; identical to SEQ ID NO: 32822
  chr9:139095014-139095131
  hyper

SEQ ID NO: 100765 - DNA, 320 bp, Homo sapiens; identical to SEQ ID NO: 32823
  chr9:139095165-139095485
  hyper

SEQ ID NO: 100766 - DNA, 637 bp, Homo sapiens
  chr9:139096558-139097195
  hyper
ggcctccactccaaccgctgtcccgcactcttgcaggccagcgtcaggccctccccgccaccctgggatctggaaactcactctctgcagtttccatctctgtgtcccgcctgcagagcggcgggactttctttgcctggccgctggccctgcacgcacccccttcctcgcgcctctgccgcccttgccgtttctgtcctcagtgtcctgctggggcttaccccgagtcccgcccaaggtgcagacggcggcggccccgggcctcgctcggtcgcgctcgagccccgtttccagcagcatcgcggccaccaggccgagtggcgcgagacgcgctcctcctaggtcagcgtcccctggagggttcggggctcccaagtcccgccgcgtcgtgcggggcagggagcccgggagccactgggcctggcgctgtccgcggtgctgaaggaggcgcccgctgcccgccccgcccgcgcgcccgcccacctcccggggcccctctcgtcgccccggtccccacccccgcctctgccccgtgtcgggcgcgcctccctccctggctgggttgggccgcactcaaggcagcccccgccctcacccctctgagacccagggtggccgtgcccgctcctccctaagc

SEQ ID NO: 100767 - DNA, 249 bp, Homo sapiens
  chr9:139100373-139100622
  hypo
cccacaaaattaccccgtgttcttcccttgttagaagagcgtttgtaaaaccaggactttgaagccaaaaggtgccatccgatgtgaaaccaggcccgcatgtttataaaatccctgatcataaatattaaagctgcaggtggcacggggcagggctgcctccaagggagcttccgccgtggctggcagcacccgggcactcacacggccgggtggtggtgcttgaccttccaccgcctggacctcacc

SEQ ID NO: 100768 - DNA, 113 bp, Homo sapiens
  chr9:139103518-139103631
  hypo
ggacagcccagagggcggacatgctccccagatgccctggtgccaggaggatgagccacggactcggccgccagggcccaaaggagcccttccaggggcgcctcccacctccc

SEQ ID NO: 100769 - DNA, 223 bp, Homo sapiens
  chr9:139111161-139111384
  hypo
cctgggctccggctgcgcttccacctgggggataagaggagacacaccaaatccacagatttacaaccagttccagttgtaataagtactatgactcatttatgtttgtggggaccttaaggcgttttgtaaagctgggttgagcatctgccaagatgagctttattctgactgcgatttccaacacgcctaagagccttcaccgacgcgcccacaatctgcc

SEQ ID NO: 100770 - DNA, 30 bp, Homo sapiens
  chr9:139114451-139114481
  hypo
ctgcgaagagctgatcgctactctggggcc

SEQ ID NO: 100771 - DNA, 55 bp, Homo sapiens
  chr9:139133128-139133183
  hypo
acctggcagctctcacgggccgtcagccccgccaaatgcccgctgacacctgcat

SEQ ID NO: 100772 - DNA, 161 bp, Homo sapiens
  chr9:139265268-139265429
  hypo
gtttcccgggggcagcgggcgcacctccagctgcaggtcacggttccgcatgagcgcggcgcccttctcctcactctggtgcgccaggcgcatggccaggtcgtagttctcctccttgcagcgcttgagctcgcggctgccggcctcgcactcctccttga

SEQ ID NO: 100773 - DNA, 90 bp, Homo sapiens
  chr9:139268822-139268912
  hypo
aactgtgcacttcagcgtgtgggctgccagagcctcatccctgcaggcttgggaacccccaggccccgcctcacccggtaaagctggttg

SEQ ID NO: 100774 - DNA, 212 bp, Homo sapiens
  chr9:139317654-139317866
  hypo
tccagaccgccctgtcgagtaaggacgggcgcctgcccaggacgtaccggctcttccggtagaaccgctccccggcctgacagacccagggagctgcagctggagcccgttcccgtgcgtgttagtttggacacgaatttagtctaaaaagctgtctggttgtataaacggtgcaaacaatgtcgccacagcacccacgcggtttgcattct

SEQ ID NO: 100775 - DNA, 40 bp, Homo sapiens
  chr9:139367918-139367958
  hypo
gaagaatcttctgcacgagcacagccggtccccgagccgc

SEQ ID NO: 100776 - DNA, 31 bp, Homo sapiens
  chr9:139375341-139375372
  hypo
aaaaaaaaaattattccgcagctctcctaga

SEQ ID NO: 100777 - DNA, 28 bp, Homo sapiens
  chr9:139375871-139375899
  hypo
gagccaccgcgcccggcccagggaattt

SEQ ID NO: 100778 - DNA, 57 bp, Homo sapiens
  chr9:139403416-139403473
  hypo
cgcactcattgacatcgtgctggcagtagctgcccgtgaagccgggtggacacaggc

SEQ ID NO: 100779 - DNA, 30 bp, Homo sapiens; identical to SEQ ID NO: 42346
  chr9:139412504-139412534
  hypo

SEQ ID NO: 100780 - DNA, 30 bp, Homo sapiens; identical to SEQ ID NO: 42347
  chr9:139419942-139419972
  hypo

SEQ ID NO: 100781 - DNA, 229 bp, Homo sapiens
  chr9:139421894-139422123
  hypo
gcacccaacagctgccgcgcccacggggatcctcagggcttccatgagtgacccgcaccccaccttccaccgtccccgcatctcctcctatcaggggcggtggggagacccctctggggctaaaaagtgaggcttgagatagggaacgccagtctcccccgactggacgagagagctgccctgtccaccaagccacccagctctcgggctcccacggaggagacccaac

SEQ ID NO: 100782 - DNA, 127 bp, Homo sapiens
  chr9:139471982-139472109
  hypo
ggacacaaaaagaggcgagactggatcagagatcccagcgagcagcgcccaggctccagggccggaggagctgcggggctcggacaaaccccaggtgctggcggcatcaccgcgggctcctttgact

SEQ ID NO: 100783 - DNA, 40 bp, Homo sapiens; identical to SEQ ID NO: 15284
  chr9:139472499-139472539
  hypo

SEQ ID NO: 100784 - DNA, 15 bp, Homo sapiens
  chr9:139482817-139482832
  hyper
cggaggagcccaggc

SEQ ID NO: 100785 - DNA, 30 bp, Homo sapiens; identical to SEQ ID NO: 42350
  chr9:139487465-139487495
  hypo

SEQ ID NO: 100786 - DNA, 2 bp, Homo sapiens
  chr9:139491047-139491049
  hypo
cc

SEQ ID NO: 100787 - DNA, 54 bp, Homo sapiens
  chr9:139491107-139491161
  hypo
cggttatgagaaacactccccgttacagcattttacgttcgcagggaaaatgcc

SEQ ID NO: 100788 - DNA, 51 bp, Homo sapiens
  chr9:139501991-139502042
  hypo
accagggaggctgtgcggggagggcccggacagtgacgcccccacggctgt

SEQ ID NO: 100789 - DNA, 30 bp, Homo sapiens; identical to SEQ ID NO: 42351
  chr9:139504374-139504404
  hypo

SEQ ID NO: 100790 - DNA, 170 bp, Homo sapiens
  chr9:139504817-139504987
  hypo
gggcggaggggagggcgacttcggtgttttccagcattattctagtggccacagcccccaggcctgtttcctctgtaaatggagatggcagcccaccccacgggcgctggaggggagctgaccctcaggccagtcaggagccctgtgacgggactcgctggagggcaccc

SEQ ID NO: 100791 - DNA, 101 bp, Homo sapiens; identical to SEQ ID NO: 42353
  chr9:139505621-139505722
  hypo

SEQ ID NO: 100792 - DNA, 76 bp, Homo sapiens; identical to SEQ ID NO: 42354
  chr9:139506440-139506516
  hypo

SEQ ID NO: 100793 - DNA, 30 bp, Homo sapiens; identical to SEQ ID NO: 42355
  chr9:139517238-139517268
  hypo

SEQ ID NO: 100794 - DNA, 33 bp, Homo sapiens
  chr9:139535581-139535614
  hypo
tgacctcatgcaatccggcgactctgctgcaga

SEQ ID NO: 100795 - DNA, 151 bp, Homo sapiens
  chr9:139546454-139546605
  hypo
ttcattcctctttacggctcagcagtgtctcactgtacggatgggccttggcttgtcaatgcactcatccgtggatgcgcatccgggtctatccacctctcggctcctgtgagcacaacgctgtgtgtacattgcgcgtctgtttgaatcc

SEQ ID NO: 100796 - DNA, 52 bp, Homo sapiens
  chr9:139560006-139560058
  hyper
gggccccaggattcccggagggggtgctggcgggccgcggctcagaggcgcg

SEQ ID NO: 100797 - DNA, 429 bp, Homo sapiens
  chr9:139606291-139606720
  hyper
agctggaagcgccggcggccgcggggagggagcgagtcttggcagctgctggctgcgccccacatccctcaccgtccaactcagcccccccaggtgtttaccgaagtgcaatgaaagcttctgttcacacggaacctgcctatggaggcggcaacggctcatccccgagcaccccacgcggaggcgaaggaagtgtcctcccggcgagtggccaaggcgcggggtctcagccaggagggaagggtcggaccccggggcgggctgcaggctcggccagcccagggctccgcgcgtctgaccccatcctgaggacccaggggaaggaccagccctggctctgcggcctcgaaccgggggcgcgcgtggggagccctgaaccccgcagcctgcgtagcgcacggggcctctctccagcgtgggaagagcccc

SEQ ID NO: 100798 - DNA, 336 bp, Homo sapiens
  chr9:139606963-139607299
  hyper
cggccgacagaaaggcgcgcgccctcgcctttaacgcgggcccgggggcgcgcggcccgcatggcgagggagcggcggccgctgcgggccgggccgggccggggctgaggccgagcgagccgcggggcccgcgcagccccggccggagcccaccatgcggcggctgcggcgcctggcgcacctggtgctcttctgccccttctccaagcgcctgcaggtaagcgcggtgcgcgcccgccgcccccggccgcctctgcctggggaggccgagctccagccccggagtgggccgagtacggagcggggccccgggttcggacacgaagggttcatgag

SEQ ID NO: 100799 - DNA, 180 bp, Homo sapiens
  chr9:139634047-139634227
  hypo
aggagacacatgagccgtgaacacgtctcccccggccgctccctggttccatgcgtgctcgtcttgggcaccacgagaacacagccatgcagcccccgatcctgcagccacagccacggcatcgcctggtcggatgcagcatctgctccggacgcctctcgctgtcggtgccaggcctgc

SEQ ID NO: 100800 - DNA, 30 bp, Homo sapiens
  chr9:139634437-139634467
  hypo
ccagaatgtcacaagcgtccatgaattcct

SEQ ID NO: 100801 - DNA, 195 bp, Homo sapiens
  chr9:139638343-139638538
  hypo
ggactgggttgggcacgcgtcttctttgcagctggctctatggttctgtggcttggcccttggtgacgacccccgccatcctccccgcaattccccggctggcccccagtcaaaagcatccttggtttgctgtggaatcgctttattctgagctggtgctgggccccgggagccgctgagcgaggtgggtggaca

SEQ ID NO: 100802 - DNA, 138 bp, Homo sapiens; identical to SEQ ID NO: 42359
  chr9:139654706-139654844
  hypo

SEQ ID NO: 100803 - DNA, 179 bp, Homo sapiens
  chr9:139662229-139662408
  hypo
tgggagatgagaacacgctcagcatcagtccatgggaagatgcaacctggaagctttttgagacccctctgtgcacctcgcagaccatggaaggcgttccacagaaacaggctcaatccctagagcctgtgagggctgggagtcagcagagctatcaccctctgcgggaagaacaagac

SEQ ID NO: 100804 - DNA, 595 bp, Homo sapiens; identical to SEQ ID NO: 42361
  chr9:139698658-139699253
  hypo

SEQ ID NO: 100805 - DNA, 30 bp, Homo sapiens
  chr9:139701246-139701276
  hypo
caagctggcgtactgcgaggggaagctcac

SEQ ID NO: 100806 - DNA, 87 bp, Homo sapiens
  chr9:139703836-139703923
  hypo
aagctgcagaccactcgggccaccctcacccagacacctttagcagtaagcaagataaaacaacttcttaaagataagtctgagcat

SEQ ID NO: 100807 - DNA, 387 bp, Homo sapiens
  chr9:139704043-139704430
  hypo
tagtgaaacaccgtctctactaaaaatacgaaaaaaaaatttaaaagaaagttgatgtccgaaccaagggccgtattggcttttcttatactctagaacatacgacgacaaagaagattttgatgaagttcaaattagagtcagcgtgctcatcagaaagaaagcgcagccaacacgtttaggaacagaaacggattatgttgaagacaaacaatccattgcgtttgtgttcagtaacccaagcatcaaaggaacttgtggctggggagaaggcttgactatttgaaatctcaggactcctctgtccaggagctcccagactcccgtggagtggaagcctgggggctcgctgaagaagtcacgtgactggaacgtgcttaatgcttg

SEQ ID NO: 100808 - DNA, 99 bp, Homo sapiens; identical to SEQ ID NO: 42364
  chr9:139705312-139705411
  hypo

SEQ ID NO: 100809 - DNA, 98 bp, Homo sapiens; identical to SEQ ID NO: 42365
  chr9:139714085-139714183
  hypo

SEQ ID NO: 100810 - DNA, 333 bp, Homo sapiens
  chr9:139717731-139718064
  hypo
gctgccccctgggcccggttcgccgttgatgctctgtgtgctgccaggtgtcctcctgatgggagaggttgccatggtacccacccatcgtcttcctcccctgcctgccggtcacctggtctgattctagcaagaaagatgaaacaggtggcagcagaaccggctctccttgtagttgctcttaaagctgcagcttgggttcggttcgtttaatttgccttttctttttctcttcccgtccccagtgaagatagtgatccggggagacaggaacacgggcaagacagcgctgtggcaccgcctgcagggccggccgttcgtggaggagtacat

SEQ ID NO: 100811 - DNA, 34 bp, Homo sapiens
  chr9:139721948-139721982
  hypo
ccagtctcaatggctcgcccggggggtgctggtt

SEQ ID NO: 100812 - DNA, 191 bp, Homo sapiens
  chr9:139734907-139735098
  hypo
ggctttcctggggggcggggccccgggcggccgccaccctgggggtggcgactacgaggagctctaggccggcgtgggcagtggccgccctggggcggggggcgtgcctgtcactgcctggggaggcatttgcctctgtaccatcgcctttgccgctgccccgtggctgccgtgtgcgcttctgagctgga

SEQ ID NO: 100813 - DNA, 36 bp, Homo sapiens
  chr9:139735532-139735568
  hypo
cagtggcctcagctgcgcccccgctcaggtgagccc

SEQ ID NO: 100814 - DNA, 80 bp, Homo sapiens; identical to SEQ ID NO: 32827
  chr9:139739053-139739133
  hyper

SEQ ID NO: 100815 - DNA, 54 bp, Homo sapiens; identical to SEQ ID NO: 32828
  chr9:139739447-139739501
  hyper

SEQ ID NO: 100816 - DNA, 83 bp, Homo sapiens
  chr9:139740567-139740650
  hyper
ggccccacctctggccgccagcggagcctagagcagctggacgagctcatcacggacctggtcatcgactcgcgacccaccgc

SEQ ID NO: 100817 - DNA, 212 bp, Homo sapiens
  chr9:139741076-139741288
  hyper
gcgcatcgcgcgtgtcggcttcctgtcgcgcggccgcggcgtgctcttcctgggcttcccaagtccaggctcggccgacaacttcctgcgctttggcctggaggggctgctgctatcccccacctacctatcgctgcgtgagctggccacacacgcggcgcccctgggcagctacgcgcgcgagctggcggccgctgggcgcctctacgaac

SEQ ID NO: 100818 - DNA, 96 bp, Homo sapiens
  chr9:139741718-139741814
  hyper
gtgcatgatcatggccgcctccgagccgcgcgcgctcgactgggtggccagcgccaacctgctggacgacatcatgtgaggcgccgggcccaccag

SEQ ID NO: 100819 - DNA, 30 bp, Homo sapiens
  chr9:139752642-139752672
  hypo
gtttgaggcagtggccgcaggcgtggcaca

SEQ ID NO: 100820 - DNA, 24 bp, Homo sapiens
  chr9:139761759-139761783
  hypo
atgaaactgcgtttcaaaaaaaaa

SEQ ID NO: 100821 - DNA, 40 bp, Homo sapiens
  chr9:139779368-139779408
  hypo
gcagccaggaggagacgccttcttacgtttgagagctcag

SEQ ID NO: 100822 - DNA, 30 bp, Homo sapiens
  chr9:139779692-139779722
  hypo
atccttgaggagtcccgtggtctcagggtc

SEQ ID NO: 100823 - DNA, 120 bp, Homo sapiens
  chr9:139782635-139782755
  hypo
tttaaagttaacttctagtatttggagggcctcatattcatggctgcatgcagatcagtgttcctgaatattactcagatgagcttttatagaagtgggttagaatcaggtgccattgac

SEQ ID NO: 100824 - DNA, 63 bp, Homo sapiens
  chr9:139793127-139793190
  hypo
ggaattgaggtgtaacgtgctgtgtgttcttccttagggctttgttcgcgggggtcacagctc

SEQ ID NO: 100825 - DNA, 104 bp, Homo sapiens; identical to SEQ ID NO: 42369
  chr9:139794879-139794983
  hypo

SEQ ID NO: 100826 - DNA, 444 bp, Homo sapiens
  chr9:139809719-139810163
  hypo
atgtgtcaggctccccgtccgcagcgccgtgcggtcgttcagaaatttgcattcccataagcattgtgggagcaccgtctcccgagacttgccagcacagtgtggtgtgaaggttggacgtgccactgtgatgtgtgagaaacacatcagtcctctgtatcgggggtccacgccgtggatccagccaaccgtaggttggaaatgttcaggtaaaaatgcactgaacacgcgcggacattttttattgacacagcgttcacgttgtattggtcatgagtcaccgagagctgatttcaggtatgagggagggtgtgcttaggctctgtgcaaacactctgccatcttccatcagggactcgagcatccttgggtttcagggaccctgagaccaacctcctatgggtggcaagggacagcagagcctcgaggcggttctgacgggcg

SEQ ID NO: 100827 - DNA, 282 bp, Homo sapiens; identical to SEQ ID NO: 42371
  chr9:139818340-139818622
  hypo

SEQ ID NO: 100828 - DNA, 206 bp, Homo sapiens
  chr9:139836762-139836968
  hypo
gcagggggacgtggccgggtcaccggcttccagcagcaggtcagggctgtcgaagcggctgcagtcggccaccatcaccgtgcggacggtgctggcattgaggttctggatcttgaacagccgcttcaccacgttgacgttctctgactccacatcctgggggcgggggcacgtgccaggtgggcgccgggcgccaggccccagga

SEQ ID NO: 100829 - DNA, 88 bp, Homo sapiens
  chr9:139856294-139856382
  hypo
tgagaaacttggccccggctcgccgattccccgagactcaccccacgtgccccatacatacaatgcggggactcggggctcctggcag

SEQ ID NO: 100830 - DNA, 30 bp, Homo sapiens
  chr9:139858592-139858622
  hypo
ggggagagggagcaccgtgcccaccctggc

SEQ ID NO: 100831 - DNA, 227 bp, Homo sapiens; identical to SEQ ID NO: 15294
  chr9:139859041-139859268
  hypo

SEQ ID NO: 100832 - DNA, 311 bp, Homo sapiens
  chr9:139872509-139872820
  hyper
gacaaacactccgtgcgcggtgggggttgggagggacgcgcaccgcacagacagccggcgacgcgcgctctcgcccgggagctgctcggggaagcgccggagcgcgggtccccgcgccgcgcgcccctccctggcgtcgaggagaaccccagcggtccgcagagctgagccgaagacccgccccgatccccgccaggaatgcgacgtcctctgccgcccgctgtatgggccaggcgctcagccagggcacagaatcgggaccgggggcggaggggccgaagctggctggtgggcggcgtgcgagggtgagg

SEQ ID NO: 100833 - DNA, 64 bp, Homo sapiens
  chr9:139879955-139880019
  hyper
cggggcagctagggacgacagcgggggtgatggggcacccgggcggatccgagccgcagcagcc

SEQ ID NO: 100834 - DNA, 15 bp, Homo sapiens
  chr9:139880323-139880338
  hyper
tagcccaggagggac

SEQ ID NO: 100835 - DNA, 55 bp, Homo sapiens
  chr9:139885973-139886028
  hypo
gcgcgggacagagagcgcagaagccttcttccctggagatcgctctgtactgtga

SEQ ID NO: 100836 - DNA, 30 bp, Homo sapiens
  chr9:139886617-139886647
  hyper
cgcctgaagcccgcgcgggtaccgggtccg

SEQ ID NO: 100837 - DNA, 340 bp, Homo sapiens
  chr9:139888764-139889104
  hypo
actggaagtgccctgcggggaggggagcgcctgccccgggacaggattgaggaatgtgccagcccccatccacctggggcaccccgccccaccccggcctgactggtttgggagcccagtccggtcctggagatccctgaggccaccggttgcaggaggcctggagtctgcgccttcttagcgtggaggatgggaccggcccgacccccggcgctcctgcccctgtggttctgggctatcgggctgagcgtcccaccctggggtttggggatgggaagtgatcccgagacctctggcccttcagatgtcaggacaccctcactcccgacaaagatgcctt

SEQ ID NO: 100838 - DNA, 61 bp, Homo sapiens
  chr9:139902974-139903035
  hypo
ggctgagcaagcagccgagaggggactgcagtgcggatggcggctccgtctcctgctgctc

SEQ ID NO: 100839 - DNA, 295 bp, Homo sapiens
  chr9:139904237-139904532
  hypo
ggtacccaatgagggcgatggccgtggagagcttccgcttgttgccgccgctgtaggtgccagccggcttgtctgcgtacttggtcagctccagcttctccagagcccacttcaccacctggccagggaacgcaggtgtcagtggaggcagggccacccagcgtgctgactccctgccccgccccacagatcctcacccgggcctcgtccttccaggagatcccacgcagccgcgtgtacagctgcaggtgctcccgggccgtgagctcgtcgaacagcgcgtcacactgcgggc

SEQ ID NO: 100840 - DNA, 39 bp, Homo sapiens
  chr9:139913362-139913401
  hypo
tgaactggatccagccgcaggccgcgttgtcaatggtat

SEQ ID NO: 100841 - DNA, 345 bp, Homo sapiens
  chr9:139915848-139916193
  hypo
gggagaccttggccacgtccagctggttccggagctcagcagacagcccagagaagcgcctggcacgcgcagcagcctgcccactgcagacagcatcccggtagccctgcagggctcccttctgactctcaggcacagtgaggatccggcccagctcccccgagcccggcgtgcaggtgagctgctccaggagggcaggagccagcagcagctcctgggatgggcacaggggtccgtggagccacggcaaggactttgtccccaaccactagggcctcaggcctcaccctgccccacccactggctggctctggggctgcctgggtcccacgacatgcctctacc

SEQ ID NO: 100842 - DNA, 154 bp, Homo sapiens
  chr9:139943348-139943502
  hyper
cccgccccgcaaggtcggccccgccccgccccgccccagcccaccttcttctggaagatcacgccgccgaaggcgcgctcgtcgaagccgtagccgcgactcagcagctgctgcacgaacatggccccggcgcagtagtcggccaggcgggccc

SEQ ID NO: 100843 - DNA, 230 bp, Homo sapiens
  chr9:139948020-139948250
  hyper
atcgctgggctatcccgggagcggggacacagcccctgggctgcgttgacggactcggcggcgggcgcggaactcccgggacttgttccttcagcaccgcgtcgccctggaagcgccaccgccccccgccccctccgcgtacccggtcggggagcgcagagcgcggaacccgggaccccacccagcccgccaggagcagagcacggtgggggtcccgggctgatcctgct

SEQ ID NO: 100844 - DNA, 124 bp, Homo sapiens
  chr9:139971509-139971633
  hyper
gcccacgccagctggcgcgacccagagggtcctgggatctctcggggcggggcgcggagtggacagggcgggcatgggcccggggcctggagaagagcaggaacggggacgggagctcgaggga

SEQ ID NO: 100845 - DNA, 119 bp, Homo sapiens
  chr9:139972624-139972743
  hyper
tgtaccagctgcaggcggagcggattcggcgggtggagcagctggccggtgagcgccacgggacccgctgcaccgtcccctggtgtgtcctgcctgccctacctcggcccggaggtacc

SEQ ID NO: 100846 - DNA, 105 bp, Homo sapiens
  chr9:139978936-139979041
  hypo
tcttaatgttctgtaggtggaatatttccaataaacacaaggtgccgtaattgactgctactctggcaagtgcagtttttgggcagtgcacgggtgttgggaaca

SEQ ID NO: 100847 - DNA, 159 bp, Homo sapiens
  chr9:140024612-140024771
  hyper
gcccagggcctcacccgggcgcggcgtcgcgggggccgagggaaggaccggaccctcccgaggtcgcggacccggccggctggggcgaggctggggtggcccctaccccgagctaagctggccgcgccgcatctcaccgtcgccggggcccgagcgctg

SEQ ID NO: 100848 - DNA, 133 bp, Homo sapiens; identical to SEQ ID NO: 32835
  chr9:140024786-140024919
  hyper

SEQ ID NO: 100849 - DNA, 134 bp, Homo sapiens; identical to SEQ ID NO: 32836
  chr9:140024956-140025090
  hyper

SEQ ID NO: 100850 - DNA, 327 bp, Homo sapiens
  chr9:140030248-140030575
  hypo
ctcacctgggagtcacgcaccattacctctaccacgttccatttgtaagtgcaggccatgtatgcctggagggaaatcaatcttctgccgaacagggtggtgttcaaagcaccaccggctccaccacactctgccttttattctgcattctgtttcttgagaccacgcgccgctacgtggaatggtctcaggagctcatgtgtttgtgctccatgaagtcagaaagtccagcctttgcactgccacatacccacccttagaacagcgtctggtacacggtaggtgctcagtgaatgtgcctagtggagtaaacgtgcggtgcggtgc

SEQ ID NO: 100851 - DNA, 103 bp, Homo sapiens
  chr9:140032848-140032951
  hyper
ctctggaaaagggggcgctgggagcgcattgcgagggggctggagagggagagaggagcggaagctgagggtgtgaaacggctggccccgaacacacctcgcg

SEQ ID NO: 100852 - DNA, 212 bp, Homo sapiens
  chr9:140033279-140033491
  hyper
acatacaagcgggcacgacgcgttcggtcctattaaaaggcacgcaagggtgcgggctgcacgcggtgacacggacccctctaacgtttccaaactgagctccctgcaggtccccgacagcacaggcccctgtcccaggacccctccaggcacgcgctcacacgcacacgcgcgctccccggctcacgcgcgctccgacacacacgctcacg

SEQ ID NO: 100853 - DNA, 9 bp, Homo sapiens
  chr9:140033618-140033627
  hyper
cgtccggac

SEQ ID NO: 100854 - DNA, 420 bp, Homo sapiens
  chr9:140033762-140034182
  hyper
cgcacgcttcagcgccccttccctcggccgacgtcccgggaccgccgctccgggggagacgtggcgtccgcagcccgcggggccgggcgagcgcaggacggcccggaagccccgcgggggatgcgccgagggccccgcgttcgcgccgcgcagagccaggcccgcggcccgagcccatgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcccaacgccatccagatggctctgtcggtgtgcgaggacc

SEQ ID NO: 100855 - DNA, 98 bp, Homo sapiens
  chr9:140041751-140041849
  hypo
ggacacgcacaggtgcgctcctcacacacacacctggacacacgctcaggtgcgctcctcatgtgcatgctcacccttacttgcgccagccagcacag

SEQ ID NO: 100856 - DNA, 132 bp, Homo sapiens
  chr9:140043219-140043351
  hypo
agagagagcacagaacgagcacaggtgagcgcgcaggctgaagacaggacaggaccggagaggcgaggccaggccaggcaaggactgaggaaggcaggcggaggcgcaggtggcaggcgcagaccatggcag

SEQ ID NO: 100857 - DNA, 23 bp, Homo sapiens
  chr9:140046638-140046661
  hypo
tgagccaccgtgcccagccactt

SEQ ID NO: 100858 - DNA, 172 bp, Homo sapiens
  chr9:140050925-140051097
  hyper
ggtaagagccagcaacggaggcctgggaggctcctgggttctgggccgcagcgcctctgcgaggtctgcaggcttcgctctaggaggggatgggggctgggcaggtccctgctccagaggaggaggacctgggcctgcggagcgccgcggtgggagtgctggagtcctggcc

SEQ ID NO: 100859 - DNA, 290 bp, Homo sapiens
  chr9:140051219-140051509
  hyper
cgccctgcgctacgccccagacggtgagtgctgggccttggcggggtccccgaacggggaggaccccacgggctctgagtcgcatgctcgcctaggcatcctcgggctgcagctcatcaacggcaagaacgagtcggcccacatcagcgacgccgtgggcgtggtggcccaggccgtgcacgagctcctcgagaaggagaacatcaccgacccgccgcggggctgcgtgggcaacaccaacatctggaagaccgggccgctcttcaagaggtgggcggggcctccccgga

SEQ ID NO: 100860 - DNA, 62 bp, Homo sapiens
  chr9:140052371-140052433
  hypo
ttcactgatgtggcccgatgggtacaatgcacacgtgcacacacagccggacaggacagcct

SEQ ID NO: 100861 - DNA, 30 bp, Homo sapiens
  chr9:140081822-140081852
  hypo
tcctggttatcaggacggctcaccagcttt

SEQ ID NO: 100862 - DNA, 30 bp, Homo sapiens
  chr9:140089410-140089440
  hypo
cccagcagagcctcccggcttctcaggacc

SEQ ID NO: 100863 - DNA, 30 bp, Homo sapiens
  chr9:140090122-140090152
  hypo
ctggggacactgacacgctccagctgggca

SEQ ID NO: 100864 - DNA, 143 bp, Homo sapiens
  chr9:140090372-140090515
  hypo
agacggggcacctgccgcttctgccaatggataacttaagtgggcctgtgcctgccaggcaggcccccaccccggcacacaggccagcagctccccactgcccagagcagggctgcacccctcggaggcgggcaagggtatca

SEQ ID NO: 100865 - DNA, 627 bp, Homo sapiens
  chr9:140107109-140107736
  hypo
gtgctggcagaggaccgagaccagcttccagggtcggcccctgcgcgcctcagggccctcgcagtggtactggcttctccacaacgctccctggtgggcaccccaggcttcacgctgcggggagggcacagaggggagcaggcagggtggcaaagggctgggctccagccacgctgacgtcacacaggcctacctggcgccggtccccacttttacaaaaaggcgtgctgtgaagtgttgacgactttgagcctggaggaggaccccgtatgctcctgccaccccagaggccacctctgccttttctcctgggcattttcacagtgctcctctgcaccctaagcaaggagtggcatgttcagtgtgcaaatggcatctttagaccccacaacggtgaaaaccccgactgtccacgtagggcccaggtccgctgagcaccgagcatcaaaagccgtttgcatagccaggtgtcagtcatttcagatgaaaaagaacgggaagatcggagacagctccccccggttctgccgggaggttttgttccgtgcgtgacgtaggtccgtgcatgacgttgtttcctgcgtgacgttgttctgtgtgggacacagtgttcgttcaagagaggga

SEQ ID NO: 100866 - DNA, 423 bp, Homo sapiens
  chr9:140108038-140108461
  hypo
ctcggcagcccctggcgtgtggaggccctgccccctcctagggtgcggccagcgtggagtgtgttttccacccgagggaggccctccccaggctccactcttcgcccgggctccactctcccgggttccactctgcctgggcaccactctccgcccgggctccagcccaggaccagcctcactgtctccacaggttcaacttcgtggccaagaagctgcaccgacggctactgcagcttgggggcagcgccctcctgcccgtgtgcctgggcgatgaccagcatgagctggggtgagtctgcgggcgtggtacccgcctccacagtctggtctggccacacgcagggtccgctcaggccagcgcacgtgctccctcccaggcccgacgctgctgtggacccctggctgcgagacttgtgggac

SEQ ID NO: 100867 - DNA, 30 bp, Homo sapiens; identical to SEQ ID NO: 42385
  chr9:140115123-140115153
  hypo

SEQ ID NO: 100868 - DNA, 186 bp, Homo sapiens
  chr9:140121048-140121234
  hypo
ggtcagtccatgggtcggacagcaggaggatacagcgcatggaactggggggaccccaggaaaggcctccaagagaaggagcgtgtcgacaagagggtggtgggtgcagcaggtgctgcaggtttcagggagtggaaggttgggacaggagagcccagacagccaggaccacgccctgcccactgg

SEQ ID NO: 100869 - DNA, 551 bp, Homo sapiens
  chr9:140127636-140128187
  hypo
cctgcccactctctgcggccacagggctttcagcggctcggcggtgcacgggatcttcaactggctcacagtgctggtcctgctgccactggagagcgccacggccctgctggagaggctaagtgagctagccctgggtgccgccagcctgacacccagggcgcaggcgcccgacatcctcaaggtgctgacgaagccgctcacacacctcatcgtgcaggtgaggacggccaccgcccccgcccagagagcctgagcaggccggatgggaggaggggaggcccgccctgccctgatggagggtcagcggagggtctgggccctgtcctgggacaggggaggagagggcagcagtgggcagggctgggctggaccccgcgggcgccagagccccgggtgagtcctgagagagggtgcagcacaccgtcacgacccctctggcccccagttggactccgacatgatcatgagcagtgccacaggcaacgccactaacagcagtctcattaagcactggtgcggcaccacggggcagccggtgaggcacccaa

SEQ ID NO: 100870 - DNA, 104 bp, Homo sapiens
  chr9:140137230-140137334
  hypo
ctcagtccaccagctcgtagaaaacacagacgagacctactgcattgataacgaagctctctacgacatttgcttcagaaccctaaagctgaccacgcccacct

SEQ ID NO: 100871 - DNA, 120 bp, Homo sapiens
  chr9:140137634-140137754
  hypo
ccatgaaggaggtggatgagcaaatgcttaatgtccaaaacaaaaacagcagctattttgttgagtggatccccaacaatgtgaaaacggctgtctgtgacatcccacctcgggggctaa

SEQ ID NO: 100872 - DNA, 37 bp, Homo sapiens
  chr9:140140229-140140266
  hypo
tgtgagcagctgccccgtggtacgcccataggtgttc

SEQ ID NO: 100873 - DNA, 89 bp, Homo sapiens
  chr9:140140759-140140848
  hypo
cagtagcctcctgcacgggaagagaactgggaggcaggtggagggctgggcttttccgggccctcattcaacctcgaggggcatggtgc

SEQ ID NO: 100874 - DNA, 124 bp, Homo sapiens
  chr9:140144101-140144225
  hypo
acatcaggaagcttccgtaaaatcccaagaggactgaggctcagggaacttctggacaggggaacacctggaggttcccagagggcggcaactagcgaggacatggaagcgccagcccctcccc

SEQ ID NO: 100875 - DNA, 123 bp, Homo sapiens
  chr9:140147052-140147175
  hypo
ggctggctgagggtccgtggggagcaccctgccctgcagcccgtctcctaccccctcgcagtggccctcgccagcccactaccagctgctcagccggcccgccttccccgccttcagcttcag

SEQ ID NO: 100876 - DNA, 71 bp, Homo sapiens
  chr9:140167020-140167091
  hypo
cgtctaagctggaggcgttgcagaaggccctggagcctacaggccaggtgggtgcccgggggggctgcatc

SEQ ID NO: 100877 - DNA, 30 bp, Homo sapiens
  chr9:140167383-140167413
  hypo
ccctccagacctgctcgggtgctggggcca

SEQ ID NO: 100878 - DNA, 30 bp, Homo sapiens
  chr9:140196166-140196196
  hyper
tgaccagcagcttcacgagctccaggttgc

SEQ ID NO: 100879 - DNA, 109 bp, Homo sapiens
  chr9:140198590-140198699
  hypo
caggtgggctcaagccgggcctggagaaggcatttggctatgctgtgggccaggagcagggcctgggagaaagtgccgtcggcatccgtggcggcggcaaacaaagggg

SEQ ID NO: 100880 - DNA, 193 bp, Homo sapiens
  chr9:140205428-140205621
  hypo
ggcccctggagcctccgggtgtggccatgttgggggcaccggccctgccccacacgctgtcttcccctgagcctttcgaaactaagaggctgcactacctgcctccagcattgcagcccccaccagttcagggccctggggctggaggtgttggacaggtggggctcttctactaggacgccaggctgggcta

SEQ ID NO: 100881 - DNA, 38 bp, Homo sapiens
  chr9:140208526-140208564
  hypo
gacctcccctagagccgcccaaccgatggtggggactg

SEQ ID NO: 100882 - DNA, 60 bp, Homo sapiens
  chr9:140211623-140211683
  hypo
tgcgggcaggggaggcggccccaggcgcgcacctgccagcccacgcggggcctctcctgt

SEQ ID NO: 100883 - DNA, 30 bp, Homo sapiens
  chr9:140216230-140216260
  hypo
gttctggaagcagcccgtaccctccaccgg

SEQ ID NO: 100884 - DNA, 95 bp, Homo sapiens
  chr9:140243648-140243743
  hypo
cccagccaggtcctccgacaggtggaagcgggcgggctctctgcacagggcttggtgcacctccagcaggcagtaggcgtcggcagctgtgtggg

SEQ ID NO: 100885 - DNA, 369 bp, Homo sapiens
  chr9:140245629-140245998
  hypo
cctgcaggcagggaccgcactgtcccctgaccccagggtgcacccagcaccctccccggggcacacggagggaagggtcaggcaggggtgcgggctgctttctttctggactgggcagggggccccagggcttcactcacccagcttggtgatagaggggtccgagaggagctgggccaccagccgggaaaaggcctgggctccctgccctgttggtggctgcgagagtgccaggacgtccagaaggaacacgtggccctccacggccacctgcaggagtgacggccgaggccggcccccagcaacaaacacaggtgtccactccacgtctacaccaaccacttggtggcactgcgggcagagaggggc

SEQ ID NO: 100886 - DNA, 30 bp, Homo sapiens
  chr9:140246519-140246549
  hypo
gcaggagtgcaccctcgtgtctggtcaggt

SEQ ID NO: 100887 - DNA, 168 bp, Homo sapiens
  chr9:140265734-140265902
  hypo
tgcattgtcctgtgccgggacatggtggcttctcagcgccatgcacccgccgcgagacgacggccccgggcgtggcaggtgacagcgccaggggtggggcccgcgcggcccacacaggggacactcctgtgagggcccggccagggcagcccccgatgcccgtgccca

SEQ ID NO: 100888 - DNA, 186 bp, Homo sapiens
  chr9:140266430-140266616
  hypo
tggccaggctcaggacgacggggctgtgatgctagacctggtcttcctcttggaaccttctgggcttaaaaatcagccttgttcacaaaggagactcagcaaaccactgtgattccaacagctccaccaattctcatccagacacctttagctgccaagcccacacttctgcgacaccacttaaga

SEQ ID NO: 100889 - DNA, 73 bp, Homo sapiens
  chr9:140267262-140267335
  hypo
gcccccacacagaggcggccctgagccaggcgcgtccttgccccaccgcccgagaagccgtttccccatgagc

SEQ ID NO: 100890 - DNA, 30 bp, Homo sapiens
  chr9:140267796-140267826
  hypo
tgggcaggtggatgccgggtccactatgct

SEQ ID NO: 100891 - DNA, 198 bp, Homo sapiens
  chr9:140274064-140274262
  hypo
aagattcacgaagcacgactgggcgctccaggccattgagtcactcattgtgaaacggctggttttatatgtcgtgcatcttaccccaataaagcattcgatgaagccgacgctccgtggctctgatttggggtgcgctctcgcccaggctggtttctgtcacccccggagttctgcagcacccgttctaaccacagc

SEQ ID NO: 100892 - DNA, 46 bp, Homo sapiens
  chr9:140274616-140274662
  hypo
tcccacccaccctgccggtccctcctcccttcgagcccttcactgg

SEQ ID NO: 100893 - DNA, 182 bp, Homo sapiens
  chr9:140325463-140325645
  hypo
caggaggagggagggcggcccccgacccttaaccagagcgaggttgttgctttgtgtccacagggaccaggagcgaaccatgatgccaggtaggaggggctgactgggccctgcgagcgcgtgcctttcctgctgggcagaggccctccacatggggccacgcgggccgggcacaggagggc

SEQ ID NO: 100894 - DNA, 30 bp, Homo sapiens; identical to SEQ ID NO: 42401
  chr9:140327964-140327994
  hypo

SEQ ID NO: 100895 - DNA, 646 bp, Homo sapiens
  chr9:140332500-140333146
  hypo
cgtgtgggaggagcccgcatcaaacacgatcccaaactggggagacagtgggatgagtgggaggcaacacctgtggacccggcccggcctcccctgccggcggggacgcaccttgatgtctgtgggcaggagcacgctggtggcctccaccaggaggagaatgagtgccgtgaggcctgagacccccgaggcccccagcagggccaagaagacctgctccttccgggacagccccatggtgcaggtggtactggttcctgtggggggacggccgtgggcacccaggctgcacttggtgtccccatcccgccctccagaggcagaggcttcgctccccgtctccctggagacgcacccctggacagccacttgccttagaggcatctccggggctcagacgcctcccgtggccatagaggcatccccggggctcagacggtctcccgtggccttagaggcatctccggggctcaggcggcctcccgtggccatagaggcatctccggggctcagacggcctcccgtggccatagaggcatccccggggctcagacggcctcccgtggccatagaggcatccccggggctcagacggtctcccgtggccatagaggcatccccggggctcagacgcctcccgtggcca

SEQ ID NO: 100896 - DNA, 48 bp, Homo sapiens; identical to SEQ ID NO: 42404
  chr9:140352105-140352153
  hypo

SEQ ID NO: 100897 - DNA, 36 bp, Homo sapiens
  chr9:140352383-140352419
  hypo
cgcgtgtgggccccccgctgccggtttcatagcagg

SEQ ID NO: 100898 - DNA, 30 bp, Homo sapiens
  chr9:140357584-140357614
  hypo
ttgctcccagttcctcgacttggcctttgt

SEQ ID NO: 100899 - DNA, 30 bp, Homo sapiens
  chr9:140379933-140379963
  hypo
caggtgaggcctcatcggagtaaacaagac

SEQ ID NO: 100900 - DNA, 68 bp, Homo sapiens; identical to SEQ ID NO: 42405
  chr9:140382557-140382625
  hypo

SEQ ID NO: 100901 - DNA, 30 bp, Homo sapiens
  chr9:140388971-140389001
  hypo
tgtgccaccctcacccgcaccaccctcacc

SEQ ID NO: 100902 - DNA, 214 bp, Homo sapiens
  chr9:140389309-140389523
  hypo
tgccctcacctgctccgtgacctcatccactccgcgccttcacctgctctgcgctctcacctgctccgcgccctcacctgctctgtgccctcacccgctccgccctcacctgttccatgccctcatccactccacaccctcatccgctccgcatcctcacccacgccatgctcacctgtgggtacctgcgcttgatggacgtgagggctcctgc

SEQ ID NO: 100903 - DNA, 481 bp, Homo sapiens
  chr9:140392377-140392858
  hypo
aaatccaggaggccacgaagtgtgtttccgagctaagctggggtggggctggggaaatccagccttccatgtgtggtttccacagtaacttccgtgtgtggtttccacggtaaccgtgctttgcccatccccagctcctgcatgccagggcagcatggatgcggagtgtgtggcacccacggcctcacctgtatattgctcgcccggcctccacctccacccagtccagggcaaagtcgatttgccgcacgaaggacgacatcctcttcaccacagtgtgcgccacacccaggacgacggtcggctgcttccgcatgattctgccgggcagcccagagtcaatcctgccccatccctccaaccctacccttcgcccagggccgcagtgctcgggaatggatgggacccacaacccccaccccacccggaaagtagagagaccactggcaggggctgggacggggcacgcaccagtcagctg

SEQ ID NO: 100904 - DNA, 88 bp, Homo sapiens
  chr9:140395491-140395579
  hypo
gaaacatttcggcagcgtctacggtttcatgatttcacgagcagtcgtggaaaatctgggttctcaagggctccgtgcagcgagccgg

SEQ ID NO: 100905 - DNA, 182 bp, Homo sapiens
  chr9:140396560-140396742
  hypo
atgccctccagggcacgaggactctggaatctgggagctcccagaggtgacccgggagtgcccaacacactggaacccagaaggcagaggttgcagtggacccggagcctgtggagaggccctggggcaaaccaagggtgagggagcgtctgcgggcaccacacccacgaaggtttgaaaca

SEQ ID NO: 100906 - DNA, 221 bp, Homo sapiens
  chr9:140396982-140397203
  hypo
ctctcaggcagaggacggccgctgacggagaggccgcatcgccccagggcgcgttgtcagcccgaggaggagccgtgggaggttcttcaggagaagaaagcggcctccctgaggaaagcagctgcactaagaaagtcagagccttcgggagatgagggggacgggggggacgcgggggacgcgggggacgcgggggacgggggggacgagagggatgtggg

SEQ ID NO: 100907 - DNA, 261 bp, Homo sapiens
  chr9:140400208-140400469
  hypo
tggactggagaagaacggagataccggcaattcgaagggatgtggttggggaacatcgcacaagggtgtggtcaggtctgaatcgcacagtgcggaaaggccggctgagcctcctgaagctgcaggtgccacatgacaccaaagccggcggcgcccccaatgcaccagcaagccacggagagggtggggccccaggcggagggtgagaatgacagccagggcctaccttgctggccacggagctcccggggtgctcgtccg

SEQ ID NO: 100908 - DNA, 30 bp, Homo sapiens
  chr9:140400875-140400905
  hypo
cctgacggctcgctgcggccaaccctgggt

SEQ ID NO: 100909 - DNA, 169 bp, Homo sapiens
  chr9:140401421-140401590
  hypo
atgccacacagatgccgcagccacatggcgctgcgggaaggaaccaggcccaggagcacagccatgtgcccctccctgggaagccagacacagagagccaggagcgctgggccttggaaaggggcgcatgtctccgaggcttacgctgagggtgcgctggtcgggtttc

SEQ ID NO: 100910 - DNA, 27 bp, Homo sapiens
  chr9:140498381-140498408
  hypo
agccaccgcgcccggtgaaacaccttc

SEQ ID NO: 100911 - DNA, 127 bp, Homo sapiens
  chr9:140507292-140507419
  hypo
agcaggggcctgggccgtcggctggctggggctcatgcagccatcccctttgcagccatccgggtgacctgcataggttcctgcggggtctccaacaaggctaatgacacagcgtgggtagtggagg

SEQ ID NO: 100912 - DNA, 74 bp, Homo sapiens
  chr9:140508476-140508550
  hypo
ccccaagcaacccaacgtggcctctgccaccaagaagttctcctacaagctggtgaagacgggcagcgtggtcc

SEQ ID NO: 100913 - DNA, 23 bp, Homo sapiens
  chr9:140511850-140511873
  hypo
accgcacccggcccagtcaacaa

SEQ ID NO: 100914 - DNA, 174 bp, Homo sapiens
  chr9:140512180-140512354
  hypo
ggagggccatgaaggcgctcgtgtctcctgcgagggctcagggtgctcggcctgtcataaatggacttaggctttgacagagcagtttagctgccctaaagaaacctgggaaggttcccttggcacttgggattgtccgtttccttttctgtctatgtgcgctgtctatgctgg

SEQ ID NO: 100915 - DNA, 19 bp, Homo sapiens
  chr9:140539579-140539598
  hypo
ctcccgaagtgctgggatt

SEQ ID NO: 100916 - DNA, 30 bp, Homo sapiens
  chr9:140582852-140582882
  hypo
tctcataccttgccacgctgctggactctt

SEQ ID NO: 100917 - DNA, 48 bp, Homo sapiens
  chr9:140615444-140615492
  hypo
cctttctcccctcctcgccggcgtcctcgccagcgttagctcttaccc

SEQ ID NO: 100918 - DNA, 285 bp, Homo sapiens
  chr9:140657710-140657995
  hypo
tcagagggttcagcacgtcccgtctctgctgcctctgggacaggaggggggatcaggcagagcacagacggaattaatgttttctgagaatttctccagttctttttaacacgatttctttcagccctcagagcctcgtgaccatggctggccatggtgagggtctgagcaggaggcttgttggcaccaggccgagaggcaccacatgcagtcacactgctcaggtgtctggctgccccgggcttgcatttgctgtggccgaagtcagcacgtggccattagtgt

SEQ ID NO: 100919 - DNA, 30 bp, Homo sapiens
  chr9:140658538-140658568
  hypo
tgagaaccactggttcgcctcctcttctcc

SEQ ID NO: 100920 - DNA, 100 bp, Homo sapiens
  chr9:140664560-140664660
  hypo
ttacaggtgtgagtcactgtgcccggcccactttatttcttcagtcttgtgtttttttctttctttctgggattccttgtacacacgttagattgtttga

SEQ ID NO: 100921 - DNA, 161 bp, Homo sapiens
  chr9:140665866-140666027
  hypo
ggtctcaaagtcctgacctcaggtgatcctcccacctcgggtttacagccgtgagccattgcgccctgctatctcccatgtctttgagcataatcgtgctagtgtctcccacaaacacttctctgtctgcacgtctctgtgctcctcggagtcctggtctt

SEQ ID NO: 100922 - DNA, 45 bp, Homo sapiens; identical to SEQ ID NO: 15313
  chr9:140680320-140680365
  hypo

SEQ ID NO: 100923 - DNA, 127 bp, Homo sapiens
  chr9:140682795-140682922
  hypo
aggctccacccgcaccgccttctgccagcgcctcagccggggtgacgctcacgcaggtgtaaggaggttgcaggtttagggatcttgtaggtgaaaggaggttgcaggcgtacggaggttgcaggtg

SEQ ID NO: 100924 - DNA, 30 bp, Homo sapiens; identical to SEQ ID NO: 42421
  chr9:140693933-140693963
  hypo

SEQ ID NO: 100925 - DNA, 390 bp, Homo sapiens
  chr9:140707510-140707900
  hypo
cgcccctgcagtgtgcgagcctcaactctcaggtgtggagcgctctgcagatgagcaaggctctgcaggactcggcccccgacaggcccagccccgtggagaggatagtgagcaggtgagcccagccccaggacggctttgtggcaaatcagcggtcagcagggctttgggaacttgcggtgaaagctgctcctgaagccgaaacatccccaggctgcagtccaaattgtcagggccaggtgtttgccagccgccccactgcacgctgtgccaccccctgggcagagcacgtcagccaccaggtgacacctgtcctttccatggcagggacatcgctcgaggctacgagcgcatccccatcccctgtgtcaacgccgtggacagcgagcc

SEQ ID NO: 100926 - DNA, 79 bp, Homo sapiens
  chr9:140708692-140708771
  hypo
cctcccacaggcactcgacatgtttctgcctgcacagccttctccctaagaggccacacactcacgtggtgcctttgag

SEQ ID NO: 100927 - DNA, 188 bp, Homo sapiens
  chr9:140708986-140709174
  hypo
tcaggtggtaagtgccgctggtccgggtctgcaaaaacagtgcaggcgtctgtgaccccagcgctgtcgtggcagcgtcgggaaggagttggaggtgagctgggtgtgacaggcaggggaggcacagcgggcaccagcacccgagtcagggtcgtgagccgaggacatggctgcggattccctggggc

SEQ ID NO: 100928 - DNA, 30 bp, Homo sapiens
  chr9:140723495-140723525
  hypo
ggcatccaggcaccacggggaggcccccgc

SEQ ID NO: 100929 - DNA, 405 bp, Homo sapiens
  chr9:140727525-140727930
  hypo
cgccgtgaaggttgacggagagctgctctcgtccacgcctttacccgcttgttggtttgggttttaacctcttgacctctgagcgtccctggctctctggttaatgttcatgctggggcaggttgtggaccaggtgtctctgccggcaggccccgccctctcggaactcggtcctggaaagccccaggtgcctccttccccgtctgcctggctgtcgtctgtggtgttgcctcttcccgtcgctgggtaacaaaccacgccacccacccgcagctcgccatggcggccacccactcggcccagtgtgcgcagcaggggttgggcgtgccgggcctcgggctgcacaggcagggtgctgctgagcccaggtccctgtggttgcgtgggcagcgtctaggttccttg

SEQ ID NO: 100930 - DNA, 97 bp, Homo sapiens
  chr9:140770013-140770110
  hypo
ctaccacaatctgtgcgatctgtgcaaggcgcagggaagtcccaagggccaggattcaccatgcctgcgtgatgccatcccccgctggcaggaacaa

SEQ ID NO: 100931 - DNA, 278 bp, Homo sapiens
  chr9:140772069-140772347
  hyper
gtgggaggcgcggggcgagggaggcgcagccggaggggccggggcggggcgggggcggccgcggggcggggccggcgcggcagggtgggcggggccggcgcggattggccgggccccgccacgtgaccggccccttatagggcgtggcgcggggccgcggagtcgggtgaggcggcggcggctgcggcggtggggccgggcgaggtccgctgcggtcccggcggctccgtggctgctccgctctgagcgcctggcgcgccccgcgccctccctgccgg

SEQ ID NO: 100932 - DNA, 37 bp, Homo sapiens
  chr9:140772557-140772594
  hyper
tgtacaaccccatcccggtcaagcagaactgcttcac

SEQ ID NO: 100933 - DNA, 759 bp, Homo sapiens
  chr9:140772756-140773515
  hyper
cgcgacctggggaggcgtcgggagacgggcgaggggggtacggagcgccccagggcccctcggagcggcgggtgcgggagcatttccgtgagtgcggcgggcgcggggcggagcccctctgctccggactcgtccctccgcacgccgggtcctggggatcctggtcggtgcacagtgcgcggctagcctggagggcaccgagggcgaagccgcgtccgtgcaggtgcgagcgctgtggggacgcggccgtgcgcgcgcctggctgcaggtgcctgcgtgtgcgggctgagctggagcctggcgctgcgcgtgcgtgcgctcgcgatgcgggctacatgcatgttcacgtgcctgtgtaggtacatgtggctgcgtgtctggagggagcagcgtgcgcctgcgcggggtctccctccagcctcgcctgggggcgctcggccccctcccctcggggccctggagtcgggcggagccgggccggaggcgctgtccgcggtgctgacggccgcccgggtgtgccgaggggctggcggcccagactgcggaggccccgcctcgcggccgcccctagggatgggggcagggagtgagggagaccaggccgcttccgccaggagaggggctccggacccagttgtctcagcccctccggagacggcctagcggtggctgctgcactgggctctgctggcgtcggcctcgtgtttccctccgtgcggcgtctgccggccagtccttaactcacgcactccattcgag

SEQ ID NO: 100934 - DNA, 18 bp, Homo sapiens
  chr9:140793805-140793823
  hypo
aagcgctgggattgggat

SEQ ID NO: 100935 - DNA, 86 bp, Homo sapiens
  chr9:140969254-140969340
  hypo
tggcttgcacagtggcggtcggttatcctgttagtctggcagccgcgctgaaggacaggcctgacccgcggcgggggttacatgct

SEQ ID NO: 100936 - DNA, 177 bp, Homo sapiens; identical to SEQ ID NO: 42427
  chr9:141022582-141022759
  hypo

SEQ ID NO: 100937 - DNA, 107 bp, Homo sapiens
  chr9:141044732-141044839
  hyper
cgggacacctggggccgccgaggcaaaggtgaggaaaaggcttcctgtctccgctgcgagtgcagcggagcgagcgcggccgcgtttcccgtcgggctgtttgtacc

SEQ ID NO: 100938 - DNA, 69 bp, Homo sapiens
  chr9:14313027-14313096
  hyper
gtgctacagtcccctcgcccaagttcactggctgtttttaaaagcttagtcccccgtaaagtcctccaa

SEQ ID NO: 100939 - DNA, 30 bp, Homo sapiens
  chr9:14315920-14315950
  hyper
agggcggggccgccccgcttccacgggtac

SEQ ID NO: 100940 - DNA, 248 bp, Homo sapiens
  chr9:14347425-14347673
  hyper
ttctcctcctgccagcgccagctggggcaaacttgagctggcaaagcgcgagaaaacttttctttggaaagtttaggtagcgcagttagtggcggaggctcagggcaagctaacagtgctggggcgggtgtggagggagtgagctgggtgcgattgggagaggggagaagggagaagggaaggagtggccagctccctaggcggttgaagatccaagtctcttcggtcaggtccgcccaaggtcccag

SEQ ID NO: 100941 - DNA, 345 bp, Homo sapiens; identical to SEQ ID NO: 3394
  chr9:14348107-14348452
  hyper

SEQ ID NO: 100942 - DNA, 30 bp, Homo sapiens
  chr9:14974087-14974117
  hypo
tgtgtacacccactgcggtatggggagtaa

SEQ ID NO: 100943 - DNA, 17 bp, Homo sapiens
  chr9:15277136-15277153
  hypo
aatttatgggctgggcg

SEQ ID NO: 100944 - DNA, 27 bp, Homo sapiens
  chr9:15488010-15488037
  hypo
agaaataaaatttatcggtttaaaagt

SEQ ID NO: 100945 - DNA, 27 bp, Homo sapiens
  chr9:15513969-15513996
  hypo
tactcaataaaaaagcgccggacgcgg

SEQ ID NO: 100946 - DNA, 29 bp, Homo sapiens
  chr9:15533122-15533151
  hypo
cccggccagaaagacgtgtttactacaaa

SEQ ID NO: 100947 - DNA, 30 bp, Homo sapiens
  chr9:16133835-16133865
  hyper
ggaggagttggtgggcgatccatgtccctg

SEQ ID NO: 100948 - DNA, 5 bp, Homo sapiens
  chr9:16154666-16154671
  hyper
ctgag

SEQ ID NO: 100949 - DNA, 26 bp, Homo sapiens
  chr9:16154745-16154771
  hyper
cggcccggggacggcagggggcggct

SEQ ID NO: 100950 - DNA, 58 bp, Homo sapiens
  chr9:16435989-16436047
  hypo
gcccagtttgggctccgaagactcagactcgttctcatagtcccgctcaggttcttgg

SEQ ID NO: 100951 - DNA, 33 bp, Homo sapiens
  chr9:16726995-16727028
  hyper
ggcctcgcgctaccacgtcggctttcccagcag

SEQ ID NO: 100952 - DNA, 30 bp, Homo sapiens
  chr9:16727304-16727334
  hyper
cttctcaggtctgaacgaagctgcctccag

SEQ ID NO: 100953 - DNA, 120 bp, Homo sapiens
  chr9:16813180-16813300
  hypo
gagactccgtctcaaaaagaagaaaaactcctaaaggtctatatacccacaacattaccataacggaagcaagcagaaaaaccattttttttttttgttttgagacggagtctggctctg

SEQ ID NO: 100954 - DNA, 349 bp, Homo sapiens
  chr9:16869976-16870325
  hyper
cacttcgaaaagagccgtctctgcaaggttgattttcctgccctgcgttctgcaccttctccgtaaagcctgcgggagcatttcctcccatctccatttaccacgggaagattccgaatgtgaagacaaggggagaggaagagtcaacgtgccgggcccgggcggctgcgccccagcgcacccggcacccacgcccagccgccggtccctcactcggcggcaagttgtaaaagttcccgtaggtcccagccgccttcctctcttccccgagctcctgccagcgctccattcatcccccactcccctccacctcgtccccccagcccgtccccaacgccctggagcctcc

SEQ ID NO: 100955 - DNA, 566 bp, Homo sapiens
  chr9:16870633-16871199
  hyper
aacttcttaccatctcggcatgctggttgtcaagtgcagcccccgcctcttggtctcctcttagcggccgcgcctggaccagcccctcggccgccgctggctccctccgtctcggcctttctctccctccccctccgagttcctccgggcctccgctctcgccgcctccgcctccccgcccgcccgcgcgcgccctcgccgcggcccctctgcgctcaggtgactgatttacactcgcgccggggtcgcgctcgcgccccgagtcccagccggcacggttccccggctcctcctcgggacaaaaaaaaaaaaaaagggaacggcttgtcccgggagggggctgccctgctcgcgggaggcgggggaccggcgggcgaggtgacctcggcggccgtgcaagccccacaagtttttcctctctctgcagaattgtcgtgactacaatgttgcttcccttttgcaaaataaaagtcggtcgttgtgttgtttgtcctcagaggtccaggggcttggggaaggaggatgtatgtttctccctccccccaccgccccgtgacttctttggg

SEQ ID NO: 100956 - DNA, 684 bp, Homo sapiens
  chr9:16871415-16872099
  hyper
acgccgaggaaagggcgcgaactttattccgactgcagcaaaccgcggcagctctttccttttcgggcactcgggcgtctctgtcccctttgaccagttcctcctccccagccccgcacgccccctcctcccctgccccttccccagcgtcccagccgcggccgacccggctccccgcgaccctctcagcccagctcctccgcgcgccgctggggagaaggcgagtgaggcggaggaaaacccagcggacagaaacctgggacgcgaacgtgctgggagaaaaggccaaaagttgcgcgcagctgggggaaaaaagtttttctggtggcggagcgttttgtgccggcccagacgccggcttgcggcgagggcttccttccctttcccgtggtctgggccgcgggcctcgggctggagaggaaggaggctgtcgcgcccgcgggggaaagaacagtcacatctgtgggtgacactcagccgacccaagtcaccctgccctggagactcagaaacgccgactacagcctaagcgcgcacacgcctgcagctgaacgatatttcttaaatacaggcaaaacacactccccggccgcaagaatggggcgggggtggggggggagcttaatcatcatcatctaactaacgtacactttgtgccaaaaacatctccgagttatgcagatt

SEQ ID NO: 100957 - DNA, 30 bp, Homo sapiens
  chr9:16933048-16933078
  hypo
tcattagaatttgtgcgtacttggcaagaa

SEQ ID NO: 100958 - DNA, 38 bp, Homo sapiens
  chr9:16964538-16964576
  hypo
cagctgcatctaggccgggcacggtggctcacgcctgt

SEQ ID NO: 100959 - DNA, 739 bp, Homo sapiens
  chr9:17135031-17135770
  hyper
acagggaacttgacccgttagcagccgcagccatggcggcgcgttcgcctccctcaccgcacccttcgcccccagcgcgacagctgggccccaggtccccacgtgttgggcggggagctgaagtacacgcaatgcgcagcgaggcctcgggttttgccggcgcagcgcgggaggtggtcgcggacgaaagtgataaaatctgggtgggtgaagaagggtcagggggccggcgagggcctgggggggcagctccggctcatgctcccctcctcagcgcgcccatggggtccagacggctagagggcatctcggtagaggaggcgatggtgacccggacgcagctgctggaggaagagctgagcagcctaaaggaggagttggccctgtgtcaggtatcgaggagtctcgcagtccccctttccccaccacagcggggccgggacccgtggggaggcgcgcctttctccctctgccttgggacctaccccgcccagcgacgctccctggcagatgcacaccctgcttcgctcgcggccgggggctggagggacgcggctgcgcccggctccccaaacccgggcccctgcccctttccgaactgcggccagacaggcttcgcctccgcgcccgggtttggttttggtcacttggatactcgcagtcgcatcctctccgcttcccccccaagcccaagttcttggtggtgacggtagctgatacctgccgggggcccaggagt

SEQ ID NO: 100960 - DNA, 586 bp, Homo sapiens; identical to SEQ ID NO: 32391
  chr9:17578706-17579292
  hyper

SEQ ID NO: 100961 - DNA, 346 bp, Homo sapiens
  chr9:17579402-17579748
  hyper
ggccgcgccccgcctcgcaagccaaggcggcggctcggggcatccccggtctgggcgtccaccctcggtcccccgcccccggcttggtgcgcgctgccttcccgcgggtccccggcgtcctgcctggtagcgctgctcgccgcccccgcatcatctcgcgcccgtgctgcaggaaggggaccgcggctgcactgctgccgcggcgcgcaggtgccttggcggcgcggtgggagattatgtaaagtcgcctcttcacgggtgaccttgcggagtcggtgcacccggctttcccgggatgtgttggcatgagcggtggccgcactgggggtggcggggcggaggccgg

SEQ ID NO: 100962 - DNA, 375 bp, Homo sapiens
  chr9:17906058-17906433
  hyper
gaaaagctccatgagcgcccaggggacaagtccccacggacaaacatgtcataacgatttcagttttgtcccattacgtgaggttgtaagtttcttcatcattcccccctcccaacaagcacaaaatcgtccccagcccctggagcatcttgcggggctcccaggtcagcaacagcactcggagctccgagctccagggaaagcgctcagggaatggctcctaggactggttcctgggaaagcgccagcgtccagggagagatttccttctccaagggccggcagggtggcattccaagcgcgagcaaggtgggcagtgagcgatcctccctttaaaaaagaataaataaatagaagccagcgcgcagccccgct

SEQ ID NO: 100963 - DNA, 266 bp, Homo sapiens
  chr9:17906460-17906726
  hyper
cgctgccggggcggctggatgtctgcgctccccgcctccgctgggctgacacgggaggggaggagcaggagctggaggggtgttgggggtggggggagcgcgaaccatctcgagccaagacaagcagcacattcacaaataacgcccccacccccagcgcacgcgctcccattcaaagcagacccgctccgcggccgcactgaagctccaaagccgcgccgcctgccccagcgcagctctgtctcgtggggcgcacgcccgagccc

SEQ ID NO: 100964 - DNA, 388 bp, Homo sapiens
  chr9:17906983-17907371
  hyper
cgaaaagcgctacagcgtgggaggtgctctcttccgcgaaggtccatcctggggctgcgctgccgcccaggctggggacaagtggcgcggggttggggctaaggcgtaccctggggtcgatcgggtcgatctctgcgtttaggcttgacccagcttcctgggaccctgtcctggcttttcgcccttacctgggtcctgcttccagccaggcagagccggggcgagaaggcggcgcctgagctggggagctgtcatccccaacagtcctctaccccccaccctttccgacagtccttcgcggagccccctctctcgttccaggctgaggcttgggcggcgccggggacactcgggtgctgggacactcctccacacttccgcccttctg

SEQ ID NO: 100965 - DNA, 111 bp, Homo sapiens
  chr9:17907450-17907561
  hyper
cggacgccggaccaggtgggctccctggtgcctccgcggtctagaggtggctctggtgggtgggtgcccgaggattggccctgaccataccccctccgaatcctcccaggg

SEQ ID NO: 100966 - DNA, 130 bp, Homo sapiens; identical to SEQ ID NO: 32399
  chr9:19127231-19127361
  hyper

SEQ ID NO: 100967 - DNA, 30 bp, Homo sapiens
  chr9:19374806-19374836
  hypo
agccataccactgctcgccatccggggcgt

SEQ ID NO: 100968 - DNA, 30 bp, Homo sapiens
  chr9:19780077-19780107
  hypo
ccaaaaacaaacaaacggacaaaaaacaca

SEQ ID NO: 100969 - DNA, 702 bp, Homo sapiens
  chr9:19788200-19788902
  hyper
actcctgagataacccgaccccatcacggagattcccaggtggctgcgaacgtcaacgcttagcaggaacgattaagcgattcacagcactcaggggattgtgtaaatgcccggcccgggcgaccagcagggacagattcaactccccgggcgcaaagtcatctccagcccgatcctcgctccccctgaaaacccaccgctcgtctccccgggagctgcctccgtaggagaatgttcgcccccagccgcgccccaactttgccttgcgtggtcccaaactttccctggtggattaataggaaaataaatctaaaggacagacgccccacctgtgagcttggagctgggttgcatttggtgaggcgcttggcccgcatccccctgagtcgtttgtaggtggctggggaatggaagcgcccctctgcgcgtctcccccgacggcaggccctgccccacgccccccatcccaagccaaaagcaagggtaggagaggcgggggctccaaatccacgccccggagcacagagagttggctaactcctagcggggcctggggcgcccacatccacggcagagccacctgtgagcctgcagagcagcaacgggatgcgcgcaaccgggatgcggggacgaccgccacagcggctacagcggcaggcggggcgcagccgcccgcacttaccaggataagatgggaggacg

SEQ ID NO: 100970 - DNA, 367 bp, Homo sapiens; identical to SEQ ID NO: 32401
  chr9:19788934-19789301
  hyper

SEQ ID NO: 100971 - DNA, 41 bp, Homo sapiens
  chr9:20620713-20620754
  hyper
tatgttactgtgctccggaccgcgtacgaacaccatccagt

SEQ ID NO: 100972 - DNA, 424 bp, Homo sapiens; identical to SEQ ID NO: 32402
  chr9:21031412-21031836
  hyper

SEQ ID NO: 100973 - DNA, 328 bp, Homo sapiens
  chr9:21395999-21396327
  hyper
ctctaacactgactacggcacgatctgattttgagccgtcagtcccctcaatacactggcacattggtaaaacggtctcgctaaaatgttccatgagaaaaatgtctcgggggaggcggcggtagagctctccctctgtagtcagagccgtgaaaggcggcgtttactcgctgctcacgaggcctgcggaccctaatccccaagcgcccgggcctccactctgcggaccccaagcgcgggtctccttgaggaaggggcgaccgcgggttagggtcgctggtgggtccgttaccgctggtccggcgccctctgtcggctgtttgtaaca

SEQ ID NO: 100974 - DNA, 706 bp, Homo sapiens
  chr9:21402440-21403146
  hyper
tttcagcgacactggcgtctgaagctgaaagcttagctcctggcacaccctggggcaggcacgggcgcctctctgctcctggcccggtgcgcggcgtccccagccccgggcgctcccaggacccgtccgctcgccccagggtccagcgtgtccccttccccaagacgtccccgccctgcgcccccacacaaacggaatccccaagattaaacccgtgcgatctcgagccctcaagtcccggaatcaacgggtccctctgtaaaaacaagtctcgctgaagtctctatgggaaataaaagccccaaacccaggggaaaatcccgaaaataaaaggtgccctgctggctacctgaggaagatgtctcaagggagaccacggcggagctgcctcctgagcagcaaaagagatttttttactcaggtcgaagctgcacaaagttggcgcgataagccgcgacgacgtttccctggggctgcgggacgccccgaaactcaaacccgcggttcccaaatcctgggcatcaggaaaacccattctggcgccttgctgcggccgtggtgcgcagcgctgggagctttgcgctctttgcgcagcgggcccgcgccccttcgaggccggctagtgaatctctgaaatcacagtggcctacacctccctggtaatggcgggagtcatcatgctcatctccagcgctgcctgctcact

SEQ ID NO: 100975 - DNA, 697 bp, Homo sapiens
  chr9:214651-215348
  hyper
ccttcggccggaggtcggcggccccgggcagagcgcgccgtctgccccagtatcgggaggccagttccgcgctgggcccacgccctcctcgcccgccgctgcctgcgcgccaggccgggtggcggagccggccgtcgctgctccgagctcggaccctcccccggggtgatttcggcttagaaggtggaaatgcggaagtttccagcgccgaccgacagacgaggtttgcgcttggctgggcatgttccgcggctactctgcggcgcgccaggcccccgctttccgcaccccgcgaccctagaagccaccgaaccgccggcgggccatggccactctgccgagcgcagagcgccgcgcgttcgcgctcaagatcaacaggtaagacgccccccgcggcgcgcaggttgcggccggacagcccagcgctggtgtgaagcggagcttcgctgcaggggccgaggccggacgagtccattcgcgtccgcggcggggcgcgcctgagacctggggcgcccggttcccgaggctgcggcggtggagccgctggacgcgcggcggctcctgcgctgggcccggcgaggtcctccccaagaatctcggtgctcctggatgtcctcagccgccggggatcccttccccgaacaacctcgcccgctccgccctccaggttcttacaggtggccgggtcccagaaggg

SEQ ID NO: 100976 - DNA, 97 bp, Homo sapiens
  chr9:21559247-21559344
  hyper
ttggacaagaggaggcggcggttccgcgaagagccaagggcggccggcgctccgggatgcgccggaccccgcggcgcatcctcgtttgggcgccaac

SEQ ID NO: 100977 - DNA, 343 bp, Homo sapiens
  chr9:21559775-21560118
  hyper
cccgagaggggcgcgcgggagtggacgttcccgcaccttcgccccatccacacctgccgccgccgccggggccgccagcgccgtggctccgccccggctccgcccctcgccgcccccggctcccgctccagccgccgccgcgaccgccgcggaaaggagggggagggaagaggcgcctggacggggctgcgggagcggccgtgctgagcctcctcccttgggcccggacgggacccaggtttctccactgcaacgcagctcccgagtgacggaattttgtgggggaagcggcggccactacgctcgcttttggcacagtagccctttgcgggtgggagcttct

SEQ ID NO: 100978 - DNA, 143 bp, Homo sapiens
  chr9:2178015-2178158
  hypo
gaggaaaaaaaaaaacggttcccagatgaagcataacaaattaaatctcagtagtgtgtgtatataagccatgcatacaaggagttcaaactaccacttgcacagtggtatgtggctcttttccatctcgtactctatggtct

SEQ ID NO: 100979 - DNA, 514 bp, Homo sapiens
  chr9:21964911-21965425
  hyper
tttctgctatttcctgaactttattacgtaaatgagacacgtgagatctggaaggaggtggaggtgaagaccctcccacctggcctgcatccagagtacttggggtgtggcactggcgtgggccccaggaaggatcccagccagttttggtgctggaggcccggccaaaggaagggctgctctcccgtcccgcgggctccgaggtcgccgcacccgggcgcgcctgggcctcgtcacccgcgctcgtgacgcgtgcttacaaaggaaacttttacaggtttcggtgggcagggccttttattgcccttctgctccacagcccccgtgcttaatcggttggttgggaggtttctttcgtccgtggttttggaaagtccccgcctccaaaccgcagtcccgcagtcagttctgcagcctcagggcctcgaacagccatgcttagaatccgtccttctttcctgctccatctacccttcccctctggcttcttttttttcactggagaaagcccacc

SEQ ID NO: 100980 - DNA, 217 bp, Homo sapiens
  chr9:21965569-21965786
  hyper
cgcgtgggctttaacagcagatctccataaaagggtcccggagatagcctctgcctggcccgaggcccagtgcctcaaagcggacgcctttgcgctcccggaggtgctcacaccacagcggagcctgctggcgagtggagcgtaggactgcgaaccagcaatctcccgagaagcggcgagggggaggggaatgtctgtgaatcggttatccctccca

SEQ ID NO: 100981 - DNA, 42 bp, Homo sapiens
  chr9:21967367-21967409
  hyper
gcggggactgggagccgagtcggattccgagactatgggcca

SEQ ID NO: 100982 - DNA, 275 bp, Homo sapiens
  chr9:21968159-21968434
  hyper
gccctgtaggaccttcggtgactgatgatctaagtttcccgaggtttctcagagcctctctggttctttcaatcggggatgtctgcagagggcagaaagaaaacaggcgttagaaacctgaggtcaaagatgtgtggcacatcccgccctcctctcttgccgtccctaccggcattgaaatacttatggataaagttctcgcaatggcttcacgtgcatgtacccgccgccaccgctctcccacacctccctggtccagcagctagtccactgcc

SEQ ID NO: 100983 - DNA, 272 bp, Homo sapiens
  chr9:21968456-21968728
  hyper
cgaccgctcaagcgctccaggtccacccggcggagggcagagaaagcgcgaccgcgcggcccgcagggttgcaagaagaaaacgagtgttatataatgagtctcagtggttgctcacaatgccaggcgcgaaggcgtgaagatgtggcctttcccttcccgcatccccaggcatcttttgcacctggtgcggagtgagccagccagcttgcgataaccaaagggcgcctcaggctctggcgctcctcggcggaatcccgtagcttccctacg

SEQ ID NO: 100984 - DNA, 92 bp, Homo sapiens; identical to SEQ ID NO: 32411
  chr9:21969169-21969261
  hyper

SEQ ID NO: 100985 - DNA, 141 bp, Homo sapiens; identical to SEQ ID NO: 32412
  chr9:21969747-21969888
  hyper

SEQ ID NO: 100986 - DNA, 215 bp, Homo sapiens
  chr9:21970940-21971155
  hyper
gcctctggtgccccccgcagccgcgcgcaggtaccgtgcgacatcgcgatggcccagctcctcagccaggtccacgggcagacggccccaggcatcgcgcacgtccagccgcgccccggcccggtgcagcaccaccagcgtgtccaggaagccctcccgggcagcgtcgtgcacgggtcgggtgagagtggcggggtcggcgcagttgggctccg

SEQ ID NO: 100987 - DNA, 215 bp, Homo sapiens; identical to SEQ ID NO: 100986
  chr9:21970940-21971155
  hypo

SEQ ID NO: 100988 - DNA, 19 bp, Homo sapiens
  chr9:21971184-21971203
  hyper
cgggcgctgcccatcatca

SEQ ID NO: 100989 - DNA, 19 bp, Homo sapiens
  chr9:21971184-21971203
  hypo
cgggcgctgcccatcatca

SEQ ID NO: 100990 - DNA, 936 bp, Homo sapiens; identical to SEQ ID NO: 32414
  chr9:21974181-21975117
  hyper

SEQ ID NO: 100991 - DNA, 505 bp, Homo sapiens
  chr9:21975190-21975695
  hyper
cgccctccggcctccctgctcccagccgcgctcccccgcctgccagcaaaggcgtgtttgagtgcgttcactctgttaaaaagaaatccgcccccgccccgtttccttcctccgcgatacaaccttcctaactgccaaattgaatcggggtgtttggtgtcatagggaaagtatggcttcttcttttaatcataagaaaaagcaaaactattctttcctagttgtgagagccccaccgagaatcgaaatcacctgtacgactagaaagtgtccccctaccccctcaacccttgattttcaggagcgcggggttcactaagtcagaaaccctagttcaaaggattccttttggagagtcggactgctctctccttcccctccccttcccctcctgcgtgtaaaacggctgtctggggcaagggtttctcagacgtgtacattgcctggtataagagcagactctgaaaagatgaggtttatttaatacggacgggggagaattctg

SEQ ID NO: 100992 - DNA, 94 bp, Homo sapiens
  chr9:22006059-22006153
  hyper
gacgaccccaggcatcgcgcacgtccagccgcgccccggcccggtgcagcaccaccagcgtgtccaggaagccctcccgggcagcatcatgcac

SEQ ID NO: 100993 - DNA, 114 bp, Homo sapiens
  chr9:22010993-22011107
  hyper
actgagaatcttgcacgaggcagatgtgtgagcttcgcgaagcaagttgactgaatgaaaaacaactttgggtagggaaaacgttgccgggggcattcgcgcttactagcacca

SEQ ID NO: 100994 - DNA, 351 bp, Homo sapiens; identical to SEQ ID NO: 32417
  chr9:22446925-22447276
  hyper

SEQ ID NO: 100995 - DNA, 207 bp, Homo sapiens
  chr9:22447488-22447695
  hyper
tgcgcaggcagcaggcgcaggaggagagcgaagcccgggggctacagaggctcctgtgctcggggctctcctggccccccggtggtcgggcatccgggggcggcggcagagccgagaatccacagtccacgggcggccctgcggcgggggctgcgctgggactgggtgccttgagacaggccagtggttccgcgacccccgctttcg

SEQ ID NO: 100996 - DNA, 611 bp, Homo sapiens
  chr9:23821051-23821662
  hyper
cgcgcgcgaaggcgccgtagcaagtgggcacacaccagacaccaccccggcgtgttccgcgggagaagccagtgcacacatcctcccgcaaggcggggttgccagtgcaacacaggaatcctgccctttttctagaaaagccccctcccccactttccctccaatacactcacctgcgtctcaacagtttccttcttgcgctacacgcggccgcacccgggcacgtccacgcccgtgcacgctgccaggcgcgactgtccccgctcggctcccgccgcccccaacctgcttgtgcccacgggaggggcggtgccacctcccgaggcgcccaattctctctactcccgccgcaacgggctgagctctaggaacttcgcgggcacaacctccgccgcccccaccagtgttcccgcccagagttcggactagggcgcaccacccctaccctgctagacgcagcgggggcgcgcacagaccttagcctcggcgtccaaaatggaccaggggcaaggcgcggacgccgtccccgcccccacgcccccagcacttgcctgctgtgactcgaagctgcagctactacggctcgtgccgctggccgtcagcactgccgc

SEQ ID NO: 100997 - DNA, 527 bp, Homo sapiens
  chr9:23822112-23822639
  hyper
tcccgaggcccggggcgctaacggggagtcagagcagctaacgtgggggttactttatgtgttcataaatgtatttataaatatatataagtatacacacatatgtgtgtctcttttaaaaattctctttttccccctacttcgcagccaaggggtcctgtccctggacagaaaataaaggcttagccccctgctgcccctccctgcctctctagagagaacctgacgtttaaataagcccagagtacctgtgcggggtgctgtactctgcttcaaacgcaaagtaggaaatcctgcactcgactatgcaaacgcttgccgctagccgcatccttctatcgccccccaactcaagacccgaaatggccaactcttcaccgagggggcgtcccatcgctgccttgccttggcccgccccttcgccaagctcaatcccttttccccagaaaaacctgtgcctgtcctcagacccggccccacggctggaagtcaaaacccaccccggagccacgcggctggagcacgtt

SEQ ID NO: 100998 - DNA, 579 bp, Homo sapiens; identical to SEQ ID NO: 32421
  chr9:23824012-23824591
  hyper

SEQ ID NO: 100999 - DNA, 223 bp, Homo sapiens
  chr9:23824795-23825018
  hyper
ccatctttctcctggcgtcaatttaacaatagctattcgaggaagtgggggcggtaaggagggggtgagggctacgtggccgagttggctcctggggtggctgcgaagcctcgcggctgcagaggggttccccctctccccgaaggcgaagtcagccgcgtaggaccaaggacagggcttggaatccacttcccagcgcccagcacagcgaggctcccaagca

SEQ ID NO: 101000 - DNA, 338 bp, Homo sapiens
  chr9:23825602-23825940
  hyper
tacgaatattcagtacgctaagcatgcgtccaccgtcttttagtctagctctttaaaattaaaaaagcagaacagtagctttgaaatgagacaaacatgtgcaattaacttcatattctgtattccgctcacttacaggttttctgggtttgccagcgcatcgctgcaactaatgattaaagaaaccaaaccgaaacttacctttctcccttaaggtttttgtgtatgtgtgtttttaaagtaacggtgcagttctcccaataaggatgagcaagaagctgctggatagttctcttaagacagcacgaaacctaaactgtgctcggcttaaaagaagc

SEQ ID NO: 101001 - DNA, 182 bp, Homo sapiens
  chr9:23826293-23826475
  hyper
ctgcctccgcactgccgtgtgtgcagctgctctgccaggctcctatcccgggcagcacgcgcggaagtatacgccgaatcgcgccacaacgtaacttgctcatcgccccaggatcctgattggtccacacgcttccattgaggccgcccaggcggggccgcgtgagacgattggctatgggc

SEQ ID NO: 101002 - DNA, 40 bp, Homo sapiens; identical to SEQ ID NO: 32423
  chr9:23829874-23829914
  hyper

SEQ ID NO: 101003 - DNA, 30 bp, Homo sapiens; identical to SEQ ID NO: 32424
  chr9:23830739-23830769
  hyper

SEQ ID NO: 101004 - DNA, 271 bp, Homo sapiens
  chr9:23831100-23831371
  hyper
ctctggcccctttaccgggacctgggaagaaacggtttttatgcttccgatgctcggaggctctttcttatattgaagatttatgtttccacttgtgtgcgatgcacgtctaatttgaaataataaaaccgggctgagcaaccagtcaatcagagccatccagggcgctccgcacgccgccctgccccccacctccctccggtctctaactctttccctcctcctccccctctcactctcctggccctccccgtcttccttcctccctcct

SEQ ID NO: 101005 - DNA, 34 bp, Homo sapiens
  chr9:23831450-23831484
  hyper
cgggccacggtgacaaaggcggagtttgtatcag

SEQ ID NO: 101006 - DNA, 30 bp, Homo sapiens; identical to SEQ ID NO: 32427
  chr9:23831747-23831777
  hyper

SEQ ID NO: 101007 - DNA, 58 bp, Homo sapiens
  chr9:23849841-23849899
  hyper
aaaccacccacagaccgagcagacgagaagaaatggtaattttcggtttaaaagttca

SEQ ID NO: 101008 - DNA, 117 bp, Homo sapiens
  chr9:23850410-23850527
  hyper
ggttggctgctgctgcgaggctgctgcagccgaggctcccgcgagcagctgctaggatccttgccgtctcgttcctgcctctttcgagctgcacaatagccccggctgggtgcacct

SEQ ID NO: 101009 - DNA, 384 bp, Homo sapiens
  chr9:23850798-23851182
  hyper
ctctctcctatctctcgtctctgtcccctgtcactcgcgcgcacacacacacacacgcacacacactttcctccctcttcccccacctccctatgccattttctgcagtcagcgttcaaaaaaagtacgaaaaccatcgggtaatttccaactgaaccgattacggacggcgaatttatccaaacacttaagcaaggagaggatcctaaaatcgaaaaacgaaggcggaaggggcgagaagaacggggtggagttgggtggcggagcgagtgggacgttaactggccaatagtttgcaactgccggtcaacacgcgcagcctactcagcgctgctccggaggcgcgggacgccgcctccacgtgagccgcgctcctcccagtgc

SEQ ID NO: 101010 - DNA, 74 bp, Homo sapiens
  chr9:25678053-25678127
  hyper
agccgcgcgttctgccggtcccactcgtcccgcgcacggatggcctccaagtggctcgccgccaggtcggcaaa

SEQ ID NO: 101011 - DNA, 24 bp, Homo sapiens
  chr9:258867-258891
  hypo
gattacgggcgtgagccaccatat

SEQ ID NO: 101012 - DNA, 433 bp, Homo sapiens
  chr9:2621293-2621726
  hyper
taccccccaggtgcacgccccgtcagtggggaggcggtggcaacagcaacgatagttgcatcagcgctaactgctgctgctgctgcgtgttctgccggaggctgccgggagggtacagtaatgactgtagggagcgcacagccgctgcggcggcaggttccctggatcaggaaattaggacaggcacccgggattggaggcgagggcggcgcgcgagccaaccagcggtcgccccgggcccccgtgagccccaggcgaacgcgcggagcagccgggcccctagagcggtccgggtggcggcggcggcagccacgaccacgaccgcggtcactcacgcacgctcacactcgcacgctccccgcgcgggcacccggctgcccggcgcgtgcaagaggagcgcgtcgagggaaaggagggccgaagccgccgcgct

SEQ ID NO: 101013 - DNA, 60 bp, Homo sapiens
  chr9:2622196-2622256
  hyper
cgtccgcgctctgggcgctctggctgctgctcgcgctgtgctgggcgccccgggagagcg

SEQ ID NO: 101014 - DNA, 80 bp, Homo sapiens
  chr9:2622942-2623022
  hyper
cctctcccttttccccgcctcgggcggcgtttggaaaccgctcgggtctcccgtgtagctgaacgcggagggggagtgga

SEQ ID NO: 101015 - DNA, 43 bp, Homo sapiens
  chr9:2623460-2623503
  hyper
cttcaggggccctgccggcctgcagtcacgtgctcctgaagtg

SEQ ID NO: 101016 - DNA, 19 bp, Homo sapiens
  chr9:26796964-26796983
  hypo
aactatttttcaaatcgaa

SEQ ID NO: 101017 - DNA, 30 bp, Homo sapiens; identical to SEQ ID NO: 42109
  chr9:26958024-26958054
  hypo

SEQ ID NO: 101018 - DNA, 259 bp, Homo sapiens
  chr9:26976028-26976287
  hypo
ttgttgttcttgtaccgtttttcaccttggtctgtgcacagagttacttggtcgccgcggtgttgtaagcctctcctttccccattgctgagagcttggatttgtttgtcacaatgggtgggtctcagtctcccatccctgaggccactgcaatgcgacagtgggacacgtctccccctgggtggggtgactgaagacctcttcttgaaggagaatgggaatccccgacaagcccccagaattgttagaaagaaagctt

SEQ ID NO: 101019 - DNA, 18 bp, Homo sapiens
  chr9:26976347-26976365
  hypo
ttgcgcagtagggtgctt

SEQ ID NO: 101020 - DNA, 30 bp, Homo sapiens
  chr9:27080231-27080261
  hypo
agaagtgaccacggccgggtgctgtggctc

SEQ ID NO: 101021 - DNA, 35 bp, Homo sapiens; identical to SEQ ID NO: 42102
  chr9:2727012-2727047
  hypo

SEQ ID NO: 101022 - DNA, 30 bp, Homo sapiens
  chr9:27282428-27282458
  hypo
tacaaatgctggcaccgatccctggagctg

SEQ ID NO: 101023 - DNA, 36 bp, Homo sapiens
  chr9:27610868-27610904
  hypo
ctgcggggcgagctgcggacacgggcaaccaaaggt

SEQ ID NO: 101024 - DNA, 101 bp, Homo sapiens
  chr9:284463-284564
  hypo
agcacctgaaaaccccgggaaacgaggggaatgctttgctctcagctactgaggttgtcctgtcaccttctcttctgccctcctttgccatggcataggat

SEQ ID NO: 101025 - DNA, 31 bp, Homo sapiens; identical to SEQ ID NO: 42111
  chr9:28641312-28641343
  hypo

SEQ ID NO: 101026 - DNA, 372 bp, Homo sapiens
  chr9:29211799-29212171
  hyper
tcccctagctcacctcggagcagcctggcccagaccaaccacccagcgttctccgcaaaaaacttcccttaaagcagccaaatattcaagggaggcgggggaaattgggcattagttcgaatacacatacaacagagcaccacggagcaacactgaaaggcaccttttttagatacagaccctatagactctctctcacccttcactccctcccaccctgagtatctgactgagaatttacagagaaccaagaggcgaaaggagagtggaggagaaagagggcattacctcccggggctgccctcagggtgcgggtcaggatctcatccccgaagtggctccagttcaaggcacagctttccagagctcagc

SEQ ID NO: 101027 - DNA, 618 bp, Homo sapiens
  chr9:29212210-29212828
  hyper
cggaagcgcgccgggactgccgctcacgtcccccgcccctgccgcgcgggctccgccaccccgcgagcacgctggctctccgcgctcaccccgccgcctcctggcgcccccacacccacccgctccgcggcgcccgctgggagcctctagcggaggcgaagggaacagcaggcgacctgcggcgcccaggttccgacgccggttgcagggagccggccaagcggcagcgtgggcttcgcgcgcccccgagtccgcaggccgggtgccgccgccgcccccacctgcccacctgcgccaggctcacctgccaccgcgtcctagttgcgttcaccggtgcccacagctctctatggcaattgggggtgggtctgcggtgctaataaaaatttaaaaaaaaaacctctctggtaaaaaaacgaaaacccaaaacccaaatccacgctgtatatcaacctccacagagaacccagtccgaaatcgttttccaataggtttcagaaagtgtgaggacaggacactcctctggcttcctgcctcgcagctgggcagcgccgcaccggctactccctgacttgccaggcgggtcgtgcgatcgcgtagcgacgcccggagagatcc

SEQ ID NO: 101028 - DNA, 2007 bp, Homo sapiens
  chr9:29213127-29215134
  hyper
caccttcccggcacccggaagcctcccagcccctcctgggccaacttggctgcctattcagttttcttccgtaaccccacagacacgtcagtcaattccctggcatcaggcaggatattctcagttgcggccgctcctcttgctttctctcgataatgcccctcccccctttctccccttaatttggaaaaatttctactccctgcccgaattaggtggggatgaggcggaaaggtgtaagaagagccactccaaggcacagcttcggaacaccgtctccctgggctgctgcagcgcgaaggtgtctacgctggggaaactttcaggggaggcagcgccggtgcggggctgggcgggcggcgggcggcggcgccaggtgaggaggctttgaggaggcggctgcaaggcgggacgcaggatagccggctggggcttggcagccgggctcagagctcgggctgcgcacacacacaggcgcgcacacccgcgcgcgcgcagctacacacgcacgcccagccctgcgcccgcggcccccggccagtggcgagcgaaaagtcgggagtcctgaggaggggtaggggttccaaggatgctgatgacagaaagagtcaatcaatcctcactagttagcggattgccggcaggcagttcctcgccgcacgccgttaagtccgttgggccacctctccgttctctgccctgtctggcatttcaactccctagctcttttcttgaagccagttacaccccctcgacacccagcgagaggccaccagactaaagatgagccccgttcccatcgccaccctccaggggccacctccgccccttctgtagtggagaattgaagtggctgcagcagctctcctgggagctgaggggctccccgaggtccttcgaatagaggagcctacacatcgcttcgtgaacataatcccctcgcatcccgtctttacctgcccactcccttcgtaacatttcccccaaggagctcccgaaagtcgcttagatgttttgaaaatgaatttcttagggaattgtagtgcctagcttttggaactgggttaatttaggtgctacgcttatattgtaaactggacggtagcaggtgaacggctcagctggagaaaggggagggattaggagtctggagacccaacccctttagcagccatttccaaggttttgcaccaggagtagctgtccgggtctctggctagctcctgtcccaacttctttttcttccctcgacggtcgggagggatcactgggtgctacaccgctggggcgtcccaggcaggagagacttcgctctcagaagcgcccccgtgtcatccacaactcccacgaaaggagcttcccaagaggagtttgttttacccggaatgggctgcaggaattaattgcttacagagagtaaacttttgcccgttgtttttttgttttttgtgctttttttaaccaaagcttgcatttgtgctccgcgtagtttctattgcaacagagcgctactctgccttttcaactgtgagacagaggattgctgaggatttctgccctctggggcttcgcgaatatctatggcttcggacctgctagcggaaaacgcaaagttgcccagcttggagatggcaccaggttcctttgctctggcgctggatgctccgctccgccacccaccgccgccgtctccatcgagaatctcctcaaaatcaagggagttcttgactgtccctctccaaattggaaggcggttgactttgccgggaaccgagttcctgagcggcaaacgtggagtcgcagagcgcagaagtgaagatttaatacaaaagatgaaacttgtaggatgacctctagcagcgctactcacagctctgaaatcgatccagagcattccacagtgagcgttgcggctcccaggggctccggaccggtaacttcaggcgcaagtctgaatttcagggatgaacctgctttggattctgtttgagccgactcagtgcagag

SEQ ID NO: 101029 - DNA, 30 bp, Homo sapiens
  chr9:2933843-2933873
  hypo
cacccctgccccagtcgtaggcccgggccc

SEQ ID NO: 101030 - DNA, 54 bp, Homo sapiens
  chr9:29826623-29826677
  hypo
gcctcctggagtccacgccaactcagactcgcactggcgcgggaggccccacac

SEQ ID NO: 101031 - DNA, 756 bp, Homo sapiens
  chr9:3181124-3181880
  hyper
cactccatgcacgcgcgatgggcgcacacactcgcatccctacacgtgcacacacccgcgctccaattaccgcgctagcgcgcaaaagagccgcaacttccgagtgggactcggcatgcgggggcagtgcccggtacttcaccatcagtcaccttcgcgtccgcctcctcccctgctggttgcacctccagccgcagagatttccggctggggcaccagaactgtccaggccgaaagagctgctcctccgtcacaaagcgcagttgcacactgtactgcaggcgcgcggggacccgggccggagccggggtcgcagccatggtccaagcgcctctgctcctgagccctagcagtgcctcccccgcgctgctctgggcaccgagaaactgctggggcaagggggagggatttggaagcgcgcaccaccttccccagctcccgttgcaagttcagtcttcgacctccgagacgcccggtgacttctgctggcacctgctgccctcggcatcacctccctcatccccctggagggcacgctggaaagctgcaactccccaccctccgcacaggagcgccccgtagacgcgcagatgggcccagccacccagcggggcggcagccctgagcacacaagtttggagagcgcgcgaggcacctgaaagtggttggggtttggaagcaaaagggtgacacctgctgttcgctgggaccgctctgcgggtgtgggcgtcggtttggaaacgtcctttgcctgag

SEQ ID NO: 101032 - DNA, 20 bp, Homo sapiens
  chr9:32253117-32253137
  hypo
gctggaggccgggcgcggtg

SEQ ID NO: 101033 - DNA, 75 bp, Homo sapiens
  chr9:32755910-32755985
  hypo
cgttggatggcctgccgggtgccggcgtctgtcagtgtgctcttcccttcaacgtcctctcgctgtccagccgct

SEQ ID NO: 101034 - DNA, 344 bp, Homo sapiens
  chr9:32782592-32782936
  hyper
gccagtcttgccccccggggccagaggaatccatctgcccctgcctaccagagcgggaggaacgcaggctctcaatgcctgcttcagcaagggaggagagaatcgcccagagctgagcggcgtcgtagggtggtggtcctgaccggtcaaggccccttctcctcgtgaactgggggccagggagcccttctccctgtccccccggcaccacagcgctgtagaagtgaaatcccggctccaaggtcaccctctcccgagcctggagctggaaagccacggggactccggggactcccccaaggcccggactagcctggcacccacccctcaccactaacccactc

SEQ ID NO: 101035 - DNA, 138 bp, Homo sapiens; identical to SEQ ID NO: 3402
  chr9:32783083-32783221
  hyper

SEQ ID NO: 101036 - DNA, 161 bp, Homo sapiens; identical to SEQ ID NO: 3403
  chr9:32783259-32783420
  hyper

SEQ ID NO: 101037 - DNA, 273 bp, Homo sapiens
  chr9:32783590-32783863
  hyper
cgccgggctccgcttgcacagcaccgggaccgacgggcactgctgggagagccgctctcccaggttccacctccccgatgcagagtccgtgggggaaaccaggctttcctcccagaaccaagggagcgagccgagggggcagctgctgtgggggcttctgaggagacagcctggcttctttccctacttcctggagagggcaggaaacctcaggtacctcgttgaccccagccggagcgtgttgatatgagagagagacggaggttgcaatag

SEQ ID NO: 101038 - DNA, 24 bp, Homo sapiens
  chr9:32828442-32828466
  hypo
cagaaaaaaagctctcggccaggc

SEQ ID NO: 101039 - DNA, 420 bp, Homo sapiens
  chr9:32999936-33000356
  hypo
gacagagactccgtctcaaaaaaatataaaaataaaaataaaaggtaacaaagagtaggtgtctgggagcttaatggacagtcgaagaaaaacaatatagaacagtggcgaagatcaaggtctctgaagttggactgcctgaattcaaacattggttctaccacctactcgctgtgtgacttgaggcaagttatttaacctctccaagccttcattccctcaagtgtcaagcggtattaacaattgctctacaccatggggttgtcacaagagctaaaggacaaagtatgtaaagctcagtgtctgataaaaagcattcaacactattatcactcttgttaatagcgaaggtagggcaagcaggagctgtggacatataaaaagatcatttgaaagcaataactgcggctgggcacagtg

SEQ ID NO: 101040 - DNA, 33 bp, Homo sapiens
  chr9:33077261-33077294
  hypo
cgcctgtactcccagcgcgcgagttcgagacca

SEQ ID NO: 101041 - DNA, 30 bp, Homo sapiens
  chr9:33136558-33136588
  hypo
gcttctgcaaagtcacgacacacaccaaag

SEQ ID NO: 101042 - DNA, 30 bp, Homo sapiens
  chr9:33306864-33306894
  hypo
aagtccagttatagacgacttgtcttatag

SEQ ID NO: 101043 - DNA, 157 bp, Homo sapiens
  chr9:33418331-33418488
  hypo
ttccatcctgcgggccgacacgcccaacccagccagtgccctgtggtagaatgtctcactcaggtcagagagtacagcaggaagagggggcttgagggggcaccttccacccatccccatggctgacaccccttccgcaactcgggaaggtccctga

SEQ ID NO: 101044 - DNA, 111 bp, Homo sapiens
  chr9:33440312-33440423
  hypo
gcgtgaacgcaactgcgggtcttggcacttaagacagctgactagaagttgctggaagagtgaggcagagcagggatggcttcccggaggaagaggcgttaaagcagatca

SEQ ID NO: 101045 - DNA, 96 bp, Homo sapiens
  chr9:33447388-33447484
  hyper
agagaagggcttccccggctccctccactcaccaccaggatgagggtccccaggcactcggccagcgcctgtcggagcagccggtagcggatgtgg

SEQ ID NO: 101046 - DNA, 58 bp, Homo sapiens
  chr9:33511134-33511192
  hyper
ggtcccagcgagcagcggctgggaaacaatggcgcgagcgtgacgtgggccggaggcg

SEQ ID NO: 101047 - DNA, 300 bp, Homo sapiens
  chr9:33523978-33524278
  hyper
cggggcaggaaccgaccctcagccccatccccgcggacggtccctggagcggccccgatctctcttcggagaagaggggcgggagtcacggccaggcgggaagggatgcgcgcctgagattccggaacgtcccgcgccagcccaggagaacccgcaagccagcggcgcctgagcccgagctgcagtcaccctctgcgggccacgcgagctcgagggcgccttccggagtccgggctggcgctgagctgtaggcgcgcgcctaaccgctttactgggctcactctatcgagaggtcggagg

SEQ ID NO: 101048 - DNA, 503 bp, Homo sapiens
  chr9:33524338-33524841
  hyper
atcgcgggtttgggggtgcatcttggatttaggggtggatcgctgggtggggagggggatctcgaatttggagctgggtgggggtggaaaggccacgaggagccgcggcgtctcaggagcgggtggtgggcatctgagaagtcgccaccatgaggaagctcctcagttttgggagacgcctgggccaggcgctcctgagctccatggaccaagagtatgcgggtcgggggtaccacattcgggactgggaactgcggaagatccacagggcggccatcaagggcgacgccgcagaggtggagcactgcctgacgcgcaggttccgggacttggacgtccgcgacagaaaagacaggtagcgggggctcagccctcggtgggagggggcccccaggcccggtttccccgcaccgcctgaggcggggtcgtcggagttcgccgggaccctgggagccgcggagccaaatggagcctcagctgctttccatcgctgggaatttccc

SEQ ID NO: 101049 - DNA, 24 bp, Homo sapiens
  chr9:33647199-33647223
  hypo
gcgagactgcgtctcaaaaaaaaa

SEQ ID NO: 101050 - DNA, 692 bp, Homo sapiens
  chr9:33676745-33677437
  hyper
gtagctgatgcccctcgctcagccgctgcttggctctggaccgcagccgggtaatggctgcggcagcagctgctggatggtggcagctactgggcctgcttctcctcagcagccagaggcctggcagcggcggcagcggaatggggagaagacgaataatcctccgaacggctgcctcctccagcggcctccggagcccgggccacggggggtgcggcggcggcggacgagaggtttaaaaccggcccgggtccctccatgtgccgccgccgccgccgccgccgccgccgtgttggaggcagtagaaggggagagaccaactctccggcgttcccagccctggaaatggtgacaggcgactcagaccccctccctggagctgcagccgccggggccaccgggggcgccgccgccgccgcttctccccccgctccaggagggggaggtgccgccgccgccgcgcctcagccggctcccgcccaagcccacggcttccaccttccctttcaggagaagccgaggaagaggctgcacagttagaaaagacgaagaagaagcgagaaacgccgccgctgccggcgccgcccccgcggatgctcacgggttgctgagaggggcttcaggccgggccgggccgggccgccgccgccgccgccgtctctgtctctcatctccctcgcctgagcccggcc

SEQ ID NO: 101051 - DNA, 30 bp, Homo sapiens; identical to SEQ ID NO: 42114
  chr9:33862299-33862329
  hypo

SEQ ID NO: 101052 - DNA, 28 bp, Homo sapiens
  chr9:34036390-34036418
  hypo
aggcgtgagccaccgtgcccagccttga

SEQ ID NO: 101053 - DNA, 36 bp, Homo sapiens
  chr9:34046353-34046389
  hypo
gtaaaggcttcatgccgggcggggtggctcacgcct

SEQ ID NO: 101054 - DNA, 39 bp, Homo sapiens; identical to SEQ ID NO: 42116
  chr9:34062515-34062554
  hypo

SEQ ID NO: 101055 - DNA, 99 bp, Homo sapiens; identical to SEQ ID NO: 42117
  chr9:34063196-34063295
  hypo

SEQ ID NO: 101056 - DNA, 57 bp, Homo sapiens; identical to SEQ ID NO: 42118
  chr9:34224348-34224405
  hypo

SEQ ID NO: 101057 - DNA, 30 bp, Homo sapiens
  chr9:34279911-34279941
  hypo
tgagggtatcaatggcgataatatgttgac

SEQ ID NO: 101058 - DNA, 71 bp, Homo sapiens
  chr9:34372844-34372915
  hypo
cggctgcgatggcctcggggttctgacgctatgcgtagcagccaggccggcggcggcgggggtaggcctgg

SEQ ID NO: 101059 - DNA, 139 bp, Homo sapiens
  chr9:34381074-34381213
  hyper
ggcagctgctggttccgcgacagtgagttcagcatgttcaccatcacttcgcgctctgctcccgcgggtccccagcgcaggagacccaaagacagatgcacagggatgggaagaggccgagtcacggacagagtgaggc

SEQ ID NO: 101060 - DNA, 30 bp, Homo sapiens
  chr9:34494080-34494110
  hyper
tttgacttgcagtggcgtgggagggacaat

SEQ ID NO: 101061 - DNA, 56 bp, Homo sapiens; identical to SEQ ID NO: 42119
  chr9:34574808-34574864
  hypo

SEQ ID NO: 101062 - DNA, 30 bp, Homo sapiens
  chr9:34577915-34577945
  hyper
ccgaggcgggctgggcgggctggcgggcgg

SEQ ID NO: 101063 - DNA, 603 bp, Homo sapiens
  chr9:34588995-34589598
  hyper
ggagatacatccaggcggactgaagagaaaaccatggggacgccgaccgacacacacatgcacacacacacgcgcgcgcgggcgcgcggattcacacggacacacatgcactggcagacgcgcaaccgtcggttcgcatccccgggcgctttgaagtccagatttctgcccgagaaagaagccacctttgggcgcgcaaaggccactacgaacctccccaaacccaggaatttttccagaccccgcgcgtgcagctgaggggtggggagaacagggacactaggacaaaccgccggagccacctccctctagtccacagtcggccccaccaccaccaccacgcccaacccccggagcgcccggacgtggggggccgctcctccagcgcccccgcccccgagtttgcaggcaaagtttctcgtgaactttcctgtcgcccccgtccgtgggcccacgggtgtcccctcactcttcccgcacgcatgagggccgccggtctgctggtcagcccgggctctgagggtccggccgcgcgcactccgccgcagggtactcaccgcgccctcgggccacccgggcttcgcgccgcgccttccgaccgcc

SEQ ID NO: 101064 - DNA, 356 bp, Homo sapiens
  chr9:34589889-34590245
  hyper
gccacgacccctccccgccacgggccccgcgcgcccccgccttggcacgctctcgctcctggcacacgcggtccgctcgccctgcgcgggcctgtgagcccccactcccactcgcccagcactggcacgcgctctgcccccccgctggcacactcgtccgcactggcacgcgtggccccctcgcgttcaccctttctcgggcgcgccctcaagacggctgtggtccccgtgcttcacgcgcagccccggccgcgggtctcgcaaacgcgcgcgcgcacacacacacacacacacacccactcggcccgctcccctagggcggctgggcgcgcactcacccccgggatcgctccttc

SEQ ID NO: 101065 - DNA, 201 bp, Homo sapiens
  chr9:34591455-34591656
  hyper
ccccagggggctgaccggcctcggcgctctaatccggccggggaggggcggacggggtgaaaattggcgagtggtttggggaacggacttgacctccagatgccctggtgtccctggctcagcctctttctgccaggttgggagcagtcgggaattctgtcccggtccaacgtccccctcggcccccggggacgcagaggc

SEQ ID NO: 101066 - DNA, 168 bp, Homo sapiens
  chr9:34665047-34665215
  hyper
tggctggctgggcagcggcggtggggctgcggcgggggaagccacgacccgagcgctggggagtaggacccaggccgctggacagacagctcatcaggcctcgcagaggctccagcttctgctccccggggtgcgccgagctgtggggcgacccgacactggcatgag

SEQ ID NO: 101067 - DNA, 57 bp, Homo sapiens
  chr9:34666056-34666113
  hyper
acgtcacagggatgccgttgcgcactaggtttgcctgtcccccggaaggggtggggt

SEQ ID NO: 101068 - DNA, 395 bp, Homo sapiens
  chr9:34701358-34701753
  hyper
ctgtggggctctgggcgaccggggcatgtgtgcggatgtgtgtccgcgcccgtgagcgtgcccatgcatctcccttcctgggcctgcagggggcgccccgagcctgggaagggaggctctggagtggggcgcggctgcggcagaggggtgggcgcatgcggctgtgaccctgcgagctcctcagagaggctgcggtgagcgggcgtccgaagtccctgggcctggaacagcctctggcgccctcccggctccctggccccgccgtccctggggtccccgcgcgcgggccgggcgtatggaggggaggctcgggctgtgggtggtgcccgcgcatccgatgacctgggccgacagttaccccgggccaggacaccgccgtccggccaaacccctgc

SEQ ID NO: 101069 - DNA, 42 bp, Homo sapiens
  chr9:34702295-34702337
  hyper
ctcctggtggccgagcggggcagtgagcgcctcccagcaggc

SEQ ID NO: 101070 - DNA, 44 bp, Homo sapiens
  chr9:34760663-34760707
  hyper
atactcctagtcctgcgacgtctcggccccgccaggggtcctgg

SEQ ID NO: 101071 - DNA, 252 bp, Homo sapiens
  chr9:34957876-34958128
  hyper
ccaaggcgccccctccgggccgcctcctccgggcgggcactgtccttgccgcagtcggccgctggcgcagtccccgcgccgcagtgccgggcgctcgtggggggcgcccacgggcacctgggccgtctgctcatcggagccgtccgccgtcctcccgcattcccacggcgccccacgcccgcgcgcccgtcgccggtcacccgccgcccgcggagccgcgagggcgtctcctggaggcgcaagaggactggg

SEQ ID NO: 101072 - DNA, 124 bp, Homo sapiens
  chr9:34971432-34971556
  hypo
cactgtagagggctccgtccaggaggtacaggaggagaaggaagcagaagcaggaacctcggtggtccaggaagagagtagtgccggccgcgcagcctgggagcggctccgagatgggcgcggc

SEQ ID NO: 101073 - DNA, 38 bp, Homo sapiens
  chr9:35060862-35060900
  hypo
gtggcacctctaccacggtttcccgcagtgctgatggg

SEQ ID NO: 101074 - DNA, 369 bp, Homo sapiens
  chr9:35162053-35162422
  hyper
cagtccccagcctgccggccggtactcaccgctacccggagttcgctcagacggtgagatttggggcgggtccgaggcagcggcgggacgctacctgcgaccgggaccatgaggagctgccagacccgtggggccggtaacgagagcagtcgcggcacctgctgagaggaaagagggagcggtccggcgcggctggggcgcggcagaggcttgcccgatcctcggccatgtcactgctctgcgtgcgcggtgagtgcgcggactgaggcggggaggcggggtgtcggcgtagaggtccccgcacccttccagtggacgtccggtgaccgtctcacccaaactttacatcccgtccgtgctttgggggtc

SEQ ID NO: 101075 - DNA, 194 bp, Homo sapiens
  chr9:3534456-3534650
  hypo
gacaggaacgttcctcgaatatccacaatcttaatctcatgtcaactataatgaagccatgtaaaggtgagaaaaggaagaaacattatcataatctaccgagatgattactatgatcttttttttttaaagtattgtggtctcatgggttgattggtttttgtttgttttttcgtttgcgtagaatgagccaa

SEQ ID NO: 101076 - DNA, 443 bp, Homo sapiens
  chr9:35616922-35617365
  hyper
gaaggaaatatcagacggagagaggggaaggggggcaggtaggtgaattgggaccatccgcaggggggcggtgcacgtcggattcaggcgcaccggatgaaggtgaatgtggcacggcagcccgggcgtcggaaggactgcgcccgggtttatcccggaaggagctgcaccccgcggggcccagcgccatccgcagccgggacaggcgcgagcacttggccccgcggctgccccgcacaggcacactcacaggggagaatccgcccgacagctggtgacgtcacggctctccaggacgcagttggctgctccgacttgaccgctgtcgaggggagcatccagtgtgagaccggaagccccgagtgttgccccttctcctcctgcgcacccgcttcgccctcgccactgggaaactccagtctgccctacgttgcctgctagag

SEQ ID NO: 101077 - DNA, 154 bp, Homo sapiens; identical to SEQ ID NO: 9888
  chr9:35675494-35675648
  hyper

SEQ ID NO: 101078 - DNA, 294 bp, Homo sapiens; identical to SEQ ID NO: 9889
  chr9:35675837-35676131
  hyper

SEQ ID NO: 101079 - DNA, 30 bp, Homo sapiens; identical to SEQ ID NO: 42120
  chr9:35696547-35696577
  hypo

SEQ ID NO: 101080 - DNA, 30 bp, Homo sapiens
  chr9:35712225-35712255
  hypo
aaaaaagaaagggggcgttgtaggtgaaca

SEQ ID NO: 101081 - DNA, 65 bp, Homo sapiens; identical to SEQ ID NO: 9890
  chr9:35728859-35728924
  hyper

SEQ ID NO: 101082 - DNA, 95 bp, Homo sapiens; identical to SEQ ID NO: 42121
  chr9:35816242-35816337
  hypo

SEQ ID NO: 101083 - DNA, 22 bp, Homo sapiens
  chr9:36036080-36036102
  hypo
aggcacagtggctcacgcctgc

SEQ ID NO: 101084 - DNA, 850 bp, Homo sapiens
  chr9:36036783-36037633
  hyper
caaagagccctggtacggggcacgttcccgcccccgggaggttttggaaacactgtgaggcagggggcggggcttgagcgggccgcagccagtcaccaaagggccgggcgctgggggcggggcctcgcgcgagcggcggcggtagcggcggcagcggctgcggccaagctgggtccgagcatcccgcggctctggagccgcccggcccggacatggcgaccgtccgggcctctctgcgaggtgcgctgctccttctgctggccgtggcgggggtcgcggaggtggcagggggcctggctccgggcagtgcgggtgagtaacctccagagcaacggttcgaagctgtcgggagcggccgccacagcgctccaagatggcgcggggcagggggcgggggtgcgcgcgacccccagaccctgcccacgtccggcgaccccgggaccccaggtctcagcgctccagaggctggtgccgaggcggggcgagtgaggaactctctccgccccaagatcttctgggcggtgactcgggtttgaggccttggtctgtcacccaccgacacgggccccctcttcggcactgaccccttcgcttgcctctgctgcttgtcagaaaagggtgcgatgcccccgcccaggatcgtcgcgaggtttagatgggatttcggatacgcagccgccctaccgcggccctagttagttattgttacttgttacttgacccgcacttggttcataacgaccttggtggcggtgagcactgacggtccccacagcccgcgtggtgggtcctggactcgggcaggagacattaaaaatcagtaaaccctgtcccccgggggctggcaggc

SEQ ID NO: 101085 - DNA, 30 bp, Homo sapiens
  chr9:360368-360398
  hypo
ttttatacccttccccgaatatccataccc

SEQ ID NO: 101086 - DNA, 30 bp, Homo sapiens
  chr9:36138930-36138960
  hypo
ctgatctgaaagcagcgtaactagagcgtt

SEQ ID NO: 101087 - DNA, 30 bp, Homo sapiens
  chr9:36162445-36162475
  hypo
ccagatacttcccagcggggaatgttgtca

SEQ ID NO: 101088 - DNA, 30 bp, Homo sapiens
  chr9:36162711-36162741
  hypo
aggaagcatttaccccgatggttacctaga

SEQ ID NO: 101089 - DNA, 108 bp, Homo sapiens
  chr9:36166287-36166395
  hyper
agccaggaatctgtccgagtctgcgggcaccctcctctctccccgcaaaggactcgcaggggtcaggaaacccccccagctgttactgggagtcggagacagtcttct

SEQ ID NO: 101090 - DNA, 28 bp, Homo sapiens
  chr9:36194299-36194327
  hypo
aggtgtgaaccaccgcacccggtgacaa

SEQ ID NO: 101091 - DNA, 99 bp, Homo sapiens
  chr9:36257346-36257445
  hypo
gtcagggccccattccgacgctataattcggtttggcttcaactgcggcgctcctacagttgggttaacgagttacctatactgcgaaactgtacccca

SEQ ID NO: 101092 - DNA, 791 bp, Homo sapiens
  chr9:36257855-36258646
  hyper
aacgtttctcaaatatacaaggaagcccagactcagaatgtagactcagagcagggaggggaccttttagcccagccttttcacgccaggacagctcgcctgccaggcagttctccaccctctctcgccccgccccgctcctaacgggacagtcagcatcccccctgattggacagcactgttccaggggacaagtcaacctgggcctccctctacatcccctcccctgctcatcagggcccaccccgagccacacggcggagccctgaattgggccaaagaggtgccctatggtgaggcctgcaggacattgggcgagagccgggtccagtgtgggcctcggggcgcggtggggtggaaagcggccggggaggggaggcctggggcaggaggccgggggaggcggccctgggggtgggcaggatgctctcccggagtcccacgccgccgcgcggctctcaccagacgccgtcagaggctccctcccacgccgccaccgcgctcctcgggcgagggacgaaccaagcgccacgaagcaggcagagcgcgagcctgcccctcggtttccgcgctcgggcgcgcgggtagacgactcgtcgctcgaccttgtccccactcctcgctcgcccagccacgcccacccggagtgccgaatccgcgatcgcgccctgacgccacccgagagagctcgcgtgattggctgctcccgtccccgtcccccaccttcccggcggtattttgaggcgcaggcagggtgctgaccagcggaccatcttccatggcctctgccg

SEQ ID NO: 101093 - DNA, 321 bp, Homo sapiens; identical to SEQ ID NO: 9893
  chr9:36258697-36259018
  hyper

SEQ ID NO: 101094 - DNA, 24 bp, Homo sapiens
  chr9:36274726-36274750
  hypo
ttttttctcttgagacggagtctc

SEQ ID NO: 101095 - DNA, 22 bp, Homo sapiens
  chr9:36318367-36318389
  hypo
aggaagaaaaagttccgttggg

SEQ ID NO: 101096 - DNA, 151 bp, Homo sapiens
  chr9:36739447-36739598
  hyper
tctcttgcgctacagcgaatccaagaaaataattaaagctttaatttatttatacgtcttctctatagatattatagatctcacaatcgccgcctcctaatttatgcacgcagagcctgcggcagctcggagccgccagggttggggggtc

SEQ ID NO: 101097 - DNA, 218 bp, Homo sapiens
  chr9:36739811-36740029
  hyper
ggagcaggatttattagcagacaggatggggaagttgattagcctccgcggctgaacggacatcctgtcagacaggcctcttaatccaatcacttacctgtggaggggagccggctgcctcctcctggcccccttcctcctcccatggcacctgcggggccacgcggggtgctccggagccagggtacacaggccaggccttccgtgcctggcctcgc

SEQ ID NO: 101098 - DNA, 123 bp, Homo sapiens
  chr9:36748460-36748583
  hyper
cctgcctggtgaggacggcagcagctccggcccatacaaagcagcaccatggacagtggcagaccagcctgagaatgcctgccaccacgccagacacaaccgagctgccgacatccttcccca

SEQ ID NO: 101099 - DNA, 36 bp, Homo sapiens; identical to SEQ ID NO: 32459
  chr9:37002482-37002518
  hyper

SEQ ID NO: 101100 - DNA, 295 bp, Homo sapiens
  chr9:37002818-37003113
  hyper
cggcggaccggctgtcaccgcacgtgaggctgggggcggctgggagggagcgagcgcagggtgggcagggggcgctgaggaccctcgctctgcggaggcggccacacctgagccacgagcgcaggcctcgggcgggccgtgtgccccagttctctgcgatggggggagaaagggaagggtgggcactgagaaggactgacccctgcagaaaggaacacggggacacggggacaggaagggctttcgcttaaattccagcctatccatggatgcaggaagcaggggatggagagga

SEQ ID NO: 101101 - DNA, 31 bp, Homo sapiens
  chr9:37003173-37003204
  hyper
aaaaacctgaactactcgttaggcatttcac

SEQ ID NO: 101102 - DNA, 1046 bp, Homo sapiens; identical to SEQ ID NO: 3408
  chr9:37025306-37026352
  hyper

SEQ ID NO: 101103 - DNA, 839 bp, Homo sapiens; identical to SEQ ID NO: 3409
  chr9:37026433-37027272
  hyper

SEQ ID NO: 101104 - DNA, 60 bp, Homo sapiens; identical to SEQ ID NO: 3410
  chr9:37027324-37027384
  hyper

SEQ ID NO: 101105 - DNA, 681 bp, Homo sapiens
  chr9:37027385-37028066
  hyper
gggtgtctacctcgtgccaaccaactcttcgagccccgccgccctccctcgtgggtctgattccactgtctttccgctgcctcttccgggacggccgccgtgcctgccccaggcgtggagtgaggaacagaggagagagcagagggtcccagccaccaaggccgccggggctgccggggctgagatggagccgcagtcggctctgactgcctgcgttgccgccgccgccgccgtcgctagccctccgcctgctcggcgcgcacagtgcgccaccgcgccgccccggagccgctttcaggacccgctgcgtgtggacagcgccgcccggggctcagctccctccgggcgggggcggggcgggggctaacctgccaatcacgctccaccaagccaatcagagtggcgtcagccggccctggcccgaaacaccgccccattggctaagcagcccacaggctccgcctgattagcggacacctgggcaatgggagagaatggggggcggggcccaggcggcggcgccacgttcattgacaaacgcgctggactaaggcctagtggatcgcggctgtggggaggggaaaggggcccacgcagtgcctggagagtcccgctgcgggtcccacgcgggctggacctccccacagcgatgctgggatcctgggacgctctcaaggcttg

SEQ ID NO: 101106 - DNA, 40 bp, Homo sapiens; identical to SEQ ID NO: 32465
  chr9:37028470-37028510
  hyper

SEQ ID NO: 101107 - DNA, 30 bp, Homo sapiens; identical to SEQ ID NO: 32466
  chr9:37028944-37028974
  hyper

SEQ ID NO: 101108 - DNA, 1442 bp, Homo sapiens
  chr9:37029348-37030790
  hyper
cagtagacaagtttccggcgctgacacccgtccccaccccccaccagggcacagctgcggaaaacggccccaggcgggactctggggacccaggaggctgcagtgcgcgccggggtggagtggcggcgttatctcttctttgtctggaaccccgcctgtccggatcttcccctttcacccccggccttggagcaggaagatcgcaacagcagagagggactgggatggaatagacttcctgcactggcttcacccgatggcgcccagtgggtcggaaataaccagaattcagatcctcggcccagactcaacatggcggcttgcacacctactggagaggcgggagtgcgggacgccctgagggatgcagccagtgacacccccacccccagcctctcttgctgagctcaggcctacaaacccaggttctctagattcttagagctaaaagggcctcgaagctatgctttctccatttcacgggtgcagaacccgaggcccagaggcaggatacgacttgtccaaagtcacacagcaagtctggggtagaagaaaggctgcgggctggaaacctttctcaaaagcgcctctccagagccgctctcgggatggtgggggaggggcgatgctgccaaatcgaagaactcggctggaatatgcccgcacacgcaggttttccttcggatacccgtgaggcttgcatagaatccccggggcacggcccgagcaggagtagcgccgattctccctttcacacagtaggtgttcggcttcgggacagtgttctgctgcgtggcacacacaggacccgtcttacctgtgcacccagagcagccccttcccgcaactctcggcgttcttgggggaaggagtttccctctggataggggtgattcatcaccgcccgagcgggcggcctctgggaagttccaaccccaaaaggcgcgaccggacctcataccgtgaccacctagcccagccttacaggtcaccaaacgacagcccagagaggttacgtgactagctcgaggctgcacagcaagtccatggtggagccgggctactgcgcctcagtcctgtctctgaacgcccacgagccgcagcctgggtccaggagagcgagactagcagctctcaccgcggctctcaacgcagtcgggcctcactctgatctacagtgatgcgctttctttctcccagtaacagggctttgggccgggccctgtgctaggcgctgggggcaggagaccgcgaaaggaaactatccaggaagaaactcaatttatgtgaaccgaattgcctttgaaagttttagtactgaaagacagcccattgagaataatgtgtgagaagccagagacctcgtttcactggggacacaccccctcccggcttccctttccacgcctcccagcgcactgcattaccgtggcttcaggatg

SEQ ID NO: 101109 - DNA, 750 bp, Homo sapiens; identical to SEQ ID NO: 32469
  chr9:37034197-37034947
  hyper

SEQ ID NO: 101110 - DNA, 380 bp, Homo sapiens
  chr9:37035506-37035886
  hyper
gtcacgaggctgggtcgcaacctagggggaagagcctagagctcgaggaaaggggggcccccggcggcaactggacatcacatatccactgagcagatttcgccacaatcggaaatgtggctgtggattcccgggcggcccccccaccaagtggtctgcgcagttccccagcgccgcctcctccctgcagcctgcgggcccgtgtccctaccccgagatttgatttttggccatctccgagtgctcgactctttccctccgcagcccagccccagcccaggcttcccgccctcccgcctcgcccgcgccgggaggcagcgcctgggaggagcggcctgtccgcgcctggagatcaaaagccctcccggaattgacatttc

SEQ ID NO: 101111 - DNA, 2227 bp, Homo sapiens
  chr9:37036127-37038354
  hyper
tgtctttttgtgtgtcgtttgtaaggcttttccttctccgcggtgtttagatgtgttttgatttggtgtgagtgggtgtcgtctgtgtgtgtgttgccttagggaatttcgtgttgtgtgtgttttgtttccttcgatttgaattttatttttttgaactgtacgttttggtgggggatcgggttatattttcatgtgttgtctttagtttttgtgtttgtgagatgcgctggtgagagtttgcgtgtgtattttggcttttgtggggctttgggattagggaggggacatcagccgctactccgttcctgcccgcacccatgaagggcagaggattaggccaagcatcacgaatcgtaggttcgccgtgctccgccgcttcgcgctctggacgctcgagaccagcgggaaacaaatgtggttcccgagggggcgcccgctggtcgtcaaaacctcgcgggcccggaggcgccgctgctgggtcagaatcgcagagcccccctcgcggggtaccgaggcccagccgccgtccccttgcccaccctctcccctgtgagtcggtctccccttgcgcctggccagcatgcttcggaccgtccggactcccgcagcgttggcccaaggggcggctcccctcggcggagcaggtgacgaaccacttcggaggacacggaattgacactgcggccctagagatacgggacaaggggccagaacgcggggagtctaggctcagatcggagtcgggatcccgggaaaatcccccatctcccttgcccgcagccctagaatcccagaaacccaactccgcgcagctttcggtttggagagcccgccctggtttgcaagcacagatacatgtgcccacacccgaacacacgcagacaccgccagagagcgagacagcgagcgggcgcctccgtagcagcggcctgcggggcggaaccggagctggcgccgcctcaaggggaaaccgaactgtagtgaccggaaatgtccccaggacagaataagccattccttctgtccacgttgccaggacttctccagctcaacacaccttggtttgtttaatgttacacgagggagaagatttagaggcagagacacatgctggctcaatcggcgaggaaatacgagcagagtctaaacagaaagaaatatggaacggggggagactagactgtggggaaggcaaattggaggcccagaaaaggggctggtgcggaagctcctccaggcccctgggcgctctggcattctgtgagaaggagaaagcagaagccgagaacagagagtgacaggaaaagaaaagagacgcagaaggggttggcctaggcacgctgcgagctgccctccagctaagacgctgcgggcaagggagggggaggccgacatcgccaggcgaggggccaaggtcgggctctttaactcagccaggaaacatcgttgggggctccagggctcgtggagcccgaactggggctcatttccggcccgatgcccctcttccccagacccctagcccggaatccagcaaaggctgggccatcgccgtccgccactgggcctccctctgtgcgagccctgggagaagcctcagggaacgactctggcactggggctcggccccggagctagcgcagagcgtgggtgggagtcgacatccaggcaggaggcaaagaagaggccccgccctaaagccgagggcccagttcttcgaaagcctgtggccggagctggactcacaggattcggggtccgtacagcgcgcacgtggtaccgcatcttcggcaggcggcgcccctaatgcccagccccgccctgcttcgtttgccgggcctgaactgtgtcagcattgagggtggacgccgagtcgcggcgagttggtcccttgcggtataaacttggggcttccctaggggcggtgccgggatggatgggggcgcctctccacctgcaactcccccagcgcagagcgcaaaaagtgcacatcgcgggccagccgtcgcctcggggtttcaggcggcgcccggggcaaaaaggagctgaggattggtttgggtcaaaacacccatttcagttggcagtggggtcctctgcgcctacagggcttcgagctccgggtgcgggctcactggggcaccatgtgccagcgactcgccacccggaaatacttgggttgcgctagaatacgcaatgggtctgtgttcgggtaacctggtgc

SEQ ID NO: 101112 - DNA, 215 bp, Homo sapiens
  chr9:37121892-37122107
  hypo
attcagagtggccatcgcatttgaaaaatggacagacattttaaccctttagacaattgtgtttcaactgtcctgtcagggcagcttactaagagtaagaaaaattttactttgaaagtaaagtgtattcatcacattccaatgaaaattggactgaaaatgaggctgtggatttgatttaaatcggccggagatggatgcgtgtgtcatcaaga

SEQ ID NO: 101113 - DNA, 30 bp, Homo sapiens; identical to SEQ ID NO: 42125
  chr9:37134066-37134096
  hypo

SEQ ID NO: 101114 - DNA, 30 bp, Homo sapiens; identical to SEQ ID NO: 5089
  chr9:37467610-37467640
  hypo

SEQ ID NO: 101115 - DNA, 30 bp, Homo sapiens; identical to SEQ ID NO: 5090
  chr9:37467940-37467970
  hypo

SEQ ID NO: 101116 - DNA, 41 bp, Homo sapiens
  chr9:37477115-37477156
  hypo
gctcactcaggaacccgcgggggcagcgcaatgaggcgggt

SEQ ID NO: 101117 - DNA, 291 bp, Homo sapiens
  chr9:37576058-37576349
  hyper
cagacccctgatgcccgaagcccgaccagacgctcagcctcggccaggactgagcggcgcctcctgggtcggtcgcctggggaagcgccccgggtcccctcccccggccgcccaagttcgcccgcagcctctgcgcaccggccgcttacctcacagggcgctcgcccaccgcggagtccgggccgcggccgccggtgccctggaagccacccgccgcccccgctggagccgcagcagccggtaggattgcggcgtgcggccagccccgcccgggggcggacagctgcctgg

SEQ ID NO: 101118 - DNA, 38 bp, Homo sapiens
  chr9:37651342-37651380
  hyper
agtgagtggaaacagcggcaacgcgggagggggagaga

SEQ ID NO: 101119 - DNA, 30 bp, Homo sapiens
  chr9:377164-377194
  hypo
gctcttccagctgtccgtgcagcccatggt

SEQ ID NO: 101120 - DNA, 30 bp, Homo sapiens
  chr9:37965461-37965491
  hypo
gacatgaaaacacaccgactgtgtgtgggc

SEQ ID NO: 101121 - DNA, 30 bp, Homo sapiens
  chr9:38067678-38067708
  hyper
tgggccgggcgctctcgctcagaggggacg

SEQ ID NO: 101122 - DNA, 37 bp, Homo sapiens
  chr9:38068121-38068158
  hyper
gccggcgtggcgggccgccgctcgctgctgctgcggt

SEQ ID NO: 101123 - DNA, 161 bp, Homo sapiens
  chr9:38189469-38189630
  hypo
gagccccacctcccatcagatcagctgaggcattagagtctcataggcgtgtgaatcttatcctgaacagggcatgcgagggatctaggttgcatgagaatctaatgcctgatgaggtggaacagtttcatcctgaaatgattccccgacaaccatggtct

SEQ ID NO: 101124 - DNA, 436 bp, Homo sapiens
  chr9:38424302-38424738
  hyper
ggaccacacttggggcgccggccgcccacgtcgcggatcccaaggctcggggacagcggcggcagcagcggcagcagcagcagaagcagcagcggcaagagcagagacaagcgcggcatggcttgctccgggacagcggcggcgcctctgcttcgcgctccgctccgcgcccgccgagcagtcaccgctcccgccccgcggccgctgattggccgggcctgcaccgcggggcgcccgcagaccgctgctccagcccgggacccgcgcggtgcccgcggcccgggtctccgagctggagggtcgccccgagagcagctctccgacctccgattggactcttgagggaaccgagacccagtcggggcgacaacttgcccgaggtcgctatggcagagtcaggattggataaccgtacggtctccggatccaaggctgg

SEQ ID NO: 101125 - DNA, 350 bp, Homo sapiens
  chr9:38620053-38620403
  hyper
cgcgggctgagtccccgagctacctgtcttttctgtcgcgggcgtccaagtcccggaacctgcgcgtcaggcagcgctccacctccgcggcgtcgcccttgatggcagccctgtggatcttccgcagttcccagtcccgaatgtcgtaacccggacccgcatactcttggtccatggagctcaggagcgcctggcccaggcgtctcccgaagctgaagagcttcctcatggtggcgacttctcagacgcccaccacccgctcctgagccgcggcggctcctcgtggcctttccacccccactccgccccaaatccgcgatctcccccgcaacccgcgatcccccccgcaa

SEQ ID NO: 101126 - DNA, 86 bp, Homo sapiens
  chr9:38620735-38620821
  hyper
tcccgcgggacgtcccggaatcccaggagtgcatcccttcccgcctgagggcctgcctggccctgactcccgacccgctcctcctc

SEQ ID NO: 101127 - DNA, 360 bp, Homo sapiens
  chr9:38620881-38621241
  hyper
ggtcggttcctgtcccggtgcagccgccgccgggtagaccgcctggcttggccgcagccagggcgacatgtagccccggttctgccaggctgggagcgccagccatcttgggagttgccaggcagctgtcgccagcaggtagagggcgcctgcagcttgggcgcccaggtggtggagcacggcctaggcggcctctggatcgcgagtgcacctggcctgagagcccgccaggccctgcccctgctcggctcctcgtctgctgaagctcgggacctctagccagtggccctctgcagccacggggaatggggctgagagccggttcccgctgcagggcagaccacctagctcagccgcagc

SEQ ID NO: 101128 - DNA, 565 bp, Homo sapiens
  chr9:38621421-38621986
  hyper
gtgcctcccgcccattcctccaccggagggggatcggggtcgctggcatgggcacttggcagtcactccggatggggttgagcaggggttctcagttttcgcccctgtgcagccgccgccgggcagaatgcctggcttggccgcagccactgctacacctagcgggtcgggcgggccggggggtgaaagcgctgggaggcgggtgccttctcgccctgtggcgcctctgggccccacggcttgtcggcctccggcgcgcagggctccccagcatcctgggcgccggcccgctgcctgcacaaagtcaactcagacaggatgaacttcggttgccttgtctggctgggctgccaggcggggcagctgacctgctgatggggtgactttcttcatcttcttgcccacaggacagcgggctgggaagccaggggccgccgggacctggggctggaaaccacatctgcccacagccgcagcctcctgcacctgtcatcctggcggcgccctgacgtcggagaagcagcaggcgcggagctcctgcagcgggcaccgctgcagcaacccg

SEQ ID NO: 101129 - DNA, 85 bp, Homo sapiens
  chr9:38622559-38622644
  hyper
gcccgagagacagcacgtcaccgtcaccgtcaccgcctagcgcccctgacccgctcccactccgctgcagcggagggtgtgtgag

SEQ ID NO: 101130 - DNA, 31 bp, Homo sapiens; identical to SEQ ID NO: 42128
  chr9:38646913-38646944
  hypo

SEQ ID NO: 101131 - DNA, 121 bp, Homo sapiens
  chr9:40633719-40633840
  hyper
ccggggcggggcggccgcggtgcacggactcgtgccaaagaccgcgccgtcagcctccgcctgcaggtggagaacgccaggctttatcactctgctgttcacccaacgcaggggctgcacc

SEQ ID NO: 101132 - DNA, 23 bp, Homo sapiens
  chr9:41242566-41242589
  hypo
aagaatgaatatggccggtcttg

SEQ ID NO: 101133 - DNA, 30 bp, Homo sapiens
  chr9:415015-415045
  hypo
gagatctctgtcattcgttccagtgctgat

SEQ ID NO: 101134 - DNA, 50 bp, Homo sapiens
  chr9:4298596-4298646
  hyper
tatagggactggagccgcgcgcaggacaacgtctccgagactgagacatt

SEQ ID NO: 101135 - DNA, 1157 bp, Homo sapiens
  chr9:4299009-4300166
  hyper
gactccagagtggtgcgccccatgcccgtgcgtcctgtaacgtgccctgattgtgtacccctctgcccgctctacttgaaatgaaaacacaaaaactgttccgaattagcgcaactttaaagccccgttatctgtcttctacactgggcgctcttaggccactgacagaaacatggtttgaaccctaattgttgctatcagtctcagtcagcgcaggtctctcagtgacctgtgacgccgggagttgaggtgcgcgtatccttaaacccgcgcgaacgccaccggctcagcgtagaaaactatttgtaatccctagtttgcgtctctgagctttaactcccccacactctcaagcgcccggtttctcctcgtctctcgcctgcgagcaaagttcctatggcatccacttaccaggtaaccgggatttccacaacaaagcccggcgtgcgggtcccttcccccggccggccagcgcgagtgacagcgggcggccggcgctggcgaggagtaacttggggctccagcccttcagagcgctccgcgggctgtgcctccttcggaaatgaaaacccccatccaaacggggggacggagcgcggaaacccggcccaagtgccgtgtgtgcgcgcgcgtctgcgagggcagcggcggcagggggaggaggaggcagaggcggggtggctggaccctcggcatcagctcattctcccctgctacacacatacacacacaaataatgtttctaaaaagttcagttgcgactttgtgcctcgcctgtcctgttcatcctcgtcctgggccggggaatgcttctgggggccgaccccgggatgctggctaattgctgccggcgggttccgtcgccggtgtgaccctggacggcgcggacggcgtacagggggtcccgggaggggcagtggccgcggcactcgccgccggtgcccgtgcgcgccgcgctctgggctgcccgggcggcgcagtgtggacgcggctgcagggagaggggaagggggaagagggagggaggaaggcagccgggcgaggagtgtggatgtgtgtgcggccgcgagggccggcctgtagccagctgcttcctgagtgtgagcgccggagggggagggggaagagtgggggcgggctcgcgggtcactaggctg

SEQ ID NO: 101136 - DNA, 129 bp, Homo sapiens
  chr9:43684951-43685080
  hyper
gctcgcttcttgactcgcgttggtgccggccgcctcccgcgcctagtgtccgggacgcgcctgaacctgccgcctccgtgcctggggcggcgccgcgcggcccccaggctcccgcggggccgacctcgg

SEQ ID NO: 101137 - DNA, 24 bp, Homo sapiens
  chr9:45356983-45357007
  hyper
gcgtgcgctcgaggcctgagggac

SEQ ID NO: 101138 - DNA, 41 bp, Homo sapiens
  chr9:45371461-45371502
  hypo
ggattacaggcgtgaaccacggcgcccggcccataattgga

SEQ ID NO: 101139 - DNA, 30 bp, Homo sapiens
  chr9:4864629-4864659
  hypo
gtgtctctgagggctcgggacattctttat

SEQ ID NO: 101140 - DNA, 35 bp, Homo sapiens
  chr9:505604-505639
  hyper
tcttgcgggtcagcacgagccgtgctgcacgagcg

SEQ ID NO: 101141 - DNA, 17 bp, Homo sapiens
  chr9:5230606-5230623
  hypo
caaacctttttgaaacg

SEQ ID NO: 101142 - DNA, 169 bp, Homo sapiens
  chr9:5864501-5864670
  hypo
atttaacctcacccccgtggggaggggggcgagcgggtatttgacccttctaaaagcctcaagtgaagggaacaaagctgtcaaaatgacaggctttcctcagggggtggtagagatgtttggggcaggtggaagaagccagcttttccagatccgcaagaattctggc

SEQ ID NO: 101143 - DNA, 30 bp, Homo sapiens
  chr9:592406-592436
  hypo
tactgaataaatgcccgcagcactggcttg

SEQ ID NO: 101144 - DNA, 329 bp, Homo sapiens; identical to SEQ ID NO: 32367
  chr9:6412571-6412900
  hyper

SEQ ID NO: 101145 - DNA, 71 bp, Homo sapiens
  chr9:6644297-6644368
  hyper
tgagagcaccctggccggtgagagggtgcctgggaagtggggaatctgctacaaaacgcaggggaagctcg

SEQ ID NO: 101146 - DNA, 15 bp, Homo sapiens
  chr9:6644539-6644554
  hyper
cgattttcagggaac

SEQ ID NO: 101147 - DNA, 1305 bp, Homo sapiens
  chr9:6644869-6646174
  hyper
gtggggtggagattccgccactcggggttggatttcagttgcaaccggagctaaccggtaagcccactcttaatcagggggtcttcctcctcttgcaaagtttaggtccatccacagggccacttgggctgggggtggtttaaaaatgtacacttttgaggcacgaagactgggtgcaggagaaagtaagctgttaagaagtaagaaggcacgaggaccaaaggcacgaatttgcttccacgccacggcccgggacccagggtgcggggaccacgcggagcgcagcagagctcagggtaggagccgggaggccgcgcaggcagagcccgggcagggcggaggggaggccgcggagggccgggtggaggtccttaccgccagccccaaggtctgcagcatctctctctggtctttgtccccagggccgatgtgcctccgagcgaagtcgtcgtgtctgggcagaaggcgctccaggaggcgcgaggccccagccgcggcgctgtccccgccgccactgctgctgtcccggctccgcggcgcccagcacggccccgatcccccagccaggcggcggccgcccccgaccccgcggcccaggcgcagcccccacgccctggcacaggactgcatggccgcggccaccgtcccctgccccggcccgcaagggtcagccgcgctcttggcccctctcctggcctcggtcccccgggtggcggctgcgcccggcctggagcccctttcgctggacagtcggccggacagatggatggacgctcgcgggcaatgaatgggcgctgcgctcaaccaagacactcgcgcaaagttgtggctccacccaaggcacctgctccgcacactttaagcggcgccctggaggcgggaggtgggttggggccaggaagcccttggccaatgaaagtagacagagggggagggggcggaacagttcccgcccccgccccctcttcctaccctcttcccagcccttccgtggagtcccgcttcccctggaccggaggctgccatctccagtcctacccactccgacgctggctggtgccgggggccgggacgctccgtacgccgcccgccagggtgtggagccgcactggggcaagatcaggtgggacagcccaaagactccgggccaagttcctgggggactcggcggagatggaagatgattctcgaagctctccatttccttaattttgaggtatctttctctgtcacatttcatctcagggaaattaatatgggcagatggcggttcttttatctttgcgggagcgtgataaagttact

SEQ ID NO: 101148 - DNA, 152 bp, Homo sapiens
  chr9:66455725-66455877
  hyper
gaaagttgtagagtgcgcccctcactgtggcaggagcagtggcgctgagcgtgcccacgggccgcggcttgggtctctctcattttccaggtggtatggccgtggacaatggcagtggcgcctggctggcccaagagcccagtccagctacg

SEQ ID NO: 101149 - DNA, 32 bp, Homo sapiens
  chr9:66455997-66456029
  hyper
cgcgctgcgctttccgccgacctcccagagcg

SEQ ID NO: 101150 - DNA, 300 bp, Homo sapiens
  chr9:66458292-66458592
  hyper
cccggcccagccaagcccgcatgactccaggcgtcatcgccaccccggggccgcgggtctcggatccaggacccccagaggcgctcgcccgtgcccccgggcagctgtctccctctacacccgaggaccgccggcctcccagagagtcccgccgtctccggcggccaggcctggctcaggaccaatgtggcaccgccctgctgttgttggggggcgccgccggaggcctctgtcccctgcgcaggcttccggctctaggggcggcctcctttccgcccacgctccagtccttccgggagc

SEQ ID NO: 101151 - DNA, 180 bp, Homo sapiens
  chr9:66494095-66494275
  hyper
cccagtcggcggagcatggtctgggtggctgctggaatgcttgcgctcgaggcctgagggacccactgttggtgccacctgccctgctctgcgcctctccacgcctgcgccggcgccccctccgcgcctgcgccccctccgcgcctgcaccccctccgcgcctgcgcctctctgcctttg

SEQ ID NO: 101152 - DNA, 157 bp, Homo sapiens
  chr9:6704461-6704618
  hyper
caggcagccaagaaacgcggagacagactactgggactgcgacgtctcctctcctgttcgctgcgatatgccggcgtcgtgttgagcgggctgcggacacagacagcctgcccggccccactgagtgtttgatccccatcctcgcagctctctagag

SEQ ID NO: 101153 - DNA, 76 bp, Homo sapiens
  chr9:6756353-6756429
  hypo
tggttgggatcctgacgttacatgcacacatttggaaaattcccagttgagtatacgttagccaagttcagaattg

SEQ ID NO: 101154 - DNA, 76 bp, Homo sapiens
  chr9:6756729-6756805
  hypo
tctgtgtgtgtagcggaactttgtttttaacaactaaagaaatatggtgacccaataatcccgttagccttagctc

SEQ ID NO: 101155 - DNA, 127 bp, Homo sapiens
  chr9:69197629-69197756
  hyper
ggggaaacagttggccgatactgttactattatcagcgttattagcggccaggacagtgtggggggcgggcgggggtaaggggcctccccgcgcctcccagcccttcgcgctcggctccagctcttt

SEQ ID NO: 101156 - DNA, 30 bp, Homo sapiens
  chr9:70652569-70652599
  hypo
ctcgaatgcagggtgcgcctctggcctgct

SEQ ID NO: 101157 - DNA, 120 bp, Homo sapiens
  chr9:71200600-71200720
  hypo
ctctttatgagaatctaactaatgcctgatgatctgtcactgtctcccgtcacccacccccccacccccgccccaccgccgatgacacggtctagttgcaggaaaacaagctcagggctc

SEQ ID NO: 101158 - DNA, 176 bp, Homo sapiens
  chr9:71223791-71223967
  hypo
tgatatcattagatacgatattagcccgaggctgcagcagcgcatccccgggcgcggcgcccaccaacactcacagtgcaagggcttggctccgagggggctgggagcccgggcgccctggagtgaggggggccaggagcgggctctggaggctgcagaggcgactctggagagga

SEQ ID NO: 101159 - DNA, 29 bp, Homo sapiens
  chr9:71369369-71369398
  hypo
ccaccacgcccggccggttccatgatttt

SEQ ID NO: 101160 - DNA, 106 bp, Homo sapiens; identical to SEQ ID NO: 42130
  chr9:71425241-71425347
  hypo

SEQ ID NO: 101161 - DNA, 27 bp, Homo sapiens
  chr9:71500809-71500836
  hypo
aaatttggccaggtgcggtggctcacg

SEQ ID NO: 101162 - DNA, 27 bp, Homo sapiens
  chr9:71501076-71501103
  hypo
agagcgagactccgtctgaaaaaaaaa

SEQ ID NO: 101163 - DNA, 35 bp, Homo sapiens
  chr9:71576130-71576165
  hypo
tcaaaaaaaaaaaaaaaaagcgtgtcaccacaaat

SEQ ID NO: 101164 - DNA, 82 bp, Homo sapiens
  chr9:71583902-71583984
  hypo
tctttgggcacagtgcgtagcttctgagggcctcatgtgcttcatgtgtgcaactgggatgttaatacctaccctgatgggt

SEQ ID NO: 101165 - DNA, 30 bp, Homo sapiens; identical to SEQ ID NO: 15216
  chr9:7164747-7164777
  hypo

SEQ ID NO: 101166 - DNA, 18 bp, Homo sapiens
  chr9:71655284-71655302
  hypo
atgtaaatatttatacgc

SEQ ID NO: 101167 - DNA, 30 bp, Homo sapiens
  chr9:71704692-71704722
  hypo
gctctgtgttagcagcgtctggatgggtca

SEQ ID NO: 101168 - DNA, 120 bp, Homo sapiens; identical to SEQ ID NO: 42133
  chr9:71734802-71734922
  hypo

SEQ ID NO: 101169 - DNA, 19 bp, Homo sapiens
  chr9:71738790-71738809
  hypo
ttatttattttgagacgga

SEQ ID NO: 101170 - DNA, 311 bp, Homo sapiens
  chr9:71788950-71789261
  hyper
cccggccaggagtcgcgcgtgacgcggttcgccgcaggagcctcgaaggcgcggcgccggcgagcccttccccggcaggcgcgtgggtggtagcggccaatttgacagtttcccgggccgggcggccagcgcggaggcgccacgctcgggtcgggggcgggctgacgccgccgccgccgcgggaggagggacaaaggggtgggtccccgcgggtcggcaccccggcggttgggctgcgggtcagagcactgtccggtggtgcccaggaggagtaggagcaggagcagaagcagaagcggggtccggagctg

SEQ ID NO: 101171 - DNA, 61 bp, Homo sapiens; identical to SEQ ID NO: 32483
  chr9:71789696-71789757
  hyper

SEQ ID NO: 101172 - DNA, 27 bp, Homo sapiens
  chr9:71921187-71921214
  hypo
tctgggcaagatgatcgccctgaataa

SEQ ID NO: 101173 - DNA, 251 bp, Homo sapiens
  chr9:71939733-71939984
  hyper
acagagaaggctcctcgctcttctctagccccagctcggcgggtggggacagacgctgagactctcggtggccggcgctgacgtgtcctggccgtgaggtgcctcccacctcgagggacttacttaaatatttggggcagggcaccctcccaggaccccaggaagccggcgcaggttcggcggggaccctgaggctgtggcgcacttgccccggcacagcgcgagcacggagtgcgcgtgggtgagagtga

SEQ ID NO: 101174 - DNA, 30 bp, Homo sapiens
  chr9:72286957-72286987
  hyper
aggcagcccctctcgcgtccgggggcgccc

SEQ ID NO: 101175 - DNA, 44 bp, Homo sapiens; identical to SEQ ID NO: 42135
  chr9:72819967-72820011
  hypo

SEQ ID NO: 101176 - DNA, 269 bp, Homo sapiens
  chr9:73027315-73027584
  hyper
catccctaaaaggctcgaagtaaagtgcgccgcgtcccccctcggtttcaaccacttctctgcaacccgacaagagaattaaataaaagatacgccatctgacttccccgctgccagcgtctcccaggtggggtggccccaccgtcgcggggtgcgggagagtcccgggggcggggcgggacaggggaggggcggacaccactccccgcgaagccacgcaccgcactcgctctgcccgccagtttaaggctctccgtggctcccggagg

SEQ ID NO: 101177 - DNA, 336 bp, Homo sapiens
  chr9:73027969-73028305
  hyper
cagattcggtggtcacgtcgctgtcggatcccatatcctcatctggactttccagactgtcgctgcacacggagggggtctggatgggtcggtacttgttcaggtccaacaagctcttggcgatggtgaccagtgtgcagtaatccttccaggtgtcccccgggtcaccgtgctccttggtcacctcgcgctcaggtagtcgcagccgctcggcgtccggagcgaccccatgctccggcaccgcagcgcggttcgaaatggaaaccagacactgggcagccacgaagtccatgtaggcggccgcggacatggtgcgggcgacggcagcccaggcgg

SEQ ID NO: 101178 - DNA, 34 bp, Homo sapiens
  chr9:73032801-73032835
  hypo
aacctattctttttccgtggtaaattgtattatt

SEQ ID NO: 101179 - DNA, 278 bp, Homo sapiens
  chr9:73219-73497
  hyper
gtggtgcggccctgacggtcgcgcaggccgacggacgacagcgcgctccggatgaagttgggcgggtagctgcgctggccctggaagaggccggtgggtcgccggtgctcgcggggcgcggtgggcactgtccgcaccgggatggggctcccctccgcggcgcctcccggccggtcctgctgcggctccggggccggagggaatccgcagccggccgggggcctccgccagcctggctgcgcgccgggactccgcctcgcgcccggccccctctccag

SEQ ID NO: 101180 - DNA, 30 bp, Homo sapiens
  chr9:73438545-73438575
  hypo
ctttttaaaaactatcggccatcacacagt

SEQ ID NO: 101181 - DNA, 97 bp, Homo sapiens
  chr9:74061662-74061759
  hyper
ctccggctgcgtctgcggctctccgcgttgtcctcgcggtcggagcagccccgctccatttccgccgcatccctccacttcttccccatgagaagtt

SEQ ID NO: 101182 - DNA, 323 bp, Homo sapiens; identical to SEQ ID NO: 32486
  chr9:74061787-74062110
  hyper

SEQ ID NO: 101183 - DNA, 173 bp, Homo sapiens; identical to SEQ ID NO: 42137
  chr9:74469850-74470023
  hypo

SEQ ID NO: 101184 - DNA, 582 bp, Homo sapiens
  chr9:74764297-74764879
  hyper
gagccagcccctgggcgcggcctgcagggtaccggcaaccgcccgggtaagcgggggcaggacaaggccggagcctgtgtccgcccggcagccgcccgcagctgcagagagtcccgctgcgtctccgccgcgtgcgccctcctcgaccagcagacccgcgctgcgctccgccgctgacatgtgtgccgctcagatgccgcccctggcgcacatcttccgagggacgttcgtccactccacctggacctgccccatggaggtgctgcgggatcacctcctcggcgtgagcgacagcggcaaagtaagcaggcgcggggtcgagcgcactccgacgggcgggaggataggtgcaaggaacctggcgcggtgcttcgcgtagcccggggttcgctcggtgcgcagtgagcgccgcggctccggagttgaacttgagtctttggctcttgggcaacgcagagagaaccctggcgctaggttcgtgggctggctggggagttcccagaagtcgggagcagtggcgtgctaacgccacaactggctcgacagcagtccgggctgcggtagagccgggagcaaggatgt

SEQ ID NO: 101185 - DNA, 30 bp, Homo sapiens
  chr9:75545858-75545888
  hypo
gaagcatccatagtacgccacggggatcca

SEQ ID NO: 101186 - DNA, 22 bp, Homo sapiens
  chr9:76966084-76966106
  hypo
ggcaccgcgcctggcctgcatt

SEQ ID NO: 101187 - DNA, 606 bp, Homo sapiens
  chr9:77111763-77112369
  hyper
caaaccacctgcccacggaaacccccgccggagaccgaagtttacccaaatagcgctcggcaaagcgctgccataaattcaaaactaactctgccgggcccgcgggggttgcgagacagggaccgaacgtgaaacccggggagccccgcgtctcttgcctccgaaggttttccgtgatcagtgtccccttctctgctggagtcggaagtgcctgtcacctgcggatctgcccgactctcccggtcggcccttcttctctgcccagttcggacagtctcgaattccccgtcgcagccccggccacctcggactccctggtccccagcccccgccccaccccccgcctccaccacgtcccctccccgcggtcccagcctctccaggcgctgctgggctctgattggcggctgcgctgacagcaggcggggcctggaagtcgcggccaagcccgccctcgcgtataagcccctctcagcgctctctctccatctctcccctctctttctctctcgctgctcccttcctccctgtaactgaacagtgaaaattcacattgtggatccgctaacaggcacagatgtcatgtgaaaacgcacatgctctgcc

SEQ ID NO: 101188 - DNA, 193 bp, Homo sapiens
  chr9:77112703-77112896
  hyper
ttaacatagcggcggcggcggcaaacgtcaccctgcagccacggcgtccgcctaaagggatggttttctcggcagagcagctcttcgccgaccaccttcttcactcgtgctgagcgggatttttgggctctccggggttcgggctgggagcagcttcatgactacgcggagcgggagagcggccacaccatgc

SEQ ID NO: 101189 - DNA, 444 bp, Homo sapiens; identical to SEQ ID NO: 32490
  chr9:77112897-77113341
  hyper

SEQ ID NO: 101190 - DNA, 151 bp, Homo sapiens; identical to SEQ ID NO: 32491
  chr9:77113558-77113709
  hyper

SEQ ID NO: 101191 - DNA, 1147 bp, Homo sapiens
  chr9:77113805-77114952
  hyper
cgttacgcttgctccggctggactctgggcctctcgaagggctggagggtgggtttcggggagtcacttggtctcctctcctgccttgccggagacctcaggtttccttcgcgctgtgctcggcctttcttcactcttttactgaagagccaggcgggtgtccgcttgacatggggatctgtgcaagctctgggcacccacccccactcccagtccctcttcctggccacacagcggttaatcgggggctcttctctatccttcgcacgtacccctgggtcttgacaacagaaagttagtaacggccagctccagaccttcttgcatcccagacccggagagaggtggtctaggcagggagcacttgggagagttgggatgcaatcactggtctcctccttccactgaaagtgatcctctcccacccagtccccctacgcccctagaggagcaccccaggaggcagcgggtctcactcccactccctcccgcacccggtgagccccgagcctggactcaagggtttgctggctggacgctgggatgtgtcaggaaagggaaggagaagaaggaacggagagagactgtccatgggggagggggttgactgtagataagaaacaaggacgtcctgatgggatggtcttgattggccggctcgctgggagtggggcacccgtgtgtgtgcgcgctggctccagctgattgtcccggttgggggttggttacacgctccactgtctaaattctttcaagaaactatacttgggcaattggagagtagagaaccttggcttagtaagagacgcccggtcttttgtttttctttttctagcccatctcaccatcccatccattctttcggtttcccccgtcccagtccagagctgccagttcgtccctccccttcttcccttctaactttccccctgtggctgggttcatactttctgaacgtcgtaaactatgcgccacctcagctcggacccagcactaggacctagggcataaaatccgctcactccttacatcgtagaaggagtgcggcgcggggtggggatgggttgtagcttgatctagcatctcctgaaggagcagtttgcagatgactgtcctggttcgccacggcggtcgctttgaggactcc

SEQ ID NO: 101192 - DNA, 274 bp, Homo sapiens
  chr9:77115210-77115484
  hyper
tcttcatattttccccggacagtgccctaccacagtatgagaggctgttccgtaagaatgggattgagaaaagatccaggctactctgacgtcttgtggagttgggagttgaacttgagagtgaacttgagaagtgaaagcgggaaaagaatcagctttcgctcgtgcagggctactaagcaccctatgttgggagaggggccatttttgacctgggctttacggtgggcccactgcatttccctcatccacacgcgcgcgctttccattccca

SEQ ID NO: 101193 - DNA, 209 bp, Homo sapiens; identical to SEQ ID NO: 32495
  chr9:77502024-77502233
  hyper

SEQ ID NO: 101194 - DNA, 123 bp, Homo sapiens
  chr9:77502613-77502736
  hyper
gctattctagatcctcgttagatgtagtgtccctggccccacccacttctatctaaggccgggggcgcagatctagcgaatcgcctaaggtccttgttccccgccagtcgagcagcctgagct

SEQ ID NO: 101195 - DNA, 30 bp, Homo sapiens
  chr9:77802622-77802652
  hypo
agtgaggtcgcgccacgccaacaccttgac

SEQ ID NO: 101196 - DNA, 34 bp, Homo sapiens
  chr9:78505588-78505622
  hyper
gccactcagaatcctcgcgcgctgctcggagccg

SEQ ID NO: 101197 - DNA, 77 bp, Homo sapiens
  chr9:78506339-78506416
  hyper
ttcttgtcccctctgcgtggaaccccctccccctcttccagatgtgctctagcagctgttgccctaactcttgggcg

SEQ ID NO: 101198 - DNA, 256 bp, Homo sapiens
  chr9:78506476-78506732
  hyper
acaccccagagttgccgggtccgtgttttgtttacttgtcttttccaagccacgcgggactggtagggtctcgggaaaaatccagagtgcccccgtggtggcttcagagacggctggaccttttgacctgaaaagtcgagtagcactagtaatctgaggcagtctcagagagggtgatcgtggggagagggggaaattaggtcttttgggggatagggggtgagcgcgcctctgatgcctgcggggaagggaaagc

SEQ ID NO: 101199 - DNA, 104 bp, Homo sapiens
  chr9:78507584-78507688
  hyper
cccgcccctcctccccgccgcctgggggatgcggcacctggagaggaggcagagctgctgtcgccgcgtttagaaggagctggggagtgcggggagtgttcaga

SEQ ID NO: 101200 - DNA, 63 bp, Homo sapiens
  chr9:78557098-78557161
  hypo
gctgcggagctggctcggtgttgccaatttaaaaggacatgcaagtctcgacttttacatatc

SEQ ID NO: 101201 - DNA, 78 bp, Homo sapiens
  chr9:79073402-79073480
  hypo
tttttttaaacaacatggaaacaaataagacctcgttctgttttctaggagctaaaaatccaacgaaagaagacacag

SEQ ID NO: 101202 - DNA, 95 bp, Homo sapiens
  chr9:79231284-79231379
  hypo
tgattctttctctcacggtgttggttgactttttcccatagatgaagagaatatttactaaaccaaaatttggggcacatcgtctaaaaactgcg

SEQ ID NO: 101203 - DNA, 75 bp, Homo sapiens
  chr9:79409102-79409177
  hypo
ttcaccaacgagatacggtgcttcagagaaaataaataaatatgctgatatggcaaatggcggaaccaggatttc

SEQ ID NO: 101204 - DNA, 30 bp, Homo sapiens
  chr9:79521303-79521333
  hyper
cagcgcccagaagtgcgagccaagtgcaag

SEQ ID NO: 101205 - DNA, 541 bp, Homo sapiens; identical to SEQ ID NO: 32498
  chr9:79626876-79627417
  hyper

SEQ ID NO: 101206 - DNA, 91 bp, Homo sapiens
  chr9:79628238-79628329
  hyper
tggatcaacaacatccgccccgcccccccaactccaccaccaccaccagacacacacagacatgggcgggcacccacgtgcccaaaggtgc

SEQ ID NO: 101207 - DNA, 249 bp, Homo sapiens
  chr9:79628692-79628941
  hyper
ctggttgctgatgtgcggagtctttgttattagtcgtcggagggagcgcaagaaagttatttaatttttaatcgttggttatttatttggtggttatggttgtcagtggccgctacctaaacagacacggcccgtaggaaagcttctggatgttggccaagaggtgtgaggcgcgggtggactgtaaaggggaaattgctctgctagggtgacacaaacgcttcccatctccacgctgattgcgcgccc

SEQ ID NO: 101208 - DNA, 199 bp, Homo sapiens; identical to SEQ ID NO: 851
  chr9:79629207-79629406
  hyper

SEQ ID NO: 101209 - DNA, 30 bp, Homo sapiens
  chr9:79629607-79629637
  hyper
aggcaacagggtcatcgccactttagagaa

SEQ ID NO: 101210 - DNA, 587 bp, Homo sapiens
  chr9:79629850-79630437
  hyper
aacctgtgtcctgggcgcctgccgggcaaggcgcggggactggacgggtcggaaacggggcagggatgcacttcgcagagatgtcaggtcgggttggtgacgctggaggcgacggattcctaaaacgttataaggggttgacgggtggcgctgctgccctgcagcgtccccagctgcgcagctcctgagctccccgctccgagcgcccagacccccagcgccactccaccgtcgagatcacagcttcaaacctcaactccttggagccttcgaaggcgcagttctgactactgagtatttcctggaaagaaaaagaagcccaaagcggtgaaatgatgcctccagggtcatccaggcctggactcgagctggaagccacgtttccgagtcctggggctggctttctcctaccctcttcaaatccactttaggagtttcgtctgggaaaagtatgcgccgagaagtcagccgaaggtcaggcaagtgccaggctagcgtgaccaggaaggctcctgggaggaccccaaacgtaactaacccaggcaaccttccgcacgtcagctaagtcagtgcgtaaagggagaacc

SEQ ID NO: 101211 - DNA, 1223 bp, Homo sapiens
  chr9:79631016-79632239
  hyper
gtcggaattaacctccggggaagtaggggaagaggagagcgcgcccccctccccaccgcggccccagctctgcaccccggcccagtgccgcgcttggaatcccccaggatcctccgcggcggccgcagcccgccactctccaaaacagacacgcgacccgagctccctgtctgcgctctaggcagcaattgcggcctgggccgccgcgtccggctgtggcctaggtggtgggaagtactttctaccctcgccaagcacaacctgaatgcggaagcgtgaggctcggggcgcttcgctcagcctccgagactgttttgtcccaggttgcgtggaacctggctcgccgaggccgaagacactggccaagcccctggcgtcccctggcgctgaacctgaggttgtggcggcgggtctgcgggctgtagcgagctcacccagtgagggcctggctcattttttgtgctcagggttcgcgttatgcgcccaagatttgtcccgggagtccctgaagggcccctcccctcgatcggttcccaggagccgcaagtgcccaacgggcacggtcccagagctgctccccaaaaggagactctgctgttccagcaacccgcggaagggatgctatccgaggtatcaacaaaagatccctttgctcgagctgcgtgtggggtcgaagtccggagagcccttaagtgtgcggcacgcagagctcctcagcagcggcctgacagcggtgcaggagaccccagcttcctgggctgggacagggctgttgtctcacggtcttgttccaaggaaaaggagccacctggctccagcaggctcttgtcaaactgtgagcgtccttggaattctgtggcttcccgaggccaagaggctgtccgctgctcggctctctcaagtgtctcagcggacaaaaatcgcgcagaaactcctatggcaggaggaaagcttccgacatacagtgaaagagaaaacatcttactttgaaaagggcttaggaccaagaagctgctcttttccccgggccttcttgcaagcttcagtcgtaacatctattctcagacgtcttctggcctaggacaaactggccacatagagctagccagaaatctagctcctgactaaagatggaaattacgggcctgacccgctcacggcactcctgcgacctggctaagccaccccacggacagacgtgctcccaccgtccagctcaccaa

SEQ ID NO: 101212 - DNA, 98 bp, Homo sapiens
  chr9:79632823-79632921
  hyper
ccccagctcagacatcgccatcccagagaaacctcatcttgtccaactcactcgctccaggaaagtgtggtggagcctccattcgccaagccctttag

SEQ ID NO: 101213 - DNA, 525 bp, Homo sapiens
  chr9:79633212-79633737
  hyper
gagagaagctcacagcgagtagatgaaaacagggaagggtaaaaggaagggggcggaagagggagatgccagagagaagagaagcaagaaggcagtgtcctgttccccctccaccgtgcttggtggcccgggtggggcgcagctgcgggaaatgcacccggagctgtgccccctcccggcgaacagcctgcgccacccgccgcaccgggaggtggctgggggctgccgagcgagtggtgaacgcgatgggtggagagcgcccgaaacgaggtggaaaagggggcgggggcgaggcacggcgccttcttgccccttcttcagctacagacgcggcggcggcggctgagtccctcagcctcggtcatgtgatagtctcgaagcgctagctgcgggggtctcggcgtctcggggaccattacaaaacgcagccaggagagcgcgtcgctgccactgccgtcgcctctcctcctcaagacaagcccgggagaaaggcggcagctgcggcgcggacggctgagcctcccc

SEQ ID NO: 101214 - DNA, 1711 bp, Homo sapiens
  chr9:79633738-79635449
  hyper
gccagcactcacccagcattcgcagacgccctctccagcccgccgctcgctcccagagtcctgcgccccacactcctcagcagaacctgcgggcgctgccgcttcagaaaccaccaaagttttttctcctcagcgacagcctagggctgcgcgtctcttctaaccccggcgacgctgcgagcctcggagaaaagagaggcgccctagaagccaatcttctctctccttaccctgatttttcactccaggaaaaggagaactccagcgcggtctggctaagtgcctggccaggggcctgcgtccagggcactggaagtcctgctgtcactggcctccaggacagcaggcgcaaactcagatttaaagggccagagtctctactgcccagaccttcctcccagccatcttggtctgggtttccctcggacctagaaaaagcaaagaggccgggaggaaacacggccccttgccactctcctctgcagccagctccagcactcagtctttggccacccgggggaagacgcagagaaggcggcggtaaacctggtgcactccgcccgcgactgtgcgcgccagtcggcaaccgtcggggccagaagttgccagcttccgagagctgagtaggcccgaaaggccaaggtcggagacaccaggcaattcggagaaggcaggagagagaagcagagagggcctggagggcgagagggcaaagtggcgggactggaggggccgagtgggaattagtgggggcagccaggccccaggaacggagtgcggagagattctgtggtccagtgcgggccggagggcggtggaggagccgggggcgatgccgcggccggggaagagctcgtacagcgaccaaaaaccgccctactcttacatctcgctgaccgccatggcaatccagcactcggccgagaagatgctgccgctgagcgacatctacaagttcatcatggagcgcttcccctactaccgcgagcacacacagcgctggcagaacagcctgcgccacaacctctccttcaacgactgcttcatcaagattccgcggaggcccgaccagcctggcaagggtagcttctgggcgctgcaccccgactgcggggacatgttcgagaacggcagcttcctgcggcgtcgcaagcgcttcaaggtgctgcgcgccgaccatactcacttgcacgcgggaagcaccaagagcgcgccgggcgccggtccgggagggcaccttcacccccatcaccaccaccacccccaccaccaccatcatcaccacgctgccgcacaccaccaccatcaccaccacccaccccagccgccgccgccgccgcccccgccgccgccgcacatggtacactatttccatcagcaaccgcctactgctccgcagccgcctccgcacctcccgtcacagcccccgcagcaaccgccccagcagtcgcagcctcagcagccgtctcaccccggcaagatgcaggaggcggcggccgtggcggcggcggcggcggcggccgcggcagccgcggtgggcagcgtgggacgcctgtctcagttcccaccctacgggctgggctcggccgccgccgctgccgccgcggccgcggcgtccacgtcaggcttcaagcacccctttgccattgagaacattattggccgggactacaagggcgtgctgcaggctggagggctgcccttggcgtcc

SEQ ID NO: 101215 - DNA, 234 bp, Homo sapiens
  chr9:79635745-79635979
  hyper
ggcgccatccaccgtgtgctccgcggccgcggcctcgcccgttgcctctctgctggagcccacagcccctacctcggccgaaagcaagggcggctccttgcactcggtgctagtgcactcctaggggacccggcgggcgtggggagaccagcggggtgagagacgccgggcccggaaccgcccaaaccacccgacggggagagggcgccctggtcaggccgggcagagctggcg

SEQ ID NO: 101216 - DNA, 363 bp, Homo sapiens
  chr9:79636190-79636553
  hyper
taggaaagcctcattcgctggtaaattggaagtcgattctgacccttattcctgggagcagaagctggcagagctaaacctcccgcgaagaatccaacagagagtgacgctgaaacggatctcagccaccacgtttctctctgctggtcgcatcctcggcggtcgcctctcgtgaacattcaagacaaaactgccgtccactaaggaaatttcgttttatttaagaaggaaaagaggaagcgtttgataccgttattttcctagtcagctaaatgggcaaggaaacggtgtcatgaataaagtcgctttggagggggaaggggaggagaggaggcagcgggaaccccacgaaatatctttggg

SEQ ID NO: 101217 - DNA, 749 bp, Homo sapiens
  chr9:79636807-79637556
  hyper
aaatcacttgtatagcgggattttgtttccctaacttacgaatgcaggaaaaactcggcacatcactcgacaatattgctcttaacgcttgcagaaacgttccatggctgttcccttccagtctcctcggacggaagcaaggggaccacccagtcacctttgcacgctgcggctgtttttgtattccgtgtgctgtttgagcgcttatgtctttcaggcgaattaattcttcagtttcaattcgtgaatgggaaagaaacttgccttgtcgctcttgcccttcccccctcttgagccccagggaatagcactttactcgcgacacaattttgggaatggaggggggcagagtggggagaaatccgctttgccctttggctctaagtcacctccgcctcttgtccgcgccgcgttcgggttgtgactttgtttatgtctgctggtgttgtacgcggtgttctctattaaagcttctctctggatatctatgctagccccgtgtgaaggtgtttcagttctccaaggatgaggccgtggtttgagtgcccacagttaggttagggtactttgcaaatccttcccctccctcttatttcttaacttcagaacttcaaaggggtgagtacacgggcgagccaccagtaagcaccgatttccttcattgctcctttcagcctttggcacaatcatctcttttactatctattattattagtagtagtattttagagacaagatcccactatgtt

SEQ ID NO: 101218 - DNA, 273 bp, Homo sapiens
  chr9:79637616-79637889
  hyper
gctaggattacaggcgtgagccatcacgcccggccaccacctatttttaatatgtccgtttcctaattgaacttaagtccaccaccatggtagagactgaattagcaaaaacccgcaacagtgcgtttttcctgtcaccactatccgtcacctctctcccattttgaggtcctcgactaccatctaaggccaggaactcggtgtcagcggggtgggtgcccgacggcgcccccttaagtctgcggtcctggacggaggcagccgggttggcgc

SEQ ID NO: 101219 - DNA, 108 bp, Homo sapiens
  chr9:79638136-79638244
  hyper
gctggggcctgggaagccgcgtcccggcctccgccctccaccctttagcacaggtctactttgaaccagcttccgtgtgcccagccaggccaacgaaagtcacctctg

SEQ ID NO: 101220 - DNA, 223 bp, Homo sapiens
  chr9:80263294-80263517
  hyper
aacctgcagccctggcgtctgctggacttgcccttctgggcaccccaagccgaaggcgcctggaagtgaaaggggacgagcagggggcgcggagctgggggtgggagctggcacctctaggagcagctcccacacttgcctccctggctggggcgtcccggccaaggtttgctgtaatctgcgcgtctggccgccaggcaccgggttccgacaggtgagtgag

SEQ ID NO: 101221 - DNA, 30 bp, Homo sapiens
  chr9:80263764-80263794
  hyper
tgctggctctgagctcggagaaggagccgc

SEQ ID NO: 101222 - DNA, 23 bp, Homo sapiens
  chr9:80303276-80303299
  hypo
ttcctattcggccatcttggctc

SEQ ID NO: 101223 - DNA, 30 bp, Homo sapiens
  chr9:80645516-80645546
  hyper
caccggccactccaccgcaggccatccccc

SEQ ID NO: 101224 - DNA, 35 bp, Homo sapiens
  chr9:80645867-80645902
  hyper
gtgaaggcagtggccgggggcgcgcccgggagggt

SEQ ID NO: 101225 - DNA, 186 bp, Homo sapiens
  chr9:80646323-80646509
  hyper
ggccaccaggtgggccgggggcgcggtgggagcggatagtctgggccgacgggagaagagaggcgggcgcgggaggcgggcgctggctcggggggcgcgtgagagaaggccgccgcgcccggcctcgctcagacgcccgcgcctccttccccgggaacaggcggcccgcctcgccccccgagccgc

SEQ ID NO: 101226 - DNA, 76 bp, Homo sapiens
  chr9:80647171-80647247
  hyper
acgcgcagcccgagccggcggccgccgttgcgtgccagggccgcagccgacctgcggctgccgtccggccgggcgt

SEQ ID NO: 101227 - DNA, 58 bp, Homo sapiens
  chr9:80849784-80849842
  hypo
ttatgaatatacaagcgtttactatattaagatttgagcatgtcgcacataaaaataa

SEQ ID NO: 101228 - DNA, 147 bp, Homo sapiens
  chr9:80852173-80852320
  hypo
ggcatgagccaccgcgcccggcctgtcttcattttttaaggtgtatataagaagtttgtaaagtgctttacaaatacaagccatttgtaaatgtatagtggtataattagggatccagactctctgattattcggaaaatatgttag

SEQ ID NO: 101229 - DNA, 145 bp, Homo sapiens
  chr9:80911891-80912036
  hyper
gaggagcaactgcttcgactcggctcagaagcgcgaccaatggggatgtgagctccttcgcgcgaaccaattagcgcagggcctgcgacagcacgggccaatggggcgccgactcggcgcaggaacaaggcgggggttcggggcc

SEQ ID NO: 101230 - DNA, 148 bp, Homo sapiens
  chr9:81181130-81181278
  hypo
aacatctttctgatacgttaatgggaaggcaaaaacaaaacaaaacaaacaaacacacaccaccttttcccactgggagatgtaacactttaacaaaatagagtctgaaagagccctgggtctagcaagcctccggggagaggctgtg

SEQ ID NO: 101231 - DNA, 154 bp, Homo sapiens
  chr9:81358951-81359105
  hypo
gtctgttgattgttacgtctttcaagcatgaattaatgaacagtttatggttattataccagcccgaaatattcaatataagctcaggttctacaattgatttggcaagaatcaattctgagtttgtctacagtggattcggcagggacttggc

SEQ ID NO: 101232 - DNA, 38 bp, Homo sapiens
  chr9:82185345-82185383
  hyper
ctaaggatggaaaggcgcactgacggaggccgccccca

SEQ ID NO: 101233 - DNA, 60 bp, Homo sapiens
  chr9:82185643-82185703
  hyper
tgctctgttcagtaccgaccgtgttcggggttcacgtggcccagtcggcaaagtttcttt

SEQ ID NO: 101234 - DNA, 30 bp, Homo sapiens
  chr9:82336772-82336802
  hypo
gcagctgcagcagcacgacttcacctccca

SEQ ID NO: 101235 - DNA, 39 bp, Homo sapiens; identical to SEQ ID NO: 32333
  chr9:841367-841406
  hyper

SEQ ID NO: 101236 - DNA, 401 bp, Homo sapiens; identical to SEQ ID NO: 32334
  chr9:841449-841850
  hyper

SEQ ID NO: 101237 - DNA, 181 bp, Homo sapiens; identical to SEQ ID NO: 3384
  chr9:841851-842032
  hyper

SEQ ID NO: 101238 - DNA, 37 bp, Homo sapiens
  chr9:842207-842244
  hyper
cgggagcccgggttcagccttagtttttttttttttt

SEQ ID NO: 101239 - DNA, 71 bp, Homo sapiens
  chr9:84241090-84241161
  hypo
gaactttctcctccccgcaggaaaagtgtttgtgtcagaggtacagattggaaactcgtgacacctcattt

SEQ ID NO: 101240 - DNA, 138 bp, Homo sapiens; identical to SEQ ID NO: 32338
  chr9:842610-842748
  hyper

SEQ ID NO: 101241 - DNA, 941 bp, Homo sapiens
  chr9:842779-843720
  hyper
cgggggttccctctgctcccgggtccctgagatccctgatcccgctctcagggcagggaattccggggttcgcccctctgggcttccccgcgatcccagagcccgcgttccaacagaattgggagggtttattgcgctagaggagtcttcaggatcttcgctcccgccctccgaggtgaggctagaggggagggttcgactccaagggaatcccagggatctctagccccgctcttctagcagagaattaaggaattctctccgctttggggtcccaaaaatctccgaccgcgccttgggagcagagggtttcggggttcgatttcctcgagcgtccccagaatctctgactctccctccttgctgagttgcacttaaattagaaaggatcttggagggcggcagcgctggctgctaggttagcgggaaagggaggctcggccggctgctgcttacgcgggtaacctgtcggaaagccttgtttgtttttctggaaaagtcgctgcaatggacacagcgttgcgcggtttccctgcgcgcctggggcgctttttgtcttcgccctccgtggatggaggctgagcgcctcagccattttgagagctctggaaattttattagcattttaaaatttgcattctcgaccgaagattaaagtgcaaattactttgaagatgttttaaagcacgcttaagaattttaaagaatatgcgcaggtggaaaaaagcgcgccagggtttgagatttggtccgtctgtggttttgtttttttgaaggttcgtaagtaggctggtaatttaacattttaacggaaagttaatgtctttagtattctaaaaggatttttggaaggcagtaatccacgttatttccagttaaaagttgtttcatctttttaagacaggttatttaaaatgaaaagataacgaagaaatgtttgc

SEQ ID NO: 101242 - DNA, 37 bp, Homo sapiens
  chr9:84294953-84294990
  hypo
tcttaagtcctctggcgaaggacgctcctcaatttgc

SEQ ID NO: 101243 - DNA, 17 bp, Homo sapiens
  chr9:85372740-85372757
  hypo
gacgggagctgttccta

SEQ ID NO: 101244 - DNA, 577 bp, Homo sapiens
  chr9:86152387-86152964
  hyper
atccctcaaggctggcgcccagggcagcccggcctctctcactctggggaaacttcgccaccgccccacgcggagaactaaagaccaccggcggagggtgagggggaccgacacggagcggaaagcaggttccgggactgagggcgtctccggagcctgggcgcgggagacagaaatgagtgaacccagctgatgcatgccttctccacgtggaagaagggaggaaataccagtgggcgacatgcaggtgcccctctcagccctcggagctcccatctcctggcggagtagggcccagaggggccagagtccctccggaggcagctgccccgcgcccctagcccgggcgcagtgagacgcgcgcgcagggtgcacgcgaggggaaggagactgggcgcggataacgcgtgcctggcgcttgcagggcaccatgcccctccatgccaggataaggccccccaccctcagaggcctgaggaatcgaaatctggctttctagcagtcccccaatcccctccgggagtgggttccttgttctcgcatgcccaccgcaaaggccccccgccctgctcccggc

SEQ ID NO: 101245 - DNA, 212 bp, Homo sapiens
  chr9:86153332-86153544
  hyper
ctgttcgctcgcctccgcctcgccccctcctttccccgcctccttctgtcgcgcgcgctcgtgcgcctccctctgcccgggctcgctcgccgaggacgcccagagcctgagacccccggcgggctcgcgacgcactcactcccacgcgcgccgagcagctgaaggaggaggcggagggatggctggcgcggctggcccgggtgccctggtgg

SEQ ID NO: 101246 - DNA, 25 bp, Homo sapiens
  chr9:86537478-86537503
  hypo
ccaccctgcccggccctatcaggac

SEQ ID NO: 101247 - DNA, 581 bp, Homo sapiens; identical to SEQ ID NO: 32520
  chr9:86755532-86756113
  hyper

SEQ ID NO: 101248 - DNA, 227 bp, Homo sapiens
  chr9:86886509-86886736
  hyper
aacaaaacaaaacagcgttcctgagcgcccagctgcagcctcctgcgagcacatcatgttccgcacgtctcgctggttcgaggacgcctcgtctgttgctatggaaacagagtagtcaaatcagactgcgacggaggactctactgagtccccgagaacaaattgtttccttctgtttggttccatttggtttaagtagcgggggagaccctcgctttctggataaa

SEQ ID NO: 101249 - DNA, 767 bp, Homo sapiens
  chr9:87282999-87283766
  hyper
ccaatagatgttttacgttcccttcgtaatatttaacgcttggcctagatccgagcattcactctaacgttcggtttcttgatccttcccatccccaaactctgcgggtagatcagtgactattactatattttgaacgagactccaacccattgctctctcgagagagaaggattgcccgcctttttcccccgggcaggagctcggcgaggccaggagagccgcgcaccggccgggcagggacgcgcaggcgtcgggcgccgctggttgcgcatctggcgccagagcgcgcccccagcgctgtgcccgccgcgacccgggccatgggctggtgctccggagcgtgccgggcgctctctccccgcgcgggggcaccagagccctcggaagtgtcaggcactgcggtgtattttccccgttctcttttaaatgactgcggaaaaacagattccgagccgcaaaagggaagacggattctcagacaaggcttgcaaatgccccgcagccatcatttaactgcacccgcagaatagttacggtttgtcacccgaccctcccggatcgcctaatttgtccctagtgagaccccgaggctctgcccgcgcctggcttcttcgtagctggatgcatatcgtgctccgggcagcgcgggcgcagggcacgcgttcgcgcacaccctagcacacatgaacacgcgcaaggtacggcaggggagcaagggcttgggatgccctacgtgggggtgggcatcgcggggagtgaatcca

SEQ ID NO: 101250 - DNA, 50 bp, Homo sapiens
  chr9:87284009-87284059
  hyper
cccctccaaaaccaccgatccccaaataggtggcccggaatgggggcggt

SEQ ID NO: 101251 - DNA, 439 bp, Homo sapiens; identical to SEQ ID NO: 9946
  chr9:87284555-87284994
  hyper

SEQ ID NO: 101252 - DNA, 254 bp, Homo sapiens; identical to SEQ ID NO: 9947
  chr9:87285279-87285533
  hyper

SEQ ID NO: 101253 - DNA, 290 bp, Homo sapiens
  chr9:87285554-87285844
  hyper
cgaggagttaagagagccgcaagcgcagggaaggcctccccgcacgggtgggggaaagcggccggtgcagcgcggggacaggcactcgggctggcactggctgctagggatgtcgtcctggataaggtggcatggacccgccatggcgcggctctggggcttctgctggctggttgtgggcttctggagggccgctttcgcctgtcccacgtcctgcaaatgcagtgcctctcggatctggtgcagcgacccttctcctggcatcgtggcatttccgagattggagccta

SEQ ID NO: 101254 - DNA, 30 bp, Homo sapiens; identical to SEQ ID NO: 42145
  chr9:87326719-87326749
  hypo

SEQ ID NO: 101255 - DNA, 29 bp, Homo sapiens
  chr9:88137397-88137426
  hyper
acacacacgcacagacgcacactcacgtg

SEQ ID NO: 101256 - DNA, 240 bp, Homo sapiens
  chr9:88137486-88137726
  hyper
ctgtcagcaagaaaggaaggcaggctgttgagtagggaagtgggagtgcctgccggcgttctcgtctgtccctacttcatccttcctctctcactgtcttacagcaaaggactacagcaaaggcgcgttcagcgcctgcgcggccaggcccggggtgctgggttgcggcttcccgcgggtaaaccctgtcggtacccgatccccgtccgcggaaggccaggagaacgcggttccccttct

SEQ ID NO: 101257 - DNA, 240 bp, Homo sapiens; identical to SEQ ID NO: 3427
  chr9:88137874-88138114
  hyper

SEQ ID NO: 101258 - DNA, 43 bp, Homo sapiens; identical to SEQ ID NO: 32372
  chr9:8857443-8857486
  hyper

SEQ ID NO: 101259 - DNA, 1005 bp, Homo sapiens
  chr9:8857685-8858690
  hyper
cgccaacactttcctccagcgccttcgcgccccgccacggccgcgccgccgcctccgggcggccaatttaatcccgcggagcagcggccgccgccgccgaagcccccctggtcgccgccgccgcccagccctcgtgcggccagcccagtccagagcgaggaagtggaagagagtcagcgagtgagtccaaaaacccgaaatccagcatccaaggcagcgcgtccccccgccctccctccacccctacccccttttcctcctcctccgcctcctcctcctcttcccgggccgtcctcttggcccttctgagcccgcggcttccgcggcggtttctcctcctcccgctcctcctgctcgccctgcgcccgcttctctcgctgccgccgccgccgctgtttgtctcctccccctcctcctcctcctcctcttcctcctcctcccgctcctcgatgctccgccgctcgcggctggggggtccggggccgcgtctcctctcctccctccgcctctcctctttcctccttcctgctgcctcttcttttaaagcggattctttggccacaaatagcaactcggctgcccccctcggtgcctccctccccttctcttcttccccccaaaagtgaagcgcacgcgaggtaaccagaaactgaggctcgtggggggagaggggtgcgaggcgacgcctgggaaagggcccgagcagagtcgagggccgggaggtggggtggccggtgcagcccagtctttggacctggcttgaacctggtagttacggctgcagaagaggtggtttggggaggggggaaaattaaacgaaaaagcccaggaaagtcattggaaaggcttctctctttgtttccttgtgtgggtgatttctaaaatcctcgtaacgtgctggggatcccacggaattgctgtgctccagcgctgggggattgtgtgtgcgcgttgcctgcgcgtgagtgtgagtgtgggtgcgcccggacgcggggagagctgggc

SEQ ID NO: 101260 - DNA, 30 bp, Homo sapiens; identical to SEQ ID NO: 42146
  chr9:88832474-88832504
  hypo

SEQ ID NO: 101261 - DNA, 30 bp, Homo sapiens
  chr9:89083624-89083654
  hypo
aggcatgagccactgcgccaggcaagggtg

SEQ ID NO: 101262 - DNA, 67 bp, Homo sapiens
  chr9:89131689-89131756
  hypo
agccttctcctgtgtcgactcccagagcggccggctgggtcctgcactcgctcgttcacatgctccc

SEQ ID NO: 101263 - DNA, 22 bp, Homo sapiens
  chr9:89330755-89330777
  hypo
ttacaggcgtgagccactgcgc

SEQ ID NO: 101264 - DNA, 30 bp, Homo sapiens
  chr9:89374984-89375014
  hypo
actactcttgtgcttcgaggcccttattta

SEQ ID NO: 101265 - DNA, 30 bp, Homo sapiens
  chr9:89518042-89518072
  hyper
ccatggcagattacacgatacagctgtccc

SEQ ID NO: 101266 - DNA, 624 bp, Homo sapiens
  chr9:89560694-89561318
  hyper
cgagtggggtccaggcgccccggggcgccaagcggccgccgccgccgctgctcctgcgcccaggcccatagggcaggtccccgcggccgcccgatgcagcagcgccgctgcccgggcgcggtgggtgcgggacgccgtcgtcgtcgtccagcggctgctcaccacccgcgcccccggtgcgctgctcgtcatcgtagtcctcatcgtagtagtcgtccaggcccccgtccgagccgctgctgccggggccgttgcccagctcggcgccgaagcacaggcgggccatgttctccttgaccgactcgcagatgggccgctcgaggccgtcgcacacgcagtcgttgagcagcgccgccttgggcatagccagcatgtcctcaatgacggtgcggcattcgtccgtgcagcgcagcccgttgaagactttgccgcagtaggtcaggtagcggctcagcgccaggttgcagcggctgtcgcggtcgcagcgccgccgggcctcggtgcagcccatgaccccgcccgcgccggggccgcccgcgccgccgccgctcgtccggggcaggcacggctcaatggcgcgcttggtggacttgcagttctcgtcctgcgcgcagtcacagtcct

SEQ ID NO: 101267 - DNA, 30 bp, Homo sapiens
  chr9:89561749-89561779
  hyper
cggcggacgcggagccggtggaaaagtttg

SEQ ID NO: 101268 - DNA, 82 bp, Homo sapiens
  chr9:89563765-89563847
  hyper
actaggagattcctccggctgcgggaaatcttcctgtacctgctgaagctgctgcgttcctcagaggcgcttggtctgccgt

SEQ ID NO: 101269 - DNA, 299 bp, Homo sapiens
  chr9:89763321-89763620
  hyper
tgctactttccatcccgttaatacaatcccggccctgtttcccggccccgcggccattgcagagtcatgaagtcatcgcagctgcgcctgcagccaggcgggaacgggaacgggaactggctggccgcggtcccttctgtcccccgccagccggaaatgtccgcgcgctgaaaagcagacgctgcctgcccggggaacggcgagagagagcgagaaaaaaaaaagcctgaaggcggcgcggcagccagcgagaggggagaaacagattcacacccaggggcctccgggcagggcccacg

SEQ ID NO: 101270 - DNA, 30 bp, Homo sapiens
  chr9:90000239-90000269
  hypo
caaaaataggtttctcggccgggcgcagtg

SEQ ID NO: 101271 - DNA, 66 bp, Homo sapiens
  chr9:90112790-90112856
  hyper
tgtgaggaggacagccggaccgagccaacgccggggactttgttccctccgcggaggggactcggc

SEQ ID NO: 101272 - DNA, 30 bp, Homo sapiens
  chr9:90113126-90113156
  hyper
ctgggaaggccaaggcggagggaaacttgg

SEQ ID NO: 101273 - DNA, 83 bp, Homo sapiens
  chr9:90113665-90113748
  hyper
gggtgccgtggtgcccggccccacgcgcgcgcggggctgaggggtcgggggcgtccctggccgcccagctttaacaaagggtg

SEQ ID NO: 101274 - DNA, 30 bp, Homo sapiens
  chr9:90279219-90279249
  hypo
ccccttcaccccctgcgcatagtgtgccca

SEQ ID NO: 101275 - DNA, 161 bp, Homo sapiens
  chr9:90287605-90287766
  hypo
aagcattgctaattgcggtctttcttccttgtgtatgaatataaatccccatgcaagtaactgcttggcacctgggcacacccggtactggaatttggttattggaaatgactgagctgtcgcggcagcttccttggagaatgcatcgctgaggattgtgg

SEQ ID NO: 101276 - DNA, 30 bp, Homo sapiens
  chr9:90316457-90316487
  hypo
gataaatggtcacaccgtaatgttcaaaaa

SEQ ID NO: 101277 - DNA, 49 bp, Homo sapiens
  chr9:90321063-90321112
  hypo
tgaaacagttcaggacgtgctgctcctggacccccgctggctctgcaca

SEQ ID NO: 101278 - DNA, 165 bp, Homo sapiens; identical to SEQ ID NO: 42147
  chr9:90322123-90322288
  hypo

SEQ ID NO: 101279 - DNA, 170 bp, Homo sapiens
  chr9:90331505-90331675
  hypo
gggtcagtcggtctccgctcaaatggtcccagagatggaggattggaaaagcagattttaattcctacgtgagctgacacttaccacctgtatttctcatcccttgttctgtcttccaggctataaagacgccttgaatcctcctccacgatacccgccccactatttgt

SEQ ID NO: 101280 - DNA, 98 bp, Homo sapiens
  chr9:90340845-90340943
  hyper
ccactgaggcaggcacgcccagctctgggacagtcagtaaacaagccacgaaccgcgccagggatcagagcacccagagtccccgcccagctgccggc

SEQ ID NO: 101281 - DNA, 79 bp, Homo sapiens
  chr9:90341264-90341343
  hyper
gcgtgactggttgagcgggcaggccagcctccgagccgggtggacacaggtaccgcagccaggccgcgccgcgccgact

SEQ ID NO: 101282 - DNA, 30 bp, Homo sapiens
  chr9:90386516-90386546
  hypo
cccggcgagtacctccgctctgtgagtggg

SEQ ID NO: 101283 - DNA, 173 bp, Homo sapiens
  chr9:90421580-90421753
  hypo
ctgctcaaggtgacccgagtcagaactgcaggtcagccccttcctggcttcctccgcaggcactgtctgctcctgaactcccaccacaatcctcagcgatgcattctccaaagaagccgctgtgacagctgtcattttcaaaaaccaaattccagtaccgggtgtgcccaggt

SEQ ID NO: 101284 - DNA, 30 bp, Homo sapiens
  chr9:90588928-90588958
  hyper
tgagggcaactatctcgccagtctgcagga

SEQ ID NO: 101285 - DNA, 93 bp, Homo sapiens; identical to SEQ ID NO: 32533
  chr9:90589194-90589287
  hyper

SEQ ID NO: 101286 - DNA, 184 bp, Homo sapiens
  chr9:90589592-90589776
  hyper
cagcaagcttaatcccgcataaaaaacgcatgcgccgagagcgtgcccgcagcagggcccacggaacgatgacagcaggcacctcctatctgcccccgcccccggcgtcacgtgactagctgcgctggtgcacgcagccgggaggggcgggctccttcccctggcaagccggaagctccgcacc

SEQ ID NO: 101287 - DNA, 84 bp, Homo sapiens
  chr9:90691103-90691187
  hyper
tggtgtcaaagcagacgtctgctcggtgtggccgtatttttgtgagcggagctgcttttgtgagcgctgcgtccctgcagcatc

SEQ ID NO: 101288 - DNA, 103 bp, Homo sapiens
  chr9:90749344-90749447
  hypo
ctcagggcctggcctcggacagagacctcccccgtctcatgaccagagacctcccccgtctcatgaccggtcctggccgctgagcccacgggtttgattttgc

SEQ ID NO: 101289 - DNA, 193 bp, Homo sapiens
  chr9:91149133-91149326
  hyper
ggcgctgaaggggagcgcgaggagtgggaggaagtgaaggaggaggaagagcacggtgtgggggaagcgcaggaggcaataggtggggcgggacggagggcagggcgctgcgtcgggagaaagtgtagaagcgctggggagagtgcccacgacgggagagcccaggggcgcgagggcgcgggagtgtgggcgg

SEQ ID NO: 101290 - DNA, 30 bp, Homo sapiens
  chr9:91149724-91149754
  hyper
agttggaggagagtgcggggatgtgggcgg

SEQ ID NO: 101291 - DNA, 409 bp, Homo sapiens
  chr9:91149976-91150385
  hyper
tgcggggaatgtgggcggggcgcagtggtgggagggcgcaggagtgtgggcggggcgcagttgggggagggtgcagagacctgagggcttgaggttgcctggctggccccgctcccagaggcgggtgccgcgctgtcgcccaggtatctggggtctctggtgtctgagtgtctcattgtcggcgcgaacacaattgctccagccacaggcgaggcctggccaaggtgtgggcgcatctggggcaggtcttgagaggtccagcgcccggtggtgcggacagaggcggggcaccgcggcgctcgccgccgcctccccgcaggtgatcatcctcctgcaggtgtcctcgggtctcaggtggctgcgtgtctgcgccatggttgacattctgggcgagcggcacctggtgacc

SEQ ID NO: 101292 - DNA, 40 bp, Homo sapiens; identical to SEQ ID NO: 32536
  chr9:91150621-91150661
  hyper

SEQ ID NO: 101293 - DNA, 69 bp, Homo sapiens
  chr9:91321072-91321141
  hypo
actagccctttgctgcgatgatgcctccccgttggggtgcggctggtccgtttgcgagggaggtgggaa

SEQ ID NO: 101294 - DNA, 398 bp, Homo sapiens; identical to SEQ ID NO: 32537
  chr9:91605965-91606363
  hyper

SEQ ID NO: 101295 - DNA, 30 bp, Homo sapiens; identical to SEQ ID NO: 32538
  chr9:91606806-91606836
  hyper

SEQ ID NO: 101296 - DNA, 1242 bp, Homo sapiens
  chr9:91792357-91793599
  hyper
tgagaaagtaaagcccgtcgaagagaaagcagcacagcatttggcctgctctgcaaggagctgggaattcttgctgcggggggcaacaagatacccaccctcccgccggggaagacacagcaggagtagggccgccactccgtgcatctctcctcccgggggctgcccagctctccccagcgcgtttcctagatactaggcaggccggacccccgctgcccagggttgggcgcccatgacactggtcagacatctggtaagccaggtggcaaaggcgtgccaaaaaagtggagcctagggaaaaccgggacggagcgggccacccgagtggtaaaccttttcccaatggatgcgggaaaagcgcatttgtagttccctcctcaccgctgtcaagcgagctgattgctaaggagtgcgcatttgcttgcctctaacgtgacagtcgcgggagcgccccgcaccccgggcttcagggaatgaaggagtctgccccgaactggccccagaacccccagcccccagggcggcccgcgcccgcacccaccttgaccacgtaggtgactccgggccccagcacctggtcgctggcgtgcggcgccccccgagggggcctgggcagcggctcgtcgccgggccggcccttcctggcggcgctcatggccggggcgcggggcgccgagggcgcactgccgtccggggcggccaggctgggcgcgctgcagctgcccgagagccgcgcgcccgcccgctcccgggcggccgacgacaggccgcggaggcccgagctggagagtttcaggtgggacaccttgtggagcaggtggcccaggctgccgggcccatcgtcgggcgccttgcgcagcgcctcgccggacaccaagtagggagccgccgccggggtcgcgcgcgccgccgaaaccttgcctccgccgccgctcaccgacaggctgtggagaaggtcatcgaccgatgtcaccgagtcattcctgaagcggttatacttggtgcgtggaagcatgcccctccgtgggctcgctgcatccgcccgggcgctgctggtgccggccccggcgcgggctgccgcgcatagcaggcgagccactgtccccggagcgggacggagagtgggggccccgggacagccttctggagaacgagagcagagcaagaggatggtgccctcccaccgttaaaagccagcacagcggcggccgcgcagccccggcccgggagaccgctgct

SEQ ID NO: 101297 - DNA, 344 bp, Homo sapiens
  chr9:91849514-91849858
  hyper
cctgcactccaggagcggtttgacttgggtggttatggaaacggagcccgatctgcatagggttaatctgccgagtagtgactacttctgtcaaattctccccaagggtaaaccctgcgggctgaggaggcagcggcggaggctgggcgcacgtgggtgctgcagtagccggcggacgcccagggcgcacgggggcgcaccgagagacctcaccgaacccaaagagcgtgcggttcgtctcgcccaaaaccacagcgctggctacagaaacccctgaaatcggaaatactctaaccaaaggtactgagagcgaatctcatctttcccatcggggaaagtagatg

SEQ ID NO: 101298 - DNA, 30 bp, Homo sapiens
  chr9:91870244-91870274
  hypo
cagagagggaccatgcgggcaaagccagct

SEQ ID NO: 101299 - DNA, 267 bp, Homo sapiens
  chr9:91995936-91996203
  hypo
ccaaaggaaatgggacgtcgaggagtcactcacccgggcacacagaagcatcgccgctcatctcctgaatcaaacccctgcaaaacaaccggcacgtgttattcacccacacacatgggggacatccccaggcagcgcatcccgccccatacctgctggggctctcggtctggtgcagagccacgcaggtcgctgtgggcgggctccaggcgcagtaggggtcccgcgccagcacacagtcctcgcaggtgccgtgcttcccacaga

SEQ ID NO: 101300 - DNA, 101 bp, Homo sapiens
  chr9:92163460-92163561
  hypo
catgagcacctttcccgagtgtaatagggtggcctgaagaaacagcacattctcctccatgagctcctgcagagccttttctttttaaaaaaaaaatacag

SEQ ID NO: 101301 - DNA, 30 bp, Homo sapiens
  chr9:92800931-92800961
  hypo
tataattaaattgtacgtatttatggggta

SEQ ID NO: 101302 - DNA, 159 bp, Homo sapiens; identical to SEQ ID NO: 42151
  chr9:92897057-92897216
  hypo

SEQ ID NO: 101303 - DNA, 77 bp, Homo sapiens; identical to SEQ ID NO: 15229
  chr9:92980516-92980593
  hypo

SEQ ID NO: 101304 - DNA, 290 bp, Homo sapiens
  chr9:93404961-93405251
  hyper
caatcatgccaaagccgcccgtgccccaatgcggacgcagcgaagccacggcagaagggggaaatcggttacctggggaagaacacaactccgctcagagcttcttcagagctccactcgcgcaggacagggcagcgcagggtgtgtggatgcggctcctcccggaggcaggcgcagcgcactccctcccgccgccgtgacgatgctgtcagctgctcgcccgccgtgcgccctgcaccgcccaccggccgtgctccctgcgcccagcgccctcgcgctccacccgctcg

SEQ ID NO: 101305 - DNA, 197 bp, Homo sapiens
  chr9:93462703-93462900
  hypo
ggttcacgccgttctcctgcctcagccttccggcgctccggagtgtttcaagcaggatatcacctgaattgtacttgaaaagaagctttcttgcagcttggtggcgcttggattgaagagtagcaagtgtggaatgtggccactaatgagcgggctggagcttagcacaggtgctcctgatgcgggctcagctaggg

SEQ ID NO: 101306 - DNA, 46 bp, Homo sapiens
  chr9:93564410-93564456
  hyper
ggacggaggtcagaccgtgcggaaagtgacccgggcaccccagggc

SEQ ID NO: 101307 - DNA, 32 bp, Homo sapiens
  chr9:93698029-93698061
  hypo
gagcaggtggttggccgggcgcggtggctcac

SEQ ID NO: 101308 - DNA, 158 bp, Homo sapiens
  chr9:93901190-93901348
  hypo
ggtaggtgaatcatgcgtttgcgtaaacagtactggtgaatggtcccattgtagacatgaagttctgcacttgcttttaaggctagcatttactcatttgccttttaaacctgtcatcatgtgcccttctaataaacatcttgaaactgtctgtccat

SEQ ID NO: 101309 - DNA, 248 bp, Homo sapiens
  chr9:93955929-93956177
  hyper
aaaaggaaatacacacgcacacatggacctaacacacaaaacgtccttctgcgggaagccagcactaggaaagaaaaaaaaaaaaatccgaagtgaaattatgacacagggttttgtaacccgcggtggcgcgcttctgaaacccgagcccggcagcggcttcttatctgcaccgcgttccaggaagcagccggcgtttcggccgcgcaagggcagccgccgcacgtaggcagcgtcccccagcccgg

SEQ ID NO: 101310 - DNA, 213 bp, Homo sapiens
  chr9:93956444-93956657
  hyper
ccgccactgctgtcacgtagcaatcaagagtaaaggttatcacaaagtctgttcttcgaaggaaagagttggaatcaaggacttcggacgggaggaagttggtaagttaccgcttcctccctcctgttttcctctccttgtttaacttctcacaagaacatgtggcagcgctgcaggttaactcatcttacataacttcggggccgtgtcaac

SEQ ID NO: 101311 - DNA, 480 bp, Homo sapiens
  chr9:94183464-94183944
  hyper
gagacgcaggcgctccgggtcgcccgcgctgcccctgtctgccccgtgcgggagccggggtccctggctccctggctccctggctcccgcggcccgggcgaacccagagcgcacccgtacgccggccccggccggtccctagcgcccgggctccacgggccgcgcccccacgcggcgcctcccagagaccctcctccctccgggtgggcggcgcagcggggcctcggcgccgcgaggaccccccgcgccagaacaaaggaatgtggggagggggcagggaggagctcaggccactgagcagccccagtataactgccgttcggaggcgcttctcggtcccgacccgaggtccccgcccgccactaccagacccgcccccagccccggattctcgcagaccccaccggcccgcaggagggagcggcgcactgggggccgcacggactcgccattggagatcgcgatcggaaggtggcgcca

SEQ ID NO: 101312 - DNA, 32 bp, Homo sapiens
  chr9:94187211-94187243
  hyper
aaaagagcacctagccgcgacttcttaagtcg

SEQ ID NO: 101313 - DNA, 42 bp, Homo sapiens
  chr9:94486293-94486335
  hypo
gcaccggctggtagccgttgacggggacgtagagctgcggcg

SEQ ID NO: 101314 - DNA, 30 bp, Homo sapiens; identical to SEQ ID NO: 42155
  chr9:94572598-94572628
  hypo

SEQ ID NO: 101315 - DNA, 87 bp, Homo sapiens
  chr9:94573085-94573172
  hypo
cacacacagggaatgcggccctaattaggaccccacttcgctgtgaggaagacagacccagaggggagacatcggcactctcatgct

SEQ ID NO: 101316 - DNA, 93 bp, Homo sapiens
  chr9:94579436-94579529
  hypo
tcagtgctggtgaggcggttggcttggcatttctctcagccaacctgactttactgaaatagagtcgagaaggaaggccgggacccagcaggg

SEQ ID NO: 101317 - DNA, 141 bp, Homo sapiens; identical to SEQ ID NO: 42157
  chr9:94658109-94658250
  hypo

SEQ ID NO: 101318 - DNA, 22 bp, Homo sapiens
  chr9:94685022-94685044
  hypo
ccgcgcccgaccaagaatattt

SEQ ID NO: 101319 - DNA, 978 bp, Homo sapiens
  chr9:94711102-94712080
  hyper
tgggcctgaaggccccgcccgccctcctccacccccgcagggtgccgagaatccggcccgaggcgcgcgggcgggaggtgctcccggagtctgcaccgccagagctaacgccgcctcctccaggcaacctaggcaggtcccaagctgcacttccgaacctccccgccgttcctctgcgccccggatccaagcagccgaaaccgcgcagggactcgggggaagtggggccccgggaggaaacccacctaggagccgggccccgcccctcccgccgccagcctcctacaggtcccgggggtccccccggcgcggccagaaggcggccgcgccccagccgctcagggacccgcgatcccagtcacaaaccatttcaatccagatcacacaccacttcggccaccccagagcggtgggggagaggaggtttcagggaccaacaaaagggatgccaaagagcccgtttccatcaagcggcccgcgggctgggaaagtcaggacccgggagccgccggcgcccccacccccgccgcaagagccgcttctccggggccacgtccaccccaggattctgccaggcatcaggccgccctgggggtggggggacgctccgagacagacgggggacactcggggccgtgtgcccttgaaggaggaagacctcggggaggaagcccgggtcctgggaccctcggggcacatctgcggactcgggtcccgggcccagggcgggtactcacattcacactcgcactcccactcgcgaccctcgggaagcgccaccgagaggctcccagccgccgccgcccgcccccagactctggaaacacttaggcgtccccagagcgcggcttattgtaaccagcccgagggggtccggggtgcgggccgggagcggcgtcgggcgagatgcgaatggccctgcctggcgcccctcgttcaggagcatgggcgccggcgcagcggccgggagcatagtgg

SEQ ID NO: 101320 - DNA, 794 bp, Homo sapiens; identical to SEQ ID NO: 32547
  chr9:94712294-94713088
  hyper

SEQ ID NO: 101321 - DNA, 30 bp, Homo sapiens
  chr9:94746198-94746228
  hypo
ccggagactgggagtcgatgcagaatggac

SEQ ID NO: 101322 - DNA, 137 bp, Homo sapiens
  chr9:94862789-94862926
  hypo
actctaactgtggaccgattactgatttattgtgccatcagtgcgctcaccaactggccctggtgtttctaggtgatccccatctcaaacctgcagaccagccccagtaatccacagctaggcgagtgtttccaggg

SEQ ID NO: 101323 - DNA, 102 bp, Homo sapiens
  chr9:94863469-94863571
  hypo
gagagaaaacttaatcgaataataaaaaaaaacaagccatagcctgaatgagaaattcaacaaagacatagataccattaaagaaaacaaacaggccaggcg

SEQ ID NO: 101324 - DNA, 245 bp, Homo sapiens
  chr9:94934584-94934829
  hypo
cctggaccacaaagacgaggaggacggcctgtctctggaccggagcagcaccatggcctcagaccacgtggtggacatgcaggacctcaccgagttcctggatgaagcctcttcgcccagcgaatatgctgtcttcctcctccactggctcttccctgagctctttgaccactgcaagctgggcgagtactacagctgctatggggatggcagcaagcaggagctggagccgcagaggctgcaga

SEQ ID NO: 101325 - DNA, 30 bp, Homo sapiens
  chr9:95416325-95416355
  hypo
gagacacagcagctacgcaggtctcaggtc

SEQ ID NO: 101326 - DNA, 169 bp, Homo sapiens
  chr9:95417482-95417651
  hypo
ctttgcctaactcaccgacacatctgttcttccctcacgtggccctgtgtggccctgcagatgcagcgaccctgaggggtgcatcgtcagcctggaatgggctctgcacctactttcccactgcgccagagcccagcggcgtcctactgggacacgctcacctgcaggg

SEQ ID NO: 101327 - DNA, 30 bp, Homo sapiens
  chr9:95442637-95442667
  hypo
ccatgcatatgaagccgatgcctgcacccc

SEQ ID NO: 101328 - DNA, 310 bp, Homo sapiens
  chr9:95485043-95485353
  hypo
atgtcatcccgcaggcggccacgctggatctccacattctggttgatctgttgggggagagggaaaggcaggtatgagcagcctccacagggcacgagaggggctcagtgcagccaggcacgccatggccagccatacagccagaactcaagagccctggcctgcaggtgccagtgtgactgcctggagaggagagggagcccagagcagtatgccagagtgcacagcggactgcagaggttccagagtaaattccctcagcccttctcacctgggaacccgtgactgcctgctccgacccttggtttct

SEQ ID NO: 101329 - DNA, 30 bp, Homo sapiens
  chr9:95501326-95501356
  hypo
ctagcctggctgcctcggttgggccctccc

SEQ ID NO: 101330 - DNA, 65 bp, Homo sapiens
  chr9:95560810-95560875
  hypo
cagacacagccttggcgttgttcagaaggagggacattccaggtgctgggcgaagcagaggaggt

SEQ ID NO: 101331 - DNA, 1045 bp, Homo sapiens
  chr9:95569676-95570721
  hyper
cacaggcctgttggccgcggcgggccttggctcccctgagcctggtgggcctgcaaagagctgcgtccaggagccgcccccagggaacaagctgccagcgggcctggggagaaccgcccgtccgatgagctcggctgagcgtgcacgcagtgccgaaatcaaggacgcctggatgcttttcgttgcagagtgacaaaggttcaacaacaggaagaggatcaggggccaagacaagaagctgaagttcggcctgccaggaaccccgggccccagcatcccacccaaggcgctgctgcaggagttccagctgctgctgaaaggtgcggtgccgcagggccagagtgcgggatcctgagccctgcatgccagtccttgcgggggccgatcgctgtgagccttactcaggtccagccgcctccagggaggacaatgtagacgaggtgcggggcgtgagggcggtgctggccgcacccctggtcctgaggccacgggagccgcgcgaggaggccgccttccactgacgcctgcaccgggaccggttgctgcagcggtgccagctgcaggagctccgcgtctgctgcttctccgacgccagggcgccgccaggatgacaggtgcaggagactgtggctgtgggcagatgtggtttccagccccaggtccccgcggcccctggcttcccagcgcgctgtcctgtgagcaagaagatgaaaaaagccacccgatcaacaggtcagctgccccgcctggcagcccagccagacaaggcaaccgaagttcatcctctctgagttgacttcgtgcgggcagcgggccggcgcccaggatgctggggagccctgcgcgccggaggccgacaagccgtggggctcagaggcgcctcagggcgagaaggcacccgtctcccagcgctttcaccccctggcctgcccggcccgcgtggtgtcccagtggctgcggccacgccaggcattctgccccgcggcggctgcacagggacgagaactgagaacccctgctcaaccccatccggggtgactgccaa

SEQ ID NO: 101332 - DNA, 85 bp, Homo sapiens
  chr9:95570901-95570986
  hyper
ccgagcccgcccgcactccccgcatctcaaaaccggggctagaggtccctgtagctgcggccaagccaggcggtctgccctgcgg

SEQ ID NO: 101333 - DNA, 337 bp, Homo sapiens
  chr9:95571355-95571692
  hyper
gagggcccctgtcagcggccccgatctctctttggaggaggagcggggcgggagtcacggccaggagggccctcaggccggaagggatgcacgtctgcgattccgagacgtcccgcgcgagcccaggagaacccgcaagccagcagcgcctgcgcccgagctgcagcagccccctgcaggccacgcgggctcgggagcggtttccggagtccgagctggcgctgagctgcaggcgcgagcctaaaggcttagccggggcccacgctgtctgagagatcggagcgttcagctacaggcacgcgcttaacggcttcgtggagctcactcggtctgagag

SEQ ID NO: 101334 - DNA, 516 bp, Homo sapiens
  chr9:95571752-95572268
  hyper
tgagctacatcgcgggtttggtggtggatcttggatttgggggtggatcgcgggtttgggggtggatcttggatttgggggtggatcgcgggttgtgggggggatggcggatttggggctgggtgggggtggaaaggccacgaggagccgcggcggctcaggagcgggtggtgggcgtctgaaaagtcgccaccatgaggaagctcttcagcttcgggagacgcctgggccaggcgctcctggactccatggaccaagagtacgctggtcgggggtaccacatccgggactgggaactgcggaagatccacagggctgccatcaagggcgacgccgcggaggtggagcactgcctgacgcgcaggttccgggacttggacgcccgcgacagaaaagacaggtatcgggggctcagcctgcggtgggagggggccccaggcccggcttccctgcagcccctggggcgggggccttggagggccccgggcaccctcggagccgcggagccaaatggag

SEQ ID NO: 101335 - DNA, 159 bp, Homo sapiens
  chr9:95709693-95709852
  hyper
cgtccctgcagctgccgggagaggaggagacagggcggctgcctgtgggtgccgcggaccttcggggcgggccagggaggcgggaccgctcctcagaaccccaggggcttcagtcctgggctgattggcgcgggaagcacagcccggccctccaggtcc

SEQ ID NO: 101336 - DNA, 243 bp, Homo sapiens
  chr9:95821220-95821463
  hyper
agcaacgatctgccccgaggacgaacctcctcgaccctccgccggcccagcaggcgccctagcggagccgaagcctggcagcgagcagttcgaaaccaggcggctgcacgcagcagcccgcgcgcccgttcccgagtggccgcagcgccttggtcccgggcgtctgcggacagcgcggccggccaagcctctccacgccgcaggctccgggcccctccgcgcccctcccggggaagtcgaaac

SEQ ID NO: 101337 - DNA, 430 bp, Homo sapiens
  chr9:95946132-95946562
  hyper
ggccttgaggtctagcgcgccgggctgcggcgtgctgaggcgttgagcctgctgcctcctctcaggaagaaacggggtcctccgcagctgacagccctgcggggcgttccaaagaacttcagaggacaggagcgctacctcgagcaaagaaccgcgggtgggagcccaggtagccggcccgcaggtggccgcgcgcgcctgccagtcagccagcccgtccgcagccaggtgggcgtgccaggcccagccccctgcgccggtccggggcggggcgaacggagccccgccctccccgcgcgccgggtcggagccggtgcgggagcggagccgcgcgaagccggcaggagcacgcgggagcgcggccccgcagtggcccggcccgagagagcagcgcgcaggagctggagcggcgccacggcccccaccccag

SEQ ID NO: 101338 - DNA, 30 bp, Homo sapiens
  chr9:95946829-95946859
  hyper
ctttacagctgcctccgggacagcctagca

SEQ ID NO: 101339 - DNA, 36 bp, Homo sapiens
  chr9:95947222-95947258
  hyper
tggcggccgccgagacgtccccggcacgctgatgga

SEQ ID NO: 101340 - DNA, 110 bp, Homo sapiens
  chr9:96024041-96024151
  hypo
cctcagtgaaggcagcgccggccctgacttgcaccttgtcccctgtgcccccagattctgcttggccacccagctccctatgctgtggacgtcgccgctcaggtccccac

SEQ ID NO: 101341 - DNA, 23 bp, Homo sapiens
  chr9:96230169-96230192
  hypo
cttttttttttgagacggagttt

SEQ ID NO: 101342 - DNA, 57 bp, Homo sapiens
  chr9:96362025-96362082
  hypo
gcagcaagggggattcggagcacgaaagggatttagaggcgccggtggggccaggtg

SEQ ID NO: 101343 - DNA, 48 bp, Homo sapiens
  chr9:96436127-96436175
  hypo
caaggactcagactacggtgagtgtcactcctgcgtggggcagggccc

SEQ ID NO: 101344 - DNA, 28 bp, Homo sapiens
  chr9:96573710-96573738
  hypo
tttttttttttgagacggagtctcgctc

SEQ ID NO: 101345 - DNA, 139 bp, Homo sapiens
  chr9:96588601-96588740
  hyper
cgccgccaccattcccgttccggttggagaacacaatgcaccgcgcacaggctgtgccaaagtccacaggcacccttcggcctccatcatcgcgccctcttcacagatgagcaaacggaggccagacgtcaccggcagg

SEQ ID NO: 101346 - DNA, 115 bp, Homo sapiens; identical to SEQ ID NO: 32556
  chr9:96588857-96588972
  hyper

SEQ ID NO: 101347 - DNA, 130 bp, Homo sapiens
  chr9:96590139-96590269
  hyper
aattgctccggcggccggggggcgggctgggcgccgggtacattagcgcctgctttgctcgctgatggtgtttatagggatgtggaacgggcctccaggaaaccgtctggcaggccgggcttcagcaaat

SEQ ID NO: 101348 - DNA, 360 bp, Homo sapiens
  chr9:96708199-96708559
  hyper
cggcgccgcctgccatgcgcagcacgagcctcgctaatgcgtttcgcatggcgcgtcagtcaaacgcccttctaatgtccttaaagcacgcagaaaattgcatccttatgaaaaaggagaaaaaaagcaaattgcctggtggaagcggagctgccgcgggggctggggcggcagcgcgtgcgggcggagttgcgttcggcagggcggacttggggcggctgtcaggggctctcccgggccaaggcgcaagagcaagacgctgcctcctcccagcgcttccaagtggcgcctgggcccacatccttgcctgctctctcccactcttccacctctccttgctcgttccggacaccctggcct

SEQ ID NO: 101349 - DNA, 352 bp, Homo sapiens
  chr9:96710044-96710396
  hyper
aagttatgagtggcccgggggaccagaatagaggtagagagctgagccagagtcagcacctgctggcccctcggctgccattaccttcctgccccgcccagcggagcgaggagtcccagctcccttacctccctacagtggggttggggaggtggcatttgagaagttttccttcagctcggagatctggccccgggctgagctgggagggagggtgggggctgtaggtgggaccgctggggaacccagcctgaacagaggggacagaggttcccagcatcagctagtctcctccgtggacacaggaacccaaagtgggctcaggggatgtcctttgcgttccttctccggt

SEQ ID NO: 101350 - DNA, 783 bp, Homo sapiens; identical to SEQ ID NO: 32559
  chr9:96710664-96711447
  hyper

SEQ ID NO: 101351 - DNA, 163 bp, Homo sapiens
  chr9:96711534-96711697
  hyper
cgggcgccaggtagctccggtcgggcacgcgcagtccgacagactgtgtcaccttggaagacaggatgcggccctttacctagagtggcagctttgtgggctaggtcagcacggggtctccgggccggcgggcaatcgtctgcctctgcgccttagctccctg

SEQ ID NO: 101352 - DNA, 30 bp, Homo sapiens
  chr9:96711975-96712005
  hyper
agttcccctctgtgccgggaggtggctgtt

SEQ ID NO: 101353 - DNA, 30 bp, Homo sapiens
  chr9:96712723-96712753
  hyper
cccccgccacccccccgcccacccctcatt

SEQ ID NO: 101354 - DNA, 888 bp, Homo sapiens
  chr9:96713146-96714034
  hyper
gcccagcctagactgcgggaaggcaactgagacctccatgagaagggggcacctgagagcacatgcaaccaagctgtgtccctgcaagggaccaccctccctaggccggtgtcagctgagtcctctctctccgtcggccaggtgccctcactgcccagaggtggaactcagcagcccaggcgccgccgccctgagtatcctgcggaaaatgtgagaactctggggagccattgctgctgcaaggacccgcgggcgggctaccgcgctggtgggggggctctgtccaaaccttgcgtcctcgacttcccatccgcctcataaagggttggtgaagaccatctcaaggaccgcacgaactggtccttcaagtcccaggaaaccgaaacaacaaccgaggcggctctctgtccgggccacttccggagcgagctctgcggcggacctctggctcccgctcctttgggcacccgcggtgcggccagaccgctcctgccagcgactctctggctggcaagggagaggaggtggagttcagactggcccctcacgcccagagtggaagcgattcctaggatcctgcagccaccgagccgcccgccgtgcctagcccgggcttgatggtgaagagcacagctgccttcgacagagccggaggaaaggaagtttaagaagcaactgcccgcgttccgcttatcttgccgagcccacccccacccccaccctcaccccctgcggattcagaagctgctccaccgagcccgattgtgtcataaaatattttattggaaaaaaagtcaccgtcttcgcaagagggggtaggggccccagcgacatcggggacccggcctccaggccgagccgacgggttgccccggggcaatctcaggc

SEQ ID NO: 101355 - DNA, 112 bp, Homo sapiens
  chr9:96714862-96714974
  hyper
aaactgagaggattccggtgcgtaccaggcaccgagggaatcggggggttgggcagagtctcagtggggagaaagaggagagcagctctgcatgcaccggggcatggcccag

SEQ ID NO: 101356 - DNA, 147 bp, Homo sapiens
  chr9:96715226-96715373
  hyper
ccatcagctgcagctcggtgaacacagtgcggctccgacgccccttcttggctttggtgcctggctccccagggcctgccgcctccagcttcccgcggagctgcaactcgagcggcaggtgtggcgcacccgcggcgccgggcagcc

SEQ ID NO: 101357 - DNA, 14 bp, Homo sapiens
  chr9:96715687-96715701
  hyper
gtgttctgtcctgg

SEQ ID NO: 101358 - DNA, 157 bp, Homo sapiens
  chr9:96716667-96716824
  hyper
agcaggtccgcactgcggccaaggccgcgttcctcgcccgctggagctcccggggactccgggccggcttgggcccgcgtcagcacccagccctcgggagcgcaggcctcctccccagaggtccgacttccctgggttgggcagccgcggccactcc

SEQ ID NO: 101359 - DNA, 524 bp, Homo sapiens; identical to SEQ ID NO: 3432
  chr9:96716904-96717428
  hyper

SEQ ID NO: 101360 - DNA, 184 bp, Homo sapiens
  chr9:96717449-96717633
  hyper
cgcggtttggcggcggcggcggcgacggcttggctccggcgcggggcccgcgcggggctctaggccggcccgcagctcggggcggcgcgcgggcgccggctcatgccccctcccccgccggccggccgggcggaggcgcagggcgcgggcggggcgcgcggggctcggccggtcgaacccggga

SEQ ID NO: 101361 - DNA, 408 bp, Homo sapiens
  chr9:96717848-96718256
  hyper
ctggaaggagagagccggagagttcgggaggcaagacccccagagacgagagtcggagggatcaaacgacacaggtgagagaaggggcagaggcagacggcgtgggccaaacaagattccagacagtgatgtgagggcaccagagacgccaccgagatgtgcgcagagagaccaaaagaggcgtgagagccagcgggctgtgacgtgacggagggcacagaggcaggcggggcagaggaagggggcggtaaagaaatgggaacagctagaaaaccggcggcttgatcggcttttaggtagccccggaaaggtcgggaggaggaggggcaaaggccgcgctcctcagctgggaaggaggtggtctcaagcagcctccagtcccgggctcaacaccgccaacccggcaag

SEQ ID NO: 101362 - DNA, 45 bp, Homo sapiens; identical to SEQ ID NO: 32566
  chr9:96720841-96720886
  hyper

SEQ ID NO: 101363 - DNA, 366 bp, Homo sapiens; identical to SEQ ID NO: 857
  chr9:96721102-96721468
  hyper

SEQ ID NO: 101364 - DNA, 353 bp, Homo sapiens
  chr9:96721688-96722041
  hyper
gggaatggagctcgtttcctcttttcttttttcttcttcttcttttttttttttaaacctttggttctgattgtccttggcccagcaggctgttggtggcgttggtggtgctgctgggactggggcaccggccttggccgcaggtgtgctgtgcccgacagaggccgcctggaccgcgcccggaacgccctgtccgggtgggctgcggcgttcgccctgcttttgccccgagccgagactggcaacatcttttctagcttcaaaacagaaaattttggaattataaaattaccccctccccacgcttacaggtcattatctcctggagaccaccaactcgctttctctttgga

SEQ ID NO: 101365 - DNA, 298 bp, Homo sapiens
  chr9:96722862-96723160
  hyper
ggcgagtgtggacccttcgagaatgctcccttggcccaggactgatccccacgagcatacagcttcggccttccgaggagagtcagggtcggtgcggaccgactccgcaggccctcccttgccccatctgggctggtgccaggccgcagctcgagacctggtttccaccccgggctcccacagagcccatgaagcgctggtcacagcccctggaagctgcagacccggcttttcgaggagcctccccgacgtgcagagcctgagaccccagagagcggccggctcgtgcgggccagaa

SEQ ID NO: 101366 - DNA, 181 bp, Homo sapiens
  chr9:96723170-96723351
  hyper
cgcccgcggaaacgactcggcttttctttcttttccccttttctttctttatttgcttttttttttcctctcttcccttcttccacccatttccccctcctctttcttttgtttttttttagtcctccccccacccctcttctttcttttgttgctcgttcactctcgctcttgtctcctc

SEQ ID NO: 101367 - DNA, 59 bp, Homo sapiens; identical to SEQ ID NO: 32341
  chr9:969556-969615
  hyper

SEQ ID NO: 101368 - DNA, 438 bp, Homo sapiens; identical to SEQ ID NO: 32342
  chr9:969667-970105
  hyper

SEQ ID NO: 101369 - DNA, 727 bp, Homo sapiens
  chr9:970185-970912
  hyper
cggggcccgggacctgcgctggccacgcagggtctcaagctgaccggaagacccggcttttggcctgtgtccaatagccccagaagagaggggtctggagccttcctcccacgcgtagtgacgctcaggtgtcctcgggttgttagtcttgacccaggagagtgcaagacaggcccaaggcctggggggattgcgttatgaatgtccaattctaaacacaaggtagagcacagacagtacatcctcacggctggattttaaccgtattttaataaacacattcgagggggtgtcagtttccccaagctctgcccccttccgcgggcgggatccatggtgtgtgcagtgtaagagtgcgcagaacgcgtgtgttcaagtgtgggcgtggcaggcgtcgtgtgctcgccccgcgcactgtgcggatcgcccagacagccttgacaggtttttgcagatgtttgggtgctacggtgtggggaaacccaggcaggagcgccaggcctaattctcctggactcttggtgagcggccgctactccacgaggggctagaagcaaagggggcacgcgcttttccccaggccgcctcttgctgccgcagtggctgagggcgctgatgacccctccccgcttccagcggacttgacccgcgggctgacaacccaccgcgacaagcaggcggctgggttcgcgccgccgccccggggcccttggctcaaatttcacct

SEQ ID NO: 101370 - DNA, 202 bp, Homo sapiens
  chr9:970992-971194
  hyper
cgtcatacccgcagccggggctccctccgctaaccacgcttggagaccccaatcggggacagaggtgggagtcagaccccccctggcctgcactgccgtttccctcgattcttgcggaaacaagactcccgcccacacataaaaatgcagctcccggccaccgggcgccggtggctcacgcctgtaatcccaacaccttggg

SEQ ID NO: 101371 - DNA, 317 bp, Homo sapiens
  chr9:971852-972169
  hyper
tacccctcccccacccgcctgccctcgggagcgggtcgcctccactccaccacctgtttaagttcctccccctcggcgcccctccagtccccaccccggccccggtccaaaaaaccagcaaacggaacttttccacagttgaaagccgcggcccgcgaggccgggctgggaggggaaagcggggcgtgtctggggggcggggccccgagcactccggaagttgccccgcccaggaggctcctgggaaagtgaggagagggcccgggcctactttcgtcctggtgtggcgcccctcagcctcccctcctcccagttcc

SEQ ID NO: 101372 - DNA, 170 bp, Homo sapiens
  chr9:9719642-9719812
  hypo
atccccctcacagctcgctatgctgcggcggtgaggggagaagggctgtaaaccttctgggatccccgacctcagggctccccatgtcagggctgtgtcattcggtaacaccctctttggggttctgcggtttctggcatctctacgctttcaggcgcactgcattcccc

SEQ ID NO: 101373 - DNA, 832 bp, Homo sapiens
  chr9:972189-973021
  hyper
cggcctggcctccaggcaaagttcgcgccccctgttcctggggtgtcggccgcgcgggccgtttcccttcattactcccgggcccctgaatccgaacgctttcccagaagcgcgcaaatccgcttgctttccccgcggctgggctttgttcagggacagcaaaggaggaggcgggaggctggtgaggttttctggaaaaggggcttgtcccgaggaggaagtgccccagatccctgagagccaacgctctggggagaagaaactttccttctcccttgaatgttgctcagattacctaaaattattttttcagcccttgtgttctaaagtcgcagggtaaaggttatcttaagacttaacatcagcgctgctcatttgtacgttggtggagacgtgccttttttcctttgcacttaaggtggacagggtctgcgacgctcccttccaggacggtgtggggaagcggccgacgtccccagccggactcacgccctcctactactgggcgtcggctccgccgcgggcgctcccgacagggagctggagtcggacgagcggctgcccccagggcctccaggaaccgcggcccagcggggagcgccccaggctagcgcttttccagttcccttcgaaagcgcggggctgaggtcgcggcgctgggccctcggatgaagccgtgctgtagctacacctgaaccccgcgaaaggctggcgcggtcgtgtatccaggctgggtctgaggaatccgcaagcgggagagcgctaactcctaggcgtgagccgctgctggcttcgagagttcgagaacatgaaggacctggcttctcccgcc

SEQ ID NO: 101374 - DNA, 30 bp, Homo sapiens
  chr9:97315453-97315483
  hypo
atcacttggcccccacgggtgccctcctac

SEQ ID NO: 101375 - DNA, 341 bp, Homo sapiens
  chr9:97317331-97317672
  hypo
atgcagtctaggaaccggcatgcgcataacctcaggatataaataatgctgaagcagagttacgttttttttgttgttgttttttttgtttttgtttttttaggtttccgtgtgtttctattgagctgctcagtgcccggcttagaagaccaggaaaaggagtcacaggtcgtatgctggaggcttgagccgcggcaccgtggcgcggctcgcctcgctgcggttggtggtggcggtggacattgcagcgcggctggaggggtaggaagaagaagatagttttgggatagatagaggtgggtaaagagtgtggttagtgccaaagggaaaaaaggatagcg

SEQ ID NO: 101376 - DNA, 106 bp, Homo sapiens; identical to SEQ ID NO: 32348
  chr9:973183-973289
  hyper

SEQ ID NO: 101377 - DNA, 30 bp, Homo sapiens
  chr9:97369352-97369382
  hypo
ctcatcttggggccccgagacacctgccag

SEQ ID NO: 101378 - DNA, 43 bp, Homo sapiens; identical to SEQ ID NO: 32349
  chr9:973762-973805
  hyper

SEQ ID NO: 101379 - DNA, 88 bp, Homo sapiens
  chr9:97401378-97401466
  hyper
ggcagacagacaggacggggcccaccgcccaaggcccgactcacaggtgcgcgatgcccgccttgcgcaccgccgaagagatggcttt

SEQ ID NO: 101380 - DNA, 386 bp, Homo sapiens
  chr9:97401694-97402080
  hyper
agctgcaggtgcgggcggcaggtgcgggccgcgggacctggcgggaggactgacagaccgactgccgccccgagtgtccgcagcgctcgtggtgcaactgggccaggccaggcgccggcgggtgaatcgcggaaacctttagacgcgggtcggccccccgcccccgggaacactcttgcgccccgcctaccccgcggaccagaccgcggctccgcctgcttggatcttcagacaaggtcggggatcctccctgcggtctcccaacccccgcccccacgcgccctgccgccccctagtcttcctgggctgtcgccccccacacacacccctccgtgccctccacccgcactgtggagcgggactcgggccatcggactctgccagag

SEQ ID NO: 101381 - DNA, 1357 bp, Homo sapiens
  chr9:975333-976690
  hyper
cagcggacttgcctacgctctcatctagcatttgattccccaccaggagatgggcttggtgcacgctctcagaagcgcatccaccgaaggctctggaactgccccgcttcgcatagagctattgtgctgccctgcagtgtatccacttgttttgtttgtttgtttgttttttggtttttgcttgtttgctgatgggcagtggggaggtgcgagggtggagggccttctttgtgcatatatagcgatagtctgcactaggccaagcccgctactcctgggagaatgggaacacgcaaataatctaaacaaagttttctgctgtcatcttgtgaaggaccctctcccccaagacatctatgactggggtctatgggttaaggaggtgaaaaagtggccccatcccatatccataactgaatcacagaatccgtggggatttgaactgagtggctggcgcaagacctccgtttgcttccagtagctgctgggagcgagggaagaggatatcggtaactttgggggcgccaatgtggcttctgtgtctgccccttgaaagtttatacccggcgcttaacaaatcctttacaggagcacgtacgtccctgacctttcaggatactgttttatattaaaacatggacaggagggtagaaaagtaaaattcgcctgcaaaatggcttgtcatccttgggccggcagatctccaaaaccattttcttctaaagcaacaaaagagaaaaaaatacgttctaaaaggaaattacgaaaagagcctaactttcctaaaccaacatcacttcactcccctatcctaaactccacccaggtccggggtgcaaccgcaacactcccgtaggttcgagttctcccggagctgagcttctgcggccaaatgtcgggataaaagcggccttgggctcggaaaaacgcggccagatctggactggagggaggagaagagagagaagcggagcggccacctcactcgcttacaggcacccccaccctcactcccgctggtcctccccttctccgccccgcgagcaccgccgcgttctggagcgccgcagtctccagccgcgggctggggtagcggagagggcttggaggagggggccgcgagcgcccccgcgagagtggcctggctgcaggtggcaaggaaggtgaagtgcaggcacccgaggggcgcaaaggaggaggaaggcgtggggcggggagtgcaaggagacagggaccccaggggcgggggtggcggtgggaaggaggaggggttgggggagggcggcggaggtgttgggtccggccggctcacgagggagctgcagaagagctggctcagaccttaatcagagctgtc

SEQ ID NO: 101382 - DNA, 30 bp, Homo sapiens
  chr9:97674944-97674974
  hypo
aaagagtaggaatctcggctatgggctccc

SEQ ID NO: 101383 - DNA, 139 bp, Homo sapiens
  chr9:97679482-97679621
  hypo
cagaagggatgtatccgctgctctgctggtcagtagctgagccttctgtatggtctgcagagctgccactgagccagaggtggtctctgtgtttcctagactcaaggtggtctccatgttttgtcgttgccatgctgtt

SEQ ID NO: 101384 - DNA, 30 bp, Homo sapiens
  chr9:97681851-97681881
  hypo
caggggctgagagttcggcttgtaaatgtg

SEQ ID NO: 101385 - DNA, 90 bp, Homo sapiens
  chr9:97682129-97682219
  hypo
ggttcccccctctctcgggtcttcctttgtctctatcatgggatattgggctgcacatgttgaaattgtgaaaagcgttgaatccataag

SEQ ID NO: 101386 - DNA, 176 bp, Homo sapiens
  chr9:97688199-97688375
  hypo
gcacagtgcctgacacgtggagaatgtacaagaaatacctgttcccttcctctttgtgtttccctccgtcttacacacaggcattcagcaggggtttaatatgaacgtgcctctatcaccatctcttccctggagtgcctcccttctgagactctcagattcgcgctggtcctggc

SEQ ID NO: 101387 - DNA, 50 bp, Homo sapiens
  chr9:976911-976961
  hyper
cgcccctgagcgggcctcgcagccccgccgtccagcgctccctggccctc

SEQ ID NO: 101388 - DNA, 432 bp, Homo sapiens
  chr9:977171-977603
  hyper
gtgcatcctcatcatcgagcggcagcgggtcatggctgcgcaggtggcgctgcgccggcagcaggccaacgagagcttggagagcctcatccccgactcgctgcgcgctctgccagggcccccgccgccgggggacgccgtcgccgccccgcagccgccgccagcctctcagccgtcgcagccgcagccgccgcgccctgctgccgagttggccgcggccgccgcgctgcgttggactgccgagccgcagcccggggctctgcaggcgcagctcgccaagccaggtaagagcgtctgaggtgcgggagtttggccgggcgcgggggcaacttcggagtgccagctgcagctccacttgggaggactggaggcaaagttttgggacgtgggcctgtcggggctttccttcctactctccgccaggccggggct

SEQ ID NO: 101389 - DNA, 200 bp, Homo sapiens
  chr9:97807628-97807828
  hypo
cacccggcgggcctccgctgcgtccactgcggacaggggtcggtgagaggccccaggtccagcgcgacttgcttttgttaaaacctccttgtgttaggtgtgctcccagctttggagccaggcttttggacacgcctgagtttttctaaagccttcttgttccggtcttcccgcaccttccagtgcggtcaaggatgctg

SEQ ID NO: 101390 - DNA, 30 bp, Homo sapiens; identical to SEQ ID NO: 42166
  chr9:97863868-97863898
  hypo

SEQ ID NO: 101391 - DNA, 171 bp, Homo sapiens
  chr9:97864916-97865087
  hypo
ctggaagggttgggccgttctgggagggtgaacaactgccttggttttcccaggactattctggttttactgcctcaggtccgacagcccaggacacccttcagaactgggccttccacctcctgaccaccactaaagggagcctcttgtcgcatgcgcactgtgtgaatg

SEQ ID NO: 101392 - DNA, 30 bp, Homo sapiens
  chr9:97867526-97867556
  hypo
aggtgggtcatgttacggggactttctgta

SEQ ID NO: 101393 - DNA, 30 bp, Homo sapiens
  chr9:97887305-97887335
  hypo
aaatactctcaacagcgtcttattctctgg

SEQ ID NO: 101394 - DNA, 62 bp, Homo sapiens
  chr9:97887619-97887681
  hypo
acaggataaatttgtcgctccctgttatattttctttaaaattgcaacgtgcagagctctct

SEQ ID NO: 101395 - DNA, 30 bp, Homo sapiens
  chr9:97891726-97891756
  hypo
cttcatgagtgatgacgcaggcatctaacc

SEQ ID NO: 101396 - DNA, 44 bp, Homo sapiens
  chr9:98076575-98076619
  hypo
attttaaaaataattcggctgctctacctgtggagtagccattc

SEQ ID NO: 101397 - DNA, 212 bp, Homo sapiens; identical to SEQ ID NO: 859
  chr9:98111349-98111561
  hyper

SEQ ID NO: 101398 - DNA, 264 bp, Homo sapiens; identical to SEQ ID NO: 860
  chr9:98111894-98112158
  hyper

SEQ ID NO: 101399 - DNA, 52 bp, Homo sapiens; identical to SEQ ID NO: 861
  chr9:98112343-98112395
  hyper

SEQ ID NO: 101400 - DNA, 287 bp, Homo sapiens
  chr9:981609-981896
  hyper
agctcttggcctggccggtttgcacgcagtgcagttgctgtgtgtgtgttgcggagggttgcggcagctggcccaggactgggaccctggccacagcgggttcaaagtaggggcaaagatagggggcagcggctccttgcggccgcaatggactgccgtctccttgcaccagggggtcggagctgcagctgagcccagcttctcgccgcctgctggggacggctctttccttggtcactgtcaggaagcagctcactaggcagctcaggaaccgcccagagacagcc

SEQ ID NO: 101401 - DNA, 25 bp, Homo sapiens
  chr9:98196381-98196406
  hypo
ccaccgcgcccggcctatgggctcc

SEQ ID NO: 101402 - DNA, 393 bp, Homo sapiens
  chr9:98277959-98278352
  hyper
aagcactgggctggtcgcccatctctgtaagggtggcagccacccaagcgcctgaatcggtgggcataagagtcacacacaccacctctcttacccaccgccccttccagaactccaaaagcctctctggcccttttcccgcagcatgggaggggaggtgggtaaggtgcgtctcttctagcccgggtgtcccgcacccctaggcgtgcgtgcgggctcgagagcgggtctgcggggcgcgagcgtgcccttccctgcggctgcggctgctcccgcgagctggcggcagcggcttccgcgcgcgcgctctgagccccctcccctcggcgctgtcactctccgcaccagcccttccatcaccagctctgcctccgctggcgagtcagtagccac

SEQ ID NO: 101403 - DNA, 53 bp, Homo sapiens
  chr9:98278666-98278719
  hyper
gcgtccccgtgtccccgcgccgcccgaggagcacggcgcgcgaggcgaggtgg

SEQ ID NO: 101404 - DNA, 30 bp, Homo sapiens
  chr9:98279806-98279836
  hyper
tggtccgaagaatcacggattgacatttgc

SEQ ID NO: 101405 - DNA, 30 bp, Homo sapiens
  chr9:98315417-98315447
  hyper
gagccaggagggtggcgtccaggggcagtg

SEQ ID NO: 101406 - DNA, 30 bp, Homo sapiens; identical to SEQ ID NO: 32577
  chr9:98315763-98315793
  hyper

SEQ ID NO: 101407 - DNA, 405 bp, Homo sapiens
  chr9:98783120-98783525
  hyper
ccagagcagcagcaacgtgggctgtttggtgcggaggttcctggtttgggttggccaggcgtagagtgcttccgacaattcacccaccctccaagacgcgcgggccggggagcggggagagggcggagggaacggcgcaccgggccccgtcggactgttggaccaaaagtcctcagtgtcgggggctcgcagcgccgccgcggcgaacccagctagggggcaccgcctgcgccgggcacagggaggccgttcggctttccccctcgcgcccattactctcaggcgtcccggggaaccccgcgggccaagtgtcgggctgcgtccgggcagaggcggcttcgcctggtgtcagcgcgtttccgaagggcacccgcggcggggcccacaactcgagctgggagccgc

SEQ ID NO: 101408 - DNA, 563 bp, Homo sapiens
  chr9:98783773-98784336
  hyper
gcggcctgggggacacggggcaaattctcggatagcgacgggcaggaaggggacccgggctggcgatgggccgagtgcctcctttgctctcacccccgcgcgaagacgaggccagtgggcgggtggcgtggggcgaggcctccgcaggccgccgggggcccaggcacctggagccgggagggtccgctcccttccccgccctggatggcggcctatgggaaagcagtctccactggatcccgcgcgcgtcgcgccgaggtcgtgggaaaccgagggcgggagggcgggagggcggaggcgccggcagggtcggcgggactggggctcggacggaggacaggggcgaggaggaggcaggaaggacgccgggtactgcggggcgcctagggggttccgagcgcagcggctgcggggccgacccgcccaggatggaatcagggccccggcgcccccacgccgctcctccaggccgaacccctgcggccccaatcccccggcctcacgcccaccccgcaggtcggccctgcagctgccttcccttcctccacctccctcccgcctcc

SEQ ID NO: 101409 - DNA, 40 bp, Homo sapiens; identical to SEQ ID NO: 32580
  chr9:98784337-98784377
  hyper

SEQ ID NO: 101410 - DNA, 155 bp, Homo sapiens
  chr9:98784772-98784927
  hyper
gcacagaggggcactcggcttgtaagcaacggagtaattcagagcccgtcagccccacgccgagtttattcaccctggcaggggcttccgcgggagccatgacccttcctaactggggtggaaggacccgcagcgccagccgggtccgggccaga

SEQ ID NO: 101411 - DNA, 466 bp, Homo sapiens
  chr9:98789547-98790013
  hyper
gtgtgctctagttcccggcaaagcaggtgggagacggagtgaccggcaggacaggctgcctggggaaccgggaaggctgaagtggacacaggaggagctggcagggagagcccaggccccgcgggctgcgggaaaggagagggcagcgactgggcgagggaggaaagaccctggccggggcagcccggcgcgggagaggctgcgtgtgcccggctcagtcacccgccctgggagaaggcggcccggttggaaagttgaggcggaaccgaaggcccccgcgtggaggctgcagcccctgcgccggccgggcgggtccggaaggagcccaggccgcacctccaggccggcgccgccgccgcccagcgcccacccgtccccccggcgccactccacatgcaccttctcccggggcgccgacggcctcggctgcccccgcagcgtttccctagcttccctccaaggcccc

SEQ ID NO: 101412 - DNA, 15 bp, Homo sapiens
  chr9:98790083-98790098
  hyper
cgactcctcagcctt

SEQ ID NO: 101413 - DNA, 20 bp, Homo sapiens
  chr9:98793021-98793041
  hypo
aggtacgtggctccagcgac

SEQ ID NO: 101414 - DNA, 30 bp, Homo sapiens
  chr9:99189069-99189099
  hypo
gggtcatagagcagccgtgggtttaacatt

SEQ ID NO: 101415 - DNA, 84 bp, Homo sapiens
  chr9:99380993-99381077
  hyper
agggtcccaaggctacggagcagcgggggtttggccaacgccaaaaaggggcagctcccgtgccaggcgcgttcagcgcgctcg

SEQ ID NO: 101416 - DNA, 177 bp, Homo sapiens
  chr9:99381503-99381680
  hyper
tgatgtccaggtacacgtcgtcctgggggtcccggcggcgcgggtcttgctgcgtggagctgcggatcttcttcacacccggcgaggtcgacgagcagcgccgcgagcaggggggcgcggcggcccagctcgaccgccgctcgcttttccgcttcatggaggcggccgcggcccgtc

SEQ ID NO: 101417 - DNA, 303 bp, Homo sapiens
  chr9:99449095-99449398
  hyper
gaggagccccagcaccgtgcctcgacctcaccggattctggtcctcactgccgcccgggcctttccgcttcttcaccaaggcggacaggctgacgcactaccacgccgcgcgacagcgaccgcgcgcaaagcgccaggaaccccccctactgcccgccccgcgctggcgaagcgcgacccgtcccgccccgccccgccctcggcacagcgtcagaggcggggacgcgcgctggtctatttttgggcatccggatggcgactgcgggaaatcgagttctcatgctggggcgaaaggtgtgtctg

SEQ ID NO: 101418 - DNA, 179 bp, Homo sapiens
  chr9:99487982-99488161
  hypo
gtggaagctcattcacggcaaattcacatgttttggatgactcagattttctctttctcactctaaattctcctgtggagtcagccagccatcctattccagctaaatcagctgatcttggtcaccaccccatccccagggatgggcggagggggtggcggcagcgacagcaggggagg

SEQ ID NO: 101419 - DNA, 41 bp, Homo sapiens
  chr9:99539965-99540006
  hyper
ctcaccgcagacccacgggctgtacgcgctttgtggcaggt

SEQ ID NO: 101420 - DNA, 518 bp, Homo sapiens
  chr9:99639574-99640092
  hyper
aactttcctgggggccgcgggcgaaggaacacccccagatgccgctgcgcagggacaggggacgcgcccagacgtagaggccctgacctctgaatcttggcggggcacccaggagcccggcttcggggtgcttagcggggcgaagccgcccccggacccgcgtggctccagcctcctgggggtacctggcagagggggctgcagcgagcgccctgccgcgccgcttcctccgcgcgtctcccgcctggctccgccaagactgggggcttccccataggcccgcgtccgagcgcgtcctcaggcttcgctccgcgagatctgggggccccgtgggctggggttcgggcggggtccgttccttgcggtccgcggtcttgaagcaatttcccggcaaagtcccgggacagcgggaaagaaactggtctccctgcctggggtcgttcccggtggatgtgcctcttcatcagacggaattttccgtctgtgcaaaaatgaagcttactcggtatcatgtgtgc

SEQ ID NO: 101421 - DNA, 19 bp, Homo sapiens
  chr9:9980357-9980376
  hypo
caggaattgggaggccgag

SEQ ID NO: 101422 - DNA, 564 bp, Homo sapiens
  chr9:99983140-99983704
  hyper
aaattatccaccaagcgctacaggcgggaaattgccagggatggaaagcagctgaggctccatttggcttcgcggctccagggcccggcgacctccaaggcccccgcctcaggcgctgcgggcaaacagggcctgggggccccctcccaccgcgggctgagcccccgctacctgtcctttctgtcgcgggcatccaagtcccggaacctgcgagtcaggcagcgctccacctccgcggcgtcgcccttgatggccaccctgtggatcttccgcagttcccagtccccgatgtggtacccccgacccgcgtactcttggtccatggagctcaggagcgcctggcccaggcgtctcccgaaactgaagagtttcctcatggtggcgacttctcagacgccaaccacccgctactgagccgccgcggctcctcgtggcctttccaccccgaccaagttccaaatccgcgatccccctccccaccccgctatccacccctaaatccaagatccaccaccaaaccagcaatccacccccaaacccaagatccacccccaaccccgcgat

SEQ ID NO: 101423 - DNA, 240 bp, Homo sapiens
  chr9:99983764-99984004
  hyper
cctccgacctctcagaccgagtgagcttaactaagccgttactcgcgtgccagcagttgggcgctccgacctctcagaccgcgtgagcccagcaaagcggttaggcgcgcgcctgcagctcggcgctagcccggactccgggagccgctctcgagctcgcgtggacggcagagggcggctgcagctcgggcgcaggcgccgctggcttgcgggttctcctgggctcgcgcaggacatccc

SEQ ID NO: 101424 - DNA, 46 bp, Homo sapiens
  chrX:103087251-103087297
  hyper
tcggcggtggggacccggtgtagccgcctcccgccctccatgtggc

SEQ ID NO: 101425 - DNA, 199 bp, Homo sapiens
  chrX:108803671-108803870
  hypo
catcatccaatccatcgagggtccagagagaacaaacaagtggagtaagggaaaattcactctatcttcttctgctggaagatccatcttctcctgcccttggacatcggagcttctggttctcaggactttggattcagcctgagtcacaccaccgtctctcctgttcctccagcttgcagatggcagatcatggaac

SEQ ID NO: 101426 - DNA, 30 bp, Homo sapiens; identical to SEQ ID NO: 46885
  chrX:11773720-11773750
  hypo

SEQ ID NO: 101427 - DNA, 36 bp, Homo sapiens
  chrX:12157151-12157187
  hyper
gtttgcacccagggccgctgccgcgggcaacttggt

SEQ ID NO: 101428 - DNA, 164 bp, Homo sapiens
  chrX:122924437-122924601
  hypo
ggtgtgagtcaccgcacctggccaagatttttgtttaaattctaaatagtaaccgtttgctttagggcttactcagttgctttttgctactcaagccatggaagagcagacaggaggctgttcagaaaaaaatgtatactaaaggatgacgttggctttttgtt

SEQ ID NO: 101429 - DNA, 30 bp, Homo sapiens
  chrX:12734830-12734860
  hypo
ggacgaggtgagctgcgaggaggacctcgt

SEQ ID NO: 101430 - DNA, 80 bp, Homo sapiens
  chrX:136134699-136134779
  hyper
ggcgaaggcaaactgcgcgcacggcgccctctagtgcccaggagctgtcactgcgcgggtgcccgcggccccagctctcc

SEQ ID NO: 101431 - DNA, 181 bp, Homo sapiens
  chrX:13707253-13707434
  hyper
tccctccgcgctggacgggagcagctggagcgggagcctggctgcgctaccgcggctgcctcctgctgtgcaggtccccgaccctctctctgtcctcattgcgcccagacgggccggcccagagctcccgggtcgtctttcgtgtggccgcgaggtgagcgggactcgggactccttcggg

SEQ ID NO: 101432 - DNA, 30 bp, Homo sapiens
  chrX:13740786-13740816
  hypo
cacgctaggattctgcgctgtccaatctat

SEQ ID NO: 101433 - DNA, 1260 bp, Homo sapiens
  chrX:13955858-13957118
  hyper
aaagaatcctacagccgccttacaccagcctcgggccaggttggagatttcagattttaaccctccggagctgagccttttgccgttgctagtcgttcccccgttgcattggaacccgctcagcacaccgcctccacctgcacccgggccgcattttaatagttggaacaagggacaaagaggagagactcagcctccgtcccatgctgtccagagtctctcctgtcactttcctggtttcaagggtcatggtttcgaaatgagctcccggaagaccccaggcttggggaaccgggtgtttgtttcgcgcgggcttaaggagaacagaagcacggcggggcggggcggggcaggactggactgggagctcgggcgacagggagagcgtcccgggaaacaggcaagaagcgactctctactggccccttaaaataaagcactagcccgggacgcgccgtctgttctctctgcaacccctcccgggtacccagctcttaggctcccgcgagccgcacgtgcgggggtgcagcctggccgcagccggagcggggaccaccccccccacaggatacaacagggaagcgcacctgggcgttccggacacctgcgccgcgcccctcccacctccagcgtcccggcttcgtcgcagaggtggccgaggaggcgccacctgagcgggggaggggcgggaccctcggaagggcgcgccctcccggggcgggggcgcgagaccgtggccgtggcgcgcagccagcgcgctcgcttacccatggctggagactggcgggaggggtgagggctgcggggcgttcgggctccccggggacgggcagagccggtggcacaagtttgcaggtctcgcgggcacgtgcgctgaccgggcttctgcgggctgcgctgcgctgcgcggggctggccgctggctcctagctcccggccggggtgggagcgcggcgcggctccgcctgcactgggggccggccgcgcggagaggggccctgacgtcagcgccgggggctttgtgcgcccggagctagggcccgattgggggcagcgggcgcgcggagtctgcaggcaaagctcgcggcttcctctgggacccccccgggcgagcgccgagggtcgcgggaaccggaaaagccagcgagggggatgggtagagaggggagtgggcttctaggatcgcggaggcggcgatccgcgtcccagatgaaaactattatggcctggggaggttggggggagcggggggctttgagg

SEQ ID NO: 101434 - DNA, 94 bp, Homo sapiens
  chrX:139804733-139804827
  hypo
tacataaatatcacccggattccctccacaacatgaaatctaaccccatgaaacccatgatagtccacaaaaccagacacgccttatatcaccc

SEQ ID NO: 101435 - DNA, 151 bp, Homo sapiens
  chrX:14048060-14048211
  hyper
agtccccccctgtgtcgcggacgtcacgttcgcaccgcaggcggtgcagtgctggaggccggaagctgcctgctaatcggctaccccgagtggagcgccggggcggcaggcgtgggatggctgcgggtggcggggccggcggagagggagc

SEQ ID NO: 101436 - DNA, 30 bp, Homo sapiens
  chrX:150560243-150560273
  hypo
ctgctgggtgcaaggcgctcagtctgcagc

SEQ ID NO: 101437 - DNA, 30 bp, Homo sapiens
  chrX:150732700-150732730
  hypo
acgccaggctctgtccggcaggtctggggc

SEQ ID NO: 101438 - DNA, 30 bp, Homo sapiens
  chrX:151080838-151080868
  hypo
aaccccaggacctctcgcctcctcccccac

SEQ ID NO: 101439 - DNA, 30 bp, Homo sapiens
  chrX:151088584-151088614
  hypo
ccatccaggttgaatcgcattccgtttctg

SEQ ID NO: 101440 - DNA, 102 bp, Homo sapiens
  chrX:15511442-15511544
  hyper
gcggcctagaggaggcgggaggcgggagtctacgggtctcggaggccctggggctccgccctcgggaatgtcactccactctcgctccgccctacgcctctc

SEQ ID NO: 101441 - DNA, 262 bp, Homo sapiens
  chrX:15756104-15756366
  hyper
agcagggctcagaggcgtggcccaggctagagggaagagcccagggggagcgcagaggcggggctaggagggagcaggggtgaatgggggcgtggcccgggcgagaggggcgtggctgtagctaaaggggtgtggccagggtggagggcagagactggcacagtttggttgggcgtgaccggggcaataagtacggacgtagtggggcgtggatctgccaggtgggggcgtggcctccattgaggggcgtggccctggtatg

SEQ ID NO: 101442 - DNA, 30 bp, Homo sapiens
  chrX:16702919-16702949
  hypo
atgcaggtaacgggccgggcgtggtgactc

SEQ ID NO: 101443 - DNA, 230 bp, Homo sapiens
  chrX:16729910-16730140
  hyper
attctgtagcagcagcgtagttcggcactatgcgccctaaccatctagtacggggaaaacgcgggggtcgttgtttaaggggtgcactgggaccggggagaggacagaaaggccatgttaccggcgctgatcaccagcctcgcagacccccgctcggggcttcacttccgccaacgccatctcagggctctcctggctcccgagggccgggagaagtggggatccgggtg

SEQ ID NO: 101444 - DNA, 476 bp, Homo sapiens
  chrX:16730152-16730628
  hyper
cgggcggaggcgggaagaagcgcgtcccggggacgcgcgggacaggctccaaccgcactgggcacgggccagcgttccccagtccccgcgccacacccggcagccgaggtctgcgagcgcggggctggcggccggacccgactcagcgctgggcagggagccggcgccatcagagagcggacaaaggagcccggccccacaagtgcaccggggctgggggtgcagggcggagaggccctggggacgagggatggcccgggcgccgaggccctgggggtctgggacaggcccagaagggaagttacctgcgcggtggtggtagcaccggggagggtggccggtgggcacggcgggctccaccccgcggctggcctggcgctcacctgtcgggctggggaaggggtcgctgccggggctgtccaaagccgcccccgggatcttcccaccgcccacacgggcctcggggtgcgcggcgc

SEQ ID NO: 101445 - DNA, 50 bp, Homo sapiens
  chrX:16730852-16730902
  hyper
ggcacttcgagtgcgcgggtgaactccacgcttcccggggaaccccggct

SEQ ID NO: 101446 - DNA, 395 bp, Homo sapiens
  chrX:16887830-16888225
  hyper
gcgtagaaagagccgcggcgctcgcttcccagcggcgggggccgcctccgccccggggccgagggcgccggagggagcgcagccgctggaggagggaagggaagaggggggcccagccctcggccccgcgcccggctccggaagtgctcggagccctcggcgcggcggtcccgtcccgcgcaggcccctcgaggcgcgcgcccagtctcgcgcccggccccgccccctgctccgcacgccaattcgcgcctttcgccggcgcgtgccgcggcctcgcgcgcccgccgccccccgcggccccggcgcgcgccgccccgcagggcctcttactctctttactcgccatcttgcgtcgggtcgttcgcccctcgccgccgcctcggactcctctcgtt

SEQ ID NO: 101447 - DNA, 112 bp, Homo sapiens
  chrX:16888552-16888664
  hyper
gcgggtttcacgcggcgttcggaggcgggcttctgggggtgggcggagcgtgccgcggcaggaagttggcgatgcgcaggcgcgagggctcgcccggcgctcccagggccgg

SEQ ID NO: 101448 - DNA, 30 bp, Homo sapiens
  chrX:19353762-19353792
  hypo
tgcagaaagcaaaaccgtggataaagggga

SEQ ID NO: 101449 - DNA, 20 bp, Homo sapiens
  chrX:19435187-19435207
  hypo
caagatggctgaatacgaac

SEQ ID NO: 101450 - DNA, 35 bp, Homo sapiens
  chrX:20160936-20160971
  hypo
agtcctttcactcgcccagccgggttgggagcctg

SEQ ID NO: 101451 - DNA, 42 bp, Homo sapiens
  chrX:22973409-22973451
  hypo
aaggataatagttttcggccgggagcggtggctcatgcctgt

SEQ ID NO: 101452 - DNA, 39 bp, Homo sapiens
  chrX:23217730-23217769
  hypo
aaaaacaaagaataaaaaataaagcgtctgacacttaag

SEQ ID NO: 101453 - DNA, 35 bp, Homo sapiens
  chrX:23714117-23714152
  hypo
cacaactcagctgggcgcggtagctcacacctgta

SEQ ID NO: 101454 - DNA, 22 bp, Homo sapiens
  chrX:23825274-23825296
  hypo
gcaagaccgtctcctcccaaaa

SEQ ID NO: 101455 - DNA, 30 bp, Homo sapiens
  chrX:24074681-24074711
  hypo
atataaagttctggccgggtgcagtggctt

SEQ ID NO: 101456 - DNA, 100 bp, Homo sapiens
  chrX:25039052-25039152
  hyper
tgtcaattcccaggccgcgcggaccggagctgggctgtcggcgtccgcacccccagcctccccacctcagcccccttttcgggctcggctcagcgccacg

SEQ ID NO: 101457 - DNA, 173 bp, Homo sapiens
  chrX:26179543-26179716
  hypo
tgagtggtgataatgcgctgccgaagtcgggtctcctgatgtcgatcctgggtttgatcttcatgagaggcaaccgtgccactgaagaggaggtctggaagttcctgggtctgttggggatatatgatgggatcctgcattcaatctatggggatgctcggaagatcattact

SEQ ID NO: 101458 - DNA, 147 bp, Homo sapiens
  chrX:2742585-2742732
  hypo
tctgatttcagagttcggatgcctaagaatgtgcatgacacagtttcccaggtgacgctgatgctgccggactaggactgagcctgcacatctcaccctgaattcaaaatcaaaagatggggtgagggttctcggcaaaacgcagcc

SEQ ID NO: 101459 - DNA, 83 bp, Homo sapiens
  chrX:2746913-2746996
  hyper
gggggctggcggaggcggggccgggcttccggacagaggccaatcgctgccctcggggcctccagcgccggctctgggccgag

SEQ ID NO: 101460 - DNA, 235 bp, Homo sapiens
  chrX:2747708-2747943
  hyper
gtggagaggggtgaccggggggcgccagctggggtggaggaagaggatgcccagaactccaagcaggtgcgcggggcggcggggcagctgctgacaccgctgaggtcgggtggtgtcccgggggcgttgtcgttgctgggcgcatgggtgttaagacgcagcggggtcgcaggtgactgtggggaggacagggggtcaaggggcccctggccagagggcacgaggctgacctgga

SEQ ID NO: 101461 - DNA, 100 bp, Homo sapiens
  chrX:2825711-2825811
  hypo
ccacgcaggtgtgaacgcagaacgcaggtgtcggccctgtggtatcagcatgaacctccctattcagtgaaaaggaggagggacacgaggcagtccacac

SEQ ID NO: 101462 - DNA, 30 bp, Homo sapiens
  chrX:2835934-2835964
  hypo
aggatacagttccagcgtcgcacaaacccg

SEQ ID NO: 101463 - DNA, 148 bp, Homo sapiens
  chrX:2836217-2836365
  hypo
ggtggcagtgatccccgcgggatgcacaattcacaccctggtgccattttcctaaaagaaacgcaaatgttcaacagagacccgctttgaagcagccctgtctgctgcaaagaacctcggaatcattccgcgtcggcaggaaaagaaa

SEQ ID NO: 101464 - DNA, 158 bp, Homo sapiens; identical to SEQ ID NO: 38629
  chrX:2846239-2846397
  hyper

SEQ ID NO: 101465 - DNA, 49 bp, Homo sapiens
  chrX:2846807-2846856
  hyper
cttagtggggcagagcggggggcgcggttcggggcgggtcttagggagc

SEQ ID NO: 101466 - DNA, 121 bp, Homo sapiens
  chrX:2847075-2847196
  hyper
ggctctgctgtctggcgtctttcccgggcacagaacgcgcctccagctacattttggagactacaaggcgccggacacaaccacgccctttacaggggcccaggctcgcccggggcgcccc

SEQ ID NO: 101467 - DNA, 159 bp, Homo sapiens
  chrX:2931173-2931332
  hypo
aagctgctgcagcaccgtggctaccgcacgggactcataggtatggcgccggaactctgcccgtggaaacgtgatcctgcagcctctctgtcatcgtgtctaaggtgtttccggggatgttggctttgtgcgcgccagtttgaccgacttctctttgag

SEQ ID NO: 101468 - DNA, 30 bp, Homo sapiens
  chrX:2933263-2933293
  hypo
tgtctttgctctcctcgcctttctgttttt

SEQ ID NO: 101469 - DNA, 30 bp, Homo sapiens
  chrX:29374805-29374835
  hypo
ctacatctatacgaccgcaaataatgctac

SEQ ID NO: 101470 - DNA, 100 bp, Homo sapiens
  chrX:2945321-2945421
  hypo
atctttggttgtgtcgtaatctttggttttaggtggcaaaggaatgggaggatgggaaggaggtatccgtgtgccagggatattccggtggccgtcagtc

SEQ ID NO: 101471 - DNA, 30 bp, Homo sapiens
  chrX:30648695-30648725
  hypo
ggacaccatgaaagccgccatggccccgga

SEQ ID NO: 101472 - DNA, 39 bp, Homo sapiens
  chrX:3229228-3229267
  hypo
ctctgactctcatctcgtccttcccgacctgattttcag

SEQ ID NO: 101473 - DNA, 471 bp, Homo sapiens
  chrX:3263355-3263826
  hyper
ggctccgcctctgggcgctggaacaaaccggctcctgcagctctgcaaaagtcctcggagttttctctctcgccagagcccgggctttccccgcccctgcctgcgcgcctgacctcggcgctgggctggttccaagggcagccgcgccagtccccagcgtcctgtgcctgcgggcggacttggcccgggcgttccataggactcttcagccccaactccctgtccggcctcccaccccggcaccaacctcccgggagacccaggaaactcgcccccagacaaccctaatcccggggactcggggtcgggtctctccgccgcggagaaagcggcctggcgccagctaggccgccagagacggtctgcgaaccccgccgggaagcaggggtgggggcgtgaggccgtctgctttcgtcttggccctgggcagacaacctggagtggccgggcgggcagccctgagcccctggc

SEQ ID NO: 101474 - DNA, 251 bp, Homo sapiens
  chrX:3263918-3264169
  hyper
cgccgcccgggactcggacaccaaaccccttttgtctgcgtgatgactgtcccggtttttttgcatggctcggatcactctaggcgttgggctgtcccctttccagggaaagcctgggtaagagtaggaggaaagaggcggggaaggagagggggaagagaggagggagaggagacttgaagtagccacagcctgagcaacttggaaagaggctcctcaagcgtcctttcccccaccgattgcaagagcag

SEQ ID NO: 101475 - DNA, 386 bp, Homo sapiens
  chrX:3264627-3265013
  hyper
cggccgggagtttgccggggccatgcccttcccggggccgggggtgaggcagctcggcttcccagcgcggcacagcaagccggcgcccttttattcccggcgctgcgaggcttccccaagtccacgcctcggcacacccccaccctgccccaccccggggagacggggcgcgggcccgagccaagggaccctggccgcgccgctctgcgctcagccttcctctcgcgtcttcattgcgcctgggcccgggtgggcatgcctcgcccactccagctgcaagaaccgcaggcggctcggggaaggagggctctttgtcagagagaagtccaggaccccaggagggaagggcgagatgcagggagcgcggtgggagccgcagtagagtc

SEQ ID NO: 101476 - DNA, 73 bp, Homo sapiens
  chrX:3265150-3265223
  hyper
cgggctggccccgccggcatcccactagctgcaggcagggctgcaacgtgagagccgccgccacgccctcccg

SEQ ID NO: 101477 - DNA, 122 bp, Homo sapiens
  chrX:33744448-33744570
  hyper
tccccgccctccccacgcgcgggggcgccctgacagtcccctgctgctcctctgctgggcgccacaactttccccaacccgtgccaacttccagggcacagcctctgcggagagtagcaggg

SEQ ID NO: 101478 - DNA, 94 bp, Homo sapiens
  chrX:34149739-34149833
  hypo
ggagtcttgggaggctccgggcttagatgggacactccagtctcgggaggctctgggaggagatgggacaccggagtctcgggaggcttcaggc

SEQ ID NO: 101479 - DNA, 102 bp, Homo sapiens
  chrX:3478175-3478277
  hypo
gcttggcttgggctcagaggcctgacaatttctatctgtggagtaacgcagttccccctccatgatgtgggtgggcctagtctaatccgttgaagacctgac

SEQ ID NO: 101480 - DNA, 33 bp, Homo sapiens
  chrX:3630804-3630837
  hyper
caggaggttttgtgacgtcggacggcccaggcc

SEQ ID NO: 101481 - DNA, 40 bp, Homo sapiens
  chrX:3694581-3694621
  hypo
ccatagttggccaggcgcggtggctcacgcatgtaatccc

SEQ ID NO: 101482 - DNA, 140 bp, Homo sapiens
  chrX:3746502-3746642
  hypo
cagtgtgagaatggccgaaaacgacacccagatgcaaacattacctgcaggccaccgcgtgctgactctctcaccaagcaggagcgggcccctccctcacgcggagccgctggcacggacagccccgggaaggtcaggct

SEQ ID NO: 101483 - DNA, 30 bp, Homo sapiens
  chrX:39868222-39868252
  hyper
gccaacactgtcacccggaacgtccccgcc

SEQ ID NO: 101484 - DNA, 30 bp, Homo sapiens
  chrX:39964600-39964630
  hyper
cgcagtcacggggaccggaagccctcgcgc

SEQ ID NO: 101485 - DNA, 30 bp, Homo sapiens
  chrX:39968920-39968950
  hyper
caccgagcggttttgcggagctgcccgagg

SEQ ID NO: 101486 - DNA, 323 bp, Homo sapiens
  chrX:40005519-40005842
  hyper
cggtgcctccccccacggccctgaggtcctccctgcgcccccactctgtttaacccccaggtggggagaggaccccgagactgcacacagcgcgcccggggccctgccggggcctgagcgggcgggggacagtgtccgggaggagggagggccgagaggctgatttaaaggttctcaccgggaagcgagcgaggcacagacctgagagccgccgcgcggtgaaatccgaggagctctcttggcgaggaggggctgtcagaggccatttatctctcgccagagtggaggctcagctcccacaccgcccgcgagtaacaatggca

SEQ ID NO: 101487 - DNA, 30 bp, Homo sapiens
  chrX:40006116-40006146
  hyper
ccccgacgcagacaccgctgtcagccccct

SEQ ID NO: 101488 - DNA, 132 bp, Homo sapiens
  chrX:40014537-40014669
  hyper
ctttagaaaaagaggcgagaaggggcgcaccgcagtgccgcggctgctgcgaccgggggagagggtcgggggctgcggagcagaggagtccgcacccccgcggccagggtcaggcggcgtggatatcacccg

SEQ ID NO: 101489 - DNA, 377 bp, Homo sapiens
  chrX:40017591-40017968
  hyper
gcccggctgcgcaggcggcgctgcccccggcggtaggaccgcggagccgcaggctgggccggggctgccgcgcgggcgttcccgggctgccggggggcgctccctcccgaggcccccctccccgctgcgggccacgctgacccaggtcggggacgatggggcggccgtccctggtgaaagcgtggcctgtagtgtcgcccctcctcgaaacgctggagcggattttaatcctgagaaacgacctctggttcccggactcccgcgatggtcaacgtgttatcgcttctcccgcgcaccccagaactctgtccccagaggcaacctgccgaggcagctgggggtggggggcgaggcctacccaccgttcacagggcgct

SEQ ID NO: 101490 - DNA, 44 bp, Homo sapiens; identical to SEQ ID NO: 38658
  chrX:40031390-40031434
  hyper

SEQ ID NO: 101491 - DNA, 632 bp, Homo sapiens
  chrX:40034425-40035057
  hyper
gcgggggctctcctccgaggggctcagcacggatcgttgggttttccccggcgaacttaacacggaggcaaaaggggcagatggaaaccaggccccggctggccccgcgcgcgtaagcgcggcactcagcagctcgacgcaaagccagggctggattttcgcggcccgggcccggcggccgcccagcgcccgcgcgatcctctctccttcgggttgagcaaacgtggtcgcctaattccgcccgggagacagcagctgtgcggcgagagggggagaaaaaatatcgcaacttttccaacagaaagtgtgtgcgcacacgagaggtgaaggcccaccccgattctgtgcacgtatcgacacagcatctaatcagtgtcactgccaggaatacgcttccgcggcgggcgacaccgccgccctcgccaacctgcaggagggaggggggatgcaaatggcgtctcgcgtcgtcctagactccgcgcagcacccgctaccgcgactccaagcagacgttgcagcaaactggggtgcagcgtctggggacgcgaacgcgcaggcggcccgagcggtcgcagggaagaggaactagcaccactccccgctacgagaccgttccccgcccccacctccgg

SEQ ID NO: 101492 - DNA, 15 bp, Homo sapiens
  chrX:40035724-40035739
  hyper
agaaaacaaggccgg

SEQ ID NO: 101493 - DNA, 124 bp, Homo sapiens
  chrX:40126463-40126587
  hyper
ctccgcgcatagcaccggggcgttttttccttccagctggaggcttcccatttaacctctaaggtgccagaagatccggatccctcgcgggcaggcctttggctggctccgggctaggctggga

SEQ ID NO: 101494 - DNA, 54 bp, Homo sapiens; identical to SEQ ID NO: 46889
  chrX:41331697-41331751
  hypo

SEQ ID NO: 101495 - DNA, 30 bp, Homo sapiens
  chrX:4335009-4335039
  hypo
ttagtgccggtaacacggaagcggctttct

SEQ ID NO: 101496 - DNA, 22 bp, Homo sapiens
  chrX:44136212-44136234
  hypo
acttacagctgaggccgggcac

SEQ ID NO: 101497 - DNA, 100 bp, Homo sapiens
  chrX:44202862-44202962
  hyper
ccagaagagagggcccggcaggcagcggcgcctcccggccgtgttgtttggcccccacgttgcctggagacgggaagcggcgtcacggagggaggagggg

SEQ ID NO: 101498 - DNA, 163 bp, Homo sapiens
  chrX:44729844-44730007
  hypo
taatgttctcaaggtcgcacagcctgtgtagagcaaggattcgaatccaggtctgcctcactccaactcccacccattgcatccactccttgctgttctgctattacatagtaatagcgggaagaaaagtgttgaggtgtggagagtgggtagcctttttttt

SEQ ID NO: 101499 - DNA, 36 bp, Homo sapiens
  chrX:44751504-44751540
  hypo
agcttgctgggatttcgaggccgggtacggtggctc

SEQ ID NO: 101500 - DNA, 22 bp, Homo sapiens
  chrX:44755610-44755632
  hypo
ccgcgcccggccaaaaataaat

SEQ ID NO: 101501 - DNA, 52 bp, Homo sapiens; identical to SEQ ID NO: 46892
  chrX:44922962-44923014
  hypo

SEQ ID NO: 101502 - DNA, 32 bp, Homo sapiens
  chrX:4606598-4606630
  hypo
atttttttttttagacggcttctcactctgtt

SEQ ID NO: 101503 - DNA, 31 bp, Homo sapiens
  chrX:4606870-4606901
  hypo
tgtgagccactgtgcccggctgtgagcagaa

SEQ ID NO: 101504 - DNA, 30 bp, Homo sapiens
  chrX:4636880-4636910
  hypo
cgccgtattagattgcggtttttgccttta

SEQ ID NO: 101505 - DNA, 196 bp, Homo sapiens
  chrX:4691958-4692154
  hypo
tttgccaaatttgtccgggcattttccccctatgaatgtgccccataaccctttgaggaactgcttggttttaactgctggcatgcagtgcattgggataaaattgtgcaaaccacatcctggggtaatgatattcctctttgctctcctcaaaccatggtcccgtggacacatagatgcccgcacctgtgatgca

SEQ ID NO: 101506 - DNA, 99 bp, Homo sapiens
  chrX:47440990-47441089
  hypo
cctctgtttgaatcccggccatgccctgtgatcttaggaaaattctacagttcctctacgccccatatttcctcatccgtaaaacgggaataagaaccg

SEQ ID NO: 101507 - DNA, 30 bp, Homo sapiens
  chrX:54977452-54977482
  hypo
ggaagcagatggcaccgtgactgtgcatag

SEQ ID NO: 101508 - DNA, 30 bp, Homo sapiens; identical to SEQ ID NO: 46884
  chrX:5757324-5757354
  hypo

SEQ ID NO: 101509 - DNA, 40 bp, Homo sapiens; identical to SEQ ID NO: 46893
  chrX:58297213-58297253
  hypo

SEQ ID NO: 101510 - DNA, 30 bp, Homo sapiens; identical to SEQ ID NO: 46894
  chrX:58304829-58304859
  hypo

SEQ ID NO: 101511 - DNA, 124 bp, Homo sapiens
  chrX:58307150-58307274
  hypo
cctttggggtgccttcggtgggagagacacgcacccagcttgggagacaggtactccacgaacacccctggtagggcacaggggctgccgggaaggcactgacctccggcggggcaccccagcc

SEQ ID NO: 101512 - DNA, 94 bp, Homo sapiens
  chrX:6143621-6143715
  hyper
cacttctatgttgcccgcagaacgcccacacaaactggcaattctgcttcgtcaggataacgaggtctccctaaactttttcttttcctttttt

SEQ ID NO: 101513 - DNA, 514 bp, Homo sapiens
  chrX:6143775-6144289
  hyper
tcacatcaccggaagggctgattctgagatgggagctcacgcacaccaccccctttcaagaaaatataatgcaacgcgctccgatgtaaaccctacgggcaacggatgccttcaaaaagcataagataagagcaacaacaacaacaacaaaccaccgccccccccaaaaaaaatgaccaaatagaaataaaataaaataaaaataaaaagaagccatactaccaccttgtggatccagctcgcaagaacatcacctgcttagttccaaaacccccacccaacccccaccccaaatttcttaagttgggtccaaatgacagatcgggatcctctgtcctcactccccgcagactcgcccaagccctaggctgaattcgtgacgcgcgcgcccagcacccgggcgagttgcaagccccggcgcaccgcaggggccaaaaccccgccggaacctcctaggaccccttcacgctgcctcctgcaccccctcccccgccatccccgagatagcagcagc

SEQ ID NO: 101514 - DNA, 807 bp, Homo sapiens
  chrX:6144913-6145720
  hyper
tccctacctcatccccgctcgcgcttccgcaggtcaggccacgcgggtgccagcgcgggctgtgggcgccccagccgcggccttggggaggggtcaggactgaagttcactctctctctgcgtggtctcgaagcccctcgcccaccccgcactgtctcctccgccgccggctgcgcgcttggcggatcttctccatcagttctgcccactggagtgggaaggggctgagccgagccgcgcgggaattgggaggcggggaagcggggaggcgggggaagagacgagatgaaatcggcccgggacagcagagaggcttgggatgggatggaagggaagagggggtggcggttgcgttttccagggctgtagaggtggtgcgcctattggaaccgactcctcagcctcctcccccgtccccacctcggggactggcggaccgtgcgccccgcaggcttaacactccccccgacaccctcgctccgagaaggggtgttctcagtgggcaccgactagggctccagatcccccgagacccagaccagggctccggtagtctgtcctcgcagcttccaacttttccgctccttcggaaaagcgggcagttcagagatggttcccagggcggcagctgcaagcccccccgcgcccccctcaaaggttcagactacactcaaaggctccgaaagaagcaaaaccaccagctctaccctccttctgcggcttgcctcacccttcccacccgcctcgaaacccacacacacgggaaaggggtgcatggagcccgctccccggtttacagaagcagcc

SEQ ID NO: 101515 - DNA, 15 bp, Homo sapiens
  chrX:6145835-6145850
  hyper
cgtcatcttatccga

SEQ ID NO: 101516 - DNA, 30 bp, Homo sapiens
  chrX:67871660-67871690
  hypo
ctcacagaaatgccacgaacatttggtggg

SEQ ID NO: 101517 - DNA, 145 bp, Homo sapiens
  chrX:69501680-69501825
  hypo
ttcagatgtgcctagcgatctcttgcctatttcctcttcctggagggtcacggaactactgagaacaatcttccccacctccacccctttgctgtgattacactacacttagcccgtgcttttccccatacgctgaccccaactt

SEQ ID NO: 101518 - DNA, 155 bp, Homo sapiens
  chrX:71525843-71525998
  hyper
ggggagggctgaggtcgactgggcagtagaggcaagttgcccaaattcgctaacttccatcccgcaattccgctgaactcggcccgaaaagccccctcttgcctcaattccccgaagtaaatctgagctttgtgcagctccggagccagagcgtc

SEQ ID NO: 101519 - DNA, 34 bp, Homo sapiens
  chrX:71526883-71526917
  hyper
gcgcgggtgctgtgccgtccgctgctctcttcct

SEQ ID NO: 101520 - DNA, 30 bp, Homo sapiens
  chrX:73740816-73740846
  hypo
ctctgcagcatgggtcggagccctcgcgat

SEQ ID NO: 101521 - DNA, 38 bp, Homo sapiens
  chrX:78711045-78711083
  hypo
ctgacctcgtgatccgcccgcctcggccttacaaccat

SEQ ID NO: 101522 - DNA, 178 bp, Homo sapiens
  chrX:7895411-7895589
  hyper
accaaggccgcgctacgctctccgcgagccggcccaggaaagtcctgcggcaggggttggtaccgcctcccgcgcaggtatgtgacgtcatcgcgccgacgaaggcgcccgctaggccccgcctgctctatttaaacttctggactcaacctggccgctagaccggagcgtcctccag

SEQ ID NO: 101523 - DNA, 554 bp, Homo sapiens
  chrX:8698504-8699058
  hyper
gccagcttcaccagccggttcaagatcatccccgagggtaaggggaatcacttccacattccacccttattaatatggcctcctctggcagcttaattcccagggcctctagggggacccccccccccaccccttgacccagctctggcaggaggggcgcccagtttaagagccaagggtttggcttccagttcccgcccagccaggggaacccctccccccagcccccatttctccttttggtccctccagagtttccctgaagcgagaaattgggaacttggaacaggtgggcacctagggatagaggcgagaagaagaaggagagaaggatgagagaagagaaaaataagcggaggatttcagagctcgcacgctcgacagggctggtacaggcagcagctgcactcgctcgcgctgagtccggaacctgctctcgtgcgcccacccgcacccggagcctcgcgcaagtcccgcgggggtccgcgccacagggcagagtcccggcaacccgctggagccaagcgcgcggctcccggagcctcccacacaag

SEQ ID NO: 101524 - DNA, 113 bp, Homo sapiens
  chrX:8699110-8699223
  hyper
cggggtttgggggacggttcccccgggactcgttgaggagtatccgaatacggccccgccaaatcccctgtccccggcacttcttccctgacgctctacgctagtccagggca

SEQ ID NO: 101525 - DNA, 314 bp, Homo sapiens
  chrX:8699436-8699750
  hyper
ggtgaggtccccaggcgcagccggacgcgcctcccagactccctcccagtgccccggagcgcctgggactttgcgggagtcgccgcccgcccggagtctcgcgcactccaattcccgggaaaccgccacatccacacacccactcccagcatccacgactctccctccccagggaaatcgcctttggtttcctgctgggaaggagggagttggggcaagatgtctcgggcttctttttcttttcaggagccgggaagaggctggaaaggagagttccagcaccccgactgtaagatccacgcccaggggaagcc

SEQ ID NO: 101526 - DNA, 422 bp, Homo sapiens
  chrX:8700038-8700460
  hyper
gcagagggtcaggaccgcgccgggcaccccgggcaccatggctgcgggtcgagggcgagggcgagggcgccgggcgcgggccgaggctccctgctccgcgccggggctgcactgctgaggaccaggcagacgccgcgactgagccggaaagttcaatccttcaactccggccggaccctcctcgccgacctccctcccagctcgccctcgaggggtggggtgagggggacaggaggccgcaccattggctggaaggcgtgtgagtgacaggggggccgggcgcagggcccatgggccggtctcgtcagctgcgagcccgggcgctccgggggagggcgacgccgagcggctttccacgccgcgcaggtctcgaggggcccagctcccacgcaggcgcctctcccgttcgcaccaaccgcttc

SEQ ID NO: 101527 - DNA, 30 bp, Homo sapiens
  chrX:91035211-91035241
  hyper
caacccttgagggtacgacccttggcgcag

SEQ ID NO: 101528 - DNA, 516 bp, Homo sapiens
  chrX:91035598-91036114
  hyper
cccagaaacagttcacgtcctcacaaaggaattctttttcttaaagcgcgtagcgataaaacggctcttttttttcgagaaaagtaatgtaccttttaaaagaggttcatcggaaaatgtgactttttaaaagcgagcagccgcaaacgggtgtattttttagactttagaagagcggagcggcagtccgcccgggttgcggctgggactcgcatctgagcgcttagtcgcaaaaggactgaggggtaggaggagaggtcactttctcagagtgtatagccagagccgcttccttgcctctcccagggaaagacttttagagcttaaccgaagatgggcccttttgcttcagaatgatttattccgcgttcctctgcttcacccgcctgcggcttagggtgtggggcgctaggctgctcatgtgaagcgcttacgggtgagccctagcctctccgatgcaaaatgtgggctgggggctgggaattgctatttgcgccactgcggcacacacccaca

SEQ ID NO: 101529 - DNA, 221 bp, Homo sapiens
  chrX:91037061-91037282
  hyper
tgggaagccgagcggcgagtccgacccgcaagcacgagcagccctgccccgcgcgctccctgcgcgcagccgccctcgtgtcccttcggcctctcctgggtcccggctcgcagccccccccttccagtccctcgctcctcagaggcgcgctaaggcgccagaggcgggggtggccactgctggcggcccgccgccggttttaaacccggggttcaaaccca

SEQ ID NO: 101530 - DNA, 41 bp, Homo sapiens
  chrX:92928695-92928736
  hyper
aattgacaaactgtacgcccaacgaacggccaaacgccact

SEQ ID NO: 101531 - DNA, 45 bp, Homo sapiens
  chrX:9433426-9433471
  hyper
gggaggttcggagcgcggccgggcgcgcggcgccgccacaagttg

SEQ ID NO: 101532 - DNA, 126 bp, Homo sapiens
  chrX:9433712-9433838
  hyper
cccgaagtgccggcgcgccttgcggggagagacggaggtcggcggggggctcctttgttttggggagggggaagtggccggtaagtttagggaagcgctcggcttttcctccggtgcccctttgtc

SEQ ID NO: 101533 - DNA, 105 bp, Homo sapiens
  chrX:97101386-97101491
  hypo
caaggaggacttaggcgcccagggccccatcaccagctccgcgggcatcagccaggagaggactggcagctagatttcacccacatgccgcggcacaagcattac

SEQ ID NO: 101534 - DNA, 101 bp, Homo sapiens
  chrX:97285055-97285156
  hypo
ggggtatgtatggtgcgggggtggggggcggctaacttcccgctttgctggagttgcaactacttttggtcggatgcctggaaagccagagtatctaaagc

SEQ ID NO: 101535 - DNA, 30 bp, Homo sapiens
  chrX:99924339-99924369
  hypo
gtcagccaacatcatcgaggagctcaggtc

SEQ ID NO: 101536 - DNA, 20 bp, Homo sapiens
  chrY:14301600-14301620
  hypo
gagcgacacagaagacgggt

SEQ ID NO: 101537 - DNA, 57 bp, Homo sapiens
  chrY:14567906-14567963
  hypo
tggccctccgcccaccgcgtgcctagatgtgggggcaccgtgcgtgttgccgaactt

SEQ ID NO: 101538 - DNA, 30 bp, Homo sapiens; identical to SEQ ID NO: 46899
  chrY:14621298-14621328
  hypo

SEQ ID NO: 101539 - DNA, 243 bp, Homo sapiens
  chrY:16635817-16636060
  hyper
catgcacccctttcccgtgtgtgtgggttacgacgtgggtgggagtggtgaggcaagccgcaaaagtggggtagagctggtggttttgcttcttcggaagcctttgagtgtggcctggaccttagatgggggtgcagggcggtttgccgctgccaccctcggcaccatctctgaactgcccgcttttccggaggagcggaaaagttggaagccgaaaagacaggcgcccggagccctggtcta

SEQ ID NO: 101540 - DNA, 89 bp, Homo sapiens
  chrY:21728053-21728142
  hypo
actgatattatactacgaccttggaagcaaaaccgttattataagcaaaagaagctagacgcaaagtccacttacgtcaggattacata

SEQ ID NO: 101541 - DNA, 116 bp, Homo sapiens
  chrY:22901316-22901432
  hypo
gagtgtccaagtgtccggacctgtaggttccagtgctcaccctgcgcttttatatatctggttgtttgcagtggatcaggagcccctggccaggattttgccggtgttgtttgttt

SEQ ID NO: 101542 - DNA, 159 bp, Homo sapiens
  chrY:22918423-22918582
  hypo
cgctgtcttgacagacgccagagagactcgtgaggttgtcaaaggtctgggagttttgcggggtttgttctggagtctggcaggaagtaatatttgctcaaaactgggcgtgaaatagcctggactgtcctttctcctccgatccggtattacccgtta

SEQ ID NO: 101543 - DNA, 94 bp, Homo sapiens
  chrY:23111711-23111805
  hypo
atcctgtggtgcactatgttttaagcctattggaaaagtgcagcattctggtgggagtgatccgattttccatgtgccccgggtccctcaccca

SEQ ID NO: 101544 - DNA, 30 bp, Homo sapiens
  chrY:23613703-23613733
  hypo
caggtaccccgagtccggcggagataaaga

SEQ ID NO: 101545 - DNA, 67 bp, Homo sapiens
  chrY:4869647-4869714
  hyper
ttaaaagaggttcatcggaaaatgtgactttttaaaagcgagcagccgcaaacgggtgcatttttta

SEQ ID NO: 101546 - DNA, 210 bp, Homo sapiens
  chrY:6778824-6779034
  hyper
aaactttccagtacccgcgacctttccgggactccgcggcggcggggcagaggcggcccaggggcggcacgcggctgctccggtgcgccgggctcttttcggccgccgcacggccgggcctcacaggctgccctcctgagagaggctcagaacacggccaggtacgcgccgccgccacagttgcgctgctagcgacgaggtgagtgctag

SEQ ID NO: 101547 - DNA, 30 bp, Homo sapiens
  chrY:6779293-6779323
  hyper
tggggaagggggaggcggctgctaagttta

SEQ ID NO: 101548 - DNA, 61 bp, Homo sapiens
  chrY:6779746-6779807
  hyper
ggcagatcctgggtccggccttgcttcccagtggtaccttctctcacggagggggcggggc

SEQ ID NO: 101549 - DNA, 40 bp, Homo sapiens
  CR856017.2_11887-39781:16677-16717
  hypo
ttcccacctccaggacgggaggtaccgctcctagggattt

SEQ ID NO: 101550 - DNA, 32 bp, Homo sapiens
  CR936360.14_69981-85448:11336-11368
  hypo
ctagtttgagccagccggccgcagtggcttac

SEQ ID NO: 101551 - DNA, 30 bp, Homo sapiens; identical to SEQ ID NO: 46912
  FP565324.3_2001-29640:15187-15217
  hypo

SEQ ID NO: 101552 - DNA, 30 bp, Homo sapiens
  FP565324.3_2001-29640:19444-19474
  hypo
ggaggagcatcttcccgtgcttgtttattg

SEQ ID NO: 101553 - DNA, 124 bp, Homo sapiens
  FP565324.3_2001-29640:19686-19810
  hypo
cggcaagtaggtggccggatcgccctccgtcccgcctcctgtgcccccagcccctctgcaccccgtctccttcctcttcttcgccaagctctgagcaccctctccggggcgctaggtgctctcc

SEQ ID NO: 101554 - DNA, 30 bp, Homo sapiens
  FP565324.3_2001-29640:25504-25534
  hypo
cattcattacagccacggctgaggactctc

SEQ ID NO: 101555 - DNA, 264 bp, Homo sapiens
  GL000220.1:138909-139173
  hypo
tttttggccatctttcgggcaatgtaactactacagcaaaatgagatatgatccattaaacaacatattcgcaaatcaaaaagtgtttcagtaatataatgcttcagatttagaagcaaatcaaatgatagaactccactgctgtaataagtcaccccaaagatcaccgtatctgacaaaataactaccacagggttatgacttcagaatcatactttctcttgatatttacttatgtatgtatttattttttttaatttattt

SEQ ID NO: 101556 - DNA, 160 bp, Homo sapiens
  GL000258.1:893139-893299
  hyper
ggctccagccctctacgccaccgtcaaggagggtcggcctggtcccgggcgggcagccaagccattccccagaaattcagattaacctggacccgcgtggaggattcagctcctagatgctcttccgtctcagaagtgcgccccccgcaccagttttcag

SEQ ID NO: 101557 - DNA, 30 bp, Homo sapiens
  GL383548.1:10245-10275
  hypo
ccctcccccaggcatcgatctcgtgaataa

SEQ ID NO: 101558 - DNA, 82 bp, Homo sapiens; identical to SEQ ID NO: 14151
  JH159140.1:144237-144319
  hyper

SEQ ID NO: 101559 - DNA, 184 bp, Homo sapiens
  JH636052.4:1361645-1361829
  hyper
ttgctgggggcggaccgtgttgacaaagtcgctggaaatcactgtcagagatgtagcttttaggatagtattgtccaggatctgctaggctctatccactgcaggccttggtggggggggagggggggcctgcgaagcacaggaaaacttgtcttttcgttgtaacttccgcttcgttactaca

SEQ ID NO: 101560 - DNA, 24 bp, Homo sapiens
  JH636052.4:1362108-1362132
  hyper
gacttgctcctacagcgcgggaaa

SEQ ID NO: 101561 - DNA, 24 bp, Homo sapiens
  JH636052.4:1362192-1362216
  hyper
tgatgtcaccgacagtgcctttcc

SEQ ID NO: 101562 - DNA, 30 bp, Homo sapiens
  JH636052.4:1370528-1370558
  hypo
agccaccgtgcccagcgtaaccaagattat

SEQ ID NO: 101563 - DNA, 18 bp, Homo sapiens
  JH636052.4:2022610-2022628
  hypo
aacaataaaacaggccgg

SEQ ID NO: 101564 - DNA, 29 bp, Homo sapiens
  JH636052.4:2254977-2255006
  hypo
ccaccgcgcccggccggtttaccattttt

SEQ ID NO: 101565 - DNA, 32 bp, Homo sapiens
  JH636052.4:2269647-2269679
  hyper
ctcggtgatgcgcttcgcgtatttgcggacga

SEQ ID NO: 101566 - DNA, 36 bp, Homo sapiens
  JH636052.4:2280989-2281025
  hyper
aagaataacccttgccgtctattttttcattacaaa

SEQ ID NO: 101567 - DNA, 89 bp, Homo sapiens
  JH636052.4:2302679-2302768
  hyper
gtccgcgacccgagccgccgcctcgaggctcaggggaagctgaacgctcggtgggctcctgggatgcatcttcgcgttctttgcgccgc

SEQ ID NO: 101568 - DNA, 211 bp, Homo sapiens; identical to SEQ ID NO: 38684
  JH636052.4:5118718-5118929
  hyper

SEQ ID NO: 101569 - DNA, 225 bp, Homo sapiens
  JH636058.1:413166-413391
  hyper
tcggggtccggcgggcggcggtgaaccacggcgcccgcggacatggacaccaggcactcggcggcgaagtagtccaggcacgccacggcggccgacatgctgggaccgcccggccgccggcgagcgccgtccgaacgcggccggccgcgggcgacggagttcccgggagcgtccgtcccgcagcctcggagcgagaagcaggaggccgggtgctcgccgcctgcc

SEQ ID NO: 101570 - DNA, 445 bp, Homo sapiens
  NW_001838014.1_249000-295694:13512-13957
  hypo
ggcccctcggcagtgcggcccctcagcagtggggccaaagcgccattgccggcagccggtcgggaggagggtgaaagagaaatcctggctgcacacagaaggcaccaactgtttgctcatcgcagagcagggcagtggtgcccaggagggcggggcatcggatactgaaacacgagcaggtttccggcatcgagactggggctggagacttcaggaaacctcattttcttccccaaacatccacccttttctttaaagtaggccaaaggcctccgtttcacgctgtgtgagccaggcgtgtcaagccacagcggtcgaggcgggtgtttctcagggcaggctttaaaggtgctcgggcccttcggccggcgccctctgcaggcagggcaaagggtggggccatggggtccctgcaaagatcaggctaaggcgactccaccgcact

SEQ ID NO: 101571 - DNA, 61 bp, Homo sapiens; identical to SEQ ID NO: 46915
  NW_001838014.1_249000-295694:3702-3763
  hypo

SEQ ID NO: 101572 - DNA, 191 bp, Homo sapiens
  NW_001838014.1_249000-295694:4069-4260
  hypo
acctggccctaaatccgactgctggagccagagccagagccgtgcggagacacggagccggccgaagccactcagggttggagccgcctcgccacacccaggaccctgggcgctacattgagggtggctgggtgcaggggtgatggcggcggttcctagttggcagccaggagacacgtactcactccagc

SEQ ID NO: 101573 - DNA, 30 bp, Homo sapiens
  NW_001838014.1_249000-295694:441-471
  hypo
ctctgagagcgtccgcgagcagctccgcag

SEQ ID NO: 101574 - DNA, 284 bp, Homo sapiens
  NW_001838014.1_249000-295694:7106-7390
  hypo
cctcgggaagtgctccgagaggtgcacaaacaggcactcgaacaacggcgatgagctcactctccacgacggatcgccagggacgatctaaatatccactcatgctcccgcacgcacgaggttccccagcgctctgggtctcaggccgccggagaggagtatttaatgcgacaccagcgccgctcgtgcgtgctgtgaagagcagccgttaaaagcggttatgcaaatctgtgtttgctgatttgtttaatgtgcacaacatactgctacgtgggccaagcctt

SEQ ID NO: 101575 - DNA, 36 bp, Homo sapiens
  NW_001838016.1_818233-828058:5545-5581
  hypo
ctttcgtgttgtcaccgagaacgtcccctgcggcac

SEQ ID NO: 101576 - DNA, 30 bp, Homo sapiens
  NW_001838016.1_818233-828058:6037-6067
  hypo
gggaagtgggggggacggagccttggcaag

SEQ ID NO: 101577 - DNA, 30 bp, Homo sapiens
  NW_001838016.1_818233-828058:6848-6878
  hypo
gcccagatgccctggcgcccaaggacccct

SEQ ID NO: 101578 - DNA, 32 bp, Homo sapiens
  NW_001838016.1_818233-828058:7308-7340
  hypo
cggtccccaagagcccgcggggtgggtggggg

SEQ ID NO: 101579 - DNA, 166 bp, Homo sapiens
  NW_001838016.1_818233-828058:7554-7720
  hypo
aagaacaggaagcgccggcagcgtgtgccccaccacactcgccgctgatgcgtggggtgtggggcgggtggggaaggtttccaaataaacagaaacacctgggcccagagaggagggcgtggctgacagaggggtccctggcatggtagaacgttctgggcagagg

SEQ ID NO: 101580 - DNA, 81 bp, Homo sapiens
  NW_001838056.1_145425-224902:38739-38820
  hypo
gcgtgggaaaggggccgctggtgtcctgtcaaagggcgaaacacccaggagtcctctcctcaggacctccttgagccgact

SEQ ID NO: 101581 - DNA, 140 bp, Homo sapiens
  NW_001838056.1_145425-224902:42669-42809
  hypo
gactcacccaaacaccgtactggcaggcctgaggctgggatgccacactgctttccccggactgtctgctgtttctgcatcctggtagcccctccgtgtagcatagtgtcccgaatctgttttgtcgaccccctggattg

SEQ ID NO: 101582 - DNA, 30 bp, Homo sapiens
  NW_001838194.1_126783-128006:853-883
  hypo
cttctcctgctcctgcgtcttcttctcctc

SEQ ID NO: 101583 - DNA, 274 bp, Homo sapiens
  NW_001838403.1_1-2251:78-352
  hyper
ccggggccctgggggcgcgttgacccctcgccctgtcccagcgggacccgggaggcgctaacagcttccgagctcgcggtcgggggacccatcccgcagaggcctggggagccgcgcgaagccggcgagcaaacagctggaaattattaccagttaatgcgctccgtgtggccgcagccgcctgttggccccggaaggcgggccctggcgctcctgcccgtcccggaggagaggcctgtcctcgggggctccgcaggcgcgggtcacccctggt

SEQ ID NO: 101584 - DNA, 70 bp, Homo sapiens
  NW_001838877.2_33615069-33616110:636-706
  hypo
cttgccacatttactcgggatattttattgacaaatatgcaggttagtccaggtgcggtggctcacacct

SEQ ID NO: 101585 - DNA, 24 bp, Homo sapiens
  NW_001839407.1_42766-49957:1190-1214
  hypo
tcgccggcccgctggtgcctctgc

SEQ ID NO: 101586 - DNA, 39 bp, Homo sapiens
  NW_001839407.1_56047-63507:7039-7078
  hypo
ttgcctacgccgctacggctctttcggaaggggtggtct

SEQ ID NO: 101587 - DNA, 30 bp, Homo sapiens
  NW_001839407.1_56047-63507:754-784
  hypo
aggggcctggtccttcgattctgaaaccag

SEQ ID NO: 101588 - DNA, 77 bp, Homo sapiens
  NW_001839455.1_124947-137693:9386-9463
  hypo
cagcccgtcctcctccgatgacacgatgctgtaggggttggcccggctggctgcggtcatcccgggggttgggggac

SEQ ID NO: 101589 - DNA, 140 bp, Homo sapiens
  NW_001839455.1_50266-109797:44348-44488
  hypo
tggcgcctcccctgacggggcagccagcctgagccgcatgggccgccctgcagaagcatggtctggggatggtaatgaacgcagcaaatgtttcacttgctctgcttctgggcccccatgctcagcgctcctccctcaca

SEQ ID NO: 101590 - DNA, 30 bp, Homo sapiens
  NW_001839603.1_36678-41438:2681-2711
  hypo
tagatgtctgtgttccgctgccaggcgctc

SEQ ID NO: 101591 - DNA, 39 bp, Homo sapiens
  NW_001839609.1_1-3470:1119-1158
  hypo
aactcttttggacaccgagccaaagcgaggcactgcgag

SEQ ID NO: 101592 - DNA, 75 bp, Homo sapiens
  NW_001839668.1_21493-58548:15519-15594
  hypo
ggtttttgaacccaccgtagcggctttttgtgcccaccgccgcacctttttgtggcttttcgcccccgctgccac

SEQ ID NO: 101593 - DNA, 90 bp, Homo sapiens; identical to SEQ ID NO: 46922
  NW_001839760.1_243903-260476:6752-6842
  hypo

SEQ ID NO: 101594 - DNA, 64 bp, Homo sapiens
  NW_001840246.1_7363-10559:45-109
  hypo
gcgacctgtggaccccggcccctaccccactaagtaatcctctgggacgcgggttgtgcaagca

SEQ ID NO: 101595 - DNA, 32 bp, Homo sapiens
  NW_001840306.1_6328-82586:11021-11053
  hypo
gttcctccatgctgtcgcgtgtgtccgaatct

SEQ ID NO: 101596 - DNA, 178 bp, Homo sapiens
  NW_001840306.1_6328-82586:33514-33692
  hypo
ctcacacttctgccccggccacccccgcaccgcacgcagactgaataaaatatgccagataaccctggcagggacaccggccaccaatgaatttaactttcctacacataatccgccaaggatgctgcgaggctatttagaaggttttgttgttctcgctgcgcgtctctccttgctt

SEQ ID NO: 101597 - DNA, 29 bp, Homo sapiens
  NW_001840646.1_6803-11069:2056-2085
  hypo
ccttccggaggagccgtggaggcataggc

SEQ ID NO: 101598 - DNA, 77 bp, Homo sapiens
  NW_001840700.1_1-4272:2301-2378
  hypo
caaagcaggcatgcagggcctcgcattggcccggggtcctaaccagtctccttcgccgtcaccgtccccaggcttcg

SEQ ID NO: 101599 - DNA, 16 bp, Homo sapiens
  NW_001840754.1_117-3691:2521-2537
  hypo
ccgcagggagggtgcc

SEQ ID NO: 101600 - DNA, 30 bp, Homo sapiens; identical to SEQ ID NO: 46924
  NW_001840841.1_1-4205:1669-1699
  hypo

SEQ ID NO: 101601 - DNA, 187 bp, Homo sapiens
  NW_001840866.1_38854-140524:80412-80599
  hypo
ctgccaggcagcttccgggaaaccaaagtctttgggttccggtgggagtatggttgcaaagctgaaacaaaggaattaacagaagggcaccaccaggagtggagcctgtggcttaatttgactcaacacgggaaacctcacccggacagggacaggattgacagctctttctcgattccgtgagtgg

SEQ ID NO: 101602 - DNA, 30 bp, Homo sapiens
  NW_001840954.1_1-14936:6819-6849
  hypo
catgagagctttgcccggttttctcccaca

SEQ ID NO: 101603 - DNA, 23 bp, Homo sapiens
  NW_001841011.1_96346-168555:36552-36575
  hypo
ggggggaacgagtgacctttcca

SEQ ID NO: 101604 - DNA, 36 bp, Homo sapiens
  NW_001841011.1_96346-168555:37241-37277
  hypo
tgcacatgtgtgaggcgcgagcggcttctcccgtcc

SEQ ID NO: 101605 - DNA, 120 bp, Homo sapiens
  NW_001841051.1_40144-46142:4764-4884
  hypo
cgcctgccttcttgcttgctgcgtctcccgggtcagggctgagattcacgctggagttgcctcagctggtgtgacctctcattctgaaacgaaatctgtacccttggctacggaatgcca

SEQ ID NO: 101606 - DNA, 78 bp, Homo sapiens
  NW_001841110.1_111-11841:9020-9098
  hypo
ggccctgggagccagcgttgagcagaacccgtacctgggcatcgccaccagggaacggctgacacgggccattgtcat

SEQ ID NO: 101607 - DNA, 37 bp, Homo sapiens
  NW_001841138.1_665891-688550:14581-14618
  hypo
gagagagacccaagccgcgaaccgtgggcatgctcag

SEQ ID NO: 101608 - DNA, 18 bp, Homo sapiens
  NW_001841138.1_67124-102688:26293-26311
  hypo
ggccgtgcaacaaacaaa

SEQ ID NO: 101609 - DNA, 137 bp, Homo sapiens
  NW_001841138.1_67124-102688:27763-27900
  hypo
agtagggagtgggtaatttgcatgcctgctgccttccttgaatgtggtagccatttctcaggctccctctccagaatcgaaccctgattccttgtcacccgtggtcaccatggtaggcacagcgactaccatcgaaa

SEQ ID NO: 101610 - DNA, 55 bp, Homo sapiens; identical to SEQ ID NO: 46928
  NW_001841145.1_177495-186900:5222-5277
  hypo

SEQ ID NO: 101611 - DNA, 37 bp, Homo sapiens
  NW_001841145.1_177495-186900:6312-6349
  hypo
ctgaccacccccaccccacactcgcccaccacccaca

SEQ ID NO: 101612 - DNA, 25 bp, Homo sapiens
  NW_001841145.1_68487-74424:228-253
  hypo
ctccacacagcggagaggtgccgtt

SEQ ID NO: 101613 - DNA, 39 bp, Homo sapiens
  NW_001841157.1_1611084-1612812:1051-1090
  hypo
aatcccctgagcacccgcagctcccgggttccctgctgc

SEQ ID NO: 101614 - DNA, 20 bp, Homo sapiens
  NW_001841160.1_117611-172877:34909-34929
  hypo
gtaatcgaatggaataaata

SEQ ID NO: 101615 - DNA, 69 bp, Homo sapiens; identical to SEQ ID NO: 46929
  NW_001842432.1_1-179261:101291-101360
  hypo

SEQ ID NO: 101616 - DNA, 95 bp, Homo sapiens
  NW_001842432.1_1-179261:103119-103214
  hypo
ttggggccgggaggccgcatcctaggcctccctggggcctgcggcgctggcagcagctccatgttgaggtcacctacagccggcaccacggcacg

SEQ ID NO: 101617 - DNA, 157 bp, Homo sapiens
  NW_001842432.1_1-179261:113208-113365
  hypo
ctcctaccactctggcgtgctgtagtgtctgtcaccaccatgaactcacagcaaggtgagcaacggtgtcccaggctccatcctccagcatatggcaggtgtctcctcctctccctggcatggagcacctgggcaggtaaagccagaaaagcctaga

SEQ ID NO: 101618 - DNA, 38 bp, Homo sapiens; identical to SEQ ID NO: 67336
  AC006359.3_31144-32210:157-195
  Hyper

SEQ ID NO: 101619 - DNA, 41 bp, Homo sapiens; identical to SEQ ID NO: 67338
  AC010098.8_29020-31687:525-566
  Hyper

SEQ ID NO: 101620 - DNA, 18 bp, Homo sapiens
  AC010098.8_29020-31687:1483-1501
  Hyper
gcggctttttgcccccgc

SEQ ID NO: 101621 - DNA, 179 bp, Homo sapiens; identical to SEQ ID NO: 67339
  AC018688.9_35552-170204:78812-78991
  Hypo

SEQ ID NO: 101622 - DNA, 94 bp, Homo sapiens; identical to SEQ ID NO: 67340
  AC018688.9_35552-170204:82698-82792
  Hypo

SEQ ID NO: 101623 - DNA, 120 bp, Homo sapiens; identical to SEQ ID NO: 67341
  AC127380.4_153-32188:9589-9709
  Hyper

SEQ ID NO: 101624 - DNA, 30 bp, Homo sapiens; identical to SEQ ID NO: 67342
  AC137488.2_1-70728:40075-40105
  Hypo

SEQ ID NO: 101625 - DNA, 40 bp, Homo sapiens; identical to SEQ ID NO: 67343
  AC145029.2_135730-137748:1618-1658
  Hyper

SEQ ID NO: 101626 - DNA, 198 bp, Homo sapiens; identical to SEQ ID NO: 67344
  AC188622.2_1-37519:11868-12066
  Hypo

SEQ ID NO: 101627 - DNA, 30 bp, Homo sapiens; identical to SEQ ID NO: 67345
  AC207871.4_32367-39588:2999-3029
  Hypo

SEQ ID NO: 101628 - DNA, 45 bp, Homo sapiens; identical to SEQ ID NO: 67346
  AC211344.3_7702-13588:3836-3881
  Hyper

SEQ ID NO: 101629 - DNA, 95 bp, Homo sapiens; identical to SEQ ID NO: 67349
  AC211950.2_11234-25326:25-120
  Hyper

SEQ ID NO: 101630 - DNA, 18 bp, Homo sapiens
  AC211950.2_11234-25326:180-198
  Hyper
aagcggcttttttttaat

SEQ ID NO: 101631 - DNA, 152 bp, Homo sapiens; identical to SEQ ID NO: 67350
  AC211950.2_11234-25326:8748-8900
  Hyper

SEQ ID NO: 101632 - DNA, 598 bp, Homo sapiens; identical to SEQ ID NO: 67347
  AC211950.2_11234-25326:13291-13889
  Hyper

SEQ ID NO: 101633 - DNA, 173 bp, Homo sapiens; identical to SEQ ID NO: 67351
  AC225595.1_16282-19523:1056-1229
  Hypo

SEQ ID NO: 101634 - DNA, 74 bp, Homo sapiens; identical to SEQ ID NO: 67352
  AC231386.2_19255-24791:4032-4106
  Hyper

SEQ ID NO: 101635 - DNA, 30 bp, Homo sapiens; identical to SEQ ID NO: 46903
  AC239873.3_5604-11530:5296-5326
  Hypo

SEQ ID NO: 101636 - DNA, 259 bp, Homo sapiens; identical to SEQ ID NO: 67354
  AC241442.1_28021-33880:323-582
  Hyper

SEQ ID NO: 101637 - DNA, 420 bp, Homo sapiens; identical to SEQ ID NO: 67355
  AC241851.2_88-34049:15133-15553
  Hyper

SEQ ID NO: 101638 - DNA, 30 bp, Homo sapiens; identical to SEQ ID NO: 67356
  AEKP01008621.1_1-2685:1692-1722
  Hypo

SEQ ID NO: 101639 - DNA, 30 bp, Homo sapiens; identical to SEQ ID NO: 67357
  AEKP01044741.1_1-4554:2853-2883
  Hypo

SEQ ID NO: 101640 - DNA, 30 bp, Homo sapiens; identical to SEQ ID NO: 67358
  AEKP01132292.1_2033-9536:6910-6940
  Hypo

SEQ ID NO: 101641 - DNA, 30 bp, Homo sapiens; identical to SEQ ID NO: 16832
  AEKP01139090.1_11256-14570:719-749
  Hypo

SEQ ID NO: 101642 - DNA, 30 bp, Homo sapiens; identical to SEQ ID NO: 67360
  AEKP01146324.1_36063-42453:2576-2606
  Hypo

SEQ ID NO: 101643 - DNA, 21 bp, Homo sapiens
  AEKP01149800.1_88-7643:5248-5269
  Hypo
gtgtgagggtgtgagcgggtg

SEQ ID NO: 101644 - DNA, 30 bp, Homo sapiens; identical to SEQ ID NO: 67362
  AEKP01149800.1_88-7643:5586-5616
  Hypo

SEQ ID NO: 101645 - DNA, 158 bp, Homo sapiens; identical to SEQ ID NO: 67363
  AEKP01153556.1_1-5252:377-535
  Hypo

SEQ ID NO: 101646 - DNA, 42 bp, Homo sapiens; identical to SEQ ID NO: 67364
  AEKP01153556.1_1-5252:995-1037
  Hypo

SEQ ID NO: 101647 - DNA, 30 bp, Homo sapiens; identical to SEQ ID NO: 67365
  AEKP01160869.1_25046-30418:2610-2640
  Hypo

SEQ ID NO: 101648 - DNA, 49 bp, Homo sapiens; identical to SEQ ID NO: 67366
  AEKP01166227.1_44013-111583:24167-24216
  Hypo

SEQ ID NO: 101649 - DNA, 123 bp, Homo sapiens; identical to SEQ ID NO: 38671
  AEKP01168736.1_1-4752:1196-1319
  Hyper

SEQ ID NO: 101650 - DNA, 280 bp, Homo sapiens; identical to SEQ ID NO: 67368
  AEKP01168736.1_1-4752:1533-1813
  Hyper

SEQ ID NO: 101651 - DNA, 940 bp, Homo sapiens; identical to SEQ ID NO: 67369
  AEKP01168736.1_1-4752:1873-2813
  Hyper

SEQ ID NO: 101652 - DNA, 30 bp, Homo sapiens; identical to SEQ ID NO: 67370
  AEKP01171299.1_4392-9704:2569-2599
  Hypo

SEQ ID NO: 101653 - DNA, 273 bp, Homo sapiens; identical to SEQ ID NO: 67371
  AEKP01171767.1_199-12179:10825-11098
  Hyper

SEQ ID NO: 101654 - DNA, 30 bp, Homo sapiens; identical to SEQ ID NO: 67372
  AEKP01184864.1_3582-5885:670-700
  Hypo

SEQ ID NO: 101655 - DNA, 58 bp, Homo sapiens; identical to SEQ ID NO: 46908
  AEKP01188815.1_1-4777:2612-2670
  Hypo

SEQ ID NO: 101656 - DNA, 30 bp, Homo sapiens; identical to SEQ ID NO: 67374
  AEKP01193750.1_12147-15056:206-236
  Hypo

SEQ ID NO: 101657 - DNA, 213 bp, Homo sapiens; identical to SEQ ID NO: 67375
  AEKP01196136.1_22995-25251:442-655
  Hypo

SEQ ID NO: 101658 - DNA, 61 bp, Homo sapiens; identical to SEQ ID NO: 67376
  AEKP01196137.1_1-1039:721-782
  Hypo

SEQ ID NO: 101659 - DNA, 196 bp, Homo sapiens; identical to SEQ ID NO: 67377
  AEKP01197830.1_1-1408:29-225
  Hyper

SEQ ID NO: 101660 - DNA, 78 bp, Homo sapiens; identical to SEQ ID NO: 67378
  AEKP01197830.1_1-1408:476-554
  Hyper

SEQ ID NO: 101661 - DNA, 39 bp, Homo sapiens; identical to SEQ ID NO: 67379
  AEKP01210344.1_1299-2924:730-769
  Hypo

SEQ ID NO: 101662 - DNA, 30 bp, Homo sapiens; identical to SEQ ID NO: 67380
  AEKP01213519.1_104-1403:796-826
  Hypo

SEQ ID NO: 101663 - DNA, 23 bp, Homo sapiens
  AEKP01218892.1_1-1226:1010-1033
  Hypo
gaggctgcaggggcacgggcggg

SEQ ID NO: 101664 - DNA, 26 bp, Homo sapiens
  AEKP01225640.1_1-1497:736-762
  Hypo
gccctgggacccttccggggttgggc

SEQ ID NO: 101665 - DNA, 54 bp, Homo sapiens; identical to SEQ ID NO: 69899
  chr1:713277-713331
  Hypo

SEQ ID NO: 101666 - DNA, 30 bp, Homo sapiens; identical to SEQ ID NO: 69974
  chr1:834881-834911
  Hypo

SEQ ID NO: 101667 - DNA, 315 bp, Homo sapiens; identical to SEQ ID NO: 69975
  chr1:840707-841022
  Hyper

SEQ ID NO: 101668 - DNA, 49 bp, Homo sapiens; identical to SEQ ID NO: 69990
  chr1:860840-860889
  Hyper

SEQ ID NO: 101669 - DNA, 224 bp, Homo sapiens; identical to SEQ ID NO: 69991
  chr1:865391-865615
  Hypo

SEQ ID NO: 101670 - DNA, 30 bp, Homo sapiens; identical to SEQ ID NO: 69999
  chr1:885425-885455
  Hypo

SEQ ID NO: 101671 - DNA, 53 bp, Homo sapiens; identical to SEQ ID NO: 70001
  chr1:895125-895178
  Hyper

SEQ ID NO: 101672 - DNA, 48 bp, Homo sapiens; identical to SEQ ID NO: 38688
  chr1:898728-898776
  Hypo

SEQ ID NO: 101673 - DNA, 30 bp, Homo sapiens; identical to SEQ ID NO: 70007
  chr1:908640-908670
  Hypo

SEQ ID NO: 101674 - DNA, 1282 bp, Homo sapiens; identical to SEQ ID NO: 70035
  chr1:913503-914785
  Hypo

SEQ ID NO: 101675 - DNA, 210 bp, Homo sapiens; identical to SEQ ID NO: 70037
  chr1:918367-918577
  Hypo

SEQ ID NO: 101676 - DNA, 57 bp, Homo sapiens; identical to SEQ ID NO: 70047
  chr1:935070-935127
  Hyper

SEQ ID NO: 101677 - DNA, 105 bp, Homo sapiens; identical to SEQ ID NO: 70049
  chr1:936563-936668
  Hyper

SEQ ID NO: 101678 - DNA, 365 bp, Homo sapiens; identical to SEQ ID NO: 70055
  chr1:942313-942678
  Hypo

SEQ ID NO: 101679 - DNA, 30 bp, Homo sapiens; identical to SEQ ID NO: 38692
  chr1:957607-957637
  Hypo

SEQ ID NO: 101680 - DNA, 90 bp, Homo sapiens; identical to SEQ ID NO: 70075
  chr1:975817-975907
  Hyper

SEQ ID NO: 101681 - DNA, 30 bp, Homo sapiens; identical to SEQ ID NO: 70076
  chr1:979970-980000
  Hypo

SEQ ID NO: 101682 - DNA, 34 bp, Homo sapiens; identical to SEQ ID NO: 70079
  chr1:984367-984401
  Hypo

SEQ ID NO: 101683 - DNA, 70 bp, Homo sapiens; identical to SEQ ID NO: 70080
  chr1:984667-984737
  Hypo

SEQ ID NO: 101684 - DNA, 43 bp, Homo sapiens; identical to SEQ ID NO: 70085
  chr1:985145-985188
  Hypo

SEQ ID NO: 101685 - DNA, 404 bp, Homo sapiens; identical to SEQ ID NO: 70090
  chr1:986504-986908
  Hypo

SEQ ID NO: 101686 - DNA, 42 bp, Homo sapiens
  chr1:1007447-1007489
  Hypo
gcttgctcaaacccacgtccacgcatacgaaaccgggctcgc

SEQ ID NO: 101687 - DNA, 50 bp, Homo sapiens; identical to SEQ ID NO: 67404
  chr1:1025254-1025304
  Hypo

SEQ ID NO: 101688 - DNA, 30 bp, Homo sapiens; identical to SEQ ID NO: 38694
  chr1:1045970-1046000
  Hypo

SEQ ID NO: 101689 - DNA, 297 bp, Homo sapiens; identical to SEQ ID NO: 67410
  chr1:1049888-1050185
  Hypo

SEQ ID NO: 101690 - DNA, 33 bp, Homo sapiens; identical to SEQ ID NO: 67412
  chr1:1053775-1053808
  Hypo

SEQ ID NO: 101691 - DNA, 30 bp, Homo sapiens; identical to SEQ ID NO: 67413
  chr1:1056382-1056412
  Hypo

SEQ ID NO: 101692 - DNA, 30 bp, Homo sapiens; identical to SEQ ID NO: 67414
  chr1:1058888-1058918
  Hypo

SEQ ID NO: 101693 - DNA, 37 bp, Homo sapiens; identical to SEQ ID NO: 67416
  chr1:1066357-1066394
  Hypo

SEQ ID NO: 101694 - DNA, 169 bp, Homo sapiens; identical to SEQ ID NO: 67417
  chr1:1067634-1067803
  Hypo

SEQ ID NO: 101695 - DNA, 35 bp, Homo sapiens; identical to SEQ ID NO: 67418
  chr1:1068726-1068761
  Hypo

SEQ ID NO: 101696 - DNA, 462 bp, Homo sapiens; identical to SEQ ID NO: 67425
  chr1:1080476-1080938
  Hypo

SEQ ID NO: 101697 - DNA, 57 bp, Homo sapiens; identical to SEQ ID NO: 67427
  chr1:1083618-1083675
  Hypo

SEQ ID NO: 101698 - DNA, 42 bp, Homo sapiens; identical to SEQ ID NO: 67443
  chr1:1094962-1095004
  Hypo

SEQ ID NO: 101699 - DNA, 30 bp, Homo sapiens; identical to SEQ ID NO: 67444
  chr1:1095467-1095497
  Hypo

SEQ ID NO: 101700 - DNA, 449 bp, Homo sapiens; identical to SEQ ID NO: 67465
  chr1:1102215-1102664
  Hypo

SEQ ID NO: 101701 - DNA, 378 bp, Homo sapiens; identical to SEQ ID NO: 67525
  chr1:1145504-1145882
  Hypo

SEQ ID NO: 101702 - DNA, 240 bp, Homo sapiens; identical to SEQ ID NO: 67526
  chr1:1146646-1146886
  Hypo

SEQ ID NO: 101703 - DNA, 634 bp, Homo sapiens; identical to SEQ ID NO: 67557
  chr1:1168350-1168984
  Hypo

SEQ ID NO: 101704 - DNA, 30 bp, Homo sapiens; identical to SEQ ID NO: 67560
  chr1:1172140-1172170
  Hypo

SEQ ID NO: 101705 - DNA, 190 bp, Homo sapiens; identical to SEQ ID NO: 67562
  chr1:1173900-1174090
  Hypo

SEQ ID NO: 101706 - DNA, 51 bp, Homo sapiens; identical to SEQ ID NO: 67564
  chr1:1174339-1174390
  Hypo

SEQ ID NO: 101707 - DNA, 30 bp, Homo sapiens; identical to SEQ ID NO: 67569
  chr1:1177998-1178028
  Hypo

SEQ ID NO: 101708 - DNA, 30 bp, Homo sapiens; identical to SEQ ID NO: 67571
  chr1:1178721-1178751
  Hypo

SEQ ID NO: 101709 - DNA, 30 bp, Homo sapiens; identical to SEQ ID NO: 67572
  chr1:1179038-1179068
  Hypo

SEQ ID NO: 101710 - DNA, 186 bp, Homo sapiens; identical to SEQ ID NO: 67583
  chr1:1190209-1190395
  Hypo

SEQ ID NO: 101711 - DNA, 23 bp, Homo sapiens
  chr1:1218784-1218807
  Hypo
atggggcttctgggccgggcacg

SEQ ID NO: 101712 - DNA, 30 bp, Homo sapiens; identical to SEQ ID NO: 67632
  chr1:1222237-1222267
  Hypo

SEQ ID NO: 101713 - DNA, 44 bp, Homo sapiens; identical to SEQ ID NO: 67635
  chr1:1223161-1223205
  Hypo

SEQ ID NO: 101714 - DNA, 83 bp, Homo sapiens; identical to SEQ ID NO: 67636
  chr1:1223512-1223595
  Hypo

SEQ ID NO: 101715 - DNA, 30 bp, Homo sapiens; identical to SEQ ID NO: 67638
  chr1:1226147-1226177
  Hypo

SEQ ID NO: 101716 - DNA, 64 bp, Homo sapiens; identical to SEQ ID NO: 67640
  chr1:1234696-1234760
  Hypo

SEQ ID NO: 101717 - DNA, 103 bp, Homo sapiens; identical to SEQ ID NO: 38707
  chr1:1235178-1235281
  Hypo

SEQ ID NO: 101718 - DNA, 177 bp, Homo sapiens; identical to SEQ ID NO: 38708
  chr1:1235901-1236078
  Hypo

SEQ ID NO: 101719 - DNA, 252 bp, Homo sapiens; identical to SEQ ID NO: 67643
  chr1:1238230-1238482
  Hypo

SEQ ID NO: 101720 - DNA, 188 bp, Homo sapiens; identical to SEQ ID NO: 67644
  chr1:1239479-1239667
  Hypo

SEQ ID NO: 101721 - DNA, 345 bp, Homo sapiens; identical to SEQ ID NO: 67645
  chr1:1245007-1245352
  Hypo

SEQ ID NO: 101722 - DNA, 30 bp, Homo sapiens; identical to SEQ ID NO: 67646
  chr1:1247668-1247698
  Hypo

SEQ ID NO: 101723 - DNA, 35 bp, Homo sapiens; identical to SEQ ID NO: 67647
  chr1:1253245-1253280
  Hypo

SEQ ID NO: 101724 - DNA, 35 bp, Homo sapiens; identical to SEQ ID NO: 67648
  chr1:1253520-1253555
  Hypo

SEQ ID NO: 101725 - DNA, 100 bp, Homo sapiens; identical to SEQ ID NO: 67650
  chr1:1257399-1257499
  Hypo

SEQ ID NO: 101726 - DNA, 30 bp, Homo sapiens; identical to SEQ ID NO: 67651
  chr1:1264857-1264887
  Hypo

SEQ ID NO: 101727 - DNA, 30 bp, Homo sapiens; identical to SEQ ID NO: 67653
  chr1:1266025-1266055
  Hypo

SEQ ID NO: 101728 - DNA, 1138 bp, Homo sapiens; identical to SEQ ID NO: 67654
  chr1:1267047-1268185
  Hypo

SEQ ID NO: 101729 - DNA, 30 bp, Homo sapiens; identical to SEQ ID NO: 67655
  chr1:1273471-1273501
  Hypo

SEQ ID NO: 101730 - DNA, 30 bp, Homo sapiens; identical to SEQ ID NO: 67657
  chr1:1280896-1280926
  Hypo

SEQ ID NO: 101731 - DNA, 82 bp, Homo sapiens; identical to SEQ ID NO: 67658
  chr1:1308761-1308843
  Hypo

SEQ ID NO: 101732 - DNA, 253 bp, Homo sapiens; identical to SEQ ID NO: 67659
  chr1:1309067-1309320
  Hypo

SEQ ID NO: 101733 - DNA, 93 bp, Homo sapiens; identical to SEQ ID NO: 67660
  chr1:1341737-1341830
  Hypo

SEQ ID NO: 101734 - DNA, 30 bp, Homo sapiens; identical to SEQ ID NO: 67661
  chr1:1344048-1344078
  Hypo

SEQ ID NO: 101735 - DNA, 215 bp, Homo sapiens; identical to SEQ ID NO: 67662
  chr1:1355522-1355737
  Hyper

SEQ ID NO: 101736 - DNA, 30 bp, Homo sapiens; identical to SEQ ID NO: 67663
  chr1:1356905-1356935
  Hypo

SEQ ID NO: 101737 - DNA, 46 bp, Homo sapiens; identical to SEQ ID NO: 38715
  chr1:1363856-1363902
  Hypo

SEQ ID NO: 101738 - DNA, 132 bp, Homo sapiens; identical to SEQ ID NO: 67665
  chr1:1371107-1371239
  Hyper

SEQ ID NO: 101739 - DNA, 112 bp, Homo sapiens; identical to SEQ ID NO: 67680
  chr1:1471673-1471785
  Hypo

SEQ ID NO: 101740 - DNA, 1096 bp, Homo sapiens
  chr1:1475243-1476339
  Hyper
ccggggtcggggcagcgcaagcggggagcgagagcgcaggccggggtgaggggagcgtaggccttggtagggggagcgcagcgggtatggggatcgcaggctggggaggggagcgcaggccggggtggggggagcgcaggcccgggaggggaccgcgggccggggagggggaagcgcaggccggggtggggggagcgtaggccggagagaggagcgtagggagtgtggggatcgcaggttggggaggggagcggaggccggggtgggggagcgcaggccggggaggggagcgcaggccggggaggggagcgcaggccggggaggggagcgcaggccgcacgggcggtaaacaaggcgcgggaggtgggccaggcggcgcgcgcgggcggggagcagggggcgcgcgcgggaagcccctccgctcaccatcacgaccgacgcccccagaatcatgaagatcatggtgttcgcgctcatggacatcgggcggggccgggccgggccggagcgccgccccccggccccggcgcccccccggccccggcccgatgctgagcccccgccgcctccgcagaggtcagcgcttccctggatcgtccgccgccgctcgctgcaaccccggcaccggccggggggaggaggcgcgggggggggggcgccggggagggacgcggggcctttctggggtctctcggcccggcccgccgcgctccgctccgccctcgggtcctccctgcgatgcgctcggctcggctcgactcggctccgctcggctccggccccctccctgcctcctcctccctcctcccccctccctccccgccgccttcctccgcctctcgggagggaccgcgcagaccgcaggccgccccgtgccagcgccgggaggagaccgccatcccccggacgccggccgggacccctccccgggagcctcggcttcgcgtcccgccccagtctggtcagacccagccccggtggcctgtccggtgaccctggacgccagtcctccggtcctggaggggcgccgaggcccttcccgccccactgctccgccctacgtcctggactcccaggtcgccgggtgcgggactgc

SEQ ID NO: 101741 - DNA, 30 bp, Homo sapiens; identical to SEQ ID NO: 38716
  chr1:1483034-1483064
  Hypo

SEQ ID NO: 101742 - DNA, 40 bp, Homo sapiens; identical to SEQ ID NO: 67690
  chr1:1502515-1502555
  Hypo

SEQ ID NO: 101743 - DNA, 375 bp, Homo sapiens; identical to SEQ ID NO: 67736
  chr1:1535001-1535376
  Hyper

SEQ ID NO: 101744 - DNA, 193 bp, Homo sapiens; identical to SEQ ID NO: 67739
  chr1:1535748-1535941
  Hyper

SEQ ID NO: 101745 - DNA, 30 bp, Homo sapiens; identical to SEQ ID NO: 67787
  chr1:1552463-1552493
  Hypo

SEQ ID NO: 101746 - DNA, 179 bp, Homo sapiens; identical to SEQ ID NO: 67820
  chr1:1563080-1563259
  Hypo

SEQ ID NO: 101747 - DNA, 103 bp, Homo sapiens; identical to SEQ ID NO: 38718
  chr1:1563663-1563766
  Hypo

SEQ ID NO: 101748 - DNA, 307 bp, Homo sapiens
  chr1:1566672-1566979
  Hyper
tcgcgcctggacgccggccgccccgtcgaacctttgggtctccgagctccccgcccccgcccccaatcaggaccggtccagacctccaggcccggcgcttagctccgtttcccgtccctcccgtctccctctcccctttgctggggcctagccggggatttaggagccacacaccctccacctcacgcgctaccctccacggggcttcccgcagccagggcccgccccttcccggctccccgggagaccctggcaagttccctccctccgccccgcaacctggcaccctccgcggcccttgcctacc

SEQ ID NO: 101749 - DNA, 684 bp, Homo sapiens
  chr1:1567229-1567913
  Hyper
ctaccctttcctaagcgggagccctggcgctgcccttcccgggctgcctggggccctcttcgctcccccctccgaggaccccgcccagcaggccatgcccaggcctctgcccctggcccacgggacgcgggtccccatgcccccggctggagacagcaggcagctcggccaacggacgggccagctggttcccttcaggggcagccttgccccctctcccgccccgtctccctcccccccaccacaccgggctgtaacccgagccgccgagccactgcctcccctccggatcctccccggaggctctgcggcccgggcccccgcgccttgctgccccatgcagccctgagccccacagcaagtctgccatgggccgcggggcccgtgtcccctcggaggccccgggggcaggcgtcgagcgccgctggcttggagccgcgctggtcgccctgtgcctcctccccgcgctggtgctgctggcccggctgggggccccggcggtgccggcctggagcgcagcgcaggtgagcggcgggggggaggccaggtgccgggttgggggggtcctcacgtctgtgggtctggtctatcggggggcccgcaggacgtgtgcggggtgtgcggggtgtttgagggtccggatgtgcgtcccgaggtcggagggttggacgcccctgtgtccag

SEQ ID NO: 101750 - DNA, 161 bp, Homo sapiens; identical to SEQ ID NO: 68008
  chr1:1625727-1625888
  Hypo

SEQ ID NO: 101751 - DNA, 25 bp, Homo sapiens
  chr1:1671766-1671791
  Hypo
tctttttttttgagacgggagtctc

SEQ ID NO: 101752 - DNA, 40 bp, Homo sapiens; identical to SEQ ID NO: 68127
  chr1:1767616-1767656
  Hypo

SEQ ID NO: 101753 - DNA, 160 bp, Homo sapiens; identical to SEQ ID NO: 68232
  chr1:1856211-1856371
  Hypo

SEQ ID NO: 101754 - DNA, 30 bp, Homo sapiens; identical to SEQ ID NO: 68233
  chr1:1857232-1857262
  Hypo

SEQ ID NO: 101755 - DNA, 30 bp, Homo sapiens; identical to SEQ ID NO: 68234
  chr1:1857706-1857736
  Hypo

SEQ ID NO: 101756 - DNA, 67 bp, Homo sapiens; identical to SEQ ID NO: 68235
  chr1:1861815-1861882
  Hypo

SEQ ID NO: 101757 - DNA, 61 bp, Homo sapiens; identical to SEQ ID NO: 68241
  chr1:1874726-1874787
  Hypo

SEQ ID NO: 101758 - DNA, 30 bp, Homo sapiens; identical to SEQ ID NO: 68245
  chr1:1888198-1888228
  Hypo

SEQ ID NO: 101759 - DNA, 30 bp, Homo sapiens; identical to SEQ ID NO: 68279
  chr1:1905791-1905821
  Hypo

SEQ ID NO: 101760 - DNA, 44 bp, Homo sapiens; identical to SEQ ID NO: 68281
  chr1:1910323-1910367
  Hypo

SEQ ID NO: 101761 - DNA, 30 bp, Homo sapiens; identical to SEQ ID NO: 68284
  chr1:1914161-1914191
  Hypo

SEQ ID NO: 101762 - DNA, 558 bp, Homo sapiens; identical to SEQ ID NO: 68285
  chr1:1914559-1915117
  Hypo

SEQ ID NO: 101763 - DNA, 505 bp, Homo sapiens
  chr1:1935065-1935570
  Hyper
gttctgcctggggggcgggggtcaaacccttccagctcagccccagggtcaaacgcatccgcccccacacccacctctggctggcctgggtcccaggttctcgggctccggaggcacagacaccccgggctgctcaggcaggcggcggtccttggcgattgccctccgcggcgccggcggcgtggtttggggcgggcagctccatggcaacggaagactccatcgtggccggagggggagcctcgcccgttctgctccccggctggagcgggtggtttggtccgacccaccaccgaccgcgcgggccggggccggggcaaggaggtcgcgggccccgaggcgcggctgaagggccaggccacaggccgcggggcggggacgtctccggggtcccagacagccaggcctggcccagggccaaggcttggaggtgacagacagacttggggggcctggaggagctcagcaccggcgcgttggcccagaggaccggggcgggtgcatg

SEQ ID NO: 101764 - DNA, 981 bp, Homo sapiens; identical to SEQ ID NO: 68299
  chr1:1950396-1951377
  Hyper

SEQ ID NO: 101765 - DNA, 30 bp, Homo sapiens; identical to SEQ ID NO: 68300
  chr1:1953110-1953140
  Hypo

SEQ ID NO: 101766 - DNA, 30 bp, Homo sapiens; identical to SEQ ID NO: 68302
  chr1:1960572-1960602
  Hypo

SEQ ID NO: 101767 - DNA, 74 bp, Homo sapiens; identical to SEQ ID NO: 68303
  chr1:1961524-1961598
  Hypo

SEQ ID NO: 101768 - DNA, 74 bp, Homo sapiens; identical to SEQ ID NO: 68310
  chr1:1974645-1974719
  Hypo

SEQ ID NO: 101769 - DNA, 116 bp, Homo sapiens; identical to SEQ ID NO: 68331
  chr1:1982311-1982427
  Hyper

SEQ ID NO: 101770 - DNA, 157 bp, Homo sapiens; identical to SEQ ID NO: 68332
  chr1:1986234-1986391
  Hypo

SEQ ID NO: 101771 - DNA, 177 bp, Homo sapiens; identical to SEQ ID NO: 38728
  chr1:2013405-2013582
  Hypo

SEQ ID NO: 101772 - DNA, 30 bp, Homo sapiens; identical to SEQ ID NO: 68360
  chr1:2013995-2014025
  Hypo

SEQ ID NO: 101773 - DNA, 327 bp, Homo sapiens; identical to SEQ ID NO: 38729
  chr1:2066352-2066679
  Hypo

SEQ ID NO: 101774 - DNA, 349 bp, Homo sapiens; identical to SEQ ID NO: 68523
  chr1:2125166-2125515
  Hypo

SEQ ID NO: 101775 - DNA, 30 bp, Homo sapiens; identical to SEQ ID NO: 68527
  chr1:2129896-2129926
  Hypo

SEQ ID NO: 101776 - DNA, 44 bp, Homo sapiens; identical to SEQ ID NO: 25996
  chr1:2136044-2136088
  Hyper

SEQ ID NO: 101777 - DNA, 183 bp, Homo sapiens; identical to SEQ ID NO: 68533
  chr1:2136856-2137039
  Hyper

SEQ ID NO: 101778 - DNA, 88 bp, Homo sapiens; identical to SEQ ID NO: 38731
  chr1:2141596-2141684
  Hypo

SEQ ID NO: 101779 - DNA, 49 bp, Homo sapiens; identical to SEQ ID NO: 68571
  chr1:2170934-2170983
  Hypo

SEQ ID NO: 101780 - DNA, 35 bp, Homo sapiens; identical to SEQ ID NO: 68663
  chr1:2253171-2253206
  Hypo

SEQ ID NO: 101781 - DNA, 370 bp, Homo sapiens; identical to SEQ ID NO: 68673
  chr1:2263053-2263423
  Hypo

SEQ ID NO: 101782 - DNA, 81 bp, Homo sapiens; identical to SEQ ID NO: 68677
  chr1:2266113-2266194
  Hypo

SEQ ID NO: 101783 - DNA, 597 bp, Homo sapiens; identical to SEQ ID NO: 68680
  chr1:2267155-2267752
  Hypo

SEQ ID NO: 101784 - DNA, 30 bp, Homo sapiens; identical to SEQ ID NO: 38735
  chr1:2268713-2268743
  Hypo

SEQ ID NO: 101785 - DNA, 52 bp, Homo sapiens; identical to SEQ ID NO: 68698
  chr1:2271392-2271444
  Hypo

SEQ ID NO: 101786 - DNA, 42 bp, Homo sapiens; identical to SEQ ID NO: 68701
  chr1:2273867-2273909
  Hypo

SEQ ID NO: 101787 - DNA, 54 bp, Homo sapiens; identical to SEQ ID NO: 68702
  chr1:2274776-2274830
  Hypo

SEQ ID NO: 101788 - DNA, 196 bp, Homo sapiens; identical to SEQ ID NO: 68704
  chr1:2275639-2275835
  Hypo

SEQ ID NO: 101789 - DNA, 111 bp, Homo sapiens; identical to SEQ ID NO: 38737
  chr1:2276089-2276200
  Hypo

SEQ ID NO: 101790 - DNA, 154 bp, Homo sapiens; identical to SEQ ID NO: 68808
  chr1:2304327-2304481
  Hypo

SEQ ID NO: 101791 - DNA, 268 bp, Homo sapiens; identical to SEQ ID NO: 68813
  chr1:2307626-2307894
  Hypo

SEQ ID NO: 101792 - DNA, 553 bp, Homo sapiens; identical to SEQ ID NO: 38740
  chr1:2308105-2308658
  Hypo

SEQ ID NO: 101793 - DNA, 48 bp, Homo sapiens; identical to SEQ ID NO: 68816
  chr1:2309850-2309898
  Hypo

SEQ ID NO: 101794 - DNA, 96 bp, Homo sapiens; identical to SEQ ID NO: 68818
  chr1:2310148-2310244
  Hypo

SEQ ID NO: 101795 - DNA, 413 bp, Homo sapiens; identical to SEQ ID NO: 68834
  chr1:2316053-2316466
  Hypo

SEQ ID NO: 101796 - DNA, 30 bp, Homo sapiens; identical to SEQ ID NO: 68840
  chr1:2330625-2330655
  Hypo

SEQ ID NO: 101797 - DNA, 33 bp, Homo sapiens; identical to SEQ ID NO: 38743
  chr1:2331363-2331396
  Hypo

SEQ ID NO: 101798 - DNA, 30 bp, Homo sapiens; identical to SEQ ID NO: 38744
  chr1:2336335-2336365
  Hypo

SEQ ID NO: 101799 - DNA, 174 bp, Homo sapiens; identical to SEQ ID NO: 38745
  chr1:2338063-2338237
  Hypo

SEQ ID NO: 101800 - DNA, 79 bp, Homo sapiens; identical to SEQ ID NO: 68868
  chr1:2351881-2351960
  Hypo

SEQ ID NO: 101801 - DNA, 30 bp, Homo sapiens; identical to SEQ ID NO: 68881
  chr1:2358761-2358791
  Hypo

SEQ ID NO: 101802 - DNA, 348 bp, Homo sapiens; identical to SEQ ID NO: 14181
  chr1:2359972-2360320
  Hypo

SEQ ID NO: 101803 - DNA, 807 bp, Homo sapiens
  chr1:2374834-2375641
  Hyper
ttggcttcttccagcgcctgggcaaacgcccagcctggagatgggaagcgctctcggccccgcccccttcccggtcccgccggctggggccacggggagccggagggaggcggagggggaggtgtggggagcggaaggccgcaggagcatctttgcggagaaagtactttggctgcggcgggcgcagggcgggccggctagccccgcgccccacctgttctgtgcgtcgcgctcgcccggttgcgcccgatctgcctccagcccggtgcccgccgcggagcccgcgcccccggccccctcccggcgcggggcgggcagggggtgtggtgcgggcggcacgagtgacagcgcgctcctcgcgcggcgcctccacggggcgcagtgtcaccgcgcacagcccgccgcgggccgcccgagctggcggggcgatgccgcgggagccggagccccagcccgagcccgagcccggccgctgactgcgcctcccggcccgcagcccccgcccccgccgccctcgctgccctcgctgcagccgccacggagacaatggacgcgggagccgccccgcagaagcacagtaggtgccgctcctgccgctgcgccgctgccaaccgggatgcgcgggtggacgcgcgggggcgccgcagccctggtgcgggtcggggctgagccgcctgggcttcagactcgggagcggaggctcggatcgcggtggcacgggcaggggtgcgggcgcgggactgtgggcgggacgggcggagcggtcttgagctctccggatggcctcaggtgcggggtgagggatct

SEQ ID NO: 101804 - DNA, 146 bp, Homo sapiens; identical to SEQ ID NO: 68928
  chr1:2382686-2382832
  Hypo

SEQ ID NO: 101805 - DNA, 195 bp, Homo sapiens; identical to SEQ ID NO: 38748
  chr1:2396998-2397193
  Hypo

SEQ ID NO: 101806 - DNA, 383 bp, Homo sapiens; identical to SEQ ID NO: 68982
  chr1:2428099-2428482
  Hypo

SEQ ID NO: 101807 - DNA, 90 bp, Homo sapiens; identical to SEQ ID NO: 68986
  chr1:2430433-2430523
  Hypo

SEQ ID NO: 101808 - DNA, 30 bp, Homo sapiens; identical to SEQ ID NO: 68994
  chr1:2434250-2434280
  Hypo

SEQ ID NO: 101809 - DNA, 66 bp, Homo sapiens; identical to SEQ ID NO: 68995
  chr1:2435884-2435950
  Hypo

SEQ ID NO: 101810 - DNA, 33 bp, Homo sapiens; identical to SEQ ID NO: 68997
  chr1:2437266-2437299
  Hypo

SEQ ID NO: 101811 - DNA, 92 bp, Homo sapiens; identical to SEQ ID NO: 69050
  chr1:2460806-2460898
  Hyper

SEQ ID NO: 101812 - DNA, 677 bp, Homo sapiens
  chr1:2461311-2461988
  Hyper
ccatctccaggatgtcggccttctccagcttggagttgggctggtgccgcgcgaactcctgctccagcagcagcttcagctgctcgatgctgctgttgatgcggtcgcggcgcatcttctccaccaccggcttccgcagctgcgggaggagggggtgtcaggctggcccggcacggcgcagggacccccgaggaccggaggccgcggggacagcgcgccgggcgagtctggtacttactcggtttttctctttggggctgagcagctccacggccacagtgctgggggccatgcctggcgcggaacaggcgacgaggcgacgcggggaggccgggcgagacgaggcgagcgggcgcgggcaaggccaagcgcgtcccgggctggcgcggacaccggccccgcgcgccgacgccctatataggcgcgggcggcggcctggcgcctggagtccgggcgccgcggccgttcccacactccgcggccaatggccgggcgggccgcacaaaggcgccggcccattagcgcacgctaaattgcctgtgaattggcgcgggcacaatgggcgctccccaaggagcaggtgggccgcgcggcacaatgtccgggctgtgggaacgcgctcgccctcattagcatcccggggcctgatgccgggagccccgcgcctcaatatgctg

SEQ ID NO: 101813 - DNA, 31 bp, Homo sapiens; identical to SEQ ID NO: 69063
  chr1:2468551-2468582
  Hypo

SEQ ID NO: 101814 - DNA, 150 bp, Homo sapiens; identical to SEQ ID NO: 69064
  chr1:2468642-2468792
  Hypo

SEQ ID NO: 101815 - DNA, 403 bp, Homo sapiens; identical to SEQ ID NO: 69074
  chr1:2472147-2472550
  Hyper

SEQ ID NO: 101816 - DNA, 33 bp, Homo sapiens; identical to SEQ ID NO: 69118
  chr1:2483840-2483873
  Hypo

SEQ ID NO: 101817 - DNA, 40 bp, Homo sapiens; identical to SEQ ID NO: 69125
  chr1:2500708-2500748
  Hypo

SEQ ID NO: 101818 - DNA, 30 bp, Homo sapiens; identical to SEQ ID NO: 14185
  chr1:2507045-2507075
  Hypo

SEQ ID NO: 101819 - DNA, 304 bp, Homo sapiens; identical to SEQ ID NO: 69127
  chr1:2519610-2519914
  Hypo

SEQ ID NO: 101820 - DNA, 30 bp, Homo sapiens; identical to SEQ ID NO: 69128
  chr1:2520957-2520987
  Hypo

SEQ ID NO: 101821 - DNA, 231 bp, Homo sapiens; identical to SEQ ID NO: 69135
  chr1:2527304-2527535
  Hypo

SEQ ID NO: 101822 - DNA, 30 bp, Homo sapiens; identical to SEQ ID NO: 69136
  chr1:2527977-2528007
  Hypo

SEQ ID NO: 101823 - DNA, 66 bp, Homo sapiens; identical to SEQ ID NO: 14186
  chr1:2537084-2537150
  Hypo

SEQ ID NO: 101824 - DNA, 141 bp, Homo sapiens; identical to SEQ ID NO: 69139
  chr1:2537758-2537899
  Hypo

SEQ ID NO: 101825 - DNA, 164 bp, Homo sapiens; identical to SEQ ID NO: 69140
  chr1:2538565-2538729
  Hypo

SEQ ID NO: 101826 - DNA, 64 bp, Homo sapiens; identical to SEQ ID NO: 69141
  chr1:2541226-2541290
  Hypo

SEQ ID NO: 101827 - DNA, 612 bp, Homo sapiens; identical to SEQ ID NO: 69146
  chr1:2560341-2560953
  Hyper

SEQ ID NO: 101828 - DNA, 156 bp, Homo sapiens; identical to SEQ ID NO: 69147
  chr1:2571507-2571663
  Hypo

SEQ ID NO: 101829 - DNA, 101 bp, Homo sapiens; identical to SEQ ID NO: 69170
  chr1:2702371-2702472
  Hypo

SEQ ID NO: 101830 - DNA, 30 bp, Homo sapiens; identical to SEQ ID NO: 69171
  chr1:2702696-2702726
  Hypo

SEQ ID NO: 101831 - DNA, 375 bp, Homo sapiens
  chr1:2706094-2706469
  Hyper
tctgcggcctccctccggccctgcgctctggacggcccggcgcgtggagatcgctgcagcatcccacgggcctcctcccgcagcaccaccagcagcagcccccgctggttccagggcacgtaggccttggcggccagcagcgcctcctcgggccgcagcctgcaggcggtgacatagtccagcgtgcccaggaacgcgctgcccgccagcacccgcagcagtccccggccgcacagcgcgcgcacacagccccccgggtgcggcgccccctgctccactaccgtctggaagtcctccatggcgcgccgcgagtccccggcgtgcagcgcgcagaagccgcgcagagccaggagaggtgcgcggtcccctgcacgg

SEQ ID NO: 101832 - DNA, 159 bp, Homo sapiens; identical to SEQ ID NO: 69173
  chr1:2708372-2708531
  Hypo

SEQ ID NO: 101833 - DNA, 503 bp, Homo sapiens; identical to SEQ ID NO: 38760
  chr1:2716736-2717239
  Hypo

SEQ ID NO: 101834 - DNA, 39 bp, Homo sapiens; identical to SEQ ID NO: 69178
  chr1:2719879-2719918
  Hypo

SEQ ID NO: 101835 - DNA, 75 bp, Homo sapiens; identical to SEQ ID NO: 69179
  chr1:2725182-2725257
  Hypo

SEQ ID NO: 101836 - DNA, 462 bp, Homo sapiens; identical to SEQ ID NO: 69180
  chr1:2725529-2725991
  Hypo

SEQ ID NO: 101837 - DNA, 119 bp, Homo sapiens; identical to SEQ ID NO: 69181
  chr1:2726839-2726958
  Hypo

SEQ ID NO: 101838 - DNA, 35 bp, Homo sapiens; identical to SEQ ID NO: 69183
  chr1:2733564-2733599
  Hypo

SEQ ID NO: 101839 - DNA, 95 bp, Homo sapiens; identical to SEQ ID NO: 69184
  chr1:2733659-2733754
  Hypo

SEQ ID NO: 101840 - DNA, 30 bp, Homo sapiens; identical to SEQ ID NO: 38765
  chr1:2770901-2770931
  Hypo

SEQ ID NO: 101841 - DNA, 30 bp, Homo sapiens; identical to SEQ ID NO: 69195
  chr1:2775401-2775431
  Hypo

SEQ ID NO: 101842 - DNA, 30 bp, Homo sapiens
  chr1:2777228-2777258
  Hypo
aagggctcttgccatcggcaaccatttgtt

SEQ ID NO: 101843 - DNA, 89 bp, Homo sapiens; identical to SEQ ID NO: 69203
  chr1:2823329-2823418
  Hypo

SEQ ID NO: 101844 - DNA, 52 bp, Homo sapiens; identical to SEQ ID NO: 69204
  chr1:2826173-2826225
  Hypo

SEQ ID NO: 101845 - DNA, 468 bp, Homo sapiens
  chr1:2827790-2828258
  Hypo
gtctgggcgccaggacgctggaggcgtgggatgatggcgattcgtctcccatcttcaaggccaacacagataggcggtccactgtcccagtgggacctgacgtggcccagagtggacggtggcccctacccaggcgcgcgcgtggccccagatcccgcgctgagtccctgcaccgcggccgccgcggcgctgctgtccccgagaggcagccctgtctctgctggcccgttaactgtgctggcagagctgttaccgtgacagtagattaatatctctttagtcagccaaaatgaacatggcatgctggtgacagtccaattttctgctaacagattgtggcctatcgaaacccggcgctcagctgatttttatttctgccagagataattcagcgcgggaggagcggccgccaccatcccatccaccagcgccgttcaatatatcccgcgccggcgtttctcacccact

SEQ ID NO: 101846 - DNA, 48 bp, Homo sapiens; identical to SEQ ID NO: 69207
  chr1:2830003-2830051
  Hypo

SEQ ID NO: 101847 - DNA, 71 bp, Homo sapiens; identical to SEQ ID NO: 69208
  chr1:2831835-2831906
  Hypo

SEQ ID NO: 101848 - DNA, 161 bp, Homo sapiens; identical to SEQ ID NO: 38769
  chr1:2833818-2833979
  Hypo

SEQ ID NO: 101849 - DNA, 30 bp, Homo sapiens; identical to SEQ ID NO: 38770
  chr1:2836432-2836462
  Hypo

SEQ ID NO: 101850 - DNA, 227 bp, Homo sapiens; identical to SEQ ID NO: 69211
  chr1:2840699-2840926
  Hypo

SEQ ID NO: 101851 - DNA, 30 bp, Homo sapiens; identical to SEQ ID NO: 38772
  chr1:2846793-2846823
  Hypo

SEQ ID NO: 101852 - DNA, 30 bp, Homo sapiens; identical to SEQ ID NO: 69213
  chr1:2850995-2851025
  Hypo

SEQ ID NO: 101853 - DNA, 129 bp, Homo sapiens; identical to SEQ ID NO: 69214
  chr1:2859680-2859809
  Hypo

SEQ ID NO: 101854 - DNA, 153 bp, Homo sapiens; identical to SEQ ID NO: 69215
  chr1:2866038-2866191
  Hypo

SEQ ID NO: 101855 - DNA, 171 bp, Homo sapiens; identical to SEQ ID NO: 69218
  chr1:2888921-2889092
  Hypo

SEQ ID NO: 101856 - DNA, 41 bp, Homo sapiens; identical to SEQ ID NO: 69221
  chr1:2896547-2896588
  Hypo

SEQ ID NO: 101857 - DNA, 448 bp, Homo sapiens; identical to SEQ ID NO: 69226
  chr1:2918274-2918722
  Hypo

SEQ ID NO: 101858 - DNA, 129 bp, Homo sapiens; identical to SEQ ID NO: 69227
  chr1:2919035-2919164
  Hypo

SEQ ID NO: 101859 - DNA, 30 bp, Homo sapiens; identical to SEQ ID NO: 38775
  chr1:2939161-2939191
  Hypo

SEQ ID NO: 101860 - DNA, 829 bp, Homo sapiens
  chr1:2984623-2985452
  Hyper
gaggaagcgtctggtcggctcccgtccgagctgctccacctgcgccgctggcctttccgcccgctacgcacctgggccccgagaggccagaggggagtgtccccagtggcccgggtccccgaaggtggcccagctcgggcgctcgcgcagccgggtactcaccttgggggcgcggcggcaggagagcgcgggcggagaggtgcgggcgccctgggacgaccagccgaggacgcctggtgtttggacggctgcccccgcgctgtccccccgtgcgaggcgtgttggcctccgtggcctcgcgagggaccgagggcggcgggtccgagtgccgcccgccggcctgggcagtggcggagcgcggagctggcggcgcctccgctgttgtttttgagccgcgaagcccgaagcagcagccgttgggtgggggcgaaggggaggaggcgggggccgggaggcgcgaggggggcggtggggcccggagggggcttcggaggagccgggttctggcgcgcgagccccgacgccccctccagcgatcgcagggcggggacgggggccgaggggagaatgcaggagaaaagcgggccggggcgacggggaacgcaaagcttttaaattagtaatcaaacgcagtaaaacggagcaaaaccagcccggactcgcgtccgaactatcggcgcgtgtgccccgagatccaaggaagtcgtgtggaaaaccgcagccgccgccccatcttcggccccggctggggcgggagcagcagcgcgacgcgccgcgacgcaggggcagggtggggggatagtcacctcgcctccggggccacctgggt

SEQ ID NO: 101861 - DNA, 43 bp, Homo sapiens; identical to SEQ ID NO: 69243
  chr1:2986039-2986082
  Hyper

SEQ ID NO: 101862 - DNA, 1236 bp, Homo sapiens
  chr1:2986346-2987582
  Hyper
gagcaccgcctttggcgtccgccagccgggcgcagaggagggagaccccgagccggggaggggcggaggagggggcgcgggccggcgcccacccggctccgcgggcgcaggggcaggggtggcgacggcgggacagccgcagccacttggggagcaaaatggagacttttgcccgggctgggaactgtggtcgtgaagtttatccccggctgtgccccgcgtggtggagggcgctcctctgggacgccggcagcctgcgcgggccgccggggcgacagtgcctccgacaggagggacccacccggccacctcccgacccgccgctgccgccctcgggcccgcgtggacccctctgtacccgcttgcctggcacagccgggcccggcggggacagagctgccccggccaggctgcccggtcctcggtcttactttctctttcgctccgtctcggccgagccccgggctccgcgcgccccgcctgccgccagccggtccttgccgcgggccgggtgctccagccacccgcgccctcgcccgccacagcgcctccgagcagcccgcgcgcaccccgcagccccggtcgccggcgccatccgcggtgaggcgggcgggcaggtgaggacaggcggagccgcggcccggccagcgcggctcccgcagccccgccgaagccccggctgcagcgaagcggccagcgccgcgcggagcggaatcggcgccgcctgctcccgccgccccctcctctgcaggccgcccgcccgcccacccgcagaagaggcgcccgggccgctcccctcgaggtccccgcccgacccacgccgttccgtccgcgcctccggggccgggtccctccaggccggcctcgcagctcccggggccgagcccccaaacgtgagccgggtgcgcgcgggactcgcggcggttttccgaagctccgctccctcggctcggggcccgcccggctcgtcccaacagctgccccgcggccgtaggccccgcgctctgtgcaccagggaaaagcagctcccgagtttgtgccggacgctcctgcgccccgccatcggccgttcccggcccctgggtgaggcgcccccttcccgccgcgctccgctgccgggtgccctcggcctcggcctcccgtgacctctgacccctcttggtgcgaacaagaccgggcgtttcgccgccgacgcgaaggggctgtctgtgcgcggcgttgcgggccctccgcgcg

SEQ ID NO: 101863 - DNA, 42 bp, Homo sapiens
  chr1:2990316-2990358
  Hyper
cgcccgcgtccacaccgcgcagcctggcgccccgaccctggc

SEQ ID NO: 101864 - DNA, 43 bp, Homo sapiens; identical to SEQ ID NO: 69246
  chr1:2999363-2999406
  Hypo

SEQ ID NO: 101865 - DNA, 41 bp, Homo sapiens; identical to SEQ ID NO: 69247
  chr1:2999823-2999864
  Hypo

SEQ ID NO: 101866 - DNA, 30 bp, Homo sapiens; identical to SEQ ID NO: 69248
  chr1:3008545-3008575
  Hypo

SEQ ID NO: 101867 - DNA, 69 bp, Homo sapiens; identical to SEQ ID NO: 69249
  chr1:3015467-3015536
  Hypo

SEQ ID NO: 101868 - DNA, 83 bp, Homo sapiens; identical to SEQ ID NO: 69250
  chr1:3032896-3032979
  Hypo

SEQ ID NO: 101869 - DNA, 141 bp, Homo sapiens; identical to SEQ ID NO: 38777
  chr1:3035035-3035176
  Hypo

SEQ ID NO: 101870 - DNA, 153 bp, Homo sapiens; identical to SEQ ID NO: 69253
  chr1:3051442-3051595
  Hypo

SEQ ID NO: 101871 - DNA, 30 bp, Homo sapiens; identical to SEQ ID NO: 69254
  chr1:3052897-3052927
  Hypo

SEQ ID NO: 101872 - DNA, 30 bp, Homo sapiens; identical to SEQ ID NO: 38778
  chr1:3063272-3063302
  Hypo

SEQ ID NO: 101873 - DNA, 30 bp, Homo sapiens; identical to SEQ ID NO: 38779
  chr1:3070343-3070373
  Hypo

SEQ ID NO: 101874 - DNA, 155 bp, Homo sapiens; identical to SEQ ID NO: 69259
  chr1:3078686-3078841
  Hypo

SEQ ID NO: 101875 - DNA, 34 bp, Homo sapiens; identical to SEQ ID NO: 69260
  chr1:3080320-3080354
  Hypo

SEQ ID NO: 101876 - DNA, 122 bp, Homo sapiens; identical to SEQ ID NO: 69263
  chr1:3087601-3087723
  Hyper

SEQ ID NO: 101877 - DNA, 54 bp, Homo sapiens; identical to SEQ ID NO: 69264
  chr1:3089947-3090001
  Hypo

SEQ ID NO: 101878 - DNA, 241 bp, Homo sapiens; identical to SEQ ID NO: 69265
  chr1:3102576-3102817
  Hypo

SEQ ID NO: 101879 - DNA, 226 bp, Homo sapiens; identical to SEQ ID NO: 69266
  chr1:3111237-3111463
  Hypo

SEQ ID NO: 101880 - DNA, 32 bp, Homo sapiens; identical to SEQ ID NO: 69270
  chr1:3128445-3128477
  Hypo

SEQ ID NO: 101881 - DNA, 157 bp, Homo sapiens; identical to SEQ ID NO: 69271
  chr1:3129210-3129367
  Hypo

SEQ ID NO: 101882 - DNA, 35 bp, Homo sapiens; identical to SEQ ID NO: 69273
  chr1:3147215-3147250
  Hypo

SEQ ID NO: 101883 - DNA, 30 bp, Homo sapiens; identical to SEQ ID NO: 69275
  chr1:3149618-3149648
  Hypo

SEQ ID NO: 101884 - DNA, 50 bp, Homo sapiens
  chr1:3155276-3155326
  Hypo
ggagagagtcctggccggggttcaggtgcaagtcccgggtggaagggcct

SEQ ID NO: 101885 - DNA, 30 bp, Homo sapiens; identical to SEQ ID NO: 38784
  chr1:3179577-3179607
  Hypo

SEQ ID NO: 101886 - DNA, 30 bp, Homo sapiens; identical to SEQ ID NO: 69279
  chr1:3182769-3182799
  Hypo

SEQ ID NO: 101887 - DNA, 90 bp, Homo sapiens; identical to SEQ ID NO: 69280
  chr1:3183016-3183106
  Hypo

SEQ ID NO: 101888 - DNA, 18 bp, Homo sapiens
  chr1:3183533-3183551
  Hypo
gcccggccacgtgcattt

SEQ ID NO: 101889 - DNA, 72 bp, Homo sapiens; identical to SEQ ID NO: 69283
  chr1:3184625-3184697
  Hypo

SEQ ID NO: 101890 - DNA, 112 bp, Homo sapiens; identical to SEQ ID NO: 69287
  chr1:3213652-3213764
  Hypo

SEQ ID NO: 101891 - DNA, 178 bp, Homo sapiens; identical to SEQ ID NO: 69288
  chr1:3217150-3217328
  Hypo

SEQ ID NO: 101892 - DNA, 30 bp, Homo sapiens; identical to SEQ ID NO: 69292
  chr1:3222385-3222415
  Hypo

SEQ ID NO: 101893 - DNA, 30 bp, Homo sapiens; identical to SEQ ID NO: 69298
  chr1:3263565-3263595
  Hypo

SEQ ID NO: 101894 - DNA, 164 bp, Homo sapiens; identical to SEQ ID NO: 69302
  chr1:3276914-3277078
  Hypo

SEQ ID NO: 101895 - DNA, 82 bp, Homo sapiens; identical to SEQ ID NO: 69308
  chr1:3294711-3294793
  Hypo

SEQ ID NO: 101896 - DNA, 66 bp, Homo sapiens; identical to SEQ ID NO: 69309
  chr1:3297673-3297739
  Hypo

SEQ ID NO: 101897 - DNA, 771 bp, Homo sapiens
  chr1:3310120-3310891
  Hyper
cgagccaggagccggcgcaggctgggtccgcagacgcccggttcccaccgcggccggcccggtctttgtcccgggaagtcgcctgaccccgccggccaggaacagtggcgttctcggcgcgtctggctgataaggcctttgtgacaccggggacaggctgtaaaaacgcagccagcttttgtctgcacctccgcgccgctggcaagggcggggccggcgagtgtggaaaagtttgcgcggattcccgttcacctctgacccccgaagcagttggaggcaggtcggggacccccgcccccgccccgccccgcctcgggccctgcgatcagcagtaatagcgattaattccgactgtggctccaagtcccatggccaaggcgccctcctcctgcaggtccagggccagggagggggagcccgcggcccggcgcgctagaccctcccgcggcggcggcggctccagggcagtgtccgcgccggaggggagggtcccccggcaagtctgctgccctcggagccggggtggggtcccaggagacaccgggggccctcggattgggggaagaggtgggggaaggggtttccttccgcagcgccgcggatcagaggagggaggcctggcgccctcggagctgcggtggggggcatcccaggagatctggctcggtgtgtagagaagggagtccgggcggcgtcctgggagtgtctgtggcctgcagagaggggatggggttggggtgtggatcccgggaggctcggaggcgctcggag

SEQ ID NO: 101898 - DNA, 262 bp, Homo sapiens; identical to SEQ ID NO: 69312
  chr1:3321998-3322260
  Hypo

SEQ ID NO: 101899 - DNA, 560 bp, Homo sapiens; identical to SEQ ID NO: 69314
  chr1:3325238-3325798
  Hypo

SEQ ID NO: 101900 - DNA, 155 bp, Homo sapiens; identical to SEQ ID NO: 69315
  chr1:3327868-3328023
  Hypo

SEQ ID NO: 101901 - DNA, 50 bp, Homo sapiens; identical to SEQ ID NO: 69316
  chr1:3328269-3328319
  Hypo

SEQ ID NO: 101902 - DNA, 92 bp, Homo sapiens; identical to SEQ ID NO: 69317
  chr1:3328533-3328625
  Hypo

SEQ ID NO: 101903 - DNA, 30 bp, Homo sapiens; identical to SEQ ID NO: 69318
  chr1:3329300-3329330
  Hypo

SEQ ID NO: 101904 - DNA, 30 bp, Homo sapiens; identical to SEQ ID NO: 69319
  chr1:3330244-3330274
  Hypo

SEQ ID NO: 101905 - DNA, 79 bp, Homo sapiens; identical to SEQ ID NO: 69324
  chr1:3335837-3335916
  Hypo

SEQ ID NO: 101906 - DNA, 180 bp, Homo sapiens; identical to SEQ ID NO: 69327
  chr1:3342141-3342321
  Hypo

SEQ ID NO: 101907 - DNA, 93 bp, Homo sapiens; identical to SEQ ID NO: 69331
  chr1:3347130-3347223
  Hypo

SEQ ID NO: 101908 - DNA, 69 bp, Homo sapiens; identical to SEQ ID NO: 69333
  chr1:3350089-3350158
  Hypo

SEQ ID NO: 101909 - DNA, 55 bp, Homo sapiens; identical to SEQ ID NO: 69334
  chr1:3350407-3350462
  Hypo

SEQ ID NO: 101910 - DNA, 33 bp, Homo sapiens; identical to SEQ ID NO: 38794
  chr1:3372809-3372842
  Hypo

SEQ ID NO: 101911 - DNA, 45 bp, Homo sapiens; identical to SEQ ID NO: 69343
  chr1:3402666-3402711
  Hypo

SEQ ID NO: 101912 - DNA, 206 bp, Homo sapiens; identical to SEQ ID NO: 69344
  chr1:3408498-3408704
  Hypo

SEQ ID NO: 101913 - DNA, 272 bp, Homo sapiens; identical to SEQ ID NO: 69347
  chr1:3411032-3411304
  Hypo

SEQ ID NO: 101914 - DNA, 30 bp, Homo sapiens; identical to SEQ ID NO: 69350
  chr1:3416275-3416305
  Hypo

SEQ ID NO: 101915 - DNA, 36 bp, Homo sapiens; identical to SEQ ID NO: 69351
  chr1:3417132-3417168
  Hypo

SEQ ID NO: 101916 - DNA, 30 bp, Homo sapiens; identical to SEQ ID NO: 69353
  chr1:3418316-3418346
  Hypo

SEQ ID NO: 101917 - DNA, 103 bp, Homo sapiens; identical to SEQ ID NO: 69354
  chr1:3426374-3426477
  Hypo

SEQ ID NO: 101918 - DNA, 30 bp, Homo sapiens; identical to SEQ ID NO: 69355
  chr1:3431090-3431120
  Hypo

SEQ ID NO: 101919 - DNA, 30 bp, Homo sapiens; identical to SEQ ID NO: 69356
  chr1:3431513-3431543
  Hypo

SEQ ID NO: 101920 - DNA, 30 bp, Homo sapiens; identical to SEQ ID NO: 69357
  chr1:3450321-3450351
  Hypo

SEQ ID NO: 101921 - DNA, 285 bp, Homo sapiens; identical to SEQ ID NO: 69363
  chr1:3463596-3463881
  Hypo

SEQ ID NO: 101922 - DNA, 675 bp, Homo sapiens; identical to SEQ ID NO: 69366
  chr1:3466869-3467544
  Hypo

SEQ ID NO: 101923 - DNA, 30 bp, Homo sapiens; identical to SEQ ID NO: 38801
  chr1:3470143-3470173
  Hypo

SEQ ID NO: 101924 - DNA, 34 bp, Homo sapiens; identical to SEQ ID NO: 69369
  chr1:3511274-3511308
  Hypo

SEQ ID NO: 101925 - DNA, 30 bp, Homo sapiens; identical to SEQ ID NO: 69372
  chr1:3527351-3527381
  Hyper

SEQ ID NO: 101926 - DNA, 61 bp, Homo sapiens; identical to SEQ ID NO: 69373
  chr1:3527713-3527774
  Hyper

SEQ ID NO: 101927 - DNA, 50 bp, Homo sapiens
  chr1:3528381-3528431
  Hyper
cctgctcgtctcatgcggaaagtccaagtcctaaccgactccagtgacca

SEQ ID NO: 101928 - DNA, 30 bp, Homo sapiens; identical to SEQ ID NO: 69382
  chr1:3564809-3564839
  Hypo

SEQ ID NO: 101929 - DNA, 1355 bp, Homo sapiens
  chr1:3567103-3568458
  Hyper
taatacggtgtctgtcgcacatatattatatcgtgtatgtaatgtataagtatttatttcgtttgcttggggttttgtttgcttttgctgagtccgacccctctacctgccgcctggcccttgcctcacgctccagtgccactgagatcaaggagagaacgaatttgccgctgactgggcagagcgagcgcgtggatcgcggccaccgcccgttcatcacccgcgcgcatctgggctggcaccgggcgaagaatcgtgcgggtctgggacctgggggcccagagggagcgagctcctgcgcgggcgctcggtccgcaggtttcgcaggctcaggggcgtgcctcgttctcacccccactccggaccccggtcctcttccctagacagcggccccctccacccctggctcccgcaggccgctagtagtccgcgccaggccccgccggcgcctctagggccccccagatcgcgcagaccctgacatccccgcctggccctgggttctgggagctgagagccggccagggtcctgctcgtacctccgggcgcccagcctcgggtctgctccccgcggacgccccaacctccccggccgaatggatggtggtgcgcgcgcgtcctactccggcggtgccggccttttctgttgccaaaactagacccaaacctctgcatgggattcgtctttgggtccccaccccgtgcgcccagcaaacagtgggtgagccatgaagatgtgcgagtcagccggaccctccccgtcaggcgcggacccgctgcggccagagaacccagtctgcgccagcccggctcgctcgcgaagccacgggcttcactgacgcgactttccaagacgtgggggtcaccatgggcagaggacatcggttcggagccagatcacgggccccataagcatcagaccataagcagcgccgccactgagagccgctcggaactcgcccagcatgtcgggtcccctagccagggcctggtgtacgtggtcgagggccctggaagccccgatggcctaggaggagcaggcgggcggggcggcgggtgtcgctggccggtagagagcttcggcctgacctagcgcaggtctggtgcgcgcagagaacaactccaagcgcaccgacgcccgcgagctccttccaaacaccgaacgggatccagagcccgagcccacaggcggcggccgggggagggagcagggtgctggccgccgcccgggagtgttcgcgtcctgggtgacccctggaaggacgtggggcccaaactccggctggggttgggagagcagcccccagaggctctccgcgggatcctctgccgggcgggaccgtggctccacagga

SEQ ID NO: 101930 - DNA, 79 bp, Homo sapiens; identical to SEQ ID NO: 69388
  chr1:3597274-3597353
  Hypo

SEQ ID NO: 101931 - DNA, 30 bp, Homo sapiens; identical to SEQ ID NO: 69389
  chr1:3597733-3597763
  Hypo

SEQ ID NO: 101932 - DNA, 132 bp, Homo sapiens; identical to SEQ ID NO: 69390
  chr1:3601814-3601946
  Hypo

SEQ ID NO: 101933 - DNA, 30 bp, Homo sapiens; identical to SEQ ID NO: 69391
  chr1:3602547-3602577
  Hypo

SEQ ID NO: 101934 - DNA, 485 bp, Homo sapiens
  chr1:3607081-3607566
  Hypo
gtttaattatggagccggcgctgaccggcgtccccgccctccccacgcagcctccttggtgcggtccaacacatcaccgggcaagctgaggcctgccccggacttggatgaatactcatgaggaataaaggggtgggccgcgggttttgttgttggattcagccagttgacagaactaagggagatgggaaaagcgaaaatgccaacaaacggcccgcatgttccccagcatcctcggctcctgcctcactagctgcggagcctctcccgctcggtccacgctgccgggcggccacgaccgtgacccttcccctcgggccgcccagatccatgcctcgtcccacgggacaccagttccctggcgtgtgcagaccccccggcgcctaccatgctgtacgtcggtgaccccgcacggcacctcgccacggtaggtgtgacgcgccattcataggatctcttcggggactttgcgggggattttgctg

SEQ ID NO: 101935 - DNA, 66 bp, Homo sapiens; identical to SEQ ID NO: 69395
  chr1:3614470-3614536
  Hypo

SEQ ID NO: 101936 - DNA, 75 bp, Homo sapiens; identical to SEQ ID NO: 69400
  chr1:3644699-3644774
  Hypo

SEQ ID NO: 101937 - DNA, 42 bp, Homo sapiens
  chr1:3659628-3659670
  Hypo
tctctttagggaagccggagaggccgccgggaacaggcagtg

SEQ ID NO: 101938 - DNA, 30 bp, Homo sapiens; identical to SEQ ID NO: 38806
  chr1:3661766-3661796
  Hypo

SEQ ID NO: 101939 - DNA, 30 bp, Homo sapiens; identical to SEQ ID NO: 69406
  chr1:3662534-3662564
  Hypo

SEQ ID NO: 101940 - DNA, 98 bp, Homo sapiens; identical to SEQ ID NO: 69407
  chr1:3663195-3663293
  Hyper

SEQ ID NO: 101941 - DNA, 467 bp, Homo sapiens
  chr1:3663516-3663983
  Hyper
ggagtgggtccgtccgagctggagtggtctccgaggggcggcggatgctcggagggggcggatcccttagggctgggggccaggacgatcccacccggagaagcctcgcgggcgagaagagggtcccttcctgcgggggcagatggaggcgcgggagccttccccgggaggtgaccgaggccagtcagcggccccggggacccaaggccggggactctcggcggccggtggacgggcagggccggcccgcctgggcaggcggcggggtgaaggtgtccagggcctgaggcggcaaagtgccgccgccgtcagccccgactgccacccaccaggcacccggcccatccccggctcccatctagggatccacacccgggcgccgcggcgccgcggtttaaagcctgtgagatcccgcaacaacccggatccggaagcgcggggtcgcggctgggcgagggcaggggtgg

SEQ ID NO: 101942 - DNA, 32 bp, Homo sapiens; identical to SEQ ID NO: 69409
  chr1:3664709-3664741
  Hypo

SEQ ID NO: 101943 - DNA, 30 bp, Homo sapiens; identical to SEQ ID NO: 69411
  chr1:3673312-3673342
  Hypo

SEQ ID NO: 101944 - DNA, 114 bp, Homo sapiens; identical to SEQ ID NO: 69414
  chr1:3678034-3678148
  Hypo

SEQ ID NO: 101945 - DNA, 68 bp, Homo sapiens; identical to SEQ ID NO: 38808
  chr1:3680032-3680100
  Hypo

SEQ ID NO: 101946 - DNA, 55 bp, Homo sapiens; identical to SEQ ID NO: 69417
  chr1:3680304-3680359
  Hypo

SEQ ID NO: 101947 - DNA, 680 bp, Homo sapiens; identical to SEQ ID NO: 69418
  chr1:3683703-3684383
  Hypo

SEQ ID NO: 101948 - DNA, 30 bp, Homo sapiens; identical to SEQ ID NO: 69419
  chr1:3693714-3693744
  Hypo

SEQ ID NO: 101949 - DNA, 30 bp, Homo sapiens; identical to SEQ ID NO: 69421
  chr1:3701022-3701052
  Hypo

SEQ ID NO: 101950 - DNA, 35 bp, Homo sapiens; identical to SEQ ID NO: 69422
  chr1:3706065-3706100
  Hypo

SEQ ID NO: 101951 - DNA, 30 bp, Homo sapiens; identical to SEQ ID NO: 69423
  chr1:3714226-3714256
  Hypo

SEQ ID NO: 101952 - DNA, 192 bp, Homo sapiens; identical to SEQ ID NO: 69435
  chr1:3786388-3786580
  Hypo

SEQ ID NO: 101953 - DNA, 37 bp, Homo sapiens; identical to SEQ ID NO: 69483
  chr1:4066154-4066191
  Hypo

SEQ ID NO: 101954 - DNA, 193 bp, Homo sapiens; identical to SEQ ID NO: 38813
  chr1:4082814-4083007
  Hypo

SEQ ID NO: 101955 - DNA, 151 bp, Homo sapiens; identical to SEQ ID NO: 14198
  chr1:4111083-4111234
  Hypo

SEQ ID NO: 101956 - DNA, 30 bp, Homo sapiens; identical to SEQ ID NO: 69491
  chr1:4111541-4111571
  Hypo

SEQ ID NO: 101957 - DNA, 30 bp, Homo sapiens; identical to SEQ ID NO: 69504
  chr1:4182092-4182122
  Hypo

SEQ ID NO: 101958 - DNA, 191 bp, Homo sapiens; identical to SEQ ID NO: 69511
  chr1:4212772-4212963
  Hypo

SEQ ID NO: 101959 - DNA, 82 bp, Homo sapiens; identical to SEQ ID NO: 69515
  chr1:4279385-4279467
  Hypo

SEQ ID NO: 101960 - DNA, 99 bp, Homo sapiens; identical to SEQ ID NO: 69518
  chr1:4285363-4285462
  Hypo

SEQ ID NO: 101961 - DNA, 177 bp, Homo sapiens; identical to SEQ ID NO: 69533
  chr1:4385832-4386009
  Hypo

SEQ ID NO: 101962 - DNA, 152 bp, Homo sapiens; identical to SEQ ID NO: 38817
  chr1:4402113-4402265
  Hypo

SEQ ID NO: 101963 - DNA, 214 bp, Homo sapiens; identical to SEQ ID NO: 69542
  chr1:4426176-4426390
  Hypo

SEQ ID NO: 101964 - DNA, 71 bp, Homo sapiens; identical to SEQ ID NO: 69554
  chr1:4486495-4486566
  Hypo

SEQ ID NO: 101965 - DNA, 75 bp, Homo sapiens; identical to SEQ ID NO: 69579
  chr1:4542688-4542763
  Hypo

SEQ ID NO: 101966 - DNA, 68 bp, Homo sapiens; identical to SEQ ID NO: 38821
  chr1:4652230-4652298
  Hypo

SEQ ID NO: 101967 - DNA, 94 bp, Homo sapiens; identical to SEQ ID NO: 69586
  chr1:4659147-4659241
  Hypo

SEQ ID NO: 101968 - DNA, 93 bp, Homo sapiens; identical to SEQ ID NO: 69587
  chr1:4659541-4659634
  Hypo

SEQ ID NO: 101969 - DNA, 44 bp, Homo sapiens; identical to SEQ ID NO: 69592
  chr1:4673712-4673756
  Hypo

SEQ ID NO: 101970 - DNA, 124 bp, Homo sapiens; identical to SEQ ID NO: 38823
  chr1:4677050-4677174
  Hypo

SEQ ID NO: 101971 - DNA, 30 bp, Homo sapiens; identical to SEQ ID NO: 69595
  chr1:4691300-4691330
  Hypo

SEQ ID NO: 101972 - DNA, 101 bp, Homo sapiens; identical to SEQ ID NO: 69608
  chr1:4696797-4696898
  Hypo

SEQ ID NO: 101973 - DNA, 23 bp, Homo sapiens
  chr1:4711648-4711671
  Hypo
taataataagctgggcgcggtgg

SEQ ID NO: 101974 - DNA, 355 bp, Homo sapiens; identical to SEQ ID NO: 69615
  chr1:4712671-4713026
  Hyper

SEQ ID NO: 101975 - DNA, 2720 bp, Homo sapiens
  chr1:4713944-4716664
  Hyper
ttccagtgactcctccggagcaagggcctggccaggcagcagctgcgctgggcgatgagggaccgttgggtaattgggggcataggaccgggcttcgctgggttcggggcagaagcgccgaagctccgacccggaacgcggtgacttcatcaacgcagaagcccgcgcagccgagcagaggagtccctcgtaggcgaccctcggacagacgctcctgcgcggcccgcgtggctcagctccgccccaggaaacttttcgcgcagcccccgctccatgcgcccccacccagtccttcttcggggccgccccctccccaaagtagctctccgggtccactgggcgcccccgtaaccgggtcggaacctcgaacggcttcgcgtgccatccggttaccctggcaacaccatccggcggcgcccggcggtccaatcctagcctgcggcctctctcgagcctttcgcaaggtggggaccgggacgcgaccggggatggggaagggggctgcaggaggccccgcctgcgctgtcgcccctgctgggcacagcgccccccaccacccgcggcgaccccggcccccgcaaggtggggcggcgagcaggagccggggccaggccaggggctcgagctcccgttcgaggggcggggaaggcgggtgacgtgagccgggccgggcgggcggagttgggaccggctccgggaggcgggggcgagcgcgcggagaggcagacgcgaggagggaggcggctgagcagcgcgggcggctctgcggcgggcgcggtgggcgcgggcggcggggccccgggatccccgcgcgcctcctccgcgcggcgccgccgccgcgcgtccccacgccccgcgctccacggcgccctcgccccgcgcgcctctcgtgcccgcctcctgccagtctccgggccgcggccgtctgcagagcgagcgctcagacggagcccccgggcaacttgagtggcgccgatcggcggcggagcctctggcagagccccccgacccggcagcgcggaggggactcgcgtccgtccgcgtcgcgtcaccccaaaccctaagcagcgccgccccatcggcgcggagctccggctggaggcaagagccgcgcgccgggagacacgcaccgtgagcggcagcgccgccggcctccctcctcgccgccccggagggcgaagccgcggctccccagccctttgctgcgccgcgacagcgccggaacacgccccgcctcgctgccgccttcgctgtgccgccggcggagggggccgcgagccccgcgccccggccggaggatgtgcgcccccgcgggccgcccagcctgagccatgcgccccaacggcggcggcgcgccggccggcatggagccccgcgcggccgcgctctgactcgctgtgcgccccgcggccggcgggcggcgggaggcggcggaccgagagccggagaccggcgccgcgggacggaagcgagcgggcgcgggcgccgcgcagatggcctgggcgagccaggtctgaggccccgctccccgaaacgtgaccatgtggattcaacagcttttaggactcaggtgagcgacccggccggcgccgggtgcgtgtgggcgcgtgggtgccaggctgggcggaagcggcgctttcctctatgttgcaaatcaagggacccctcttcgcttcccgcaagcgggcaacggggtgcaccggtagccggaaaggggcgcccgcccggagcctggagcagcaccgcggccctggcggggagcggccgggtctccagggttccgcgcgtccggggtcggggcagcggcgcccgccccagcaacccgggaagtggggccggccaggcgcgcccgcagctctaggagccagcagcgcagtgtcctggccggctgccccggcgcgcctcctccccggggcccggggcgaggcgccggccgctgggcgcggcgggcgcgggggccggggctgccggggaaagctaaagctccgggctcccagcgagagcttcgcaggcggagttggaggaaaccacagccaaacagccactccgctcccccttctcctttctcggggccccggggctgagcaggggcctcccaggctcccagctgccgacccagctgtttgcgggtgacctccgggcccgacgggcgctcacagctggcgggcagctggggcgggagagctggggttcttggggagctccggcggccaccccgctgtaaacacacacgcacatacgcccgccggcgcgcccggggcttgtctgtgtctgggactccagggccagatggaagagggggttcgagcctagagcccgtggtgggggtgtccagaaagacccttctcggcaaactttgccagcccgccggggttctcgggcttctctggcttctgcctggggtggcccagggcccaccagagcacagctgtcgtttttgctgggcaggctgcctctgagccctcgccctcctgccggggcattcaccgagctcgtgcatttgggtcccgggttggaaccgcgagcggggaggacagaggtggaggcggagagcagcgtgcggttctcgagtttgtccactgggatgcactgcgctcccgcgttggggacgaaaaggccagtagttgttagcccgctgcttgagccgcccccactcagggatgaagctgcggggggagtgaggcgaagggagggaggatctagtgcgtgtcctgattttg

SEQ ID NO: 101976 - DNA, 235 bp, Homo sapiens; identical to SEQ ID NO: 38825
  chr1:4726593-4726828
  Hypo

SEQ ID NO: 101977 - DNA, 120 bp, Homo sapiens; identical to SEQ ID NO: 69631
  chr1:4771547-4771667
  Hyper

SEQ ID NO: 101978 - DNA, 224 bp, Homo sapiens; identical to SEQ ID NO: 69632
  chr1:4772478-4772702
  Hypo

SEQ ID NO: 101979 - DNA, 177 bp, Homo sapiens; identical to SEQ ID NO: 69634
  chr1:4782333-4782510
  Hypo

SEQ ID NO: 101980 - DNA, 30 bp, Homo sapiens; identical to SEQ ID NO: 69689
  chr1:5220720-5220750
  Hypo

SEQ ID NO: 101981 - DNA, 30 bp, Homo sapiens; identical to SEQ ID NO: 69718
  chr1:5463052-5463082
  Hypo

SEQ ID NO: 101982 - DNA, 30 bp, Homo sapiens; identical to SEQ ID NO: 69733
  chr1:5544893-5544923
  Hypo

SEQ ID NO: 101983 - DNA, 52 bp, Homo sapiens; identical to SEQ ID NO: 69740
  chr1:5661868-5661920
  Hypo

SEQ ID NO: 101984 - DNA, 30 bp, Homo sapiens; identical to SEQ ID NO: 69746
  chr1:5777938-5777968
  Hyper

SEQ ID NO: 101985 - DNA, 30 bp, Homo sapiens; identical to SEQ ID NO: 69751
  chr1:5816415-5816445
  Hypo

SEQ ID NO: 101986 - DNA, 93 bp, Homo sapiens; identical to SEQ ID NO: 69757
  chr1:5890942-5891035
  Hyper

SEQ ID NO: 101987 - DNA, 43 bp, Homo sapiens; identical to SEQ ID NO: 38828
  chr1:5893925-5893968
  Hypo

SEQ ID NO: 101988 - DNA, 49 bp, Homo sapiens; identical to SEQ ID NO: 69759
  chr1:5894998-5895047
  Hypo

SEQ ID NO: 101989 - DNA, 66 bp, Homo sapiens; identical to SEQ ID NO: 69763
  chr1:6046211-6046277
  Hypo

SEQ ID NO: 101990 - DNA, 183 bp, Homo sapiens
  chr1:6053472-6053655
  Hyper
ttacagcacacacaccgccacttctgaccctgagcccctactcctatcttaagcttctccctcctgccaggccttggcacaaagcacttccgcacctccctacctgctgctgctcccaggatgcaaagaccccactgctgcaccgcgtcctgcggcattagcagcagccggggtacctgccca

SEQ ID NO: 101991 - DNA, 188 bp, Homo sapiens; identical to SEQ ID NO: 69767
  chr1:6071300-6071488
  Hypo

SEQ ID NO: 101992 - DNA, 32 bp, Homo sapiens; identical to SEQ ID NO: 69768
  chr1:6086259-6086291
  Hyper

SEQ ID NO: 101993 - DNA, 171 bp, Homo sapiens; identical to SEQ ID NO: 69769
  chr1:6131714-6131885
  Hypo

SEQ ID NO: 101994 - DNA, 30 bp, Homo sapiens; identical to SEQ ID NO: 69771
  chr1:6149015-6149045
  Hypo

SEQ ID NO: 101995 - DNA, 203 bp, Homo sapiens; identical to SEQ ID NO: 69779
  chr1:6166315-6166518
  Hypo

SEQ ID NO: 101996 - DNA, 317 bp, Homo sapiens; identical to SEQ ID NO: 69780
  chr1:6171630-6171947
  Hypo

SEQ ID NO: 101997 - DNA, 269 bp, Homo sapiens; identical to SEQ ID NO: 69781
  chr1:6186398-6186667
  Hypo

SEQ ID NO: 101998 - DNA, 30 bp, Homo sapiens; identical to SEQ ID NO: 69782
  chr1:6189031-6189061
  Hypo

SEQ ID NO: 101999 - DNA, 311 bp, Homo sapiens; identical to SEQ ID NO: 69783
  chr1:6208626-6208937
  Hyper

SEQ ID NO: 102000 - DNA, 30 bp, Homo sapiens; identical to SEQ ID NO: 26021
  chr1:6221982-6222012
  Hyper

SEQ ID NO: 102001 - DNA, 921 bp, Homo sapiens; identical to SEQ ID NO: 69787
  chr1:6239141-6240062
  Hyper

SEQ ID NO: 102002 - DNA, 436 bp, Homo sapiens; identical to SEQ ID NO: 69788
  chr1:6240272-6240708
  Hyper

SEQ ID NO: 102003 - DNA, 333 bp, Homo sapiens; identical to SEQ ID NO: 69789
  chr1:6240931-6241264
  Hyper

SEQ ID NO: 102004 - DNA, 229 bp, Homo sapiens; identical to SEQ ID NO: 69791
  chr1:6266484-6266713
  Hyper

SEQ ID NO: 102005 - DNA, 502 bp, Homo sapiens; identical to SEQ ID NO: 69795
  chr1:6280243-6280745
  Hypo

SEQ ID NO: 102006 - DNA, 49 bp, Homo sapiens; identical to SEQ ID NO: 69796
  chr1:6281776-6281825
  Hypo

SEQ ID NO: 102007 - DNA, 45 bp, Homo sapiens; identical to SEQ ID NO: 69797
  chr1:6294199-6294244
  Hypo

SEQ ID NO: 102008 - DNA, 321 bp, Homo sapiens; identical to SEQ ID NO: 69798
  chr1:6301689-6302010
  Hyper

SEQ ID NO: 102009 - DNA, 548 bp, Homo sapiens; identical to SEQ ID NO: 69799
  chr1:6304118-6304666
  Hyper

SEQ ID NO: 102010 - DNA, 907 bp, Homo sapiens; identical to SEQ ID NO: 69800
  chr1:6309182-6310089
  Hyper

SEQ ID NO: 102011 - DNA, 32 bp, Homo sapiens; identical to SEQ ID NO: 69801
  chr1:6332155-6332187
  Hypo

SEQ ID NO: 102012 - DNA, 113 bp, Homo sapiens
  chr1:6360521-6360634
  Hypo
ccctctccacaaacacggaatctcaccggaccccacccgatcctgtgatgcacaaggccggccctctccacaaacacagaatctcaccggaccccacccgatcctgatgcgcg

SEQ ID NO: 102013 - DNA, 30 bp, Homo sapiens; identical to SEQ ID NO: 14204
  chr1:6360980-6361010
  Hypo

SEQ ID NO: 102014 - DNA, 111 bp, Homo sapiens; identical to SEQ ID NO: 38837
  chr1:6391430-6391541
  Hypo

SEQ ID NO: 102015 - DNA, 29 bp, Homo sapiens
  chr1:6422825-6422854
  Hypo
ttggctaggcgcggtcgtgcacgcctgta

SEQ ID NO: 102016 - DNA, 274 bp, Homo sapiens; identical to SEQ ID NO: 69828
  chr1:6446079-6446353
  Hypo

SEQ ID NO: 102017 - DNA, 30 bp, Homo sapiens; identical to SEQ ID NO: 69829
  chr1:6446992-6447022
  Hypo

SEQ ID NO: 102018 - DNA, 59 bp, Homo sapiens; identical to SEQ ID NO: 69832
  chr1:6479255-6479314
  Hyper

SEQ ID NO: 102019 - DNA, 735 bp, Homo sapiens; identical to SEQ ID NO: 69833
  chr1:6480216-6480951
  Hyper

SEQ ID NO: 102020 - DNA, 409 bp, Homo sapiens
  chr1:6484931-6485340
  Hyper
cgggctcctctggcccgcaagaacacgtgcatggcgtcctggggaaggcgctgagtgcggagtcgcggcgccgcacgcggcaccatggccctggagcaggcgctgcaggcggcgcggcagggcgagctggacgtgctgaggtcgctgcacgccgcaggcctcctggggccctcgctgcgcgacccgctggacgcgctgcccgtgcaccacgcggcccgcgctgggaagctgcactgtctgcgcttcctggtggaggaagccgccctccccgccgcggcccgcgcccgcaacggcgccacaccggcccacgacgcctccgccaccggccacctcgcctgcctgcagtggctgctgtcgcagggcggctgcagagtgcaggtgggtccgcgcggttcgccaggggcactga

SEQ ID NO: 102021 - DNA, 89 bp, Homo sapiens; identical to SEQ ID NO: 69836
  chr1:6488312-6488401
  Hypo

SEQ ID NO: 102022 - DNA, 435 bp, Homo sapiens
  chr1:6500744-6501179
  Hyper
cttcgcggcgagccgcggccacaccaaggtgctcagctggctgctgctgcacggcggggagatctcggctgacctgtggggcgggaccccgctgcacgacgccgccgagaacggggagctagaggtcagcgcgggcccggggtgggggcgcgcgccctctgctggcaccgcgctttcagcacggccctgcccgggcgcgggggtcccagctcgcggccgcggccgggtcctcactgcgtgcccccgcagtgctgccagatcctggtagtgaacggcgcggagctggacgtccgcgaccgcgacgggtacacggccgccgacctgtcggacttcaacggccacagccactgcacccgctacctgcgcacggtggagaacctggtacgatccctgagctgctcctgtcgcattctttcttctcgcccctccacccca

SEQ ID NO: 102023 - DNA, 2018 bp, Homo sapiens
  chr1:6507126-6509144
  Hyper
gcccagccagtgccccgtctccaccgttgagcccaagtgccaggtctgcgtggtcccctcctggctgtgtgagccccctcccggctgtgtgcgtccctccgggctgtgtgcgcccctcccggctgtgtgcgcccctccccactgtgtgcgcccctcccggctatgtgcgtccatctcggccgtgtgcgtgctgggccgcaggcgccagggccggggcccggacgctccacaaagggctctttgtgtcgccgcggcgccccccgcgcgggtgcctgaccgggggcgggagcagggtcgtggcgtccgaacctccgggctgcagggggcgcggagcgggcgggctggcccagaaaacaaatcctgcggtgtcgcatttcctgcaacgtgagccaggtcgggcggggtgaagggtctgaggccaccgcagggacgcatgggctggagagtggggcagaggacagcccccacccggtcactcagtctttggcccggccgcctcactctccctcactgagctgggcctagttgggggcagctgcgatggggtgggaagccacgctgtcacccgaccccgccttacggcccctgaaatccgaggcttgagcgcgggtgtcggtgtcgctttcgtggatggcgatggtttccagatgcaggaggggaagggtggggacgcgacccggagccgggggccaaatatgagaggcctcctctgcccacagtcagccctctcccctctcgggcggggatgaaggtgggggctcagctcccagcttagggagaggcgcagggggcggggtcacatctggccggggacgggtgcagagccgcggccaggtgtggcaaagtagttggcgccccctgtggcatccgcgacggctgggggggttcagcctgggattggcgggccccgggtgatgtcaggccgtcggagcccataggctggctgtgcgcgggtggctgtaacctgagaggaagtatcaggtaacgcaggtgtcgggtcctgccgcccccacagccaggtgcacagcgggggccaccagcaccgtggcaggtaggagcagcccccggacgggcaaccggggtccgtggcaagccggagcctccgagagcacaggctctggagggggctccctccggccccggacccccgaaagacagggctccgcggagccctggggacccgcagtccttctgacagccgagagcggagtgcggccgagggcctagtgagggctaagctgggaggtgccccttcgccagctccccctggcgtcggggctgggccaccccgcccctgggcccgcctcttctggcctcagtgggggcccctgtgccccttggccggtgcccagaacccctccctgtaaggcgggcggagcctgcccttccaccgaggcccccatgaccctcgcccgctgcccactgtgagaaccagggggtctaggaagtcagctgctgcacccctcgacggccgctggccgcgagtccccaggaggtgaagagctgggtggggaggcgtggggggcgcctaccgggcaggtgcccgagccccaccggtcactgtcttcccgcagctgagctcctgtgacggccacgacgggctgcggaggcaggactccagccgcaagccccgcgccttcagcaagcagcccagcacgggggactactaccggcagctgggccgctgccccggcgagacgctggccgcacgcccgggcatggcgcacagcgaggaggtgcgtgcccgccagcccgcgcgcgccggctgcccgcgcctcggccctgccgcccgcggctcactcgaaggcccctccgctcccccgcaggcggcgctgcttcctgggaaccatgttcctaacggctgcgccgcggaccccaaggcgtccagggagctgccaccgccgcccccaccgccgccgccgcccctgccggaggccgcgagttcgccaccgccggccccgcctctgcccctcgagagcgctggccctggctgcgggcagcgccgctcctcctcgtcc

SEQ ID NO: 102024 - DNA, 34 bp, Homo sapiens; identical to SEQ ID NO: 69842
  chr1:6533352-6533386
  Hypo

SEQ ID NO: 102025 - DNA, 36 bp, Homo sapiens; identical to SEQ ID NO: 69843
  chr1:6537501-6537537
  Hypo

SEQ ID NO: 102026 - DNA, 30 bp, Homo sapiens; identical to SEQ ID NO: 69844
  chr1:6542460-6542490
  Hypo

SEQ ID NO: 102027 - DNA, 260 bp, Homo sapiens; identical to SEQ ID NO: 69845
  chr1:6545379-6545639
  Hyper

SEQ ID NO: 102028 - DNA, 46 bp, Homo sapiens; identical to SEQ ID NO: 69846
  chr1:6545885-6545931
  Hyper

SEQ ID NO: 102029 - DNA, 20 bp, Homo sapiens
  chr1:6621025-6621045
  Hypo
agagtcggaagactctgtct

SEQ ID NO: 102030 - DNA, 139 bp, Homo sapiens; identical to SEQ ID NO: 69864
  chr1:6627618-6627757
  Hypo

SEQ ID NO: 102031 - DNA, 30 bp, Homo sapiens; identical to SEQ ID NO: 38839
  chr1:6635034-6635064
  Hypo

SEQ ID NO: 102032 - DNA, 209 bp, Homo sapiens
  chr1:6663691-6663900
  Hyper
cgccctaggggctcccgggcctccctgaagcagctgctcggactccacgagagggtaactgggtataaagagcgagggctcaaagtcagataggagaccgccttgaaactagatgacgccactaagcacagtcccgccgtcacttgtactgcggtggggaatggtgaaagaaggaatcgcccttattttagttccgatagacacagcac

SEQ ID NO: 102033 - DNA, 30 bp, Homo sapiens; identical to SEQ ID NO: 69870
  chr1:6765811-6765841
  Hypo

SEQ ID NO: 102034 - DNA, 23 bp, Homo sapiens
  chr1:6776365-6776388
  Hypo
agggagaccgtggggagagggag

SEQ ID NO: 102035 - DNA, 183 bp, Homo sapiens; identical to SEQ ID NO: 69873
  chr1:6801549-6801732
  Hypo

SEQ ID NO: 102036 - DNA, 17 bp, Homo sapiens
  chr1:6811500-6811517
  Hypo
cgcgcctggcctataat

SEQ ID NO: 102037 - DNA, 30 bp, Homo sapiens; identical to SEQ ID NO: 69883
  chr1:6964959-6964989
  Hypo

SEQ ID NO: 102038 - DNA, 195 bp, Homo sapiens; identical to SEQ ID NO: 38841
  chr1:6984148-6984343
  Hypo

SEQ ID NO: 102039 - DNA, 112 bp, Homo sapiens; identical to SEQ ID NO: 69891
  chr1:7023766-7023878
  Hyper

SEQ ID NO: 102040 - DNA, 35 bp, Homo sapiens; identical to SEQ ID NO: 69894
  chr1:7067754-7067789
  Hypo

SEQ ID NO: 102041 - DNA, 30 bp, Homo sapiens; identical to SEQ ID NO: 26040
  chr1:7130249-7130279
  Hyper

SEQ ID NO: 102042 - DNA, 30 bp, Homo sapiens; identical to SEQ ID NO: 38843
  chr1:7162881-7162911
  Hypo

SEQ ID NO: 102043 - DNA, 30 bp, Homo sapiens; identical to SEQ ID NO: 69909
  chr1:7315042-7315072
  Hypo

SEQ ID NO: 102044 - DNA, 30 bp, Homo sapiens; identical to SEQ ID NO: 69910
  chr1:7445788-7445818
  Hypo

SEQ ID NO: 102045 - DNA, 30 bp, Homo sapiens; identical to SEQ ID NO: 69911
  chr1:7500700-7500730
  Hypo

SEQ ID NO: 102046 - DNA, 221 bp, Homo sapiens; identical to SEQ ID NO: 69937
  chr1:7728823-7729044
  Hypo

SEQ ID NO: 102047 - DNA, 44 bp, Homo sapiens; identical to SEQ ID NO: 69944
  chr1:7740637-7740681
  Hyper

SEQ ID NO: 102048 - DNA, 201 bp, Homo sapiens; identical to SEQ ID NO: 69945
  chr1:7750833-7751034
  Hypo

SEQ ID NO: 102049 - DNA, 39 bp, Homo sapiens; identical to SEQ ID NO: 69946
  chr1:7764052-7764091
  Hyper

SEQ ID NO: 102050 - DNA, 137 bp, Homo sapiens; identical to SEQ ID NO: 69947
  chr1:7764556-7764693
  Hyper

SEQ ID NO: 102051 - DNA, 139 bp, Homo sapiens; identical to SEQ ID NO: 69948
  chr1:7765187-7765326
  Hyper

SEQ ID NO: 102052 - DNA, 40 bp, Homo sapiens; identical to SEQ ID NO: 69954
  chr1:7842867-7842907
  Hypo

SEQ ID NO: 102053 - DNA, 25 bp, Homo sapiens
  chr1:7908876-7908901
  Hypo
ttctgtacatcgttcaggtcaatgt

SEQ ID NO: 102054 - DNA, 465 bp, Homo sapiens; identical to SEQ ID NO: 69961
  chr1:8002286-8002751
  Hyper

SEQ ID NO: 102055 - DNA, 30 bp, Homo sapiens; identical to SEQ ID NO: 69962
  chr1:8044661-8044691
  Hypo

SEQ ID NO: 102056 - DNA, 309 bp, Homo sapiens; identical to SEQ ID NO: 69964
  chr1:8086092-8086401
  Hyper

SEQ ID NO: 102057 - DNA, 30 bp, Homo sapiens; identical to SEQ ID NO: 69965
  chr1:8152862-8152892
  Hypo

SEQ ID NO: 102058 - DNA, 722 bp, Homo sapiens
  chr1:8277113-8277835
  Hyper
tcccagagatgagggcgaggggaggggaccggagagcagagggaggcgagggagcagaaggaggagcccccaggtgggaggacgggggtctgcccagctcggccggggagtgcagtaggggggcgtcctcccgactaagggcaaaggaggtgacggcggggacgcccgccccgtgacgaggagggctcggccgagccgtcccggggcgacaggaagcggccgccctttgaaggcccagcggcggcgctgggtcagccaggccagcttgtgggggagcggccgcccgcgcacggctggggccggggccagggccggagggcgccgcaggaaggggccggggccggggcggcttctctccccgcagccggcgcctccacgcggcggtcaagctcgcgcgtgggctttagcagtttcgggcgtgcacgtgcgcggaggctcctgcctctgcggagctcgcgccctcaagagacttccaggagggtttggagcccgggtttctctttcccccagccccggaacccgagtctgctccaagtgcgcatctgcgcggcggccgacggggacgcagcccggtgtccccggcaggaccccggagcaacgtctcctggagcctgtgcagaagctgggcttggcgagggagggggtgcttccggggacacccgcgcagggaaaaggaggatgctagtgacccatcctttctcgccgtgcgctttaatttcaac

SEQ ID NO: 102059 - DNA, 150 bp, Homo sapiens; identical to SEQ ID NO: 69996
  chr1:8742771-8742921
  Hypo

SEQ ID NO: 102060 - DNA, 30 bp, Homo sapiens; identical to SEQ ID NO: 70036
  chr1:9174714-9174744
  Hypo

SEQ ID NO: 102061 - DNA, 130 bp, Homo sapiens; identical to SEQ ID NO: 70040
  chr1:9243203-9243333
  Hyper

SEQ ID NO: 102062 - DNA, 30 bp, Homo sapiens; identical to SEQ ID NO: 70050
  chr1:9379709-9379739
  Hypo

SEQ ID NO: 102063 - DNA, 19 bp, Homo sapiens
  chr1:9391674-9391693
  Hypo
tcaccgtgcctagccggca

SEQ ID NO: 102064 - DNA, 30 bp, Homo sapiens; identical to SEQ ID NO: 70068
  chr1:9580479-9580509
  Hypo

SEQ ID NO: 102065 - DNA, 83 bp, Homo sapiens; identical to SEQ ID NO: 70069
  chr1:9648276-9648359
  Hypo

SEQ ID NO: 102066 - DNA, 55 bp, Homo sapiens; identical to SEQ ID NO: 70070
  chr1:9661692-9661747
  Hypo

SEQ ID NO: 102067 - DNA, 67 bp, Homo sapiens; identical to SEQ ID NO: 70071
  chr1:9711452-9711519
  Hyper

SEQ ID NO: 102068 - DNA, 916 bp, Homo sapiens; identical to SEQ ID NO: 70072
  chr1:9712098-9713014
  Hyper

SEQ ID NO: 102069 - DNA, 30 bp, Homo sapiens; identical to SEQ ID NO: 70074
  chr1:9740821-9740851
  Hypo

SEQ ID NO: 102070 - DNA, 30 bp, Homo sapiens; identical to SEQ ID NO: 70077
  chr1:9828369-9828399
  Hypo

SEQ ID NO: 102071 - DNA, 30 bp, Homo sapiens; identical to SEQ ID NO: 70091
  chr1:9877098-9877128
  Hypo

SEQ ID NO: 102072 - DNA, 30 bp, Homo sapiens; identical to SEQ ID NO: 70092
  chr1:9897055-9897085
  Hypo

SEQ ID NO: 102073 - DNA, 32 bp, Homo sapiens; identical to SEQ ID NO: 70093
  chr1:9899160-9899192
  Hypo

SEQ ID NO: 102074 - DNA, 30 bp, Homo sapiens; identical to SEQ ID NO: 70094
  chr1:9907045-9907075
  Hypo

SEQ ID NO: 102075 - DNA, 242 bp, Homo sapiens; identical to SEQ ID NO: 67385
  chr1:10057380-10057622
  Hyper

SEQ ID NO: 102076 - DNA, 155 bp, Homo sapiens; identical to SEQ ID NO: 67388
  chr1:10094917-10095072
  Hypo

SEQ ID NO: 102077 - DNA, 86 bp, Homo sapiens; identical to SEQ ID NO: 67392
  chr1:10103747-10103833
  Hypo

SEQ ID NO: 102078 - DNA, 55 bp, Homo sapiens; identical to SEQ ID NO: 67393
  chr1:10166572-10166627
  Hypo

SEQ ID NO: 102079 - DNA, 30 bp, Homo sapiens; identical to SEQ ID NO: 67402
  chr1:10206714-10206744
  Hypo

SEQ ID NO: 102080 - DNA, 23 bp, Homo sapiens
  chr1:10232969-10232992
  Hypo
ttgtgttacaactgccgacagga

SEQ ID NO: 102081 - DNA, 30 bp, Homo sapiens; identical to SEQ ID NO: 67409
  chr1:10493353-10493383
  Hypo

SEQ ID NO: 102082 - DNA, 92 bp, Homo sapiens; identical to SEQ ID NO: 67411
  chr1:10534389-10534481
  Hypo

SEQ ID NO: 102083 - DNA, 35 bp, Homo sapiens; identical to SEQ ID NO: 67415
  chr1:10601654-10601689
  Hypo

SEQ ID NO: 102084 - DNA, 30 bp, Homo sapiens; identical to SEQ ID NO: 67424
  chr1:10783213-10783243
  Hypo

SEQ ID NO: 102085 - DNA, 30 bp, Homo sapiens; identical to SEQ ID NO: 67426
  chr1:10819797-10819827
  Hypo

SEQ ID NO: 102086 - DNA, 169 bp, Homo sapiens; identical to SEQ ID NO: 67428
  chr1:10838656-10838825
  Hypo

SEQ ID NO: 102087 - DNA, 287 bp, Homo sapiens; identical to SEQ ID NO: 67436
  chr1:10854374-10854661
  Hyper

SEQ ID NO: 102088 - DNA, 30 bp, Homo sapiens; identical to SEQ ID NO: 67437
  chr1:10856927-10856957
  Hyper

SEQ ID NO: 102089 - DNA, 621 bp, Homo sapiens
  chr1:10948439-10949060
  Hyper
ctcaagtgcctcattcgcgccctacccaggtccccgcccaggatcacaggatttgtgaccctggccttggccttgtccctaaaaccgtcacccgggtctcccaggcgagaggggcgggaggctccagacgcccagagcccacagcttcccgcccggggcggctgagcggtcccggggagagccctggagagagacagagaaggggaggcgtggagcggggcccccacagcagaagaggggcaggagggaggcgagagggggccggagtctggcccgagacagaaggggcggaggggcgcggggtggacgcggcccgggggtcccagacggggcgcccctccccacccggcccgccctgccccaccccccggcgcgggaggcccctgctccgcagtcggcggcgcccgggggagggggcgctgtgggggctcccggccgcccgccgcctgatgcgtatcgatcgcagcccggggtcgacgcgggggcaccagctgccggcgggcggggcgaccgcacattagcgcggccgggaccactccccggaacgcgggccgggcagcccattagacgcccccgggcggccgggcgaccactgcacgggcggggcgaggctggctccaa

SEQ ID NO: 102090 - DNA, 18 bp, Homo sapiens
  chr1:10959337-10959355
  Hypo
taccctgtagggggccgg

SEQ ID NO: 102091 - DNA, 91 bp, Homo sapiens; identical to SEQ ID NO: 67468
  chr1:11036267-11036358
  Hypo

SEQ ID NO: 102092 - DNA, 104 bp, Homo sapiens; identical to SEQ ID NO: 67481
  chr1:11073857-11073961
  Hypo

SEQ ID NO: 102093 - DNA, 29 bp, Homo sapiens
  chr1:11089945-11089974
  Hypo
gctgggattacaggcgtgagccacacctg

SEQ ID NO: 102094 - DNA, 19 bp, Homo sapiens
  chr1:11091314-11091333
  Hypo
tcatgcctgtaatcccggc

SEQ ID NO: 102095 - DNA, 62 bp, Homo sapiens; identical to SEQ ID NO: 67487
  chr1:11095139-11095201
  Hypo

SEQ ID NO: 102096 - DNA, 30 bp, Homo sapiens; identical to SEQ ID NO: 67489
  chr1:11104788-11104818
  Hypo

SEQ ID NO: 102097 - DNA, 30 bp, Homo sapiens; identical to SEQ ID NO: 67492
  chr1:11115120-11115150
  Hypo

SEQ ID NO: 102098 - DNA, 30 bp, Homo sapiens; identical to SEQ ID NO: 67493
  chr1:11118714-11118744
  Hypo

SEQ ID NO: 102099 - DNA, 42 bp, Homo sapiens; identical to SEQ ID NO: 67500
  chr1:11124188-11124230
  Hypo

SEQ ID NO: 102100 - DNA, 201 bp, Homo sapiens; identical to SEQ ID NO: 67501
  chr1:11131698-11131899
  Hypo

SEQ ID NO: 102101 - DNA, 43 bp, Homo sapiens; identical to SEQ ID NO: 67502
  chr1:11139758-11139801
  Hypo

SEQ ID NO: 102102 - DNA, 30 bp, Homo sapiens; identical to SEQ ID NO: 67503
  chr1:11141247-11141277
  Hypo

SEQ ID NO: 102103 - DNA, 110 bp, Homo sapiens; identical to SEQ ID NO: 67506
  chr1:11193073-11193183
  Hypo

SEQ ID NO: 102104 - DNA, 30 bp, Homo sapiens; identical to SEQ ID NO: 67520
  chr1:11376239-11376269
  Hypo

SEQ ID NO: 102105 - DNA, 30 bp, Homo sapiens; identical to SEQ ID NO: 67521
  chr1:11380230-11380260
  Hyper

SEQ ID NO: 102106 - DNA, 42 bp, Homo sapiens; identical to SEQ ID NO: 67522
  chr1:11417975-11418017
  Hypo

SEQ ID NO: 102107 - DNA, 1524 bp, Homo sapiens
  chr1:11538873-11540397
  Hyper
tgcaggggcggggaccgacccccaggggtcgctgcgccttgcgcttcccccgcccgcgggcgccagggccgggctgaaccaccgcgcggatcggcagggggagcggcggcgaagacagcgccagacagcgggtcccagagaccgcagcgcgcggcgtggcgcagggtctcgccggccactgattcaaggcgcggcggcgcggagcccgagaggcgccagggattgggcggcagcgcggctccggagcctggctcggacacccccgcgacccgtggtaggagcccggacccaaacaaaggcgggcggcgaataaaaggcggcggcggagcggagtgctcgggttgcgagctgaggactgggattcgcgcgcagcttcccgcggtctgcttgccctggagcggagggggagccccagcctcctgcggctccgagaagcttccccctgcgacttccgcgaggagacgagtctgcgcagcgtggtggccgccgccccccgaccctctgcgcactctctcccgcgccggcggctcagcctagccccgttcggccggccgaggtgagtgcacggccgcggggcgccatccgggcttggtctcggggctgggggatgcattgctaggaggagggggaagtcctccgcgccgtccgcaccccgacctgcttggcgccgcgcgcgaagttctctcgctctccagccagcccgggatgcgggcctcggagccccccgggaaagacggtcaggggtggacagaacccaagcttgccctctacgaccgggccccagctccgcaccatctccccgcgggactgcagcattcttggtcggccaaggggagttggatgttggatgtccaggaacggcaaggcttccgacctctggcccctgcttgtcccctctgagggatatctgggtccataaaagttgagcgtcagtctgaagccgcccttggatcgggctctcgcccatgctagagcggagggaggggacagagtaaggctaatgaccccctccacccactccctacctagcgtactcgtgctctcggagggacatttccccgattaacctggctgcaggtccggccggggagggcgcgtgggggcttggggcgggccgggccagcgatggatccgcgcgcgcgagggtccccaggctctgccgagaacgcgaacgagggtggaggtggagtgggcagccgggcagtggcggcgctgagggtcgggaaagattcccagcgcaaggggcgccaagtcccgggagccaaccccaccgccgggagaacttttcccaactccctggggaggccggcagcagggctgggaaggcgcctccttgggggcttctcttctcggcctctgctccacggccggcgccagcttcccgctgtcccccactcactgcgagactgcgcgcaggtctccgtcagcccactccccgggtcagcaccgcggacagcgcctcgcggccgccctagaaactcagaagcccgcgcacacccacagtccacgcgcacactcacaccc

SEQ ID NO: 102108 - DNA, 30 bp, Homo sapiens; identical to SEQ ID NO: 67543
  chr1:11591786-11591816
  Hypo

SEQ ID NO: 102109 - DNA, 99 bp, Homo sapiens; identical to SEQ ID NO: 67544
  chr1:11596484-11596583
  Hypo

SEQ ID NO: 102110 - DNA, 30 bp, Homo sapiens; identical to SEQ ID NO: 26053
  chr1:11611023-11611053
  Hyper

SEQ ID NO: 102111 - DNA, 30 bp, Homo sapiens; identical to SEQ ID NO: 67554
  chr1:11645732-11645762
  Hypo

SEQ ID NO: 102112 - DNA, 30 bp, Homo sapiens; identical to SEQ ID NO: 67559
  chr1:11721254-11721284
  Hypo

SEQ ID NO: 102113 - DNA, 30 bp, Homo sapiens; identical to SEQ ID NO: 67563
  chr1:11740384-11740414
  Hypo

SEQ ID NO: 102114 - DNA, 278 bp, Homo sapiens; identical to SEQ ID NO: 67566
  chr1:11751289-11751567
  Hyper

SEQ ID NO: 102115 - DNA, 210 bp, Homo sapiens; identical to SEQ ID NO: 67567
  chr1:11752448-11752658
  Hyper

SEQ ID NO: 102116 - DNA, 30 bp, Homo sapiens; identical to SEQ ID NO: 67570
  chr1:11780195-11780225
  Hypo

SEQ ID NO: 102117 - DNA, 76 bp, Homo sapiens; identical to SEQ ID NO: 38854
  chr1:11792825-11792901
  Hypo

SEQ ID NO: 102118 - DNA, 36 bp, Homo sapiens; identical to SEQ ID NO: 67575
  chr1:11822246-11822282
  Hyper

SEQ ID NO: 102119 - DNA, 30 bp, Homo sapiens; identical to SEQ ID NO: 67577
  chr1:11839862-11839892
  Hypo

SEQ ID NO: 102120 - DNA, 33 bp, Homo sapiens; identical to SEQ ID NO: 67578
  chr1:11848300-11848333
  Hypo

SEQ ID NO: 102121 - DNA, 83 bp, Homo sapiens; identical to SEQ ID NO: 38855
  chr1:11854720-11854803
  Hypo

SEQ ID NO: 102122 - DNA, 30 bp, Homo sapiens; identical to SEQ ID NO: 67581
  chr1:11861082-11861112
  Hypo

SEQ ID NO: 102123 - DNA, 317 bp, Homo sapiens; identical to SEQ ID NO: 67584
  chr1:11919143-11919460
  Hyper

SEQ ID NO: 102124 - DNA, 85 bp, Homo sapiens; identical to SEQ ID NO: 38856
  chr1:11936694-11936779
  Hypo

SEQ ID NO: 102125 - DNA, 30 bp, Homo sapiens; identical to SEQ ID NO: 67586
  chr1:11938065-11938095
  Hypo

SEQ ID NO: 102126 - DNA, 30 bp, Homo sapiens; identical to SEQ ID NO: 67587
  chr1:11938661-11938691
  Hypo

SEQ ID NO: 102127 - DNA, 30 bp, Homo sapiens; identical to SEQ ID NO: 67588
  chr1:11939935-11939965
  Hypo

SEQ ID NO: 102128 - DNA, 358 bp, Homo sapiens; identical to SEQ ID NO: 67616
  chr1:11958880-11959238
  Hyper

SEQ ID NO: 102129 - DNA, 15 bp, Homo sapiens
  chr1:12041510-12041525
  Hypo
cgctgctgcactcca

SEQ ID NO: 102130 - DNA, 76 bp, Homo sapiens; identical to SEQ ID NO: 38857
  chr1:12078805-12078881
  Hypo

SEQ ID NO: 102131 - DNA, 828 bp, Homo sapiens
  chr1:12123122-12123950
  Hyper
ctactcacatttcaccgtttcttggggcaggagtggaggtgggggcattggaacccccttggggcctcctaatatcctgtgagtccccacctccagggccagaagctgcctgcctccgctccccgcagcccaggtgcggcgggcagcacactccctagagccaggaccactagttccgtcaaatccggggcgggccattcaaacagctaagggaggcgtctcctagtgtgccttttcctgagtcatctctgcacgtgtttgcccccttttttcttcgctgcttgtagctaagtgttcctggaaccaatttgatacgggagaactaaggctgaaacctcggaggaacaaccacttttgaagtgacttcgcggcgtgcgttgggtgcggactaggtggccgcggcgggagtgtgctggagcctgaagtccacgcgcgcggctgagaaccgccgggaccgcacgtgggcgccgcgcgcttcccccgcttcccaggtgggcgccggccgccaggccacctcacgtccggccccggggatgcgcgtcctcctcgccgcgctgggactgctgttcctgggggcgctacgagccttcccacaggtaagcgggtgacgggcgcctggggaggtgccggcggtccagagcccggacagtgtggggtgcgtgggacgcaagggaggacactcctcaccccgttccctgcccagctggagtgagggggcgcgggtgacaagcaggaacaccggaatatgctagcacccacaggtgggaggctggctgaagggctagtggtggggggcgcctccttctcaccccgcgatggctgggactg

SEQ ID NO: 102132 - DNA, 94 bp, Homo sapiens; identical to SEQ ID NO: 67628
  chr1:12175071-12175165
  Hypo

SEQ ID NO: 102133 - DNA, 30 bp, Homo sapiens; identical to SEQ ID NO: 67630
  chr1:12201701-12201731
  Hypo

SEQ ID NO: 102134 - DNA, 20 bp, Homo sapiens
  chr1:12204539-12204559
  Hypo
actcaaagccactgtcggcc

SEQ ID NO: 102135 - DNA, 30 bp, Homo sapiens; identical to SEQ ID NO: 67633
  chr1:12227408-12227438
  Hyper

SEQ ID NO: 102136 - DNA, 81 bp, Homo sapiens; identical to SEQ ID NO: 67634
  chr1:12227644-12227725
  Hyper

SEQ ID NO: 102137 - DNA, 639 bp, Homo sapiens; identical to SEQ ID NO: 67637
  chr1:12251319-12251958
  Hypo

SEQ ID NO: 102138 - DNA, 56 bp, Homo sapiens; identical to SEQ ID NO: 67639
  chr1:12304691-12304747
  Hypo

SEQ ID NO: 102139 - DNA, 30 bp, Homo sapiens; identical to SEQ ID NO: 67649
  chr1:12551925-12551955
  Hypo

SEQ ID NO: 102140 - DNA, 57 bp, Homo sapiens; identical to SEQ ID NO: 67652
  chr1:12655969-12656026
  Hyper

SEQ ID NO: 102141 - DNA, 17 bp, Homo sapiens
  chr1:12805063-12805080
  Hypo
aacgcatgcctcctctg

SEQ ID NO: 102142 - DNA, 824 bp, Homo sapiens
  chr1:13839429-13840253
  Hyper
ctcccccagcctagccggctcggctcacctttgggcagtttggatgcgttctcctggatccaggagaagaggtgggcgaagtcacagtcgcacagccaggggttcccgtccagacgcagggagcgcagcgcgggcagcgcggccagggcggccacgctgaggctgcgcaggttgttgtcgttgagctccagcacctgcagcgactccagggtctcgaaggcgtcctcgtgcacgcccaccaggttgttgttagccaggctaagcttcaccagcctcccggccgagcggaaggcgccggcgcccagctgggtcaagttgttgtagctgaggtcgaggaacacgagcttggccgagccgctgaacgtgccctcctccagcgagcgcagcgagttgttcctgaagtccaggtagaccaggtcgccgtagaagatgaagaagtcctcggggatccgctggatgcggttgccggccaccagcagcttgcgcacgtccagggggaaagggtctggcacgctgggcagcccgcggtcgcggcagtccacggtgtgcgggtcggtgcaggcgcagcccgcggggcacgcgtgcccgggcgcgagcagcagcagaaggctgcagagcccgagcgccgcggcggcgcaggctggggctcgggggcgcatggccggggggcccgcgccggccgcggcgagaaggaagcggctctcggagcgagccctggcgcgggacggcgcggtgaggcactggctgccgggcgcggggagccagagggcggcccgggcggggagggcgtgcgcccgggcgtgcgggggcgatggagcgcggcg

SEQ ID NO: 102143 - DNA, 177 bp, Homo sapiens; identical to SEQ ID NO: 26061
  chr1:13840521-13840698
  Hyper

SEQ ID NO: 102144 - DNA, 77 bp, Homo sapiens; identical to SEQ ID NO: 67668
  chr1:13854197-13854274
  Hypo

SEQ ID NO: 102145 - DNA, 21 bp, Homo sapiens
  chr1:13882124-13882145
  Hypo
aagagtcgcttctttctttgg

SEQ ID NO: 102146 - DNA, 872 bp, Homo sapiens
  chr1:13910055-13910927
  Hyper
taatttttaaaaccccgtttgttgcatgtggtccctttccctcctgttgttgagcagaataaaagcccattttgccagggcccgcagtcctggcggcccccgcagctgcggccctgtaactttaaacctggcctgagatcatcgttttggcgccggccaaacagagcccgagggcgggcctagcgcgcccggacggagaccaccttgcggccgaccccgctcccccgcctcctcgggagagataaatgctgactccgctcggaaagttctcaactgcaaagtttgctgtccggctgcctagggtctgggaagctcgggcaccctccctctccggggctcctgctcccacccctccggcccccccaccgtcgcgctcctccaggctgggcctgtggccgcggtgctttttaattttcccccagctcagaatcttgctgctcggcccccaggagagcaacaactcaacgggaacgatgtggaaggtgtcagctctgctcttcgttttgggaagcgcgtcgctctgggtcctggcagaaggaggtaagacccagcgcaagtggcttcctgccgtcgctgatggggacgagcgagcagagacttgctggaatgcccgggcctggtattcgaggttgtccaggggagcgcgggggagctgagggtgtgtgcgtgtcaggcggctgagcgccggaggaggagaggcagcggcttagtcggtgccaggtcccaaagacgcagctgcgcgggtgtgccgggaggagccccggaatccacaggctgcgaggtgggcagcacagggggcctccctccgagtcggcagcaccagagagatcgggtggaaggttcacagtaggcagccccgcttgctggcagca

SEQ ID NO: 102147 - DNA, 160 bp, Homo sapiens; identical to SEQ ID NO: 67674
  chr1:13936570-13936730
  Hypo

SEQ ID NO: 102148 - DNA, 730 bp, Homo sapiens; identical to SEQ ID NO: 67675
  chr1:14026466-14027196
  Hyper

SEQ ID NO: 102149 - DNA, 116 bp, Homo sapiens; identical to SEQ ID NO: 67676
  chr1:14079260-14079376
  Hypo

SEQ ID NO: 102150 - DNA, 54 bp, Homo sapiens; identical to SEQ ID NO: 67677
  chr1:14125568-14125622
  Hypo

SEQ ID NO: 102151 - DNA, 194 bp, Homo sapiens; identical to SEQ ID NO: 38860
  chr1:14139406-14139600
  Hypo

SEQ ID NO: 102152 - DNA, 928 bp, Homo sapiens; identical to SEQ ID NO: 67679
  chr1:14218911-14219839
  Hyper

SEQ ID NO: 102153 - DNA, 60 bp, Homo sapiens; identical to SEQ ID NO: 14211
  chr1:14730412-14730472
  Hypo

SEQ ID NO: 102154 - DNA, 1700 bp, Homo sapiens
  chr1:14924504-14926204
  Hyper
cctcatctctgtccccgccaatattcagcccggctaagaagcttaggagctggctaaggctgctcctccacctggatgcacacacagggctagggctgtggagaggcgggagcaccagcggcccacgccgaggaagataggcgctccctcctggggtgggcagcgcaggtctggcctgcgggtggggggtggagagtgagaggcacgcggggcaccagctcagctcccctctggggatttcgtactcgcagtttaaggaaccggtggagcacgaactccactcctgagctggcgcaagcgtctcccttccatggagatccaccccggctcccctctgaggccccctttccaagcaccctctcttccgagcacccagcacctccccaaccttagcacggctcggggcaccagttctccagggcgggggctgccccaccgctcaagggaggggacagagggccggcctcggtccaggcgacccctgcccctcgccaggggcgccaccttggccccctcccgactgccgtccgccgcctccgcccccccggggggtgtgtctccgaagtacgggggcgcgggaggccaagggtgcccccagcctccgaccgagaccccctcccgagccggcggcgaatggtaggctccatttaaagagtgcctggtggcgcgcggtgtccttcttggagcagctctcggcgcccgcccgccggggtctcggcgatcgctgctcctcctcctccttctcctcctcttttttctcctccgcctcctccccccgccgcctcgccaccgccgcggctagggctggaggcgccgctgtcattcctgtgccggaggaaccggcgctgccggtgcctgggggtcggggcgcgggcgaagccgggccgcggaggacacaacaggtagagccgggggtgcccggccgcgcgccccccgcgcatcatgcagctctttgtcacctctctcgcccccaggccaaaatcctgagcatgatggaagacaataagcagctcgcgctccgcatcgatggggcggtccagtcggccagccaggaggtgaccaacctgcgagccgaactcacggccaccaaccggagactggcggaactgagcggcggcggcggccccggcccgggcccgggagccgcggccagcgcctcggcggcgggggactcggcggcgacgaacatggagaacccccagcttggagcgcaaggtaggatcgccccggcgcccagggcggaggaaggcgagcagagcacgcccggcctcggaggtggccggggacccggggtcccccacacccggggcgaaatcgctttgcattctggcttgtaaccctttccgcccggcggtggccaccgctgctctccggctgggagttgcaggctgctgtcattcacgaaaacccgagcgcagtgtgcacggggtcacacggtcacaccggccccggccagcctgagcgaggcgcagccggcgggtcccttccggcatcagaaagtgccctttccgtggcaccagccccctagctccgtgcaaacttttcatgccggggccttttccccaccccccgcaggggtgaatggcacagttccccccacttccttaggctccttcccagagagagctccgggctctgccgccgtggttgggatagaggattgcactgctgtgcacttttctccgcggatgccaaatccc

SEQ ID NO: 102155 - DNA, 44 bp, Homo sapiens; identical to SEQ ID NO: 67712
  chr1:15149251-15149295
  Hypo

SEQ ID NO: 102156 - DNA, 85 bp, Homo sapiens; identical to SEQ ID NO: 67730
  chr1:15251189-15251274
  Hyper

SEQ ID NO: 102157 - DNA, 81 bp, Homo sapiens; identical to SEQ ID NO: 26071
  chr1:15251499-15251580
  Hyper

SEQ ID NO: 102158 - DNA, 127 bp, Homo sapiens; identical to SEQ ID NO: 67733
  chr1:15314099-15314226
  Hypo

SEQ ID NO: 102159 - DNA, 85 bp, Homo sapiens; identical to SEQ ID NO: 67770
  chr1:15479692-15479777
  Hyper

SEQ ID NO: 102160 - DNA, 116 bp, Homo sapiens; identical to SEQ ID NO: 67771
  chr1:15480110-15480226
  Hyper

SEQ ID NO: 102161 - DNA, 125 bp, Homo sapiens; identical to SEQ ID NO: 67773
  chr1:15480940-15481065
  Hyper

SEQ ID NO: 102162 - DNA, 181 bp, Homo sapiens; identical to SEQ ID NO: 67795
  chr1:15573580-15573761
  Hyper

SEQ ID NO: 102163 - DNA, 30 bp, Homo sapiens; identical to SEQ ID NO: 67796
  chr1:15573999-15574029
  Hyper

SEQ ID NO: 102164 - DNA, 30 bp, Homo sapiens; identical to SEQ ID NO: 67808
  chr1:15599088-15599118
  Hyper

SEQ ID NO: 102165 - DNA, 30 bp, Homo sapiens; identical to SEQ ID NO: 38862
  chr1:15651124-15651154
  Hypo

SEQ ID NO: 102166 - DNA, 31 bp, Homo sapiens; identical to SEQ ID NO: 67878
  chr1:15714388-15714419
  Hypo

SEQ ID NO: 102167 - DNA, 114 bp, Homo sapiens; identical to SEQ ID NO: 67925
  chr1:15911093-15911207
  Hyper

SEQ ID NO: 102168 - DNA, 30 bp, Homo sapiens; identical to SEQ ID NO: 38863
  chr1:15928989-15929019
  Hypo

SEQ ID NO: 102169 - DNA, 442 bp, Homo sapiens; identical to SEQ ID NO: 67934
  chr1:15929958-15930400
  Hyper

SEQ ID NO: 102170 - DNA, 30 bp, Homo sapiens; identical to SEQ ID NO: 67957
  chr1:16049826-16049856
  Hypo

SEQ ID NO: 102171 - DNA, 73 bp, Homo sapiens; identical to SEQ ID NO: 67962
  chr1:16059027-16059100
  Hypo

SEQ ID NO: 102172 - DNA, 126 bp, Homo sapiens; identical to SEQ ID NO: 67963
  chr1:16059358-16059484
  Hypo

SEQ ID NO: 102173 - DNA, 501 bp, Homo sapiens
  chr1:16085333-16085834
  Hyper
ggcggcccaggtaagcgggccgggtgggtgggggtcgcgtccctccgtccctgtccccggtgcacacaggtgacagcgccggcagtgctcggccggagcctgctcggtcgccagccgggacccccggcgcggcgcccctggaggggcctgcgggtggggggtgcggtcctcacgccctttgcgtcccagtctcttggtctctctccccggagtcggggagtcggcaggtccggggcgagggctcagtgaggccggcggagggccgagtcccagcccgggagcgggagccggggacccggcgcgcagggcggaagctcccgcacaaaaggccggagtcccgcacatggatcgaattaaagctccggcggcgcccagcggtgaccccggcggccgccctgctcggctgcctgcggagggtcccgcgtttccggagcccgggggcgctccaggccccttttcctagccagggtcaggcaaggggagggacgggtcccggggctg

SEQ ID NO: 102174 - DNA, 196 bp, Homo sapiens; identical to SEQ ID NO: 68011
  chr1:16375246-16375442
  Hyper

SEQ ID NO: 102175 - DNA, 34 bp, Homo sapiens; identical to SEQ ID NO: 68013
  chr1:16455953-16455987
  Hypo

SEQ ID NO: 102176 - DNA, 359 bp, Homo sapiens; identical to SEQ ID NO: 68018
  chr1:16475073-16475432
  Hypo

SEQ ID NO: 102177 - DNA, 68 bp, Homo sapiens; identical to SEQ ID NO: 68019
  chr1:16482476-16482544
  Hyper

SEQ ID NO: 102178 - DNA, 30 bp, Homo sapiens; identical to SEQ ID NO: 68020
  chr1:16483726-16483756
  Hypo

SEQ ID NO: 102179 - DNA, 30 bp, Homo sapiens; identical to SEQ ID NO: 68030
  chr1:16532867-16532897
  Hyper

SEQ ID NO: 102180 - DNA, 438 bp, Homo sapiens; identical to SEQ ID NO: 68031
  chr1:16533298-16533736
  Hyper

SEQ ID NO: 102181 - DNA, 257 bp, Homo sapiens; identical to SEQ ID NO: 68032
  chr1:16534506-16534763
  Hypo

SEQ ID NO: 102182 - DNA, 67 bp, Homo sapiens; identical to SEQ ID NO: 38867
  chr1:16535138-16535205
  Hypo

SEQ ID NO: 102183 - DNA, 76 bp, Homo sapiens; identical to SEQ ID NO: 68037
  chr1:16542965-16543041
  Hyper

SEQ ID NO: 102184 - DNA, 404 bp, Homo sapiens
  chr1:16553382-16553786
  Hyper
gctgcggaaggcgcacgaatcctacggccggctgggcacctactgctgcagagggttgcgcaggcgcaggcgtcgccgtggctccgccgagccctcagagtcggggttgggccgggcctggggtcaagggcagggttacggccccctagggagactccgcccctggcggaccccgccccacccctccacatgagacggcgcgcgcaggctcagttcctcggcgtagcacagcggctcccaggcgcgctcagctcggcgaagggtgcggcgctatgccggggtactctcctgggctgctctcccaggaggagagggaaggacccctaagcccctcccctcacgatctcggccgggaggtgacagatccctttttttgttgttgttttgtttttttgagacaacat

SEQ ID NO: 102185 - DNA, 36 bp, Homo sapiens; identical to SEQ ID NO: 68054
  chr1:16693059-16693095
  Hypo

SEQ ID NO: 102186 - DNA, 48 bp, Homo sapiens; identical to SEQ ID NO: 68060
  chr1:16736310-16736358
  Hypo

SEQ ID NO: 102187 - DNA, 277 bp, Homo sapiens; identical to SEQ ID NO: 68073
  chr1:16861465-16861742
  Hyper

SEQ ID NO: 102188 - DNA, 30 bp, Homo sapiens; identical to SEQ ID NO: 26080
  chr1:17033955-17033985
  Hyper

SEQ ID NO: 102189 - DNA, 35 bp, Homo sapiens; identical to SEQ ID NO: 68079
  chr1:17034330-17034365
  Hyper

SEQ ID NO: 102190 - DNA, 30 bp, Homo sapiens; identical to SEQ ID NO: 68096
  chr1:17215966-17215996
  Hyper

SEQ ID NO: 102191 - DNA, 30 bp, Homo sapiens; identical to SEQ ID NO: 68107
  chr1:17416193-17416223
  Hypo

SEQ ID NO: 102192 - DNA, 30 bp, Homo sapiens; identical to SEQ ID NO: 68109
  chr1:17444308-17444338
  Hypo

SEQ ID NO: 102193 - DNA, 44 bp, Homo sapiens; identical to SEQ ID NO: 68110
  chr1:17445869-17445913
  Hyper

SEQ ID NO: 102194 - DNA, 18 bp, Homo sapiens
  chr1:17498377-17498395
  Hypo
gcccggcctctttttttt

SEQ ID NO: 102195 - DNA, 39 bp, Homo sapiens; identical to SEQ ID NO: 68128
  chr1:17679581-17679620
  Hypo

SEQ ID NO: 102196 - DNA, 140 bp, Homo sapiens; identical to SEQ ID NO: 68129
  chr1:17689938-17690078
  Hypo

SEQ ID NO: 102197 - DNA, 86 bp, Homo sapiens; identical to SEQ ID NO: 68136
  chr1:17757487-17757573
  Hypo

SEQ ID NO: 102198 - DNA, 37 bp, Homo sapiens; identical to SEQ ID NO: 68137
  chr1:17787462-17787499
  Hypo

SEQ ID NO: 102199 - DNA, 93 bp, Homo sapiens; identical to SEQ ID NO: 68142
  chr1:17865877-17865970
  Hyper

SEQ ID NO: 102200 - DNA, 179 bp, Homo sapiens; identical to SEQ ID NO: 68172
  chr1:18033374-18033553
  Hypo

SEQ ID NO: 102201 - DNA, 173 bp, Homo sapiens; identical to SEQ ID NO: 68190
  chr1:18152682-18152855
  Hyper

SEQ ID NO: 102202 - DNA, 32 bp, Homo sapiens; identical to SEQ ID NO: 68214
  chr1:18387093-18387125
  Hypo

SEQ ID NO: 102203 - DNA, 51 bp, Homo sapiens; identical to SEQ ID NO: 68217
  chr1:18433884-18433935
  Hyper

SEQ ID NO: 102204 - DNA, 507 bp, Homo sapiens
  chr1:18434309-18434816
  Hyper
ggcgctgcagccgatcggactctgggccgcggtgggcaccgcgcgcagctagggagccgagaaccgcggcgagccccgaggacgcccagagcgcgagggtcgctgcgcctcgcagagccggagccgagtcgagccgggcgcccgggctgcctggccgcggcggcatgggggcgcccccgcggctctccgcgctgcccgccaccgcctcggccagtggccggaggcaggagcgcgtctgagcccatggcgaggggacccgccgccaccgcctccacccccgccgccccgccaccgccgccagctcccgggcaccatgcgaaccgccccgagcctccgccgctgcgtctgcctgctgctcgccgcgatcctggacctggcgcgcggtgagtgcgcgggcgcctggcgggagccgagcggtgaacgtgcgcggggacggggtgccgggggagggcgctggccggggtcgctccgagaggctcgggctacgagcaccggtcctgcccgggg

SEQ ID NO: 102205 - DNA, 98 bp, Homo sapiens; identical to SEQ ID NO: 68220
  chr1:18435431-18435529
  Hyper

SEQ ID NO: 102206 - DNA, 1511 bp, Homo sapiens
  chr1:18436334-18437845
  Hyper
ggacattgcagggggcgggggttggaggctggggacctaaggtaagcacccctttccctgggaatgcgcagaacagagagacgcggcagggtgaaggagaggactgatgagaagggcttgttgggaaaccctggctccgtcaggaccccaccctgcgagctctccctggaacccgggagcagggttcttctggctgcccggctgcagagagctgacccggcatcctgacgcctcaaatccctttgcccgcctctgcgggctgcgggaggcgggggttggcgtgcctgagggtgagcgcatctgggccggtgcagccagcgcggcctcggagctccgctgctcaggatgaaggaagagcgcagacgcggatcgcgaatgggaaactttccgcgtctggggcgcagagggagatccgaggcagccgggagccctctcttctccgcagaggagagcacacgagggtggggtccctccttcctccttccaagtctgtgcccagaatggggggcggggtgcgagaagagtccgtgagagacgcaagaggcgggctgtgccggaggagggcgcccttcctggaggtggccgagagaggtgcacctggcagcggctttgcagggccacctgcctccgagggcgcagagaggagcaacccgcgccggccttcacgaacgtactggcggtcactgctcggggaggggcacggccagaacgccctcgccggttctgcccctttgggtggcagagcaagggtgcccgacgctagagagtcgggtctggcaggaggaaggaggccgctgcccctcgcactggctgggccggaagtccttgccctggctccccacttcccagaatcagaccctccaaaggagaaacccacatttctcgggactcctgggcgtgtcctggggcgttttcaactcctccagcccccgtgaaccgtgcctgggcacttctgggaagtcctgcactggagcctgtgcagtggcgccgggctggggatggaggagtggtccttagccgctgttcagccctgggaaacgttccgctgagagcagggtgggggcagccccagttaggggtagcccacggccccagccgggggtctccgggattgcgcgggcggaggtgggcggccctgcgggttctcgggttctcgggttctctgtctccgcagccgcgtgtcagcaggtggatgggatggaggggctgtctccgctaggccgccgcaaccgcaacgccgagactgcgggggctgtgcgcgcgcgagcgggtgtgacgactttatatatttatcctcccttcacacgcccccttcccactgggcggggcctctggcgcggcagggtttcttctccagccccaactgggggagttaagggccctaatcccttgcaggctgcctcgcccatgcccctccagcgtggccccgcccctagccataaactccacccctcttccaccccataaccgctctgcaaatgggagtttttcattttcgtgttttaagtgca

SEQ ID NO: 102207 - DNA, 30 bp, Homo sapiens; identical to SEQ ID NO: 68225
  chr1:18448183-18448213
  Hypo

SEQ ID NO: 102208 - DNA, 122 bp, Homo sapiens; identical to SEQ ID NO: 68239
  chr1:18703326-18703448
  Hypo

SEQ ID NO: 102209 - DNA, 30 bp, Homo sapiens; identical to SEQ ID NO: 68243
  chr1:18801486-18801516
  Hypo

SEQ ID NO: 102210 - DNA, 30 bp, Homo sapiens; identical to SEQ ID NO: 38873
  chr1:18818951-18818981
  Hypo

SEQ ID NO: 102211 - DNA, 44 bp, Homo sapiens; identical to SEQ ID NO: 68246
  chr1:18956211-18956255
  Hyper

SEQ ID NO: 102212 - DNA, 1143 bp, Homo sapiens
  chr1:18956470-18957613
  Hyper
tgtatcaagtcttgacgggctccctccctcccatttcccacctctttgggcccccagatcctcacaccagcaccaactccctgtaaacccaactacctgctggaaaggagttataggcccggcctgggggcctgaggaggacggcggcggctggagacgtctgcacggggcggaactggaaggggaggaagaaacctgtgcctagcacttggcagacccactttgccaagcctcggaaccagatacggttactgggggcttctcagagcggcaggaaggtagagtaagaaccggacaccggggctctgacattacacagaaaaggtcagaattcctcccttcaagtcaccctaggccggttcccggggagcctcactggaggaatttcagagggtgtaagacgagggagaagatgagaaatagggcggactctggccctcggaggccagagaaaaggcgagactccagagaggcgccggacccgaggcagacattcccatacagccgggactccgagagcagccgtgggcgacctgggggccggggactcggcggatccggcccattcatcaaaggaaggcactgggacaaagttggccccctccccttctcccccagcccccaactcgccgggatcggctccctctcttttcacggcggttcaaattctcccccaaaacgaggtcgagccggggattagaaaagagggaaaaaaatattcgttggcgatttcttttcgttattggtcctccgctcccttgcgccctggcccccttccctcctcatgaataaaagaaaagtccgaacctatcagatcgcgctcactgcctcctcctcctcctcctcctcctcctcctcgtacttcggtgaacacttttgcacaacttacccagctgatcactcgcgccccctcgcttttccatttctctttccccaaccccgtcaccccctgtctcctccgtccagccctgaaacccgaggaggctccttcttccgtctgtccccgggtctcctaggggacggggctgtgaaagctggtgtggagggagaagcgagtgtggtccggagaaagaaggcgtggagaagagggagggagcgagagcgagagaataaatatataaataaatacgagaacgaaatcca

SEQ ID NO: 102213 - DNA, 444 bp, Homo sapiens
  chr1:18957985-18958429
  Hyper
ttaaaaaaaagaagacgaagaagacggaaagaaagagatcgcagcaggggtgaagggagcggacgggaagcgatttttgccgactttggattcgtccccggcgtgcgcaagaatggcggcccttcccggcacggtaccgagaatgatgcggccggctccggggcagaactacccccgcacgggattccctttggaaggtaagaacgcccaggctggcctcgccgcgactccgccgcccggaactcggggtccttggagaggctgcggtctccaggggacggtggcggcgccggcgatagcagagggatcccgttctcttctgggtcccagtccgggcgcggaacccagggagtttctgggacccatacttgtccgcttctgcgtgggtttcactgcccggcggccttcgtttcgcaggtcgctagctgccggtctttacccgca

SEQ ID NO: 102214 - DNA, 1118 bp, Homo sapiens
  chr1:18958829-18959947
  Hyper
tagagaacctctaaacggcgagaggggcacggcaatgtccaaacgagaagaaagagctgattttgtaaagcgtccttcctaaacatccagcgcccgcccggggagacccgataggacgggcggcggcgaaccgggtcctggctggagaaaaggctgggagcgcacagcggagagacccgctcctgtgtttttgttctgttttctttttaaactaatggaaggcctcaacctgtcactgagggatcatttggcttctgagggtaggtagcctagggtgtcacagagaagtcattagaaatatgtgcgactttttttttttaaattactcttcctgtgatcgtttgagtccctggcgcgtgaggaaggggagaggaggcagggagggggtgggtgggctggcagcctgcgatccgggaggagctcccttgggcagcgagacggcgccgggtccctgaattagacagaggcgaagagagcggctccgtgatcaagtgcgcgccggcagccacgcaggcgggagagcgcgcaaacccggggatttgcagtggcactctcctgtagcgaatgcaagtaaaacaggcggctgaggacgcgcggcggattagaacaatatttgcccaacatgacgcagaatactgaggagagccgagtgccggtcgctaaagaggctcttgaatataaagttgggcgctcgagagctcttgagcgctaatggcatatcccgccacggagaccgagtgactccgactttgcgacgcacgatttctgattaaatccgagagtggcttcagacaccgacttttacaaagagaggtggggggaccgggagagcgagggagggggcggtaggaacggcccagcagcggagcctcttctcgcctcctccctttcaattacagtcagctccctccactcccgcggctgtgaaatcgttctaatcttccagatctccgcagccgctgagtccccaaattggggggatcgaggccggattagtgcgctgggtgtccccccaatcttctgtgaggaaattgtgtagactttgcattaaggcaaccaggcgttctcccctccccagcacacaccagtgatgcctgtcttcccggttcccaaagtca

SEQ ID NO: 102215 - DNA, 170 bp, Homo sapiens; identical to SEQ ID NO: 68254
  chr1:18960861-18961031
  Hyper

SEQ ID NO: 102216 - DNA, 1220 bp, Homo sapiens; identical to SEQ ID NO: 68255
  chr1:18962727-18963947
  Hyper

SEQ ID NO: 102217 - DNA, 231 bp, Homo sapiens; identical to SEQ ID NO: 68256
  chr1:18964253-18964484
  Hyper

SEQ ID NO: 102218 - DNA, 137 bp, Homo sapiens; identical to SEQ ID NO: 68257
  chr1:18965943-18966080
  Hyper

SEQ ID NO: 102219 - DNA, 30 bp, Homo sapiens; identical to SEQ ID NO: 68258
  chr1:18966326-18966356
  Hyper

SEQ ID NO: 102220 - DNA, 41 bp, Homo sapiens; identical to SEQ ID NO: 26100
  chr1:18966656-18966697
  Hyper

SEQ ID NO: 102221 - DNA, 129 bp, Homo sapiens; identical to SEQ ID NO: 26101
  chr1:18968003-18968132
  Hyper

SEQ ID NO: 102222 - DNA, 1483 bp, Homo sapiens; identical to SEQ ID NO: 68261
  chr1:18969348-18970831
  Hyper

SEQ ID NO: 102223 - DNA, 367 bp, Homo sapiens; identical to SEQ ID NO: 68262
  chr1:18971716-18972083
  Hyper

SEQ ID NO: 102224 - DNA, 30 bp, Homo sapiens; identical to SEQ ID NO: 68263
  chr1:18972559-18972589
  Hyper

SEQ ID NO: 102225 - DNA, 163 bp, Homo sapiens; identical to SEQ ID NO: 68264
  chr1:18972950-18973113
  Hyper

SEQ ID NO: 102226 - DNA, 73 bp, Homo sapiens; identical to SEQ ID NO: 26105
  chr1:18973661-18973734
  Hyper

SEQ ID NO: 102227 - DNA, 30 bp, Homo sapiens; identical to SEQ ID NO: 68266
  chr1:18978567-18978597
  Hyper

SEQ ID NO: 102228 - DNA, 38 bp, Homo sapiens; identical to SEQ ID NO: 68267
  chr1:19020254-19020292
  Hyper

SEQ ID NO: 102229 - DNA, 91 bp, Homo sapiens
  chr1:19043052-19043143
  Hyper
cctcttttctcccttcgcgccccatttcccttcgccccctgtgccaccacccccttgctcaccgtctccctgatcgcgtcataaccctgag

SEQ ID NO: 102230 - DNA, 555 bp, Homo sapiens
  chr1:19043352-19043907
  Hyper
cctctcccccacccccgtgtcccctttccgaattcctccgctgctggtgggctccgaggcagggaccgggcgcgggctcccgaggccgggcggacccaagtccagggcgggggttggggcggcggccggagcggggatcgggtctggggggatccgcgcggccgcccctccccgcgctccgccgccgccgccgtcgccgccgcgcctttgatccatggcccgaggccgcctgacagtggaaaatgcggggagacaaaaccactcagtcaaagtgattcccaacaactgtctccccgagataaggacgccctcgggctcggcggcctgcttaattcccgctgcccgggcctgggatcccgagcagccgcgcgcctggccgccccccggactgcggagccgccgctcgctcgtccagtcttggtcgcggggcctcggccgtctcgggacggggcaggcggcgaagggacgggcagccggtaagcaagacccttgctgcctgctggagagagaggctccctcgggagcgccccgttccccacccgttcattagttcat

SEQ ID NO: 102231 - DNA, 242 bp, Homo sapiens; identical to SEQ ID NO: 68280
  chr1:19075291-19075533
  Hypo

SEQ ID NO: 102232 - DNA, 30 bp, Homo sapiens; identical to SEQ ID NO: 68282
  chr1:19119663-19119693
  Hypo

SEQ ID NO: 102233 - DNA, 30 bp, Homo sapiens; identical to SEQ ID NO: 68286
  chr1:19147954-19147984
  Hypo

SEQ ID NO: 102234 - DNA, 30 bp, Homo sapiens; identical to SEQ ID NO: 68289
  chr1:19204137-19204167
  Hypo

SEQ ID NO: 102235 - DNA, 124 bp, Homo sapiens; identical to SEQ ID NO: 68290
  chr1:19213653-19213777
  Hypo

SEQ ID NO: 102236 - DNA, 103 bp, Homo sapiens; identical to SEQ ID NO: 38875
  chr1:19676719-19676822
  Hypo

SEQ ID NO: 102237 - DNA, 53 bp, Homo sapiens; identical to SEQ ID NO: 68307
  chr1:19683185-19683238
  Hypo

SEQ ID NO: 102238 - DNA, 30 bp, Homo sapiens; identical to SEQ ID NO: 68309
  chr1:19739205-19739235
  Hypo

SEQ ID NO: 102239 - DNA, 23 bp, Homo sapiens
  chr1:19980869-19980892
  Hypo
tgggtgaccgagtgagatctttt

SEQ ID NO: 102240 - DNA, 391 bp, Homo sapiens
  chr1:19992140-19992531
  Hyper
cgcggtctgttctcacggacggtccccgtccagcctgcgcttcgccggggccctcatctgctttcccgccaccctatcactcccttgccgtccaccctcggtcctcatggtcccagagccgggcccaaccgccaatagcaccccggcctggggggcagggccgccgtcggccccggggggcagcggctgggtggcggccgcgctgtgcgtggtcatcgcgctgacggcggcggccaactcgctgctgatcgcgctcatctgcactcagcccgcgctgcgcaacacgtccaacttcttcctggtgtcgctcttcacgtctgacctgatggtggggctggtggtgatgccgccggccatgctgaacgcgctgtacgggcgctgggtgctggcg

SEQ ID NO: 102241 - DNA, 28 bp, Homo sapiens
  chr1:20127443-20127471
  Hypo
gcgtgagccaccgcgcagccccaactag

SEQ ID NO: 102242 - DNA, 30 bp, Homo sapiens; identical to SEQ ID NO: 68379
  chr1:20205294-20205324
  Hypo

SEQ ID NO: 102243 - DNA, 30 bp, Homo sapiens; identical to SEQ ID NO: 68385
  chr1:20247063-20247093
  Hypo

SEQ ID NO: 102244 - DNA, 30 bp, Homo sapiens; identical to SEQ ID NO: 68417
  chr1:20416390-20416420
  Hypo

SEQ ID NO: 102245 - DNA, 25 bp, Homo sapiens
  chr1:20492314-20492339
  Hypo
tgtgcgcgcgcgcatgtgtgtttag

SEQ ID NO: 102246 - DNA, 30 bp, Homo sapiens; identical to SEQ ID NO: 68434
  chr1:20498645-20498675
  Hypo

SEQ ID NO: 102247 - DNA, 454 bp, Homo sapiens
  chr1:20512345-20512799
  Hyper
agagagaaacagaggcggtgacgctaggaagaggaggagagaaggaggccgcgggtccctgtcgcctccaggccaggcaatccactccaggctcgcaatccaccgacctggagttcacggcctccgccctcctggcccagcggcccccacccgaccccacccgaccccacccgacccaggccggttccggtcacgccggaagcacgtggccccccaccctgcggcgttgcccgggagaccagggttgtttaccagcaggacagagcccgggcgcaggcggcggatggagcggaacggctaggtgagagcggctgcccgatcccgcggcctgcccttggcctccgccaggcctggaaggggccgggggaggccagtccccgagaccccagcacatcacccgggagggcctccccagacccagcccgggggacgcaaaccccgggagacaggcgag

SEQ ID NO: 102248 - DNA, 29 bp, Homo sapiens
  chr1:20534652-20534681
  Hypo
acagagtgagaccccgcatccaaaagaaa

SEQ ID NO: 102249 - DNA, 413 bp, Homo sapiens; identical to SEQ ID NO: 26111
  chr1:20618140-20618553
  Hyper

SEQ ID NO: 102250 - DNA, 267 bp, Homo sapiens
  chr1:20669698-20669965
  Hyper
ggtcaaaggcctgcacgacagccaacgcctgcagtgggaggtgagcttcgagctggggacccctggaccggagcggggcggcgcgcaggatgccgacctatggagcgagaccttccaccacctggcggcccgcgccatcatccgcgacttcgagcagctggcggagcgcgagggcgagatcgagcagggtgagcgccacggaactgcgcccctcccgcggacggcctccggaggacagccccgctccacagccgctcccccttcccc

SEQ ID NO: 102251 - DNA, 105 bp, Homo sapiens; identical to SEQ ID NO: 68451
  chr1:20692819-20692924
  Hyper

SEQ ID NO: 102252 - DNA, 30 bp, Homo sapiens; identical to SEQ ID NO: 68452
  chr1:20693939-20693969
  Hyper

SEQ ID NO: 102253 - DNA, 336 bp, Homo sapiens
  chr1:20810594-20810930
  Hyper
accccaggtaagtcccgagcgcagctccggtgggcaaggctaggtgcggagatgagcggaaccaggaggggacgccaaaaccggttcccacgacgcgcagcgggtgggggttagggcctggcctgggcgggcgccccctcctgcgcgccctctcccagccgctggccgactgactcggccgccccgcgctccccgctgccgcagaggtcagagcctcccttcgctgcctgccagggacacatgccgtaacctcggcctctcttaccgtctcgacttagcctcgcctttctcagtccctccatcgtccctcggcgcgacggccggcagccgatcgag

SEQ ID NO: 102254 - DNA, 469 bp, Homo sapiens; identical to SEQ ID NO: 68482
  chr1:20811286-20811755
  Hyper

SEQ ID NO: 102255 - DNA, 175 bp, Homo sapiens; identical to SEQ ID NO: 68487
  chr1:20878485-20878660
  Hyper

SEQ ID NO: 102256 - DNA, 1732 bp, Homo sapiens
  chr1:20878905-20880637
  Hyper
gcctgtgcagggtcccgggcagcgcgagcctgcgtggggggaggggagaagagggcaaggggaggggacaagagagctagcggtcccgcccggtgatgtaggcagcccggggaggtggagccgcgacgcctgaaggagtccccaccgcagccgcgctctcggtctgccccactaagcagccgccagcggctccggcgacccaaattgcggcggcagggaccgcggaaatcccaccgtttgggcttggtggacgtccagcccacctcacccccagccccggcccctcctcgcttcccagacggctggagacactcccgggaaaagcggtcctcagccactcggccgccgtccgcacctcggctgctggcccggctgggcaccgggcatctgcgaagctagccctgcctggcactgggcatctccaggcaacgactgtccccggccctgcccagcttctcgcgactccagggcggtggacttctgcgcgccttccctcccccggtctcccgacaggacgccggtgagctccctgcgcccccagcccctttcgccgccgccgcgatgctgccctggagacgtaacaaattcgtgctggtggaggacgaggccaagtgcaaggcgaagagcctgagtccggggctcgcctacacgtcgctgctctccagcttcctgcgctcctgcccggacctgctgcccgactggccgctggagcgcttgggccgtgtgttccgcagccggcgccagaaagtggagctcaacaaggaggacccgacctacaccgtgtggtacctgggcaacgccgtcaccctgcacgccaagggcgacggctgcaccgacgacgccgtgggcaagatctgggctcgctgcgggcctggcgggggcactaagatgaagctgacgctggggccgcacggcatccgcatgcagccgtgcgagcgcagcgccgccgggggttcggggggccgcaggccggcgcacgcctacctgctgccgcgcatcacctactgcacggcggacgggcgccacccgcgcgtcttcgcctgggtctaccgccaccaggcgcgccacaaggccgtggtgctgcgctgccacgctgtgctgctggcgcgggcgcacaaggcgcgcgccctggcccgcctgctccgccagaccgcgctggcggccttcagcgacttcaagcgcctgcagcgccagagcgacgcgcgccacgtgcgccagcagcatctccgcgctgggggcgccgccgcctcggtgccccgcgccccactgcgccgcctgctcaatgccaagtgcgcctaccggccgccgccgagcgagcgcagccgcggggcgccgcgcctcagcagcatccaggaggaggacgaggaggaggaggaggacgacgcggaggagcaagagggaggagtcccccagcgcgagcggccggaggtgctcagcctggcccgggagctgaggacgtgcagcctgcggggcgccccggcgcccccgccgcccgcgcagccccgccgctggaaggccggccccagggagcgggcgggccaggcgcgctgagagccgaaggacaggactcgcagccccaggcccgacccgccagactcacagcctccaaccccggccctgcccgcttcggctgccccggcccccggcccgtgtctcccccgtggtctccgtgttgtccgccccgccgcctcattttggctcagggtgatgcctgatacgcccttggttattg

SEQ ID NO: 102257 - DNA, 25 bp, Homo sapiens
  chr1:20897067-20897092
  Hypo
ggattacagacgtgagtcacccatc

SEQ ID NO: 102258 - DNA, 93 bp, Homo sapiens; identical to SEQ ID NO: 68495
  chr1:20916163-20916256
  Hyper

SEQ ID NO: 102259 - DNA, 30 bp, Homo sapiens; identical to SEQ ID NO: 68506
  chr1:21024801-21024831
  Hypo

SEQ ID NO: 102260 - DNA, 30 bp, Homo sapiens; identical to SEQ ID NO: 68507
  chr1:21026148-21026178
  Hypo

SEQ ID NO: 102261 - DNA, 30 bp, Homo sapiens; identical to SEQ ID NO: 68508
  chr1:21030592-21030622
  Hypo

SEQ ID NO: 102262 - DNA, 36 bp, Homo sapiens; identical to SEQ ID NO: 68512
  chr1:21042027-21042063
  Hypo

SEQ ID NO: 102263 - DNA, 337 bp, Homo sapiens; identical to SEQ ID NO: 68513
  chr1:21042750-21043087
  Hypo

SEQ ID NO: 102264 - DNA, 219 bp, Homo sapiens; identical to SEQ ID NO: 68514
  chr1:21044015-21044234
  Hyper

SEQ ID NO: 102265 - DNA, 154 bp, Homo sapiens; identical to SEQ ID NO: 68516
  chr1:21058263-21058417
  Hyper

SEQ ID NO: 102266 - DNA, 164 bp, Homo sapiens; identical to SEQ ID NO: 68555
  chr1:21523130-21523294
  Hypo

SEQ ID NO: 102267 - DNA, 51 bp, Homo sapiens; identical to SEQ ID NO: 68558
  chr1:21568327-21568378
  Hypo

SEQ ID NO: 102268 - DNA, 83 bp, Homo sapiens; identical to SEQ ID NO: 68559
  chr1:21573351-21573434
  Hypo

SEQ ID NO: 102269 - DNA, 294 bp, Homo sapiens; identical to SEQ ID NO: 68560
  chr1:21573828-21574122
  Hypo

SEQ ID NO: 102270 - DNA, 141 bp, Homo sapiens; identical to SEQ ID NO: 68562
  chr1:21586789-21586930
  Hypo

SEQ ID NO: 102271 - DNA, 30 bp, Homo sapiens; identical to SEQ ID NO: 68563
  chr1:21594515-21594545
  Hypo

SEQ ID NO: 102272 - DNA, 40 bp, Homo sapiens; identical to SEQ ID NO: 68564
  chr1:21611198-21611238
  Hypo

SEQ ID NO: 102273 - DNA, 35 bp, Homo sapiens; identical to SEQ ID NO: 68567
  chr1:21682446-21682481
  Hypo

SEQ ID NO: 102274 - DNA, 146 bp, Homo sapiens; identical to SEQ ID NO: 68579
  chr1:21754473-21754619
  Hyper

SEQ ID NO: 102275 - DNA, 40 bp, Homo sapiens; identical to SEQ ID NO: 68581
  chr1:21831562-21831602
  Hypo

SEQ ID NO: 102276 - DNA, 254 bp, Homo sapiens; identical to SEQ ID NO: 68583
  chr1:21835380-21835634
  Hyper

SEQ ID NO: 102277 - DNA, 505 bp, Homo sapiens; identical to SEQ ID NO: 68584
  chr1:21835915-21836420
  Hyper

SEQ ID NO: 102278 - DNA, 42 bp, Homo sapiens; identical to SEQ ID NO: 68586
  chr1:21846323-21846365
  Hypo

SEQ ID NO: 102279 - DNA, 30 bp, Homo sapiens; identical to SEQ ID NO: 68591
  chr1:21934551-21934581
  Hyper

SEQ ID NO: 102280 - DNA, 37 bp, Homo sapiens; identical to SEQ ID NO: 68593
  chr1:21948897-21948934
  Hyper

SEQ ID NO: 102281 - DNA, 30 bp, Homo sapiens; identical to SEQ ID NO: 68594
  chr1:21949180-21949210
  Hyper

SEQ ID NO: 102282 - DNA, 315 bp, Homo sapiens; identical to SEQ ID NO: 68595
  chr1:21996075-21996390
  Hyper

SEQ ID NO: 102283 - DNA, 120 bp, Homo sapiens; identical to SEQ ID NO: 38884
  chr1:22092109-22092229
  Hypo

SEQ ID NO: 102284 - DNA, 635 bp, Homo sapiens
  chr1:22140673-22141308
  Hyper
ggtttcgaataagggattgtagatttgaattaaattaaattaaatcatttaatccttacaatcattctgagattgattaatcatccccattttaccgatgaggaaaatgaggctcagagagggcgagtaactcgcttgggatcacacagcgggcaggggacagagtagagttcggggtcgcgccgcgcggctccagtttccgtgccttccgctgcagccgacctggcggaactgtgcgggcagacgtggcagggggacgggctgctgctgcgctcgcacgccgcatcgcgcaggttctacttcgtggctccggacaccgactgcgggctctgggtgcaggcggcagcccccggcgaccggatccgcttccagttccgcttcttcctggtctacagcctgacccccgcgcccccggcgctcaacacctcctccccggccccggccgacccgtgcgcccccggctcctacctgcagttctacgagggcccgccgggggcgccccggcccctggggtccccactgtgcggcctgaacatcccggtgcctgtggcatcctccggaccctttctaggcctgcgcctggtcacgagaggccgccagccccgcgtggacttcgtgggcgaagtcacctcttt

SEQ ID NO: 102285 - DNA, 179 bp, Homo sapiens; identical to SEQ ID NO: 68625
  chr1:22333829-22334008
  Hypo

SEQ ID NO: 102286 - DNA, 208 bp, Homo sapiens; identical to SEQ ID NO: 68628
  chr1:22349452-22349660
  Hypo

SEQ ID NO: 102287 - DNA, 41 bp, Homo sapiens; identical to SEQ ID NO: 68633
  chr1:22378609-22378650
  Hypo

SEQ ID NO: 102288 - DNA, 119 bp, Homo sapiens; identical to SEQ ID NO: 38886
  chr1:22447958-22448077
  Hypo

SEQ ID NO: 102289 - DNA, 37 bp, Homo sapiens; identical to SEQ ID NO: 68653
  chr1:22468804-22468841
  Hyper

SEQ ID NO: 102290 - DNA, 30 bp, Homo sapiens; identical to SEQ ID NO: 68697
  chr1:22710484-22710514
  Hypo

SEQ ID NO: 102291 - DNA, 184 bp, Homo sapiens; identical to SEQ ID NO: 38887
  chr1:22777513-22777697
  Hypo

SEQ ID NO: 102292 - DNA, 814 bp, Homo sapiens
  chr1:22889595-22890409
  Hyper
cggagtgtgtcaccacgcgaagcactcggtgttggggtcatgcgggcaggagcgagcatgcggtggatgtgcggcccgcgcgtgtgtccacagagggaatccctgggtgggtctggtcctggtgtcgccgggacgtcccgatggtggcttcgcgcactggggccctgagccctgagtccaagtgcgcagcgcggggcgcgcccccgaaggtgcccgccgggggagtgtgggcgtgcgcacgtgcggcggcggtggccgcgggccgggtggccgcggtgcgggctccgtgtcccccacccccccgcctcggtgctgattggctcggcgccgtgacgggccggcccccgcccggggcggcggcggcggcggcgggcgcgggtgcccgcgtgtgcgctgggagccgcgtgtgcgccggggtgtgcgcccggccgggtgtgcggagagcgagggagcgcgctccctcccgacgcgcgggccgcagcggccaagcccgagggtgcgtggcgcccccgcccgcccggcccggcccggccatggcccccgcccggggccgcctgccccctgcgctctgggtcgtcacggccgcggcggcggcggccacctgcgtgtccgcggcgcgcggcgaaggtgagcggcggcggcggggcggggcaggggcggccgaggggcgcggggcgcggcgcgcgctgcctgcggctcaacttcctttgcatggaccctgagctccaaggcggccgggatccctcggcccggggggcggggtggcaccgcggaagagacccgggattaagggacagagcggtggagatgggaa

SEQ ID NO: 102293 - DNA, 30 bp, Homo sapiens; identical to SEQ ID NO: 68783
  chr1:22893250-22893280
  Hypo

SEQ ID NO: 102294 - DNA, 193 bp, Homo sapiens; identical to SEQ ID NO: 68784
  chr1:22896425-22896618
  Hypo

SEQ ID NO: 102295 - DNA, 154 bp, Homo sapiens; identical to SEQ ID NO: 68785
  chr1:22900779-22900933
  Hypo

SEQ ID NO: 102296 - DNA, 107 bp, Homo sapiens; identical to SEQ ID NO: 68786
  chr1:22902850-22902957
  Hypo

SEQ ID NO: 102297 - DNA, 78 bp, Homo sapiens; identical to SEQ ID NO: 68787
  chr1:22903278-22903356
  Hypo

SEQ ID NO: 102298 - DNA, 222 bp, Homo sapiens; identical to SEQ ID NO: 68788
  chr1:22927359-22927581
  Hypo

SEQ ID NO: 102299 - DNA, 48 bp, Homo sapiens; identical to SEQ ID NO: 26132
  chr1:22933907-22933955
  Hyper

SEQ ID NO: 102300 - DNA, 73 bp, Homo sapiens; identical to SEQ ID NO: 26133
  chr1:23038177-23038250
  Hyper

SEQ ID NO: 102301 - DNA, 30 bp, Homo sapiens; identical to SEQ ID NO: 68909
  chr1:23693485-23693515
  Hypo

SEQ ID NO: 102302 - DNA, 33 bp, Homo sapiens; identical to SEQ ID NO: 38890
  chr1:23694078-23694111
  Hypo

SEQ ID NO: 102303 - DNA, 33 bp, Homo sapiens; identical to SEQ ID NO: 68911
  chr1:23704242-23704275
  Hypo

SEQ ID NO: 102304 - DNA, 299 bp, Homo sapiens; identical to SEQ ID NO: 68917
  chr1:23748862-23749161
  Hyper

SEQ ID NO: 102305 - DNA, 74 bp, Homo sapiens; identical to SEQ ID NO: 68919
  chr1:23750737-23750811
  Hyper

SEQ ID NO: 102306 - DNA, 88 bp, Homo sapiens; identical to SEQ ID NO: 68929
  chr1:23833064-23833152
  Hypo

SEQ ID NO: 102307 - DNA, 84 bp, Homo sapiens; identical to SEQ ID NO: 68931
  chr1:23859450-23859534
  Hypo

SEQ ID NO: 102308 - DNA, 72 bp, Homo sapiens; identical to SEQ ID NO: 68932
  chr1:23884932-23885004
  Hyper

SEQ ID NO: 102309 - DNA, 41 bp, Homo sapiens; identical to SEQ ID NO: 68943
  chr1:24017587-24017628
  Hypo

SEQ ID NO: 102310 - DNA, 206 bp, Homo sapiens; identical to SEQ ID NO: 68959
  chr1:24119111-24119317
  Hypo

SEQ ID NO: 102311 - DNA, 17 bp, Homo sapiens
  chr1:24246049-24246066
  Hypo
atttattttttaagacg

SEQ ID NO: 102312 - DNA, 21 bp, Homo sapiens
  chr1:24426643-24426664
  Hypo
ccaccgcgcctggcctccagt

SEQ ID NO: 102313 - DNA, 47 bp, Homo sapiens; identical to SEQ ID NO: 69012
  chr1:24435099-24435146
  Hypo

SEQ ID NO: 102314 - DNA, 43 bp, Homo sapiens; identical to SEQ ID NO: 69051
  chr1:24611924-24611967
  Hypo

SEQ ID NO: 102315 - DNA, 112 bp, Homo sapiens; identical to SEQ ID NO: 69059
  chr1:24648230-24648342
  Hyper

SEQ ID NO: 102316 - DNA, 319 bp, Homo sapiens; identical to SEQ ID NO: 69061
  chr1:24648832-24649151
  Hyper

SEQ ID NO: 102317 - DNA, 83 bp, Homo sapiens; identical to SEQ ID NO: 69070
  chr1:24701375-24701458
  Hypo

SEQ ID NO: 102318 - DNA, 180 bp, Homo sapiens; identical to SEQ ID NO: 69080
  chr1:24740809-24740989
  Hypo

SEQ ID NO: 102319 - DNA, 154 bp, Homo sapiens; identical to SEQ ID NO: 69087
  chr1:24768639-24768793
  Hypo

SEQ ID NO: 102320 - DNA, 88 bp, Homo sapiens; identical to SEQ ID NO: 69129
  chr1:25220516-25220604
  Hypo

SEQ ID NO: 102321 - DNA, 43 bp, Homo sapiens; identical to SEQ ID NO: 69130
  chr1:25228594-25228637
  Hypo

SEQ ID NO: 102322 - DNA, 1428 bp, Homo sapiens
  chr1:25255940-25257368
  Hyper
actgaaccgggtgcccgggtgtcgccgcggcgtctcgggcacctcccatccccactgctcccgaggctctggctcccgcagctcagacgcccggagccccagggccggcgccctcccgccccgggtcccgcactcaccttgaaggcgacgggcagcgtcttgttgcagcgccagtgcgagggcagcacggagcagaggaagttggggctgtcggtgcgcacgagctcgcctgcgtggtccgccagcacgtccaccatcgagcgcacctcgggccgggcgcgccctccgggccccacggccgcctgcgcgctcagcgcgccgctgttctcgcccatcttgccgccgccgccgccgcaggggaaggccggggagggaggtgtgaagcggcggctggtgcttgggtctacgggaatacgcataacagcggccgtcagggcgccgggcaggcggagacggcgcggcttcccccgggggcggccggcgcgggcgcctcctcggccgccgctgccgcgagaagcgggaaagcagaagcggcggggcccgggcctcagggcgcagggggcggcgcccggccactactcgccagggcccgcccgctgcgaggcctcgctggcccgacggccgcccgcagcctgcccggctagtcccgcatcctcggcgcgcggccccgcgtgcggccgcccctcgtggctgtcccggctgcctgggccgcggcggggcccgcgcggggctgtgccgctgccgccgcctcccgccccgaagctcgcccgcggccgccccgactccgcggccgcagccccagaacaaatcctccagaatcaagtggcggggccgcggccgcccgcgcggggttagtacccccggggcccgcggggcggggctggcggagcgacgcgtcgcacagccaatcggcggagcccccatcgcgggcacctcggtggcgttcgcggggaggaacggggcctgccggaggccgcccaacggggaggggcggaaggcgccaccccgcggaggaggccccagtgccacagcccagggcccccgagagctctgggagcccggggcaaatgctagaaatttgcttagaacgtccgggtcccacggaaggcgcccttgccgccctctctcgggtcgtagctccctgacgctggggcgcaaccccttcgctcctcctccccgctggccgcggccgggcttccccagctcttgctgcttcgggcctgtgacttctgcaaccccgggctgggggccgcggggtctcagggccggtgacgccgcactgggagccgccccaaagaggttactcacctccctcgtcccgcacattattctgacccaagagcctccaccccacacgggattttgcgcgtcgtccacgcccggccggcggcctttgctgctcccagccctgcgcggctttggtcccag

SEQ ID NO: 102323 - DNA, 117 bp, Homo sapiens; identical to SEQ ID NO: 26139
  chr1:25259018-25259135
  Hyper

SEQ ID NO: 102324 - DNA, 64 bp, Homo sapiens; identical to SEQ ID NO: 69134
  chr1:25269281-25269345
  Hypo

SEQ ID NO: 102325 - DNA, 30 bp, Homo sapiens; identical to SEQ ID NO: 69137
  chr1:25351684-25351714
  Hypo

SEQ ID NO: 102326 - DNA, 30 bp, Homo sapiens; identical to SEQ ID NO: 69142
  chr1:25417486-25417516
  Hypo

SEQ ID NO: 102327 - DNA, 35 bp, Homo sapiens; identical to SEQ ID NO: 69143
  chr1:25425784-25425819
  Hyper

SEQ ID NO: 102328 - DNA, 30 bp, Homo sapiens; identical to SEQ ID NO: 69144
  chr1:25501519-25501549
  Hypo

SEQ ID NO: 102329 - DNA, 29 bp, Homo sapiens
  chr1:25601203-25601232
  Hypo
ggggaaacaaagggccgggcgacgtggct

SEQ ID NO: 102330 - DNA, 30 bp, Homo sapiens; identical to SEQ ID NO: 69148
  chr1:25856663-25856693
  Hypo

SEQ ID NO: 102331 - DNA, 30 bp, Homo sapiens; identical to SEQ ID NO: 69149
  chr1:25857535-25857565
  Hypo

SEQ ID NO: 102332 - DNA, 30 bp, Homo sapiens; identical to SEQ ID NO: 69150
  chr1:25999651-25999681
  Hypo

SEQ ID NO: 102333 - DNA, 30 bp, Homo sapiens; identical to SEQ ID NO: 69151
  chr1:26222050-26222080
  Hyper

SEQ ID NO: 102334 - DNA, 602 bp, Homo sapiens; identical to SEQ ID NO: 69152
  chr1:26249024-26249626
  Hyper

SEQ ID NO: 102335 - DNA, 32 bp, Homo sapiens; identical to SEQ ID NO: 69153
  chr1:26336891-26336923
  Hypo

SEQ ID NO: 102336 - DNA, 92 bp, Homo sapiens; identical to SEQ ID NO: 69154
  chr1:26337163-26337255
  Hypo

SEQ ID NO: 102337 - DNA, 30 bp, Homo sapiens; identical to SEQ ID NO: 69155
  chr1:26372114-26372144
  Hyper

SEQ ID NO: 102338 - DNA, 30 bp, Homo sapiens; identical to SEQ ID NO: 69156
  chr1:26372535-26372565
  Hyper

SEQ ID NO: 102339 - DNA, 113 bp, Homo sapiens; identical to SEQ ID NO: 26142
  chr1:26372988-26373101
  Hyper

SEQ ID NO: 102340 - DNA, 603 bp, Homo sapiens
  chr1:26551658-26552261
  Hyper
gccttcaacctgatccgcttctcgaccagcgatacactgtacctgcacggccgagtgaccctgtgtgacacgcgggcaagacgcccatgccaaccagtgagtgggcagccccgggacctcctgcgcagccgccgcagccttgcctgcaaagcagttcctgccgggcaggctgggtagccggactcccagctgcgccgtcttcacggaagcggtgctgatgcgggacctgggggactgcggtgctggggactggccagtcctaccgggggcggggcttgtggaagactgggcgggattttgaagacctaggtcttgtggatggtgaactcacttggggcggggagggaggtggggctaccctggggtcttgggcaaagtcctcgcctggccggcttcgctacccttgtgcttgcgttgcccacaagcttgtagtcagaagaactcgcctgggagggatcgctcctgggagatccgaacgcgggagggcctggagcgcggcggcagctggatagcattcgggcccatccgaataagcggtaaatggatcatttctggggcctccctgactcctcttccagagcctcctaccgacctgctctgtcc

SEQ ID NO: 102341 - DNA, 36 bp, Homo sapiens; identical to SEQ ID NO: 69159
  chr1:26612389-26612425
  Hypo

SEQ ID NO: 102342 - DNA, 30 bp, Homo sapiens; identical to SEQ ID NO: 69160
  chr1:26627535-26627565
  Hypo

SEQ ID NO: 102343 - DNA, 30 bp, Homo sapiens; identical to SEQ ID NO: 69161
  chr1:26648095-26648125
  Hyper

SEQ ID NO: 102344 - DNA, 31 bp, Homo sapiens; identical to SEQ ID NO: 69162
  chr1:26723047-26723078
  Hypo

SEQ ID NO: 102345 - DNA, 121 bp, Homo sapiens; identical to SEQ ID NO: 26144
  chr1:26735162-26735283
  Hyper

SEQ ID NO: 102346 - DNA, 396 bp, Homo sapiens
  chr1:26735591-26735987
  Hyper
tcctttttaccccacgaagtcccacctcccattccttacgctcaagttttcatttcttggagagcaccccgtacgagagaaagggaaataacttctgcagtctcttgctttcctccccatcttccccttccctacccccactcatccggtctctctgaaatacacatgtgcccacatccgcacgtgcacacacacacacacacaaacacacacacagagccacagcgtgagaattccaaaaggttctgcacactcggtggagaagattgaattcagagcaagcggatgcccccgaaagcaggctctgtccctttaaatgggttgtagtggtgggggaggggaactggccggagctggcattgtccagtttgaactgaacaccggaagtgaaggggc

SEQ ID NO: 102347 - DNA, 1143 bp, Homo sapiens
  chr1:26737181-26738324
  Hyper
ggggagggggctgcccgcggggggttgggtcattgtcttttagaatttgggagcctttgaaaagccgtgggccctcccaccgctattgtgcgggggaagatgtagcagcttcttctccgaaccaaccctttgccttcggacttctccggggccagcagccgcccgaccaggggcccggggccacgggctcagccgacgaccatgggctccgtgtccaaccagcagtttgcaggttcgagctcgggacttagcggggacactttaggattcaggggcggccaggagccacgtagaagggaggtggggaactgagtcctaggctgcccaaaggaccccaagacggtgcggccttctgcttcatagggccgtctctggggccaggaaccttggtgtcccagtggcgtgcgcgccagactacgtgggtggatggagaggagaggcttgtcccgccgtgagtctctgggaaacgcgttgtgggaagaggagcaaaactttcggggcactactgtcccggtgtacgctaggggaacgcgggaggcgaccgggataggtttcttctcttctgttgcttggtagctgccccctcctggctgtccacttgtggggctggatactcgggtctccctgcctggggcccgagacggccctccgattccgtgccccccagctaagtgcccggccctccctctctccaggtggctgcgccaaggcggcagaagaggcgcccgaggaggcgccggaggacgcggcccgggcggcggacgagcctcagctgctgcacggtgcgggcatctgtaagtggttcaacgtgcgcatggggttcggcttcctgtccatgaccgcccgcgccggggtcgcgctcgaccccccagtggatgtctttgtgcaccaggtgagactgattccggtaactttgcccagggaagggcgtctaggcgcccatatccacgggtgggctccgggctcgcagttgaattgagggccatcgggagccctcattatgcatccctgtctttgcttcggcaccccaattctgagtccctgttaactatctcgtgggggagtagtgggaggcagcaccaattatcagcacccccgcccccttccgggaacccctccggcttaccacgtgtctattacctc

SEQ ID NO: 102348 - DNA, 30 bp, Homo sapiens; identical to SEQ ID NO: 69167
  chr1:26758265-26758295
  Hyper

SEQ ID NO: 102349 - DNA, 18 bp, Homo sapiens
  chr1:26879273-26879291
  Hypo
gcccggcttaaattgtga

SEQ ID NO: 102350 - DNA, 43 bp, Homo sapiens; identical to SEQ ID NO: 38900
  chr1:26969603-26969646
  Hypo

SEQ ID NO: 102351 - DNA, 90 bp, Homo sapiens; identical to SEQ ID NO: 69174
  chr1:27113624-27113714
  Hyper

SEQ ID NO: 102352 - DNA, 30 bp, Homo sapiens; identical to SEQ ID NO: 69176
  chr1:27183642-27183672
  Hypo

SEQ ID NO: 102353 - DNA, 406 bp, Homo sapiens; identical to SEQ ID NO: 69177
  chr1:27189908-27190314
  Hypo

SEQ ID NO: 102354 - DNA, 70 bp, Homo sapiens; identical to SEQ ID NO: 69182
  chr1:27319476-27319546
  Hyper

SEQ ID NO: 102355 - DNA, 112 bp, Homo sapiens; identical to SEQ ID NO: 69185
  chr1:27339342-27339454
  Hyper

SEQ ID NO: 102356 - DNA, 30 bp, Homo sapiens; identical to SEQ ID NO: 69186
  chr1:27358149-27358179
  Hyper

SEQ ID NO: 102357 - DNA, 18 bp, Homo sapiens
  chr1:27558365-27558383
  Hypo
tgggggttctctggccgg

SEQ ID NO: 102358 - DNA, 187 bp, Homo sapiens; identical to SEQ ID NO: 69188
  chr1:27628242-27628429
  Hypo

SEQ ID NO: 102359 - DNA, 30 bp, Homo sapiens; identical to SEQ ID NO: 69189
  chr1:27675398-27675428
  Hypo

SEQ ID NO: 102360 - DNA, 76 bp, Homo sapiens
  chr1:27684179-27684255
  Hyper
ggcgctagagtgggccgcccacctgctcttgcttctgctcctggtgcagattctccgccagcgctggcagctcctg

SEQ ID NO: 102361 - DNA, 30 bp, Homo sapiens; identical to SEQ ID NO: 69193
  chr1:27710201-27710231
  Hypo

SEQ ID NO: 102362 - DNA, 32 bp, Homo sapiens; identical to SEQ ID NO: 69194
  chr1:27719783-27719815
  Hypo

SEQ ID NO: 102363 - DNA, 104 bp, Homo sapiens; identical to SEQ ID NO: 69196
  chr1:27844518-27844622
  Hypo

SEQ ID NO: 102364 - DNA, 30 bp, Homo sapiens; identical to SEQ ID NO: 69197
  chr1:27844988-27845018
  Hypo

SEQ ID NO: 102365 - DNA, 35 bp, Homo sapiens; identical to SEQ ID NO: 69198
  chr1:27868411-27868446
  Hypo

SEQ ID NO: 102366 - DNA, 244 bp, Homo sapiens; identical to SEQ ID NO: 69199
  chr1:27876089-27876333
  Hypo

SEQ ID NO: 102367 - DNA, 475 bp, Homo sapiens; identical to SEQ ID NO: 69200
  chr1:27960621-27961096
  Hyper

SEQ ID NO: 102368 - DNA, 30 bp, Homo sapiens; identical to SEQ ID NO: 69201
  chr1:28198358-28198388
  Hypo

SEQ ID NO: 102369 - DNA, 688 bp, Homo sapiens; identical to SEQ ID NO: 69202
  chr1:28199059-28199747
  Hyper

SEQ ID NO: 102370 - DNA, 113 bp, Homo sapiens; identical to SEQ ID NO: 69206
  chr1:28293291-28293404
  Hypo

SEQ ID NO: 102371 - DNA, 89 bp, Homo sapiens; identical to SEQ ID NO: 69216
  chr1:28853681-28853770
  Hypo

SEQ ID NO: 102372 - DNA, 74 bp, Homo sapiens; identical to SEQ ID NO: 69217
  chr1:28865161-28865235
  Hypo

SEQ ID NO: 102373 - DNA, 246 bp, Homo sapiens; identical to SEQ ID NO: 69219
  chr1:28919075-28919321
  Hyper

SEQ ID NO: 102374 - DNA, 23 bp, Homo sapiens
  chr1:28926140-28926163
  Hypo
atggcacgcgcctgtggtgccac

SEQ ID NO: 102375 - DNA, 18 bp, Homo sapiens
  chr1:29047659-29047677
  Hypo
tttttttttgtgaggcgg

SEQ ID NO: 102376 - DNA, 23 bp, Homo sapiens
  chr1:29061371-29061394
  Hypo
accgcacccggcttttttttttt

SEQ ID NO: 102377 - DNA, 39 bp, Homo sapiens; identical to SEQ ID NO: 69224
  chr1:29074244-29074283
  Hypo

SEQ ID NO: 102378 - DNA, 616 bp, Homo sapiens; identical to SEQ ID NO: 69225
  chr1:29138528-29139144
  Hyper

SEQ ID NO: 102379 - DNA, 30 bp, Homo sapiens; identical to SEQ ID NO: 69228
  chr1:29205490-29205520
  Hypo

SEQ ID NO: 102380 - DNA, 395 bp, Homo sapiens; identical to SEQ ID NO: 69230
  chr1:29448515-29448910
  Hyper

SEQ ID NO: 102381 - DNA, 139 bp, Homo sapiens; identical to SEQ ID NO: 69231
  chr1:29449756-29449895
  Hyper

SEQ ID NO: 102382 - DNA, 333 bp, Homo sapiens; identical to SEQ ID NO: 69232
  chr1:29450241-29450574
  Hyper

SEQ ID NO: 102383 - DNA, 223 bp, Homo sapiens; identical to SEQ ID NO: 69233
  chr1:29462383-29462606
  Hypo

SEQ ID NO: 102384 - DNA, 32 bp, Homo sapiens; identical to SEQ ID NO: 69234
  chr1:29463290-29463322
  Hypo

SEQ ID NO: 102385 - DNA, 42 bp, Homo sapiens; identical to SEQ ID NO: 69235
  chr1:29463615-29463657
  Hypo

SEQ ID NO: 102386 - DNA, 45 bp, Homo sapiens; identical to SEQ ID NO: 69236
  chr1:29516592-29516637
  Hypo

SEQ ID NO: 102387 - DNA, 36 bp, Homo sapiens; identical to SEQ ID NO: 69237
  chr1:29564766-29564802
  Hyper

SEQ ID NO: 102388 - DNA, 863 bp, Homo sapiens; identical to SEQ ID NO: 69238
  chr1:29586000-29586863
  Hyper

SEQ ID NO: 102389 - DNA, 38 bp, Homo sapiens; identical to SEQ ID NO: 69239
  chr1:29785074-29785112
  Hypo

SEQ ID NO: 102390 - DNA, 616 bp, Homo sapiens; identical to SEQ ID NO: 69240
  chr1:29804767-29805383
  Hyper

SEQ ID NO: 102391 - DNA, 188 bp, Homo sapiens; identical to SEQ ID NO: 38915
  chr1:30351554-30351742
  Hypo

SEQ ID NO: 102392 - DNA, 215 bp, Homo sapiens; identical to SEQ ID NO: 69255
  chr1:30558965-30559180
  Hyper

SEQ ID NO: 102393 - DNA, 45 bp, Homo sapiens; identical to SEQ ID NO: 69258
  chr1:30723094-30723139
  Hypo

SEQ ID NO: 102394 - DNA, 430 bp, Homo sapiens
  chr1:30815412-30815842
  Hyper
taaaacgggcgctggcgacagcagcgcaggctggttaagctgcggcaggtccttgcagaggaggggctcttcccaggagggcgctccagccgaggcccctctgccttcacctgcgccatgaccacttccctcggccctctcccctcctccacgcctcctggggccgctctccagggtcctgggacgagaccagccccgggcagggcagcgcggggagccaggggtcccacacccaggagggcccctcaccgcaagggacgggcttaggcggataaatgtccggctcccctcgaggggcagagtcagcaccccccacacggtccctgagatggccctgggaccgagccgccgcccccgacttgtgattcagcctcttcctgcctggctttcccctccccactgtgcctcctgggatcgcctcccaaatcag

SEQ ID NO: 102395 - DNA, 232 bp, Homo sapiens; identical to SEQ ID NO: 69267
  chr1:31157994-31158226
  Hyper

SEQ ID NO: 102396 - DNA, 181 bp, Homo sapiens; identical to SEQ ID NO: 69268
  chr1:31208071-31208252
  Hypo

SEQ ID NO: 102397 - DNA, 33 bp, Homo sapiens; identical to SEQ ID NO: 69269
  chr1:31249862-31249895
  Hypo

SEQ ID NO: 102398 - DNA, 30 bp, Homo sapiens; identical to SEQ ID NO: 69272
  chr1:31439991-31440021
  Hypo

SEQ ID NO: 102399 - DNA, 52 bp, Homo sapiens; identical to SEQ ID NO: 69274
  chr1:31481385-31481437
  Hypo

SEQ ID NO: 102400 - DNA, 18 bp, Homo sapiens
  chr1:31498805-31498823
  Hypo
aagcttatcttccaccgg

SEQ ID NO: 102401 - DNA, 48 bp, Homo sapiens; identical to SEQ ID NO: 69277
  chr1:31712619-31712667
  Hyper

SEQ ID NO: 102402 - DNA, 30 bp, Homo sapiens; identical to SEQ ID NO: 69282
  chr1:31846047-31846077
  Hyper

SEQ ID NO: 102403 - DNA, 356 bp, Homo sapiens; identical to SEQ ID NO: 69284
  chr1:31846296-31846652
  Hyper

SEQ ID NO: 102404 - DNA, 30 bp, Homo sapiens; identical to SEQ ID NO: 69285
  chr1:31863025-31863055
  Hypo

SEQ ID NO: 102405 - DNA, 30 bp, Homo sapiens; identical to SEQ ID NO: 69286
  chr1:32098396-32098426
  Hypo

SEQ ID NO: 102406 - DNA, 433 bp, Homo sapiens; identical to SEQ ID NO: 69289
  chr1:32179994-32180427
  Hyper

SEQ ID NO: 102407 - DNA, 806 bp, Homo sapiens
  chr1:32180688-32181494
  Hyper
gagcctcccgatggtcgctgtgtctgcccattggaccaggggccagggcgggcggggctttgggcgacagaactggctagggtgggagaggagaggaagctgccaggttctggggatcccgaccccaccccgccgacagccacgcctccagcccactctggccacgccactggtctgcctttggaccacactcatggccgggtgccttccctgactccgccctaggccctgcctcctatctggctccgcccagccctggccaaccttagaacctgtcccaaggtccagagaggcctagatgaggggtagcctgcctctgagaggcatggagccctcctcccgcgtggggtcagggaatagaagggcgtcgagggtggcgggtgagggaacgttcctggcgccgcgaacgggaagcctccaggctgcaggacgtagctgcggggacccggcagtctgcgaggctggagtggccgaggccgccccgagcatagaaacagccctgtatacgtgggcacagaaaggcccagggaggcgcctgggcagaagtgtctaggacgatgcctctgccacggagccctggagtgggggcagctgatggctcaagacacatgagctctggtggcgagtacagggacgcggggtttggggaggcccaagtcaaggtccatccttctgggatgaggggcggaggatgggaggcggagcccggtctccagggcaccagccctccacctagcgggaagcttgggaatcgcggagtgcagaggtggggtgcggaaagggttccaccgcgcctgggctccttt

SEQ ID NO: 102408 - DNA, 190 bp, Homo sapiens
  chr1:32226201-32226391
  Hyper
ggccgggggaaggggcgcggcgacgcgcacatccgtcgcgtttatccacctggcagctccaattcgcccgcccgtcactcaccctccgcctccccggcgctcgccgcccgacctgcccaggccgccacgcaggcggtgacccccactcggtggctttgggtcctctgccagcgctcggacccaaggacag

SEQ ID NO: 102409 - DNA, 1195 bp, Homo sapiens
  chr1:32237521-32238716
  Hyper
cacaaagggccccaccgccggaagccgcccgcgctcccacaccttgtgcaggtctcccctgaaatgaattttaatttccgctgagggcaggcggcgtcgtgagtcctgagcccgtggcggcggcggcggcgcgggtgtggggccgcgcggccgggagcgggcggaagagagcgcgaatttgaatttcaaaggcatctggaacccaagtgcttctgcgttgcccgattgtgtgtgtggcgcttttgtgtgtccgcgaatgcgcgcgtgcgtgtgtggcgtgtgtctgggtgttttatgactgtcctccgtgaggccgtgtgtgagcccttgcgtgggccgtgagtgcggcagggagcgcggtgtccgggggccgcctgtcggtgtgtctgtgcgtgcttgtgcgctagcctttgcctctgcgagtgcgtatttttaggaccgagtctgtctatatgagcctgtgtctgtgtgtgtgcgctcccggccctgcgtgtgtctgtgagcgtctgccggggcgcgtgtgtgctcggaaccccgcggtggtgtgcgggtgtgtccgtgtgtctgtgcacgtgcaggcgagcgttcccatctgtgtgtgtgcatctgagtctgggctatgtgtgactcagggaccagtctatgagcctgcctgtgcctttgagccgatacctgtgtgtgactcagggacgagtctatgagccgatacctgtgtgtgcttgggtgtctgtgtcgtggtgtgtccctgcaagcgtttgtgcctgcaggtgctggagtgtgtagctgtgggaatgagtgcgtgtgagtgtgcggaaggggcaccgcgcgagggagcgccggtgcggaaggctaagcgagcccgcgccctccacggacggtgccgccaccccctccctccgccccgcgctatgtgcccctgtgtgcccgcgccgccggggccgtctctgggctccgggagggggctgagcgagcggccctttcctcccagggaccccgggcccgccgccagccctgggcacacccgccccttcctccagcggccccgctcgctgacccacgggcactcgatgggcactcgggaggcaatggccggagaggatgggcagttagcgggagggactgagtggcgccggcttcacgctcattctgctgagggcttgggggcagctcatcagtcttccgcaatgggcctgct

SEQ ID NO: 102410 - DNA, 458 bp, Homo sapiens
  chr1:32410234-32410692
  Hyper
ctagagcttcccctgcgtccgcctttgggggaggggagggagtgaagctgtgaattccgggagaagtcaagggtcgctcggggcgtgggtccgcgcgcggaggggctcgctgtcccggtgccagcgggagctggaaagcttcggctggggcctgagtggacgggaaggcggcggcctccgcgggatccttcccggggccgatccacagtcaggatccccagctccaccgccatcaagtgggactggagttcggccagagaagaaaacgacttcgggaactggcaacgagggagagggaaaagttgagaaacgtgactcagcctctttagttcatctttcacgtggggcagcggaggcctggcggggacggggagccgctcggggactgcaggcccgtaggtcgctccctatccgtgagggattggttggttccaggacacctgcggatcccaaaatct

SEQ ID NO: 102411 - DNA, 70 bp, Homo sapiens; identical to SEQ ID NO: 69299
  chr1:32705509-32705579
  Hypo

SEQ ID NO: 102412 - DNA, 84 bp, Homo sapiens; identical to SEQ ID NO: 69300
  chr1:32741460-32741544
  Hypo

SEQ ID NO: 102413 - DNA, 21 bp, Homo sapiens
  chr1:32756498-32756519
  Hypo
cctgccctcctaggccgggcg

SEQ ID NO: 102414 - DNA, 125 bp, Homo sapiens
  chr1:32827740-32827865
  Hyper
ctggagaacccccaacggtgccccctgccgcccctggcactcagcgcgggccagaatcggggactggaggcctctggccatggcgcctggagacggggtcgcgcagaccccggacacccgagggg

SEQ ID NO: 102415 - DNA, 30 bp, Homo sapiens; identical to SEQ ID NO: 69304
  chr1:32829362-32829392
  Hypo

SEQ ID NO: 102416 - DNA, 18 bp, Homo sapiens
  chr1:32918164-32918182
  Hypo
aaaactatgtctaggcgg

SEQ ID NO: 102417 - DNA, 30 bp, Homo sapiens; identical to SEQ ID NO: 69306
  chr1:32930129-32930159
  Hyper

SEQ ID NO: 102418 - DNA, 408 bp, Homo sapiens; identical to SEQ ID NO: 26170
  chr1:32930619-32931027
  Hyper

SEQ ID NO: 102419 - DNA, 74 bp, Homo sapiens; identical to SEQ ID NO: 69313
  chr1:33220942-33221016
  Hypo

SEQ ID NO: 102420 - DNA, 130 bp, Homo sapiens; identical to SEQ ID NO: 69320
  chr1:33336741-33336871
  Hyper

SEQ ID NO: 102421 - DNA, 121 bp, Homo sapiens; identical to SEQ ID NO: 69321
  chr1:33351599-33351720
  Hyper

SEQ ID NO: 102422 - DNA, 379 bp, Homo sapiens
  chr1:33352075-33352454
  Hyper
gcgccgccttccctgcgcagtcggtgtctccgcgtcgctgggtgagtgggggcagctccagccggggccgggggatgagggcagggggttcccggagctgggggcccacgtccagggcttcccaacaccgccgctcccgggcttcccgggaatccttgccccgggtggcgggggcgctggggactgggaagcgcgcggtgctctccagggtcctgaccgccgagtggccggcccctaggaaccgcgttcgaccgccctggagcgccccctccaggaggggccacgcgccgggcgctgtcctagtgctgagcggatggaggcgggggctgggggacagagctgagggaggtttggagcgggtccccggggctggcttctc

SEQ ID NO: 102423 - DNA, 435 bp, Homo sapiens; identical to SEQ ID NO: 69325
  chr1:33358628-33359063
  Hyper

SEQ ID NO: 102424 - DNA, 75 bp, Homo sapiens; identical to SEQ ID NO: 26173
  chr1:33390730-33390805
  Hyper

SEQ ID NO: 102425 - DNA, 19 bp, Homo sapiens
  chr1:33425641-33425660
  Hypo
actccgtctcaaaaaaaaa

SEQ ID NO: 102426 - DNA, 421 bp, Homo sapiens; identical to SEQ ID NO: 69329
  chr1:33438500-33438921
  Hyper

SEQ ID NO: 102427 - DNA, 149 bp, Homo sapiens; identical to SEQ ID NO: 38921
  chr1:33441493-33441642
  Hypo

SEQ ID NO: 102428 - DNA, 143 bp, Homo sapiens; identical to SEQ ID NO: 14223
  chr1:33473115-33473258
  Hypo

SEQ ID NO: 102429 - DNA, 77 bp, Homo sapiens; identical to SEQ ID NO: 69335
  chr1:33631065-33631142
  Hypo

SEQ ID NO: 102430 - DNA, 316 bp, Homo sapiens
  chr1:33772299-33772615
  Hyper
gagcgggagtgaggccgggccggctgggccggcggagaagccggagggccgggaaccggcggcggcgctagttccgcagcagccggtaccccttgggcgcccacagcagtcgcgggcggcggatctcggcccgcgggccgatgtccgggctccagcagaactcgggcgacagcaccttggcgggcttgtgcagccagaagaacttgttgaggtggctctcgtcgtgccagcgcgcctccaggccgcgcgcgcggtcccagtccaggccccccgcacagtgcgccgtcagcccgcgcagcgccgccacgctgccccc

SEQ ID NO: 102431 - DNA, 38 bp, Homo sapiens; identical to SEQ ID NO: 69338
  chr1:33772904-33772942
  Hyper

SEQ ID NO: 102432 - DNA, 32 bp, Homo sapiens; identical to SEQ ID NO: 38924
  chr1:33798865-33798897
  Hypo

SEQ ID NO: 102433 - DNA, 118 bp, Homo sapiens; identical to SEQ ID NO: 69340
  chr1:33896068-33896186
  Hyper

SEQ ID NO: 102434 - DNA, 30 bp, Homo sapiens; identical to SEQ ID NO: 38925
  chr1:33981589-33981619
  Hypo

SEQ ID NO: 102435 - DNA, 48 bp, Homo sapiens; identical to SEQ ID NO: 69342
  chr1:33985077-33985125
  Hypo

SEQ ID NO: 102436 - DNA, 41 bp, Homo sapiens; identical to SEQ ID NO: 69345
  chr1:34090896-34090937
  Hypo

SEQ ID NO: 102437 - DNA, 34 bp, Homo sapiens; identical to SEQ ID NO: 69346
  chr1:34100658-34100692
  Hyper

SEQ ID NO: 102438 - DNA, 30 bp, Homo sapiens; identical to SEQ ID NO: 69348
  chr1:34115492-34115522
  Hypo

SEQ ID NO: 102439 - DNA, 28 bp, Homo sapiens
  chr1:34130113-34130141
  Hypo
attttaggccaggagcggtggctcatgc

SEQ ID NO: 102440 - DNA, 89 bp, Homo sapiens; identical to SEQ ID NO: 69352
  chr1:34180223-34180312
  Hypo

SEQ ID NO: 102441 - DNA, 22 bp, Homo sapiens
  chr1:34558017-34558039
  Hypo
aataggaacagctcccgtccac

SEQ ID NO: 102442 - DNA, 1323 bp, Homo sapiens; identical to SEQ ID NO: 26177
  chr1:34628590-34629913
  Hyper

SEQ ID NO: 102443 - DNA, 920 bp, Homo sapiens; identical to SEQ ID NO: 69360
  chr1:34630137-34631057
  Hyper

SEQ ID NO: 102444 - DNA, 375 bp, Homo sapiens; identical to SEQ ID NO: 69361
  chr1:34631434-34631809
  Hyper

SEQ ID NO: 102445 - DNA, 500 bp, Homo sapiens
  chr1:34632102-34632602
  Hyper
ctgatttggccaaaacggagcgttggcatctgtgtggccaagggggcagtggccggcgggcggtggggcctgagaatttccggggaagggtgtggagagggactgtagggatggcgagccaggctgggggtggctggcgacccaggttggccggctgtcagcgtggccaggaatttccatccaaggaagggtgtgaagaggggctgtggagttgacgatatgaattggggggcgggggcagggctggaggagtggaggcttgtccctactccccatgaaaaacttcctccccagagccacgctttcgcagcctcctagatgccactcttcctccctccccccaccccaagttgttccggtttccctgcatgagctcatcccacagctggggagccagcccggtggccctgggcgggcgaatctcctcagaatcgcgggcctggtccccacccccaacacgcttgtatgcccgcccctcccgacgccgccttgctgggtgc

SEQ ID NO: 102446 - DNA, 771 bp, Homo sapiens
  chr1:34642367-34643138
  Hyper
gagatttgtgtggagcggcgaagtggggcggcggcgcgtttggctttgacttctgatcccccgaagcgctctggggtcctttgggccccacccccacccaccccaccggcgggtcttgggctccgaacccagggcgccccgcgcaccgagccgttgcgtttgaaacccacagaaagaattcccccgctcgacgacggcgagggtgtgggagctactggcaggcaaattggtgggagccgcccggcccagcctgccttgccgagtcagcgcgctcttgagccgctgggcccttcccggtgcccgcctggcagcgcggcgcggctggggcaggggtctgctgggggccggggactaagggctgtgggcccatccacacacgcctcatcccttctttccgggggcagcagagcagcagcgggagaccgggagcaggaggggtagggcgagagaaaagcaggacctgggccgggggtgggagtcgggccgttgacgctcgctctgcgaggggctccctgggaacgcccaggcgagcgcctcctgcggggccccgccccccgagtgcctacaatggtgccaggcccgcacccagtcctccgcgtggcttagcgggacagcatgggctgagcccaggcgccgaaagttgtcacggcggcgtcgcaagggggcagtgccagggactgtggggagagccagccctccccttccagctgttcccagatgtcattctgcccgcccaggcgcctggttcctgagctccgcagcattccactg

SEQ ID NO: 102447 - DNA, 27 bp, Homo sapiens
  chr1:34979405-34979432
  Hypo
aagaagagggctgggcgcagtggctca

SEQ ID NO: 102448 - DNA, 296 bp, Homo sapiens; identical to SEQ ID NO: 69370
  chr1:35246877-35247173
  Hyper

SEQ ID NO: 102449 - DNA, 391 bp, Homo sapiens; identical to SEQ ID NO: 69371
  chr1:35258480-35258871
  Hyper

SEQ ID NO: 102450 - DNA, 876 bp, Homo sapiens; identical to SEQ ID NO: 69375
  chr1:35350991-35351867
  Hyper

SEQ ID NO: 102451 - DNA, 128 bp, Homo sapiens; identical to SEQ ID NO: 69376
  chr1:35369947-35370075
  Hypo

SEQ ID NO: 102452 - DNA, 108 bp, Homo sapiens; identical to SEQ ID NO: 69377
  chr1:35390565-35390673
  Hyper

SEQ ID NO: 102453 - DNA, 176 bp, Homo sapiens; identical to SEQ ID NO: 69378
  chr1:35394614-35394790
  Hyper

SEQ ID NO: 102454 - DNA, 1089 bp, Homo sapiens
  chr1:35395042-35396131
  Hyper
gcggcttacctggcccggctcgggctccggccgggttacatggtgccggcggcccgggccgggggcgctgcggcgttgggcaggcgggcagggaccggggcccggcactgcggagcccccagctgaggggccgcgccggctgcggagccccaagcgagcgccgagcggcagcgggcgcgggagcgggaggcggccaagccacggaggctggatttcccggggaccgggaaggggaggcggggggatcccgcccgcgcgctccgcccccgcccccgcccccgcgcagggcagccgagcagggagagggagagggagaggaagagggagggggaccgagctccccgcccccgcgcggacccaggagggccgaggtcgccgcccgcgggcggccgccggggtcccggaggagcgcccacctcgctgagcgacggtgctgggggcgcccagcgtaggggcaggaatgagatccccctccccggggacccaggaacaggcacccgaagtgtcacggccacgcacagccgacctgggtacagggacccaagcccggcggcgggcgggcggtcggggaccagctcagcctcacggaccgggtctcgccccccgccgaggggcagtcacgccctgaatgtcacacacagcccccaggcccgtccgcttaggagactctccttcgggctttcccggtcggccgcctgacctcagctcctggcttggggtcagggagcccccctcttcggccccagcccctgccaggatggggcgctgtgcccggcctcggagccgctggcaggcgtcccccacccacagtccgcacagccgaggcatccccagtgtggagggagagccccgctgtacctgccgcctgtgctgggcccccgcccgtgcccactgtgcccgcccgcctctgggccctgagcctgggattgtgccatggcggggtcggggtggggggaaagggactgtccgaagcacagctggaggctgcggagcccggacacaggctgcgggagccgagaggcggagagcggactgcagcagtcccctggcttgaatccgtcttggcgcccagagcgatgctgtaatggg

SEQ ID NO: 102455 - DNA, 23 bp, Homo sapiens
  chr1:35660562-35660585
  Hypo
aggcgggaccgggtgcggtggct

SEQ ID NO: 102456 - DNA, 136 bp, Homo sapiens; identical to SEQ ID NO: 38930
  chr1:35664720-35664856
  Hypo

SEQ ID NO: 102457 - DNA, 1240 bp, Homo sapiens; identical to SEQ ID NO: 69392
  chr1:36042478-36043718
  Hyper

SEQ ID NO: 102458 - DNA, 139 bp, Homo sapiens; identical to SEQ ID NO: 69393
  chr1:36056226-36056365
  Hypo

SEQ ID NO: 102459 - DNA, 41 bp, Homo sapiens; identical to SEQ ID NO: 69396
  chr1:36173241-36173282
  Hyper

SEQ ID NO: 102460 - DNA, 237 bp, Homo sapiens; identical to SEQ ID NO: 69397
  chr1:36173696-36173933
  Hyper

SEQ ID NO: 102461 - DNA, 120 bp, Homo sapiens; identical to SEQ ID NO: 69398
  chr1:36271443-36271563
  Hypo

SEQ ID NO: 102462 - DNA, 105 bp, Homo sapiens; identical to SEQ ID NO: 69399
  chr1:36334781-36334886
  Hypo

SEQ ID NO: 102463 - DNA, 167 bp, Homo sapiens; identical to SEQ ID NO: 69401
  chr1:36549703-36549870
  Hyper

SEQ ID NO: 102464 - DNA, 252 bp, Homo sapiens; identical to SEQ ID NO: 38933
  chr1:36563342-36563594
  Hypo

SEQ ID NO: 102465 - DNA, 47 bp, Homo sapiens; identical to SEQ ID NO: 69403
  chr1:36591033-36591080
  Hyper

SEQ ID NO: 102466 - DNA, 30 bp, Homo sapiens; identical to SEQ ID NO: 69410
  chr1:36666375-36666405
  Hypo

SEQ ID NO: 102467 - DNA, 22 bp, Homo sapiens
  chr1:36736011-36736033
  Hypo
aggcacacgcacacgcacgcat

SEQ ID NO: 102468 - DNA, 88 bp, Homo sapiens; identical to SEQ ID NO: 69413
  chr1:36762204-36762292
  Hypo

SEQ ID NO: 102469 - DNA, 94 bp, Homo sapiens; identical to SEQ ID NO: 69415
  chr1:36789434-36789528
  Hyper

SEQ ID NO: 102470 - DNA, 20 bp, Homo sapiens
  chr1:36966967-36966987
  Hypo
ctggccgattagcactgttt

SEQ ID NO: 102471 - DNA, 180 bp, Homo sapiens; identical to SEQ ID NO: 38934
  chr1:37148125-37148305
  Hypo

SEQ ID NO: 102472 - DNA, 30 bp, Homo sapiens; identical to SEQ ID NO: 38935
  chr1:37227648-37227678
  Hypo

SEQ ID NO: 102473 - DNA, 2670 bp, Homo sapiens
  chr1:37498362-37501032
  Hyper
gtgttcaagagggtccggctcccgggcggccgcccaggaggagacccacccgctgggtttctgaccgcctcctaggaaaatctcaagtacggaaaccaagcccgacaccggttccggcacctctttcacgccgctggcagcccaaggtccgccctgaagaagagctgtagaggaggaaggtggccctggctcggcggagtccggctcgcctggtgccaggcgctggtgctggcgccgagtgaacccaggcggcccaggtgtccggcctggtggcgggcgcagggcctgcggtgatggaggctccgtcttagcccggccaggcccagccctgccggtcgtcggcccgggacatgcgcggcgctcaggcctgcagggtgccttgggcggccacaacaaagttaaagaccggagtaagagtctccggcgagaagagacgcggagaagccggagccccggaaagccgcgcgcagccccgccagccgccgccagctgcggaggaattcgggctaactttaaaaaccgctggcgtccctgggccgcctgcccgggccgcactgggcggcctccatcgtcccttccctctacctgcactgccccaggcgggagagaggccttggccccgagggaccagctgcagcgggcagcggggtcctgctcccccaacccccgccccatggcacggggctgaaccggtaccaccgaggccaagggcgaccaccaggagagaagaccggctgccctcgtcatgcgaatctgtgccctgcgacctcgctgcggctgctcgagctatgccagaggtggggacgaagggcccgcggggagtgaggtgggcagaggagagaagttggcgccttccccagggtccccactctgcggagaagcccgatcgcagaactcggtcggctgcggttcatgctggcagtcaccgcgaaatgcgccctcgactcgggatcgcactggaaaccttcgccacactgtgccaggtctgacctcccaggagcgcgccaagggcccctcgcccactgcggcccggcggcctcctccccaataagtaaggcccgtgaccccgactctggaactttgtcctcacagggaggagctcctggtggtcaccgatcggctcagcagctcggagagaggttaggaaaatctctccggaacgcgttgggaggccccctcattcccgccccctcccgggcgcacggagacccccggctccagggagcgcttaccgatccggatgacgtggggcatcccgcgcgagtccgggatccagaaggcgcacacgaggagcccggcccagtattcccaaaccagactccggaggcgccgccagggagcggtcatcgttgggcgccgccgagcgtgcccggggcgcggccgtggcgggctccctggggcggcagctctaggcgcgggcgcgcagcagccccgaaggcgccgcctggcccagccgcccggctcccgagcgccgctgcaagtggggggcgccccgcggcgccgcgcacatcttactggggggccgccccgccggcgcccgccccgcctggctgccgcccacgggctgcccgcgagcgaggctcctgggctccgcccggactccgctcggactcggctccggctccgactcgcgtcggctcggctcccgcgcgggctcccacctgccccggctgccgggctctggcgggcgggctgcacgcgtctccggccgctcctcctccagccgccgccgatgctatcgcccgggctcgcacaaagccccggagtggagttgcacgcgcgcacactctccctcccagccccctcccctgcgccctgcctcccgcctcccgcgccgcccgccgcccgcgctccctccgcgcactcccccgcgcacacacacttcacactcacacttgccgaggcgcacactcgcgcgctcacacctgcgcggggggcggggaaggggaccctggccccattgtagggggacgcccggagaacgaggactctcctcgcttcccagacgtccccacccgccccgccggccccagtcccttctactgcgagggcacggagcccgggagccaggcgtggagcgcgagagctggcaccgcgagctgggagacggcggcagcccagcggccggaccagctggaggagacgcgcccgccgggagcagcgagaccgggagcccgccgtctgcggagcctggcctcgcggctcccacgcggcgggcgctggctggacggcggtggcagcgggagactgacccgggaaccggcttccctccccaaccccattcctcctggcagcagagttggggctgggggttcggagaggcagaattcaaagcgaattgtctacgctgggccaggggagctgagggagttggtagaggtgggagagcccaagtcagaccccctgctgtgggaagctggacttgaccgcgcacaggtcctggggctgcggaggaggaagaccgctcacgccttagatgtaggggggcgtgggcgccgggcccgctccctctcagccctctcccgtaactgtgcaggaagggctggtgccccctccctcattctcctgagaaagaataaagagaaactgtaatttgtcgtgggatggagtaggatccgtgggggagcaagctaaaggggttaaaaagaaaaacaacgttgtttattagca

SEQ ID NO: 102474 - DNA, 30 bp, Homo sapiens; identical to SEQ ID NO: 69432
  chr1:37501855-37501885
  Hyper

SEQ ID NO: 102475 - DNA, 192 bp, Homo sapiens; identical to SEQ ID NO: 69433
  chr1:37549296-37549488
  Hypo

SEQ ID NO: 102476 - DNA, 107 bp, Homo sapiens; identical to SEQ ID NO: 69434
  chr1:37721088-37721195
  Hyper

SEQ ID NO: 102477 - DNA, 26 bp, Homo sapiens
  chr1:37899676-37899702
  Hypo
gcgtgagacaccgcacctggccaggg

SEQ ID NO: 102478 - DNA, 30 bp, Homo sapiens; identical to SEQ ID NO: 69437
  chr1:38099986-38100016
  Hyper

SEQ ID NO: 102479 - DNA, 30 bp, Homo sapiens; identical to SEQ ID NO: 69438
  chr1:38100242-38100272
  Hyper

SEQ ID NO: 102480 - DNA, 33 bp, Homo sapiens; identical to SEQ ID NO: 26198
  chr1:38100650-38100683
  Hyper

SEQ ID NO: 102481 - DNA, 30 bp, Homo sapiens; identical to SEQ ID NO: 38936
  chr1:38207058-38207088
  Hypo

SEQ ID NO: 102482 - DNA, 481 bp, Homo sapiens; identical to SEQ ID NO: 69441
  chr1:38219523-38220004
  Hyper

SEQ ID NO: 102483 - DNA, 963 bp, Homo sapiens
  chr1:38229885-38230848
  Hyper
caactgacagcacatcggaatcgcgaactggaaggcatcagccatccagggcccagaccaaccccgcggtcaacgcctcagattccagctcctccggattctgcacctagatatgacgcctctggattcaactgagcgtatagctcccctaaatgcacaatcagaggcaagacgcgggctccagtatcgccgacagcctcaaacccggcaacgcggagcgcgcccggcagactacgctcagaattcagcactgcggacagttccatgatcagcacgtcgggcagcgcccggatccagccccctcgaccagcattccaccttctgttggccacactgtggtctcctagcccctgtagtccgggctccatcccgtctccccatattccgagctcacctccgcatctccctgtctccactcttcatctccccgcccccgcacctcccacctccaatcactcagcttgtccgtctcaccggccgctggaccgccgcctctggctcccgcggttcctggcctctttctttcccaacctcccgggtctccagcccccaagctcctcagcgcccctctcttcgctactgcttgatcacatttttctctgtctctccagttctttgctgcctgcttgcttcaagccccaatacagactctagtctctccaatgactccttcccccagaacccccatcgccagccccctatcttttggtatgccacgctccgagcagagctcaccagtcttctcaccttcctcggcggtcccaggccgccagggtcccaaaagcagcgcgagacagagctgcatccggcagaggaagaggcgcagcgggtgtggaccggcgcaggtctccatggtccgcagaccgagctgtcagtccggcggcggctcaagccgcgccagcctagcaccgctgagcaatgcccccagaccccagagccagcggggggcggagtctcaccgct

SEQ ID NO: 102484 - DNA, 99 bp, Homo sapiens; identical to SEQ ID NO: 69444
  chr1:38342587-38342686
  Hypo

SEQ ID NO: 102485 - DNA, 87 bp, Homo sapiens; identical to SEQ ID NO: 38937
  chr1:38398355-38398442
  Hypo

SEQ ID NO: 102486 - DNA, 85 bp, Homo sapiens; identical to SEQ ID NO: 69446
  chr1:38456465-38456550
  Hypo

SEQ ID NO: 102487 - DNA, 36 bp, Homo sapiens; identical to SEQ ID NO: 69447
  chr1:38493396-38493432
  Hypo

SEQ ID NO: 102488 - DNA, 2421 bp, Homo sapiens
  chr1:38510058-38512479
  Hyper
aacttttccaagtttcgtttggtgtggccaggagggcagggccccgcggggagcaggggccgcgctatgcggcggtcggtctgcagcagggcagaagccccttcccgtctgggtgtgtgggagcgcagacccctccggcgtggccgggaaccaagccggggctcggatgaaacgaaacgaaaaatgaacactcgaattttttttgttagttttttttttttttttttgcttttttttggggggagggtagggtagggaaatataaggggaaaaataaattaggctagattaaagctttggctatttcctgcttttatacacagacgcggctctcgcgacctcccctccggggccccgataaatacagtatactgcgatttaaattaagggcgcgggcggagttagaaggaccccaggagccgagaggctccacgaataaataaaaaccgtaaaaaaccaagcccggagaaaggggaaagcggggtggggcgcatccttataggagagaagaggcgtgtagcgaataaagtgacagccccccaccctggacccgcaggctcaggagtccacgcggggagaggggatggagaactctcctcgcttcgtcctctctcccggggaatccctaaccccgcactgcgttacctgtcgctttggggaggccgctgccgggatccggccccgaacagcccgggggggcaggggcgggggtcgtcgaggggatgggggcagagagcaggcggcgggcaggatgcccggggtgagttggcgagttccggatcttcgctcctctctcccggggctcgggcgacgcagcctaccgggctgtcttcgccgctcaccggagagggtcgtccgggtgtttggttttgttcgaaagtttctgggcttttttttttttttgtaaaatccaaagcaaccgaacaaaaagagtccaggccgcgcgggcgggctgcgcgcccgcgccctgcagcgcgccggcgggggcccggcccgcggggtcactgcactgagccgggcagtgtgtggtggtggtggtggtgcagcgccgccggcgggggcggtgggggcgcggagggtggcgatgcgccgcccccgccaggccctagctccccaggcgcgtatacatcgtccatgggcgggtggcccgcgccggccgcaggggtcatgcgcttctccttctgccgccggttgcagaaccagacgcgcaccacctccttctccagctgcaggctgtctgccaagccggtgatctcgtgcgccgagggcttggggcacttgagaaagtggctctcgagcgcgcctttgacccccacctcgatggacgtgcgcttcttgcgcttgcggccctgcgccgcgatcttgtccaggttggtggggctgccgctggacgagtcggtctcctccagccacttgttgagcagcggcttgagcttgcacatgttcttgaagctcagctgcagggcctcgaagcggcagatggtggtctgcgagaacacgttaccgtagagcgtgcccagcgccagccccacgtcggcctgcgtaaagcccagcttgatgcgccgctgcttgaactgcttggcgaactgctccaggtcgtccgagctgggcgcatcctcgtccgagtgctcgcccaccgatgagccgccgccgcccgcgcccgggtgcaggtgcgccgccgccgcgtgcaggccgcccgcgtgtgcatgtccgtgtgcgtgtccgtgggcgcccagatgcggcggcggcgacggctccagctgcgcctcgtggccatcctcgtgcagcgcgtggtgcaggcccggccccgcgccgccaccgcccgccgccagcatcccggccaggccgccgccgccgccccccgggtaggccgcctgcgcgtacagcccgagcggctggggctggtggcccccgctggccccgggcgagggcgacatggccgggcccaagtggtgcgctgtgctgccctgcgcccatgccgcgcccgcgtgggccgccccctggtgcaccaggcgcgcgtggaaacctccgccgccgccgccgtcgtcggctcggccggtgccgccgccgcctgccttgccgtgttctaggtgcgggccgccggcccaatcgccgccgccgcctcctcccgtgggtagccactgggggtgcgctaggcccacggggtggcccgcgcccgcgcccagccactcgtggtgcatcagcttctgcacttcgcggtacgcggcccctgcatgcaatcgctccgcggccgccgccgccgccgccgccgccgcggcgtccgggtgcataagcggcccggtgcccccggctccgccaccggggccccgcggcaggtactgcgcggtggtggccatgccgccccgcgccctgcgccgcgccgccgccgccgctccgctccgtctgcgggccccgccgcct

SEQ ID NO: 102489 - DNA, 90 bp, Homo sapiens; identical to SEQ ID NO: 69453
  chr1:38513064-38513154
  Hyper

SEQ ID NO: 102490 - DNA, 111 bp, Homo sapiens; identical to SEQ ID NO: 69454
  chr1:38599710-38599821
  Hyper

SEQ ID NO: 102491 - DNA, 30 bp, Homo sapiens; identical to SEQ ID NO: 69455
  chr1:38673189-38673219
  Hypo

SEQ ID NO: 102492 - DNA, 88 bp, Homo sapiens; identical to SEQ ID NO: 69456
  chr1:38953066-38953154
  Hypo

SEQ ID NO: 102493 - DNA, 43 bp, Homo sapiens
  chr1:39025476-39025519
  Hyper
gtgggaagactggggcgagcgggcggggcggggcggggggcga

SEQ ID NO: 102494 - DNA, 422 bp, Homo sapiens
  chr1:39044044-39044466
  Hyper
aacttaagaggggagcgcgcccaggatgggagcgagccagagaggagggggcggcggcggcgagagcgggcgggggacacggggaccgggagacgcgatccggagagcggtgggaagtattcgcctccgttcctcaaacacaggatgcgagcgccctttggagaagtcgcgctcggcggaaacgctaactccccggccaagtgcaaatgtaaagaggccctgagagcactttgtgcaaatatcaggccgggaagtgctgcgcccgcggagctgccgggcacctcggcgcccccgcgccctcggctgcgcgctaattcactttgccgtcacctctcgggcggggtcgggcgggcgcgggcagccggagcgcgcagagggcgcagagcgcctcgcagggccaggggccgcggccctgcctaatg

SEQ ID NO: 102495 - DNA, 30 bp, Homo sapiens; identical to SEQ ID NO: 69461
  chr1:39061965-39061995
  Hypo

SEQ ID NO: 102496 - DNA, 151 bp, Homo sapiens; identical to SEQ ID NO: 69462
  chr1:39075192-39075343
  Hypo

SEQ ID NO: 102497 - DNA, 550 bp, Homo sapiens; identical to SEQ ID NO: 69463
  chr1:39269643-39270193
  Hyper

SEQ ID NO: 102498 - DNA, 156 bp, Homo sapiens; identical to SEQ ID NO: 69464
  chr1:39284433-39284589
  Hyper

SEQ ID NO: 102499 - DNA, 31 bp, Homo sapiens; identical to SEQ ID NO: 69465
  chr1:39345389-39345420
  Hypo

SEQ ID NO: 102500 - DNA, 142 bp, Homo sapiens; identical to SEQ ID NO: 69466
  chr1:39416821-39416963
  Hypo

SEQ ID NO: 102501 - DNA, 32 bp, Homo sapiens; identical to SEQ ID NO: 69467
  chr1:39547658-39547690
  Hyper

SEQ ID NO: 102502 - DNA, 407 bp, Homo sapiens
  chr1:39957357-39957764
  Hyper
gaccgcagccacagccggactggtgggaacggcggcgacagacggattggctgacagtcccagccctcagaacagccccggcctcgaagcgttggcgtctgcgtccgcgtcagcgtccgcttgtcccggagccggggcaggtgcgcgcggggggcgctccagggaccgcgctgaggccgcagacgccgcccgccgagccccgccccctgctcgccgaactcagctccccgttcgccgtcggggcgtccccgggcccaggggcggcggcggagctgatgtgcgcccgctgagcgcccccggcccgccatggccgcgcgccccggaccgctctggcttctgggcctgacgttgtgcgcgctgggcgggggcggccccggcctgcgacccccgcccggctgtccccagcg

SEQ ID NO: 102503 - DNA, 34 bp, Homo sapiens; identical to SEQ ID NO: 69468
  chr1:40025741-40025775
  Hypo

SEQ ID NO: 102504 - DNA, 696 bp, Homo sapiens; identical to SEQ ID NO: 69469
  chr1:40105024-40105720
  Hyper

SEQ ID NO: 102505 - DNA, 47 bp, Homo sapiens; identical to SEQ ID NO: 69470
  chr1:40136996-40137043
  Hyper

SEQ ID NO: 102506 - DNA, 441 bp, Homo sapiens
  chr1:40137560-40138001
  Hyper
gtgcattgcttttaccgatttgggtttcttcttgggcgcgaggttgtcgtagaaaatcttggcttcctcccagaccggggccgcagcggtctccgctcctggcccgggctcgcggggctcctggggctcccggggctgcccaggttccatgctccggctctgacccggcccggccagagcaggcggcggcgtagacgcggaggtggctggggctgggctgcaggagggaggcgagtcccggcgagggaagggggcgggcagcggcgaggaggctgtgcgtgtgagctgggctccccgcccgccgggcggggggaggtcacactggccctctcggtcgcccgtgtgtcgctgccgctgctgctgctactgctgtacggtatgagggatagctgggctctccttccccgaccgacccacgccagcagccggttgggtggtgag

SEQ ID NO: 102507 - DNA, 581 bp, Homo sapiens; identical to SEQ ID NO: 69473
  chr1:40157602-40158183
  Hyper

SEQ ID NO: 102508 - DNA, 140 bp, Homo sapiens; identical to SEQ ID NO: 69474
  chr1:40204314-40204454
  Hyper

SEQ ID NO: 102509 - DNA, 241 bp, Homo sapiens
  chr1:40236079-40236320
  Hyper
gttaagcgctcaattcgtttctcgtatttctgcccctttatcacgcgatctacataaatgttaggaacgtggatgtcttctggggggaaagcccccacctccacgatctcttccacctccaccgccgtgacgtctgcagctttgcacatgggcacgttgaaattgcgggcgcttctcctgaagaccacgtttcctgcccggtcggccttccaccctttcaccagggcgaagtctgcccgga

SEQ ID NO: 102510 - DNA, 144 bp, Homo sapiens; identical to SEQ ID NO: 26221
  chr1:40237059-40237203
  Hyper

SEQ ID NO: 102511 - DNA, 258 bp, Homo sapiens
  chr1:40254091-40254349
  Hyper
gccgcccccgcccagcgcgcatagcgccaggcccaggagccagagcgggccggggagcgcggtcatggcaggccgggggcgctcagctggggcgctcagcgggcgcgcatcggctccgcggccgacccagggcctggggacgccccgacggcaaggaggctgggctcggcgggcggcgggcggcggggcggggcgggacgggcggcgaccgcggcctcagcgcggtccctggagcgcccgccgcgcgacacctgtcct

SEQ ID NO: 102512 - DNA, 85 bp, Homo sapiens; identical to SEQ ID NO: 69479
  chr1:40349616-40349701
  Hypo

SEQ ID NO: 102513 - DNA, 23 bp, Homo sapiens
  chr1:40350021-40350044
  Hypo
agcaaacctttggcccggcacag

SEQ ID NO: 102514 - DNA, 24 bp, Homo sapiens
  chr1:40409694-40409718
  Hypo
accaggcaatataggcgtattcat

SEQ ID NO: 102515 - DNA, 27 bp, Homo sapiens
  chr1:40573661-40573688
  Hypo
agactttttttttttcgagacggaatt

SEQ ID NO: 102516 - DNA, 30 bp, Homo sapiens; identical to SEQ ID NO: 69484
  chr1:40722325-40722355
  Hypo

SEQ ID NO: 102517 - DNA, 1008 bp, Homo sapiens; identical to SEQ ID NO: 69485
  chr1:40781208-40782216
  Hyper

SEQ ID NO: 102518 - DNA, 234 bp, Homo sapiens; identical to SEQ ID NO: 69486
  chr1:40782674-40782908
  Hyper

SEQ ID NO: 102519 - DNA, 138 bp, Homo sapiens; identical to SEQ ID NO: 38945
  chr1:40905029-40905167
  Hypo

SEQ ID NO: 102520 - DNA, 32 bp, Homo sapiens; identical to SEQ ID NO: 69489
  chr1:40974460-40974492
  Hyper

SEQ ID NO: 102521 - DNA, 17 bp, Homo sapiens
  chr1:41117054-41117071
  Hypo
gccaggggaggggcacg

SEQ ID NO: 102522 - DNA, 17 bp, Homo sapiens
  chr1:41117191-41117208
  Hypo
ggcgctttattgcagct

SEQ ID NO: 102523 - DNA, 196 bp, Homo sapiens; identical to SEQ ID NO: 69494
  chr1:41267850-41268046
  Hyper

SEQ ID NO: 102524 - DNA, 611 bp, Homo sapiens; identical to SEQ ID NO: 69495
  chr1:41284141-41284752
  Hyper

SEQ ID NO: 102525 - DNA, 95 bp, Homo sapiens; identical to SEQ ID NO: 69496
  chr1:41288701-41288796
  Hypo

SEQ ID NO: 102526 - DNA, 90 bp, Homo sapiens; identical to SEQ ID NO: 69497
  chr1:41326990-41327080
  Hyper

SEQ ID NO: 102527 - DNA, 359 bp, Homo sapiens
  chr1:41327695-41328054
  Hyper
tacggcggcagagtccggagcgcatgagggccatgggcggccgcggcggacggcggcctctgcaccaggcggtagccctcggcgagcatcaggtggtcggccatggcggcaggccggctgcctgcggggacagcgcgcggtggtcagcgccggctcccccggcccgggccagcggctgctctgcggcgggagacccgggcaccgtgcggtccctgcagctcggccgggcggagcaaaaccaaacccgactggtgccccggcccagcccactactgcgcaccttgcggccgcagcctggggtcacaaaggcccgcaacctgtagtgctccgaaacctccgcgtcgcgtagctgggctcgg

SEQ ID NO: 102528 - DNA, 118 bp, Homo sapiens
  chr1:41350079-41350197
  Hyper
gcacggcggttcccacgctcgggccctggttcgggggcgttctcgggacggcgtggccgcgctcaccaccaccgcggaggccgggctgtaattaggataattgcgctgctcccagcct

SEQ ID NO: 102529 - DNA, 136 bp, Homo sapiens; identical to SEQ ID NO: 69500
  chr1:41444838-41444974
  Hyper

SEQ ID NO: 102530 - DNA, 36 bp, Homo sapiens; identical to SEQ ID NO: 69501
  chr1:41451976-41452012
  Hypo

SEQ ID NO: 102531 - DNA, 116 bp, Homo sapiens; identical to SEQ ID NO: 69502
  chr1:41486048-41486164
  Hypo

SEQ ID NO: 102532 - DNA, 33 bp, Homo sapiens; identical to SEQ ID NO: 69503
  chr1:41602320-41602353
  Hypo

SEQ ID NO: 102533 - DNA, 1037 bp, Homo sapiens
  chr1:41847281-41848318
  Hyper
ccacagaactccatccggcacaacctgtcgctgcacacccgtttcatccgcgtgcagaacgagggcaccggcaagagttcgtggtggatgctgaaccccgagggcggaaagacagggaagaccccgcggcgcagggccgtgtccatggacaacggggccaagttcctgcgcatcaagggcaaggcgagcaagaagaagcagctgcaggcgcccgagcgaagcccggacgacagctccccgagtgcgcccgccccggggccggtgcctgccgcagccaagtgggccgccagccccgcctcgcacgccagcgacgactacgaggcttgggccgacttccgcggcggcgggagacccctgctcggggaggcggccgagctggaggacgacgaggccctggaggccctggcgccatcatcgccgctcatgtacccaagccccgccagcgcgctgtcgccggcgctgggctcgcgctgtccgggtgagctgccccgcctggccgagctgggaggcccgctgggcctgcacggcggcggcggcgcggggctgcccgagggcctgctggacggcgcgcaggacgcgtacgggccgcgggcccgcgcccaggcccggcccggtgctgggtgcgccgggggagctggcgctggcgggcgcagccgccgcctaccccggcaaaggggcggccccgtacgcgccgcccgcgccctcgcgcagtgccttagcccaccccatcagccttatgacgctgcccggcgaggcgggcgccgcgggcctggcaccgccgggccacgccgccgccttcgggggcccgcccggcggcctcctgctggacgctctgccggggccctacgctgccgccgccgccgggccgctgggcgccgcgcccgaccgcttcccggccgacctggacctcgacatgttcagcgggagcctcgagtgcgacgtggagtccatcatcctcaacgacttcatggacagcgacgaaatggacttcaacttcgattcggccctgcctccgccgccgccgggcctggccgggg

SEQ ID NO: 102534 - DNA, 30 bp, Homo sapiens; identical to SEQ ID NO: 69506
  chr1:41848613-41848643
  Hyper

SEQ ID NO: 102535 - DNA, 99 bp, Homo sapiens
  chr1:41848877-41848976
  Hyper
caaatcgccctccgacgaccgccacccccacagttcagtctccccctcccatccctgccggccctcgcttctcccctcccccgtcggagtcagtccctc

SEQ ID NO: 102536 - DNA, 66 bp, Homo sapiens; identical to SEQ ID NO: 69509
  chr1:41967207-41967273
  Hypo

SEQ ID NO: 102537 - DNA, 195 bp, Homo sapiens; identical to SEQ ID NO: 69510
  chr1:41991590-41991785
  Hypo

SEQ ID NO: 102538 - DNA, 115 bp, Homo sapiens; identical to SEQ ID NO: 69512
  chr1:42128232-42128347
  Hyper

SEQ ID NO: 102539 - DNA, 30 bp, Homo sapiens; identical to SEQ ID NO: 69513
  chr1:42610107-42610137
  Hypo

SEQ ID NO: 102540 - DNA, 23 bp, Homo sapiens
  chr1:42633276-42633299
  Hypo
tgtgctgacgtgtgtgtatacac

SEQ ID NO: 102541 - DNA, 78 bp, Homo sapiens; identical to SEQ ID NO: 69516
  chr1:42802583-42802661
  Hypo

SEQ ID NO: 102542 - DNA, 30 bp, Homo sapiens; identical to SEQ ID NO: 69517
  chr1:42803057-42803087
  Hypo

SEQ ID NO: 102543 - DNA, 75 bp, Homo sapiens; identical to SEQ ID NO: 69519
  chr1:43209082-43209157
  Hypo

SEQ ID NO: 102544 - DNA, 154 bp, Homo sapiens
  chr1:43250818-43250972
  Hyper
ccggctccatcttcccgatgtggtcgcggctgaagccgggcctgggcattctcgggacagccagagtgggccaggggaccacgtcccatccccagaggccggccctccgtcggagggtttccagcctccaggaaaggagcgggggctgggaggg

SEQ ID NO: 102545 - DNA, 30 bp, Homo sapiens; identical to SEQ ID NO: 69521
  chr1:43393760-43393790
  Hypo

SEQ ID NO: 102546 - DNA, 30 bp, Homo sapiens; identical to SEQ ID NO: 69522
  chr1:43414183-43414213
  Hypo

SEQ ID NO: 102547 - DNA, 57 bp, Homo sapiens; identical to SEQ ID NO: 69523
  chr1:43446019-43446076
  Hypo

SEQ ID NO: 102548 - DNA, 16 bp, Homo sapiens
  chr1:43531822-43531838
  Hypo
gcgcccagccaagatg

SEQ ID NO: 102549 - DNA, 353 bp, Homo sapiens
  chr1:43533892-43534245
  Hyper
ggcaggcggggtgtgcgccccggccgcttccagtcggcgcgggagctgggacggaagctgtgcgccctcggagcccctgcagtcccctcaccgggcgctcccaaacagcccgcggggcgctgggcgcggggccaggaaatccggcgccggcccttgaagcgcacccgggccgggagggggcggcgggggcggcgggggcgggctgggcgctggcaccacgaccgcccgctgagcaacgtgactgcgcgggctcgggtccccaccaggacaaggcggcctctgtgccgacccagctgattcctctcgggctgcaaatcccttccggctgacagccctgccggctggggccaggc

SEQ ID NO: 102550 - DNA, 369 bp, Homo sapiens; identical to SEQ ID NO: 69527
  chr1:43613473-43613842
  Hyper

SEQ ID NO: 102551 - DNA, 30 bp, Homo sapiens; identical to SEQ ID NO: 69528
  chr1:43750677-43750707
  Hypo

SEQ ID NO: 102552 - DNA, 30 bp, Homo sapiens; identical to SEQ ID NO: 69529
  chr1:43752107-43752137
  Hypo

SEQ ID NO: 102553 - DNA, 30 bp, Homo sapiens; identical to SEQ ID NO: 69530
  chr1:43787010-43787040
  Hypo

SEQ ID NO: 102554 - DNA, 92 bp, Homo sapiens; identical to SEQ ID NO: 38953
  chr1:43826882-43826974
  Hypo

SEQ ID NO: 102555 - DNA, 91 bp, Homo sapiens; identical to SEQ ID NO: 38954
  chr1:43834716-43834807
  Hypo

SEQ ID NO: 102556 - DNA, 89 bp, Homo sapiens; identical to SEQ ID NO: 69534
  chr1:43893329-43893418
  Hypo

SEQ ID NO: 102557 - DNA, 49 bp, Homo sapiens; identical to SEQ ID NO: 69535
  chr1:43919778-43919827
  Hyper

SEQ ID NO: 102558 - DNA, 57 bp, Homo sapiens; identical to SEQ ID NO: 38955
  chr1:43991727-43991784
  Hypo

SEQ ID NO: 102559 - DNA, 30 bp, Homo sapiens; identical to SEQ ID NO: 38956
  chr1:44000506-44000536
  Hypo

SEQ ID NO: 102560 - DNA, 30 bp, Homo sapiens; identical to SEQ ID NO: 38957
  chr1:44016696-44016726
  Hypo

SEQ ID NO: 102561 - DNA, 57 bp, Homo sapiens; identical to SEQ ID NO: 69540
  chr1:44043730-44043787
  Hypo

SEQ ID NO: 102562 - DNA, 115 bp, Homo sapiens; identical to SEQ ID NO: 69541
  chr1:44068774-44068889
  Hypo

SEQ ID NO: 102563 - DNA, 30 bp, Homo sapiens; identical to SEQ ID NO: 69543
  chr1:44304865-44304895
  Hypo

SEQ ID NO: 102564 - DNA, 142 bp, Homo sapiens; identical to SEQ ID NO: 69544
  chr1:44351091-44351233
  Hypo

SEQ ID NO: 102565 - DNA, 30 bp, Homo sapiens; identical to SEQ ID NO: 69545
  chr1:44396459-44396489
  Hypo

SEQ ID NO: 102566 - DNA, 351 bp, Homo sapiens; identical to SEQ ID NO: 69546
  chr1:44401909-44402260
  Hyper

SEQ ID NO: 102567 - DNA, 45 bp, Homo sapiens; identical to SEQ ID NO: 38961
  chr1:44463208-44463253
  Hypo

SEQ ID NO: 102568 - DNA, 173 bp, Homo sapiens; identical to SEQ ID NO: 69548
  chr1:44463830-44464003
  Hypo

SEQ ID NO: 102569 - DNA, 150 bp, Homo sapiens; identical to SEQ ID NO: 38963
  chr1:44497521-44497671
  Hypo

SEQ ID NO: 102570 - DNA, 146 bp, Homo sapiens; identical to SEQ ID NO: 69550
  chr1:44584392-44584538
  Hypo

SEQ ID NO: 102571 - DNA, 92 bp, Homo sapiens; identical to SEQ ID NO: 69551
  chr1:44718072-44718164
  Hypo

SEQ ID NO: 102572 - DNA, 423 bp, Homo sapiens; identical to SEQ ID NO: 69552
  chr1:44726893-44727316
  Hypo

SEQ ID NO: 102573 - DNA, 30 bp, Homo sapiens; identical to SEQ ID NO: 38967
  chr1:44794138-44794168
  Hypo

SEQ ID NO: 102574 - DNA, 26 bp, Homo sapiens
  chr1:44871018-44871044
  Hyper
tcgcgaacacaaacccggggccagcc

SEQ ID NO: 102575 - DNA, 86 bp, Homo sapiens; identical to SEQ ID NO: 69556
  chr1:44871104-44871190
  Hyper

SEQ ID NO: 102576 - DNA, 1552 bp, Homo sapiens
  chr1:44872293-44873845
  Hyper
gcgaccttctctgcccggaacccagccccgccaccgcactccggagcctccggcctcccccaccccacccccgccccccaacccggggcttttcagggctcggcctgggcgtttcgcctttgtgctttgtaagagaaagccttttcttccagggcacaacaaacttgggcggagagcttccgtgtggccccccgggcgaggccgcccacggtggtgaggccatccgaggggatgcccggttcatcccccagtccaggagcctctccgagagctcgcggcccaggtcgaccccagctggcgagggcgcgcaggagtcccgaagtagcggggactagggcagccaggaggcagggggaaagctctcgcttcccgttaagcacaccctgcattctcgggtcgtggatgcagctccagcggagagcccgtgttccggccctgagccaggcgcgcgtcgcactgggtgggtgcatggggcccgggccataggtgtgggggcacagccctacctggccggcccgggtcgtctggggtctgcgccggcccactggcccgggagccgccgagggggagagcaccgcactcgctgcccacgacgcccagcagccacatcttgcctctcgcctccgctccggactcggcttgaggggcaaaggggagagaaaggaaaaataaagaaaaaaaagggcggcagtgaggaagcagcgaggggactggggggagcagagtgggcaggggggctttgccttgcctggcctcctctttccgtctcgcgggctcttcctgcaaaggggaatgagcagaggggggaaaggcagaaagagcgtcgaggaagagcggtgctggcgtcttccgtgccgatccctcctggcccgcagagacccggcaaaagtggcgtgagttcgcttgctgcgcttcgaggcaaggctggggaaggccgaggacggggcggcgccgcgtcgcgccgctggtggccgacagggccggggccgggcgcggagcgagcggggacacacacctgttctgcgagccgcgcggtgtgcggcggccggacggccgcggtgcgggccgcagaaccctccctcccgcactgcgcatccgcagtccaggagctggaagggcccggcagccccgcgccggtccgtatttgcaggagaagcgggagtggaggagtccgcggctgcccgctgaagcggtggtgcgcgcggcggcgggacccgggtgacccccggggcggggctgctcgggggctggaggtccttggactttggtcgaaggctggcagctctgagcccctgccccgcgggccccgcgcggctgcggaccaggggcccttgcacgtgtcggttcttcctggactggcgctttggttgcccaaagttgggcgcagattgtttcgtgcggaggttgttgggacccagagtattctatatacaaaggcaaccgagagccggagggagaggtcgggccaaagagtagtgggctcggctccgcgttgggcccaagtttatgtaggtttcgccttcacctcttcttcccccgttttccctaaaag

SEQ ID NO: 102577 - DNA, 1216 bp, Homo sapiens
  chr1:44883069-44884285
  Hyper
tggggccaggctggacgggagcagtccctgatggctgcagagccatctggcctggcttggcttggctcggcgcgccgctcgcctggcggctgggctcgctgtagttgtgctcccgctcttcccctgccctcgctccacgccgcgccgctctgtgcggcggctgcctcctcttacggccggaatgcctaatcaccatggtgagaaaacggacaccgcagccgtcctccctcctcgccccgcgccctccctcccatcaattgtcatgcagaagtgatccgggctgccgttttctcgcggccgcccgccagcccctcgccgctgccggcagaagggtggctggtaattgatcttctgggggagggggcgcggagaggcgcgagaactggccccggggaggccaggccacggggtgggccccgttcgcttacttgcaagggacccccagcctccgccaccgaggcggcttgcaagtggtttcagaaatgttggtgatctcgccgtcgctctgcagcacttggaggccgcaggaggactccgcgcgccgcctcgagggccgggagcgcccagcccgcggccgcacacacgagggcccgtcgcgccccccgccctgccccgcctcgccctccacgtccctgcacccccaagtcgcactaagaacccagtccccgatcggtttcctctacgccgtctgagcagaagagagtgggaaccggggtgacggataaggggggggcgcccacgcgacgtcggggtgcatgggagcgcgcgggaggcgctagtgggtgcacggggcgtgagggggacacagcgcgggcgtggggatggccactgcgcggggagggttctgcctggagaaggagggatgggaggaggttgggggagcagggcgcgtggaggagggaggttggacgtgtgtacagcgcctggggacctcgctggccccttggtgcccccaggactctgaggcttctcctttcggcttgaaatgtttttcccttcctgcttttcaaatctgtaaaaatgttccggggaatgtttccgaagtccagggctccgtccttcggcgggattgctggcattcgggcaaggcgagtcgcggtggcctctgaggctcgcagccagcacagcggggctcgttaaagtctgggcaatttctggaactcttcccacgggaagttttccggggctgccttccggtcagcggccccaggttgat

SEQ ID NO: 102578 - DNA, 30 bp, Homo sapiens; identical to SEQ ID NO: 69564
  chr1:45063652-45063682
  Hypo

SEQ ID NO: 102579 - DNA, 62 bp, Homo sapiens; identical to SEQ ID NO: 38968
  chr1:45103094-45103156
  Hypo

SEQ ID NO: 102580 - DNA, 49 bp, Homo sapiens; identical to SEQ ID NO: 69566
  chr1:45106627-45106676
  Hypo

SEQ ID NO: 102581 - DNA, 38 bp, Homo sapiens; identical to SEQ ID NO: 69567
  chr1:45156636-45156674
  Hypo

SEQ ID NO: 102582 - DNA, 30 bp, Homo sapiens; identical to SEQ ID NO: 69568
  chr1:45194741-45194771
  Hypo

SEQ ID NO: 102583 - DNA, 18 bp, Homo sapiens
  chr1:45197991-45198009
  Hypo
ttttttaaagagtctcgc

SEQ ID NO: 102584 - DNA, 20 bp, Homo sapiens
  chr1:45240494-45240514
  Hypo
caccgcgccaggcctaaaaa

SEQ ID NO: 102585 - DNA, 384 bp, Homo sapiens
  chr1:45250005-45250389
  Hyper
acgcggccgaagttccggaggctgatggccggggagggcgcccctacgcccaggaagcggccgagcaacggggtctgcgcggcgggcgcgggccgaccagatccgggggacgcctccacctgcaggctctgctcagggtcgtcgctcatgctgcgggcgggagggcgggctgagccggggcacagggcgggagcggggacgcgggatcggctctcggggaaggaccgaggcatcggtgccccagaggctgagcgaggacccgcgtgccgggtcaggcccagtgcaagccactcaccgcaggttgaaggtggagcccaggaatgagggccgcagagactcggccgccgtggccacagtgtagggtggctgcggctggtcctcatc

SEQ ID NO: 102586 - DNA, 434 bp, Homo sapiens; identical to SEQ ID NO: 69573
  chr1:45251837-45252271
  Hyper

SEQ ID NO: 102587 - DNA, 24 bp, Homo sapiens
  chr1:45264938-45264962
  Hypo
aggcaaggtggctcacgcctgtaa

SEQ ID NO: 102588 - DNA, 100 bp, Homo sapiens; identical to SEQ ID NO: 38971
  chr1:45280516-45280616
  Hypo

SEQ ID NO: 102589 - DNA, 100 bp, Homo sapiens; identical to SEQ ID NO: 69576
  chr1:45293217-45293317
  Hypo

SEQ ID NO: 102590 - DNA, 80 bp, Homo sapiens; identical to SEQ ID NO: 69577
  chr1:45308235-45308315
  Hypo

SEQ ID NO: 102591 - DNA, 113 bp, Homo sapiens; identical to SEQ ID NO: 69578
  chr1:45308747-45308860
  Hyper

SEQ ID NO: 102592 - DNA, 104 bp, Homo sapiens; identical to SEQ ID NO: 69580
  chr1:45466045-45466149
  Hypo

SEQ ID NO: 102593 - DNA, 30 bp, Homo sapiens; identical to SEQ ID NO: 69581
  chr1:45468126-45468156
  Hypo

SEQ ID NO: 102594 - DNA, 16 bp, Homo sapiens
  chr1:45645619-45645635
  Hypo
aggagccaagatggcc

SEQ ID NO: 102595 - DNA, 23 bp, Homo sapiens
  chr1:45936888-45936911
  Hypo
caagactccgtctcaaaaaaaag

SEQ ID NO: 102596 - DNA, 38 bp, Homo sapiens; identical to SEQ ID NO: 14239
  chr1:46079131-46079169
  Hypo

SEQ ID NO: 102597 - DNA, 352 bp, Homo sapiens
  chr1:46632620-46632972
  Hyper
ccgcacttctagctgcgttcaaccaggctcaggaggtccttcaagatcttggcttccttttcctgactccgcgcccggcgcggttaattatagccccaccccgcgactacctgcttcgctcccacccgcgcgcccaggaccctagctgcgggactctagcggggaaggcacccccaattctgggccctggcgaccttgggtcagggccaggaaaggcacttccagccaagcgctggcgccgggtgcgcctcgctttacggaaagaacgccccgcgaataaatccggagcggatttgcatcacagcagccgcgagaaggctagctgctgccaaagctccgaagctctggatgt

SEQ ID NO: 102598 - DNA, 41 bp, Homo sapiens; identical to SEQ ID NO: 69590
  chr1:46653449-46653490
  Hypo

SEQ ID NO: 102599 - DNA, 40 bp, Homo sapiens; identical to SEQ ID NO: 69591
  chr1:46668917-46668957
  Hyper

SEQ ID NO: 102600 - DNA, 51 bp, Homo sapiens; identical to SEQ ID NO: 69594
  chr1:46859925-46859976
  Hyper

SEQ ID NO: 102601 - DNA, 883 bp, Homo sapiens
  chr1:46913659-46914542
  Hyper
gggccctgactaggacgttacgggaagggggtcttgaattctgatctcgtttctgcctaagacctatcgcctttttgaacctcagtttcccctttggctgcatagggaaggggtgcccacatgcccccgcccgcattcagttcgaaggaccagccagtaggccctgcgccgcccagggaccgcccggcctttgcgtccggcccagctcaagccccttccgccgcgcgcggcctcgggagcgctgggcaggcagcccgggtgggagcgcccacgtctcccgcggacacggacggacggatggacgggcggccgcgcaggcccgcgccccgctcccgccccgcctgccgcgcctcccggggcgcccgcattaaagcgcatatgcaagccatgaattatcaactgaaaggagtcaattaccggctctaaaaacgagtgtctgcgctcgcagcgccccgggccatccgcctatttacggagcgatctaccccgcccggctggggagggggcctcgggagggagagagacggagaaacggagcccgagaccgggagagagccggagaggcagggactggagagtctgggacacgaaggagaggcggggagagaccgagattcagcgagacgcgcggagggccggacgggagccaaggcggctcagttcctcttctcccccgagcaggcgaggagaggtggggtctcaggacctccaaggccctgttccccttccattggcatttgtgtaaggacgcaggccctccgcactgctgactgtggcactgggcagggagtcccctagactaggggtttggggttagatctggggctcaggcagcgctgggctgggcgtagtttgcagagggaccggccgtcctggcaggaaa

SEQ ID NO: 102602 - DNA, 111 bp, Homo sapiens; identical to SEQ ID NO: 69599
  chr1:46921772-46921883
  Hypo

SEQ ID NO: 102603 - DNA, 249 bp, Homo sapiens; identical to SEQ ID NO: 69600
  chr1:46932507-46932756
  Hyper

SEQ ID NO: 102604 - DNA, 593 bp, Homo sapiens
  chr1:46951169-46951762
  Hyper
gggggtatctctgagcggtgaaggggagtagccgtcggagggcggggacagagcggtagctgccttgcgctgggattgggggtgggggtgggagtggggagggctctttaagcggcggccgcgctaataacctgtccaggagatggctcgtggcaaattgctttgttagtcttgtcagcgcggccggggccgccgtcagcgcgcgccatggatcaagatgatgaatcgctgcggacggcgcagatgcgggcggcccgcggccgggcccccgggtaggggtgggaggtggagggggccgcggggggcccggccgccgccattaactccggaattaggtctaagccgcccaccacccagccactgccccggggagcgccagccgttggggcgggagcgggcccaggatggggactgagacccgcgtcccccacccgaacctggacctagcctcctctgaacgcagagggcagtgggccgcccggaaggggcggggaggggccccggccctcaagccgcacagccaggtgttcccgctcttcgaggacatcccctgcccgcctggaggttgagagggcggccgcatggggcattcg

SEQ ID NO: 102605 - DNA, 40 bp, Homo sapiens; identical to SEQ ID NO: 69603
  chr1:46954864-46954904
  Hyper

SEQ ID NO: 102606 - DNA, 930 bp, Homo sapiens
  chr1:46956241-46957171
  Hyper
cagcttcctggtccacgcgaaccccgcagtgctccgggcattgcccgggtctggctttggtctcgcccgcgcagatcccgttcaaactcagctgccaccaagtgcgccttttctctctggattgcgattctgcacgaattttccagttgagggtggttcggcgctcagccagcctctgccctcgaagacgcggccttggtctaggaaccttcaggtgggtgtttggggcgcagtggccctagttccctagaattcgttttgcctcccgcggcctcagccggcgtgggtcaggcgagctccggcgaggaacggcaggctggggccagtccccggagcggctctcggggcgcttctaggggagcagtcaaagggttgcgaggactgccagggtctttcctccctaggcttcccacactggatggccgtaactcagtcgttgacggcgacaggccaggggccctgatggactgtgcagggtcccgggcaccaccggctgaactttctggcggtcacaaattcccggaacctgcgcaggggcttcgttggcactggtggttcacttaaggagcttgagggaaacctcctcttccccaaattcgcaccaaatctggggccccgacttttcctggattccagccacactcggtttgggaggcagtgggctcctcaggcttgtgatttgcggcaggaaggagtcccggaatggaagaacggggaggacgagatccgaggccttttcaccctctttgcaagcatgcagttcaccaaagccgagaacccaccgggcctggagcgcagcctcagcgctggttccgacccgggccccagaaggtctttttcgtttgagaaaagtcctcggaggccggggcagggtgcgccgatattggtttactaagggcgcctccagtttgagggcgttggggaaagagg

SEQ ID NO: 102607 - DNA, 30 bp, Homo sapiens; identical to SEQ ID NO: 69607
  chr1:46958750-46958780
  Hyper

SEQ ID NO: 102608 - DNA, 350 bp, Homo sapiens; identical to SEQ ID NO: 69609
  chr1:46998912-46999262
  Hyper

SEQ ID NO: 102609 - DNA, 683 bp, Homo sapiens
  chr1:47009449-47010132
  Hyper
ccctcagccccctcccgccagcgtcccccagctccttcacttgcctgagcccgtccgtggacactcccctgcgggtccgaccaggctgacccttgagcaccctgggtcagcaggaaggaaagaccccgagagcgcaggaccaccaagagaggccgggccacctcctccgccgtccgctgacttctaggggctgggccggcgcacagcaagggggttggaggtggggtcgccctctcccacgcggctgggtttccaggcggtgtcctgggccgagccgcttggagatcctagatcagcatgtgggtgggaaagggcgccccgtcctgggcccccccgcccctgcgcgcagagcagagacgcgcagacccgctcccactccgcttggctcccttggagcagccccggcggcggcagcgatgggctgggaggggccggcacgctggcctgcgcgggtccccagccgcctcccgccacccggaacccctctccttcaagcgttgaccgccgacccacagctccccttcaacccggggcgagcggggttcttaccatacacctcccctctccgctcggttccatccttctcccgttctcctctaggcttcacggtttgcaagcacccttgcaaataactcctagcccacccacaccgtctcgtccgcactttccgagagccaggcacg

SEQ ID NO: 102610 - DNA, 30 bp, Homo sapiens; identical to SEQ ID NO: 69613
  chr1:47041243-47041273
  Hypo

SEQ ID NO: 102611 - DNA, 137 bp, Homo sapiens; identical to SEQ ID NO: 69622
  chr1:47691603-47691740
  Hyper

SEQ ID NO: 102612 - DNA, 793 bp, Homo sapiens
  chr1:47694793-47695586
  Hyper
ttcctcaccccaggccggaacacaaggccttcctagacaccgtttccaccggcaccattcccctgaaaactcacctggggcatatttagagagaccggcccctctgaataggatctccactccgccggaaaggggcggaagccgaggaagaggatgcacacccgggtctttgctttccccctttttcgctgagaggcctgcagttacgctgcggtgtggtcctgggcgatctgccgcgcccaaagcgagtttccaggaaagataggggtggagagaaagaggcagggcaagagggagggagagagagaaatgggggtcaatggctgggaattacctcctgtccccgaccaaccagtccagggaatcgcaaacagctttccgcccccaacctgcaggtgtttggagcctttcctctaccccctcctccccccacccgccttaaaaaaccctatacatgaccaatcaggaatagctatttagtccaacagcaacaacaacccctcccgacaggctgtctggaacattttcgaaccctccaactgggatcggtctggttcagtgtttgttttctaagcagggaggtgtctacgcggttgcctcctcagccaggtctccggctgccgctacaccgcgaagggatagtcccgggcctggatgggcggaggtccgtgttgggaaaggcgaatagtcttcagactctggtcggtgggacagaaccttgaagtcccccccacctcattctctctctgacccccatccacccacctccagcccaaagcgaaaccagaaccca

SEQ ID NO: 102613 - DNA, 2314 bp, Homo sapiens
  chr1:47695896-47698210
  Hyper
aggtaaaaacaaacccgacactactttcaaggatgtagcaggattgagcttgcttttattttttcctagtggattttgtttaatttgttttgcctaaatcgtcaggcttatgatcacacatcgaagtcttggattaactgcgaaggcctccttctatttgccgcggctttggtggacatataggaataattcttccctggattgcaatacaatgcggaagattttctttctcctcttctaatccaaaagaggggaggggaggaaagaagaggggaatccatccattcccggcgtgttcgcggggggttaatgttgcgtgttcgctgggggttaatgtttgccttatgaccaagtctctgtgtccgtgcctctctccattttctcttcctacctcaaacccagcaacttagaaaacggctgtagcggaaaaaaacccgctgctttgttctcccgccaaaggagccaaaagggacaaactgctgcgctctgggatgattattttaattaaaatagatgttaatgatgacgattgtgatggtgatggcattagcaattacaataattgacaaaacaaaattctttcaacccgagctagggccccactaacccggtccctcccagagcccggattcggcctcggtctcggatgcgacgggtatcagacccaagcggcaacgtcgctcacccgaagagggggcgggaaaatcttcccaggaggtgatcccgaatgtccccacccgaggctcgaggcctggtgaatgtgcccattgtcctttcggggcctctcccttggagcccggcggccgcacccacgaaactgaccagaaatggatgaagccggagtgcagcgggaaccgaagcccgcagctaccggctcgaaggcgccggcctcggcgagcgctgctcagcttcaagcctggaggagcctcccactcaccaacgaacccctcaaacacctaggcacaggcgggcctccgggcagagcagccgccgaccgggcgctgtccgcccacccaagccaacaactggctcccgaatacatcataatttggaataaaatgtgaaatcccgctccccgcccccatgccgccgcccccaccagcgcctcgatctctcgctcgccctccccccactcccgcccccagcgatttgcaaacgcacctctaaaggacacaggcacacaggcatacaactcagtgcggacaggaccacacagggtccagccccacagaagggcagcaaacaaacaccacctagcactgccccagaagccgacttggtcagccccgcacactgcccaacaggacacaacgaaatcagtcaaacgcagcggctcacggacacacaatccagcacagtcgggatcacacacgcccgacataacgacgacaccacccaaacacagtcgcaggggccacacacccccacacacagaatcagatccctgctgagaacaccaacggagcacaatcgtacgcaacgaagaaaacgcagaagggcctcgaagggtccacatctacacaccccaaccgcgcaggcacaccacactcggacacagagcctgtcgccaagaagaccacacttagaagcagccaacgccgcccacagttctcatgaacgcactctcacaatcccaccgcatgcacacaaccacgaagaagaaatgaaaaccaaccacagcctcgcgcatttctgtatattgcgtaaggaaaagggggaaggaaggaagagagtctccgaggcgggaggggcggcggcagccggggcgggggcgtccgtggaaaatgcccccccaccgccccccccggccatcgaaaggaaccgagggaaagggagcgaagacctcttttgcggacgtggggaaaaagaggaggaaattgatgaagaattcggtgggaggccgcgggttgcttttcccctagaaaaaggccagaatgctcacgtttttccgctacgggggtacgcgtgtggccattttgaggcccggtcctgagcggcggcggcccggcccctcccgcggcccccgctcccccgcccgccccgcgcccgcccggcccctccaccgacgcgctgtaatcccactcacgttccaggcctcgttagcatgggccgaggcgcgccggggccgtgtgcgccgcagagataaggcactgccgcgggtccgcccgcccccgataagcgcctcggccattatgggccaaatgattcattttaatttggcaatttcaccggagggagtggggactggttgagcggcgctaggaccggctccggaacgcgctgcggggagcgttggacgcgctgtctaggaccc

SEQ ID NO: 102614 - DNA, 30 bp, Homo sapiens; identical to SEQ ID NO: 69630
  chr1:47701225-47701255
  Hyper

SEQ ID NO: 102615 - DNA, 84 bp, Homo sapiens; identical to SEQ ID NO: 69633
  chr1:47749513-47749597
  Hypo

SEQ ID NO: 102616 - DNA, 391 bp, Homo sapiens
  chr1:47881997-47882388
  Hyper
gcagcgacatggatccgcccgccgcgttctctggcttccctgccctgccagcggtcgcgccgtcggggccgccgccgtcgccgctcgcaggagccgagccagggcgggagccagaggaggcggcggctggccgcggagaggcggcccccacgcccgcgcccggcccggggcggcggcggcggcggcccctgcagcgcgggaagccgccctactcgtacatcgcgctcatcgccatggctctggcgcacgccccgggccgccgcctcacgctggccgccatctaccgcttcatcaccgaacgctttgccttctaccgcgacagcccgcgcaagtggcagaacagcatccgccacaatctcacgctcaacgactgcttcgtcaaggtgccccg

SEQ ID NO: 102617 - DNA, 100 bp, Homo sapiens; identical to SEQ ID NO: 69637
  chr1:47882747-47882847
  Hyper

SEQ ID NO: 102618 - DNA, 355 bp, Homo sapiens
  chr1:47904375-47904730
  Hyper
gcgagccgggcaacccgggcaagggcaactactggacgctggacccggagtcggccgacatgttcgacaacggcagcttcctgcggcgtcgcaagcgcttcaagcggcagcccctgccgccgccgcacccacacccgcaccctcacccggagctgctgctgcgtggcggggccgcggcggcgggggatcccggcgctttcctgcccggcttcgctgcctacggcgcctacggctacggctacgggctggctctcccggcctacggcgcacccccgccggggccggccccgcatccgcacccgcacccgcacgccttcgctttcgccgcggcagccgccgccgctccttgccagct

SEQ ID NO: 102619 - DNA, 718 bp, Homo sapiens; identical to SEQ ID NO: 69640
  chr1:47909442-47910160
  Hyper

SEQ ID NO: 102620 - DNA, 599 bp, Homo sapiens
  chr1:47910434-47911033
  Hyper
ttccagctctagtttcgggaacggatttttccgcgggctagtgggcgcggcgcggcgcagggcggagcgggcaccgcctccttccgtagcggagcgagagctgccgctcgaggctgaggccgctccggaggcctggaggcttcggactgctggactagtggggaaggaaggcggtttcctccgcagcgccccggtgctgcactccgcaccgtcaccttctgggttgtttctggcgctccctctgctctcagcctcgagtcctgggtccctgcggagcgctgtcttttcgctccacgcggactctgagcggaagtcgctcgctgtccgcgactttgcatttctcctgcagcaggggtctctacccggtgccttcctcccggcacgctagcctcctcgccgaaatttcgtcgtcccggagtcggtaaccgagtcccaggctttactgccactccactccctgctgggttatttaagagatacgcggcttccgaggggttttcatcagaccccgcaagtgcgctcggctgggaaggatgcgctccgatgccgctacaggggttccgcgcgtttcaccgcgggaagcccgggcattggagatc

SEQ ID NO: 102621 - DNA, 30 bp, Homo sapiens; identical to SEQ ID NO: 69643
  chr1:47911260-47911290
  Hyper

SEQ ID NO: 102622 - DNA, 63 bp, Homo sapiens
  chr1:47911816-47911879
  Hyper
cagttcactgggtgccggctgccccagccagctatggtctgcagagcccgaaggcaggcagga

SEQ ID NO: 102623 - DNA, 30 bp, Homo sapiens; identical to SEQ ID NO: 69645
  chr1:47944568-47944598
  Hypo

SEQ ID NO: 102624 - DNA, 382 bp, Homo sapiens
  chr1:48058924-48059306
  Hyper
ccgcacctcctgctccgcggcccgccgccgccagcccggggctgacctctcagagcagggcggaggattttcacagcacagcttcccgagagagcgggattaagggggaactgctcgggtgggccagagccaggggctagggggaggccgggcggaaacccaaaacctccgcagctgtttccagtttgccgccctggctggaccgcggtggctgcgtgcagagcgagcaaggctgcgcgggcctggagcgcccacggggcgcgggacctctctctgtctccccccgccccgcggggctctctctcgtcctctctgtcttggtggggctcagtctgtctctcgttttctctccctgtttctaagatctcgtggaatcaaagac

SEQ ID NO: 102625 - DNA, 51 bp, Homo sapiens; identical to SEQ ID NO: 69647
  chr1:48175121-48175172
  Hyper

SEQ ID NO: 102626 - DNA, 304 bp, Homo sapiens; identical to SEQ ID NO: 69648
  chr1:48190874-48191178
  Hyper

SEQ ID NO: 102627 - DNA, 154 bp, Homo sapiens; identical to SEQ ID NO: 69649
  chr1:48247049-48247203
  Hypo

SEQ ID NO: 102628 - DNA, 338 bp, Homo sapiens; identical to SEQ ID NO: 69650
  chr1:48462159-48462497
  Hyper

SEQ ID NO: 102629 - DNA, 714 bp, Homo sapiens
  chr1:49242299-49243013
  Hyper
cttgtggagcaacagcgcgccccagtcgcggggggcgcgcggggggctctcgggcccggcgcccaattcctccgggccccggtacacggcgtacaccttctggttgtcaaaatccagccgcgagcgggggctgaagtcgcgcacgcacgacacgggcagcgcgtagcagacgttgtcctccaggaaccgcacaaaggcgtacatggtgggcgccgggggcgggccccggtcgggcagctcagcccgcggggcgggcgcggaggtggggatccggcggggggcgcgagtctcgctacggtgctggggggggcgggggcggctccccaggacccaggctccccccactgttattgttcctgaaagcaccgttctgccaatcggctgctttcgcctgggcgcggaaaagggagggagggggggaaagggggacgaggggcggatgaggggggtttggaagcgcactgccacttgcaaagtcagacccgagcaatcacagccggagcgcgattcgaatggggagggaaaagggttcagagattcagttgcaataaaaataataacaagagcattgcaggaaaaaaatgcattgattaaaaggtgcgctgcgtgcaggattatattgcttcaacaatcgcgctgccaaattgcattgcaacaaaactgcattgccaagtagagaagtgtatgagtgagtgaatgcgggataggggtggg

SEQ ID NO: 102630 - DNA, 225 bp, Homo sapiens; identical to SEQ ID NO: 69654
  chr1:50489447-50489672
  Hyper

SEQ ID NO: 102631 - DNA, 601 bp, Homo sapiens; identical to SEQ ID NO: 69655
  chr1:50513629-50514230
  Hyper

SEQ ID NO: 102632 - DNA, 984 bp, Homo sapiens
  chr1:50798652-50799636
  Hyper
aaaggccagctggggcgccagacgactcgccctgccccgtcgacgccccagacggtgttgccgacctccgccccgcagcgctggtgtgggcgcggccggacctcactcagcctgcactgccccgcgccgctcgccgcgtccacactgtccttgggaggacgcgcggggaagccgcgcacgatgcggcagcgccccctgccgggctccgggcgctccgctcccagccggctcggcgagtgctccgggaaaggggtccggaccccacacgcactgggttccaggacaggctctcgctcgggctgggccgactctggcccgcctaggccccgggcacgctgcagtgaaggcggtaccctcaccacagtcacagaacgtgtcggctgcccgcgcgtcctcccaaggacagtggacgggagctggggctggagagggtaacgacctgcccaaggtcacacagcaccgcagtggcacagccaggactggcacccacacctcccgcggaaccttgcaggggcccaaaccacctgggttctagagctccttgaactggcctcttgggctttagggaagagctggggacgagggaatggggtggggccacaccacattagcacggacccttgggtgacttgggcggaagacggggcgtcagggccgcctgcgcgcgcgtgacctccaagggtccttctggcgctcctccggcgctgcgtgcggcgctgggctgcggctcacccgacacaccggcggcagccgcggctgccccctactggcggaaggaagagtcgccgctccggggcccttggcggccgccgctcttcgcgcctccttggcctggctgccacccttccaccctcgggggagaccccgcgctctgtgctcactcggggaagagaggctcaatcacggcctggaccagcactagggacctaaacgctcttctcagtgtgcgtgaagccaggtcctcaaatccgccttcagtaagag

SEQ ID NO: 102633 - DNA, 4730 bp, Homo sapiens
  chr1:50880848-50885578
  Hyper
aaggtgctagtgtgtcgctgctgctgctgttgtgcaggaggggtggggcggggaagctccccaccagtcggagctacccgcggcggcccgggttcgcatcctcccactgctcagaccgagtcggctccagcttgctttgggaagcattcaggaataaacgtggacagtagcggtcaggaaggagattcccgtttccccttctcccaggaggaaaagaggtaacgctgccgccactgccctctctttccagggtgggaacgccgcccgagaccggggtaccccacactcctccctagcgctgatcccagcggagctcaggccgcagtcccctcctgccggctgcggaagctcccagaagcggagactcaatcgcccccctgcccctgctaccaggccagagtctggagtacagatactggctccctggggcctgggtgtgcgaccccaggccggtcattgcaggtctctgcgcctccctgttcctgactgtgcaatgggcagcgggtcaggggcgcaccgtgggcgcagtacgttcccaggcgccaagggctgtgactgaccgacctgggcttccaccgcggggcctgggccatggagacgctccgggcccaggaacgggggacctcgggtgccccactacctcactcctagaacgcccaccgctcacgaagccttcctgagctctacccgaaggtgctgacagcctggagctgaggccaaggcgcttgggggcacgctgcttctccctgggcctcctatgttcacggaaggagagtttccgcaaacctctcactctcggccagcagaccccgcttcatgagaggaggagacccactaggggcggtggagaggcgaagtgatccagggtcccggaaagttggacaattccctggaccagatggctctcagtttcctcctctgtaaaatggggccggtaataagcaactctctggattcaccccggtttgctgcgaggatgaactaatataatagtctttaagtctgtgacgctccagatgttcttgggaatgagtaacgcgggtccacaggccgccccctcgggtccggccagagcatcggcaggaaccgaggagcctcgggggacccagcgtaggtccttcccgaaaccaacaccttgggtgcggtggggcagaggacggggatgaggcggccggaaccgccctacgaggagaggctgggaggctccgaaaacctggggtagggggagcgcaccggggctttagagggcgcagcggccaagggcaagaaagtttacactcccagaagcttccgcacgctttctcccgcctgcctcttttctttctaactcttccctctcctgtctcctctcgccctcttttttctccttttttatccccttttcgtccatcgctcttgccggcatctttcttctctgggtccttctcccccactttcatctcatcgcgctcgcacttcatcaccagacagccaaaccccctttccaattaaagtggaattaggcaactcaatcaaattagttccccattaaagcccttctttattaaaccgttttcttgtcctgctattaagtttcactgcctggcggaactcgagccggccccagaagtttaccttgggatgtcgccggacccagccgaggggaggagtcattcttttcctggagcgggggagtcaccctgcggggagcgggagggactggaggttgaaggagagggtcggcccaggagcggctaatttgctcagctcggcgtgaggagggaaggtgaaaagggtgagagacgaggtctggctcgaagtcgcgtgctcacggcccctctcccaaattacactttttcaaggaaggcagcatgccacccccaactccccagaaccccataactcccaggctgtagcccttgtcagaagaatggtagcagccaccctgcccagccgtcgccttcgttgcctgtggttccaaatctgagatggggagcgcgcagtgtgtacatccaaatctacacctcggaaagagcagggactgggcccccagccttgcaagatccctgtgaagactggggccgacgatccaaaaactaagagccggggcaaggtgacccctccgcaagggtgcccaagctggggtacacactgtgttccctctgctcagcggtcgcgggtccttcgggagttgtgagccccgcgccactctggtgggataggtcttccgagtaccacaggaagtctcctctcccagtagccccgagggtcggagatcccacgggacctcggacaagcgtctccttagcgccgcggcctgagtgggaaatcacgaccttccccagcgccccacccccaccccctatttctcgaggagcgggacgggattcggcattgttttcttagaaaataacatttatttctagctcatatctatgcaaaggaaagcacaaagtgctgctctgcagcagcgttttccgctgcgggcccttcagtcagggcgtttggcgagtcccgggaggcgaggatgggcccgcgagcgggcggttctggctcagtcacacgtcgctctgttcctgcttcagtgcgcaccttgacggctccttagggacagaccagccgcaggcaagaggggcaggtgggcaggattcatcccgagtttccaatatatttaatctctaaacctgataagtacaatgcgcgcatagtctaatttttttccattttgtccctttttttgcttgttttgaatgtttttcacgttaataccgaggtcacctacagattacaattaataacttagaattccattttataacattatacactggcttgtatatatatatgtatagattatatatagatttatacatatataaaaacacactgcaccaaggaaacccatgcttatcggcataagcaacaaagagagcgacaaataccgcaacgaggaaagtgcaccttaaaacttgtttcctttttttttttttacaattgtatcgatatatatgtgtgtcccaaagactcagtgccaagagatttatacatcctaaatttatatttgttagagcgaatatttaaattttttaaaagtgagggctggggagacacagaaaagactctcggattatcctgccatccactgagagccggatgagcacagctaaggagccgcaggagcctgcgctgctgtcgcagcctctgaattctcatgaattcccagccttttggaaagggggccgggtgaggctggaagagggatccggaggtaggagatgaggacccaggccgcgcaccccctccgagaacacctgcacctgtctgtagctgctccccctttgctcagccttccccacccaccctcctaaacaaaacccaaaaaccaccttagagtgagaagacgcccagccagggcgcagagagagcgctgggcgaagaggggtcgatggcccgcgggaacagggctggggttcctgtttggggaccggccggctgccaggcccctcgccctactgcttctccggagcgccgttgaccataggcccgtacaggccgccgccgtaggtcggctccttgtgcaccgccgcagcagcggcggccgagcggtcacgcatgagatcgctaaaggcgtagtccatgggtgggcggaagccgagcgtgggcaccaagccggcagtggagtagggcgccatgaaggccagaccgcggctgtgcgccgccgccgcggagtaggccaggcgcagggggctgaggccgagcggcgcgcccagcgggtaggcgcccgcgtcggcaccgaagtgactggcgttgggctgcagcggcgagaaggccgagcggctgctcagcgagcccagcgccccaggcgccatggcgccggccagcaagggtctgtggtgcggaggtgcggcgggccccgcctgcagcggcgcaggcagcccaggccccccggcggcggcggcggcggcggcggcggcgtcgacgcggctgggccacgcgtcgtctgcagctgctgcagcacccacggcggccttatctgggggcgccgcagggcccaggccggccgccaggcccccacggtggtggttcagcacctgctcgatggcctgcaccacgtcgccgccgcagccctgcaacaccagctccaggacgcctcgccggtggcctgggaacacgcgtgtcaagatatccagcggcgtccgctgccgtggacccgagcctccgcccagccctggcgccggcgcggcctcaccctcttctttgtcagcctctgaaccggattcagagcccagagggctagcggagcccgggctgtcctcctcgccgccgccgccagggccagcgctgcctgggcagctgccacctgcctctttggaggcccgagctaggggcgaaccagaaaaggactcgccatcgccgttctccgagcctgagccgggccgcacctctggggacgacgtcccgggccccgagtctgcgccgtcgggtgataagggcttcaccggcggcggcagcgggctgcccgggcggcctgcctgcagcagcgtcttaggaaacaggtcaaacttctgcaacttggcctctgggaggggagaaaacgtgtcgtgaggagcggttagctagaagacagcagtcacagcacctcggccctttggatctcagtttcctctccctcagccccacagcccttattcactaggctccagtgcccctctttctttttgctctagcattccttccgctctgagccccta

SEQ ID NO: 102634 - DNA, 1350 bp, Homo sapiens
  chr1:50885950-50887300
  Hyper
ctcccaagtttagagcggatccctcctttccctcaacggctctggcctaatttcttccctccccacaaaaagccacgggggtccagaaaaagagggtggtgctaggcaggcagtaggaagcgaagaggaaaagacataggaaagcagacctgagaaaccagggagggtgcggaagaaactagaaggagggagggcgcagcaagcggttgtccagagggcgttaggaacgcgagaaggggaaaagaaactagggcgtctcagaacctagggcgtctcaaaacctagggtgtcagttaaagggggggggattccttaagggagttgggaaggagcagagggaaagggcctgtggagaagcgcagagcgaacgaagatgcgcaggtttccacctggggagaagacgaagcaaagaagcagggacctgcctgcgtttgggtagaggcgagtaaaaaaattaaagcgtgtacatttcggcccgatgcaggagaaaggggtaaagtgcaaatgctccagaagcgggagaaaggagagtttctgtacccacgctccatacccgaggctgggcgagcggtgaaccctagcagtcgcggcgactggacacgggggttctactctttctgaaccgagacaagcccctgggccccgtgccccagagctacgatcctgctgcccctacctgcggcctggccgcgctctcacctgagccccctgcgccagctgctccgcctccggtccccgcgggcgctcccgctccaggtcccccgccgtcggcggcgcacactgaaccgaagacctcgtaggcgggcctcggggggatgatgccgttggcggcggccagcgccagcccctcggcagtgccgtagagcagctgcagctcgcgcgcctcgttctcctcctgcgcctgctgcctgcgcagcgccacctgcgccgccatgacacgctggcgctccgcgatgagcgtgcacttggcgcacaggcagtccttccagcgacagtagcgtttgtggcccttgagggccgacaccacgccatggttgcgacagcgcgcgcacttgggggtccgcgggtacttctcggctgcccgcagcaacagtggcggcccccgcagcaagccgcctgccacgctcaccggtagcgatgcagcggccgccgcggctgccgccaccgacgccaccgacgccacaggcggccccgtcgctgttgccgccgccgccgtcgccgcgccgggcacgctgggcagctccgagcgcagctccatgacaggacctgacgggaaagaaggtgggagaggggagagacctggtgaggagcacaccgcgcgctaggccaaagcgccgccttgaggaaccc

SEQ ID NO: 102635 - DNA, 30 bp, Homo sapiens; identical to SEQ ID NO: 26294
  chr1:50887723-50887753
  Hyper

SEQ ID NO: 102636 - DNA, 3258 bp, Homo sapiens
  chr1:50888226-50891484
  Hyper
gtctggagtagtagtcggggcggaagacgtatcctgcgaaaagttaggcatttcgggagggggatctttctcgaagaccacctcacactgccctcccctcccctccgggtttagggacagagtcgtcagacacgccctccccgtcttggggtcccaggggacccctctcgagcgcaggctcctgcgttctgatctcagagttggggtcctaggacacggatggcccagcaggccgcaccaagccaggggagtcgccttcgcaactggccataaacggacaccagagtccctcccacgccgcagccccataaggcccaagcaggcccagctccccgcttctgccgcggtctcctctgcttcccgcgttccccgtccctgccagagcccgcgacagagtccttgtgtctccgtccgagagtcccagacctcctctctatgagcgttgcctcctctcccagacccttcgggcgtccctaaggcccacggggcccaggcctcctcaacaggggccgcagaccaggtctccacccactgctctccctgcggccctcaactacctgccttgggctccgggatcctcctcctccgctggcgctgcacgcgcctcccggctccactggcgacgctggagctcttggccgcttccctttgcccccggccccttatctgaccacgtcaccctccttcagtcaccatgtccgaacttccggacccctcagaacgcagcgcagtccaaccctcccttcagaaatccgggtcggaggctcgtctgcgggccgcgtggttggaacccgcgacctgactctcgccgtgccgggtcccctcgcggtgcgcgccggacgctgcgcgcagccggggcccagttgcccggcgctgccagactctcaatgagccgctcgcccgctctattgttggtccttagggctccattagacagaattggacaacaatgtggcgcctgccattggccaggggaggcagacggcgctctgattggccgggcccgcgcccggggagccccgcattctgcagtgtccgaaagattcgaaactccaaaagctccactgcgtgcctctgggaggggagggggcgcgccaggaaaggagtggaaaaaagtgggcgaggaggagcgttgaaaatttcctgacaagtagtttccgtgcgcccgagagcgtgtgaattgctcctaattaccgtgtccggtgcgcctctctgcgtagacttgtgtaacctctcggcttctggggcgccggctcggctgcaccgctcttactggcctggggcgcttggcaaagccgagcttcccaagtggctctggagccctgaggcgggatggggggcaggtgacaattcaattactgcggtcggggtaggggcgggacaagggtgcgggggtggggaagggagggtgttcaaggcataaatgccaggacgatttttcctgccttcttcctgctatgtttcggcgcgctcccaaatccgacgagtttggggtagttgggggctgctttggttttttcctcctgtctccttaaagctcagttactttattttaaaagtcctgatacgatagtcatcctggagggtaagtgtggtttatgaagattttcgtgtttaaagagaagctcagcgaagagaaatgagattgcacttcctgtcggtgcccgccacgtccctcgcgccctgagcctttcctctccccgcccctcttttcgcgtccctcagccccttttgagctctcttttcctcacttttcagcatctcgatttcttttccgtggtggtgggattctttttgtcgttattgcaaatgaacaaatagcccccccccctttttttttcttttctaaacgaaagtaaaaagtggcctctgtgtctccgcagattctcttaaactcaggacgcgcatcggtctgtccgaccttcccggcaagagacaaagtcactgctgggaggccccctcggacagttttcagttttaactttcgccttattctcgtcttgtcttgatgtcacggccctgaggaacagctcgttctgcagaagaggtaacaggtttcagattttgtttcctttttgaaaggctgttgcctttcaaacatctggaattaatgccgcggccctcgggcgagtcgccctcggtttctgtagctctgattttatctctgtgtcttttcccctctaatttctaaagttctgtttttccctctaattctgtttttccctctaatttctaatgttctgtcactctcgtttttgttctctacttttctctctctccttcagaataaagaaaattcgtttaaataatgaggaaaatgagcgttcctgtcgttctccctccactcttgaccgtgcgtctctgcgttgctctttcgaacctccaggccggcgggaatctgggcgcgcagactcggcccgggtcgtcgcggcctcaggacgcagcccattccgcctggcacgactactgggccgcgtcttgtcagtctatcagcttctgagcccaggaatgggggtgggggaaggacggtgcgactaacgggcccccacccgaagaccgcagaacctggcgccccggaagagccctggaagatgcccaccgggaggctgaggctggagggaggagtgggtgggggtgattcgctggaggaccgggcggagagcttccagaaagttcaccaggccccggcgcgagggcgctccgacacggacaaggtctatgatagcgataaaaagctggttactcgctcccagaaaatgccacttgctggagtctgtgaatgggtttaggagagagaagggtgtcagcccccgcgagggtctcccgcgtgaagtgaggataagggagtgcttcagggataatatgtcctctaggagcgcaggacccagaccccaccttccaacacctggaggttccgaggccaagtatgtctagccccggctgcacctgggtaggtgagccatggggtcgggggaagagcgccgacaaccgccggattccgcgcaggggccgccaggcgcctgctcccagagctcctttggacaaagttttcgggaaattctattaaaccgaaaacgaaataaactatacaaatctgcctagcttttgagggggcggtggcccaggtatccttctcgcttgaggccaggtcaccgtgagatttccccactccggaccggggatcccgcagaagccaagggtgtagccacgaggactcgggaacccgaggcggcccagcagatgcgtgaggaacttcat

SEQ ID NO: 102637 - DNA, 1724 bp, Homo sapiens
  chr1:50892153-50893877
  Hyper
cacagatttccacctcggtgatagcacacgccgacaggagcacattcttacgcaggtatgccctggtttatgcgcggagctccagtcttacttctacagttgggccccgggcagaaaaagccaaaaccctccgggacaaatgaggcggctgagagcagagggtcttcctcacacatccacacgcgtactcttagctcagaatcatttgctgacgcctctgctgtgccaggggctgggggcccgggtgagagggcccagccaagaaaatccaccccatccctattcgcccccggccccatcccccacgcccacgcccaggaactggtggcgtccaaagggactgcgttggggtgaggccggggttgagggcctagggcgcagagccggctggagacgcggcgtggggaagggggccgagggtgagtagtgtagctctgagtaaaagagccaggggcgccgatgggggacccgggaggcattgacttttgcgctgtttgcccgcggcctcggagcaagcagacgccatctgtttgccggctgcgacgcgtcccgtttaattaccctcccggcagcctaatagagatgatattaaactaaatctttctgacattaaaagtaattatccccaaaccggtggctccgggacggaatggcccctcccgcacccaccccttccctggccgcgccggattccgttagtttggctgatactctccgcccgggaatggggcgcagaggaaagggggaaagtgcctttgggagaaggaatctccacgggttgccctacacgcgttttcccgcacaaccacagactctcctgttcctatgtgaacacacgcacgtgtacacacagacacgtagcgacattttcctccagatcaactcatgagtcatgctgatgaagaccctcagccgcgcacaccctctgtggacagggagacgcgcagcttggtttcctgtccccgtcctctgacaccgctaaaatggtcattttccgtggtcatagccacggatctatgccacgacctgggaccgggcataatttcggagccagaaagtactcctgtggtggcgccgggtttctcaggcgctcttccagctaagggccaggagcccagcgatttccctacagttgcttactgaagtcgcaccattctctgcgaggcaggtccgattattccacttgtcaggtgagaaaacagactcggagaggtgagatgacttgttccacattatcacaattagtgagtaacagtgcaaaaatcaaacccgggagtaccctcatccaaagccaggtctgtctgcacagtgcaggcgcagcgggcgctgcgaatcggctcctggcccaatgcacccctccacacccgttggccgggaacccgctggtgctcagcttctatccggaccccggacctaaaggccgggcagaacaaccaactgaaggtggaggagcgagggcactggtgctgattgagcggcaggagcccccgaggcggagtcccagcggctgcagccctcctttggatcaagccctcgcgtcttccgggcaggcggaagggaggcgtctgcccagtgtcgccaggcttctcacgattttctggttgggagcatctaagcctgagacaaacgcatggagagcggtgttcaccgccccactatttgtttctatttgtgagcgtctactgagtacagccactctgataaacactcggtgtgtgctctct

SEQ ID NO: 102638 - DNA, 379 bp, Homo sapiens; identical to SEQ ID NO: 69674
  chr1:50896073-50896452
  Hyper

SEQ ID NO: 102639 - DNA, 30 bp, Homo sapiens; identical to SEQ ID NO: 38979
  chr1:50918985-50919015
  Hypo

SEQ ID NO: 102640 - DNA, 225 bp, Homo sapiens; identical to SEQ ID NO: 69676
  chr1:51099269-51099494
  Hypo

SEQ ID NO: 102641 - DNA, 20 bp, Homo sapiens
  chr1:51176289-51176309
  Hypo
ttcgagacagagtctcgctc

SEQ ID NO: 102642 - DNA, 30 bp, Homo sapiens; identical to SEQ ID NO: 69678
  chr1:51439947-51439977
  Hypo

SEQ ID NO: 102643 - DNA, 481 bp, Homo sapiens; identical to SEQ ID NO: 69679
  chr1:51442325-51442806
  Hyper

SEQ ID NO: 102644 - DNA, 35 bp, Homo sapiens; identical to SEQ ID NO: 69680
  chr1:51727596-51727631
  Hypo

SEQ ID NO: 102645 - DNA, 159 bp, Homo sapiens; identical to SEQ ID NO: 69681
  chr1:51761751-51761910
  Hypo

SEQ ID NO: 102646 - DNA, 209 bp, Homo sapiens; identical to SEQ ID NO: 69682
  chr1:51763180-51763389
  Hypo

SEQ ID NO: 102647 - DNA, 213 bp, Homo sapiens; identical to SEQ ID NO: 38985
  chr1:51795524-51795737
  Hypo

SEQ ID NO: 102648 - DNA, 42 bp, Homo sapiens
  chr1:51810611-51810653
  Hyper
ccccttggtcccgtccgcgccttccgccgagtccccacccct

SEQ ID NO: 102649 - DNA, 30 bp, Homo sapiens; identical to SEQ ID NO: 69685
  chr1:52068030-52068060
  Hypo

SEQ ID NO: 102650 - DNA, 37 bp, Homo sapiens; identical to SEQ ID NO: 69686
  chr1:52084092-52084129
  Hypo

SEQ ID NO: 102651 - DNA, 37 bp, Homo sapiens; identical to SEQ ID NO: 69687
  chr1:52094622-52094659
  Hypo

SEQ ID NO: 102652 - DNA, 45 bp, Homo sapiens
  chr1:52194923-52194968
  Hyper
ctccatcaacccccacgcgacacaactttccggaagtaagcaaaa

SEQ ID NO: 102653 - DNA, 128 bp, Homo sapiens; identical to SEQ ID NO: 38986
  chr1:52455042-52455170
  Hypo

SEQ ID NO: 102654 - DNA, 117 bp, Homo sapiens; identical to SEQ ID NO: 69691
  chr1:52456223-52456340
  Hyper

SEQ ID NO: 102655 - DNA, 39 bp, Homo sapiens; identical to SEQ ID NO: 69692
  chr1:52524541-52524580
  Hypo

SEQ ID NO: 102656 - DNA, 80 bp, Homo sapiens; identical to SEQ ID NO: 69693
  chr1:52832632-52832712
  Hypo

SEQ ID NO: 102657 - DNA, 796 bp, Homo sapiens
  chr1:53067865-53068661
  Hyper
cctggctctggggtccggggcaggggtgcgctgcctcaggacagacggtgaaactgaggtccagagccggacatccaccgcctgcggagggaacgagaacgcggcgcgtcctgccttgcgggccgagcggcgccagagccgcctcctcccgccccccgcgctagatccccccgccccgtctttgccctcgcgacgccgccacctccggaacaagccatggtggcggcgacggtggcagcggcgtggctgctcctgtgggctgcggcctgcgcgcagcaggagcaggacttctacgacttcaaggcggtcaacatccggggcaaactggtgtcgctggagaagtaccgcggatcggtgagtgcgcggggtctggcggcgccgctgggcccggcctcgccctggcggggcctgctggggacgccccgcagcccggtcccccgcgcggtgtggctccgaggacgctccagccgcgcggccgccaaaccccggcccccgccccgctcggccgtgacctctggcgcggcgcccccatcccgcgcccggcccggcccggcccgcggctacgtggcacggccttggcgcggaggaacccgaagcgctcgcagtcggcgcccacttcgctaccggcacctttgggcagcggggtccagaccttcgccgggaggccgggcaccactgcccagcctttgccattcacgggtgaaaaaagtaaccgtagcatcgtgcggcctttccctctcccgtcctcattttctgcatctggaacggggagtggctgattcggagtccagtgaag

SEQ ID NO: 102658 - DNA, 707 bp, Homo sapiens
  chr1:53098659-53099366
  Hyper
tgtctgccccagccccgaatgccccgagactcccggcgccggctcggtgcaggtaaggcgcccgcgccctggcctcgaattcccgccccgccactctggccgcgtcgtgctgtcgttgcgcacccagcgccctcgtgcaggcagggggagcgcagtggggagggggcaggaagcgcaggcagagccaggcgagcacgcggctcccggcccagctccccgcgtccgctccggctcctgccgcgttccagcagccgtcactcccgccgccggcccccgccgcccgccccgcctgcccctacccctccgcgcgggccgggcacctggccgccgctcggtcctcggggccccgcgctgctgtctctgtctcggcttctctcggcccctgggtctcttcgtctctgccgttctcaggctcagctccgtctcgctcggtccctcgcttccccgccgggctctagccggccgtctggtggcccgaggtggcggcgggctgggcgcggggcgcgatgagcggcgcctgcacgagctacgtgagcgcagagcaggaggtggtgcgcggcttcagctgcccgcggccggggggcgaggcggccgctgtcttctgctgcggcttccgcgaccacaagtactgctgcgacgacccgcacagcttcttcccctacgagcacagctacatgtggtggctcaggtaccgtccctggccctca

SEQ ID NO: 102659 - DNA, 32 bp, Homo sapiens; identical to SEQ ID NO: 69698
  chr1:53129138-53129170
  Hypo

SEQ ID NO: 102660 - DNA, 368 bp, Homo sapiens; identical to SEQ ID NO: 69699
  chr1:53168827-53169195
  Hyper

SEQ ID NO: 102661 - DNA, 1007 bp, Homo sapiens
  chr1:53308268-53309275
  Hyper
gggaggctggggaggcgggaggagaacggttggccccggcagcggcgtgtcggagggcggatggggctaggaggccgcccggggggtggggtctgcggcgggccggcccccgcgtgcgcgtcgcctcgccgggcatttcaaaagctcgccggcagggcgcggcgctagctccgtgtgcctcgcaggcgtggtgggcgcgtcctggcagccgcccgcttggttctcgcgggatccgggctccggctcgacgccggctctctttttgacgccccgccgccggggttgccatggttcatttcttgcacccgggccacacgccccggaacatcgtccctcctgacgctcagaaggatgccctgggctgctgcgtggtacaggtgagcaccggggtgcgggcggcgacgcggacctcggcgccacgtccagctccggcgagcgcggcgagtctcctgggacgctgccgaggcacttgctggggagtgtggcccgcgcggggctgcggtctagatgccgagccccttccaggcgcaggcgtcgctgcggaggtgcgttgtcgggggaggcggcctgggcgccgcggagcggggggtgcttttctgcgcccggcgaagcgcgtggaacttgcgccctgaggcagcgcggcgagagcccagtcccagagaccggggcgagcctcctcaggattcctcgccccagtgcgggctgctgtgagcttagacgtaggtgcagggcatggcactcggcttggcccgtagtggacggtgtttttgcagtcatgaacccaaacgccgcaaaccttgaccgtttccccacccgtgttgtggacgcagcgccccgcggaggcggtgaccctttggccgttaccacctgaggcctttgggcccggggccgggcgagtagcttagtccggctgggggaactggaacccgaagtctgagattctttcagttccgcgcgtccgcccccgtccccgtcccgtccccagcctttgccgaatgcctgttact

SEQ ID NO: 102662 - DNA, 30 bp, Homo sapiens; identical to SEQ ID NO: 69702
  chr1:53392828-53392858
  Hyper

SEQ ID NO: 102663 - DNA, 39 bp, Homo sapiens; identical to SEQ ID NO: 69703
  chr1:53479895-53479934
  Hypo

SEQ ID NO: 102664 - DNA, 136 bp, Homo sapiens; identical to SEQ ID NO: 69704
  chr1:53527470-53527606
  Hyper

SEQ ID NO: 102665 - DNA, 970 bp, Homo sapiens
  chr1:53527817-53528787
  Hyper
ggggcgggagagaggcggggaggagaaaacccacaacaaaacttgcgtcgcggagagcgcccagcttgacttgaatggaaggagcccgagcccgcggagcgcagctgagactgggggagcgcgttcggcctgtggggcgccgctcggcgccggggcgcagcaggtacagggcgctggcagccggggtgggccgaggggccgggggctgagcccgggcagcgcactcagacgtccccgcctctccggatggctccagcagctgcctggggcgggcccgccgcatctcaccccctctgtaggaccctgcacccagggcacggccggagatctcctcctctggagtgcgacccctgcgcagtcaggacccaggcaggggccttctcctctctgagcagaggctggtccccgtccccaggcccctcccgctgcgcacatctggaaagaatctgagggcggttgggggcgggggctggagtgggaggacgccggcgggcgacagggaatgtggggggcaggtggaactgcgtaggggcggggacccctgtcatgagagcctgggcccgaagtatccccgcgtctttccacgtcaactcatcaggccccctagcgactccaacctccacctctttatagatagagaaactgaggcccagagaggggcagaggtctggccccagggcgcgtcggacgccgggtgggtcccctccggggctcggcttccccggccactgtgccgccccagcttagtgccaaccactagttgagctaaaggtctcagctggcggtctggagtccgtctatctgtctacgcggctgcttcccagccgggacagctggagggaggaaggggtgggggtccgcgaagcgcgaggagcgagatccgcgccttcctgcgaatgaggcagaagccccaggttccaggtccccgagccacagcccggcctggggcgggggacgagatcttggcgtt

SEQ ID NO: 102666 - DNA, 30 bp, Homo sapiens; identical to SEQ ID NO: 69707
  chr1:53561195-53561225
  Hypo

SEQ ID NO: 102667 - DNA, 30 bp, Homo sapiens; identical to SEQ ID NO: 69708
  chr1:53573022-53573052
  Hypo

SEQ ID NO: 102668 - DNA, 24 bp, Homo sapiens
  chr1:53703048-53703072
  Hypo
aaaaccttccaagcccggccgggc

SEQ ID NO: 102669 - DNA, 27 bp, Homo sapiens
  chr1:53705674-53705701
  Hypo
tcagtcttaacacggagtccttttctc

SEQ ID NO: 102670 - DNA, 102 bp, Homo sapiens; identical to SEQ ID NO: 69711
  chr1:53990535-53990637
  Hypo

SEQ ID NO: 102671 - DNA, 38 bp, Homo sapiens; identical to SEQ ID NO: 69712
  chr1:54142594-54142632
  Hypo

SEQ ID NO: 102672 - DNA, 1271 bp, Homo sapiens
  chr1:54203433-54204704
  Hyper
aatctccacaggagccgccaggcacgttggcagggccgaactcacccttcccggcggcggcggccttggatggaccgtagtctcggggactgcggggccggaggaggtcgtgggcgcgcggtggcggcgcaggcggccgggctagcaggtcccgcgggcccctgtccccgcagccgccgccactcacggtgaccctgaaggccatgtgcgcgccgaggctggcggggccgcggtcggggccgggcgcaccaggggcctccttaggcctcttgtccgagtgtgcctcagccacctcgcaatgcatggcgccggggcggggcgcacggctgggggtcgcgccgggctcctggggaggggagacagcacagccagttagaatgcggaaagcggcccccgtattgtcccggggccgagtttgagcaggtcactgccccttcggtggattgcgcgtctttaacataggttagcaccacgacacctagcccaatcagaggtcaaacccacctgattccacgcaaaagccccctcgctcaggagcggttcgcccttccctggtgtggggaggaccccaggcccccgcgccgcggcgcattaccgcgaagtcccacccaaatcctcctccaccgaaaccagcctcctttgcacgaatggtgaaactgaggcctggagcgggtaaggcgcctgttccgcgtcccccagtggaacacggagccggcggcaacgaggattcccagagcagggctcgggcgaagccccggagacggctccgggtaggtcacgggctgcgcgcttcgtcgactctccggggccgagctgcgcgcagaagctggggacccgaacccaaaggcccgagggaaacccccagagactcacccgcgaccacccgaacctggaaaacaggagtcccaagctgggcgctgaatcctgcgacgcgaacccatcacgcgcagccgggacacccacattcctatgcgcagcggaggaatcgagcccgtcgcgcgcgcaaaccggcacagtgggcaatgcccacgcggccgccgccacacacccgcacacccgccgaggcacgcccggggacggacacgccacccacactgccgctggtcagacgctcagcagcgcacaaccacacagtcccacgctctcgccacacgcgcgtgcgatgggggccgcgacagagcctccctcagcccttccatcaggggcccccaaactctccgttcccctccgcgctccctgcgccatccccaagctgccggggttcgagcgtc

SEQ ID NO: 102673 - DNA, 43 bp, Homo sapiens; identical to SEQ ID NO: 69714
  chr1:54530324-54530367
  Hypo

SEQ ID NO: 102674 - DNA, 407 bp, Homo sapiens; identical to SEQ ID NO: 14242
  chr1:54586590-54586997
  Hypo

SEQ ID NO: 102675 - DNA, 119 bp, Homo sapiens
  chr1:54587510-54587629
  Hyper
gacgcgcaggcagcacgcacaggccgcctctttctccaggcatagtcgtactcacacgcactctcccgcccacccagaccccagatcccccgacactcacagcacggcaggagcatagg

SEQ ID NO: 102676 - DNA, 30 bp, Homo sapiens; identical to SEQ ID NO: 69719
  chr1:54683784-54683814
  Hypo

SEQ ID NO: 102677 - DNA, 30 bp, Homo sapiens; identical to SEQ ID NO: 69720
  chr1:54712302-54712332
  Hypo

SEQ ID NO: 102678 - DNA, 186 bp, Homo sapiens; identical to SEQ ID NO: 69721
  chr1:54722666-54722852
  Hypo

SEQ ID NO: 102679 - DNA, 30 bp, Homo sapiens; identical to SEQ ID NO: 69722
  chr1:54757013-54757043
  Hypo

SEQ ID NO: 102680 - DNA, 35 bp, Homo sapiens; identical to SEQ ID NO: 69723
  chr1:54757429-54757464
  Hypo

SEQ ID NO: 102681 - DNA, 52 bp, Homo sapiens; identical to SEQ ID NO: 69724
  chr1:54766254-54766306
  Hypo

SEQ ID NO: 102682 - DNA, 30 bp, Homo sapiens; identical to SEQ ID NO: 69725
  chr1:54808954-54808984
  Hypo

SEQ ID NO: 102683 - DNA, 30 bp, Homo sapiens; identical to SEQ ID NO: 69726
  chr1:54814665-54814695
  Hypo

SEQ ID NO: 102684 - DNA, 33 bp, Homo sapiens; identical to SEQ ID NO: 38995
  chr1:54839900-54839933
  Hypo

SEQ ID NO: 102685 - DNA, 20 bp, Homo sapiens
  chr1:54849481-54849501
  Hypo
ataaaaagcaagaaccggcc

SEQ ID NO: 102686 - DNA, 17 bp, Homo sapiens
  chr1:54880702-54880719
  Hypo
cccggccacgtagagca

SEQ ID NO: 102687 - DNA, 373 bp, Homo sapiens; identical to SEQ ID NO: 69730
  chr1:54940331-54940704
  Hyper

SEQ ID NO: 102688 - DNA, 23 bp, Homo sapiens
  chr1:55231044-55231067
  Hypo
tttgtttttttgagacggagttt

SEQ ID NO: 102689 - DNA, 65 bp, Homo sapiens; identical to SEQ ID NO: 69732
  chr1:55446357-55446422
  Hyper

SEQ ID NO: 102690 - DNA, 63 bp, Homo sapiens; identical to SEQ ID NO: 69734
  chr1:55462125-55462188
  Hyper

SEQ ID NO: 102691 - DNA, 261 bp, Homo sapiens; identical to SEQ ID NO: 69735
  chr1:55462673-55462934
  Hyper

SEQ ID NO: 102692 - DNA, 117 bp, Homo sapiens; identical to SEQ ID NO: 69736
  chr1:55505045-55505162
  Hyper

SEQ ID NO: 102693 - DNA, 43 bp, Homo sapiens; identical to SEQ ID NO: 69737
  chr1:55505516-55505559
  Hyper

SEQ ID NO: 102694 - DNA, 155 bp, Homo sapiens; identical to SEQ ID NO: 69738
  chr1:55529091-55529246
  Hypo

SEQ ID NO: 102695 - DNA, 32 bp, Homo sapiens; identical to SEQ ID NO: 69739
  chr1:55731721-55731753
  Hypo

SEQ ID NO: 102696 - DNA, 184 bp, Homo sapiens; identical to SEQ ID NO: 69741
  chr1:56943121-56943305
  Hyper

SEQ ID NO: 102697 - DNA, 30 bp, Homo sapiens
  chr1:57110648-57110678
  Hyper
gcctcctgcctccctcggcaccctcgccta

SEQ ID NO: 102698 - DNA, 616 bp, Homo sapiens; identical to SEQ ID NO: 69743
  chr1:57110882-57111498
  Hyper

SEQ ID NO: 102699 - DNA, 221 bp, Homo sapiens; identical to SEQ ID NO: 69744
  chr1:57224849-57225070
  Hypo

SEQ ID NO: 102700 - DNA, 30 bp, Homo sapiens; identical to SEQ ID NO: 69745
  chr1:57687138-57687168
  Hypo

SEQ ID NO: 102701 - DNA, 303 bp, Homo sapiens; identical to SEQ ID NO: 69747
  chr1:57887764-57888067
  Hyper

SEQ ID NO: 102702 - DNA, 2288 bp, Homo sapiens
  chr1:57888297-57890585
  Hyper
gcctccccacccccacgccattccttcagactctcccagcctaagcggaagtgccccagcagacccccaacaatgaggatttgtgcgatgcagttgggggttgggggtagttcacacggagtgaaacgtacacagtctggcgggtctgggagcagccaagtggcgtccgcctctccaggcagcgatcccttgtgcccactgccccccatcaggcccaccagcaccaccaaaaaacaaaaacagagaaaagaaaaagcgccttaaaaagtgcagagaaaagatgcgccctcccaccaggggtcacaataatactcctcgggacgcagccagcggaggcagggtcctggctgcagcagccaccctggttttgaaatttactttgtacactcacccagtggcccctttcagacgccgcgacacgacctccccccatctcggactccctgcctctgggttctctcggcggttgacaccctcttgtgtgcctgctttatgagccgaaccacagagatttaaagtttccttggtagaaaaaaaaactgagctctctgcatccaagtcagagcgtcgagtctggagcagagagaaggaagaggggcgggctggggaggcgactagctgggcgtggggggagggggtgctggggagtggatggagggggacgagcggcagagaacagagtccacagaggatccgaagaaaggccggggtccgaggaacgcgggatccagttctcacggtgcccgcgaaagggctgggattactgggatagagtcggtttttcgagaggtcgaagccgaatctcagcgctacggaggagtagggaagtgagaacggggttcggccgaatgaggaaaagggtctggccaccagcgagggagggagggagtttcgggagcccaggacagcgggagaaggcaggctcgaggtccgatatagccaggaccgcaggaggaaagagggcgcagggggtcttggagagagacgcgtgtcaggggtggacaagtctggagacaggatcgcgcgtggtcggaagtagggagacaggggcgcggggatggggggcaggacagagaaagagaagtcgcccttttcctcccagcaagtggagggagaaggcgaaaaactgctgcagtcgccatcctcccagcacccctagccaaactgctgagtggcgcgtcccaggagccctcctccgcgccccggggctccagcgaagcctcctggctccccggcgccctgtcctcgcggggcacctgcggcgctgaactcaagggttgccgcgcgcccccgccgcgcctcacctcgcctagcccagagcatcctcctccgctgccgcagccgcccaggaagcggctccccatgcccggcgggcggcggcactcaggcgcgctctgcagcccggggaagcccgggcgagcgccgagctgggtccatcctccccgggagccaccggccccgcgtcagagtagggggaggagaccgccacccgcgcggacccgcctcctcccgcggccccccgccccgccgccccccgcgcccgcccggcgccccgcggcaccgctcacctgctagctccccggccgccgccgccgggccgtgagcccctcgccccggcctcgcggctccctccggggcgctctctgcgcagccggagcgcgctccgagagcttagccgagtggcggtggcgacgaggaggtggaagaacgagcgagcgagcgagcgagcgagcgggggcgccgcggcttgcagtcgcgcctctggagcccctgcactctctctccatcccagcgtggaagggggagagacgagccgagagcgaggggtccccgccccagccgcgccagcgtggagagggtaagggaggggggttgtcacaaagtatccagtgttttctcccccatcaccaccactggacgcagctccgcctggcctctctcatttttctctaagatctacccttttatccaagcctcgaaaacatatgcatacccaaatatatggagtgccaggaagggcgaaaccacgaggggagtctccgcgagggcatgttgcccccacgccccttggcaggagggggcgctcgctcccagccgccagtgcaggttcggcggctcctgttttgactgaggtttcccaggcaaagttcggcaagttgggagggagaaggctggcacgtgtcaagtttccgtcagtcctcaggagagacccgtgcccctgagagcacgcagaccacggttaactccggcttactccccgcgactcccctactcggctcttagaatga

SEQ ID NO: 102703 - DNA, 1118 bp, Homo sapiens
  chr1:58715153-58716271
  Hyper
cagaaagaaagcatgcgtccggatggcgggagggttaaaattacagtctttgggtaagacccctggccagcttgcctggtttctagatacataagtggacagaaaagaaatgaagagaacgcggactgagcgaggaaatgctcaagaccacaggactgaaccccccggaagtctcgacgctgcccagccagccagagtccagtcgtcgacgcggatgaagttgtttccccgggacaggaagggttaaatggctgcgcgtcaactcggcctcgactggggtgtcagggagcaagagccgcttgtctcgggggattccgcttggggggttcccaggggtcgccctggcgctccggccacaacttgggcggctctgtgcggcggccctcgcctgcgcctttgcgcgccacccaaaactttgcgcacactgcagccgccgccttcccgctcttcgcggtgagacgcgcgccgccaagtgccgcaggcagccctccacagccgccgcggcagccgctgcctggcttctggctccagacttttcccccactgcctccagttcccacccaggaggctccctcgcggccgcgagagctcggcgcccgacccacagtaggcagtgcgggcacagtgttgcagaccaccacctcgccaggtccgggcagcgcccactagacggacaggcgcccgcggccgcccctaccccggcgcgcccacctcgagcctctcacgccgcggcgggcgggcgcaacatattctcctacctccagccgccgaggaccacactctccgctcagccctctcgactcatcctccggctgcagtagagggcgagcgggctccgcttttgttccctggggctggcaggtccgtgtggggccagggcgcgcgggagacgccgcggagctgggtatcccggagaggggatgctcactcctagcggctccgctggcagcagtagtggcggtggcagcagaggcagcggtagcaacagcagcagtagcagcagcagcagcagtagagatagtgccggctctctgcaggccacatctttcataccttatacatcactaccgcattcccccgaataggggagcccctcagcatttcgccacctagcgcgg

SEQ ID NO: 102704 - DNA, 30 bp, Homo sapiens; identical to SEQ ID NO: 69756
  chr1:58721839-58721869
  Hypo

SEQ ID NO: 102705 - DNA, 508 bp, Homo sapiens
  chr1:59042049-59042557
  Hyper
taatagatgagcgtgcgctccacctgcaggggttctccgcgcacgcgcaagtccaggccgccgcggccctggaatagagactcgcccttgatgtccctctcgaagtagtaggcggcatcgccgatatccacgtcaccggcggccttctgagacgtgttctgccgcagctcgatctggatggtgggctgctcgtagtgcacggccgccacgaacttggggtgcagccgatagcgctcgcggaagagccgcctcagctcggcgtccaggtctgagtggttgaaggcgccggcggtggggcggtggcgcaggtcaatgaggatgtggtgggtgcgcaccagctcatcgcagcgtaggctcaggtcgcccttgtccgtgcggcgcacgcccaccgagttcacgcaccagcacaccgacgtctggttgcactggcgcgccttgaagcggccctcggggtcgcagtcggggtcgtagaggccatcgttgtccacgagcgcgtgctcactcggcc

SEQ ID NO: 102706 - DNA, 51 bp, Homo sapiens; identical to SEQ ID NO: 69761
  chr1:59348317-59348368
  Hypo

SEQ ID NO: 102707 - DNA, 455 bp, Homo sapiens; identical to SEQ ID NO: 69762
  chr1:59612368-59612823
  Hyper

SEQ ID NO: 102708 - DNA, 209 bp, Homo sapiens; identical to SEQ ID NO: 69766
  chr1:60662398-60662607
  Hypo

SEQ ID NO: 102709 - DNA, 37 bp, Homo sapiens; identical to SEQ ID NO: 69770
  chr1:61339518-61339555
  Hypo

SEQ ID NO: 102710 - DNA, 267 bp, Homo sapiens; identical to SEQ ID NO: 69772
  chr1:61508687-61508954
  Hyper

SEQ ID NO: 102711 - DNA, 340 bp, Homo sapiens
  chr1:61519364-61519704
  Hyper
gagaacgaggccgtccgggctaggttcccggggctcaaagacgcaaagggaaggcgacaaaggtttctcacaggtcgccgttagggagagggggcagcgcaggaaacccgtttatttaaagttcagttgtgttgggcatctgatccaggacaactcgcccaggagcccggcgggtttcagctgccaccacgaaagtaaggatcggttctgccgcgtcgccccctccttccccttgggatgtgccaggcgggcgacagataagggggcgcggcgcggggtcagccaccgagccagagggcggcgcccggttgcagcgctccacagccgcctcctgcagcct

SEQ ID NO: 102712 - DNA, 77 bp, Homo sapiens; identical to SEQ ID NO: 69775
  chr1:61541784-61541861
  Hypo

SEQ ID NO: 102713 - DNA, 102 bp, Homo sapiens; identical to SEQ ID NO: 26338
  chr1:61549208-61549310
  Hyper

SEQ ID NO: 102714 - DNA, 48 bp, Homo sapiens; identical to SEQ ID NO: 69777
  chr1:61555978-61556026
  Hypo

SEQ ID NO: 102715 - DNA, 16 bp, Homo sapiens
  chr1:61653734-61653750
  Hypo
gttgagacagagtctc

SEQ ID NO: 102716 - DNA, 147 bp, Homo sapiens; identical to SEQ ID NO: 69784
  chr1:62189753-62189900
  Hypo

SEQ ID NO: 102717 - DNA, 73 bp, Homo sapiens; identical to SEQ ID NO: 69785
  chr1:62207769-62207842
  Hyper

SEQ ID NO: 102718 - DNA, 22 bp, Homo sapiens
  chr1:62657668-62657690
  Hypo
attctttttctttttcgagacg

SEQ ID NO: 102719 - DNA, 291 bp, Homo sapiens; identical to SEQ ID NO: 69792
  chr1:62784355-62784646
  Hyper

SEQ ID NO: 102720 - DNA, 308 bp, Homo sapiens; identical to SEQ ID NO: 69793
  chr1:62784870-62785178
  Hyper

SEQ ID NO: 102721 - DNA, 30 bp, Homo sapiens; identical to SEQ ID NO: 69794
  chr1:62793243-62793273
  Hypo

SEQ ID NO: 102722 - DNA, 553 bp, Homo sapiens; identical to SEQ ID NO: 69802
  chr1:63539428-63539981
  Hyper

SEQ ID NO: 102723 - DNA, 30 bp, Homo sapiens; identical to SEQ ID NO: 69804
  chr1:63783677-63783707
  Hyper

SEQ ID NO: 102724 - DNA, 325 bp, Homo sapiens; identical to SEQ ID NO: 69805
  chr1:63784115-63784440
  Hyper

SEQ ID NO: 102725 - DNA, 86 bp, Homo sapiens; identical to SEQ ID NO: 69806
  chr1:63784701-63784787
  Hyper

SEQ ID NO: 102726 - DNA, 1408 bp, Homo sapiens
  chr1:63784987-63786395
  Hyper
ctctcctgggaagttcgcttgttgagactcaaagagtcactcaaactcataattgcgtgtgtgtgtctactcattctccctctatctctccaataaccctttgagactcagaaactttttatccacatacaccctttatcacattttcttccccccactacatgtgtctcactttctctctgtatctgtctcgcttcttccgtctctgtcctacagcttggcggtaactgacgacctgtgagcttttagctgcaaactgcaactacgcggcaaacaatttatttagcccgacatctagccggtctccggcaggaccctgcaccgcgtcgggatcggacccttccgctggggcggcctcctgcgtcaaggccagcaggaaccttcctgtcgccctccccggccgccgcttcgcctccttcccgcccccggaggttgtgcaggcgctatggtccgcctggagggagaaagccggcggccggttcctgagccgagagcggccgcggaaaaatcctctgcctccgctggaaatcgatattaggccggcgcgggcgcgggacgtcggggccgcagccagtaggttgtgcacgtctcatcatttagctaatcgagtcgaaaagtttctgtaagggccggacccagcatcagatggtaacactgattgaacaagagattagcacaatagatctctaaccgaggggaagcgttgcttttcacgctacgcgccgtaattaatggtatgaatcaattaatttgacttttattgtgtcgaaggaaaaaagcgcaacaaatggaaccggcagctgggagttgttcgtcctccacccccttccccagggaggttccaaggagacaccggggaatggacggatcaggctgggccgtggcagagggagggtaggaggcagcgaccagcagcgtggagggagtccagagagctagcctctgcggacggcggaatcgaaattaggctcatttggagactacttcgagaccggtgaggggagccctgtagccaccatcctccggcgcgcatccacacatactagtccacgcgggcccagccaccaaggccgcggcagggccagcgctgcgccccgggcccctgcctttagggctgggcaacccaagcagagcaaaggaggttcctgaatgtgtaaatttccgctttttagctttttttttttttttttttggaccttccgacacttcggttgctgaggcagttgcagacgcgacctctgcagtcctgggcgatggccagccagctcagctcgggtcggtttcgcggaaagctgtctagacggcattgtaaacggttcggagcctgcgggccacaaagctgtggagctacggaaatcaactctgagatgcgttttagggccgtgtgcaacctcgggatcatttagat

SEQ ID NO: 102727 - DNA, 3812 bp, Homo sapiens
  chr1:63786656-63790468
  Hyper
gcaccactgtccatccggaattaaatccacatcccagcatcttctgcaaatatttcactaattatttcctctcggaactcctcccctcgtgctccttcctctggtgaggccggcgctcccctcccaggccgcagcggacagacagggattgggttccgtgtgcctgccacaccaggcaggctcttgcggctcccaactaggcggcctaaatgagggaggaaagaggaggcgcatcgctgattcaccgcgtcaagagcactgactttccttggaggtgtgaggtccacgcaccccagccacgcacttgggggtcggtttgcggtgcctccccctccagtcccagtgaaatccccacagtttttcctactatcactgacttgccttgcactccgcgtgcattggccacacatcctcgcctcctccacccgctccgccgccggttttcttggaagttaaatcttggaggatttgtccacaccttaagagaagaaaatccacgttagctggcagcaacggagatcccagcatgctggcatgcccaagtctgcccaggttcccccaaggccatgcccgccgcccgggaagtcactgcccgcacccctcacgtttcttcagccgcccctgggcgctgcgtctaacctgaagacaccaggcctcttcccggatccactcgacttacccaggccgctgccaatcccagctccttccccagcgcctcatttccgattttttcatatgctaagtcgtttaacaactccaagtagccagttatggcttctttatttataggttccctgctattttacgtcgtttttatttctctcggcaactattctagtagattaatcaatagccattttctgaccttcgggaaccccagctgatgctttttgtggccgcacgaaaaaatacatacaggaaaacacgcccgcatcaagccgggaaagagcaggtaggacctgagtggtttggttgggggagggggaaaaagacatctcagcaggtgtcttccccggaatgagcactgaggccagaggggaatctgaaatctaattagcaggagggagccgggtgcgctgctcttactctttaaagctaaaaacaatgaaacaaaaagcaaaacagagactaagttttgctttttaaaacacgatatgggaacctcgttctaggtcgcccagtccctgtctaaggagtgtgacaaagtgggggggagaagggcggaagggagagggggcggggaaggcagggcagcgacagtcgcacagtcccgcggacgctcccaggcccacgccctgactcgctcacacccacccacactcacacccacccgctccctgggccccagggcccggatccagcctgggtgggggggtctccgggcgggccgcagcgccctccgtgccccggggatgctggcgcacagtgcggagcggagttgcgcgtctctcgtccctttgttgacaattccctgaaccaacttgagtttggccggctcggccgcggccctgacgtcacgcacggtcacgtggccccgcctcccgctggatctttaagtagaaagtaatctatcaggccagtccttaaaacgggactttcgactaccggggcttcggcgtccctgacacccagccccctgcccccccgctactgtccctgcccgcgccctcccgagctgctcggcgcccggcgtcccgcgcccgcctggaccgctcctgcgccccacgccagggccagaggccgaggaaggcgggctaagtgagggggcgcggcgtggagaaccgccggggccgggagcggtagcgagcgcctagtaccgagcgccagggacggcaggagttcgcggagcgcggccgctgggggcggacggcagagcccgcgccacgcgatgcggggccgccgagtgtgagctgagcccagcgggccccaagccacctgcggccccctcccctctccctgccccccatctttcgggggcactcaaaccctcttcccctgagctccgtggcagcccccgaacaccctcatcgcccgctgccccctccccgccgccgctaccaaccccgaggagggatgaccctctccggcggcggcagcgccagcgacatgtccggccagacggtgctgacggccgaggacgtggacatcgatgtggtgggcgagggcgacgacgggctggaagagaaggacagcgacgcaggttgcgatagccccgcggggccgccggagctgcgcctggacgaggcggacgaggtgcccccggcggcaccccatcacggacagcctcagccgccccaccagcagcccctgacattgcccaaggaggcggccggagccggggccggaccggggggcgacgtgggcgcgccggaggcggacggctgcaagggcggtgttggcggcgaggagggcggcgcgagcggcggcgggcctggcgcgggcagcggttcggcgggaggcctggccccgagcaagcccaagaacagcctagtgaagccgccttactcgtacatcgcgctcatcaccatggccatcctgcagagcccgcagaagaagctgaccctgagcggcatctgcgagttcatcagcaaccgcttcccctactacagggagaagttccccgcctggcagaacagcatccgccacaacctctcactcaacgactgcttcgtcaagatcccccgcgagccgggcaacccgggcaagggcaactactggaccctggacccgcagtccgaggacatgttcgacaacggcagcttcctgcggcgccggaaacgcttcaagcgccaccagcaggagcacctgcgcgagcagacggcgctcatgatgcagagcttcggcgcttacagcctggcggcggcggccggcgccgcgggaccctacggccgcccctacggcctgcaccctgcggcggcggccggtgcctattcgcacccggcagcggcggcggccgcggctgctgcggcggcgctccagtacccgtacgcgctgccgccggtggcaccggtgctgcctcccgctgtgccgctgctgccctcgggcgagctgggccgcaaagcggccgccttcggctcacagctcggcccgggcctgcagctgcagctcaatagcctgggcgccgccgcggccgctgcgggcacagcgggcgccgcgggcaccaccgcgtcgctcatcaagtccgagccaagcgcgcggccgtcgttcagcatcgagaacatcataggtgggggccccgcggctcctgggggctcggcggtgggcgctggggtcgccggcggcactgggggttcagggggcggcagcacggcgcagtcgtttctgcggccacccgggaccgtgcagtcggcagcgctcatggccacccaccaaccgctgtcgctgagccggacgactgccaccatcgcgcccattcttagcgtgccactctccggacagtttctgcagcccgcagcctcggccgccgccgctgctgcggccgccgctcaagccaaatggccggcgcaatagggacgcgccaatggccgggacccagggtccggcggcggcctcgagcaacaaatgcacctccaggctgcgcgccctgtcccaagcccggtcccggtcccgctgcccaatcctggactctgcctctccccaatttcctttcccctgagcccccaacgcctaccttccgcggcctccatcccctcgcgcacacctaagctggtcgagcaaactcaccgcgcgcccgccggggatagctttccatacaggtaaaaccgaaaaccgaattttccaaaaatgcaccccgacggcgcctgctcttagta

SEQ ID NO: 102728 - DNA, 39 bp, Homo sapiens; identical to SEQ ID NO: 69816
  chr1:63791977-63792016
  Hyper

SEQ ID NO: 102729 - DNA, 523 bp, Homo sapiens
  chr1:63792549-63793072
  Hyper
acttataaaattactcgctcatatttccgcgcatagcagcaataccggccgagcctgcgccagcagcgtgacactcagccacaagccaccgccggagactcgcagggctttttccagcgctacattcattaggcggcggggtgaacgggagagacctgccggcaactttccttccagccagttcttacccttgaacgacggcctaaagatggtccccttcctttatgtcgtggaaggcaggaaactctcggacccagaccctcaagctgccagcggttgtttaaagtcctggcagatgtcaggaagatgggcccggccgtcgcaccctcaaaagctctttttcgtttaagctttttaaacctcgaagatttagcacaaaatgggaaatgcaaatatcatagacaatgatcgcaagcacttagtggtggggctgggggaagcctgaaacccttgtttgatgttatggaacgcaggcacctgcgacaaacggcactggaaacagctctctcgttgagatttaaag

SEQ ID NO: 102730 - DNA, 307 bp, Homo sapiens
  chr1:63793338-63793645
  Hyper
gtggatctggatgtccggggaaaggcgaatgaagagtagagcaaaacatgtgccggctgttgagggctgtcgatgcgatggcagatgtggcctgtagggggcgacgagcagacggaaaacttcgcggtttgtctggaatggtccagccccagccccggacgcctctccttccctcccaggctctgagcctcctgacatccttgcttattctcaggccccggaagcctaggtcgaatctcgagaagctgatttcctcctttcccccgcctgtgtcctgggaggaacagagtcccgaggggagtttgtc

SEQ ID NO: 102731 - DNA, 1152 bp, Homo sapiens
  chr1:63795348-63796500
  Hyper
aaagacagacacagacgcgccgggccggtggaactcagctccgggaaggctgtggacctggaccctggggctccccgctgcctgggcgcctctagcccggcgatgagtggttctgcggggaccgacggccccatttccttcttgcctcgtgatgtgggagggaagaaagaaggcggcaactgcaggcccgaagctcccctcgcccagcggcccaaccacagtgctgtcgtgtcggggatcggtccccaagggagcccccaaccccctgcccacgccgagatcacccccgtgccaacctcgagggctcggcctgcgggactccagctgcccctgcctggagggagggaagggagaagagaatacgaattaattacgaaggaaacccaggtgtgaaaggcacccgccgcggagctgggcgtgcagcggggcgcgcggtgggacctctgctcccgtccccgtcccgcggctactcagttgcccgctcatgggaggctcgcgacggaaaataaatcccctcagagtgaacctgggaggccgagaggacccagcctgggatctctgggggaaataggggcaagtttaccacggtttaattaagccacagccctagcacgaggaccccggcgacccatccgggctgggggatggactggagtgccccccaccccaggccgcgaaccggcagcgagaagcacactctccgccatccccggccccgccgcttccgcctctgcggactccgcgtttgccatgctccttcccggggtccagggaccggagctgcggtgcacgtcttattgaaggggagagctttggttcttttcctccctgcatccctcccactttcctctcaacagatagtaagcaagactcaattttctccaaaaaagcccgttacccctttctgcaaggggcgcatgcctaggttcacagggagctctcttgtcagccccagaacaaccctaaactccaaatgttctgtttgctctcgaggtacccctgggatgcagcgtctcctccgcgaagccttcctgagcctccctgcccagaccagttgctccttcttgaagctcaccgtgccaattaatgagccattgtcattagtgttgccctctgagttcctggtgagttcctgaccgtctagcattgctg

SEQ ID NO: 102732 - DNA, 667 bp, Homo sapiens
  chr1:64240116-64240783
  Hyper
gcccgccgctcctggcgctgctggccgcgctgctgctggccgcacgcggggctgctgcccaaggtaagaggcgcccgccggcccccgcccgcccagaccccctgacccgtggccacccttccgccgtccagccgggcgcgggacacgcaggaagcgccgcgctggctccggggcgcgtccggccacccgccacggggctcgccggcgccgccaggccagggtttgccccggagccccgccaggccagggtttgccccggagccccgcggcgggccggggcgcgcccagggactcgttcctcggtgcgcagcagcgattgtcagcgctgacaggaagcgtggaggggtttgagggtcctgggggtgatcggggcacttctgtgcagggcgtccccccttgtctccctggacctctagcgcgccccagccggtgttcaggcaagtctatcctgcccccaagttgcgagccggcccggaaggcgcggtccaggagggagtttggattttcagtggtgctcgccagagcccaggcggctcgcggatcgacgcaaacaaaagccctgtcctcctggggctccggcggcctcgcatcgccaccgcccccggccctccggccctcccgagagtcatcatagaggccaaaacttgtgcgccgctgcagccgctgc

SEQ ID NO: 102733 - DNA, 39 bp, Homo sapiens; identical to SEQ ID NO: 69827
  chr1:64240997-64241036
  Hyper

SEQ ID NO: 102734 - DNA, 17 bp, Homo sapiens
  chr1:64734652-64734669
  Hypo
atgttctgaattagccg

SEQ ID NO: 102735 - DNA, 16 bp, Homo sapiens
  chr1:64734789-64734805
  Hypo
gcgacaaagcaggact

SEQ ID NO: 102736 - DNA, 96 bp, Homo sapiens; identical to SEQ ID NO: 69837
  chr1:64937203-64937299
  Hyper

SEQ ID NO: 102737 - DNA, 358 bp, Homo sapiens; identical to SEQ ID NO: 69847
  chr1:65468302-65468660
  Hyper

SEQ ID NO: 102738 - DNA, 619 bp, Homo sapiens
  chr1:65731231-65731850
  Hyper
gggggaagagagaaacgaatttaaataaaaactcaaaaaaggaaagggctaaccgaaaaatgagccaaccaaattttaagttcaacaacaagcattctggaggattctggggttttaaattcggaggctccttaaatattctgccgcagttgggggaggagcgatggacccctaggtctccggaggctacacgtgttccccgatcccgtttccagggggagcccttccttcctattgcgctggtcgtgctcctggcccgcgtgcccaggaagggcgcagcggagtcgcgtgcccgtccgggcggaggacgccgtctccgcgcggcggtgccgggcccctgcttccggaacgctaattttagggttcgccggcccccctttcttttcacccgctttccgtgcgagccgctgcgcagcagtctgcgcttcgagtgcgctgtgttttaaggaggccccggcgcttgccccttgggctcgggggcttgggtgcgcaggtgggggctggcacgcagcccgttgggcaggtttcgcgcagcgaccctccccacgccggagctaagttctttgggtgagacgtgcaacaacgcaggccccaaagctctctgcgcgcagcgccgcgg

SEQ ID NO: 102739 - DNA, 69 bp, Homo sapiens; identical to SEQ ID NO: 69850
  chr1:65774834-65774903
  Hyper

SEQ ID NO: 102740 - DNA, 30 bp, Homo sapiens; identical to SEQ ID NO: 69851
  chr1:65775296-65775326
  Hyper

SEQ ID NO: 102741 - DNA, 30 bp, Homo sapiens; identical to SEQ ID NO: 69852
  chr1:65775826-65775856
  Hyper

SEQ ID NO: 102742 - DNA, 21 bp, Homo sapiens
  chr1:65940402-65940423
  Hypo
agaaaaggccaggtgcggtgg

SEQ ID NO: 102743 - DNA, 892 bp, Homo sapiens
  chr1:65990955-65991847
  Hyper
tgggggtgggagggacgggggaaccccagtgcctatctcaagcctgcggtcaccgacgcgggtccggggtgggggggtactgccagggaactcgcggcaccgcgtgcttgctgagttcgcctgggctctcggcctccctgcgggcaggggtcctccctccccagcgccgggtctctcctcccgcaggcccgcggccacccgcagcggcattccccgccgccgcccccgccacctgcgcgaccgccctagccgctcgagtccgctcctcccgctcaggggcggctgcggagggcgcggggcgcacgcgggcggccacccgactcttccctcccttctccccaccccagcctgctcctgctcagccccacctccccacgcactcggctgccctcctcctctcctgagagttgccccgcaccttgggcgaggagttcggagcggccccatcgcagagcccacggccagccgagcgcgcgcgacgcaggtgcccgagccccggcgccgccgccatctctgccttcggtcgagttggacccccggatcaaggtgggacctgcttccctctccgacaccccctattgccacctcttcccgctctgggtaactcgagaatggggctttgggacgcgcgtggcagacgcggagccccgcgggccgcttagggactgggagtccggggcagcttagcgggaccaccagaggggccagcgcccggcgggcggcgggggtggggtgggtgcgacgccgggcgactctcggctcccgtggggcgaggaagatctggacacacggctgacagcagccggcagcgcctggagcgaacctgctcgggaccaccgagagagcatgccacccggccaacttcttttccaggcttcgtgcctactttgga

SEQ ID NO: 102744 - DNA, 23 bp, Homo sapiens
  chr1:66030258-66030281
  Hypo
cgtgaatccgtttcttaatgttt

SEQ ID NO: 102745 - DNA, 702 bp, Homo sapiens
  chr1:66258145-66258847
  Hyper
tcaaaccaggattttcggtctctggctttggataggcacgcagggctgtgcgtaatccttcagctctggtggtaagggagatgcagtgagctcccggctgggagagagggttattttgcaaaactcccctggtaccgtgcccgcggaatattgcaggaggtctgtgaggtaggtgggggaaaaaataacctgggagggcaatcagggagaggccagacgactggggacggcgtgctttgcaccctagaattgacaggtggtggcctcagcagttacaacctactacacagcatctcgtccgtgcgatacggtcacattgttattccccgcacccggctgaggagcgcagcgcggcagaccaagtggcaccggcgagctgtctctcttccggggggcgggggtggacagtagggagagggggtttaaagggccagaggacgagagaagagctgaggggcgcgtcgccagcgcctgtgtctccctggcgcgggttccccaggctagcccgctggcccgtccgcgcgcgcgcccccggcccgcgcgccccttcccggggctcctggcctcgcctcagcggctgcaggctcttcgtcgcgggccgggctgcacgcgagcgccctccgggcagactttcgtcccccacccccgggagcgcggaaggctcactcgcagcgcatggtctacccgcgccgggcggagccc

SEQ ID NO: 102746 - DNA, 354 bp, Homo sapiens; identical to SEQ ID NO: 69863
  chr1:66259077-66259431
  Hyper

SEQ ID NO: 102747 - DNA, 622 bp, Homo sapiens; identical to SEQ ID NO: 69867
  chr1:66998790-66999412
  Hyper

SEQ ID NO: 102748 - DNA, 201 bp, Homo sapiens; identical to SEQ ID NO: 69868
  chr1:66999472-66999673
  Hyper

SEQ ID NO: 102749 - DNA, 378 bp, Homo sapiens; identical to SEQ ID NO: 64
  chr1:67217965-67218343
  Hyper

SEQ ID NO: 102750 - DNA, 116 bp, Homo sapiens
  chr1:67390334-67390450
  Hyper
cggaacttacaacccgaagttctgctgcttgtgactgcctgccggagagactggcatggtggcgaccagctggggagtggtgcaccacccctttttttggccgcctctgaagtccc

SEQ ID NO: 102751 - DNA, 29 bp, Homo sapiens
  chr1:67391067-67391096
  Hyper
agttcgcctcgccccgttcgcttcggtcc

SEQ ID NO: 102752 - DNA, 648 bp, Homo sapiens; identical to SEQ ID NO: 69872
  chr1:67773132-67773780
  Hyper

SEQ ID NO: 102753 - DNA, 86 bp, Homo sapiens; identical to SEQ ID NO: 69875
  chr1:68297687-68297773
  Hyper

SEQ ID NO: 102754 - DNA, 222 bp, Homo sapiens
  chr1:68298379-68298601
  Hyper
cactcgggggtccctcgcggggtgcgtcatatgggctctcccctctgcgacccgctatttccctgctagacccccagcgcccagcggattccaaggctgcgctcccgccggctggtcccgggaggtagaaagtaggcagaggggcgtggcgtccctgtcgcccccacatgccagccctcctccaacgcctgacaccaccacaagccacggctgggaacactg

SEQ ID NO: 102755 - DNA, 262 bp, Homo sapiens; identical to SEQ ID NO: 69878
  chr1:68696775-68697037
  Hyper

SEQ ID NO: 102756 - DNA, 30 bp, Homo sapiens; identical to SEQ ID NO: 69879
  chr1:68698056-68698086
  Hyper

SEQ ID NO: 102757 - DNA, 30 bp, Homo sapiens; identical to SEQ ID NO: 69880
  chr1:68698513-68698543
  Hyper

SEQ ID NO: 102758 - DNA, 123 bp, Homo sapiens; identical to SEQ ID NO: 69881
  chr1:68703942-68704065
  Hypo

SEQ ID NO: 102759 - DNA, 30 bp, Homo sapiens; identical to SEQ ID NO: 69882
  chr1:68761411-68761441
  Hypo

SEQ ID NO: 102760 - DNA, 301 bp, Homo sapiens; identical to SEQ ID NO: 69885
  chr1:70032971-70033272
  Hyper

SEQ ID NO: 102761 - DNA, 111 bp, Homo sapiens; identical to SEQ ID NO: 26378
  chr1:70033503-70033614
  Hyper

SEQ ID NO: 102762 - DNA, 652 bp, Homo sapiens
  chr1:70033922-70034574
  Hyper
ggagccttctgggggcggggagggagctgcgcctccgccaccgccgccgccgccgccgctgctgctgcggtcgctagcgcggcgcgctgggcaggctgaggctggggagtggacgcgctcctgcctcccccgccggcgcttcgggcttcccctcagccgcttcccgcgggaacctctccagccgtccacctgaagggcactggcatcatggtctaacgtggcaccttcctggattcccctctatctcctgttcttcctaccttctactccttccctcctcttctcctccgaagaccctggcgcccactccactgcggacccctgaacacttaaggaataacccttggcagctgcacgactacgctctccgaaacctcatgggcagtttctcccgccggcgatgtgagtaaggcacgctcgctccgtggcggagggtgctgcgggggcccggccgcggcgaccgtaggcgcgcgaggtgtgggaccccagaggccggccgggggcgggggtggcagggcgggaggcttcggcgctcgcggggagctgcttgtgcggtggccgagggaggcggcgaagatgtggtaggttgcagagcatttggaaatggggtgctaactgggcgggtgcatgggagcaccgagtagcttgagct

SEQ ID NO: 102763 - DNA, 336 bp, Homo sapiens
  chr1:70035088-70035424
  Hyper
cccttgaggatcttgcgtcctcctctccgagttattaaggatgcaggacgtgtttcggattcgacgtggaaagagggagggaagcacattagcattaaggtaatcatggcaccctggctcgtggactattagattggctaccagtggtctctaatcttactgtttgcagagtcaagaatgggggcgggggttgggggactgtatagattgccttttaaaatagtgtgacttcataataacggagatggctgaaagattgcttccttacactacttctcggccatcagggctgaataaaggacccgcctccgccctctactccggctcttctctggc

SEQ ID NO: 102764 - DNA, 29 bp, Homo sapiens
  chr1:70599140-70599169
  Hypo
cgatccgaccgcctcggcctcccaaagtg

SEQ ID NO: 102765 - DNA, 75 bp, Homo sapiens; identical to SEQ ID NO: 69893
  chr1:70672852-70672927
  Hypo

SEQ ID NO: 102766 - DNA, 38 bp, Homo sapiens; identical to SEQ ID NO: 69895
  chr1:70710368-70710406
  Hypo

SEQ ID NO: 102767 - DNA, 32 bp, Homo sapiens; identical to SEQ ID NO: 69896
  chr1:70793696-70793728
  Hypo

SEQ ID NO: 102768 - DNA, 30 bp, Homo sapiens; identical to SEQ ID NO: 69897
  chr1:70859409-70859439
  Hypo

SEQ ID NO: 102769 - DNA, 885 bp, Homo sapiens; identical to SEQ ID NO: 69900
  chr1:71512862-71513747
  Hyper

SEQ ID NO: 102770 - DNA, 30 bp, Homo sapiens; identical to SEQ ID NO: 69901
  chr1:71520000-71520030
  Hypo

SEQ ID NO: 102771 - DNA, 30 bp, Homo sapiens; identical to SEQ ID NO: 69902
  chr1:71532563-71532593
  Hypo

SEQ ID NO: 102772 - DNA, 194 bp, Homo sapiens; identical to SEQ ID NO: 69904
  chr1:72118097-72118291
  Hypo

SEQ ID NO: 102773 - DNA, 153 bp, Homo sapiens; identical to SEQ ID NO: 69905
  chr1:72383459-72383612
  Hypo

SEQ ID NO: 102774 - DNA, 436 bp, Homo sapiens; identical to SEQ ID NO: 69906
  chr1:72747831-72748267
  Hyper

SEQ ID NO: 102775 - DNA, 379 bp, Homo sapiens; identical to SEQ ID NO: 69907
  chr1:72748650-72749029
  Hyper

SEQ ID NO: 102776 - DNA, 869 bp, Homo sapiens
  chr1:72749709-72750578
  Hyper
acgcagcagcccctccgcagctcgccgggctgttttcagccctgccctggcccaaggcagaaggagatactaggcgtggggccacccctactcttttttcttctttccttcttgaactcatttccagattcaagatccttaagcttttccgggccatttgcaaatcaatgcgagaaccgaggctgagtcgttagcagttacaccaatcaatcttgttcagcgaggagtttgggaagcagagcggggaagtgaaaatggaaaataagtaattaaaaaataagctccctccccctcacacactttttcccttcctccaccccatccccctttagcagtgtttgaagaagatattctttgccagatcccagttcttcttttggaggaaatgaagcaaaacctcacacgtccgtaactcgttttccataatgctagcagggtcatttggcaaagcgcaccgaagcaagactctctgcaggggtcagcatccggctgcctccgcagactgagctctttacgaggcaggcagggagtcgttttgcttggtggtagcagtgttcagagtgatttttatcgccatgcacggggatatatggggaaagggaagggttcccatcacctgtgaccacccagactggcttacagacgaatccttaactagcaacacctccctgctgaactggcactccaaggctgggcagctaacggagacatttgcgtcaggagtcactgatgttagtattctgccttaactctcaaaaccgactcggaaactgagagtgcaatagtttcaaccgcattttgaaacatcaataaaatgttagtcatttgcggatgaatgaaaacattttctttaccgtctggtatgctag

SEQ ID NO: 102777 - DNA, 30 bp, Homo sapiens
  chr1:75593985-75594015
  Hyper
ctcctttttccccttcgtggccgttttatt

SEQ ID NO: 102778 - DNA, 164 bp, Homo sapiens; identical to SEQ ID NO: 69913
  chr1:75595334-75595498
  Hyper

SEQ ID NO: 102779 - DNA, 651 bp, Homo sapiens
  chr1:75595733-75596384
  Hyper
cctccaaaccacaggcgtgcttaaggcgctattgtcggcttggaaatgtcacaatgaataaatggtgtgatggactttagcgtttcgcgccatagcttttagccgggaagctttccaggctgccctgcttaatttcggcgtggttcctaattttctctctcccatcctctctcttagactggaaacgcttcccctatttcttccgtagcggaccgggagagcttactggcgctctgcgaaccggctggaaagaaacaccgagtcactcgtacagactcttggtcgcagaacttggctttccgctattggtcctccagaaccgcttgaaacaactggccccagctggcgcatcagaccgcagtgaggaatgccgcggggcgggtggcgaaggcagggtctgcccgccagtggattcccgggtgtcccgcgtggagcaggcttgcccagctgggaagcccatcaaacctcagtcttggcccacagtgggagagagaccagtgggtcccagacggaggccctcgcccgcttttggcgacctccactggcgtgaataaaagcacccctctcttaccctcagaaactgtgggtagcaaggtataaaacggagtctgggaccggtaagtcccaaggtgagcccgtatacagctctgc

SEQ ID NO: 102780 - DNA, 973 bp, Homo sapiens
  chr1:75596611-75597584
  Hyper
aattctgccagaatccgcaccttcttatgatcgcgaaagtctccccatcctccaccgcctcctacagtcctatggcccactgtacccttggcgctggagccctggaggtgggcggtgagggccgcgggccagggaaagctcgggtccgcaagagcagggctctgtttctgcgcctgcaggccgcccgggagtcctggatgcgcctcctttgaccacgttttctctcaggctccagctgtgcctcgccccgatctccacaggtctgacccaggcgagtccctagaaggcgggcgggaggagccgtagcaggggcagtttcgggaatccgagtttccggagattgcctgagcaccgcagaacctccaggttaagttctctcaaacgtgtggttactcaccccgaggagctcagaggcaaagggttcaatagtcaagttggtggggactttccctacttaaagttataatttgctaattcggatctattgcttttaaatatcgagttccagagacctctgtcaatgcaggcttaatttcatcccactgatgaaggatgtttataaacggcgcctgcagtgcgagctgagtgtgaaaatatcagttttatgccttttgataagaattaccgaggcggaaggctcattagacgattacaaatttcgcagctgctcgcagcccaattaggcagctcttcgggtgagtggaagctgtgggggtcagggcgggttgatgttccctctctccagcccggacctccaatcaaggcctggctccacgggatctagaccccttccctgcccccatctgtttttagggagatacactcaaggcttcccttaagcaggagaggcacagcctgggacaggacgcactccgaagtctctcaggctgtctttcccatgggcttgcaaaaagccctgtggtccacggatgttggtagacaccttgggtgggcctgccgcctctgattttca

SEQ ID NO: 102781 - DNA, 981 bp, Homo sapiens; identical to SEQ ID NO: 69919
  chr1:75597825-75598806
  Hyper

SEQ ID NO: 102782 - DNA, 315 bp, Homo sapiens; identical to SEQ ID NO: 69920
  chr1:75599376-75599691
  Hyper

SEQ ID NO: 102783 - DNA, 1320 bp, Homo sapiens
  chr1:75600108-75601428
  Hyper
aaggaattttaagaacggttcatcagaaagtggtcaggccacagcggcctctttggacgaagacacacttgtagcattatccttctcggcatcagcttttattagtggatcggggcgggggaggggggagatcggcagacacggacagcctctgaccctctggagttggtatgtgataagcagccctagcagtgccatgtattggaagaacgatcagatgtttgtgtgtaaactagtagcaaaggacgtgccggagctggcagttccccctgagaaggtgagcgagccgacgcctggccagaccagctgaatcgcagtgtccttgaaactcgagttgtttgggctcctaaacaaggttcagaaactacctgtaacggcctcatcttcagacctggcaattttttttttttattacgtagtagcgttagtcagtaatcattgcactccctccccaaaagctcacttaacctgagacatggagactgtaatttgggagatgaagcctcgagcctaaggcgctctcaggtccatgtgagtcgtgcttttgttctatttgctgtggtgatcgtggcggtccgggagagtgggtcgggaggactgggcggctgtcgggtggaaccggagacctggctcgtttcgttcggctgcccgcggacacttgcctgccctgaggcacacctccctctgcggggctccagaaaggcctccgggatccctgggcttgccgggagagccattttacctaaaatgccaaaagaaaaccgcagggcacaaaacgagtcacgcggtttgtctgagtagactggggaagctgacaagctctcacctcactcgggaggcaggacctgtgggtatttggtgttttaagtttgaaatcatctgcagcctgtctgagggcctcagcaggacgcgcgcggggcgcccctgactatttctttgctccgaagccggttggggacaccaggcgaaagcggagctgttctgtttaaacgccctttgtgtgtgaggacgcggcctcagtgcagctacgctgggtcccgcgtagggagcgcaccccagaaagggagggtctcggccgacggtccgggaggcccccaggttggtatcttgcctggtgcttccagagggagggagaaggggaggcgaacagtcagaaatgcagaagtgcgagccgctcgagttcggggtacccacccgcccccgagctagagtttttggaaacgaaagcggtctaagcccagggacgctgcgttttcgtttaagaacaaaactccagcaaatacttggaaacacttgagtaacgcgcgttgtttctttaaa

SEQ ID NO: 102784 - DNA, 1526 bp, Homo sapiens; identical to SEQ ID NO: 69925
  chr1:75601633-75603159
  Hyper

SEQ ID NO: 102785 - DNA, 775 bp, Homo sapiens
  chr1:76080278-76081053
  Hyper
gaaaagcaaaaagcacgccaaagcctgagcgctgctgtagtccaagccaatgtattcagtaatacccttcacccctcagttctcatctgagttcctgtccttttttatataaccccaaaggctcagtaagtcgctgcctcccaggtcattgggcccattgtgttgaaatccaacttcgaacgacgccccttccttgccaccatcctcaggtccagttcccccgcgcacagccttcctcaccgcgcatggtgtcgagcccacttccacctctctgcagtgctgcagacaacctctagggctctgcgagtcccccagcgagagctagggagccgacaagctgcgacctctgcgagtccgcgctgcgggagcgggtggcttgcacctgctccccgcgcgccggctctgcgacccctaggcaagacgcagcccaggaggctccctcccgagtcgcgccccggaccacgccgcaatgcctcgtcaccccagcaacaagctcttccttgtcctccccgccatcgcttctctccgcgaactttccaactttggaagcccgggttccaaaggagcaacagggagactgcttagccggagccactgcccgtctcgacaggttggggagcaggaagtagcctgcagggactcggccggtagcaagtccccttgaccgcagggaaaaggagaggcagccagctccaatctcctcctgaggatggaggttggggaaatggatgcagaacttgtcaccctagggacgaaggggcggagggagggggga

SEQ ID NO: 102786 - DNA, 484 bp, Homo sapiens; identical to SEQ ID NO: 69928
  chr1:76081342-76081826
  Hyper

SEQ ID NO: 102787 - DNA, 341 bp, Homo sapiens; identical to SEQ ID NO: 69929
  chr1:76082037-76082378
  Hyper

SEQ ID NO: 102788 - DNA, 30 bp, Homo sapiens; identical to SEQ ID NO: 39004
  chr1:76259201-76259231
  Hypo

SEQ ID NO: 102789 - DNA, 24 bp, Homo sapiens
  chr1:76354586-76354610
  Hypo
tttttttttttgagacggagtctc

SEQ ID NO: 102790 - DNA, 24 bp, Homo sapiens
  chr1:76354730-76354754
  Hypo
caacacgcccggctaggactggga

SEQ ID NO: 102791 - DNA, 44 bp, Homo sapiens; identical to SEQ ID NO: 69933
  chr1:76540206-76540250
  Hyper

SEQ ID NO: 102792 - DNA, 161 bp, Homo sapiens
  chr1:76540496-76540657
  Hyper
tgcccctgacccaggcgcgcccgctgctcggtggcaggagggccggcggagcgccatggcctgcatcctgaaggtaacgacttggatctgtggctcggacgcgtggttggccagccccttgctgctcagaggcacggagtcagccgcggtcccaccgcatc

SEQ ID NO: 102793 - DNA, 170 bp, Homo sapiens; identical to SEQ ID NO: 69936
  chr1:76955378-76955548
  Hypo

SEQ ID NO: 102794 - DNA, 678 bp, Homo sapiens
  chr1:77332866-77333544
  Hyper
tgtttttatcaacatcgcaaaacagaaaatttaggttgcagattttcacatggctatcacgttcagaatccaatcaggttctccttctttactacttgatgacttctttaaagataaataagcccgcggaccaagaagtgggtacactggctcggttaactctctctccccagaaatttcactactgaaaagattattatttgggggcggggaaggggatgtagaggtctttaggacccagcaggcggcggcaggcggcagttgtgtagatcgctgagagactacgagggtccggttcagttttaattctgtctctaatctctgcaacagccgcgcttcccgggtcccgcggctcccgcgcgcgatctgccgcggccggctgctgggcaaaaatcagagccgcctccgccccattacccatcatggaaaccctccaggaaaaagtggccccggacgcgcgagcctgaggattctgcacaaaagaggtgcccaaaatgaagaccctgatggtgagtcagttgtggcaactccaccgggcaaagagggggatccccgggctcagggtccacgggacgcaccgtggagactccgagacgcctaaccctgggccgcgaggtcgcctgttacaaagggacaactttctacccgctccgcgttccctcccgattctccagctct

SEQ ID NO: 102795 - DNA, 1151 bp, Homo sapiens
  chr1:77333763-77334914
  Hyper
caaacttgcaaggatcgcaaggatccagggccccaggaaaggaggggtgtgaaggactcaaaattccagcagcttggctggggtggctgcgccagacgggcccttccccaaagtgcaaacccacccctgtcctcggccccggcgcgctccctccctcagcccggggccgtacaccacctgccctctaccgagagatctgggcggcggcggccgaaagcagcgacgcgcccggagcatcccttgcgatacgctaggggacggtgctttctctgtcccagttgcgtgcggcggggctggggcccaggccgccccaaatctcccccactagagtgaccaccgcacagttgtccccgctgggcgcgctcctccggtgtctgcgctcagccgctctcctcttctctctcccgcccgcccgcagcgccatggtctggcagtgtgtttagcgctcaccaccatgtgcaccagcttgttgctagtgtacagcagcctcggcggccagaaggagcggcccccgcagcagcagcagcagcagcagcaacagcagcagcaggcgtcggccaccggcagctcgcagccggcggcggagagcagcacccagcagcgccccggggtccccgcgggaccgcggccactggacggatacctcggagtggcggaccacaaggtgacagcatgcccgccagcccgctcgccactcagcctggggatcccgcacacctgagccttccccctttcccggggctgggaggcgctgtgagtaggtgccgttcgaaggctggaggggagtggacccgctggggtagggtgggctagttccaacttggtatgaattcttatttggagaaagacacaaagttttgtagaaaataggggtgaggtgcgtggaccccaaagcctaatttcccagcagaaatcggccctggaactagaactccctgatccccagaattgcagctgcggatggaggtccggttcctgaagcctcgggtttggccgccgagtcgctgcctggtgggaggaaactggggttggcgcgggtaccagcctgagcgttcctctgacccggaaccggagggtgagcgcagccagcccgcggccactgctcgggatccagcgttcccctctgatctctccagcgcattgctttgggc

SEQ ID NO: 102796 - DNA, 1527 bp, Homo sapiens
  chr1:77747299-77748826
  Hyper
ttcctgggagttcctcggagacccggaggtaaccgtgtatgtgcgtgcgagtgtgtctgtgtgcgtacaaggtccggagaagcgaaacggtcgcaggttcctacagaccccgaccctgttcccttggccacctggtccccggtagctgcatccctgggcggcgcacgcagtgaagcgtcgcgctctggcgccggtgccgcaccgaggggtatgactacgaccccttgcgcgtgcccgcccccacctccgcacctcgcgccagcccgcgcagcgtgaccggcagccgccgcagacccggctcggggaggcgcggagcgcggcgcgctgaaccggagaggcgggccggctgctgccttgcgttcgccacgctgtcctccctcctccgctccctgcgccccacccctggcggccgcgctgcctggcagcccgggaagccgcggcacagctgctcggcgcctgcagctccggctcgggggctggaaccgaagcgggggcggcgggagcgcggagaccacagcccccggggagaggcggagggggtccctggcctgggcggagaggctgagctgagtgcgcgtgagaaagagggctgcaccgctgctcggcgcggactctgccagccccagcttcagccccggctcaggtcgccgcagcccgggagcctccccgcttgcgccccaaggcacgcgcggcacagccatgaacaccaacgatgccaaggagtatctggcccggagggaaatccctcagctttttgaggtagggctagagctggccgacgggcggtagcatccggggactgcatctcaggggttcgggttgaggcagccgcgccccgtcccaccttccccacacggggcatgtaatgaaggggcttgtagaagcgcactcgcccgctcccccgagggtagtcgcctttcccgcgggttgccagggtccttgtcagaaggctgggcttagaagcctgcatctcacagatcaagtttcagtcttccagcagggttctgaaagcagcctgctcccatcgcgcccctcggatgtggacacccagggtgggctgcagaccgcggccgggccgcactctctgggggcgagggccaggtcaggtggctgcactgtcgcccagcagcgagtaaagactcgaaactgagggagccagagccctagtcactctgctggtcgagggtcggaacccctgggggaaagaggaaatgtggacgaaggcagcccttcctggagacagcttggaagagagggatgaagatgcaaaaagcaaaacccaacctatcaagtgccacctccccggtgacaggcccccagccttgctctgcgctttcgctgaatgaactcctgagcacgtttttcccgttgcctaggaagggttgggccgcaggtttcgccagtgctcgacaacccacctggagatagcgggtcggggagggagctgcgaggggggcggactcctgttgctcagtcttcagaccgcagcacagcatcatctgcaccgggacccgggaatggggggac

SEQ ID NO: 102797 - DNA, 22 bp, Homo sapiens
  chr1:78122948-78122970
  Hypo
gagccaccgcacccagcctaaa

SEQ ID NO: 102798 - DNA, 158 bp, Homo sapiens; identical to SEQ ID NO: 69952
  chr1:78244687-78244845
  Hypo

SEQ ID NO: 102799 - DNA, 927 bp, Homo sapiens; identical to SEQ ID NO: 69953
  chr1:78354035-78354962
  Hyper

SEQ ID NO: 102800 - DNA, 949 bp, Homo sapiens
  chr1:78511435-78512384
  Hyper
gtttgccttctaaggcgtattgttctgtagcgtcggcatcctcaggcgttcacgtaaatagagccattttttacaaggagtagggataaacctggtgataggatgagggactacgtaactttctttctctccagatccatcccgggggaggctgggcgggcgggcggctgctccggtccaggggtggaggtcggggccctgacccgacgcagccaggcggaagcgcggctgccattggaggctgcttttacctgcgcggggcccggggcgcaaagtccgaggcgccggggggaggaggcggcggacggcagcgcaggtgggcccgcgctctcggccctgcaagatgcccctgaagctgcgggggaagaagaaggccaagtccaaggagaccgccgggctggtggagggcgagccgacgggcgcgggcggcgggagcctctcagcgtcccgggctcccgcacgcaggctggtcttccacgcgcagctggcgcacggtagtgccacgggccgagtggagggcttctccagcatccaggagctctacgcccagatcgcgggcgcgtttgaaatctcgccgtcggaggtaaggcgccaggtgctcaggctctcccgcctctccgccgcgccgcgccgcgccgcgcgtatttctgtgggcccaggagggttgagcggcgtttcccggagcgcgaaatccgatgccgtgttgagtccgccgggggcgtcccgggggaaagtgagtgtgccttccctggaagggaaaatttaacttggcaggaccgcagaaagtcacagtcccccttgctccgagatctggcctttgggaagcgggttgagggaggcaacctttcttccgcttgcaaatgtgtttgctccagatgtcccggattccgccggccgttcaaggcgtgagcaccttcccagactcgagatctggcggggcagattaata

SEQ ID NO: 102801 - DNA, 757 bp, Homo sapiens
  chr1:78956796-78957553
  Hyper
cgatcaggatctccgcgctgggatcggtggaacttgaggcagcggcggcgcggggcgccatggcacaccgagcggctccgtcttctgctcctcagagagcccggctggcggcctgggatgacaaggtaccatccctccagaggctgatcccaatgcatcggcttcgcttatctagacccagatttaatcaactcaccccctgagacacccagccacagcttctgctggctgagcctgacactgagtttggaccagattccccaagctagggagacgcatagagaaagaagggtactcgagctaacccatccccattctgagctgctctgcgggggattgggtagaaagggtctcagaagagggaaatcggcacagattccgcttctcgccgttgcggggttccctgcgggcggcactgcgagttcctcacccgggcacgtcctcactccccgtgcccgggatgagggagaaaacagccctttggcgtttgagcaattgcagaaagtttcagcgagttcgttagtttggagggaatgttgcgaggccaggccgaagggcgggggggatagtaacgggcgaaagtcgaactgtgagtaagacctggagaaggcgaccgtcctgggggtagcctaggcagttccactcgggctgggcgcaggaaaggctggctccggaattcccagcctccgggaaagctagctgctcgggaaacgccaatcgaattagctcagagaagagtggccgtggccttgtgtat

SEQ ID NO: 102802 - DNA, 222 bp, Homo sapiens; identical to SEQ ID NO: 69959
  chr1:79294494-79294716
  Hypo

SEQ ID NO: 102803 - DNA, 36 bp, Homo sapiens; identical to SEQ ID NO: 69960
  chr1:79472423-79472459
  Hyper

SEQ ID NO: 102804 - DNA, 77 bp, Homo sapiens; identical to SEQ ID NO: 69963
  chr1:80515982-80516059
  Hypo

SEQ ID NO: 102805 - DNA, 35 bp, Homo sapiens; identical to SEQ ID NO: 26422
  chr1:82266147-82266182
  Hyper

SEQ ID NO: 102806 - DNA, 89 bp, Homo sapiens; identical to SEQ ID NO: 69967
  chr1:82266766-82266855
  Hyper

SEQ ID NO: 102807 - DNA, 44 bp, Homo sapiens; identical to SEQ ID NO: 69968
  chr1:82267616-82267660
  Hyper

SEQ ID NO: 102808 - DNA, 491 bp, Homo sapiens; identical to SEQ ID NO: 69969
  chr1:82267888-82268379
  Hyper

SEQ ID NO: 102809 - DNA, 271 bp, Homo sapiens; identical to SEQ ID NO: 69970
  chr1:82268689-82268960
  Hyper

SEQ ID NO: 102810 - DNA, 34 bp, Homo sapiens; identical to SEQ ID NO: 69971
  chr1:82269276-82269310
  Hyper

SEQ ID NO: 102811 - DNA, 30 bp, Homo sapiens; identical to SEQ ID NO: 26428
  chr1:84158496-84158526
  Hyper

SEQ ID NO: 102812 - DNA, 465 bp, Homo sapiens; identical to SEQ ID NO: 69977
  chr1:84464413-84464878
  Hyper

SEQ ID NO: 102813 - DNA, 35 bp, Homo sapiens; identical to SEQ ID NO: 69978
  chr1:84543374-84543409
  Hyper

SEQ ID NO: 102814 - DNA, 293 bp, Homo sapiens; identical to SEQ ID NO: 69979
  chr1:84544218-84544511
  Hyper

SEQ ID NO: 102815 - DNA, 38 bp, Homo sapiens; identical to SEQ ID NO: 69980
  chr1:84944530-84944568
  Hypo

SEQ ID NO: 102816 - DNA, 658 bp, Homo sapiens
  chr1:85358311-85358969
  Hyper
tttcctaatcaccatcgatggcaatgagactgagtttggaaagaaccacgtgtgcaaaggcagacgcaacccgtgcggcgctctcctggcctctgcgcccagcccgccagccctcagcagcggacgcaacgccgattttgcatctagattgctttttgctcctagcggggaaaaaggtgggaaaagagcaagttgtgccatacacccgccgggagagtcttgtcccggggtttggagtgggtctggagcccaggcttgcacgccaggcaaccccgaaaagccgcaggctagagccctgcaggcgccgctgcgccccggcctccccacgacgcacgccctggtgactgcggctcggggtaccctccctgcgcccggaccctcactcaccgctcacgttcacccgcgccgccgagcccgggagcgggggcccctgcggctgccgcatgccctcggggtcgagcgcgacggggcgaccgggcgccgggctccagccgggcgcggagaagcagcggaggacgcggcgggcgggcggagcgcctcctctccagcgacccctgcgacgcgtccagagccaaaggaaagtttggcggtgcgagggagggacctagggacagcggcccctccctgccccgccccgccccgccgggtgcgttcgacg

SEQ ID NO: 102817 - DNA, 178 bp, Homo sapiens; identical to SEQ ID NO: 69983
  chr1:85359170-85359348
  Hyper

SEQ ID NO: 102818 - DNA, 256 bp, Homo sapiens; identical to SEQ ID NO: 69984
  chr1:85463282-85463538
  Hyper

SEQ ID NO: 102819 - DNA, 16 bp, Homo sapiens
  chr1:85463598-85463614
  Hyper
gcgcctggccccttct

SEQ ID NO: 102820 - DNA, 78 bp, Homo sapiens; identical to SEQ ID NO: 69986
  chr1:85463869-85463947
  Hyper

SEQ ID NO: 102821 - DNA, 37 bp, Homo sapiens; identical to SEQ ID NO: 69987
  chr1:85513662-85513699
  Hyper

SEQ ID NO: 102822 - DNA, 30 bp, Homo sapiens; identical to SEQ ID NO: 26435
  chr1:85527927-85527957
  Hyper

SEQ ID NO: 102823 - DNA, 62 bp, Homo sapiens; identical to SEQ ID NO: 69989
  chr1:85774021-85774083
  Hyper

SEQ ID NO: 102824 - DNA, 682 bp, Homo sapiens; identical to SEQ ID NO: 69992
  chr1:86621263-86621945
  Hyper

SEQ ID NO: 102825 - DNA, 561 bp, Homo sapiens
  chr1:86622190-86622751
  Hyper
accatgcttcaaacccgcaacaagaaaaaaaggaggggagggggtgaagtcgggaggaggtaggaaatagcacccgaaggggaggacaggcttcctagctctctggctcggtaacgaacgagcccagggttgcgctccccggggagggcgggcgaggaggtaaacctcactgggaggcctcggggcgccggcggcagcgggagccgggctgctagtgcagcactcaagttcacttgcggttcaaaggcgactctgtgactccagtggagtcctctgctttgggcctgggaggagaaaggggtgggggtagggaaggagatgaagtgggggaggaagtccttggaaacagcccgcgcccgaacgtttgtcaaacaagcacacacacccacttcggaaatcaagtcggtgcgagggggccggtggcaactgcaggcgctcggcgttgactgccgccggctgctttgcctggaagaagaggagccaagcaaatccggccggtgttaaatttcaccgctcactgacttgcaatgacatcaccaaacactgcgcacacctccccct

SEQ ID NO: 102826 - DNA, 221 bp, Homo sapiens; identical to SEQ ID NO: 69994
  chr1:86860814-86861035
  Hypo

SEQ ID NO: 102827 - DNA, 30 bp, Homo sapiens; identical to SEQ ID NO: 69995
  chr1:87229260-87229290
  Hypo

SEQ ID NO: 102828 - DNA, 30 bp, Homo sapiens; identical to SEQ ID NO: 69997
  chr1:87617400-87617430
  Hyper

SEQ ID NO: 102829 - DNA, 174 bp, Homo sapiens; identical to SEQ ID NO: 69998
  chr1:87617684-87617858
  Hyper

SEQ ID NO: 102830 - DNA, 187 bp, Homo sapiens; identical to SEQ ID NO: 70000
  chr1:88928315-88928502
  Hyper

SEQ ID NO: 102831 - DNA, 30 bp, Homo sapiens; identical to SEQ ID NO: 70002
  chr1:89664391-89664421
  Hyper

SEQ ID NO: 102832 - DNA, 62 bp, Homo sapiens; identical to SEQ ID NO: 70004
  chr1:90292117-90292179
  Hypo

SEQ ID NO: 102833 - DNA, 55 bp, Homo sapiens; identical to SEQ ID NO: 70005
  chr1:90309435-90309490
  Hyper

SEQ ID NO: 102834 - DNA, 124 bp, Homo sapiens; identical to SEQ ID NO: 70006
  chr1:90847612-90847736
  Hypo

SEQ ID NO: 102835 - DNA, 748 bp, Homo sapiens; identical to SEQ ID NO: 70008
  chr1:91171967-91172715
  Hyper

SEQ ID NO: 102836 - DNA, 161 bp, Homo sapiens; identical to SEQ ID NO: 70009
  chr1:91172920-91173081
  Hyper

SEQ ID NO: 102837 - DNA, 564 bp, Homo sapiens
  chr1:91176389-91176953
  Hyper
aggaactccaggcatcgcagcacaacgaactcactaggacaagcggctccgcatggggctgggggctggacgcccgccgccagggactgagaaggcaacgatcaaagccgccacaagggtttgttagctggccctctccaagtcccccgggggcgtcctaattgctcgtcccacagcctcccgctcacaggctgtccgacctcgccggcgctcagccgcgggcagcagaacagctgcgaggctcgaggagcgtccgcctgccgcccagcccctgccggcgttgtcatcgctgcccagcgcttcggaccctcgctgccccaggaagacccctagaagaaggaggaggggaggacagagggatcaccacaccggtgaagctggggcctctatgcaggtcaggacggcagcaaagttggccgccgacttagccagcacccgcagcctgcaagtacagattttctcccacagcctcctgggttgctttgaaaccatccatttaaaaagaaaggaactcatacatatcaaataatggttcggaagaggccagcacgaaaaatggagctg

SEQ ID NO: 102838 - DNA, 112 bp, Homo sapiens; identical to SEQ ID NO: 70012
  chr1:91177380-91177492
  Hyper

SEQ ID NO: 102839 - DNA, 417 bp, Homo sapiens; identical to SEQ ID NO: 69
  chr1:91177840-91178257
  Hyper

SEQ ID NO: 102840 - DNA, 90 bp, Homo sapiens; identical to SEQ ID NO: 70014
  chr1:91178931-91179021
  Hyper

SEQ ID NO: 102841 - DNA, 64 bp, Homo sapiens; identical to SEQ ID NO: 70015
  chr1:91179460-91179524
  Hyper

SEQ ID NO: 102842 - DNA, 231 bp, Homo sapiens; identical to SEQ ID NO: 70016
  chr1:91180075-91180306
  Hyper

SEQ ID NO: 102843 - DNA, 1063 bp, Homo sapiens; identical to SEQ ID NO: 70017
  chr1:91181807-91182870
  Hyper

SEQ ID NO: 102844 - DNA, 906 bp, Homo sapiens
  chr1:91183087-91183993
  Hyper
aggcgaaggcgaaggcgaaggcgcaggcgaaggcgaaggcgcaggcggcgggaagctacgccaaagccgccgccgccgccgctgccggggtctgcccacagcctggcaccgggcggcagcggtggcggcggcggacgcggcaggtgcagcgaccgcgaagcccgggcggccgcgcgccctcggaactcccccgcggctcccgaggtggcagccgcgcgccactcggcagccccgtagccgagtttctgaactttcttggaaagttgcggggcagacacggccgcagcggttgcggcaacccgaggaggaggaggaagaggaggacgacgagaaggagcaggcacagaaggaggaagcggcggagacgcgatgccgggcgactccggccgctgccgggcgcgttcgcttgtaatccggctgctggcgggcggcgccgaccccctcccgtgacgtcacggccactaccgccgctccccgcgccgcgccgcgccgggcccgcgcccccgccaccgaggccgcgcgtccggccccgcgcccctattggccgcgcccgcgcgagcgagggacgccgacgtgccagggagccaataggcgcagcgctcgtgagcccgtcagcggactcggctcggactccgctgctcttttgagaacccgcacatccctgagcccgcagccctgagccgaactccgagtccagtggtcccggtgtccacaatcacgagtgcgaggcaaagggagagggaggaagagatcagagggagaccagagaaagggaaccaaaggggagaaagaaaaaaaaaagtagcaaggattcgcccgttttcttaagtcagaagagagagagaagaggacgggaagggacttacctttaggctccagcgcggcggccctcgcagcctccccaaa

SEQ ID NO: 102845 - DNA, 871 bp, Homo sapiens
  chr1:91184194-91185065
  Hyper
tccgcgtccaccaggcgctctcggggaggacgaggcctgaggctccaagctggggaaccagcctggtctccagctggaaaaaatgcctggccagacgctttctcccgaacgggggagctaatgcccgaggcgttctctggtggcgagggcagccacggttcactgcggtgtcgggcgggcgcggggctcaggacccatagcggctggtctgcagcccgcgcccctgccgcgccccgcggcagtccgtccacctctgtcccccggcccctttcggcgagcgctcatttggaaaggaaacagtcactgcggatccacttgggacccggagcatgactgtaacgcctcgttggagtgtatcaacttgcattattttctctaggacgtctccaacctgtctcatgttgaatgtcagagtaatgggaagtgccagtgacaagacggcgtattactcctgattaagtgccgtgtcaacctaattagcagagtaattataaggtgctaatgaatgattcaaagttctttgagttacattttactccaaattaccattttaagaaccctatgaatctgcgaggcgggcatcgcttccgtggctaggtctggaatgatgttcgagtggcctttaatgtctccaaaggctgggccgaaatctggagtttagttgcagttctggaggtcactttctgggccacagcttttatctgttgaggacgaagggaggggtgtcagggaggcaaatgacctcctgggacaagctcttgcctttcggtcggaactgcttctgtgtgagccctgggtccggaagcgggtagctgggcgactcatcctgcctgcgttttcctagggaaatcggtgtgtttgacccagaaaa

SEQ ID NO: 102846 - DNA, 871 bp, Homo sapiens
  chr1:91185125-91185996
  Hyper
cgtctcagtggcatttttcctagggctgttccgagagaacagcggggattgaagggacggaggcaaggagatgcacaatccgggcagctctcgctcttctcggaaggcgaagggagtttggcggagaagacggggttggtgagccgaggcggggactccggacgtgctccatcccggcaggggccgacagtggccagaggggtgcggggaggccctcgggaacgggtgactgggccccgccgggtggggtcgggccactgtaggctggagcggggttggatcaaatgcctttggcgcgggaactgagtgctggcccgggagaccctccggagagctcgcgggctcggcctcggcctcggcctcggccttcggccgcggttaccgaaacacagacggtagacttgtggaggtggcttatccgaggccgcagggcccgacgctgcacagcttcgcagcctaaatatcctgcgcctctgtcacagttgaccgctgtggggaggacaggaagggctctagggctgcccgagactgcaggctgaccctacctactctaccctcttcaaatatcgattagggttcttcccattccaacatcatcatccaccaacttcccgaatatggtgcgttttctcctagccctgggaggttccaactcgaactcccctcgctgcatattcagggtgggaagtagggagggggagaaaacaaatttaaaatccagaactgacggcactgcacaaatcaattattctcgaccttgataaataattcatttaagcctgtttttgttttgttccgacgcctaaaatgactcaagagctcaaaaggctgatcgcacagcttgtgttgggcggttcgacagggtcttttt

SEQ ID NO: 102847 - DNA, 3834 bp, Homo sapiens
  chr1:91188983-91192817
  Hyper
accaaaacctcagagcgctgagcaaagatgccaatcagagaaagagaaattcatttgcgatgttaattaacaagcggctaattaaaacggcactttgagtgctaatcaatcgccttattaagttacagccatcactggaacaaattgaaacctccccgccccgttttctgcctttggtgcaggcggggccgcgttcccagataccgtgagaggccttggggcgcggaggttgggggcagcctcggtcagctttctcagtctctcccaggtctacagaatacgccactggacaagtgcctaagcagcgacttctggtccagacacaccgcccggggagtaagtagttgcgtcgaagaacaactcattcagcagcagttaacaccgacgtttcctcctagaaagagctcccgcaaagcggggggatgtgacctgtgggcccccagcaggggtaggaggcagttcagcccgagagggggcgctctagggcctggatcctgcatccctatttcctggaacacacccaacgcctcattctgaaaaccctgcttaggccctggccctggtgccgctcagcaaccaggaaagagctggacctgccttcaggcagcaagaacaggactgccagcctcctgtggctctgtctcccgaggctccatgagaaggggatgggggtgcaagaagggaagagtgaggtggtgtgctgggcgtcggggacgaggacgcacgccagccaagacgtgcctcccacccagcccacgcgcgcttccccacccccctggccctccaaaatcggtaagagaattaagatttcgaatccctattttgaggagccttccgcatttcctaattgttaaattcctgcttttcaccaaattcccgggggagaaacatttggcaataagaagggactgtgaatttaaatgctaattgagtgggtcctttttccgcagctccacctgcctggcagcctctgttgaaaccaaacacactcggagcgcccagtgcaacattcttggggtgccgagtagaagcgcagtaaagagagaccctagcggactcctgtctggtttgctttttaccgactcttacagaaaaaaagagaatgccattggaagaagctcttttgcgtggtgggcgatgtgtgggtgggggacttgtggcatggcccacggtgttgtttctgtgcctgcgatgacacacgtatgtcttgagctgtgggctcgccttcctggaggtgcgcccgaccgcatctgctggtgggtctgagcgtgcttggggtgtcccaggagaactgagagaacggctcccacgtgcaaagttccaaagcattaatattttcatcatattatcattattcaatataataatatttgttcggttagcggcactaattaggccacattaaaaccgtagtgtgtccctaatggtgcgtaatgtgctcacactcacatttttctctctgaggatgggcggctgcaggctggtaggggaggagagacaggcaagcggcgggctggattagggcgtgacgccccccaccacgcacacaaacatacacagcccactggatgtctgccgggtgggagccgcaatctccgcgcggtcgatggggccctccgctgcgcactcggccctgcgccgagcaccctgcagcctcctcccgcgacacggcgctttgaactcggcggattgattttgcttcccttcccccttttgtgtgtgtttgcgttcaattggttaggtttttaagatttgggagggctggtgtgaaagaattaaaatactcttaactggagcccctccgccgagaactggaggtcccgcctcctagttcggcgctttcaggaccctcttcccagagggaatttctttcagaaattccagggtgggcttgtaaaagacgcttccgcagagcaggtcccgtcagggtctttttcctgttcctggtgccagcggtcggcccgggcgccccgcagacctcggcgaggtagatgttaagctcggagagtgcccctcccgcaggcgccgtggcgagatcactctgaatatgtaacatatttgtaacgtgcgccgaggtgtgatgtgtgtgctgaaatagggggatgggggaattcgaagccggattgggaaggcgggggggaggcgcacagaactcacaatgtacttcgcaatctaacaatctgaacattcatttattaaaagctgctgcgtgacatttacactgagccaccagtctctgcctctaatccgggcgaaaacgattgtactgccgagttatggctgcagcgtatggggacgctgctgtccgcggccggacagagcccatcagctacaacgcggaaggcctctgcacccccttgggggcgggaggaaagtactgccagtcctgcctgggggccgagggtaacaagcaccgagcctctcgctccacgcagggccagctgcccagctcagcgaagctcttgtgatctggtgcgtgtctctcgctcttccctccccatcaaagaagtaaactttctacctactccccctaatccgatcgtttagagctgctgttttccttttgtcagattcctcctccccgatcagtctgagtacacgatcagaactgctcagagagcaggaagcacattgatttcagcttgttctgtccacagacaggccctgacaaggttgttagaacagccggagaggtctatacaatcacttaattaccaaaactgtcagtcaggcgggacgcggatccgcgtcccgggctgcgctaggcattccagcactgggccgcgcgcgtgattgatcggtgctgatagcaccgcaaaataattacggcgaattttctgatgtgtgattttatcccaagttcatgcttcagagaggtaatcggagaatgagaagggtcagtgccatttcggattacctggaatctgcgagaaagggtaaaatgggggaaggagctccgaggaaaacgggagagatgggggtgcagagagagagggaagaagaaagcgagttatggattgctggagggactgcaagcaattcgtcaaactgtgcaagtgatttccttcagagccagcatatggcagattgattttgtccaacgtcggttttagccacatttaaaatgatccagcggttattactgcgattggcttaggaactgacaggcagttttaggcgcaaggagtatagatcctgtttaccggagatgtgttcgtaactgctgtcaaatacagttaagtaaatatcattagcgaagagctctgttaagagaaatgccaatccaataaatatgcttttcctccccgccctccgcatggctgcctgcgcttcctccagaggttctccttcctgctcctttgctgcttgggtcagacgtcccaggcatggtgctgactcccgccaccttggagccccgagctgagcctcgggcagaagatgacaggccagccgtggggcaaggaggccgcggaaacgcggaacggcttcggggagacggaagcgcccaatgagattcaccctgcagcccgggtccagcccaccttcctcggagattgccgcggccctcgaacccgggcctaggtcttcatgtcccggcggccagaggacgttgcggggaccactggggagctgccctcagtcagctctctgccccacgccggaggtcctggcgcggcttctttcccgaactagactggcgactctgggccaggccccaaggaccgccccggcctctccggctttgcggggagaatctgaggaaccgagtccaagatagccgacctaggctgttttcacccagaccctgcgtccccgacccgctggagtgaatct

SEQ ID NO: 102848 - DNA, 952 bp, Homo sapiens; identical to SEQ ID NO: 70031
  chr1:91194539-91195491
  Hyper

SEQ ID NO: 102849 - DNA, 641 bp, Homo sapiens
  chr1:91195879-91196520
  Hyper
taaaatcattgttcacgtgtcaatttaaaagaccattaaagcagcttattttggttttaattggaacctcctcccttccaactacaggcttaaaagaaaaaaaaaaaaaactctcccccacacccaggcgcgcgcacgcacgcgggcacgcagcagcgatggggatgtaggtcaccccgcgggttagggccacgcgcccgcactcccgccgcagccgcaaccgcagccgcagccgcagccaacgcggccgcggagcgacgcagtccgcagcctcgaatttccagaaattccagcactggcagcagcacgtctagttcgaacgcttccaattaaacaacaccgtattcgcttaaagattttcgcaaaaagtgcactggggccaaaaatcaatcactctccctagcctgacccggtgaaaacagatgcataacatattcatgcgctgagcacgccgagcagcccagcgcggaacttttttttttttcttcttcttcttcttcttttaaataaagcgaggaggacttccgcggctcggcagtcctgctaaagctggcagatgcagcaaaactaatatgtgtaaatgctttaaagcaataatctgcttacagcgacacttccccgaacggcggcaggactgaggg

SEQ ID NO: 102850 - DNA, 1125 bp, Homo sapiens; identical to SEQ ID NO: 70034
  chr1:91316237-91317362
  Hyper

SEQ ID NO: 102851 - DNA, 515 bp, Homo sapiens; identical to SEQ ID NO: 70038
  chr1:91869861-91870376
  Hyper

SEQ ID NO: 102852 - DNA, 55 bp, Homo sapiens; identical to SEQ ID NO: 70039
  chr1:92048970-92049025
  Hypo

SEQ ID NO: 102853 - DNA, 48 bp, Homo sapiens; identical to SEQ ID NO: 70041
  chr1:92494924-92494972
  Hypo

SEQ ID NO: 102854 - DNA, 128 bp, Homo sapiens; identical to SEQ ID NO: 26473
  chr1:92495704-92495832
  Hyper

SEQ ID NO: 102855 - DNA, 1142 bp, Homo sapiens; identical to SEQ ID NO: 70043
  chr1:92948324-92949466
  Hyper

SEQ ID NO: 102856 - DNA, 516 bp, Homo sapiens; identical to SEQ ID NO: 70044
  chr1:92949691-92950207
  Hyper

SEQ ID NO: 102857 - DNA, 2116 bp, Homo sapiens; identical to SEQ ID NO: 70045
  chr1:92950434-92952550
  Hyper

SEQ ID NO: 102858 - DNA, 156 bp, Homo sapiens; identical to SEQ ID NO: 39010
  chr1:93222691-93222847
  Hypo

SEQ ID NO: 102859 - DNA, 18 bp, Homo sapiens
  chr1:93543647-93543665
  Hypo
gcccggctgcatctgctt

SEQ ID NO: 102860 - DNA, 30 bp, Homo sapiens; identical to SEQ ID NO: 70052
  chr1:94045521-94045551
  Hypo

SEQ ID NO: 102861 - DNA, 30 bp, Homo sapiens; identical to SEQ ID NO: 39011
  chr1:94048058-94048088
  Hypo

SEQ ID NO: 102862 - DNA, 82 bp, Homo sapiens; identical to SEQ ID NO: 70054
  chr1:94048417-94048499
  Hypo

SEQ ID NO: 102863 - DNA, 37 bp, Homo sapiens; identical to SEQ ID NO: 70056
  chr1:94343568-94343605
  Hypo

SEQ ID NO: 102864 - DNA, 41 bp, Homo sapiens; identical to SEQ ID NO: 70057
  chr1:94345747-94345788
  Hypo

SEQ ID NO: 102865 - DNA, 30 bp, Homo sapiens; identical to SEQ ID NO: 70058
  chr1:94490609-94490639
  Hypo

SEQ ID NO: 102866 - DNA, 30 bp, Homo sapiens; identical to SEQ ID NO: 70059
  chr1:94701656-94701686
  Hyper

SEQ ID NO: 102867 - DNA, 55 bp, Homo sapiens; identical to SEQ ID NO: 70060
  chr1:94702935-94702990
  Hyper

SEQ ID NO: 102868 - DNA, 33 bp, Homo sapiens; identical to SEQ ID NO: 70061
  chr1:94703324-94703357
  Hyper

SEQ ID NO: 102869 - DNA, 229 bp, Homo sapiens; identical to SEQ ID NO: 70062
  chr1:95007667-95007896
  Hyper

SEQ ID NO: 102870 - DNA, 154 bp, Homo sapiens; identical to SEQ ID NO: 70063
  chr1:95071346-95071500
  Hypo

SEQ ID NO: 102871 - DNA, 884 bp, Homo sapiens; identical to SEQ ID NO: 70064
  chr1:95391740-95392624
  Hyper

SEQ ID NO: 102872 - DNA, 72 bp, Homo sapiens; identical to SEQ ID NO: 70065
  chr1:95392995-95393067
  Hyper

SEQ ID NO: 102873 - DNA, 151 bp, Homo sapiens; identical to SEQ ID NO: 70066
  chr1:95428423-95428574
  Hyper

SEQ ID NO: 102874 - DNA, 34 bp, Homo sapiens; identical to SEQ ID NO: 70073
  chr1:97185220-97185254
  Hypo

SEQ ID NO: 102875 - DNA, 193 bp, Homo sapiens; identical to SEQ ID NO: 70078
  chr1:98338299-98338492
  Hypo

SEQ ID NO: 102876 - DNA, 1190 bp, Homo sapiens
  chr1:98510732-98511922
  Hyper
tctctcttgctcccacgccttcgcagctgacctgagaggggggacgtgccttgcgtttgttggtgtttgagactcgtcctaaaggcagaggcagggaagacagcgctgaagaggcgtcccaaagagattggacgtctgaacagtcactgcctgccccaacctctttcaggaaggttccaggtctgtgccacactgcaaccaatccggttcccatcctgtttctccaccccttctcggagaatccgaaaagaaaatatgcgttcctgagagacccgccacacttccgatctggaagttccgcggggacccagcccccgggcccccgccccctccccatctcggccgccaagtctggttgcggagcagcgcggccggccgggggtggggctccggcaccgccccgggctcgggattcgcgaagtcacgcgcttccgcaggcttgcgggggcaccttcgcccacggacacgccctttctgcggaggcagcccccagcgaccctctgcccagcttcggcgcctcactcgcgacgctcccaaactgctcaaggcctttcagtcgttcccaactttagaaaatcgccccgtccgcgtctctccctccagccgcaccccaccgtggagaggagaggagcggactgggaacgccgaaccgccccgcaggctcggggaaacggacccccttccgctccccgcccatccccttcacctcgccccccgccccctgcgcgaacccattttccagtcctggtcaccagaggcgcagcgcacagcctttccggtggaaccagtgcgaaaacacccgaggaaatgaaaagaacaagaaagtgctaccttggcaaccacgggcgtttagtggccagctggtgggctggggagggcggccgctgcccccctgccgctggtactctcctcgactacgcgtattcttaagcaataacaacgtaatccgtattatccacccaagaatacccgtcaccgaagagagtcagaggaccaagctgccgctgccgctgctaccgctgccgctgctaccgctgccgctgctactgccgccgccgccgccaccagaactcttgctgctcgctgagcccgcccctgcctggggatgggctgagcttgaccgggaccataaatccataactcgatttccctaaagaaggatccaaagctgtgctcggctgcttcctgcc

SEQ ID NO: 102877 - DNA, 315 bp, Homo sapiens; identical to SEQ ID NO: 26483
  chr1:98513940-98514255
  Hyper

SEQ ID NO: 102878 - DNA, 247 bp, Homo sapiens; identical to SEQ ID NO: 70084
  chr1:98514484-98514731
  Hyper

SEQ ID NO: 102879 - DNA, 309 bp, Homo sapiens
  chr1:98515068-98515377
  Hyper
cttgggaagggacctcggcgcctcgcgctggctgtgccccagtgccttcgcgtggtggcggcttgctcatgcttccgaggagtcccaggcgatagccttcagctgatgcgagcttccagaaaggagtggggaagggaaaaaatcatctaatgcaatcaaatcgatctgatctacaccatctgtcgcctgccactatacacaaacgttaaaataggaaaacggaaaacactgacagccgagagggttggtctgcaaagagttcatttttagcagagcataattcgatatggtcggcgtacagttacaaaa

SEQ ID NO: 102880 - DNA, 1051 bp, Homo sapiens
  chr1:98518986-98520037
  Hyper
ataccagagtgatctcggcgctcgcgcagttttgagagagggtcccgaaaaccgccggaggccaggtgtcgcggacgggccccgggctaaactctcgtctggcgaagtgaagagcgcaaagtctccaggcccagcgcgccttcgcggggcaggccggacaccctagccccgggccgggctcgctcttctctgaagccctggagcgggcaaggggcaccattctggccacaggaactctagtttcagcagccgcagcccgccagcgctggctcggaccggggcctcctctgggagagtaggagagcgaaaaaatcaaccaccaccttggatttcagatcgaggaaaggaagccaaagcaaaggtgtggttacacaggacatccatagacaaatcgttgcctctctaagtgggcctgagctttgcggctccagaagcgcgaggcgcggttggtgcggacgcgggggcgtgggagtcatcgctctccccgcagccctggccgagctctctgctgtcctcccgagtttgggccagagaccacggctcactccctaacgccctcgcaaggacggctgcccgtcgggccaagggcgccccgggctggaggccggagcaagacggccccgcgggactcgggagccttggtaaggcggaggctcagaccccgttcacgaaaacgcctggctcctccaggatttgtcaggtcttaagcagctccgagaaggctccgctggctcttggggaaccccgctgtgcggctcacccccgtttgtctctctcaagctctcgccctcctcccctggtcctcccttctccagatcccctgccctgcccgaggtccgggccgcgcgggctgagcccaatacgcccggagaagagcgccggagccccctgctggccggacgcggcaggcgcggcggcccgctcggtcccctccgccccgcgggctctgcccagcccggacccgcctccaccctccagtgccctggcgctgggggcgtgctaaaagcaacagaaaacaaaacaaaaacaaacaaagcgccaaaccccactc

SEQ ID NO: 102881 - DNA, 40 bp, Homo sapiens; identical to SEQ ID NO: 70095
  chr1:99127631-99127671
  Hyper

SEQ ID NO: 102882 - DNA, 1286 bp, Homo sapiens
  chr1:99469561-99470847
  Hyper
gatcccctctctcctcgccggcccgcccgccgctgctcttcttccaggcacaatcgaagaggaggcagtgagcgagtcaaggccacagagtggatggaatcaaggttcacccccaaagctcacctcctttgcaacccggatccccactcctcaccacctacggcccctcttcccttccatccccgcccagtcacccaacgctgaagccaccgcggggtgtgggggggtgacgtgtgggaagagctgggggcttccttcgcacccaccctcacgcgccctagaatgtcctctggggaaggggctgcccataacttggaggaacttagaaggcaaaacctactgcgccccaacccttagaggggcctcaaccccgaaggcgaggggcgagatcagggactcggcgacgagggcgagcgcccccgggcttaccacgagcacggggaccccggcggccagcgagtagaggagcacggggggcacggcgctgctgtcctccgggcccgggtagggtttgcggtaggcgctgtcgtggcagaagaagccctgcacgttcacggtgaacgtgtccgtatactcgaagtagtacgccagcatcaccgtccctgccatgatcaccatctggaaatagagcatgctgctggtgagcgccgcgggcagcaggggcatgcacgcctcccgggccgggccgagccgagccgagcgggcggtcgacgcggtgggccccctccccggtccgccgaggcagccaccgggggcgcggcggcggaggcggcgggaggacgaggcacgggaggcgggatggagccgctggaggaagaggcggaggcaggtccgggcttcgaggcgccggcaggctgcagaggaggcggctacccccggacgagccccctctcccctgcccgccccctgcccgccgcaagcgccgcccgccccggcgcggggtcgcgagggagggcggggagtcccgggcgacgggcagcggccgctgcgcccctgcacgagaccattcgagaagcagcggcgctgggtcaatcccccaggctagcccggaggaggcgctgcgtgggcggacggggcggcagccggcgggacagcggcacctgtacccctcacagggcggacgctgtggggctggagaagctcctggcgggggtaaaatcaaaagggggggaggggaggcagtagagatggagcttccagaaactcttccgaggcaccagctgagaggtttaagaaacccgcacaacgcctgggaaaatggtgcgtggacgcgtcttccgagcgca

SEQ ID NO: 102883 - DNA, 89 bp, Homo sapiens; identical to SEQ ID NO: 70101
  chr1:99611990-99612079
  Hypo

SEQ ID NO: 102884 - DNA, 88 bp, Homo sapiens; identical to SEQ ID NO: 70102
  chr1:99612139-99612227
  Hypo

SEQ ID NO: 102885 - DNA, 197 bp, Homo sapiens; identical to SEQ ID NO: 39017
  chr1:100436557-100436754
  Hypo

SEQ ID NO: 102886 - DNA, 86 bp, Homo sapiens; identical to SEQ ID NO: 4943
  chr1:100437183-100437269
  Hypo

SEQ ID NO: 102887 - DNA, 34 bp, Homo sapiens; identical to SEQ ID NO: 39019
  chr1:100814764-100814798
  Hypo

SEQ ID NO: 102888 - DNA, 30 bp, Homo sapiens; identical to SEQ ID NO: 39020
  chr1:100928393-100928423
  Hypo

SEQ ID NO: 102889 - DNA, 1359 bp, Homo sapiens
  chr1:101004456-101005815
  Hyper
agtgtcaggatggaccgcgctgccagaagccgacgctagcgagggaggtgtgaagagttggccagaatgaccaactcctcctccacatccacctcctccaccaccggtggctcgctgctgctgctctgcgaggaagaggagtcgtgggcgggccggcgcatcccggtgtcactcctgtattcgggcctggccatcgggggcacgctggccaacggcatggtcatctatctcgtgtcgtccttccgaaagctgcagaccaccagcaacgccttcatcgtgaacggctgcgccgccgacctcagcgtctgcgccctctggatgccgcaggaggcggtgctcgggctcctgcccaccggctctgcggagccccccgcagactgggacggcgctgggggcagctaccgcctgctacggggtgggctgctgggcctcggactcacggtgtccctcctctcccactgcctcgtggccctgaaccgctacctgctcatcacccgggcgcccgccacctaccaggcgctgtaccagaggcgccacacggcgggcatgctggcgctgtcctgggcgctcgccctgggcctcgtgctgctgctcccgccctgggcaccgcggcccggcgccgcgccaccgcgagtccactacccggcgctgctggccgccgcggcgctgctggcgcagacagctctgctgctgcactgctacctgggcatcgtgcgccgcgtgcgtgtcagcgtcaagcgggtcagcgtgctcaacttccacctgctgcaccagttgcccggctgcgccgccgccgccgccgccttcccgggcgcccagcacgcgccgggccccggtggcgccgcgcacccggcgcaggcccagcccctgccgcccgcgctgcacccgcggcgggcacagcggcgtctcagcggcctgtcggtgctgctgctctgctgcgtcttcctgctggccacgcagccactggtgtgggtgagcctggccagcggcttctcgctgccggtgccctggggagtgcaggcggccagctggctcctgtgctgcgccctgtccgcgctcaatccgctgctctacacgtggaggaacgaggagttccgccgctccgtgcgctcagtcctgccgggcgtcggcgacgcggcggccgctgccgttgccgccacagccgtgcccgcagtgtcccaggcgcaactgggcacccgcgccgcgggccagcactggtaacctagccggggcccgagggaagcggagatccccggcttccgacgtccttgggcaccgtcgcctccttccctcctagggcatcccctgcctgaacgaagacttccgccgcgaagcccgatagatcgggggaaaatgggg

SEQ ID NO: 102890 - DNA, 363 bp, Homo sapiens; identical to SEQ ID NO: 67394
  chr1:101701718-101702081
  Hyper

SEQ ID NO: 102891 - DNA, 427 bp, Homo sapiens
  chr1:101702369-101702796
  Hyper
ccagctgacagagggcgtggggggttaaggcattaacccctcccagcctcttcctgaagaaaccacccagccttggcgcggcgctgggtgacttcgcgtagcaggcagggaactggccgcggcgagcgggactggccattggagtgctccgctgcggagggaggggaccccgactcgagtaagtttgcgagagcactacgcagtcagtcgggggcagcagcaagatgcgaagcgagccgtacagatcccgggctctccgaacgcaacttcgccctgcttgagcgaggtagggggcggcgaatggcgggggtcgcgggcgcggggagcccggttgtggtagggcttaggtgtcagaaacgaatttttaagtcgaacgaggcaaacaaaaacttagaaaacatgcatctccgggcgctgaaaatttgca

SEQ ID NO: 102892 - DNA, 79 bp, Homo sapiens; identical to SEQ ID NO: 67397
  chr1:101703188-101703267
  Hyper

SEQ ID NO: 102893 - DNA, 76 bp, Homo sapiens; identical to SEQ ID NO: 26499
  chr1:101703566-101703642
  Hyper

SEQ ID NO: 102894 - DNA, 83 bp, Homo sapiens; identical to SEQ ID NO: 67399
  chr1:101721485-101721568
  Hypo

SEQ ID NO: 102895 - DNA, 394 bp, Homo sapiens; identical to SEQ ID NO: 26500
  chr1:101775094-101775488
  Hyper

SEQ ID NO: 102896 - DNA, 30 bp, Homo sapiens; identical to SEQ ID NO: 67401
  chr1:101918826-101918856
  Hypo

SEQ ID NO: 102897 - DNA, 122 bp, Homo sapiens; identical to SEQ ID NO: 67405
  chr1:103572643-103572765
  Hyper

SEQ ID NO: 102898 - DNA, 746 bp, Homo sapiens
  chr1:103573422-103574168
  Hyper
ctccctttattgtcccgcctacattcatctctttctccagtttccaattccaacctggtagcagctacaatctggattgtatttaagggaattgcttttttttttttttcttgaagagcggggaggaagggtaaagtggggggaggggcgcagaagcagtaggaccgacggcaatctcccacctccccaaatccattttttcttacctcctctgacctctctagcttggaagaggaaggtcaatgcgagggttgttacggtgaaatcccagagccaccgtttcgttttccacctagaggaccacggctccatctccgagccccgcactcacaactgtgaactcaacccacgaaattgcgactgcagaccaacttcgtcctttccaaggtatcgccagggatgtttgctacacagccattggggagggagagggggaaaaagtcaaagggctttttcttctaaatttgatggtttgcgttcttcgtgtctctagccctttcctctccctctgagttggccccaccggccgggaccctccggccgcgaccctctgatccttcctctgccgggccctgccttcagaatgaaggcagatgaggggcttccaccaacaagctgagagtactgtgtgcccctaaaggcttcatgccgtcagtgggctggacgagtggctccgggcagccccctcctccgcccactcccctccctgctcccagctccccctcccagggcgaaactgacaagca

SEQ ID NO: 102899 - DNA, 23 bp, Homo sapiens
  chr1:107161642-107161665
  Hypo
tgagaccccgtctaaatatatat

SEQ ID NO: 102900 - DNA, 18 bp, Homo sapiens
  chr1:107598664-107598682
  Hypo
gtgagttaggccgggcgc

SEQ ID NO: 102901 - DNA, 109 bp, Homo sapiens; identical to SEQ ID NO: 67421
  chr1:107600250-107600359
  Hyper

SEQ ID NO: 102902 - DNA, 1874 bp, Homo sapiens
  chr1:107682621-107684495
  Hyper
gaagtgggaggtacacgaggagttactggaaacggcgcttctgtggaggagccgggggggatggggagtagagggagggggccctgttgcctcagcgccccgaggtcgtggagcggcagcagctgcagccggagcagcaccagcaacagcaacagcgagcgggacggagttaggaccgctcggagcgcacaggtctcgaggtagtataaggtttgctatccttccacttgctggcagttgcagaagaagatctgctttttaagtgaaacgtacatgccacccctccgagggctgcggcttccccgggcttgcttctttgccgctcctctttccggctctcgcgctcactctttaattggcactggcccctaagtttgccaggagctcgctgcccgctcggagcagggtcccggccgggagccgctggtgggggcggggagtccgggagccgcaatccagaagcgtcgtgggccatgtatatttcatcaaacggactttgggtgcgtcgcgtctcactgccatcagtgctatgtgcagtgacatttctgacttgagtggaggaatgcgcgaaggaaacccgggcgaaattggtattagaggatcttcttggcgccaatgctaattgtcctgatttatgccccttctgactaagctcaacgtcttcatctgaaataaaatgaaagcggtgccaagcggcatagaaccgcctggccgctggttctgatccccgggaaccagaaaatcgtcctgcggcttgaaaaaaaaaaaaagaggaaaaaaaaaagaaatagaaatagaaaaaagaaaaaatatccctcagtaaaagtttaaggcgagaagtgtcagaggcagcggagcgaggaggcgcggaggagagccggcgagcaggggactgggctggcacgacctccgaaggctgagatctcattattaatatcactatatttttggagggagaggcacctttctcatcctctcttcctctccgcccacccttactccctccccctcatctacctgtcaaagtcactgatcttttgcatttcggaagaggacgtcaacgggaaggaattccccctctgggtgcgggctccgagagggggcgacttgcaggaggctccccccgggggcggaggcgaaggtaattaagcggcggggagtggcgggccggcgctgggttctcggtcctcggggtcctctcccgccggcggccgggcgcgatcggaatccccgggctgcggcggtggcggcggctcgggtcctcacgcccacccctcccgctccgcccgctcccgcctggggaggaggctccgcgggagctgccgccctccgcccgtacgccgcccgcgggctccgctgctgcggccgccgcccgaggcggaccaggctggctgcgcagggccgccgccccgcgccgtcggctcggctcccgcccggcgcaagggcaaacgagccacacggtaagtgcctgcggctcgcctctcctactgcgacccgagcctctcgcccgtgcccctctcccccgggtttccccaccccccgccgccccccgccccacccgctgcgatgcacaggcgggagggaaggctccgggtgggcgaggaactttgtaaagcgccccgaggaggcagcgcgcggagccctacgcgcacacacagcggcacacgctcacacccacacacaagtcttcccgggggtgcgccccgggccggtgatgcgtcctcttgttgtgtccggagcccaggcgtggggtctgagcctccatccgccgactgacaggggccccgcgctctccctctctcacgcacacctggccacacacatcgctcaggcggcttgtcgttattttttctttctttcgccaattatatttg

SEQ ID NO: 102903 - DNA, 190 bp, Homo sapiens; identical to SEQ ID NO: 67429
  chr1:108432636-108432826
  Hypo

SEQ ID NO: 102904 - DNA, 1992 bp, Homo sapiens
  chr1:108506595-108508587
  Hyper
ctgcaggaaggaaagcggaatctctagtgaaacttctcatttcctgtcgctgctgagagaggctggactcgctccttctcacatggcttaggaagagctgtaaacgggagcttgccggctggccaccagctcaggggccctgggggcggcctccgggttctgctccctgttcttccctttgaccaatgtcactcctggacagataacgggaccaaacgcccttcacttcctcgagtcctcatgtatgtcatggttcctcttttaggaaaacatgagtacaagacgcaaagcaaaagaagagactaaaggcaaattaccccatcacctcgtttcgtccctccccttcgttattatagaagagcttgatcaaattccctttgtcgcgccacacacacgcagagtaggtgaagggcaccctaagacaacttatttctttcccgcctcacagaaagcctttacgaaatcctcacaccatctccggacgcaaagctttcgcattcagcttgaggagctaaaccatttcaagccaaggtaggaaacgccaaagtggtgccgaagtggtcccaaagcagaaggctgggaagcagggcaagctcagcgcacctagacgtttgcatttacacaaagaaattagccgcatgattaatgggagctgccggctggaggcggggcgcccgtgccggcctcctcacctgggacatctgcggcctcaggttgatctccttcaggttgatggagtgcgcccggaggttgttaagcagctggcagagcaggactccatcgcggagggtctgcgcaaggtcgaacacctgagccgagtcccaggtcacccggtggttggtgggcagcaccttgcaatggatgagccactgcgcgcactgcttccacggctccatgcccgacggctccgggacgcggctgggccggggcgggcggcaaggatgcggccgccgccgccgccgccgcggttcctccgcgccccgccgacgccaacagccgccggccctttccccgcgcgggatcgagggagcaggagccgcggctgacgggtcgcgggcgccgcgctaggctcggctccggtcccggcccgggtgcgccgcgacccggccgccgctgcagcgagtcccgcgcgctctccgtgcgccccggccggctcggcggcggctgccgcgcacaggcttccgactccagcgcccggcccgccactgagcatgcccagcacgccggccggtctcgctgcggtccgcaagtccccagacgcgcgggtgggagcgcgccggcggccggggctggggtctgtggccgagggcggggcgcgggggaggggccggcggaggggggcggcggccagaaaggggatcccgcgcccccgcctgcagccttgcggggctcacgcagcccccggcgtcctggggtcttctctcggggcggcttcccggctttgcggggagtgtggctgaatactgtaatacgatggggtcccccaggaccccctaaacaacaaatgctcaaaggagcgacggattaattggggcacccagactccccagagcaatgaaaaaagtgcctagagcatcagtagagcacggcgctgaaagttttagagatcgtcgccccctcgccccttgcagctctatcccctccattctctatagctgattcctcagcctattcctcctagttgcccctagtggtgttttggcaccctcaaagtgagtgagagtgcgtgtgtggagacgcctgcggaaaccgccccgatccctgagcctatttcctcgcgaggtgattttcacttggagctggtttgcccctgcactgtcaggctcggaactgtttgccgttgctgttctggcccttttgctgaccccacaaaaacctgcttgagaaaggcctgtgccacggtgctagactgcgcatgcgtcggcgactggcggccgggtttgagagcaaagcgcgttagccctgggcagctcctgccgggctgttctggga

SEQ ID NO: 102905 - DNA, 30 bp, Homo sapiens; identical to SEQ ID NO: 39021
  chr1:109076927-109076957
  Hypo

SEQ ID NO: 102906 - DNA, 643 bp, Homo sapiens; identical to SEQ ID NO: 67439
  chr1:109203578-109204221
  Hyper

SEQ ID NO: 102907 - DNA, 30 bp, Homo sapiens; identical to SEQ ID NO: 39022
  chr1:109370476-109370506
  Hypo

SEQ ID NO: 102908 - DNA, 98 bp, Homo sapiens; identical to SEQ ID NO: 67445
  chr1:109585374-109585472
  Hypo

SEQ ID NO: 102909 - DNA, 37 bp, Homo sapiens; identical to SEQ ID NO: 67446
  chr1:109585772-109585809
  Hypo

SEQ ID NO: 102910 - DNA, 28 bp, Homo sapiens
  chr1:109593505-109593533
  Hypo
tcaagggccaggcaccgcggctcacgcc

SEQ ID NO: 102911 - DNA, 36 bp, Homo sapiens; identical to SEQ ID NO: 39026
  chr1:109631646-109631682
  Hypo

SEQ ID NO: 102912 - DNA, 30 bp, Homo sapiens; identical to SEQ ID NO: 67450
  chr1:109642384-109642414
  Hypo

SEQ ID NO: 102913 - DNA, 103 bp, Homo sapiens; identical to SEQ ID NO: 39027
  chr1:109644233-109644336
  Hypo

SEQ ID NO: 102914 - DNA, 35 bp, Homo sapiens; identical to SEQ ID NO: 67452
  chr1:109646883-109646918
  Hypo

SEQ ID NO: 102915 - DNA, 71 bp, Homo sapiens; identical to SEQ ID NO: 26513
  chr1:109656220-109656291
  Hyper

SEQ ID NO: 102916 - DNA, 576 bp, Homo sapiens; identical to SEQ ID NO: 67454
  chr1:109656494-109657070
  Hyper

SEQ ID NO: 102917 - DNA, 30 bp, Homo sapiens; identical to SEQ ID NO: 67455
  chr1:109679322-109679352
  Hypo

SEQ ID NO: 102918 - DNA, 30 bp, Homo sapiens; identical to SEQ ID NO: 39028
  chr1:109701309-109701339
  Hypo

SEQ ID NO: 102919 - DNA, 110 bp, Homo sapiens; identical to SEQ ID NO: 67457
  chr1:109772113-109772223
  Hypo

SEQ ID NO: 102920 - DNA, 30 bp, Homo sapiens; identical to SEQ ID NO: 67458
  chr1:109797867-109797897
  Hypo

SEQ ID NO: 102921 - DNA, 61 bp, Homo sapiens; identical to SEQ ID NO: 67459
  chr1:109941488-109941549
  Hypo

SEQ ID NO: 102922 - DNA, 78 bp, Homo sapiens; identical to SEQ ID NO: 67460
  chr1:110009016-110009094
  Hyper

SEQ ID NO: 102923 - DNA, 235 bp, Homo sapiens; identical to SEQ ID NO: 26515
  chr1:110009583-110009818
  Hyper

SEQ ID NO: 102924 - DNA, 30 bp, Homo sapiens; identical to SEQ ID NO: 67462
  chr1:110010091-110010121
  Hyper

SEQ ID NO: 102925 - DNA, 80 bp, Homo sapiens; identical to SEQ ID NO: 67463
  chr1:110086023-110086103
  Hypo

SEQ ID NO: 102926 - DNA, 30 bp, Homo sapiens; identical to SEQ ID NO: 67464
  chr1:110186147-110186177
  Hyper

SEQ ID NO: 102927 - DNA, 21 bp, Homo sapiens
  chr1:110196410-110196431
  Hypo
acagaagtgcccaggcgcgtt

SEQ ID NO: 102928 - DNA, 438 bp, Homo sapiens
  chr1:110230121-110230559
  Hyper
agaagagctttgctccgttaggatctggctggtgtctcaagcgcacagccaagtcgctgtggacctagcaagggctggatggactcgtggagcctcagggctgggtagggaagctggcgaggccgagccccgccttgggcttctgggcgccctgacttcgctcccggaaccctcgggcctgggaggcgggaggaagtcttactgagtgcagccccaggcgccctctcccgggcctccagaatggcgcctttcgggttgtggcgggccgaggggcggggtcgcagcaaggccccgcctgtcccctctccggagctcttatactctgagccctgctcggtttaggcctgtctgcggaatccgcaccaaccagcaccatgcccatgatactggggtactgggacatccgcggggtgagcgagggtccgctggacggtggga

SEQ ID NO: 102929 - DNA, 697 bp, Homo sapiens; identical to SEQ ID NO: 67466
  chr1:110282542-110283239
  Hyper

SEQ ID NO: 102930 - DNA, 55 bp, Homo sapiens; identical to SEQ ID NO: 67467
  chr1:110305550-110305605
  Hypo

SEQ ID NO: 102931 - DNA, 3130 bp, Homo sapiens
  chr1:110610349-110613479
  Hyper
gcgacctgcagaactcgctgaggcccaggctcctgcagctcccgccgaagactcaaagccagagtggacataaacgccgtgggcaggaccccggtgaggcctcggtgcccttcttgggggttctcagcgttggcccagaagcctcagcccgggtctaagaacttgggactctcctcgactttggcgatcggccgggtcatccggctcagggcctcagcggcagcgggcaaaactctagtaggagtctcttgccgagggcgtgtttcgacgtcagagccaaactcgggacagactagccaagcgcggacggcgcgagagtggctggcagcgccagcacgcagcctgggttcagagcaaggctgggcgctctcagcaaagggcggcctggggctgcgcgggcggcggactgcaggcgggagaagagcgaggtgcgccaggctctggggcgcgcaactgcccagcctcgtgaaagatcgcgccgcagatggggcgcagctgcgcgctcactcgtgtggactggaaacgctccgagccggttattttaaaaaccgggaaataaggcgggttccctcttcgcccgccacttcccaccaagtaggctgtgcggccctgggggctgactgtcctcaagcagccaggctccaccgcgcgccgcgctgcgccgaggtccgctctgccgcagggacgctggcagcccgttgaacaccggcaagagcgccagaggctagcggccgccaggatctctaccaggctctgctcgcacccgcctgcctccctttcgtttggcctgtcctccgttcaactgaaatcgttaattttcttacccccttgttctcattttgatatattctacgctttaaacatgctccgttttcttttgtttagtctgctccctccctctttgtcctttcccccttctctagttatccgtttcgttcgatcttgctcctgctttttttattcgttcgttcctcatttattcattttagttcatcccagctcgccgactgccatttaccctctcgttctcgccgcgctctccgttgttttgttcaatttcccttccccttttcttggttgtcgctcgctttctttggttttctttctcggtatttcgttgtcaaggccacccttgccgtcggatcccggggtgctgggtttctcccggccgctcgttccgcaccagcgctctctgcagttcgcgcggcaccggtgtggtccgggggcccgagctgtcggtgccggatgcggcgcgcctagcagggacgcgggcctgggggggtggctcctgcccgacgcggagcgctgagccaggccgggtacctgtctctggcggtgctcaccgcactgcgcggcctctgccgtctggctgggatcagaggagccaggccaactgcttctcattaagtcccaactgtggtttttatcaggaaagcctctttcaaagggcacagacacgaagctccgcggactcgttcatttcctccgttgacccacacacacctccccgccctcccctacacattcccaccgccccggctgggcgaaagccggagatgcccggccactccgtggaggcccgcgaggcgccagccgggcggcggcagggggttgaggcggatcttggaggatccagttctgggcctaggctgcgggatatggcagcgcagataaggtgggtgcagtgcggaagccgagacgccttacaggtcatagggtgcggcggacggccgcagagctgccgatcagcctgccaggcccctgccttcaggcgcattctcggatgccggcgcggtccagccggccttagcacagggcaccggcccgtgagcccgcggcgccagggggttaggctgcccagggctgctcctgactgcccagcggtgatgatccagcgcggggaagccaagactgccagaagggcggctatcatagtgcataacggcagggaggccagcttagtatgagaaataagaatacagttattccgtcttgaggacagccctggcattgcacgaccagtcgcggccagactgtgccagtctgccgcacaggcagcacccttcctgtgaaggctaggcccggggaggagagacgggccaagaccaggccgcagtccccagccgaccccgatttgaccactctaggttgaggcccagcctcagggccctcaaagggcgccagacacaaaagccgcgcttcttcgtcaggtctcagtgtggctccacagccctcggccgggtctgggcttcagggtaggtggcagttccagtccaacttcggcagagcatgctctctccttcccaggtccaactgctttcgggccccgactggactccgggccgtcgccactgcaccttccctcgacctcccgccttccattcccgccgccgaggaacggtggttcaccctcccgccccacactggcctttgcctggcccgggccagcgccaacccggcttccgtggaagccgtggcgaaaggcgagaggggcaaaaagttgagaaataggcgagcgggagagataagcaggaaggcccgggtgggcccgggtaaggaagaagaagagagggtcgggctgcgcgctacgccccgcgccgcgcgttaccttccgcggggccctcgtagaagtggccgccgttgagggccgggccgggcccgaggtcctgcaggtacttggcgggcggcttggccggctctgggaggtagggctccaggggcccgcaggccggaaagcgggtcagccgcgggccgcggggcggcgcggggtgcaggtgaggcgcagcggcgggggttccctgcgggcccggaggctcgtcccccgaggccacataggggccgggtgcaggccccacgcggaaaggcgcgcagtgctcggggtccatgccggctcagggcgcacaggcctccggggctccggggctcgcgctgcccgcgccgcctgtgagcgcccgccaagggggagggacctgggcgcgggggcgcggagcccccgggagcggcgcgcgccgcggggggcggggggcggggggcaggggagggggccgcgcctctgacttaatgctggaaccatccacgtcacgtgtggccccgtgcgggttaacccctcggagcccgggaaccccctccc

SEQ ID NO: 102932 - DNA, 1286 bp, Homo sapiens
  chr1:110626380-110627666
  Hyper
cccctccgccaaaaccgtatgatattttagggaagcccctctttattcattagaaatcggctgctttgagtttggcccctaaaaacttgcctcctgccccggaagatttattttattaaatggtccacacctgaaagtaattgagtctcggcgtgggtgcggggactgcggagggagggtccaggcgcggcagcggcagtggcggcggctctcagctcctctccagcttcgcaccctgtgcctccgggcgccctagtctccccgccacgccgcgacctttcctcggcctcccgctcccgctttgcggaaaggtccggggcgcgtgtaggggaaggagagagaggtatgtggggcgagcgggagttgagcgtggatgtggggaagggggtgcgtcctgcgtcgcccccgcaccctcgcgtggccgggcgcagatccccgtgcacgggtcctccgcacacccttgccagcccgcagggattgttcgccgcgttggtgactccttcccaaaatgggaataaaagatcgaaatagctagtaagcatgcaaagtttattgtcaacctcaagtctctataaaaccagatcaaagggaacaggcgtttggtttcttcccagatcgctggggggcctcggggctcaggaagccccaggagtccagcccgctgccgctcactgcgctcttctctccagccgggtccaagggctcgagcatcgcaacctgcggcctgagttggccccgggcgcacgcgagggaaatggatgcagtgcccgtgaacttggggcctgaataattgataacaacccgctgggtgcccgtcgcgcggccaggcctgcggggagcggagccggaggcagcaagcaaaggaaacgcacgagccgggagcgcgggcgcgcggggccacgaaagaccgaccgactgtccgacgggcggtgggacaagaggacggatgctgtgggggggccccggaacccgccgccacaactcgcggcccacgcgggtcgcagccgccagccgtagggagctgccgagcagcgacgttccgcattccatcgggttcccgcgccctactgggcttgtgcggcgcagtgcctgcgtgtgctttcgttttctcaaggccattctgataaaacatacgtgctggttccctttcttttctcagaatgattcttcaaggcgaatgactcgaaatggagatttcttctaacaccgcgtgatcaccgacaacttttgcaggacgggatgaaactcctctgggtttccagtcagatgtgcgagtgggctctctt

SEQ ID NO: 102933 - DNA, 519 bp, Homo sapiens
  chr1:110672833-110673352
  Hyper
ctgtattttcagcctcggtttgacgtcaggctctcacggtcccaaaggatgggctttgtacatttccaggccgcagaccggagcctcccatccctttgggcctcttgggcggtccctacggccacctcccgcagctccctgggggcgggggaccgctggatgagggaggaggggaggtactggggggaaagggcggttggcgggaaggaagtccaggtgagacaggcccgcgttgggactatcgtgcgcggtatgtcggccggcaggtggggctggtccgggcgcaggaggcggtagagcaggagcagcagggggagccaggctggccgagctggggggtgagcacgtttgtctcaggcagctcatcgcctgacacccccgggaacgggctctgccccaaggcctaaaatgagggaagatgaggaaatgggggtggggacgatggagaggatggaaggggcggcgggggggtgcggtggtctgcgcggtacagcagcgtccctgcgggttcccctcatt

SEQ ID NO: 102934 - DNA, 1412 bp, Homo sapiens
  chr1:110692884-110694296
  Hyper
ggccccattcctctccgagggcagaagccctggcgagggctccagggtctgcatcccctgaccaggggcctcaagaagctaagcccccttgcaactccctctcccgccccacgcccaccctctccgcctacgtcggccatcagagcctcgctcgctgcccgagagcctcgcattgacgccggcccgcgcgtgagtcaagcctgcgtcacggcgccccgccgccagggtggcctttcggaaagcgagggaacagtgcgcgcagcgctccgcccagctccgttctgctccgcagagccggcgctgccagggcgcagggagggcggcactcggccccagtcttcgcaatcccgcgcgctctctccgccgtgggacctgggtccccgcgccgctcccctgagccccgagcgcgcggcgggcgggagccaggttgggactggtggtgaggcagggagtgaggagcgagcggagtcgcgtgcgccggcgcgcagctccgggtcgccccagccccagccgggggcctgtggcccgggggaggagctgtgcgtccgcgacccgtcggggatcgcagctgctcggccggagtgcacgggccgagtctgcgcgactacccacgcgtgacaggtgagtcgctggccgcgccccgcctggctttaccgggccggccactgcaactttccctgttctggccccgccccagccagggagggctgaggaccaaggtgtgaggcggcgctgcccccgcatccgcccgaccctgcgctcgtcccgggctcctctcgccgctccagccgccgttgcctggcgacggagccccggggcccgctctccttcgcgcatcggggtccccagcggcgtacgcacgggttggacaccgggcttcagcttctggtgctcagaagggcccaagaactccggaggaaattgggcttagctgcggaggcaagcgcccgcggagaaccggagggggcctgtccggcccatccgcggcttgaaactgcgcgcccagggcgcagttccactgggagcctcttacgcagctggagaccccagccccagccgctcggcctcaggcctgtgaccttgacagtaacattggcaagcgaagcagaactgtcacgcccgagatgaatatttaattctcagtcctggggctggtcctcgctggattcggagctagcagagagcccttcctccctcgtgggaagcgcatctggggaacggaatggctgagacaggggacgtgcgtgtggtgcccatctggagggggcgccgtcctggcgggtcgagaggcctctgctgcatttatgcctgtgtgcgccgtgctctgaagcgatgctggatgctcgcagtactatgggtgggccgctccccaggggcgcggctgccttggaaagaagcgtgatgtttccttt

SEQ ID NO: 102935 - DNA, 159 bp, Homo sapiens; identical to SEQ ID NO: 67480
  chr1:110726609-110726768
  Hypo

SEQ ID NO: 102936 - DNA, 746 bp, Homo sapiens
  chr1:110754116-110754862
  Hyper
ttcttatgatcagctcggtgtgtgtctcctcctaccgcgggcgcaagtcggggaacaagcctccgtccaaaacatgtctgaaggaggagatggccaagggcgaggcgtcggagaagatcatcatcaacgtgggcggcacgcgacatgagacctaccgcagcaccctgcgcaccctaccgggaacccgcctcgcctggctggccgaccccgacggcgggggccggcccgagaccgatggcggcggtgtgggtagcagcggcagcagcggcggcgggggctgcgagttcttcttcgacaggcacccgggcgtcttcgcctacgtgctcaactactaccgcaccggcaagctgcactgccccgcggacgtgtgcgggccgctcttcgaagaggagctcaccttctggggcatcgacgagaccgacgtggaaccctgctgctggatgacctaccggcagcaccgcgacgccgaggaggcgctcgacatcttcgagagcccggacggaggcggcagcggcgcggggcccagcgacgaggccggcgacgatgagcgggagctggccctgcagcgactgggcccccacgagggaggcgcgggccatggcgccgggtctgggggctgccgcggctggcagccccgcatgtgggcgctcttcgaggatccctactcctcccgggccgctagggtgagtggcaggagcccgtgtctccccatcttgggtctgcaaggggtccgtggtgggtggtgg

SEQ ID NO: 102937 - DNA, 765 bp, Homo sapiens; identical to SEQ ID NO: 67483
  chr1:110883470-110884235
  Hypo

SEQ ID NO: 102938 - DNA, 42 bp, Homo sapiens; identical to SEQ ID NO: 67486
  chr1:110949152-110949194
  Hypo

SEQ ID NO: 102939 - DNA, 165 bp, Homo sapiens; identical to SEQ ID NO: 67488
  chr1:111039979-111040144
  Hypo

SEQ ID NO: 102940 - DNA, 674 bp, Homo sapiens; identical to SEQ ID NO: 67490
  chr1:111097796-111098470
  Hyper

SEQ ID NO: 102941 - DNA, 947 bp, Homo sapiens; identical to SEQ ID NO: 67491
  chr1:111149588-111150535
  Hyper

SEQ ID NO: 102942 - DNA, 38 bp, Homo sapiens; identical to SEQ ID NO: 67494
  chr1:111204435-111204473
  Hypo

SEQ ID NO: 102943 - DNA, 1373 bp, Homo sapiens
  chr1:111216695-111218068
  Hyper
tgaggatgaccagcacggacacgatggcgatgccccgggccggcccggagctctcggggtactcgaagagcagccacacctggcgctggaagtcgcggcggggcaagggccgctcctcctcccgcaggaagccctcgtcctcgcggaacttctccatggcctcctcgcccagctggtagaagcggatctcctcggagaaaatgtcgatgggcacgttgaccggccggcggatgcggcccccggactgatagtagtagaggatggcgtcgaagctgggccggttgcggtcgaagaagtactcgttgcggagcgggtcgaagtacctcatgcgccgcttggggtcgcccagcagcgtctcggggaactggcaaagggtcttcagctgcgtctcgaagcgcagcccggagatgttgatgaccacgcgctccccgcagcagtcctgctcgcccgcggccggcagtgagggcggcagcggctcgtagcggtcgcagccgccgccgccacagccgccttgaggcggggcccctccaccatcggccacctccggctccagcaggtggtccccgggcaccacggtcatgtcgggcggcagctcgcggcctgcggcgggctccgcgtagccgtggttcaccagcgtgtgggcaccgccgctgctcgctgggcgctgaggagggtgggcgcggtggcgggctgagggcggcggcggcgagcgcagaaggctgaggcgctcgtccatgcggcggggaagaggcggcagcggtgaggccaggtcgctcctcctcgcgctccccgccctttcgccgcctccgcccccgagccgagcccaccgcctgttgcagccaaagccgcgatgctctgtctgggtctggcgcggtcagccgggctcccgcacggggacgcctcctccctccttctcgcgctctccgccccctcccctgcggggcgcgcgcccgcctccgcgtccccttaggattcccgcccaccgcgcgggcgcgcgtcccgctctcgggggcagccgccgggcctgcatttcttgcagccctcaaggcccctcggtgtcagcgaaagagccctcatgttgtacctcggcgccccgcgggaatgcccacccagcagagccggcccacggggagtcaggctgccggcccgggcccctaggctccgcccgcttctggtcagcgcccctcgcccccggcccgcctggccgcgtcccagtcgccagggttttcggcccgtgggccgggagagctcccgccgcggccccgcgggcgccggccccctggcctccacacccctaggtacagcccggggagggcaggcgggcccagtgtccagggagggagtgcaggccaggcgggcgccctgggccagag

SEQ ID NO: 102944 - DNA, 715 bp, Homo sapiens; identical to SEQ ID NO: 67504
  chr1:111505931-111506646
  Hyper

SEQ ID NO: 102945 - DNA, 41 bp, Homo sapiens; identical to SEQ ID NO: 26539
  chr1:111813546-111813587
  Hyper

SEQ ID NO: 102946 - DNA, 199 bp, Homo sapiens; identical to SEQ ID NO: 39035
  chr1:112084890-112085089
  Hypo

SEQ ID NO: 102947 - DNA, 16 bp, Homo sapiens
  chr1:112192214-112192230
  Hypo
acgaccagaatattag

SEQ ID NO: 102948 - DNA, 496 bp, Homo sapiens; identical to SEQ ID NO: 67509
  chr1:112282866-112283362
  Hyper

SEQ ID NO: 102949 - DNA, 279 bp, Homo sapiens; identical to SEQ ID NO: 67510
  chr1:112531573-112531852
  Hyper

SEQ ID NO: 102950 - DNA, 679 bp, Homo sapiens; identical to SEQ ID NO: 67511
  chr1:112533107-112533786
  Hyper

SEQ ID NO: 102951 - DNA, 152 bp, Homo sapiens; identical to SEQ ID NO: 39037
  chr1:112784462-112784614
  Hypo

SEQ ID NO: 102952 - DNA, 530 bp, Homo sapiens
  chr1:113051583-113052113
  Hyper
tccgcacactaggcccgcagctcccttcagcgccgcagaccccctgacaccgcacccggtcctcaggcagcgcgccccagaccccgggttcggcacgccgtcgtcggcttccggacatcgcaacttgcgcccctctcggggatcctcctcccgggctctggaccccaggtgatcctaggtccccagccgccggcgaacaccatggccccccaggggggtgaggtaggagcagcctgagtacccccagaaggtgccccgtccacgcccctccgggctgcgcggcgggagtcttcggggagctatgctgagaccgggtggtgcggaggaagctgcgcagctcccgcttcggcgcgccagcgccccggtccctgtgccgtcgcccgcggcccccgacggctcccgggcttcggcccgcctaggtcttgcctgccttctgctcctgctgctgctgacgctgccggcccgcgtagacacgtcctggtggtaagtgtggctctcaggctgggcgggtgaggcgcttggtaggagag

SEQ ID NO: 102953 - DNA, 30 bp, Homo sapiens
  chr1:113286877-113286907
  Hyper
gccgggctcctctctcgctcccagggcctg

SEQ ID NO: 102954 - DNA, 671 bp, Homo sapiens; identical to SEQ ID NO: 67515
  chr1:113392209-113392880
  Hyper

SEQ ID NO: 102955 - DNA, 217 bp, Homo sapiens
  chr1:113497971-113498188
  Hyper
ccatgagtagaagggcgctgcggcggacgctggcagccacaggttgaatgacaaagagcccccgtcagcaccactcccaggagtctgcgggctgccccgtcccctccgcaaagtctactcgaaccctgcagtcacgccttggctgtggggaatgcggctctccgcaccactctcgcaagtcaccaggtggggcaaggatcggcgggccaagaaggtt

SEQ ID NO: 102956 - DNA, 30 bp, Homo sapiens; identical to SEQ ID NO: 67518
  chr1:113617180-113617210
  Hypo

SEQ ID NO: 102957 - DNA, 86 bp, Homo sapiens; identical to SEQ ID NO: 39038
  chr1:113751201-113751287
  Hypo

SEQ ID NO: 102958 - DNA, 59 bp, Homo sapiens; identical to SEQ ID NO: 67523
  chr1:114355897-114355956
  Hypo

SEQ ID NO: 102959 - DNA, 120 bp, Homo sapiens; identical to SEQ ID NO: 67524
  chr1:114448980-114449100
  Hypo

SEQ ID NO: 102960 - DNA, 893 bp, Homo sapiens
  chr1:114695312-114696205
  Hyper
cctgccgcgactccccggagacgccgcagctgcgcgccagggtccagcccggcggggatcgggctcgggactcacccgctccggcgagctcgactcagctcgggctcccgcctcggctaggcagccgcctggggctgcgtcccgcgcagggtcagcgcggatcgggcaggaggcgccctcttggcaaagtcggctagaggcgccagctcagtcgcgcaccggccccgagtccgagtccgagagggacggagggagcgagttataggggcgagagggggtgggggaaggacgccgcaacaccctcataccctcccccaccccgccccctgtcccccgccccccagcggagacgcggaaaaccactcgcagccggagagacacccggacacaaagacctcgtgccagccgcagacccaagtttctcccggagagactgggggtccgcccgcgttcaccgcgagaacacacaaacggacggacagaccgacgcacggacccggggacctcgacactcgctaggaggcaagccctattcctcagccgggcgcccctcgtctcccgctctctccatggacccctctcctggcaaatcgcccgcagagcgagcttggagatgcgagggaaactgaagccccaagggtgccccgtcctgggagcctggctgtctgcggggtcccccgcattccgcagtagtaatacaggagggccgggggcttctaccccaacctccgctccccttcgggtctctcctggctgtgcaagcgatgggccagagggctggacgaggctggctcccaatccagaatcccgagctggggagttctctctaggttctggggctcctgggaccggggctttggggaagggagatcgcaggacggatatccaggaag

SEQ ID NO: 102961 - DNA, 804 bp, Homo sapiens
  chr1:114696412-114697216
  Hyper
tgccgagcagcagctcgaacccgcgccccggccgcactggggcggggcacgacggccccaagaagaccctccctgcagcggccccctgcggctccgctctgcttttaatcacttccccgcagggtccccgcccctcacgtggcatcccgcggcagctggcgagtctggcgcctcgcggccgccccctctacactcagggactggcctgagtccggggggtgggggtttcgaggcgggaagccgggctgtcccgaatctcggagggtgcaaggccaggaaagagtccgggttcccactccgcattcactgcctggtgtgaccttgggcgtctctgagcctcaattttcctctccgtaaaggaggtgtaatgattttaagtacttcacggactccctggggatagaaagatcgtgtttgtgaaaacactgggtaaactgccacatgccacacgaatgacagagaaatagataaccccgtaacagaaagagcgacggtcaggcagggtctgggaggaccttggccgaggttcctgacgggagcagttagactggcccccgagtcccagcttcggaggtagaagaccccaagacaggcgggcgatgcgaactgcaagactttccgagctccgcaatcctgcggtccgcggtacccgcatgttgctatggcgacgggaggcagcggccgtctctctccatggcaacgggagggaaaagtttctggcaaacaggaatggggggtcatttcaagagggcgcagggcgctcagttccgccgacccacctccttgcttcggtgaaacagcacc

SEQ ID NO: 102962 - DNA, 257 bp, Homo sapiens; identical to SEQ ID NO: 67532
  chr1:114697661-114697918
  Hyper

SEQ ID NO: 102963 - DNA, 96 bp, Homo sapiens; identical to SEQ ID NO: 67533
  chr1:115055222-115055318
  Hypo

SEQ ID NO: 102964 - DNA, 693 bp, Homo sapiens
  chr1:115631944-115632637
  Hyper
gccccctgccctgaccggccctcccggctcctggtctcacccagaagagcaggttgaagccaagcagcaggtacttgatgcaccgcaggcccccgcggaagcgccccatgctgcggcccggcggcgggatccccagtccccaggcccgcgctacgagcgcggggagcggcaggctccggcggggagggggcggagcggggaggaccggggcggggcctccggggggcggggcggggcccggcggggaggggcgcgtggaccccaagcggcgtggctggcgacgggtgggggcgccagcgggtggagatcgagcagcccgagggagcacgttcgctcttctcccggacccagggaccaccttccttccctccagtgggcgcaccgccgccggctatcggagcacctgcagggcgggagcgcccaccggggactggggacccatttaatcagcgccctgtgcggagaccggtttgaggcccgggcgatgcttgagggataagcacttggtctcgtggctatggaaatctaggaaggtgacctcgggtagaagagctaagtggggtcggaggttgccccgaagctggcaggaccagtcgcggggcacctgactgagtgtccagggctgcggctccgcggcgcggagcaagcacacaagcagcttctaggggaccctccctccggcccctcccccct

SEQ ID NO: 102965 - DNA, 30 bp, Homo sapiens; identical to SEQ ID NO: 67539
  chr1:115828832-115828862
  Hypo

SEQ ID NO: 102966 - DNA, 1181 bp, Homo sapiens
  chr1:115880037-115881218
  Hyper
actcaaggcgctccccgccctaaccttccacgcccgcttctcccacacctggcagcagacagctggagatgaagcgtgtgacccaagtggcagggctgaaccttggcgacctctacctgaggttgtccaacgcggctccgtggagggccccggtacgccggacggaccccggcgttggctcgcagacttcctgcgttaacccccggggccctcagtcacgactcccagcccttccgagacgcgctgagggaactgccccaggtctagcgcgccccgttccgctcctccccctacctgggggccgcgcagcactttccctactcggcgctcacctcagccagcgcgctctgcgctccccccgcggtgctggccgccactcctcccgccctggcgcgccagctgccggcgcatccctctccgcgcccattcgctctccctcacttgcgcgttatccacttctagccctcgagctagaccctggcatggccgtgggcttctgcaggcgccagggctgctccctggactgcaggccatcctgggactagggactccacgaccagaactaacgctgttccctcggtccgactcgtcctcccgcgagggtcccgcgcccccacacccactcgggacatttctcagggctgctcttcggcctgcgggagcctcgggggtaaccagagagctcgccagaccggtatccttgcaaactctcccgcgaagcccagccacccctgcccgcgcccgcgctgcgcccctctcgggatcggctcggggcagcctgactcaccgctgcgctcccctccggctcccagcgctctctgctgtgccggagcgccgagctgctctcacacaggcttcttgaattcttagcccctcctcccgtactcctgagtcacacgctccaaatcctggcccccatccctcccctccccaccaccagccccgcacctgctgtggctgggctgtggtgcccggctggagggggtcctggggactacagacggatcgctcctggagggctggccagacccagccagagaaggactttaaaccttcagaggtcaaagggaaacccactggggtctgaggggccgcgcgcgcaaagccgggagggggagtttctggggcaccggcaggggtcgttgggccgactggctggggctgggcggagttgctcgcag

SEQ ID NO: 102967 - DNA, 142 bp, Homo sapiens; identical to SEQ ID NO: 67546
  chr1:116213911-116214053
  Hypo

SEQ ID NO: 102968 - DNA, 196 bp, Homo sapiens; identical to SEQ ID NO: 67547
  chr1:116214288-116214484
  Hypo

SEQ ID NO: 102969 - DNA, 45 bp, Homo sapiens; identical to SEQ ID NO: 39042
  chr1:116214942-116214987
  Hypo

SEQ ID NO: 102970 - DNA, 30 bp, Homo sapiens; identical to SEQ ID NO: 67549
  chr1:116247777-116247807
  Hypo

SEQ ID NO: 102971 - DNA, 574 bp, Homo sapiens
  chr1:116371021-116371595
  Hyper
caccgtgtccacaggcgcccactggtgtggcgtcctgagagtgcgtgcgtgagcgagcgagcggcttatcctagactgaagacccagggaaacagatctgtgtggaggatgtttctgttttcagcagaacagacgcagcccccgagtcagtgccgtcagaagacacgtcagtcaattcagtggaaaacacttccagtgtgaggcgttcgccggcgccccttagacgcggccgggtctgaggcgcctgccgagcgaggtggcgcggcccgggagctgtggtcgaagcccctgggcctggcgtgtaggctgcgcgggcggcggcgggctgggggcggggctctccgccctccgcgcgggtccgcctggcccctcccccgcccaccccgcgcccgtcccgcctcccccaccttctcccagaggaggtgacagacgggcctgtaatttggttccattcgctcgactggagcaacacctgcccccctcccctgggacgcgagggtctcatcccaaaccagacaagaagccaaagacaaatcccagcccacatgcagatccgacgcggaaaggagcgcgg

SEQ ID NO: 102972 - DNA, 1644 bp, Homo sapiens; identical to SEQ ID NO: 67552
  chr1:116380300-116381944
  Hyper

SEQ ID NO: 102973 - DNA, 111 bp, Homo sapiens; identical to SEQ ID NO: 26566
  chr1:116382387-116382498
  Hyper

SEQ ID NO: 102974 - DNA, 61 bp, Homo sapiens; identical to SEQ ID NO: 39043
  chr1:116574202-116574263
  Hypo

SEQ ID NO: 102975 - DNA, 771 bp, Homo sapiens; identical to SEQ ID NO: 67556
  chr1:116710521-116711292
  Hyper

SEQ ID NO: 102976 - DNA, 30 bp, Homo sapiens; identical to SEQ ID NO: 67558
  chr1:116946453-116946483
  Hypo

SEQ ID NO: 102977 - DNA, 30 bp, Homo sapiens; identical to SEQ ID NO: 67561
  chr1:117239297-117239327
  Hypo

SEQ ID NO: 102978 - DNA, 359 bp, Homo sapiens; identical to SEQ ID NO: 67565
  chr1:117452844-117453203
  Hyper

SEQ ID NO: 102979 - DNA, 34 bp, Homo sapiens; identical to SEQ ID NO: 67568
  chr1:117665071-117665105
  Hyper

SEQ ID NO: 102980 - DNA, 30 bp, Homo sapiens; identical to SEQ ID NO: 67574
  chr1:118173786-118173816
  Hypo

SEQ ID NO: 102981 - DNA, 110 bp, Homo sapiens; identical to SEQ ID NO: 67576
  chr1:118277822-118277932
  Hyper

SEQ ID NO: 102982 - DNA, 30 bp, Homo sapiens; identical to SEQ ID NO: 67579
  chr1:118522258-118522288
  Hypo

SEQ ID NO: 102983 - DNA, 286 bp, Homo sapiens; identical to SEQ ID NO: 67582
  chr1:118727824-118728110
  Hyper

SEQ ID NO: 102984 - DNA, 75 bp, Homo sapiens
  chr1:119521963-119522038
  Hyper
cccagggatcctccacgtcacgatcccacaggatgactttcctttttaacagactagctacgatatatactgacc

SEQ ID NO: 102985 - DNA, 643 bp, Homo sapiens
  chr1:119522297-119522940
  Hyper
tcaccagggccttcccggttagcccagggtccccacatttctccaggatgtaattagagctaagaacagccgccatccctcagggttccgggtcccgggtttccagggtcccgggtttccaaggccccgcgataaccccgggcgcacgcggcgcgatgcggcgaggcgaggcgaggcggtggggccagcgcggagccccaggcgcgagaacaggaactcgggctggcacaccgaggcctcgcagccaagccgcgcctgacccgttcgccgttccggccccgcggcgcctccaaggccgggccgaggggccgaggggccgagggcgggcagacgcggccacggcctaattctgacttctgaaggtcaccgaaactgcgctgtttttccagagatgggttgaagagaagagatgcaatcccagttccttctgcggcgaaacgggatctgaaattcttggagagggggaagaattggacgttttcatcgtgcgtggaggaaaattgggggaggggaagtgagtggcaagtaagggggttaactgcttcccggaccctatccggagtttaaactacacgctcccagctgtgggatagtaaagagaacgcagcggtgaggggattcggaaaatcggttcatccagttg

SEQ ID NO: 102986 - DNA, 885 bp, Homo sapiens
  chr1:119526767-119527652
  Hyper
tagcagttgagctgacgggtgcgtgcgagaatgcgagacctgccacgtgtacacgtgtacgcggagtgtcgatctgcctgcgtgtccttggatgtgcctgtctaggtgcccacccgcgcgcgccaccacatccccaggcctctggaacgcagctgctgtgtggcccggcccgaagtttctggaggaggaaatccctccacagaaggtttacattatttcgctccgcgggagacccggcttcggcagcacttagcagaagattttggcgggaaaggcccaagccctagctgaggactccgggtggagcaggggctgaggtccgagcgcagatggcgccgccgagcgcctgaaatatacttgcaaggccgcagcaatatacttgcaaggccgcagccggagcagctgttccagccgatcctagctcgaaagttcctctgttgctctgggagagggcgggggagagcaggctcgagagccaggctcctccgaggctggtcttgaggcacttctctagtagcttctccaaaagactgagagtgccggcgtaggtatgacagtgagggtacctcacagacccttctccaaagtctggcgggccttggggtttttcggggccaccaggctcggtggaatttttgaaacgctttcgaaatacatagtttcctctgtggagtgagtgcctacaacgcgcaggccggactgatcccccgttgctgcaggttggtgccccaagctgcgggtgctcgggcgccaactaaagccagctctgtccagacgcggaaagaaaaatgggctgtgaaaaagcaaaaggcctcgtctttgaatgaaagttaaacattaaaatctgaccctagagttgtctaaagatcgcggaattttgaagct

SEQ ID NO: 102987 - DNA, 310 bp, Homo sapiens; identical to SEQ ID NO: 67595
  chr1:119527868-119528178
  Hyper

SEQ ID NO: 102988 - DNA, 956 bp, Homo sapiens
  chr1:119528611-119529567
  Hyper
acataaggccctagacgggctccgtgcgatctggggcctcccaagagaaaacttccccgggacaggacgtctgccacgcgcagctaaacaacttctgttttttccgccgtggggaaaataaaagaaccttacaaattctaaggcgtcataacccctgcaagaacttctaactgtatgaaggcccacgcgagattttgacaatagataaatgagctgaggaaatagggtctggccagcgaagggaaacacacagtagccctgggtgcctttctggaatgcccacgcaggggtccgcgtggacaagcacttgcattcaaatacaggaaaaggcttggacggtcgaaataaatctccttttaattttcttttcatcgactaataaaaataattccccagcactaaactcaaataccgtaacgggccacaaaaacacggagaattcataaaactctatctctgcaggtcacccgctaatcgcattattattagcctcgggagcatggaaattgaactgtcactgcctaaagagaaaatgtaagcgacagctgtccctcctctgagttggacagctttgtggctgagatccccaagctcctgagccccagaccgtctctatcccagtgcaggccgctgccccctccccgggcttgtcagcgtgtgaagcggggtctactccccagctctggctgttcagcaggagcaccttccagcatggttttagaagtccgggctggaaagcttctgaaaccgctaaaccaagttgcgagcgttgtatgtgcgcgcgcgcacactcaagattcttccgacaacagctgttcccccgggctgtttttgcacagttgaaatcttggcacttaacacaaaacgttaaagttggcttctcccctcctagggttctgttaaaatacagacatgacatcccccctgctttttacatgttccgtgcacataatata

SEQ ID NO: 102989 - DNA, 1509 bp, Homo sapiens
  chr1:119529777-119531286
  Hyper
caactggtcattccccgaagactgaggtattggattggagaacgccgcgccagtcctcccgagttctcagaagcgagtcctagatctcggctcccgccgttgccttcggcccgcgcccctcccaatcccagggaccggcagcccttcatccacggacacccagaaagctgcgctctccacccaaaagaaaaagaaatgcaaacaaacaggactccttgcttaggctggcgacgaaaatgcaaggctcagtccagccccaaaaattggttccggtgaatttagggaggctcagggcatttgcgcgaagaaacagaaacctatgttggggcaaggcagggcgtcaatggcagggcctagctcctcacccgcgaccggcgactggcccttcggcgtcccctctccgcccgcctcccgcggtcggctgcgacgcactcacccgggtgaggctccaggccgtgtgccgccgcgtcctccgtgtctccgagtgggcccgcggggctcagcgcctccatagacaggtccagccccttctcctcccagtctcgcagtttccgttttttatttgagccgatcaaggcttcaacggagaaggcatgtgctcgcgagctcagggcgactgcagatcttctcctttcactcattttagccgcccacacccctgcctccgcttgcccccgctaccgagggagcagccggcgccctcaagctctgagcgcccaccgggcccggcccgggagaggcggaggcgcgtcggacgaggctgagactgcggctcgcgggtctctccaccctccccctgcgtcctcctccgccctcctctgccggatccgacctgcgcccctacgctggcccagctgctaggaactagcgccccgagcgccgcccgctcgctgcatgagcgcccgagtcctgcttcccacccaccggggcaggcgctcacagactgtgtccactgaacttcatcttgtttttgttattattattattctctctcctctctctctctctctctctctcccctccctctctttttctctcctccccctctctctctcttcctctctgccttcccgtcctccctgtgatccaaacttctgggaaacttttttttccgctaaattcctcccttcccgaggaacagggggcaggcggtgcgctcctgtccgaggggtgagggagagggagggggaggaagaaaaagactgagggggaaaaaagccagcccccaaccaatagcgaggagggaacaagagaaactccgagagcgcgaaccaatgagaggaagggagagactgaggcccgggccaaagcgcagcgccagtcgtcccctggatgctcctgggccgactttaacccctggcttcccggtttccccatgggttactccaagagggaggtaggacagttgaaagttgaggtctgatctgcgcctttacaaactcctgcaaatcccaaatccatacgtttttcttccagatctgctggtctcatagacgctgcaagtccaga

SEQ ID NO: 102990 - DNA, 492 bp, Homo sapiens
  chr1:119531601-119532093
  Hyper
agagcaaggggcgggcggcggagcgcggggtttagggcgagctcctcaggcgtattccagctgggccccctcacgccgcaaatactctctttccctacggcccgaacgctgggctgcgcttcgcctgttccgggctcttgttgcagagaacctatggagaggtgacaggcaagaacagctaggaactttaacagaagagaaggagctttttcaaaattccctgcaaatcccgttacctcaagaccatggctttcccggccagctgatctcccccctggccgccccctgccttttgcgatctctaaggactgcattcaacatggatttctaaggaattaaaaaatccaacgctcctggccattcttaattcccacacctcttcccaagttacgccaccggtcgaggacggcaggagacccccgagtgcagagaaagctcaaaccggcagcgaagtcggtcctagccaagctgaaaaaacgtctcggatttcgc

SEQ ID NO: 102991 - DNA, 30 bp, Homo sapiens
  chr1:119532909-119532939
  Hyper
aatttccttccccagcggctggggcctctc

SEQ ID NO: 102992 - DNA, 71 bp, Homo sapiens; identical to SEQ ID NO: 67604
  chr1:119535278-119535349
  Hyper

SEQ ID NO: 102993 - DNA, 207 bp, Homo sapiens
  chr1:119535573-119535780
  Hyper
tcataaatttatctgcgttctatcggcattggggcaagaggagagcgaaaaggggggggaagccccgattttatatttgtgactataaaaaagcgccacccggtttcctcgccttcggccgccgcggtgtggccggcagagccggggccggcgggccgcaaaattgcgcgattgttcgctgacttcggtctgcgcaggagcagggcc

SEQ ID NO: 102994 - DNA, 249 bp, Homo sapiens; identical to SEQ ID NO: 67606
  chr1:119536142-119536391
  Hyper

SEQ ID NO: 102995 - DNA, 30 bp, Homo sapiens; identical to SEQ ID NO: 26588
  chr1:119536719-119536749
  Hyper

SEQ ID NO: 102996 - DNA, 30 bp, Homo sapiens
  chr1:119542030-119542060
  Hyper
tttaattcactttcccggactggagcctca

SEQ ID NO: 102997 - DNA, 382 bp, Homo sapiens
  chr1:119542261-119542643
  Hyper
gccctcacccagccccggcatggcctagacaaccgctgctcagccctgcgcccgtgaaattacattattttctccccggcccaatcatcgttttacaggaaaaaaaaattaaataaatataaattgctgctttgcaagatcaaagtgccgatttctggtgcatctggaggagtggggagatggggaggaaagagagggggagagtggcgcagccgtggttgcccaacttcaaagggttctcaacagtgcattttgccattgtattttaacatctcttccccaccagtttggcagggtgcgcagcggagaagcgtgtagcttcagagttcagagcttgtggagaaaccttgctttgaccatctctgagcgcccccacgggact

SEQ ID NO: 102998 - DNA, 1562 bp, Homo sapiens
  chr1:119542991-119544553
  Hyper
acccggccacctgggcgactacgtaggcctggtacaggaggcaggagttgcctctgtccccactgcgctttccttaatcgaagagcgggtagatgccggccaagcaaagtgctcgaaagtgtagctgggacgcccacgccggaagcctggagaggcaagttgcgagttcgcagggcttgggagttttttgcggcggaagaagctgaatctaggggctgagtccccgggaagggatggccgcctcttagctttcgccaggagattatcttggagcccagcggccgagattgagagctctttctgcggaacctgcctccggagtcagatgagcaaggggaccgccacgtcctcaccgagctcccagcggcctttggggcgggtccggggacaagccggaggactaggcttctcccagagcgcggctgtctttcccggaaagacccaagtgcgcgatgtcagcccgcctgcacttcatctgagttgtccttatgtggccatttctgtttcaaatttcagatttttctactaaaaaaggatgggttaaaacagctgagagcgcgcctgctctttcccgccctgggttctacatctctctagccgcccaccagactgcatctccaatctgggagctatcctcaccttgggagggtggggcaacaatgttattctcgtttcccgataaggaaaccaacgtccctacaacttgacgttaaatggtcccaggttcctgagcctcaaatctaggactattacctaggtcacctaaaaatttttgttctttccactcccccgagggtgattctgttagcctcgcaggcccttctcccacccgtcatttgaagtcatcgaccccggggcagccccaacagttctgtgcgggcctgcgcgcaccgccctcaccttgcgcgccaggcatctcacctcagccgggcaggtgcagaggtgacaggcgcggcagccgcggttcgtccggccgaggggcaggaggaggctggccgccgccttctgctgcccgcaggctgagggggcaggggagggggaacagggctgggaaactgccgtcagcgggtcccggccccgcctcccgaacgcaacgtccaggaaacctcagaactttctattgtctgagaagcttcactgaacaaattgtccctaaaactttagagctgcgaagagcggatcagggcaggttctagtgtggccctgtgccccggagcctgcctgccataaagtgtgaccggaagcccccccccccccgcccactgtcagaaccactgaggagagaagagcgcggcgccttagtgccgccctgcgtcgtggtcgggaagccgagcaagcggtgtggacgccccaggagcagggggatccaggcctaaactcatgggttccgaatgggcaagggagcagaatcaagcatcggtgggcgcttatagaaagcgcgtctgtcttggaacacccttaccagggtacccaaccccagcgccaggtttcctggccttgcaaggagaggttgaatttgtcaggattccccactctagaaggtggctcgtggtggtgaagct

SEQ ID NO: 102999 - DNA, 112 bp, Homo sapiens; identical to SEQ ID NO: 67611
  chr1:119545108-119545220
  Hyper

SEQ ID NO: 103000 - DNA, 340 bp, Homo sapiens; identical to SEQ ID NO: 67612
  chr1:119548577-119548917
  Hyper

SEQ ID NO: 103001 - DNA, 2204 bp, Homo sapiens
  chr1:119549129-119551333
  Hyper
agcctcaatcttaaccgcgtatgatcgtttccactgcacctgtgcgggagagacaggcgcatatccccgtggcgtcggatctctaaattatctaatctggcggctgcgtacgactcagggaaagccctggccgcgagctttttcaccaggcttgagctcagcagccgggcccgcagtgttgccgccagtggggaggcagggaggctgtcggcgcgccggagccaggcgggaaagggactacagccgcccgccgttgtagcgcaggaagcgggcggtgccaacacacacctcgcagctctgcacgttcttcgtgtcttggaggagagtagagcctccgtgtgaagctccgtccgcacctgacgaagaggagggcgtcttgcgccactccagcgactctgcgatgttaagacgcagacccgctgctgcgcctgcctttgtcggggcgggcgggcagccgccgctcggagcaaggtggggctgcggggagggagagccgcggggcagatccctggccaaggtcctctagaaagcccgctctgcgcccaaacgcgccgctcggtccgtgggccacttcggacctgacgctgccggtgaattcacgcgctccgggacgcgcggggacctttgacgaggtttttgaactggggatcgtcccctgtaacctggccgcgttacctccccaggtgagccggactcgcgggtgggttcggcagccggcgatgtggcaaaaaggcaacctcgccttatttctaggggcttggagatgaagagcggctgagtgtccccgtctaccccaacccgggtattaccctcttttccgtcttctagaaggggaaaaccatgctgttttgaattcaacatatttagattctgaaaatcgacggcccttcccttctttcctaggaaggcctgccccgtaggcacaaccttcggagaaacgggcggcgcgtgagttccctggagccgcctcctgggcatccaggctcctgtcgcacggctggtgcggcgcccactgggcgtggggactgggcccaaggctcccgggaccgggtcgtggttaacgccgaggccaagcccttcgaagaactctgagttctctgcctgacgttttgtccctcaggaagtgtcccttcccgacttttgagggtgtcttgttctttgacggggtggccctgtgggggaggaaggagaagtgttcctccactgctgttctgtggagcgggacctggctttgttcggcctccctgctctcgggagcctgtactccggctcgcacgcctgactgctggccctggccgctgctcgggccccgcgcaggcacacgggacaaggcgaagccccgacgcccagagggcgcttgggcccagcacacccgcgcacagcccaggaaacgggaaaggccactgtctgcttccctttcgcagattctatccgctggcacgcgaaggtcacacgggctctcaatgctaatttggaatgggaagcaccacgaagggttgaggtagcctggtggccctgactgcgcagggtgcggacagtgagcccgtatccagcttcgctgccacgcgcctagcagcccggcggccccggcccggcccaaggaggaggcaggccgcctgggtcggcttccgtggcctgggggtaagctctgattcaccccaaggtgaggtccccggggatgcccagattcgggccgggaaacgcaccgggagagaaccaccaagcgctcttggttatgaaccagagcttataactgtggccgcagctagacctaggggaggcctgagcgccgaagcctccgtttcctcgaccggaattcgtgagctattaaacatgggccctagcggggcccacgccctgtcttcctttgctgacaaggctccgcggggtagtgggcgggagacaagggtctcagaacagaggggctggcccggcgcggcgggccaggaactcccgggcgtgtgtgtgcagtggtgcggggtgggggtggaggtgaggtctcctttagttcctgggatctgggaatcccggcttctcgatctcatccggcgcggagatcttaagggtcggtggaccagttagtgtgtacggcctcacccctccgcctccagctttcgaggctctccgcttcagagctccaaaggaaaacttctgcgacttcaagaacgtcctgcgcattcacatggggtcgcttcctggctggt

SEQ ID NO: 103002 - DNA, 153 bp, Homo sapiens; identical to SEQ ID NO: 67617
  chr1:119683985-119684138
  Hypo

SEQ ID NO: 103003 - DNA, 304 bp, Homo sapiens; identical to SEQ ID NO: 67618
  chr1:119869950-119870254
  Hyper

SEQ ID NO: 103004 - DNA, 460 bp, Homo sapiens
  chr1:120190340-120190800
  Hyper
tgggcttggtttctccgagggtctctgatgcccccttcggtggtcggcgggacggtcctattccctcttgcatcgctgtctcctccctcaagtctcagcctcctcctccccgcccctcgccacatacccctgagggagctcagtcctggctttgggggcgcgagagcaccccataagcccggggccctgcgccccaggggagcggacaacggtccactttacgaggcacaacttcgcccagccgttccgccaccgcactcgaacacacaccccatccccgcagcggtcgggtctggtcccgatcagccccatccccgggaggcggttgagcccagccacagccacgctcctacctgcgaggcggctggcgcggcgaggagctagggcaccgagcgccccggcccgagccccgcaccgcagcgcgtctgcccttgtgcggcggcggcggctgcagcggccg

SEQ ID NO: 103005 - DNA, 147 bp, Homo sapiens; identical to SEQ ID NO: 67621
  chr1:120191165-120191312
  Hyper

SEQ ID NO: 103006 - DNA, 63 bp, Homo sapiens; identical to SEQ ID NO: 67622
  chr1:120254521-120254584
  Hyper

SEQ ID NO: 103007 - DNA, 145 bp, Homo sapiens; identical to SEQ ID NO: 67623
  chr1:120321244-120321389
  Hypo

SEQ ID NO: 103008 - DNA, 101 bp, Homo sapiens
  chr1:147775362-147775463
  Hyper
tcaggcccagggagtcgcggacccgggcgtttcctgggatgctgggtctgacgcctgcgagggtcaggacggggcgaaggccattccgctgcccttccagc

SEQ ID NO: 103009 - DNA, 100 bp, Homo sapiens; identical to SEQ ID NO: 67685
  chr1:147775523-147775623
  Hyper

SEQ ID NO: 103010 - DNA, 251 bp, Homo sapiens; identical to SEQ ID NO: 67689
  chr1:150185824-150186075
  Hyper

SEQ ID NO: 103011 - DNA, 30 bp, Homo sapiens; identical to SEQ ID NO: 67691
  chr1:150504403-150504433
  Hypo

SEQ ID NO: 103012 - DNA, 30 bp, Homo sapiens; identical to SEQ ID NO: 67692
  chr1:150529962-150529992
  Hypo

SEQ ID NO: 103013 - DNA, 138 bp, Homo sapiens; identical to SEQ ID NO: 67693
  chr1:150565309-150565447
  Hypo

SEQ ID NO: 103014 - DNA, 149 bp, Homo sapiens; identical to SEQ ID NO: 67694
  chr1:150602992-150603141
  Hypo

SEQ ID NO: 103015 - DNA, 30 bp, Homo sapiens; identical to SEQ ID NO: 67695
  chr1:150693359-150693389
  Hypo

SEQ ID NO: 103016 - DNA, 104 bp, Homo sapiens; identical to SEQ ID NO: 67696
  chr1:150850631-150850735
  Hypo

SEQ ID NO: 103017 - DNA, 50 bp, Homo sapiens; identical to SEQ ID NO: 67697
  chr1:150940902-150940952
  Hypo

SEQ ID NO: 103018 - DNA, 58 bp, Homo sapiens; identical to SEQ ID NO: 67698
  chr1:150947697-150947755
  Hyper

SEQ ID NO: 103019 - DNA, 61 bp, Homo sapiens; identical to SEQ ID NO: 67699
  chr1:151032676-151032737
  Hyper

SEQ ID NO: 103020 - DNA, 34 bp, Homo sapiens; identical to SEQ ID NO: 67700
  chr1:151080126-151080160
  Hypo

SEQ ID NO: 103021 - DNA, 37 bp, Homo sapiens; identical to SEQ ID NO: 67701
  chr1:151104646-151104683
  Hypo

SEQ ID NO: 103022 - DNA, 145 bp, Homo sapiens; identical to SEQ ID NO: 67702
  chr1:151106046-151106191
  Hypo

SEQ ID NO: 103023 - DNA, 114 bp, Homo sapiens; identical to SEQ ID NO: 67703
  chr1:151118621-151118735
  Hyper

SEQ ID NO: 103024 - DNA, 120 bp, Homo sapiens; identical to SEQ ID NO: 67704
  chr1:151169648-151169768
  Hypo

SEQ ID NO: 103025 - DNA, 138 bp, Homo sapiens; identical to SEQ ID NO: 67705
  chr1:151170068-151170206
  Hypo

SEQ ID NO: 103026 - DNA, 94 bp, Homo sapiens; identical to SEQ ID NO: 67706
  chr1:151252667-151252761
  Hypo

SEQ ID NO: 103027 - DNA, 84 bp, Homo sapiens; identical to SEQ ID NO: 39049
  chr1:151300852-151300936
  Hypo

SEQ ID NO: 103028 - DNA, 30 bp, Homo sapiens; identical to SEQ ID NO: 39050
  chr1:151345799-151345829
  Hypo

SEQ ID NO: 103029 - DNA, 81 bp, Homo sapiens; identical to SEQ ID NO: 67709
  chr1:151347981-151348062
  Hypo

SEQ ID NO: 103030 - DNA, 60 bp, Homo sapiens; identical to SEQ ID NO: 67710
  chr1:151445917-151445977
  Hyper

SEQ ID NO: 103031 - DNA, 71 bp, Homo sapiens; identical to SEQ ID NO: 67711
  chr1:151481576-151481647
  Hypo

SEQ ID NO: 103032 - DNA, 69 bp, Homo sapiens; identical to SEQ ID NO: 67713
  chr1:151513143-151513212
  Hyper

SEQ ID NO: 103033 - DNA, 54 bp, Homo sapiens; identical to SEQ ID NO: 67714
  chr1:151678593-151678647
  Hypo

SEQ ID NO: 103034 - DNA, 316 bp, Homo sapiens; identical to SEQ ID NO: 67715
  chr1:151689335-151689651
  Hyper

SEQ ID NO: 103035 - DNA, 544 bp, Homo sapiens; identical to SEQ ID NO: 67716
  chr1:151693862-151694406
  Hyper

SEQ ID NO: 103036 - DNA, 77 bp, Homo sapiens; identical to SEQ ID NO: 67717
  chr1:151801573-151801650
  Hyper

SEQ ID NO: 103037 - DNA, 61 bp, Homo sapiens; identical to SEQ ID NO: 67718
  chr1:152009237-152009298
  Hyper

SEQ ID NO: 103038 - DNA, 272 bp, Homo sapiens; identical to SEQ ID NO: 67719
  chr1:152080369-152080641
  Hyper

SEQ ID NO: 103039 - DNA, 105 bp, Homo sapiens; identical to SEQ ID NO: 67720
  chr1:152083260-152083365
  Hyper

SEQ ID NO: 103040 - DNA, 859 bp, Homo sapiens
  chr1:152083590-152084449
  Hyper
atgcggctcttaatccgctcccgggcctgttcctgctcctcctcagctagctcctgctcgcgcctctcttcctcatgctcgcgcttcagccgctgctcgagcctctcttcctcctcctcgcgcttcagccgctgctcgcgcctttcctgctgctcgcgccttagttgctgctggcgcctctcctcctgctcctcgctcttcagcagctgctggcgcctctcttcctccggctcctcgcgcttcagccgctgctcgcgcctctcctcctgctcgagtctctccacctcctcgcgcttcagtcgctgctcgagcctctcttcctgctcgcgcttcagccgctgctggcgcctctcctcctcgcgcttcagcagctgatcgcgcctctcctcctgctcgcgcttcagccgctgctctcgcctctcctgctcgagcctcttctcctcctcgcgcttcagcagctgctcgcgcctctcctcctgctcgcgtcttagttgttgctcgctcctcaaccgctgctggagcctctcttcctcctcctggcgcttcagccgctgctcgcgcctctcctcttgctcccgccttagttgctgctcgcgcctctcctgctgctcgcgcctctcctcctcctcgagcttcagccaacgttcgcgcctctcctcctcctggtcgcgcttcagctgctgcttgcgcctctcctgctcgtgcctctccgtctcctcctcgcgcttcagccaatcgcgcctctcctcctgctcgcgcttcagccgctgctcgcgcctctcctgctcgtgcttctgctcgtgcctctcctcctcctgctcgcgcctcagctgctgctcgcgcctcagctgctgctcgc

SEQ ID NO: 103041 - DNA, 859 bp, Homo sapiens; identical to SEQ ID NO: 67723
  chr1:152084689-152085548
  Hyper

SEQ ID NO: 103042 - DNA, 30 bp, Homo sapiens; identical to SEQ ID NO: 67724
  chr1:152192377-152192407
  Hypo

SEQ ID NO: 103043 - DNA, 66 bp, Homo sapiens; identical to SEQ ID NO: 67725
  chr1:152276060-152276126
  Hypo

SEQ ID NO: 103044 - DNA, 30 bp, Homo sapiens; identical to SEQ ID NO: 67726
  chr1:152282667-152282697
  Hypo

SEQ ID NO: 103045 - DNA, 51 bp, Homo sapiens; identical to SEQ ID NO: 39054
  chr1:152286249-152286300
  Hypo

SEQ ID NO: 103046 - DNA, 462 bp, Homo sapiens
  chr1:152487789-152488251
  Hyper
gtggaaagaaaaagccggctcgcctttgaaaggctgcctttcttccaggtttgtcgtgaggagctccgcgatgtcctctcaacagagcgccgtttccgccaaaggcttttccaaggggtcgtcccagggccccgctccgtgtcccgccccggcgcccaccccggcgcccgcctcctcctcctcctgctgcggctccggcaggggctgctgcggcgactcaggctgctgcggctccagctccaccagttgctgctgcttcccaaggagacgccgccgacagcggagtagtggttgctgctgctgcgggggcggcagccagaggtcccagcgctccaacaaccggagctcaggatgctgctccggctgctgagaggcccgcaacccccagcgctgcgctagagaaacccgcccagcccagagcgggcccgccccgctgcggctcccacgcggggctgggcctcg

SEQ ID NO: 103047 - DNA, 16 bp, Homo sapiens
  chr1:152696808-152696824
  Hypo
ggagtcttgctctgtc

SEQ ID NO: 103048 - DNA, 30 bp, Homo sapiens; identical to SEQ ID NO: 67734
  chr1:153395112-153395142
  Hyper

SEQ ID NO: 103049 - DNA, 79 bp, Homo sapiens; identical to SEQ ID NO: 26613
  chr1:153438376-153438455
  Hyper

SEQ ID NO: 103050 - DNA, 109 bp, Homo sapiens; identical to SEQ ID NO: 14268
  chr1:153539476-153539585
  Hypo

SEQ ID NO: 103051 - DNA, 219 bp, Homo sapiens; identical to SEQ ID NO: 39057
  chr1:153540023-153540242
  Hypo

SEQ ID NO: 103052 - DNA, 150 bp, Homo sapiens; identical to SEQ ID NO: 39058
  chr1:153608334-153608484
  Hypo

SEQ ID NO: 103053 - DNA, 40 bp, Homo sapiens; identical to SEQ ID NO: 67741
  chr1:153620461-153620501
  Hypo

SEQ ID NO: 103054 - DNA, 89 bp, Homo sapiens; identical to SEQ ID NO: 67742
  chr1:153644958-153645047
  Hypo

SEQ ID NO: 103055 - DNA, 87 bp, Homo sapiens; identical to SEQ ID NO: 67743
  chr1:153650936-153651023
  Hyper

SEQ ID NO: 103056 - DNA, 989 bp, Homo sapiens; identical to SEQ ID NO: 67744
  chr1:153651443-153652432
  Hyper

SEQ ID NO: 103057 - DNA, 65 bp, Homo sapiens; identical to SEQ ID NO: 67745
  chr1:153662197-153662262
  Hypo

SEQ ID NO: 103058 - DNA, 102 bp, Homo sapiens; identical to SEQ ID NO: 39060
  chr1:153937070-153937172
  Hypo

SEQ ID NO: 103059 - DNA, 80 bp, Homo sapiens; identical to SEQ ID NO: 67747
  chr1:154098530-154098610
  Hypo

SEQ ID NO: 103060 - DNA, 22 bp, Homo sapiens
  chr1:154107501-154107523
  Hypo
ccacgcccggcctctgtgtacc

SEQ ID NO: 103061 - DNA, 23 bp, Homo sapiens
  chr1:154156755-154156778
  Hypo
gccggcctcggcctcccaaagtg

SEQ ID NO: 103062 - DNA, 176 bp, Homo sapiens; identical to SEQ ID NO: 67750
  chr1:154238843-154239019
  Hypo

SEQ ID NO: 103063 - DNA, 30 bp, Homo sapiens; identical to SEQ ID NO: 67751
  chr1:154292635-154292665
  Hypo

SEQ ID NO: 103064 - DNA, 364 bp, Homo sapiens
  chr1:154298110-154298474
  Hyper
ccccgccccagcccccggcatgggcagtacggggccgccggggcgggcgccgagcgctgagcgctgaggtgaggcgaggcgaggcgaagcgggggcgcccgggagcgcggggccaggagggcagagggagatgcggccgcagccgcggggctggaggggccggggagcgggtgtagactggggagcaccgggggccaagatttgggagctgcggccagacggggcggggatggcggccgactggagacgaggggctgtcgggttcccggggacggggcagagcgggggtctgcgtacaggatgggaggatggggtgccgaaggggcgcgtggagagcaggagagcggcgcgagtgccaaggaga

SEQ ID NO: 103065 - DNA, 30 bp, Homo sapiens; identical to SEQ ID NO: 67754
  chr1:154302983-154303013
  Hypo

SEQ ID NO: 103066 - DNA, 30 bp, Homo sapiens; identical to SEQ ID NO: 39064
  chr1:154305492-154305522
  Hypo

SEQ ID NO: 103067 - DNA, 129 bp, Homo sapiens; identical to SEQ ID NO: 67756
  chr1:154324138-154324267
  Hypo

SEQ ID NO: 103068 - DNA, 138 bp, Homo sapiens; identical to SEQ ID NO: 67757
  chr1:154325447-154325585
  Hyper

SEQ ID NO: 103069 - DNA, 995 bp, Homo sapiens
  chr1:154474549-154475544
  Hyper
tgctccgtgcgcccccggccggccgtcgcccacgcccggcagggtggggttctcacggctcggggcgccgagcgggcgggcgctagcctctgctccggacacggcaggcgacaggcacgacgcgcggggggccccgcccgggctcgtcttcaacgcctgcccggcccgaggacaccgtggctctcggaggcggcgggcgccgggggcttccccctgctctttcctcctgcggtgggagaggccaggcccacggaagccccctgcggcccagcccacgctcccagggaccagagaggaccgagcggaggcggcgggagtatccccggcgcagcgacagacggtggacggacggcgagcggcccatcaactccgcgcgcccctcccctccgcggctggcgcctcccagccccgccacctcctgcccagagctgggggcggcggggtgagcgccatggcagaggcgggtcgggctgcgagctctggagaaaggggcggcggccgcacgtgcggatcggccgcgccccactgagcagagagcccccttctgccgccgacagcccgcgtctgcaccgagccggtctcggccgggcgctgccttcacacgcgcccaggagtgtcacgtgcgccgctcacccccgggaaggaagcccctcgcccacccactccgctctactccactctttctgcagacgttatttttggcggtagggcagaggttgcggcccgaggtccgggcgcagggacaacggtcgccagctcctgcgctagttccgttactcttcggtggcacacggtcctgggcagcgcgaggctcttcccgccgtggccgccggggattggctgccggcaagccccgccccgtgcccccgggctcagagggggcggagcgcggagggagaaggcgcgaaggctgggcgtcgcgatcgcaggtgcacgcgcgtggcccgcgagacgaggtatggcttgtcggccccaggtcccgggatgccaggcga

SEQ ID NO: 103070 - DNA, 54 bp, Homo sapiens; identical to SEQ ID NO: 39065
  chr1:154499777-154499831
  Hypo

SEQ ID NO: 103071 - DNA, 78 bp, Homo sapiens; identical to SEQ ID NO: 67763
  chr1:154516767-154516845
  Hypo

SEQ ID NO: 103072 - DNA, 32 bp, Homo sapiens; identical to SEQ ID NO: 67764
  chr1:154533446-154533478
  Hypo

SEQ ID NO: 103073 - DNA, 37 bp, Homo sapiens; identical to SEQ ID NO: 67765
  chr1:154536500-154536537
  Hypo

SEQ ID NO: 103074 - DNA, 227 bp, Homo sapiens; identical to SEQ ID NO: 67766
  chr1:154540058-154540285
  Hyper

SEQ ID NO: 103075 - DNA, 189 bp, Homo sapiens; identical to SEQ ID NO: 67767
  chr1:154682354-154682543
  Hypo

SEQ ID NO: 103076 - DNA, 30 bp, Homo sapiens; identical to SEQ ID NO: 67768
  chr1:154685747-154685777
  Hypo

SEQ ID NO: 103077 - DNA, 47 bp, Homo sapiens; identical to SEQ ID NO: 26621
  chr1:154733207-154733254
  Hyper

SEQ ID NO: 103078 - DNA, 179 bp, Homo sapiens; identical to SEQ ID NO: 67772
  chr1:154808666-154808845
  Hypo

SEQ ID NO: 103079 - DNA, 30 bp, Homo sapiens; identical to SEQ ID NO: 39069
  chr1:154851806-154851836
  Hypo

SEQ ID NO: 103080 - DNA, 21 bp, Homo sapiens
  chr1:154954412-154954433
  Hypo
tcaccgcgcccggcctttttt

SEQ ID NO: 103081 - DNA, 30 bp, Homo sapiens; identical to SEQ ID NO: 67776
  chr1:155019681-155019711
  Hypo

SEQ ID NO: 103082 - DNA, 309 bp, Homo sapiens; identical to SEQ ID NO: 67777
  chr1:155043397-155043706
  Hyper

SEQ ID NO: 103083 - DNA, 45 bp, Homo sapiens; identical to SEQ ID NO: 67778
  chr1:155054426-155054471
  Hyper

SEQ ID NO: 103084 - DNA, 199 bp, Homo sapiens; identical to SEQ ID NO: 67779
  chr1:155055105-155055304
  Hyper

SEQ ID NO: 103085 - DNA, 30 bp, Homo sapiens; identical to SEQ ID NO: 67780
  chr1:155064834-155064864
  Hypo

SEQ ID NO: 103086 - DNA, 31 bp, Homo sapiens; identical to SEQ ID NO: 67781
  chr1:155113365-155113396
  Hypo

SEQ ID NO: 103087 - DNA, 66 bp, Homo sapiens; identical to SEQ ID NO: 67782
  chr1:155146189-155146255
  Hyper

SEQ ID NO: 103088 - DNA, 44 bp, Homo sapiens
  chr1:155147233-155147277
  Hyper
cggagaagggggtgccgctgaccgggttgcgctgcgggagaggg

SEQ ID NO: 103089 - DNA, 30 bp, Homo sapiens; identical to SEQ ID NO: 67784
  chr1:155154997-155155027
  Hypo

SEQ ID NO: 103090 - DNA, 98 bp, Homo sapiens; identical to SEQ ID NO: 14271
  chr1:155160925-155161023
  Hypo

SEQ ID NO: 103091 - DNA, 32 bp, Homo sapiens
  chr1:155161766-155161798
  Hypo
cggggctgaggtgacatcgtgggctggcgggg

SEQ ID NO: 103092 - DNA, 30 bp, Homo sapiens; identical to SEQ ID NO: 67786
  chr1:155176630-155176660
  Hypo

SEQ ID NO: 103093 - DNA, 36 bp, Homo sapiens; identical to SEQ ID NO: 67788
  chr1:155311784-155311820
  Hypo

SEQ ID NO: 103094 - DNA, 21 bp, Homo sapiens
  chr1:155563460-155563481
  Hypo
aataaaattgccattcgggcc

SEQ ID NO: 103095 - DNA, 23 bp, Homo sapiens
  chr1:155578174-155578197
  Hypo
ctaccctcacattctcgaatttc

SEQ ID NO: 103096 - DNA, 120 bp, Homo sapiens; identical to SEQ ID NO: 67791
  chr1:155578917-155579037
  Hypo

SEQ ID NO: 103097 - DNA, 30 bp, Homo sapiens; identical to SEQ ID NO: 67792
  chr1:155659966-155659996
  Hypo

SEQ ID NO: 103098 - DNA, 59 bp, Homo sapiens; identical to SEQ ID NO: 39074
  chr1:155668700-155668759
  Hypo

SEQ ID NO: 103099 - DNA, 30 bp, Homo sapiens; identical to SEQ ID NO: 67794
  chr1:155675909-155675939
  Hypo

SEQ ID NO: 103100 - DNA, 34 bp, Homo sapiens; identical to SEQ ID NO: 39075
  chr1:155826302-155826336
  Hypo

SEQ ID NO: 103101 - DNA, 58 bp, Homo sapiens; identical to SEQ ID NO: 67798
  chr1:155830324-155830382
  Hyper

SEQ ID NO: 103102 - DNA, 30 bp, Homo sapiens; identical to SEQ ID NO: 67799
  chr1:155888002-155888032
  Hypo

SEQ ID NO: 103103 - DNA, 23 bp, Homo sapiens
  chr1:155892702-155892725
  Hypo
aaagacagtcctggccgggcgcg

SEQ ID NO: 103104 - DNA, 23 bp, Homo sapiens
  chr1:155892965-155892988
  Hypo
agcctgggcgacagaaaaaaaaa

SEQ ID NO: 103105 - DNA, 42 bp, Homo sapiens; identical to SEQ ID NO: 67802
  chr1:155893814-155893856
  Hypo

SEQ ID NO: 103106 - DNA, 29 bp, Homo sapiens
  chr1:155905289-155905318
  Hypo
ggtaggattacaggcgtgagccaccgcgc

SEQ ID NO: 103107 - DNA, 30 bp, Homo sapiens; identical to SEQ ID NO: 67804
  chr1:155911541-155911571
  Hypo

SEQ ID NO: 103108 - DNA, 30 bp, Homo sapiens; identical to SEQ ID NO: 39078
  chr1:155911924-155911954
  Hypo

SEQ ID NO: 103109 - DNA, 220 bp, Homo sapiens; identical to SEQ ID NO: 67806
  chr1:155912424-155912644
  Hypo

SEQ ID NO: 103110 - DNA, 143 bp, Homo sapiens; identical to SEQ ID NO: 67807
  chr1:155954169-155954312
  Hypo

SEQ ID NO: 103111 - DNA, 20 bp, Homo sapiens
  chr1:156010528-156010548
  Hypo
caccgcgcccagccagtcca

SEQ ID NO: 103112 - DNA, 204 bp, Homo sapiens; identical to SEQ ID NO: 67810
  chr1:156030654-156030858
  Hypo

SEQ ID NO: 103113 - DNA, 105 bp, Homo sapiens; identical to SEQ ID NO: 39082
  chr1:156031479-156031584
  Hypo

SEQ ID NO: 103114 - DNA, 52 bp, Homo sapiens; identical to SEQ ID NO: 67812
  chr1:156212895-156212947
  Hypo

SEQ ID NO: 103115 - DNA, 542 bp, Homo sapiens; identical to SEQ ID NO: 67813
  chr1:156215329-156215871
  Hyper

SEQ ID NO: 103116 - DNA, 30 bp, Homo sapiens; identical to SEQ ID NO: 67814
  chr1:156216765-156216795
  Hypo

SEQ ID NO: 103117 - DNA, 30 bp, Homo sapiens; identical to SEQ ID NO: 67815
  chr1:156232727-156232757
  Hypo

SEQ ID NO: 103118 - DNA, 39 bp, Homo sapiens; identical to SEQ ID NO: 67816
  chr1:156233282-156233321
  Hypo

SEQ ID NO: 103119 - DNA, 206 bp, Homo sapiens; identical to SEQ ID NO: 39083
  chr1:156253833-156254039
  Hypo

SEQ ID NO: 103120 - DNA, 33 bp, Homo sapiens; identical to SEQ ID NO: 67818
  chr1:156268868-156268901
  Hypo

SEQ ID NO: 103121 - DNA, 91 bp, Homo sapiens; identical to SEQ ID NO: 67819
  chr1:156271355-156271446
  Hypo

SEQ ID NO: 103122 - DNA, 116 bp, Homo sapiens; identical to SEQ ID NO: 67821
  chr1:156339144-156339260
  Hyper

SEQ ID NO: 103123 - DNA, 760 bp, Homo sapiens; identical to SEQ ID NO: 67822
  chr1:156357837-156358597
  Hyper

SEQ ID NO: 103124 - DNA, 1492 bp, Homo sapiens
  chr1:156390096-156391588
  Hyper
gaggccggctttccccgggcccctctgcgcagtgtatggggttatttttactttcggttatctagctttatgaagactccacaccactcatacagctagataaccaaagataacaaccaaccccgcctcctggctgctgtcgccgcctcttccacgcagcctcccggccgccgccgccgccagcacctccgcagcttcccggtcgcccgtcagcgggagtaggagggaagggacacgagtggagttgagggggagggtgaagagagaaatgaagtccgagacaaaacaacaacaaaaacctcagacacggagatacagacacgacagagaccgaaaaaggcgtggaaaggacgcgatgacccgtggcgtcgaagtcggggagttgaccccgatccagacccaaaaagtttctggtgccccatttcccgctctcccattcgggccaggagcaggagttccgctggtcccaggtggaagggacgcgcgggcttttcgtgccacccgggaagaccgcagcgacccaggcagaggcctccccagcctcgccgggtctccactgcccttctctggaagatcgagggcgcatccgacagccagagccctgccttcggcggagcccgagcctggcgcgggatggaaatggggagccgcggtgccggcccggccacgtcgccaactcagaaaggcgttggaagcgaagcggagcccttgtgggggaaagagccggattcaagaggccgactaaaaggggaaatgggcagccaaaccccggaggtaaaaaccccagagatgtcctaataggaagcagggaaatcccggcgacccaaagagagaggaaaggctgtggggggcgggtgggggcgacccagagactcccaagcgagtctctcaaggagagaaggaaacagcagagaccccacccgggaagagatccgggagagtacccatgagaggggcggaggggaggaaagcagagggcgacagggcaggtgaccagagtcccaggccctgcagagccccggataaacggctttgttcaaagaggaccagagatcacccagggttgtgaaaatggccgggggttcgaggcgagcggtgctctaggggtgggaaaggggtgcgatcaggaacgggaaaccgcagccccgaagagggtgggggctcggccggcccctcgtggcggacgcgcgggcacgccggattccgaggcgctcgcccacctcgtgctccacgctggccaggccacttacatcgagcccagggtgcccatccgtgctctcccgcgcggtcctcccggccagttcccgcccctggagcgccagggccctgagttccagatgccggggctcagcgggcgccgggcagaggaggctgccctgctcttagcctccgccgagcctaggcgagcagggtggagcgggtctcacctcctagctccctcctctgcctctgccgcggctctggccccggcgcgctccggctccggactttt

SEQ ID NO: 103125 - DNA, 1246 bp, Homo sapiens
  chr1:156405367-156406613
  Hyper
cgccggcagggcccccgaggcgcctctgcctgctctctccgttcttgccggcggcagcgattcggactcccgctttcgacaaagtctcagctccgcagcagcacccggcgcggactcgctgggcgcgcggactgagctccgggtggaaccaggaccctcgcgccctcgccctcgccctcgccctcgccctcgcccgagctggaccaccgcgagcaccgccgacgccagccgcagagccgcgggtgcgcggggaagaggaaacgaaagcgcgggctccggagctgaggtgagaagtgagcagaaagtgaaaagagaatccatcggaaacagataaaaaaggaaaaacaaaacccactcgaaaagaaagaaaacgttacaacaaaaaggataaagtaacgctaaatgaaataaaaaggagacatactaaaaacgttaaagttgttaaactaagtgatagaaaaggcgaagaaacaacagggctaggaaagggctccgaggcgcccgcagggaagggggccctagacggggcgatgaggcttttgggagcctccggccgcgggcgcggcggggtccggcgggtgcgcagcggccggggctcctccgcgcgctgcccgccgccggcacccggctcgggcgaagagccggctggacggtcagccagccccacccacagagagtcgcgggagcccgagggccgggagctgcgggactccttcgcccccacctctgccgcccgccgaacccgaccccgggaaatcctcctagccgccgcctcccagcgccgggtctccccgagcgtgtgctctcggctgcgaggccctgcatgcgcagtgtctgggttcgcggcgtcaagcggagcctcggtccagcctgggcagccgagagcgcggggactgctgaacgcggtccgctccccgccagccgttcgggaccccagcctgggggaaagccgacagcgtccctctccgcgcaaactccacgcggcagcctggactgggatgtggggccagggggctgaataattaacaaccaggagaagccggggagagcgggaagcctggcaagccagggaaagggaagatgagacagagagacatagagagacagggacagagggagacagagagggggctaagagcgacgcgggcgagagaggaagaaaggctggggagaaggaaaaatgagataaataaaggaaaaaagagaagcgaagggcggtgggagaggcagccgggcctctctggga

SEQ ID NO: 103126 - DNA, 146 bp, Homo sapiens; identical to SEQ ID NO: 67829
  chr1:156432169-156432315
  Hypo

SEQ ID NO: 103127 - DNA, 47 bp, Homo sapiens; identical to SEQ ID NO: 14276
  chr1:156433495-156433542
  Hypo

SEQ ID NO: 103128 - DNA, 30 bp, Homo sapiens; identical to SEQ ID NO: 67831
  chr1:156434427-156434457
  Hypo

SEQ ID NO: 103129 - DNA, 37 bp, Homo sapiens; identical to SEQ ID NO: 67832
  chr1:156441193-156441230
  Hypo

SEQ ID NO: 103130 - DNA, 333 bp, Homo sapiens; identical to SEQ ID NO: 67833
  chr1:156468600-156468933
  Hyper

SEQ ID NO: 103131 - DNA, 51 bp, Homo sapiens; identical to SEQ ID NO: 26633
  chr1:156474407-156474458
  Hyper

SEQ ID NO: 103132 - DNA, 167 bp, Homo sapiens; identical to SEQ ID NO: 67836
  chr1:156594060-156594227
  Hyper

SEQ ID NO: 103133 - DNA, 836 bp, Homo sapiens
  chr1:156594429-156595265
  Hyper
gctgctcgagggctccgtgcgctaccctgtgctcaccgcacgcgccccgtgcggcggccgaggccggcccgggatccgcagctacggaccccgcgaccggatgcgcgaccgctacgacgccttctgcttcacctccgcgctggcgggtgaggcgcgggacgaaggcagggtcttggggaggggtctgaaaaatgtgggggacgaggagtggacctcagcttgagatcagggcagggtctccgggtccctccaaggcaccgcccccccatcagcccgcccgcccgcccaggctccagctcacctctccaaaccctccctgcacttttgcctcgatcccccaactcctcttacccaagctcgatccagcacctctgcggtcccgcaccccaactccgcctcctgggtgtcagccgcccctctccgcccaccctgccctcggtcggtgacccgctgtggtccccaggccaagtgttcttcgtgcccgggcggctgacgctgtctgaagcccacgcggcgtgccggcgacgcggcgccgtggtggccaaggttgggcacctctacgccgcctggaagttttcggggctagaccagtgcgacggcggctggctggctgacggcagtgtgcgcttcccaatcaccacgccgaggccgcgctgcggggggctcccggatcccggagtgcgcagtttcggcttccccaggccccaacaggcagcctatgggacctactgctacgccgagaattaggcgcccaccgtgtcccctccagcgcgcgcgaagaagcttgggagtcgtggcgggggtctctcgccacccctttccggagagcctcccct

SEQ ID NO: 103134 - DNA, 344 bp, Homo sapiens
  chr1:156611775-156612119
  Hyper
gaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtaggtgagtgcctccgcagccccgccgcccgccgtggggtcggggacagggagaa

SEQ ID NO: 103135 - DNA, 623 bp, Homo sapiens
  chr1:156626475-156627098
  Hyper
gatggagacccaggccggaactccatccctcaccctggttcctgtctcttagaaaaggcaccagcgcccctgcccaagagcccctccaggctcctgctaccccctcattctctactagctcttttgcaccgccctcctgtcccccttagtcccgcccctctcggcctgcggtagtggaaggagaccagccccttccaggggacctggccctctgggttttggggccctaagatgcccgcccttatgtgccgcaggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacagtgggctgggagacagggcgggaggggcccctgccatatgctctcactctctctcactcgcctaaccgccttcctcattaacccatgcacttattccttggttttctcaagcgtgcattccctcactcattcgttcactccccttctcattctctctcccttcccaccctacgcttaggcagtggccttcgggaacggagagtggaggtt

SEQ ID NO: 103136 - DNA, 30 bp, Homo sapiens; identical to SEQ ID NO: 67844
  chr1:156636236-156636266
  Hypo

SEQ ID NO: 103137 - DNA, 263 bp, Homo sapiens
  chr1:156646593-156646856
  Hyper
cctgcgcgttcaggccgacgcgctcctcctcgtgcgccacgcgtagagcctctagctcgcgctccagctctgccacctggctactcagccaggcccgggcgcatttctctgcctcgacggcgcgccggttgcgggctacctcctccgtcgtccgctcccgggccagccgcagctgctggcatcggcctgccacgccctccagctcttcagccaggttgtcgcgcgccacctcggccgcgtgcttctcccgccagcgttggtca

SEQ ID NO: 103138 - DNA, 90 bp, Homo sapiens; identical to SEQ ID NO: 67847
  chr1:156676449-156676539
  Hyper

SEQ ID NO: 103139 - DNA, 34 bp, Homo sapiens; identical to SEQ ID NO: 39087
  chr1:156690386-156690420
  Hypo

SEQ ID NO: 103140 - DNA, 30 bp, Homo sapiens; identical to SEQ ID NO: 67852
  chr1:156783716-156783746
  Hyper

SEQ ID NO: 103141 - DNA, 999 bp, Homo sapiens
  chr1:156814754-156815753
  Hyper
gaggggcaagcaaagcgaggctctggggttagcgagaagtcaaaccccaaacctttgcacagggtccttggggtcggtgatgggggtagaaggtgtgtgtgtggatcacctactgtggggcatggtgcgcgcaaagacgaaggtggcggcgctgcagcccacggtgtgcgccgcgtggttgcaggcatggatgtcgatccggtattccgtgaagtggcgcaggccgctcagcaccgctcgctcacggggcaccttgtcctcctggatctcgaaatccgagctgttgccccccagccggaggggcccagctgcccggcggtgccgccctgagtccctggggagagcgagtcagagccaaggcccagcccccaaagccacgcccctcagcacctgccctagtcctgctcacctttgggggctcttgttgatggacgtcaccttccaaggggatctggggaggccaggagtagccctatcaggcctgtccggatgcacccctgtgccctctgcagcgcgtaccgcctccaaaagcacccacaacccgggacccgcccacacaagcaaggccccacccacaaaccccacccctcccgcaagacccgcccctcacaggccccactcatcagaccctcccaggccgcgcgcgctcttcgcacatggggatggtgatcgcgttgtgtagaaagttttcaaacttcttctggaacgaggcctcttgcgcctccagcgggggcagaacctgaccaggaggtgggtgctggcaagggcagcagtcggactccatctcggcctcaggatccccgtcttcgccgtcgaagcgcggatcgttgttgctggtgggcagccgcaagcctggcgccgcagcgggaagacactagtaagacaggcggtctacccgcctctgatcccccccacctgccggggccctgcgcctccatctccccttccccacccgccccgcggccggcctgcgcgtcgtccctgcgcaccgcggtggca

SEQ ID NO: 103142 - DNA, 505 bp, Homo sapiens; identical to SEQ ID NO: 67856
  chr1:156818562-156819067
  Hyper

SEQ ID NO: 103143 - DNA, 56 bp, Homo sapiens; identical to SEQ ID NO: 67857
  chr1:156823879-156823935
  Hypo

SEQ ID NO: 103144 - DNA, 124 bp, Homo sapiens; identical to SEQ ID NO: 67858
  chr1:156829116-156829240
  Hyper

SEQ ID NO: 103145 - DNA, 100 bp, Homo sapiens; identical to SEQ ID NO: 67859
  chr1:156829475-156829575
  Hyper

SEQ ID NO: 103146 - DNA, 153 bp, Homo sapiens
  chr1:156830195-156830348
  Hyper
tttcttcctagagttcggagaatgttctacctaacttactccaagtgacatgctcactcccctaggcacgcgcgccgcgaggatggagcgctgagcctggggctggctaggatgacctggacagcaacctttcctcaacgcagtcatcttccc

SEQ ID NO: 103147 - DNA, 246 bp, Homo sapiens; identical to SEQ ID NO: 67861
  chr1:156830950-156831196
  Hyper

SEQ ID NO: 103148 - DNA, 180 bp, Homo sapiens; identical to SEQ ID NO: 67862
  chr1:156838167-156838347
  Hypo

SEQ ID NO: 103149 - DNA, 389 bp, Homo sapiens; identical to SEQ ID NO: 67863
  chr1:156843312-156843701
  Hypo

SEQ ID NO: 103150 - DNA, 91 bp, Homo sapiens; identical to SEQ ID NO: 67864
  chr1:156849311-156849402
  Hypo

SEQ ID NO: 103151 - DNA, 270 bp, Homo sapiens; identical to SEQ ID NO: 67865
  chr1:156849702-156849972
  Hypo

SEQ ID NO: 103152 - DNA, 733 bp, Homo sapiens
  chr1:156862991-156863724
  Hyper
cagtgcgattaggggcggcaggaggagaggggggcctcgccctgtcagcctctccgagactagtgggatgcggtgcccgggaggggtcttaataagatcacggttgctgggcagcactggacagtgcccgacgtaggcgatctcattgattccttcccacaaccccactttgcagataggaaagctgaggcacgagagggtaagtaacccaggccgcacaacgaggggaagctagggagggactggggccctgggcccctgcgctgacctcccctcctcatccccttcttatccccctctgctcctggcccaggccgcgcagagtcggcctctgtgatcccacccagaatacagttttccctcccgggcgcctggatctcccctcccccggctcctgtttccttgtcaaaacttcctgccttggcgagggcccgagttcccacccccttcctgccccccgcccctcggcgcccctcccggccctgcgatcagcagcgtcccgcctccccgccgctcccgcagtcaggctggggctcgaagtggggaccctcgccccgtcctcggctgtccagtcctcctcctcgcagaccccggcggttcctaccccaggccgcaggggagacggggccccaaggcaggtgagtgactgcgcgccccctggcaggggaggcccggtggtgcggccccggagaccaccctgccccggggaaagggcttgcggtccctgaggtcc

SEQ ID NO: 103153 - DNA, 96 bp, Homo sapiens; identical to SEQ ID NO: 67868
  chr1:156866303-156866399
  Hypo

SEQ ID NO: 103154 - DNA, 195 bp, Homo sapiens; identical to SEQ ID NO: 67869
  chr1:156890228-156890423
  Hyper

SEQ ID NO: 103155 - DNA, 146 bp, Homo sapiens; identical to SEQ ID NO: 67870
  chr1:156890673-156890819
  Hyper

SEQ ID NO: 103156 - DNA, 788 bp, Homo sapiens
  chr1:156893504-156894292
  Hyper
cagaagaggggaccccgttgtctaccgtgcacgcacgcccgttagtcccctttctccgagctcttgctttccccgtttcctatcaagtgttttcagcgtccgtacttccaagcgtttgcaagttgaatggctgcaaaaatatccgtctgaggagggcccctccgcccgcgcgggagagcttggggatgcgggggtgggcgtggccccttctctcacgcccctgcctgcccccgcagaggagtaccagtgctccggggtcctcgagaccgacttcgccgagctctgcacgcggtggggctacacggacttccccaaagttgtcaaccggccccgcccccacccgcccttcgtcccctccgcctctttgtcggaaaaggccaccttaggtgagtgacagtggagctccccggtgcctgccagggccgcctagtccatcctcagcctcccttcccacgccgggccaaatggagggacgcggggcggtgtgtgtgtgtgagtcggcggtattcgacgaggccggtggggaggtgggggagtctcccgtcttcctttccaacccagcagaggcgcgagtggccggagaggcagagtccgcaggccggcgcctcccctctggcggtgtcctccaatcccacccgggcacccgtgggccggcccggcgtggggccctggaggtggctgttcccctccctcctcacctctgccttccagacgatccgcggctgtcggggtcctgcagcctcaatagcctggagagcaaatacgtgttcttccggcccaccatccag

SEQ ID NO: 103157 - DNA, 30 bp, Homo sapiens; identical to SEQ ID NO: 67874
  chr1:156897401-156897431
  Hyper

SEQ ID NO: 103158 - DNA, 40 bp, Homo sapiens; identical to SEQ ID NO: 67875
  chr1:156897769-156897809
  Hyper

SEQ ID NO: 103159 - DNA, 30 bp, Homo sapiens; identical to SEQ ID NO: 67876
  chr1:156915778-156915808
  Hypo

SEQ ID NO: 103160 - DNA, 30 bp, Homo sapiens; identical to SEQ ID NO: 39092
  chr1:157086435-157086465
  Hypo

SEQ ID NO: 103161 - DNA, 30 bp, Homo sapiens
  chr1:157164721-157164751
  Hyper
ctgcacagttgggcacggagggaccccgag

SEQ ID NO: 103162 - DNA, 37 bp, Homo sapiens; identical to SEQ ID NO: 67879
  chr1:157247210-157247247
  Hypo

SEQ ID NO: 103163 - DNA, 96 bp, Homo sapiens; identical to SEQ ID NO: 67880
  chr1:157247367-157247463
  Hypo

SEQ ID NO: 103164 - DNA, 48 bp, Homo sapiens; identical to SEQ ID NO: 67881
  chr1:157346340-157346388
  Hypo

SEQ ID NO: 103165 - DNA, 162 bp, Homo sapiens; identical to SEQ ID NO: 39094
  chr1:157458773-157458935
  Hypo

SEQ ID NO: 103166 - DNA, 227 bp, Homo sapiens; identical to SEQ ID NO: 67883
  chr1:157490582-157490809
  Hypo

SEQ ID NO: 103167 - DNA, 191 bp, Homo sapiens; identical to SEQ ID NO: 39096
  chr1:157527405-157527596
  Hypo

SEQ ID NO: 103168 - DNA, 87 bp, Homo sapiens; identical to SEQ ID NO: 39097
  chr1:157543012-157543099
  Hypo

SEQ ID NO: 103169 - DNA, 30 bp, Homo sapiens; identical to SEQ ID NO: 67886
  chr1:157543676-157543706
  Hypo

SEQ ID NO: 103170 - DNA, 38 bp, Homo sapiens; identical to SEQ ID NO: 67887
  chr1:157608817-157608855
  Hypo

SEQ ID NO: 103171 - DNA, 36 bp, Homo sapiens; identical to SEQ ID NO: 39098
  chr1:157791984-157792020
  Hypo

SEQ ID NO: 103172 - DNA, 412 bp, Homo sapiens; identical to SEQ ID NO: 67889
  chr1:157895130-157895542
  Hypo

SEQ ID NO: 103173 - DNA, 22 bp, Homo sapiens
  chr1:157905741-157905763
  Hypo
aattaagctataggccgggtgc

SEQ ID NO: 103174 - DNA, 228 bp, Homo sapiens
  chr1:157963288-157963516
  Hyper
ggaaatgagtttgtgcgcgtgagtgtgcgcgcgcgcgtgtgtgtgtgcaggggcgggcgcgggcgggcggggggcgggctcccgggctcccgggctcccctcctccccagcccgctcctctggctcgctcgccaactccgggccccagccgcgggcgggcgcacggcgggcggacagcatgctgagcctcctcgtctggatcctcactctctccgatactttctccca

SEQ ID NO: 103175 - DNA, 154 bp, Homo sapiens; identical to SEQ ID NO: 26658
  chr1:157963737-157963891
  Hyper

SEQ ID NO: 103176 - DNA, 30 bp, Homo sapiens; identical to SEQ ID NO: 67894
  chr1:158064583-158064613
  Hypo

SEQ ID NO: 103177 - DNA, 55 bp, Homo sapiens; identical to SEQ ID NO: 67895
  chr1:158064823-158064878
  Hypo

SEQ ID NO: 103178 - DNA, 530 bp, Homo sapiens; identical to SEQ ID NO: 67896
  chr1:158083182-158083712
  Hyper

SEQ ID NO: 103179 - DNA, 30 bp, Homo sapiens; identical to SEQ ID NO: 67897
  chr1:158120029-158120059
  Hypo

SEQ ID NO: 103180 - DNA, 40 bp, Homo sapiens; identical to SEQ ID NO: 67898
  chr1:158129286-158129326
  Hypo

SEQ ID NO: 103181 - DNA, 600 bp, Homo sapiens
  chr1:158150556-158151156
  Hyper
ataatggttgtaaagcgtcccacacgttgacccaaagtctcctttgaaacaggaaattgagacacgccggttgtgaaacctactgaagtgagcggcggcgccaggattcctgggaccccgacctctttgcagctcgcacagctaagggcgagggcgcccttcggcagaagcagcaaaccgccggcaagcccagcgaggagggctgccggggtctgggcttgggaattggctggcacccagcggaaagggacgtgagctgagcggcgggggagaagagtgcgcaggtcagagggcggcgcgcagcggcgctccgcgaggtccccacgccgggcgatatggggtgcctgctgtttctgctgctctgggcgctcctccaggcttggggaagcgctgaaggtgggtggaacgagggcgcttgagtgcactcgcgggagggcggagagagggagctgggtagggacggggagggcaacgcctgatggggactggtgagacccgggacgcactggcgcgatctaggtagaaaactcgctgctccctggctccggggagaggcagcgcggcacagagttcgctggcatcagccgcctcctgaagctc

SEQ ID NO: 103182 - DNA, 30 bp, Homo sapiens; identical to SEQ ID NO: 67902
  chr1:158165497-158165527
  Hypo

SEQ ID NO: 103183 - DNA, 141 bp, Homo sapiens; identical to SEQ ID NO: 14282
  chr1:158169208-158169349
  Hypo

SEQ ID NO: 103184 - DNA, 30 bp, Homo sapiens; identical to SEQ ID NO: 67904
  chr1:158232713-158232743
  Hypo

SEQ ID NO: 103185 - DNA, 60 bp, Homo sapiens; identical to SEQ ID NO: 39101
  chr1:158237112-158237172
  Hypo

SEQ ID NO: 103186 - DNA, 20 bp, Homo sapiens
  chr1:158366698-158366718
  Hypo
tattttggccaggggcggtg

SEQ ID NO: 103187 - DNA, 30 bp, Homo sapiens; identical to SEQ ID NO: 39103
  chr1:158578092-158578122
  Hypo

SEQ ID NO: 103188 - DNA, 16 bp, Homo sapiens
  chr1:158591676-158591692
  Hypo
ggagtcttgctctgtc

SEQ ID NO: 103189 - DNA, 15 bp, Homo sapiens
  chr1:158591932-158591947
  Hypo
cgtgagccactgcac

SEQ ID NO: 103190 - DNA, 42 bp, Homo sapiens; identical to SEQ ID NO: 67910
  chr1:158639312-158639354
  Hypo

SEQ ID NO: 103191 - DNA, 178 bp, Homo sapiens; identical to SEQ ID NO: 39107
  chr1:158669704-158669882
  Hypo

SEQ ID NO: 103192 - DNA, 300 bp, Homo sapiens; identical to SEQ ID NO: 67912
  chr1:158672332-158672632
  Hypo

SEQ ID NO: 103193 - DNA, 183 bp, Homo sapiens; identical to SEQ ID NO: 67913
  chr1:158686993-158687176
  Hypo

SEQ ID NO: 103194 - DNA, 135 bp, Homo sapiens; identical to SEQ ID NO: 67914
  chr1:158687415-158687550
  Hypo

SEQ ID NO: 103195 - DNA, 30 bp, Homo sapiens; identical to SEQ ID NO: 67915
  chr1:158710956-158710986
  Hypo

SEQ ID NO: 103196 - DNA, 32 bp, Homo sapiens; identical to SEQ ID NO: 67916
  chr1:158712034-158712066
  Hypo

SEQ ID NO: 103197 - DNA, 30 bp, Homo sapiens; identical to SEQ ID NO: 67917
  chr1:158712492-158712522
  Hypo

SEQ ID NO: 103198 - DNA, 107 bp, Homo sapiens; identical to SEQ ID NO: 39109
  chr1:158723718-158723825
  Hypo

SEQ ID NO: 103199 - DNA, 17 bp, Homo sapiens
  chr1:158730575-158730592
  Hypo
ctgggtgcagtggctcg

SEQ ID NO: 103200 - DNA, 30 bp, Homo sapiens; identical to SEQ ID NO: 67920
  chr1:158746532-158746562
  Hypo

SEQ ID NO: 103201 - DNA, 32 bp, Homo sapiens; identical to SEQ ID NO: 67921
  chr1:158760470-158760502
  Hypo

SEQ ID NO: 103202 - DNA, 42 bp, Homo sapiens; identical to SEQ ID NO: 39112
  chr1:158815297-158815339
  Hypo

SEQ ID NO: 103203 - DNA, 39 bp, Homo sapiens; identical to SEQ ID NO: 67923
  chr1:158840962-158841001
  Hypo

SEQ ID NO: 103204 - DNA, 60 bp, Homo sapiens; identical to SEQ ID NO: 67924
  chr1:159088824-159088884
  Hypo

SEQ ID NO: 103205 - DNA, 376 bp, Homo sapiens
  chr1:159141385-159141761
  Hyper
ccgcgactgcagcagcgccggctccctcccggtccccacctcggccccgggctccgaagcggctcgggggcgccctttcggtcaacatcgtagtccaccccctccccatccccagcccccggggattcaggctcgccagcgcccagccagggagccggccgggaagcgcgatgggggccccagccgcctcgctcctgctcctgctcctgctgttcgcctgctgctgggcgcccggcggggccaacctctcccaggacggtgagtgagggagggggcggcgcctggggaggtggggagtgacccgaggcgggggctgggatcgggagtctcgcggaaggagcctgttggctttgtttggaaccggggttaaagtcac

SEQ ID NO: 103206 - DNA, 206 bp, Homo sapiens
  chr1:159158305-159158511
  Hyper
cagctggctctgagtcgcgctgggacgactggcgaagttcacccgggactccaaagcccggacacgtagcagctctgggctctgctcagcagcggatgagctcactgaattttgcgcacttgattggctacttcggggcgctgcggcgggagaccctgaaaagattcgcaaggccggtttctttgtccctccgcctcttcaggttg

SEQ ID NO: 103207 - DNA, 79 bp, Homo sapiens; identical to SEQ ID NO: 67931
  chr1:159187230-159187309
  Hypo

SEQ ID NO: 103208 - DNA, 33 bp, Homo sapiens; identical to SEQ ID NO: 67932
  chr1:159202103-159202136
  Hypo

SEQ ID NO: 103209 - DNA, 24 bp, Homo sapiens
  chr1:159448019-159448043
  Hypo
tttttttttttgagacggagtctg

SEQ ID NO: 103210 - DNA, 51 bp, Homo sapiens; identical to SEQ ID NO: 67936
  chr1:159642793-159642844
  Hypo

SEQ ID NO: 103211 - DNA, 41 bp, Homo sapiens; identical to SEQ ID NO: 39114
  chr1:159650169-159650210
  Hypo

SEQ ID NO: 103212 - DNA, 26 bp, Homo sapiens
  chr1:159679196-159679222
  Hypo
agactccgtctcggaaaaaaaaaaaa

SEQ ID NO: 103213 - DNA, 96 bp, Homo sapiens; identical to SEQ ID NO: 67939
  chr1:159683839-159683935
  Hypo

SEQ ID NO: 103214 - DNA, 393 bp, Homo sapiens
  chr1:159750379-159750772
  Hyper
ccccagggcatccagcgtgaaggaggtagaactaggccggcccgcgaggaggcaggggcaggcgccagtgacgcaatgactgcaacatgccgccagggtgcagcagagcccgaccccgggttgttccatccgcagcaaacaattcctaactcgctccaggtcttccttcttagctgagtgggttgaaccccgtggaagtaaccccccgcccattatgatgatccagccaatcaccgcgtgatctgctcggacggggcgggatcgcggcgcttccctcggtcgctcagagactgggttccgcgttccagccccgccccaggttctgggccaatccccgcggctgggcagagcgacccgagggcggcgccctgcagaccacgtggcccgggaggc

SEQ ID NO: 103215 - DNA, 114 bp, Homo sapiens; identical to SEQ ID NO: 26669
  chr1:159751133-159751247
  Hyper

SEQ ID NO: 103216 - DNA, 79 bp, Homo sapiens; identical to SEQ ID NO: 67943
  chr1:159869607-159869686
  Hypo

SEQ ID NO: 103217 - DNA, 23 bp, Homo sapiens
  chr1:159876328-159876351
  Hypo
agaacatttaggagccgggcatg

SEQ ID NO: 103218 - DNA, 169 bp, Homo sapiens; identical to SEQ ID NO: 14290
  chr1:159883486-159883655
  Hypo

SEQ ID NO: 103219 - DNA, 45 bp, Homo sapiens; identical to SEQ ID NO: 67946
  chr1:159915746-159915791
  Hyper

SEQ ID NO: 103220 - DNA, 19 bp, Homo sapiens
  chr1:159930262-159930281
  Hypo
ttttttcctttgagacgga

SEQ ID NO: 103221 - DNA, 91 bp, Homo sapiens; identical to SEQ ID NO: 67948
  chr1:159931588-159931679
  Hypo

SEQ ID NO: 103222 - DNA, 72 bp, Homo sapiens; identical to SEQ ID NO: 67949
  chr1:159932029-159932101
  Hypo

SEQ ID NO: 103223 - DNA, 71 bp, Homo sapiens; identical to SEQ ID NO: 39120
  chr1:160025702-160025773
  Hypo

SEQ ID NO: 103224 - DNA, 257 bp, Homo sapiens; identical to SEQ ID NO: 67951
  chr1:160039671-160039928
  Hyper

SEQ ID NO: 103225 - DNA, 171 bp, Homo sapiens; identical to SEQ ID NO: 67952
  chr1:160040333-160040504
  Hyper

SEQ ID NO: 103226 - DNA, 76 bp, Homo sapiens; identical to SEQ ID NO: 67953
  chr1:160135228-160135304
  Hypo

SEQ ID NO: 103227 - DNA, 173 bp, Homo sapiens; identical to SEQ ID NO: 67954
  chr1:160370097-160370270
  Hyper

SEQ ID NO: 103228 - DNA, 30 bp, Homo sapiens; identical to SEQ ID NO: 26673
  chr1:160370599-160370629
  Hyper

SEQ ID NO: 103229 - DNA, 36 bp, Homo sapiens; identical to SEQ ID NO: 39121
  chr1:160451199-160451235
  Hypo

SEQ ID NO: 103230 - DNA, 30 bp, Homo sapiens; identical to SEQ ID NO: 67958
  chr1:160503724-160503754
  Hypo

SEQ ID NO: 103231 - DNA, 30 bp, Homo sapiens; identical to SEQ ID NO: 67959
  chr1:160508436-160508466
  Hypo

SEQ ID NO: 103232 - DNA, 97 bp, Homo sapiens; identical to SEQ ID NO: 67960
  chr1:160523172-160523269
  Hypo

SEQ ID NO: 103233 - DNA, 17 bp, Homo sapiens
  chr1:160524877-160524894
  Hypo
tttttttttttgagacg

SEQ ID NO: 103234 - DNA, 30 bp, Homo sapiens; identical to SEQ ID NO: 67964
  chr1:160654992-160655022
  Hypo

SEQ ID NO: 103235 - DNA, 94 bp, Homo sapiens; identical to SEQ ID NO: 67965
  chr1:160693863-160693957
  Hypo

SEQ ID NO: 103236 - DNA, 30 bp, Homo sapiens; identical to SEQ ID NO: 67966
  chr1:160698365-160698395
  Hypo

SEQ ID NO: 103237 - DNA, 25 bp, Homo sapiens
  chr1:160752829-160752854
  Hypo
gaaaacaaccctgaacgcaggtgac

SEQ ID NO: 103238 - DNA, 197 bp, Homo sapiens; identical to SEQ ID NO: 67968
  chr1:160787406-160787603
  Hypo

SEQ ID NO: 103239 - DNA, 30 bp, Homo sapiens; identical to SEQ ID NO: 39124
  chr1:160820959-160820989
  Hypo

SEQ ID NO: 103240 - DNA, 30 bp, Homo sapiens; identical to SEQ ID NO: 14294
  chr1:160853373-160853403
  Hypo

SEQ ID NO: 103241 - DNA, 101 bp, Homo sapiens; identical to SEQ ID NO: 67971
  chr1:160880601-160880702
  Hypo

SEQ ID NO: 103242 - DNA, 120 bp, Homo sapiens; identical to SEQ ID NO: 67972
  chr1:160883883-160884003
  Hypo

SEQ ID NO: 103243 - DNA, 151 bp, Homo sapiens; identical to SEQ ID NO: 67973
  chr1:160953002-160953153
  Hypo

SEQ ID NO: 103244 - DNA, 27 bp, Homo sapiens
  chr1:160992336-160992363
  Hypo
cttaatagtcttggccgggtgcgtggc

SEQ ID NO: 103245 - DNA, 57 bp, Homo sapiens; identical to SEQ ID NO: 14297
  chr1:161007705-161007762
  Hypo

SEQ ID NO: 103246 - DNA, 193 bp, Homo sapiens; identical to SEQ ID NO: 67976
  chr1:161044630-161044823
  Hypo

SEQ ID NO: 103247 - DNA, 181 bp, Homo sapiens; identical to SEQ ID NO: 39131
  chr1:161056643-161056824
  Hypo

SEQ ID NO: 103248 - DNA, 30 bp, Homo sapiens; identical to SEQ ID NO: 67978
  chr1:161059519-161059549
  Hypo

SEQ ID NO: 103249 - DNA, 30 bp, Homo sapiens; identical to SEQ ID NO: 67979
  chr1:161062448-161062478
  Hypo

SEQ ID NO: 103250 - DNA, 646 bp, Homo sapiens; identical to SEQ ID NO: 67980
  chr1:161067928-161068574
  Hyper

SEQ ID NO: 103251 - DNA, 78 bp, Homo sapiens; identical to SEQ ID NO: 67981
  chr1:161121163-161121241
  Hypo

SEQ ID NO: 103252 - DNA, 224 bp, Homo sapiens; identical to SEQ ID NO: 67982
  chr1:161228649-161228873
  Hyper

SEQ ID NO: 103253 - DNA, 668 bp, Homo sapiens
  chr1:161275455-161276123
  Hyper
ggggtgggggggtggcgatcacttgtccgagttcaggcccatcatgttcttgagggcgtttttgaggctggttctgctgggggacttgacagcaggccggagctccgggctctgctcatcctttcgtagctccatctcgatgaccatcacctttgggcctttggcggactccacccctaacccccgatcccccgcccggcccgctaaccgctatttcttatccttgcgagactcccccagccccttggccttcttctcactgacagctttggtgcttctgctgtggtccagcattgcatacagcactggcgtctgggggaggggcgcacacatcagtcaccgagcgactggggcttgactgttcccatcccacccctcactgctgcccggcggctcccagggttctccttcccatcttgtctaggccccaagtcccgctaacctgccgcccgcgcttcgacgcgtcctttcctggcttgtgcaatttccccttctccatagcactgcaagaagagagactgctgtacgtttggcctcgccggaaccccttgcaccgcggacacagcttcctcttccccttggccctcccacccactggagtagtctccgcccagatgggggatagtggggagagggggaggggagctaggctccgccccttacctgag

SEQ ID NO: 103254 - DNA, 41 bp, Homo sapiens; identical to SEQ ID NO: 67985
  chr1:161358973-161359014
  Hypo

SEQ ID NO: 103255 - DNA, 360 bp, Homo sapiens; identical to SEQ ID NO: 67986
  chr1:161367762-161368122
  Hypo

SEQ ID NO: 103256 - DNA, 140 bp, Homo sapiens; identical to SEQ ID NO: 67987
  chr1:161409851-161409991
  Hyper

SEQ ID NO: 103257 - DNA, 169 bp, Homo sapiens; identical to SEQ ID NO: 39134
  chr1:161442404-161442573
  Hypo

SEQ ID NO: 103258 - DNA, 252 bp, Homo sapiens; identical to SEQ ID NO: 67989
  chr1:161450235-161450487
  Hypo

SEQ ID NO: 103259 - DNA, 29 bp, Homo sapiens
  chr1:161471750-161471779
  Hypo
ccaccgcacctggccggttctcttgaatc

SEQ ID NO: 103260 - DNA, 215 bp, Homo sapiens; identical to SEQ ID NO: 67991
  chr1:161481646-161481861
  Hypo

SEQ ID NO: 103261 - DNA, 99 bp, Homo sapiens; identical to SEQ ID NO: 67992
  chr1:161493379-161493478
  Hypo

SEQ ID NO: 103262 - DNA, 184 bp, Homo sapiens; identical to SEQ ID NO: 67993
  chr1:161494827-161495011
  Hyper

SEQ ID NO: 103263 - DNA, 283 bp, Homo sapiens; identical to SEQ ID NO: 67994
  chr1:161509756-161510039
  Hyper

SEQ ID NO: 103264 - DNA, 163 bp, Homo sapiens; identical to SEQ ID NO: 67995
  chr1:161510099-161510262
  Hyper

SEQ ID NO: 103265 - DNA, 17 bp, Homo sapiens
  chr1:161529750-161529767
  Hypo
aaagcctcactctgtcg

SEQ ID NO: 103266 - DNA, 34 bp, Homo sapiens; identical to SEQ ID NO: 67997
  chr1:161577201-161577235
  Hypo

SEQ ID NO: 103267 - DNA, 30 bp, Homo sapiens; identical to SEQ ID NO: 39137
  chr1:161577640-161577670
  Hypo

SEQ ID NO: 103268 - DNA, 128 bp, Homo sapiens; identical to SEQ ID NO: 26682
  chr1:161581762-161581890
  Hyper

SEQ ID NO: 103269 - DNA, 413 bp, Homo sapiens; identical to SEQ ID NO: 68000
  chr1:161582234-161582647
  Hyper

SEQ ID NO: 103270 - DNA, 81 bp, Homo sapiens; identical to SEQ ID NO: 68001
  chr1:161591283-161591364
  Hyper

SEQ ID NO: 103271 - DNA, 140 bp, Homo sapiens; identical to SEQ ID NO: 68002
  chr1:161591628-161591768
  Hyper

SEQ ID NO: 103272 - DNA, 231 bp, Homo sapiens; identical to SEQ ID NO: 68003
  chr1:161695622-161695853
  Hyper

SEQ ID NO: 103273 - DNA, 277 bp, Homo sapiens; identical to SEQ ID NO: 68004
  chr1:161697067-161697344
  Hyper

SEQ ID NO: 103274 - DNA, 45 bp, Homo sapiens; identical to SEQ ID NO: 39138
  chr1:161879452-161879497
  Hypo

SEQ ID NO: 103275 - DNA, 54 bp, Homo sapiens; identical to SEQ ID NO: 68006
  chr1:161913485-161913539
  Hypo

SEQ ID NO: 103276 - DNA, 30 bp, Homo sapiens; identical to SEQ ID NO: 68007
  chr1:162389828-162389858
  Hypo

SEQ ID NO: 103277 - DNA, 500 bp, Homo sapiens; identical to SEQ ID NO: 68009
  chr1:162792053-162792553
  Hyper

SEQ ID NO: 103278 - DNA, 30 bp, Homo sapiens; identical to SEQ ID NO: 39140
  chr1:163363352-163363382
  Hypo

SEQ ID NO: 103279 - DNA, 214 bp, Homo sapiens
  chr1:164290500-164290714
  Hyper
atgcaaaaaaaactgcgccgtgttcccctctgttgtgtgcgccgcgtccggggagcctgggccgtgcctccctggcgtatgcaggtcgccggcgcagccgccagctccgggggccgcgcttccagccacccgcagccggcggggcccgccgggcagcacgggaatcgcggagcgcggcagctcccctgcgcgccgccgccgccctgctcctggc

SEQ ID NO: 103280 - DNA, 40 bp, Homo sapiens; identical to SEQ ID NO: 68014
  chr1:164637945-164637985
  Hypo

SEQ ID NO: 103281 - DNA, 30 bp, Homo sapiens; identical to SEQ ID NO: 68015
  chr1:164642633-164642663
  Hypo

SEQ ID NO: 103282 - DNA, 30 bp, Homo sapiens; identical to SEQ ID NO: 68016
  chr1:164667343-164667373
  Hypo

SEQ ID NO: 103283 - DNA, 30 bp, Homo sapiens; identical to SEQ ID NO: 68017
  chr1:164708418-164708448
  Hypo

SEQ ID NO: 103284 - DNA, 67 bp, Homo sapiens; identical to SEQ ID NO: 26690
  chr1:165086960-165087027
  Hyper

SEQ ID NO: 103285 - DNA, 220 bp, Homo sapiens; identical to SEQ ID NO: 68022
  chr1:165204374-165204594
  Hyper

SEQ ID NO: 103286 - DNA, 541 bp, Homo sapiens; identical to SEQ ID NO: 68023
  chr1:165204825-165205366
  Hyper

SEQ ID NO: 103287 - DNA, 276 bp, Homo sapiens
  chr1:165321596-165321872
  Hyper
cctgaactaggatggcggcacaggttgaaggagagggcttcagttcaggccccaactactgtcctaaaagcccctgcatccgagggttctgcagaaaaccaggaaggcgacagtgaaagggcgaacgggctgtgcgcttagctccgaatggcagcagagccatttccgagcccaaactgtccggactccagcgaacaaacccgagcgggaaacgcgcacagggcacaggggacagaagctgcggggtcaatacagtctcaccgcaaggcacaggcg

SEQ ID NO: 103288 - DNA, 37 bp, Homo sapiens; identical to SEQ ID NO: 68025
  chr1:165322183-165322220
  Hyper

SEQ ID NO: 103289 - DNA, 30 bp, Homo sapiens; identical to SEQ ID NO: 68026
  chr1:165323443-165323473
  Hyper

SEQ ID NO: 103290 - DNA, 2815 bp, Homo sapiens
  chr1:165323676-165326491
  Hyper
ctgtatacataaatccgcacccgctgcccgcccgggtactgcctgctctggcttccgctctcttccgaggctgggcaagtccaaaagttcccgaaaggggggttcaaagaggggcgctcagtgcacgtgatttcgtttcatctagggtgttgggggtggggagattcctcactggatttggtttctccagcagaactgtctcatcctccacattcatgccgctctagcggttccgagtgaaagaggcaagaggtttaaaggacagaaggaaaactccctcctgctaaaaataaataaataaaataaaataaaataaaatacgggcttcccaaacttgaaaagctccaagggcagagtgggtgggggagccgtaaccagaatctctggcttcagctctgcaagacccgtgtgtggacactcttccggggtccttgactcgctgctcctcctctgtcgctgcaaaggagttgtgaggggggacccacaggacccgacatccagctccagttaattaacgcggagcctagggcccagccgcgcggtctaatccccgcgctgcgttgcctactggcccagaaaagtctctctcggccttgcccatggctgaaattggggctggagttggtgggggagagaagcctcctcgaacttgggcgctccaggcctcgggtctcggatgctattgcctctaggccgcgagaagagggcggcatttatgagacgtcgatcagctccgagattaaaaatccagccctgggtatttttaatcacttgccactcagacgcctacgaacaagctcgcccgcccctcgcggctttggggaattcggtgcccagtgcgtgaggcctggggcggcttgttggatttatttgggtagggacgacccacaagcactgacggacagatagtgatggggctcaatttagtgtatgaagaggggcgctagcttccctatcgcggaccaggtcccagagagcggggctccagagctcagcgccaagcggaaagagagtgcgcccaggacgcacggcctgaacactcacccagcagcgaggagaaggaggccgaggtgtcgatcgcgctttggaagttctcctccatctttaggccgtccagcatgttcgggccgggccgggaggacctgtagaggagaagaaacgatgcgtctgacgtccgtgcccgctgggactcggcgccagcagccaccgcactcctgggaaagaactgagggagtgtccagggcgaccagaatcagccaggaggatagggtccagccaagagaatgtagggtgggaggagagatcagtcacagcgaactgctctggctgatctgatttcacttgaagtcaacacgttatgtacttaggcctccgccccccaactgcgtttctccttctcctgcccccctcacccccacctacatcccttgccccaggttttccatcccgaatccgactccgccccaacctatacgaaggtgggccctcgggacgtctctgcaggaacgcagctactggggtatattgggtatataaagagtgggtaccctccctcgagcgaccgggtccaggcacgcgggacgatggggtttgcaatcccgcgtcccagccgccccgttgcggccctcacctgccccaggtcgagaaggggcactgtaagggacccggagggcgtcccgcccgcttctggactcctggcgctgcgctctgttggggtgcgcgcaggagccggtgtgcggggcgcgcggggaggtcctcccgccagtcggccagtgccgggaatgtctgcagaagcaaaagagtcgcctcggggaggagccccggctggcccggctcactcttggatgcatttcaagtcaactttcagaaacacgcccgcccgagccacagcctaggcacgggcagccttacttacctggtaggcgagctctctcccagtgactggagcagagagaagttgcggagcgctgctggaagcttctgcccgggaaggcgtcgcccccgagactgcagccggaggagccgccctcggcttcggagcgccggggagggagccggagcgaacgccggccgctggctctgctcctcggcgcgcccaggctgggccgggacgtggtcgcgagctgccggccttcccgggacgtcctaccagcccgcgtcgctcctcagcgggaggagagggccagttgcttctccaaggctaggagggaaggcagaggcccagggtcctgggtgcgagtcggccctgcttcgccggggcggatcctgcagcttctgacaggggccgcggcgctgcgtgcgcggcggcggagagggggtggggtgcgctgggcggggggctggcagcgcgtcccgtggcggggccgtggtgctccctttcccagcctggctgcgcggccaccacacggccgctgccctctgagcccctccgcctctgggagctctcggacacgctaagtttcctcccctccacgtgtaactgttacctcggggcgctctggcccggtcgccccccagtgcccctcaccccgactgggcctttgcggagatgtcggcgcctcctggacagcggtgccgccacgaggattcccccgccgctctccaactgctgctataaaagcgctgcaatccttacccgggccccgggaagcgctgagaagctgtttagcgccagtagatgtgggcccagcagctcctagctcctcaaacccctcatcacccgagggctcatgccagtttccaacttcctttaaggtcgaaccatattcactcatggggcgtacagaggccatgggactcacggcctaagaatcat

SEQ ID NO: 103291 - DNA, 209 bp, Homo sapiens; identical to SEQ ID NO: 26700
  chr1:165345473-165345682
  Hyper

SEQ ID NO: 103292 - DNA, 331 bp, Homo sapiens
  chr1:165414227-165414558
  Hyper
aacaagagtggtcatcgcttcctagcagcccggggagcacaggctgggccagccctctgggattagtcaggaatctgcctctagatcggagagtccacatagtgcgtttgagacggctgtggcggcagcagctggtgcctgtcagtaatcacgcataatgctgccgccgccgccgccgccgccgtcaccgctactcttgccaccgccgtcgctgctgcttgagatcctgttgctagtttgattaactcagggttgggctgctgcgtgcgactcttccagctcccggcgcgtccccagaggtccctaccgggtggcacgatctattatctag

SEQ ID NO: 103293 - DNA, 30 bp, Homo sapiens; identical to SEQ ID NO: 68040
  chr1:165550859-165550889
  Hypo

SEQ ID NO: 103294 - DNA, 30 bp, Homo sapiens; identical to SEQ ID NO: 68041
  chr1:165624524-165624554
  Hypo

SEQ ID NO: 103295 - DNA, 23 bp, Homo sapiens
  chr1:165664216-165664239
  Hypo
aaaaaggacgatgagctataaag

SEQ ID NO: 103296 - DNA, 36 bp, Homo sapiens; identical to SEQ ID NO: 39142
  chr1:165809083-165809119
  Hypo

SEQ ID NO: 103297 - DNA, 30 bp, Homo sapiens; identical to SEQ ID NO: 68044
  chr1:166104124-166104154
  Hypo

SEQ ID NO: 103298 - DNA, 1420 bp, Homo sapiens
  chr1:166134166-166135586
  Hyper
ccttttagctattgtcgttgccacctgctcagagtctagttctgaaaggaggcgggtgcggagttatgaaaatttggtaaatataaaagtcccggacgcgaccgcccgtagcctgcggcccctggcggttgaggagccgcggcgatccttggtcttcaccgcagcagccaagcccggcgcgcaccaaccggcgctgctgaaagttggagagctcccagctcgccgatagaattcggcggtgggcgccaggggaatcccttccagtgccgcaattaggaaagttttaaaaagtaaggaccctagacagacaagagatccatcctttcctttagcataagaaacaccccgcgccgcgccagccgaacgctgctcgcacaaggctatccgcccttcttggccgggacgcactcggtgccttccagctccccaccagaactggtccagggggcgcggaaacagagaggcaactgtgtccggcttgtggttccagacggaaacgcctccgggctccctggcccgggggacaagggttcgaaacttcaacagtcgcgagggcaaggacagaactaccaactcccgctcggatgcccgggacctgctcttccaagcccgctccggtttctccaaaggacgcgcggcacagcccatgcgcccccggcactccactccactcctctatggtttcccccaaactcttcccggggagccccacaaagcacagacggcgccctgaaactcgccaggcactcgccagccatccccacctccgcctctcgaaccctccttgtcgcgttcttcccgccccgcacctttctcctcgcgtttctgggaagtcagaagcaaaccacgagaaaatgccttcgcaaggagcctccctacacccgccctgtcactgaaacaaaagcgtagggaggagggaggtgggagaggaggcgggaggaaggtttagaaagacgatggggacagcagtaggaaggagctggggaggggggtcaaggtggcaagcagagctgggggcccagagtccgctcccgtgccgcgcggcgagtcgcttacatgcccaggtcgctgtaggtgttgaagaactccatctgattgcacgcctgaatccagcccaccacccaggtctcgtggcgggggatggggggcatgaccacgcgggcggaggctttgaagtagggggtcttgtagcgcaggacgatgggcgaggtctcctcgatgcgcgtggggcactggtcgatggtggcgcacacatcgtacaccacgatgttctcgcgccggatccgcgccttgcaggtgatgctttggatacagcccatcctgcagcccggtgccggcacggcgcggcgtggggcagcgcgggggcccgcgcgggcagccgggggcgcccgtcacgccggcatggcgacgcgccgctcgc

SEQ ID NO: 103299 - DNA, 19 bp, Homo sapiens
  chr1:166312814-166312833
  Hypo
agcacgctgtcacctctca

SEQ ID NO: 103300 - DNA, 230 bp, Homo sapiens; identical to SEQ ID NO: 68049
  chr1:166360872-166361102
  Hypo

SEQ ID NO: 103301 - DNA, 18 bp, Homo sapiens
  chr1:166479382-166479400
  Hypo
aggcgtgagccaccgcgc

SEQ ID NO: 103302 - DNA, 94 bp, Homo sapiens; identical to SEQ ID NO: 68051
  chr1:166853653-166853747
  Hyper

SEQ ID NO: 103303 - DNA, 354 bp, Homo sapiens
  chr1:166916746-166917100
  Hyper
gaacgcaagcctgcacgcctgaatagcggcagctggctttggagaaaaatgggacaactgtctcctgcccggctttcaagagctgccattctttctttccaggggctgagccaatttctcggtgccacccactctcgcgcctgcccccagcccccgtttcctcccccgctcgggccggcgcgggtccacccgactacaatgcagcgcgcggctgacccagctgctccggctcctgcccggggtaaccacggtaaccgcgggccgccaggaatgcgcgctaattgaaggccgagtttcctcccacagtgatgagcaacaagtgaagcaaaaatagtgaggcggaataaaggctgc

SEQ ID NO: 103304 - DNA, 196 bp, Homo sapiens; identical to SEQ ID NO: 26708
  chr1:166945272-166945468
  Hyper

SEQ ID NO: 103305 - DNA, 30 bp, Homo sapiens; identical to SEQ ID NO: 68056
  chr1:166958831-166958861
  Hypo

SEQ ID NO: 103306 - DNA, 30 bp, Homo sapiens; identical to SEQ ID NO: 68058
  chr1:167274768-167274798
  Hypo

SEQ ID NO: 103307 - DNA, 30 bp, Homo sapiens; identical to SEQ ID NO: 68059
  chr1:167340601-167340631
  Hypo

SEQ ID NO: 103308 - DNA, 30 bp, Homo sapiens; identical to SEQ ID NO: 68061
  chr1:167393583-167393613
  Hypo

SEQ ID NO: 103309 - DNA, 77 bp, Homo sapiens; identical to SEQ ID NO: 68062
  chr1:167505794-167505871
  Hypo

SEQ ID NO: 103310 - DNA, 30 bp, Homo sapiens; identical to SEQ ID NO: 68063
  chr1:167525159-167525189
  Hypo

SEQ ID NO: 103311 - DNA, 769 bp, Homo sapiens; identical to SEQ ID NO: 68064
  chr1:167599108-167599877
  Hyper

SEQ ID NO: 103312 - DNA, 30 bp, Homo sapiens; identical to SEQ ID NO: 68065
  chr1:167608107-167608137
  Hypo

SEQ ID NO: 103313 - DNA, 38 bp, Homo sapiens; identical to SEQ ID NO: 39144
  chr1:167789113-167789151
  Hypo

SEQ ID NO: 103314 - DNA, 98 bp, Homo sapiens; identical to SEQ ID NO: 68067
  chr1:167823344-167823442
  Hypo

SEQ ID NO: 103315 - DNA, 16 bp, Homo sapiens
  chr1:168004664-168004680
  Hypo
acggagtgagactctg

SEQ ID NO: 103316 - DNA, 30 bp, Homo sapiens; identical to SEQ ID NO: 39146
  chr1:168058977-168059007
  Hypo

SEQ ID NO: 103317 - DNA, 34 bp, Homo sapiens; identical to SEQ ID NO: 68070
  chr1:168116121-168116155
  Hypo

SEQ ID NO: 103318 - DNA, 77 bp, Homo sapiens; identical to SEQ ID NO: 68071
  chr1:168150740-168150817
  Hypo

SEQ ID NO: 103319 - DNA, 43 bp, Homo sapiens; identical to SEQ ID NO: 68072
  chr1:168151281-168151324
  Hypo

SEQ ID NO: 103320 - DNA, 637 bp, Homo sapiens
  chr1:169396286-169396923
  Hyper
taagctactctcagacgagtatccttcatacatagtgaagaaaggtgttaccagacttccccaccagtgccagactcggtggacctcggactccagaggataaggcgccaccagaaagcttcttccctcactacctaccctccctcccagctataccagacgtttatacctttaccctctatcccaccattaacatctccgcatcgtccttcccttctctccctctatatccctcttgcctgtgtaaaatgcggcggctgggatcacagagatggccgggggagttctcctctcctcctctttctaagctcttcacattgaggcaaaggagaccccggcacctgcctccgcggcagccaggaccacactgccatggcaacagcgtgcctctgcgtcctccatccgggcctctctaactacgagagcgacaaaaatctgcgcaggcgcatgcaatatcctcagaccaccgacccctcccggcacccatcccggtgcttgcgaagggccagtgaagctgaggtttctaaggggacgactaaggaatccacgcatcactaacgttatagagactcgcgaagtgccgctgtgttggttgtgaaatttccctcttgtagctgtctctcgtcagatttagaat

SEQ ID NO: 103321 - DNA, 26 bp, Homo sapiens
  chr1:169457163-169457189
  Hypo
agagcgagactcgcgagtactcgtct

SEQ ID NO: 103322 - DNA, 39 bp, Homo sapiens; identical to SEQ ID NO: 68080
  chr1:170629373-170629412
  Hyper

SEQ ID NO: 103323 - DNA, 63 bp, Homo sapiens
  chr1:170629999-170630062
  Hyper
tggttgatattaacacgaatgacaagtgggtgattttcaagaagcgcccggtccctctagaga

SEQ ID NO: 103324 - DNA, 1304 bp, Homo sapiens
  chr1:170630336-170631640
  Hyper
acagcaacgttaaaacgcaactgtgtaaatgaggatagagagtgcgaaaggagggagaggcgaggagctgctctatttctagggaggttttggggagactgatcagctccaaggacagaccgctgggaagggaaaaacggcccacatcgaactggatgccggatggaaacctctctgcgctattagactgcgtccagtacagcagatggcacgagcacgtgcggcgctcagcttaggctctcggaggcagctgagttggaaatcccgacggaaagcacccacaagctcccactctgcgctggcccacccgcgtgcacgcccaccccccacgcgcgtccctggctcagaagcgcacagatgtttactgcttagagccggtaccgctggggagatcgagcgacttgcgcggcgcacagtgcggcgctggcagggctctgggctcccggtcgggggttcgagcggccaagggatgggggtgggggcggggagagtggggggagggcgaaagaccgccgagaggaggggggagtgggtggactaatgatgaaaaagtctcctccatcccagttccttaattaaatgcatggaaagaaccgaggcgagcacatctggtttcaatctacagccctttgatggcatcaaatgttcttttcccagatcagggctggaagttctgggctaactatggccgtttggagcccagaaaccatttacacacactcgtacccttctttctctccagtcgagcctcttgactataggacgaaaaaaaaaaaaagtctagcaatcaagggagtgcgggagtacggatgcgtgtgtgtgtgtgtgagtgcgcgtttaaagaacataaaacgccacaaataagcacttaatattttactgagtcgtcatacagtaactcatttctaatgagactgttaaagctgttaccaaattccaacaggtcatgaaaaaactgctcagcacctctctgtcttctgtcaggttagggctccgcagacggacgacagaggattatccgtagacttagatgggggttcctccgcccctctctgtcctcctgccaccacagccaggctggacgcagaaccgcacggaagcctccccaactcctgcctctgggagtgctcctgcctgcttcaaggaatctgggcagcgggaccctctgggtttagcgtcctcgcctggggaagcaactttggccttaccgtagaagttacaaaattggcgggggtagggagaaagattataatatatatttggagtcctttcttccagtttaataaacacgtacttttctcatt

SEQ ID NO: 103325 - DNA, 33 bp, Homo sapiens; identical to SEQ ID NO: 26717
  chr1:170633073-170633106
  Hyper

SEQ ID NO: 103326 - DNA, 256 bp, Homo sapiens; identical to SEQ ID NO: 68084
  chr1:170633381-170633637
  Hyper

SEQ ID NO: 103327 - DNA, 391 bp, Homo sapiens; identical to SEQ ID NO: 68085
  chr1:170633892-170634283
  Hyper

SEQ ID NO: 103328 - DNA, 168 bp, Homo sapiens; identical to SEQ ID NO: 68086
  chr1:170637642-170637810
  Hyper

SEQ ID NO: 103329 - DNA, 586 bp, Homo sapiens
  chr1:170640121-170640707
  Hyper
agaagctctaattcccgagaactttggggcttatttttaccatcattgagtctgcccaggctcagctctcttacaaaggtataaatctgaaattcatgtattaatttgaatccccaagatccgagttatgagaaagggcaagggcaggctctactcctattttgtttactttcaccgagttactgtgaagtgattggaaactttcttaacgggcagagagagaatacacggaaactcggatgcagtaataaagttgacataggagtcggaacagggggctctttttggatctcacctttactggggcttgaggttgtggaatgggtggaagagtaattaactgaatgaagaattttaacgttgaaaacagagcccacagtatttttggttatagtggtgtggtctctgcctcggcaaagaaacaaacacccccaccccatcttcgcagttctcctctctgctgtagcgacgccaggcgctgctttccgccgggtaaattagcggcgagcctcgccagacgctttcctccttgccttctttcgccgaaagggggcgcgctcctcccaggctgcgctggtacctatcc

SEQ ID NO: 103330 - DNA, 120 bp, Homo sapiens; identical to SEQ ID NO: 68089
  chr1:171452989-171453109
  Hypo

SEQ ID NO: 103331 - DNA, 56 bp, Homo sapiens; identical to SEQ ID NO: 68090
  chr1:171555005-171555061
  Hypo

SEQ ID NO: 103332 - DNA, 37 bp, Homo sapiens; identical to SEQ ID NO: 68091
  chr1:171625525-171625562
  Hypo

SEQ ID NO: 103333 - DNA, 30 bp, Homo sapiens; identical to SEQ ID NO: 68092
  chr1:171707361-171707391
  Hypo

SEQ ID NO: 103334 - DNA, 111 bp, Homo sapiens; identical to SEQ ID NO: 68093
  chr1:171731284-171731395
  Hypo

SEQ ID NO: 103335 - DNA, 1443 bp, Homo sapiens
  chr1:171810200-171811643
  Hyper
cctgggaggagtcatcgcggattctggagaagggcgtgacagaggagatttcctttcgggaagtgtagtctggcagcggtgccccggtggtggcggcggcggtgctgctgttgctggtgatcgtgtggtggtgttagcggcgatagtgctttccactgggctttggcttggtagccgctgaaagagaacaacgctgccgctgctgctgatttcatgccatttcctgacccggcgctgtaacttggcctctgagccttggccacagaacgcagaggccgtggcatctggccgcagctgggctgcagtgcgtgcgcgcctggcctggtggtccgatgggaagcccggggcggggcagccgcggggcgggggcggggcgtcgcggagataggccacgcccctgcccgcccgcgcaggcgcgctgcgggtcgttagctgtcagagccaagcggcgggctggcggcgggctccgacgtctgcgccaggacctggctggctgagcccggcgcagcagcagcagccagggcagcgcggcccctactccctgtcaggtcgtagaggcgagcagggaccagctggtcgccggcccctcgggcaagatggggaaccgggagatggaggagctgatcccgctggtgaaccgtctgcaggacgcgttttcggcgctgggacagagctgcctgctggagctgccgcagatcgccgtggtgggcggccagagcgccggcaagagctcggtgctcgagaacttcgtgggcaggtaagcgcgcagggcgcggagtaaggatgcggcagtggggcgaccccgctgcgggccgttggaacgtggacgggcagcgggagccagagggtggatggaccaggcgctgcggtggaatggggggcagagtggaatggggggcagagtggcggtgtccgtggggcgggcggggtcctccagctctgggcatcctccgtcccctgccaccccccgcctggtggccctcctgcctgcctttcatcgtgcgatacaaagccatttcctccctgtcctccagtcggggagtcgggggaggggtccgccccgggctcgacccccaccccctcggtgcgcgccagccccgggcagcctccctgcgtagcgcgccgaaagcttcccagtgcccctctcctgttttcccagctcaacacccccctccttttcctgtcgccctccgtgaggctccctgtgaggctgtggggctttatcccccgagccccctcccttaggtggagatgctttccttctcgccagggttctcgttcctctcagctgtctactgttgcctgcctctagctggggaggcggggtgcgaggagaaagacgtcgtttgttgtggtgaagctttatccagagacgcttccccaccattctcctcccggagagtcgaagaataaaaggtggtgtgtttgcgtgtgcacctattc

SEQ ID NO: 103336 - DNA, 30 bp, Homo sapiens; identical to SEQ ID NO: 68097
  chr1:172815503-172815533
  Hypo

SEQ ID NO: 103337 - DNA, 17 bp, Homo sapiens
  chr1:172902655-172902672
  Hypo
atagcagacttgggccg

SEQ ID NO: 103338 - DNA, 16 bp, Homo sapiens
  chr1:172943420-172943436
  Hypo
ccgtctcaaaaaacta

SEQ ID NO: 103339 - DNA, 30 bp, Homo sapiens; identical to SEQ ID NO: 39153
  chr1:173090762-173090792
  Hypo

SEQ ID NO: 103340 - DNA, 61 bp, Homo sapiens; identical to SEQ ID NO: 39154
  chr1:173477004-173477065
  Hypo

SEQ ID NO: 103341 - DNA, 411 bp, Homo sapiens; identical to SEQ ID NO: 26726
  chr1:173638647-173639058
  Hyper

SEQ ID NO: 103342 - DNA, 146 bp, Homo sapiens; identical to SEQ ID NO: 68103
  chr1:173794930-173795076
  Hypo

SEQ ID NO: 103343 - DNA, 82 bp, Homo sapiens; identical to SEQ ID NO: 68104
  chr1:173897008-173897090
  Hypo

SEQ ID NO: 103344 - DNA, 21 bp, Homo sapiens
  chr1:173897630-173897651
  Hypo
aagctccgtctcgaggaaaaa

SEQ ID NO: 103345 - DNA, 84 bp, Homo sapiens; identical to SEQ ID NO: 68106
  chr1:173993036-173993120
  Hypo

SEQ ID NO: 103346 - DNA, 30 bp, Homo sapiens; identical to SEQ ID NO: 39158
  chr1:174421982-174422012
  Hypo

SEQ ID NO: 103347 - DNA, 38 bp, Homo sapiens; identical to SEQ ID NO: 68111
  chr1:174956311-174956349
  Hypo

SEQ ID NO: 103348 - DNA, 47 bp, Homo sapiens; identical to SEQ ID NO: 68113
  chr1:175048461-175048508
  Hypo

SEQ ID NO: 103349 - DNA, 89 bp, Homo sapiens; identical to SEQ ID NO: 68114
  chr1:175346485-175346574
  Hypo

SEQ ID NO: 103350 - DNA, 504 bp, Homo sapiens; identical to SEQ ID NO: 68115
  chr1:175354872-175355376
  Hypo

SEQ ID NO: 103351 - DNA, 347 bp, Homo sapiens; identical to SEQ ID NO: 68116
  chr1:175365589-175365936
  Hypo

SEQ ID NO: 103352 - DNA, 78 bp, Homo sapiens; identical to SEQ ID NO: 14308
  chr1:175372494-175372572
  Hypo

SEQ ID NO: 103353 - DNA, 246 bp, Homo sapiens; identical to SEQ ID NO: 68118
  chr1:175375200-175375446
  Hypo

SEQ ID NO: 103354 - DNA, 18 bp, Homo sapiens
  chr1:175388664-175388682
  Hypo
aattcctctgtggcacga

SEQ ID NO: 103355 - DNA, 30 bp, Homo sapiens; identical to SEQ ID NO: 68120
  chr1:175415084-175415114
  Hypo

SEQ ID NO: 103356 - DNA, 30 bp, Homo sapiens; identical to SEQ ID NO: 68121
  chr1:175421411-175421441
  Hypo

SEQ ID NO: 103357 - DNA, 30 bp, Homo sapiens; identical to SEQ ID NO: 68122
  chr1:175463981-175464011
  Hypo

SEQ ID NO: 103358 - DNA, 152 bp, Homo sapiens; identical to SEQ ID NO: 68123
  chr1:175472199-175472351
  Hypo

SEQ ID NO: 103359 - DNA, 35 bp, Homo sapiens; identical to SEQ ID NO: 68124
  chr1:175861012-175861047
  Hypo

SEQ ID NO: 103360 - DNA, 20 bp, Homo sapiens
  chr1:176318951-176318971
  Hypo
cagcacgctgtcacctctca

SEQ ID NO: 103361 - DNA, 104 bp, Homo sapiens; identical to SEQ ID NO: 68126
  chr1:176694805-176694909
  Hypo

SEQ ID NO: 103362 - DNA, 718 bp, Homo sapiens
  chr1:177133445-177134163
  Hyper
agtgggtgtgtagagcgagctggagtggggggtgggggcgccggtccagcgcctccggccgcctcgacctcccccgggactcacccagcacgaagtagggcagctccgtgttctccaggtcgtccaccacgaccatttctcccgggaagtcgttgcgcaccgagaagaggagcttgggctccgaggccgaggggctgtgcatgatgctcaggtcgttctcgcgcaggaagggcagtgccgacaccgtgatgcttttgagcttgcactccagctccttggatggatccacgtcgccggcggccgtggccagcaccgccgccggcccccagcagcaggcgagcagggcgcagagcccggctaaagccatcttgagccccggccgccttcctcctagcgctgcgatggtgggggaggaagcgagcggggagggagcgagggagcgagcgcgggaggcgggggaggttagggaggggatggagagccgggagagccctggaccccggaatgagatgccgcttgcagagtcctgggtttaagctctgatgtctggagagccccggattctttgtttcccggagctgcttatctggagaagggaaagcgggggaggggggagaggagaaaaagggaaggaaggacgtcgaaaggaaagaggaagggagctgaggattctagggaatcaggtcagcccccagctggctgccggtgctcctgcctc

SEQ ID NO: 103363 - DNA, 589 bp, Homo sapiens
  chr1:177140105-177140694
  Hyper
gacactgcttaggtacggagcgcggagtcggagcggggacgcgccgggctgcagctctgggatgcaatccgcctgcctcgcaagctgctcgccgctgcgctggcagcgcttacgctgagctcggaggatcccattaggacttgcccggggatgtgcacctgccgtgcgctccgaggtcagtggcaggtctgcaggcagccgagggagcggtgaagccggaagacctgtctctgcccatgtgcaaggcagtgatttcgggtgagagagcgggtgggtgagtctctttagagttggaaagaaggcaaaatcttgggtttctcctcggcggagggacaggggactcccccagttgggtcttgcacttcccttacctctcccaccccgcgtgcgccccggcccagtgccgaagccccacttcaaagatgctctgggagaccgggatcctggctgctcagcgggaaggcagcaggcaagtggtctaacgttggcggcggtggcggtggcggcggcggcggcaccgacagtaaagcggggagcaagagaatttgaaaagagacatccgctccctctcacacgctgagggggaggc

SEQ ID NO: 103364 - DNA, 481 bp, Homo sapiens; identical to SEQ ID NO: 26732
  chr1:177150773-177151254
  Hyper

SEQ ID NO: 103365 - DNA, 46 bp, Homo sapiens; identical to SEQ ID NO: 68138
  chr1:178006897-178006943
  Hyper

SEQ ID NO: 103366 - DNA, 108 bp, Homo sapiens; identical to SEQ ID NO: 68139
  chr1:178063625-178063733
  Hyper

SEQ ID NO: 103367 - DNA, 45 bp, Homo sapiens; identical to SEQ ID NO: 68140
  chr1:178531753-178531798
  Hypo

SEQ ID NO: 103368 - DNA, 30 bp, Homo sapiens; identical to SEQ ID NO: 68141
  chr1:178617443-178617473
  Hypo

SEQ ID NO: 103369 - DNA, 16 bp, Homo sapiens
  chr1:178665797-178665813
  Hypo
gcgacagagccagact

SEQ ID NO: 103370 - DNA, 30 bp, Homo sapiens; identical to SEQ ID NO: 39167
  chr1:178857986-178858016
  Hypo

SEQ ID NO: 103371 - DNA, 280 bp, Homo sapiens; identical to SEQ ID NO: 68145
  chr1:178994064-178994344
  Hypo

SEQ ID NO: 103372 - DNA, 30 bp, Homo sapiens; identical to SEQ ID NO: 68146
  chr1:179050657-179050687
  Hyper

SEQ ID NO: 103373 - DNA, 36 bp, Homo sapiens; identical to SEQ ID NO: 68147
  chr1:179262288-179262324
  Hypo

SEQ ID NO: 103374 - DNA, 26 bp, Homo sapiens
  chr1:179333328-179333354
  Hypo
tcatgcctgtaatcccggcactttgg

SEQ ID NO: 103375 - DNA, 588 bp, Homo sapiens
  chr1:179544716-179545304
  Hyper
aatccgtaccttcctcgggccgctcgctctccaacagcgccaccacctcggtgccctcctcgccggagcctcggacctcatccacgtccaccaccgtggcggcgggcgctcggggctcccccggggtccccgcccgtccggagcccgacggctcgggcccagcctcctggcgcccgcggcctccgccgctcctctcggcctttgccctcttgttctccttgtgcggagtcctgccgcctcgcccgcgggactccctggaggagctccgcgccctcctctccatcctcagagctgccgggcggctggagcagcagcgcgggagcgctaggggcacgggagcgcagtccctgtggagtcgctgcgggtccgcgtggcgtgcccgggggaccctaaagaccgtcgggtgggggctgagggcgaggggcgggacaccggggccgcgggcggggcgcacccggaaccccgacagctgtgtcttggtggagctgtggactgcgcccgccgactcccacggccggggcggcgctgaagcagagagaggcctgggtgggagagccggccccgggcagggtgcgggcgttgaaaagt

SEQ ID NO: 103376 - DNA, 29 bp, Homo sapiens
  chr1:179704902-179704931
  Hypo
gctgggataacaggcgtgagccaccgccc

SEQ ID NO: 103377 - DNA, 1568 bp, Homo sapiens
  chr1:179711932-179713500
  Hyper
tgactgatctgatcccgccctgccacgaggcccgggtacccctcagcggcggggacatccaggtgtccctggatttccagggcacagtgcgggccggaaataggaacacagaggagcccttcgggaggctctcgaggcagtctctttccagtggatagcgacacaccctggtccctaagattctcatgctctccgaattttccgtcctggacccgatctgtagggcgcaaagtcccctgtactgaggcgttcccagggcgcccgcctcccgcgtttacatttcttaggcaaaaaggcagcggagctaagcaggggtgtttggaaggcgcccgttgcgctgtttgactgcgtggcttcacttggcccgcgtgcatcagcctctctggcgggggattctccccggactccggccagcgccaatcaggtcgcgcggtacctgcccccagccctggccacctggaggggcgatgaggctccacgcccggagcagggcagtcctcggagcgccggggaggccgcggagcctcacgtgtgccgccccagccgctggcgcccggaaggacgcgctgcgaccccgtgggagccgaacgcgggagtcgctgcccgagcggagctgctcagccgcggtaacgggtcggggcctcatcgtgcaggggagcgagcggaggggcggggcggggcgcgggcgggctgaggagccgccgggctcgggctccgcgcggggatgtgtctggccaccgcgtactttcgagggcgcctcaacacccgggtaagcgcgccccggctgcctccctctgcccaccgcgccgccttcagcgtagcagttccccactgggtctgggtctgcgccctggctctccctctccgcgccaggggcctctcgctccgaggggcgcggcgactcgggggcatctccggcctcgtggccagaccgcgggtggcggtgctcgcgcctcggggccggacttgccgggtccctgcccccgggccgtgccgaaggcgctctactcagcgtgtctgcagcgacccgcttctctgcgctttcagccgggccggacctcacgcggacgccgctgctgctgctgcgcctcgcgcccgccgccacccggggagcatgaggccggggcaggggacccgggtagggtgggggccgaccggcggggtctgctgggccaatgcgccgccgtcggtcagtgagtccggattcgtgccggcaactgtgggcagccttgagaccggggctcggtttgctggtgatttttccgaagttttacaaaataaagagggcgaagtgccttcgcggcgcggcgtgggcatgcaggcggcagggcctgtgggagccggcgtctcggccagcgagtctggggccaggacagcgggggtaggacggagaagccggacgtgcccgtggggccgcggtgtccttgctcccgaggccccagagcgggcgaccgcactccgattccagagggccctgcgcgctcaaggcgccggccacacggaagcctccgccccgcggcccagaggggggcctggccaagcagagagcagagcgggcaagcagaagg

SEQ ID NO: 103378 - DNA, 209 bp, Homo sapiens; identical to SEQ ID NO: 68157
  chr1:179743860-179744069
  Hypo

SEQ ID NO: 103379 - DNA, 188 bp, Homo sapiens; identical to SEQ ID NO: 68158
  chr1:179781711-179781899
  Hypo

SEQ ID NO: 103380 - DNA, 30 bp, Homo sapiens; identical to SEQ ID NO: 14309
  chr1:179849955-179849985
  Hypo

SEQ ID NO: 103381 - DNA, 30 bp, Homo sapiens; identical to SEQ ID NO: 39172
  chr1:180096076-180096106
  Hypo

SEQ ID NO: 103382 - DNA, 30 bp, Homo sapiens; identical to SEQ ID NO: 39173
  chr1:180137119-180137149
  Hypo

SEQ ID NO: 103383 - DNA, 616 bp, Homo sapiens; identical to SEQ ID NO: 68162
  chr1:180198061-180198677
  Hyper

SEQ ID NO: 103384 - DNA, 44 bp, Homo sapiens; identical to SEQ ID NO: 68163
  chr1:180201524-180201568
  Hyper

SEQ ID NO: 103385 - DNA, 1057 bp, Homo sapiens
  chr1:180202237-180203294
  Hyper
aaatccagcttatttcggcggcagctggactattcctttgcttatttggggatgggtgaggggcataccctttaggaaaacgtttccaaatgatgtaataatttctctctcatctctggtcttgctccagacttggcctcttcctcgccactctgtcccggcctcccgcccccgcaggctcccgtgcggacttagcagttcgcgccgtagccctcctggttttttaccgcgccttggtcgcgcggcccccggtgcgggcctcgtcgctccgacagccctacagctgtccctacggcccgcaccgacagctcgtccccgccacctccctccgggctgtagggacgtcgagatccgaatcctcacagcgcctgacccggggccgtgttgggtacgggtacggcgagagccttccgagccgcctccaaaactctccccgcggacctcagcagtccctccacgcgtcggggccctgctggccggccatgccctctgaggagacgcggaaaagagcgaggcatataggaaggtggggcgttttatccgcctcggttttgacccatctgccatgtagtctccccaggcaccgagggaaaggacgacggaagcccgccgcccggatcgctggcgggagagagggcagcccgcacgggagaaggaggagccccgcggggtctccgctgggggtggtaattggaatgcaggcctgggggtctctgtccccctccttgtctcctaaaatgcttccggcaagctctggcgaaccccgaagctgtaggaaaaaggtattttattttgtgtttggtagggtcggggtaaaggttttccctgggacttcctctcctggggctcctccggggtgcgtggggtaatgtcccagcgcaggtcgagttgcagatccgagtccccggggttgttgactgtccttcttgcaggacatttcttaagggggtgagatggattcactgtccaagacaggagttcactcaaacgctggtgctgttcgctcttctttccattcctgccttgtctcctagtgcgagaaacagacacacacaac

SEQ ID NO: 103386 - DNA, 2017 bp, Homo sapiens
  chr1:180203354-180205371
  Hyper
taatagattgagattctatcatattccgaacattccgatatagcagctgtaggcaccatagacctccctccctgcgtcgcgagaatatattctcaggcaggagacaatttttacagatgaggtcagctgtccccgccggccgattcgggcctgatgggttgggggttccgatgtcctaactgctaggatcccgttccagcccctggccagagctgtgtaccacaaagaagggagtttggagaaacccgggtaagcgcggcagcgccccgcttgggacagcggatggctgaggactcccaaggggcgagagggctccggcctcctcctttccagggccttgttatctgagagggccgttagcacggagggaagcttggaaagccgctgtcccagtgcgctccgcatgcggaattaactgttaaagccggacacggagcacgcaggtgcagcaggtgaggggcaaaggtctgcattgagcagtccgcagtgtcccgggaagtcgtaaagtcgggactgagaagaagcaggacctaactcaagtttatttcctctcttggccgaggtccgggctcgtggaaaaccagagctaggcggggctacgcagggctgagcaggagtggcgtcctagggtctgggagcgcgacccacatgacctcgctacgaccggggcagggctcctccgccccgcgggcagatgccggcctgggtggcccggggaacagacgatgaattctttaaatgagcgtttgctgcgcacccatgggcggctcacgatcctgggcactcgcccgggaatcccgggcgtgctctgggttttgggggactcgccggtggaggtagatgtggacagggcggccggcccttcgcgggtagccggctttgcgcttactgcgtcccgcagcggtgggtaaaggtcgtagcccagaaggggacaagggagggaccgcctctctctccccggtgcgctgcaatagaggttcctgcgccttggcccttgcagtccatccgcccagaggttcgcgcccgttttcggagcttattatctcaggtagcccagaggtccgactgagctggaattagccaggcctgggacccctttgctgccctttagagtggtggcagggacttttccagcaaggataggcgcggcaggcgcgagtgcggacggcgcgcccattaggaggaggccgggtgaaaacctctcttcctctccagacccatttcgttccaagcatttggaatgacaaaattaaaccccaaccctggcggctcgagtctaatgtgactgtttaaccctgggaaagcgatgctcccattttcgaaggggctcctcctcttcggagcggggaggccgccggcgggtgtgcccggcccgcgcgttctgcgggtgttcgagcctcggctccccactcggttccgcagcttagtggaccttgacgagcgctggaaacgtgtcaggctccagagagacagagtctctacctaggcggctgaggatgtcaattaaaatcgaccagggaagggagttggcggcactgtgcgccgccggggaaggcgaggtggcgcgggccaccgggtgcactcaccgcacgagaggccgcggctggactgggaccgagcgcatccctgtgtctcagggggtttgctttgtgcaggatgggaccttattatttttagacagtggggcaaacgtgtcttttaaagagatccgaagggtgaaactaatgaaaaaggaaatgaattactagaaaagccgtgaagggataaaaccgggagcagcaggaagttgaaggaaggacgaccgaagctaggtgtatctgcacctgcctcttgacacgccaaaaacaaaggggggttaaggcaagaatgtagactaaatgctgtgaggattagggtaacgcgagccctcaagacgtctcggagaccgcctacagggctgcaaataccagggtccatttttaaaaatcgagtgctcctagaggtggggtgggggtgggagagccgggaaaccagcaaa

SEQ ID NO: 103387 - DNA, 60 bp, Homo sapiens; identical to SEQ ID NO: 26748
  chr1:180206312-180206372
  Hyper

SEQ ID NO: 103388 - DNA, 264 bp, Homo sapiens; identical to SEQ ID NO: 68171
  chr1:180235531-180235795
  Hypo

SEQ ID NO: 103389 - DNA, 239 bp, Homo sapiens; identical to SEQ ID NO: 68173
  chr1:180881341-180881580
  Hyper

SEQ ID NO: 103390 - DNA, 428 bp, Homo sapiens; identical to SEQ ID NO: 26750
  chr1:180882004-180882432
  Hyper

SEQ ID NO: 103391 - DNA, 30 bp, Homo sapiens; identical to SEQ ID NO: 68175
  chr1:180885601-180885631
  Hypo

SEQ ID NO: 103392 - DNA, 32 bp, Homo sapiens; identical to SEQ ID NO: 68176
  chr1:180891177-180891209
  Hypo

SEQ ID NO: 103393 - DNA, 30 bp, Homo sapiens; identical to SEQ ID NO: 68177
  chr1:180896448-180896478
  Hypo

SEQ ID NO: 103394 - DNA, 30 bp, Homo sapiens; identical to SEQ ID NO: 39175
  chr1:180910386-180910416
  Hypo

SEQ ID NO: 103395 - DNA, 99 bp, Homo sapiens; identical to SEQ ID NO: 39176
  chr1:180925089-180925188
  Hypo

SEQ ID NO: 103396 - DNA, 30 bp, Homo sapiens; identical to SEQ ID NO: 68180
  chr1:180925404-180925434
  Hypo

SEQ ID NO: 103397 - DNA, 22 bp, Homo sapiens
  chr1:181013386-181013408
  Hypo
ctgcgcccggcctgatcttttt

SEQ ID NO: 103398 - DNA, 47 bp, Homo sapiens; identical to SEQ ID NO: 68182
  chr1:181286584-181286631
  Hyper

SEQ ID NO: 103399 - DNA, 149 bp, Homo sapiens; identical to SEQ ID NO: 68183
  chr1:181286935-181287084
  Hyper

SEQ ID NO: 103400 - DNA, 897 bp, Homo sapiens; identical to SEQ ID NO: 68184
  chr1:181287305-181288202
  Hyper

SEQ ID NO: 103401 - DNA, 179 bp, Homo sapiens; identical to SEQ ID NO: 68185
  chr1:181381915-181382094
  Hypo

SEQ ID NO: 103402 - DNA, 1063 bp, Homo sapiens; identical to SEQ ID NO: 68186
  chr1:181451296-181452359
  Hyper

SEQ ID NO: 103403 - DNA, 419 bp, Homo sapiens
  chr1:181452691-181453110
  Hyper
ttcaacagttcacagcggcgggctgctgctgctgcctctccgaagagctcgcggagctccccagaggcggtggtccccgtgcttgtctggatgcggctctgagtctccgtgtgtctttctgcttgttgctgtgtgcgggtgttcggccgcgatcacctttgtgtgtcttctgtctgtttaaacctcaggatggctcgcttcggggaggcggtggtcgccaggccagggtccggcgatggagactcggaccagagcaggaaccggcaaggaacccccgtgccggcctcggggcaggcggccgcctacaagcagacgaaagcacagagggcgcggactatggctttgtacaaccccattcccgtccggcagaactgtttcaccgtcaacagatccctgttcatcttcggagaagataacat

SEQ ID NO: 103404 - DNA, 736 bp, Homo sapiens; identical to SEQ ID NO: 68189
  chr1:181454613-181455349
  Hyper

SEQ ID NO: 103405 - DNA, 312 bp, Homo sapiens; identical to SEQ ID NO: 68191
  chr1:181701511-181701823
  Hypo

SEQ ID NO: 103406 - DNA, 44 bp, Homo sapiens; identical to SEQ ID NO: 68192
  chr1:181727256-181727300
  Hypo

SEQ ID NO: 103407 - DNA, 49 bp, Homo sapiens; identical to SEQ ID NO: 68193
  chr1:181767758-181767807
  Hypo

SEQ ID NO: 103408 - DNA, 101 bp, Homo sapiens; identical to SEQ ID NO: 68194
  chr1:181922685-181922786
  Hypo

SEQ ID NO: 103409 - DNA, 238 bp, Homo sapiens; identical to SEQ ID NO: 68195
  chr1:182026109-182026347
  Hyper

SEQ ID NO: 103410 - DNA, 30 bp, Homo sapiens; identical to SEQ ID NO: 68196
  chr1:182270970-182271000
  Hypo

SEQ ID NO: 103411 - DNA, 382 bp, Homo sapiens
  chr1:182584162-182584544
  Hyper
agagcagcaaatatccgcggctcgccgccccgggctctgtggcaccatcagcagcttgcgcaggacacagacgtcggctcacgcgccgcagccctcggccccggaagagccgcggccgcggagcagcgaacgcgtgcctgccagggaaaagcagtcaccaggaacgcggcgttttggtcggctgcccatcgccagccctgtccgcgcgagatgccctgctccgaagctcttgtgagctccgcggcctgcggctccggaaggcgaagctcttccaggaagcagcggcggccccactggccctctcaggctgcggagaaagggcgggaggccgcggggctctccaggactcagtggtttcggagaaactcgacttcccaggctc

SEQ ID NO: 103412 - DNA, 30 bp, Homo sapiens; identical to SEQ ID NO: 68199
  chr1:182650639-182650669
  Hypo

SEQ ID NO: 103413 - DNA, 63 bp, Homo sapiens; identical to SEQ ID NO: 68200
  chr1:182758405-182758468
  Hyper

SEQ ID NO: 103414 - DNA, 29 bp, Homo sapiens
  chr1:182807578-182807607
  Hypo
gccaggcagaatgcccgccttcactgagc

SEQ ID NO: 103415 - DNA, 21 bp, Homo sapiens
  chr1:182815386-182815407
  Hypo
tttgagatggagtttcgcttt

SEQ ID NO: 103416 - DNA, 30 bp, Homo sapiens; identical to SEQ ID NO: 68203
  chr1:182911546-182911576
  Hyper

SEQ ID NO: 103417 - DNA, 68 bp, Homo sapiens
  chr1:182922085-182922153
  Hyper
cgctttccccttcaccgggcgaggggaggccaccaccgaccgcactgggatcgcggtgcccttcaggg

SEQ ID NO: 103418 - DNA, 234 bp, Homo sapiens; identical to SEQ ID NO: 68205
  chr1:183058613-183058847
  Hypo

SEQ ID NO: 103419 - DNA, 158 bp, Homo sapiens; identical to SEQ ID NO: 39180
  chr1:183129382-183129540
  Hypo

SEQ ID NO: 103420 - DNA, 30 bp, Homo sapiens; identical to SEQ ID NO: 68207
  chr1:183204607-183204637
  Hypo

SEQ ID NO: 103421 - DNA, 1797 bp, Homo sapiens
  chr1:183385871-183387668
  Hyper
gaggtttttaacaagcgagcccagttcagcgcaccttttaagtttaaagatgaatatttttagcctaagccacctcgccctgtctttaccgctgtggtgtggttttcactaaacctccctaggagggctcgcgcagtcctcaggctccggataaacacgtgtgcccgcatccagctccggcgcgccctgcatttcagcaccgccgcctctggagagcgccttgctggcgggccaggtcagggcctcccacacgctctctcatccatcccagcccactcgcttttccctactcctcgcttctctcagtttcaagaaaaagcacccccaacttctaacttctcaattcctgcttctaaagtgacctccgcgtccctctttccgtgtctaaacgctcatgccccacgcctttgagtcctacgagcagctgcgaagccgcgtggcttcccaccggtggcgcgagacctccaataggcatctatcgatcacctttcccctaccgctgctggaccccgaaccagccagccggatgcccccgctcgctctctctgactccacgccccaaagcttctaagaaacaaacgcgcgataagtcccctccccccaacacgcacacgcatatactcacacacagtcattcgcacattcgtacacacactagacgcctcaagccttccgagtgccatcgccaccctgggcagagcctcagccaacttgggccccgatccttcggctccggctcgcgcagggcctcccgcagcctccgcccggccccctccccgtcctaggcagcgggtccctgaggccgaacctaggcggaaaagggccccctccctattcactcagcatccacctcgcgcgggcaatacacggcccacaattcccaaacactggtccctgggccgcccagaatcaccagccaaatccgaaattaatcttgaagccccagcccctgtcaccggtgtgtcgggcgcgagtgtgtttgcgaatcccaggcacatacatgatttaactccttcgagctttcggcccatcctaaacaaacagcacgttatctccagccccttcctcccctactcggcgccccaacctctgcccccatcccggtcttcgccagcctggtagccgaaccaccgcaccgccacactccagttctggtatctcgaacccctgcccagccccaaatgatactcatctctagtcccctcccatcccccacctttggccccctgcgagccgggtctggccccggcaagtgacgcctcggaaacgcagtctgcgtaccctcccctgagtccaaaatgaaggggccgacctccaccagctggatgagccggcccacccctccgaaggggcacacgccttcccgttcgatcgccctggaaaacacaggtgcctgggaaaggagaggagcggaagcggcttccagaggtgggcgggaggactcaccaaacatctgaatgtgccctttggtgatgggattgaagctgccgcaggcgagcaagataacgtgggtcttggtggtctcggtcatggtgcagatgggtccttcgcggtggtctaggggttgcctctctttttgtgtctcgttgtgtctgcagagggagaaaggaaggcgaggctccggcggtggatgctgtggactccaaggagccgctccagacgcaaaccgcgtcactctccgcctccccttaacgcttgcagctccggctagatccgaggctgcttttgtattgctctgctctcttctctcctcggtcgctctcttttcgttctggcttccttcgcatctctcgcctg

SEQ ID NO: 103422 - DNA, 41 bp, Homo sapiens; identical to SEQ ID NO: 68212
  chr1:183462983-183463024
  Hypo

SEQ ID NO: 103423 - DNA, 331 bp, Homo sapiens; identical to SEQ ID NO: 26763
  chr1:183774098-183774429
  Hyper

SEQ ID NO: 103424 - DNA, 30 bp, Homo sapiens; identical to SEQ ID NO: 68215
  chr1:183907120-183907150
  Hypo

SEQ ID NO: 103425 - DNA, 1392 bp, Homo sapiens; identical to SEQ ID NO: 68216
  chr1:184005438-184006830
  Hyper

SEQ ID NO: 103426 - DNA, 30 bp, Homo sapiens; identical to SEQ ID NO: 68224
  chr1:184442660-184442690
  Hypo

SEQ ID NO: 103427 - DNA, 25 bp, Homo sapiens
  chr1:184608977-184609002
  Hypo
acaaaggggcttggccgggcgcagt

SEQ ID NO: 103428 - DNA, 62 bp, Homo sapiens; identical to SEQ ID NO: 68227
  chr1:184633288-184633350
  Hyper

SEQ ID NO: 103429 - DNA, 23 bp, Homo sapiens
  chr1:184721182-184721205
  Hypo
ggccaagtcggctttttctaaag

SEQ ID NO: 103430 - DNA, 100 bp, Homo sapiens; identical to SEQ ID NO: 68229
  chr1:184725924-184726024
  Hypo

SEQ ID NO: 103431 - DNA, 122 bp, Homo sapiens; identical to SEQ ID NO: 68230
  chr1:184764179-184764301
  Hypo

SEQ ID NO: 103432 - DNA, 120 bp, Homo sapiens; identical to SEQ ID NO: 68231
  chr1:185073818-185073938
  Hypo

SEQ ID NO: 103433 - DNA, 102 bp, Homo sapiens; identical to SEQ ID NO: 68236
  chr1:186649596-186649698
  Hyper

SEQ ID NO: 103434 - DNA, 77 bp, Homo sapiens; identical to SEQ ID NO: 68237
  chr1:186649956-186650033
  Hyper

SEQ ID NO: 103435 - DNA, 40 bp, Homo sapiens; identical to SEQ ID NO: 68238
  chr1:186797074-186797114
  Hypo

SEQ ID NO: 103436 - DNA, 30 bp, Homo sapiens; identical to SEQ ID NO: 68240
  chr1:187043706-187043736
  Hypo

SEQ ID NO: 103437 - DNA, 22 bp, Homo sapiens
  chr1:187755700-187755722
  Hypo
ccgctcccggccatcaataatt

SEQ ID NO: 103438 - DNA, 561 bp, Homo sapiens; identical to SEQ ID NO: 68272
  chr1:190444251-190444812
  Hyper

SEQ ID NO: 103439 - DNA, 516 bp, Homo sapiens
  chr1:190445138-190445654
  Hyper
ctagtgacctagtgacgggtgaggggcgccaagtggtgcggaccacagtctcaacccccgttccctctcggtgggagtcaagggggaaaagcccttgaatcccgagacggggggatggggcgacgctgcagctggagtacttttatgtctgggagctaaaagggcttttgaatttaaaaaaacattgcttgggttgtcgcgtcagccatcaatgacgacaagaatagttatttcccagaaattaaaaaaaaaaaaaaggaaaagaaaagcgtgaacaataggttcttacctccatgtatcccaagaaaaggaaatgttgtagagaccaggaacttgtccttaatttgagggcggggggcggatgttcagagaaaaccctcagtgggtgttaaaaattaccgatacatgcaggtttggcatttaatgaatatcgtgctttcctcattatgtgtcaattgtgaagtaaaagtaaagattaaaatgtttctcaacacaactatacggaagaggaggtga

SEQ ID NO: 103440 - DNA, 641 bp, Homo sapiens
  chr1:190447121-190447762
  Hyper
tttaagagttacctgcgttgggaccattatcattaggattaatagtattccatcagtgcatttcactagtatttcccttgaacattttcacttgcagcaactgagggaggcgtagtaaggaagcccaacacaaccaattcccccactccccaaataaaccactacgaccggtcacattacgatgaccaaatcatcagcgatttgcacgaggcggtggggggtggggggtgcgggcggtgatcgaagggctgaagatgcggaggaggccgagtcgctaggcgctttcgggggcgctgtgccggtgaggcttaggcaaggggacggggaaccgtggttagatgcagcagcggcggcagcagccctcccaggtcccacttctttggcgttcctgctgcctgtgactcaagacaattgacttccacctgaaccctcagctccgaacgccttgcattagaagctagagctttggaggttctgaggacggtccctggggagcaagtggtaggtttcgaggcgcccgcttcccctctgattcctgcagtaactgagagagagtgtgccagaaatggctttgctgccgaatgcattatcttgccattttcgtgtcccaatactgaacaaacgatcgcctgatcgatcgg

SEQ ID NO: 103441 - DNA, 30 bp, Homo sapiens; identical to SEQ ID NO: 68278
  chr1:190448036-190448066
  Hyper

SEQ ID NO: 103442 - DNA, 34 bp, Homo sapiens; identical to SEQ ID NO: 68283
  chr1:191390212-191390246
  Hypo

SEQ ID NO: 103443 - DNA, 30 bp, Homo sapiens; identical to SEQ ID NO: 39183
  chr1:191565747-191565777
  Hypo

SEQ ID NO: 103444 - DNA, 155 bp, Homo sapiens; identical to SEQ ID NO: 68288
  chr1:191763145-191763300
  Hypo

SEQ ID NO: 103445 - DNA, 38 bp, Homo sapiens; identical to SEQ ID NO: 68291
  chr1:192175514-192175552
  Hypo

SEQ ID NO: 103446 - DNA, 188 bp, Homo sapiens; identical to SEQ ID NO: 68295
  chr1:193668360-193668548
  Hypo

SEQ ID NO: 103447 - DNA, 126 bp, Homo sapiens; identical to SEQ ID NO: 68296
  chr1:194532864-194532990
  Hypo

SEQ ID NO: 103448 - DNA, 37 bp, Homo sapiens; identical to SEQ ID NO: 68297
  chr1:194626743-194626780
  Hypo

SEQ ID NO: 103449 - DNA, 84 bp, Homo sapiens; identical to SEQ ID NO: 68298
  chr1:194827966-194828050
  Hypo

SEQ ID NO: 103450 - DNA, 217 bp, Homo sapiens; identical to SEQ ID NO: 39185
  chr1:195732322-195732539
  Hypo

SEQ ID NO: 103451 - DNA, 64 bp, Homo sapiens; identical to SEQ ID NO: 26773
  chr1:196577371-196577435
  Hyper

SEQ ID NO: 103452 - DNA, 680 bp, Homo sapiens; identical to SEQ ID NO: 68305
  chr1:196577707-196578387
  Hyper

SEQ ID NO: 103453 - DNA, 30 bp, Homo sapiens; identical to SEQ ID NO: 68308
  chr1:197091622-197091652
  Hypo

SEQ ID NO: 103454 - DNA, 30 bp, Homo sapiens; identical to SEQ ID NO: 39186
  chr1:197771436-197771466
  Hypo

SEQ ID NO: 103455 - DNA, 146 bp, Homo sapiens; identical to SEQ ID NO: 68312
  chr1:197879400-197879546
  Hyper

SEQ ID NO: 103456 - DNA, 1465 bp, Homo sapiens
  chr1:197879606-197881071
  Hyper
atgcatgtcgttaccaaatacctagaacggtattggaccgcaaagaggttaaacccggttgctttcgacaggaatgagttgaaagcacccaagcgttttcgggtgggtatcgccgtccatccattcgatggcctcgctgatgagcatagaagatgaacccgggaggactgtcccttcctggctgcgaaacctgaccgatataggggagattctagaagaaagagctaaggaggccagggcggaaagaggaaagtcaggtgtaggggagattaaaaggtaaactggtgggactgaccgggctggtgggactagttagcgaagccaagtgtttgggtagaaacagagatcttgtaggaggtgctccgagctacatttcgggatttgggatgaaaagagaaagccagggggttcgccgctcctggtttgttccttaccgaccctaaactgtatggcggagcttgtgggtcaggcgtggaggcggcatccactcccacgtgccccacatgcagcagcaatcccacgcggttttcgcaagcggctgggaggcaagcgggcgtccccccacaccccccccccactgcgccctggacccacgccacgcaccgccaaggagtagctatggtggcacgtggaggaggggcgggtaggcagggcggcaccatcaccgggaccagcatcttggaacggtcaatctcactgctcatactctcctccctaccggcgcgggagccttgctgtaatcccctgccaccccatctccgactgtgaggggcgcaccgggtgggggaatgggtaaataactggcccaaggcccagcttccaggtcctccctccactttcccgcggcctgactgcgccccgggcaacacagccccttgggaacctgcgaccaggtaatgtggcctccgccccgtcccgggtctggctgcatcccctctaacccctgcctgcccgggtccaagtgagggttttctcccggaaggttaatcaccacccccatcccctagccgggtcccgggaggaagagatgccccggctctctcgttgacccggcctcgaacgccgacctcgagcgcagaatactcccgagtgctgggttcctgatacccagcccgggagcgaggggagtgaaggagggaccgggacaggaaggcggggacgcggtgggtgaacaatcaatggcttagcctagtttccccgcaggagctaccgcccattcaccgtctatgcaagcaccagctggcggcagcatcttttaggtacaagctgcagggaggcaaaagctggctggggggccgggagcccagggcacgccgcgggactccagtccccctgctgcgccccagcctcaagacgctctgggctttatgaggttcagttaccgccgagtcctccattaacacctcctctgattattgagaggctggaagggctgaacgcaacctcagagcgtttctctgggcac

SEQ ID NO: 103457 - DNA, 192 bp, Homo sapiens; identical to SEQ ID NO: 26777
  chr1:197881412-197881604
  Hyper

SEQ ID NO: 103458 - DNA, 156 bp, Homo sapiens; identical to SEQ ID NO: 68316
  chr1:197882052-197882208
  Hyper

SEQ ID NO: 103459 - DNA, 67 bp, Homo sapiens; identical to SEQ ID NO: 68317
  chr1:197882427-197882494
  Hyper

SEQ ID NO: 103460 - DNA, 279 bp, Homo sapiens; identical to SEQ ID NO: 68318
  chr1:197885015-197885294
  Hyper

SEQ ID NO: 103461 - DNA, 30 bp, Homo sapiens; identical to SEQ ID NO: 68319
  chr1:197885683-197885713
  Hyper

SEQ ID NO: 103462 - DNA, 21 bp, Homo sapiens
  chr1:197886252-197886273
  Hyper
cgcgcgcgtgtgtgtgttttg

SEQ ID NO: 103463 - DNA, 2805 bp, Homo sapiens
  chr1:197886851-197889656
  Hyper
ctttccctccatcctcgagcgtctctgcgctcctacagggcagccctctctggtcccttgcctccttcactcggatgagctgaaagccccgggcgtgtgtatatggaaatagtggggtgccgagcagaagacaactcgtgtcctttccgccccccagccatgctctttcacgggatctccggaggccacatccaaggcatcatggaggagatggagcgcagatccaagactgaggcccgtctggccaaaggcgcccagctcaacggccgcgacgcggtaaggaagggctccgccgcggcggtagccgggcacccctgcgccctctgttaaaccaagccgactccctggccggtggagaaccggagcggcgggtcgtagagacgtccgcttgagggtggcgggtgagttttctcccgtccacctatgcctacagggctaagaaacggtcgtttttctgaatcgaaatgtctgcagctggctatcctccgtcgcagctgattccgaaagagcagggagaggaactgggaggaggtgggatggggggtggtggcattctcttctacagacctcaaggttcccttgattccggggcaggcgtctccccggcgaggatccgcagctccgagggcaagctgggcataagcaataggaggacggcgcgctgccgaggcgtccgagccaagcaggagcccaggtggccttagtctctgggcctgatgaccggacctgtggagtagattccgacgcgactgggtcatttccagttctctagacgctcggggcttgggacccctaaccgagagaatctcagggtttctggcatcccgactcagtccctctaaggagacagcactacgtttagcgccaggacccggcgggtgtcatgtgtagggggaaatcaaataaaacatacggaggagcgcggcacccagtcgaaacgcatgaactttataaccaacccttaaacaagctaatcaaccaccactgtttctactatccataataataaagtcatgtcctcttaataaagaaaactaattacttatctaagcgcttccctttccagattactaacggggggggggggggactacagaagtctccggaaattatttcggccaaacatagctgtgtagatcctttggtaccacagtaggacttgtagcccaaactaatcaggagactgctctagcccttatcagctgggttttgggtccggccaagtagcccaactggtgaacgtgtctatatttgtaacactcattcagtgccggggcccctggtcggagtaaagggctaaactttactttttcaggcccgctgaagtttcgtggggaagatcaacccatttctgctagtcgtgagggaaatgtccggaggttaactccttttccctttttctggtcatcacttttaaaaacaaatagtagcaacccaaacccaaattttgcagcggggctgggctcctcaaggtggggccactggggcatcccgagtcgggtcagtgggacccagagggaagcataacttgggcactaaacagattttcaagacaaaggtctcagtacgcctgttgatgctagggaaagaggggactgtatacagcgggctggacagcggaccctctttgggaacagccactttacacatttattgggaacggcaccaatagccctgaaaattagggaacagcaggggctgccaaatatatctcaatcaaaacaaagtcgaccaaattatgagcagaggtccaataatctcccctttgcttttgatttcaatgctgcttataagaatttagagaaatcgaactgtaatattttttgtttaaaaataacctgtgctcgttgaaatttccttttcactcccttatcatttccgttgttttattttgtgtgcgtcgaaaaccacaatttttagcttgtaattatttgaattcggaaacgatcaccaaactgtagtcaatattttcctagtcctttttaagcgaggctccggatggctgggatgtctttaggttagtagtcccgggaggacgcgaacgccggttcaggcagacacggaagaaagcaagcgggccgcaaagagagaaatcacaaatgtttcccctgacttttgcctttgtgcagtggaccctggcccctgccgctctccctgcacaccctgggcttggtctgcctgggggagaaccccgcgtcgtgcggctacaccgcgcgccctcctcagccttgcggtgtgctttctttgcagggcatgcccccgctcagcccggagaagcccgccctgtgcgccggctgcgggggcaagatctcggacaggtactatctgctggctgtggacaaacagtggcatctgagatgcctgaagtgctgtgaatgtaagctggccctcgagtccgagctcacctgctttgccaaggacggtagcatttactgcaaggaggattactacaggtactcccctacacccccacttcctacgcccgagtacacctggaggggccatctgcctgagcccggaatcccctctccgtcccctaccttttgccccattccgggtgctgttatcatttcggagaccaggcaaacccactgcatatgccttcaagctgtaatctccctgaccgacggtgagggtgggtgggagggacattaaaaatctagagctttatcagcgaataccacgcactcccatcacttctcagcttggctggcggaacttggggaaatctggggaagagtaaatggacgtggtctccgtctaccgagacttgattgggtgtttgttttccgcttgctacgaatt

SEQ ID NO: 103464 - DNA, 288 bp, Homo sapiens; identical to SEQ ID NO: 68327
  chr1:197890549-197890837
  Hyper

SEQ ID NO: 103465 - DNA, 205 bp, Homo sapiens; identical to SEQ ID NO: 68328
  chr1:198097470-198097675
  Hypo

SEQ ID NO: 103466 - DNA, 150 bp, Homo sapiens; identical to SEQ ID NO: 68329
  chr1:198124631-198124781
  Hypo

SEQ ID NO: 103467 - DNA, 222 bp, Homo sapiens; identical to SEQ ID NO: 68330
  chr1:198181340-198181562
  Hypo

SEQ ID NO: 103468 - DNA, 16 bp, Homo sapiens
  chr1:198918249-198918265
  Hypo
ggcctgggcggaggcc

SEQ ID NO: 103469 - DNA, 17 bp, Homo sapiens
  chr1:198918546-198918563
  Hypo
tgcgcagaggctactgg

SEQ ID NO: 103470 - DNA, 205 bp, Homo sapiens; identical to SEQ ID NO: 68335
  chr1:199249992-199250197
  Hypo

SEQ ID NO: 103471 - DNA, 30 bp, Homo sapiens; identical to SEQ ID NO: 68336
  chr1:199360890-199360920
  Hypo

SEQ ID NO: 103472 - DNA, 36 bp, Homo sapiens; identical to SEQ ID NO: 68337
  chr1:199842536-199842572
  Hypo

SEQ ID NO: 103473 - DNA, 240 bp, Homo sapiens; identical to SEQ ID NO: 26787
  chr1:199998199-199998439
  Hyper

SEQ ID NO: 103474 - DNA, 56 bp, Homo sapiens; identical to SEQ ID NO: 68339
  chr1:199998732-199998788
  Hyper

SEQ ID NO: 103475 - DNA, 176 bp, Homo sapiens; identical to SEQ ID NO: 68340
  chr1:200008515-200008691
  Hyper

SEQ ID NO: 103476 - DNA, 38 bp, Homo sapiens; identical to SEQ ID NO: 68341
  chr1:200009412-200009450
  Hyper

SEQ ID NO: 103477 - DNA, 427 bp, Homo sapiens; identical to SEQ ID NO: 68342
  chr1:200009750-200010177
  Hyper

SEQ ID NO: 103478 - DNA, 847 bp, Homo sapiens
  chr1:200011257-200012104
  Hyper
ccgctgggaggacctcgcctagcatccctttattaatatttcacgaaggcaggctcctgccttctctggagcctcttttctcggaatgttcccaaactctggctaactcactcccctgtgagccatcctagggctctgtggcccgggaagagacgcgtcaactccgcgggtctgcgcgcagtccttagccgcaaagtgctgcaagtgacccccctgacggccctttccgaccgaagagctcgggaaccaaagagaaaaaaaataactttattttcaaaagaacaagtcatcactgcggcgatactgtggcggaggactttggcgatggggtgggggctatttctctttcctttttggtaaacaaatcagaggaaacttctgcccggccgtggctttccatcccccacctgccccaccccctgcaaacgccactgattaacttaaaacaaactcggctgcgtgtttgtgcgccgttgggtagcaggaggtagagcctaggcgagagcctggtgcgcccacgggtttcgccgaagagtgcccgggggagtgcgggcagggtcccggctgcgcagacctgcgggtgcccgcccacccgcgccccgcgctcccatacttgacctgtgtggatgtggagtctccgggaaataccggatcaggcacttcctggggtctcctggtcactgcccttcctgtgcatagtttgtcatctttttagctgcgaagacgccttcgtgggtctgcgtccggagcaaggcggttacccgatcccggcagtgagccgcgccgcgcgtcgtggcggcctgatttctgtttaactttaatagggcgatctcgaggtgtttatatt

SEQ ID NO: 103479 - DNA, 30 bp, Homo sapiens; identical to SEQ ID NO: 68345
  chr1:200183084-200183114
  Hypo

SEQ ID NO: 103480 - DNA, 160 bp, Homo sapiens; identical to SEQ ID NO: 39187
  chr1:200505065-200505225
  Hypo

SEQ ID NO: 103481 - DNA, 33 bp, Homo sapiens; identical to SEQ ID NO: 68347
  chr1:200519383-200519416
  Hypo

SEQ ID NO: 103482 - DNA, 18 bp, Homo sapiens
  chr1:200588770-200588788
  Hypo
gtccggcccatgtatgtt

SEQ ID NO: 103483 - DNA, 335 bp, Homo sapiens; identical to SEQ ID NO: 68349
  chr1:200860242-200860577
  Hyper

SEQ ID NO: 103484 - DNA, 77 bp, Homo sapiens; identical to SEQ ID NO: 68350
  chr1:200864028-200864105
  Hypo

SEQ ID NO: 103485 - DNA, 33 bp, Homo sapiens; identical to SEQ ID NO: 68351
  chr1:200870109-200870142
  Hypo

SEQ ID NO: 103486 - DNA, 49 bp, Homo sapiens; identical to SEQ ID NO: 39190
  chr1:200941620-200941669
  Hypo

SEQ ID NO: 103487 - DNA, 30 bp, Homo sapiens
  chr1:201084201-201084231
  Hyper
ttgacgcacttgactcgctgcctctcgcgc

SEQ ID NO: 103488 - DNA, 184 bp, Homo sapiens; identical to SEQ ID NO: 68354
  chr1:201244242-201244426
  Hypo

SEQ ID NO: 103489 - DNA, 322 bp, Homo sapiens; identical to SEQ ID NO: 68355
  chr1:201252494-201252816
  Hyper

SEQ ID NO: 103490 - DNA, 46 bp, Homo sapiens; identical to SEQ ID NO: 68358
  chr1:201368848-201368894
  Hyper

SEQ ID NO: 103491 - DNA, 55 bp, Homo sapiens; identical to SEQ ID NO: 68359
  chr1:201383691-201383746
  Hypo

SEQ ID NO: 103492 - DNA, 192 bp, Homo sapiens
  chr1:201437613-201437805
  Hyper
ctagggtgatctgggcgttccagccgggatcttccagggggcagcggaagtcgatctcgccgcccccttcggtcaccagcgtgaagtagatgtggcgcccggtgctctccacgcactccacggccttgatgcgggcgaagctgagctccttgggccggccgcccgtgcccttggcctcgaagagctgcagcc

SEQ ID NO: 103493 - DNA, 73 bp, Homo sapiens; identical to SEQ ID NO: 26796
  chr1:201438552-201438625
  Hyper

SEQ ID NO: 103494 - DNA, 206 bp, Homo sapiens; identical to SEQ ID NO: 68364
  chr1:201445697-201445903
  Hypo

SEQ ID NO: 103495 - DNA, 91 bp, Homo sapiens; identical to SEQ ID NO: 68365
  chr1:201508375-201508466
  Hyper

SEQ ID NO: 103496 - DNA, 292 bp, Homo sapiens; identical to SEQ ID NO: 68366
  chr1:201508694-201508986
  Hyper

SEQ ID NO: 103497 - DNA, 30 bp, Homo sapiens; identical to SEQ ID NO: 68367
  chr1:201583245-201583275
  Hyper

SEQ ID NO: 103498 - DNA, 94 bp, Homo sapiens; identical to SEQ ID NO: 68368
  chr1:201797447-201797541
  Hypo

SEQ ID NO: 103499 - DNA, 30 bp, Homo sapiens; identical to SEQ ID NO: 39194
  chr1:201851118-201851148
  Hypo

SEQ ID NO: 103500 - DNA, 76 bp, Homo sapiens; identical to SEQ ID NO: 68370
  chr1:201915663-201915739
  Hyper

SEQ ID NO: 103501 - DNA, 394 bp, Homo sapiens; identical to SEQ ID NO: 68371
  chr1:201977576-201977970
  Hypo

SEQ ID NO: 103502 - DNA, 85 bp, Homo sapiens; identical to SEQ ID NO: 68372
  chr1:201981114-201981199
  Hypo

SEQ ID NO: 103503 - DNA, 204 bp, Homo sapiens; identical to SEQ ID NO: 68373
  chr1:201982388-201982592
  Hypo

SEQ ID NO: 103504 - DNA, 118 bp, Homo sapiens; identical to SEQ ID NO: 68374
  chr1:201983113-201983231
  Hypo

SEQ ID NO: 103505 - DNA, 98 bp, Homo sapiens; identical to SEQ ID NO: 39199
  chr1:201984047-201984145
  Hypo

SEQ ID NO: 103506 - DNA, 164 bp, Homo sapiens; identical to SEQ ID NO: 68376
  chr1:201986490-201986654
  Hypo

SEQ ID NO: 103507 - DNA, 22 bp, Homo sapiens
  chr1:202025754-202025776
  Hypo
ttacaggcgtgagccaccacgc

SEQ ID NO: 103508 - DNA, 123 bp, Homo sapiens; identical to SEQ ID NO: 68378
  chr1:202042364-202042487
  Hypo

SEQ ID NO: 103509 - DNA, 15 bp, Homo sapiens
  chr1:202081789-202081804
  Hypo
cgtctcaaaaaaaaa

SEQ ID NO: 103510 - DNA, 88 bp, Homo sapiens; identical to SEQ ID NO: 68381
  chr1:202101759-202101847
  Hypo

SEQ ID NO: 103511 - DNA, 248 bp, Homo sapiens; identical to SEQ ID NO: 68382
  chr1:202183428-202183676
  Hyper

SEQ ID NO: 103512 - DNA, 30 bp, Homo sapiens; identical to SEQ ID NO: 68383
  chr1:202208039-202208069
  Hypo

SEQ ID NO: 103513 - DNA, 139 bp, Homo sapiens; identical to SEQ ID NO: 39203
  chr1:202311995-202312134
  Hypo

SEQ ID NO: 103514 - DNA, 278 bp, Homo sapiens; identical to SEQ ID NO: 68386
  chr1:202611761-202612039
  Hyper

SEQ ID NO: 103515 - DNA, 127 bp, Homo sapiens; identical to SEQ ID NO: 26799
  chr1:202613418-202613545
  Hyper

SEQ ID NO: 103516 - DNA, 1043 bp, Homo sapiens
  chr1:202678665-202679708
  Hyper
cgggctgtcagcacccgccaggctgcgagcctagcccttggggacagagctgaagcagggacggggcgtcctaggtcgtgctgagtcatgagatttggagagaggggaggggcgcctccagccccttcttgggcccctgccccagctcctcgtgcccgttgcttccagatggcccctgcagtctgtctccccaacctctccctgacccagggtctccggctcccagcgcccagaccccaccccccgccccacttcccacgacggcggtgccaggggtccccgaagcttgagactggggcaaaagaaccttccttggagaccgctagggctggcgggggctgggctagacgcgagtgggttcgtcccagggaaaggagagagggacgggggcgcagagccggccggtgcaggggacgcgtggcccgcccctctctgcagcaacccgcgggaggaaatctgcccccagcccagccccagtccctcagaggagccggctcctcgcccctcgggtccgactccccgagacgaaccttccatccggacgcttccaaactcccccaaaggacggggcagactcccggcccccttggcctcaaacttccccaaccctactcacctctcgggacccagaccaccccgtggcccctcgactcagtagcaggaaaggagaaactttggagagggaggtccgtgcccccaccggcgggggtatggacttaccggagagcgacccgaaggaggcgggagagatccggggtctccaatgtgagggggcgtcggacggcaaggacgcgtggctggcgacggtttcgcaggggcgcccgttcccctgggggcgcgaagtccccgctccaccgctgccccaactcggctccgaagtgcctttgccgcaagacttgctgagcttagcagtctgcgccgaggcggcagagggagggggcctgatcgatgggcgcgcgcggcgagcgctgcagtgaggggaggagaccaagcggcgtgggagggcggggaccgaggcggaggaggcccggaggaggcggagg

SEQ ID NO: 103517 - DNA, 16 bp, Homo sapiens
  chr1:202829801-202829817
  Hypo
gcgcctggccagtcaa

SEQ ID NO: 103518 - DNA, 76 bp, Homo sapiens; identical to SEQ ID NO: 68391
  chr1:202840809-202840885
  Hypo

SEQ ID NO: 103519 - DNA, 30 bp, Homo sapiens; identical to SEQ ID NO: 39204
  chr1:202856302-202856332
  Hypo

SEQ ID NO: 103520 - DNA, 97 bp, Homo sapiens; identical to SEQ ID NO: 68393
  chr1:202856952-202857049
  Hypo

SEQ ID NO: 103521 - DNA, 30 bp, Homo sapiens; identical to SEQ ID NO: 68394
  chr1:202861824-202861854
  Hypo

SEQ ID NO: 103522 - DNA, 30 bp, Homo sapiens; identical to SEQ ID NO: 68395
  chr1:202897655-202897685
  Hypo

SEQ ID NO: 103523 - DNA, 83 bp, Homo sapiens; identical to SEQ ID NO: 68396
  chr1:202898246-202898329
  Hypo

SEQ ID NO: 103524 - DNA, 155 bp, Homo sapiens; identical to SEQ ID NO: 68397
  chr1:202933730-202933885
  Hypo

SEQ ID NO: 103525 - DNA, 30 bp, Homo sapiens; identical to SEQ ID NO: 68398
  chr1:202934371-202934401
  Hypo

SEQ ID NO: 103526 - DNA, 149 bp, Homo sapiens; identical to SEQ ID NO: 68399
  chr1:202936921-202937070
  Hyper

SEQ ID NO: 103527 - DNA, 79 bp, Homo sapiens; identical to SEQ ID NO: 39207
  chr1:202995301-202995380
  Hypo

SEQ ID NO: 103528 - DNA, 482 bp, Homo sapiens
  chr1:202995837-202996319
  Hyper
tcgtctatcgcacctcgggaaacagccctttttgactccgtatgtgctacctccggcaggcgtcggtactgcttaccctgccgcccctcgccctcctttgcggtgccctgtgcccttgggggtgaggataggggcgatgcctgatctgcggggagggcgtggagtgcgccctctgctccatcggcttcaggggagggggccgagttggcgagtctcccggtgggaacggagcagactgcgcccccatttcccctccaggagagtcagaaaaagcgcctctcggctccggggccaaccccactcctttggggacgcgattctgatgggctgaggtcttcgctcttcgcgggggtcttaatctttcccgagttgctcatagcacccctgttcctgtcgctagctctccattcctcgaactgccagcctcagtctgtgccagagatgcccccatctccgcagtgccagggcggtggggtggaagg

SEQ ID NO: 103529 - DNA, 30 bp, Homo sapiens
  chr1:203044840-203044870
  Hyper
ccctgcagcccccaccggccccgccaaaga

SEQ ID NO: 103530 - DNA, 262 bp, Homo sapiens; identical to SEQ ID NO: 68403
  chr1:203086936-203087198
  Hyper

SEQ ID NO: 103531 - DNA, 659 bp, Homo sapiens; identical to SEQ ID NO: 68404
  chr1:203096850-203097509
  Hyper

SEQ ID NO: 103532 - DNA, 40 bp, Homo sapiens; identical to SEQ ID NO: 68405
  chr1:203236950-203236990
  Hyper

SEQ ID NO: 103533 - DNA, 30 bp, Homo sapiens; identical to SEQ ID NO: 39208
  chr1:203257678-203257708
  Hypo

SEQ ID NO: 103534 - DNA, 267 bp, Homo sapiens; identical to SEQ ID NO: 68407
  chr1:203298174-203298441
  Hypo

SEQ ID NO: 103535 - DNA, 85 bp, Homo sapiens; identical to SEQ ID NO: 39210
  chr1:203429564-203429649
  Hypo

SEQ ID NO: 103536 - DNA, 20 bp, Homo sapiens
  chr1:203764131-203764151
  Hypo
gccaccgcaccggccacgtg

SEQ ID NO: 103537 - DNA, 18 bp, Homo sapiens
  chr1:203832761-203832779
  Hypo
taacgtttccacttttat

SEQ ID NO: 103538 - DNA, 38 bp, Homo sapiens; identical to SEQ ID NO: 68411
  chr1:203911836-203911874
  Hypo

SEQ ID NO: 103539 - DNA, 68 bp, Homo sapiens; identical to SEQ ID NO: 68412
  chr1:204042624-204042692
  Hyper

SEQ ID NO: 103540 - DNA, 30 bp, Homo sapiens; identical to SEQ ID NO: 68413
  chr1:204042936-204042966
  Hyper

SEQ ID NO: 103541 - DNA, 40 bp, Homo sapiens; identical to SEQ ID NO: 68414
  chr1:204044387-204044427
  Hyper

SEQ ID NO: 103542 - DNA, 407 bp, Homo sapiens; identical to SEQ ID NO: 68415
  chr1:204120648-204121055
  Hyper

SEQ ID NO: 103543 - DNA, 81 bp, Homo sapiens; identical to SEQ ID NO: 68416
  chr1:204159610-204159691
  Hyper

SEQ ID NO: 103544 - DNA, 38 bp, Homo sapiens; identical to SEQ ID NO: 68418
  chr1:204333521-204333559
  Hypo

SEQ ID NO: 103545 - DNA, 30 bp, Homo sapiens; identical to SEQ ID NO: 68419
  chr1:204333856-204333886
  Hypo

SEQ ID NO: 103546 - DNA, 30 bp, Homo sapiens; identical to SEQ ID NO: 39213
  chr1:204535867-204535897
  Hypo

SEQ ID NO: 103547 - DNA, 30 bp, Homo sapiens; identical to SEQ ID NO: 39214
  chr1:204536295-204536325
  Hypo

SEQ ID NO: 103548 - DNA, 162 bp, Homo sapiens; identical to SEQ ID NO: 68422
  chr1:204586294-204586456
  Hypo

SEQ ID NO: 103549 - DNA, 153 bp, Homo sapiens; identical to SEQ ID NO: 68423
  chr1:204587558-204587711
  Hypo

SEQ ID NO: 103550 - DNA, 30 bp, Homo sapiens; identical to SEQ ID NO: 68424
  chr1:204588003-204588033
  Hypo

SEQ ID NO: 103551 - DNA, 112 bp, Homo sapiens; identical to SEQ ID NO: 39216
  chr1:204588271-204588383
  Hypo

SEQ ID NO: 103552 - DNA, 30 bp, Homo sapiens; identical to SEQ ID NO: 68426
  chr1:204589092-204589122
  Hypo

SEQ ID NO: 103553 - DNA, 30 bp, Homo sapiens; identical to SEQ ID NO: 68427
  chr1:204643879-204643909
  Hypo

SEQ ID NO: 103554 - DNA, 752 bp, Homo sapiens
  chr1:204653466-204654218
  Hyper
aacagatgggagctgcggcagcctgaggaacagagcacaaagcccagctgacattttccttcctgttcgtttgggtgggggaggaagggtagggagcacagtgctacccccggggcccctccccaggttccgggtctcctgcacctctttagcttctccgctcggccccagatggagctcagttccctcaccccgcggctcctcgccggctgggcagccagagcctgcgccaccctttgccagcaggacagacggcccacctgtggctggccagcccatcctgtctcctgggtcctgcggtgggctcagagccacccttccgtttccgcttccccctgaccgagtccccaggctgagccccaggccggcccatcccccaccccaaaggtcccatcccaggctgcggtcggaccccagccagccggcccgggaggagcctagctcctggttccagatacttcagacagacccaaggccaccttgtccctccgcacagactcgcgagctccaaggaggagaaagtccccaggctctggagcgcttccagcctgccagtccgcccgtgtcacgccctccctaacctcactgccacctctcggctcctccacatctccagggccccactctacccagcaacagtttgggggaggttctggcctctccaggcgaaggcccaggcgccctctccctggccgcttctgggcattctccagccctccgtccctctgcccctcggccgcctccctctccca

SEQ ID NO: 103555 - DNA, 194 bp, Homo sapiens; identical to SEQ ID NO: 68430
  chr1:204654575-204654769
  Hyper

SEQ ID NO: 103556 - DNA, 74 bp, Homo sapiens; identical to SEQ ID NO: 68431
  chr1:204721208-204721282
  Hypo

SEQ ID NO: 103557 - DNA, 564 bp, Homo sapiens; identical to SEQ ID NO: 68432
  chr1:204797757-204798321
  Hyper

SEQ ID NO: 103558 - DNA, 46 bp, Homo sapiens; identical to SEQ ID NO: 68435
  chr1:205043046-205043092
  Hypo

SEQ ID NO: 103559 - DNA, 145 bp, Homo sapiens; identical to SEQ ID NO: 39218
  chr1:205310661-205310806
  Hypo

SEQ ID NO: 103560 - DNA, 24 bp, Homo sapiens
  chr1:205311046-205311070
  Hypo
gattacaggcgtgagccaccgcgc

SEQ ID NO: 103561 - DNA, 528 bp, Homo sapiens
  chr1:205312478-205313006
  Hyper
ccaatcaccatgatccgcttccccagggcggtgacggccacccccgcccgggctgtgggcagccggggcaaggcggtccactggtcggcctccggggagtagacctcgaagcagtccatggggacgccgttgtcgtcacatcccccgatggcatagacctggcccccggtctccagcagggagcagtagacccggcggctgggcagtggcgccaggcgcttccactggaagtccttgacgttaggcacctccatggcagccttggggagcgcccgggcgccgggagaggtgcgagcgcgggggtccaccggctacttggcgccggctcccacggcccctatcgccacctccatctggctcccgagcgccggacccagccagaccccggccagtgcttcaccgtgccccgagtctcagcggtccggcggcgtccacgcctggccctgcggggggaacgcggtgaatcaagggcagctggggccacgcgccctccggcgggcagcggatgggctccgcagcccctggtca

SEQ ID NO: 103562 - DNA, 482 bp, Homo sapiens; identical to SEQ ID NO: 68443
  chr1:205399652-205400134
  Hyper

SEQ ID NO: 103563 - DNA, 1182 bp, Homo sapiens; identical to SEQ ID NO: 68444
  chr1:205424654-205425836
  Hyper

SEQ ID NO: 103564 - DNA, 101 bp, Homo sapiens; identical to SEQ ID NO: 68445
  chr1:205425896-205425997
  Hyper

SEQ ID NO: 103565 - DNA, 299 bp, Homo sapiens
  chr1:205537592-205537891
  Hyper
aatgaaagccatgcacgaatactctcccaaggagaaacatatgtacaacaagattttgccttctgttctgggggaaaggggggtgccgttagaccctcgaagtccatctgtgaagcgcctaggtttaaaggggtccgggtttcctccactgccacagcccgggtgcggggagagggcccctagccttatccggagatacaggatgtctcgggctctccatctgccgggctctaaaatgggcgctcggtccctgggggctgcatccggaggctggggggactggtcgagggagagcgggc

SEQ ID NO: 103566 - DNA, 30 bp, Homo sapiens; identical to SEQ ID NO: 39220
  chr1:205548923-205548953
  Hypo

SEQ ID NO: 103567 - DNA, 361 bp, Homo sapiens; identical to SEQ ID NO: 68453
  chr1:207200818-207201179
  Hypo

SEQ ID NO: 103568 - DNA, 216 bp, Homo sapiens; identical to SEQ ID NO: 68454
  chr1:207224789-207225005
  Hypo

SEQ ID NO: 103569 - DNA, 39 bp, Homo sapiens; identical to SEQ ID NO: 68455
  chr1:207225631-207225670
  Hypo

SEQ ID NO: 103570 - DNA, 77 bp, Homo sapiens; identical to SEQ ID NO: 68456
  chr1:207227177-207227254
  Hypo

SEQ ID NO: 103571 - DNA, 44 bp, Homo sapiens; identical to SEQ ID NO: 68457
  chr1:207477842-207477886
  Hypo

SEQ ID NO: 103572 - DNA, 87 bp, Homo sapiens; identical to SEQ ID NO: 68458
  chr1:207567724-207567811
  Hypo

SEQ ID NO: 103573 - DNA, 29 bp, Homo sapiens
  chr1:207590078-207590107
  Hypo
gaggcaggcggatcacgaggtcaggagtt

SEQ ID NO: 103574 - DNA, 25 bp, Homo sapiens
  chr1:207598909-207598934
  Hypo
ccaaactcaccgagtcatgcaggct

SEQ ID NO: 103575 - DNA, 603 bp, Homo sapiens; identical to SEQ ID NO: 68461
  chr1:207627530-207628133
  Hyper

SEQ ID NO: 103576 - DNA, 32 bp, Homo sapiens; identical to SEQ ID NO: 68462
  chr1:207648482-207648514
  Hypo

SEQ ID NO: 103577 - DNA, 30 bp, Homo sapiens; identical to SEQ ID NO: 14325
  chr1:207656486-207656516
  Hypo

SEQ ID NO: 103578 - DNA, 858 bp, Homo sapiens
  chr1:207669258-207670116
  Hyper
cagggtgtttggaggcgagctgccatcatccaccgcctttgtctggaagcgcagggcctcacacgcgggatccatcggaagcccgagcattgtcaagctctgctgctgcacctgggtcagcaaggtgggctctgccagcgaaactcgttagaaacaatgcaaatggggagtaaacatgacctcgcccatgaaggggaagctgtggtcaaaagcattttgtcccggaaccccgcagccctccccacactctgggcgcggagcacaatgattggtcactcctattttcgctgagcttttcctcttatttcagttttcttcgagatcaaatctggtttgtagatgtgcttggggagaatgggggcctcttctccaagaagcccggagcctgtcgggccgccggcgcccggtctccccttctgctgcggaggatccctgctggcggttgtggtgctgcttgcgctgccggtggcctggggtgagaggcgggcgggcgtggggaggcgcccgggcggacgaggaacccggggccccgcagagaactcgcgtgcagcgctgagctgcgctgctctgcgcgcccgggtccgaaggcagcgcgatgggtgggctgagcgcgcgacccggcagggcggcgggtgtaggatccttctgcgcactggagaccctcgctgcttctgggtaagcgtggagttcccaggtgcaggggcttaagtcgtgacgagcgcagtggaaggcgcagatgctgagcgggtgccgcacgaaattccttgcctttgtgtattcacagcctcggctggctatagccaagacgtggcgttgatcctagtgaaagggaacttggggatccgacaaacctgagtt

SEQ ID NO: 103579 - DNA, 30 bp, Homo sapiens; identical to SEQ ID NO: 68467
  chr1:207760894-207760924
  Hypo

SEQ ID NO: 103580 - DNA, 29 bp, Homo sapiens
  chr1:207786426-207786455
  Hypo
gcttctttgtacctgcgtttggtgggtcc

SEQ ID NO: 103581 - DNA, 137 bp, Homo sapiens; identical to SEQ ID NO: 39225
  chr1:207787630-207787767
  Hypo

SEQ ID NO: 103582 - DNA, 71 bp, Homo sapiens; identical to SEQ ID NO: 68470
  chr1:207818268-207818339
  Hyper

SEQ ID NO: 103583 - DNA, 24 bp, Homo sapiens
  chr1:207829567-207829591
  Hypo
gcgagattccgtctcaaaatcaat

SEQ ID NO: 103584 - DNA, 30 bp, Homo sapiens; identical to SEQ ID NO: 39226
  chr1:207857205-207857235
  Hypo

SEQ ID NO: 103585 - DNA, 171 bp, Homo sapiens; identical to SEQ ID NO: 68473
  chr1:207911135-207911306
  Hypo

SEQ ID NO: 103586 - DNA, 38 bp, Homo sapiens; identical to SEQ ID NO: 68474
  chr1:207921798-207921836
  Hypo

SEQ ID NO: 103587 - DNA, 99 bp, Homo sapiens; identical to SEQ ID NO: 68475
  chr1:207991495-207991594
  Hypo

SEQ ID NO: 103588 - DNA, 99 bp, Homo sapiens; identical to SEQ ID NO: 68476
  chr1:207991654-207991753
  Hypo

SEQ ID NO: 103589 - DNA, 30 bp, Homo sapiens; identical to SEQ ID NO: 39229
  chr1:207992298-207992328
  Hypo

SEQ ID NO: 103590 - DNA, 694 bp, Homo sapiens
  chr1:208083989-208084683
  Hyper
tcctccccagtctcccggttctggctgcaacttcgcactccgcgcctctggcaaccagaagagaccctggcatctccaaagcgctttatctcagtccattggaaccagtcgtgctgaccgattcacacctcggctaacgcacactcgcgggggtgatggccttcccttcccctcccacccccgtcagctcccaggtgaggcgctggccccggggggaagcagctgtgggcggcagtgcgtgggttgggcaggggtcccttccctccgtgagactctgctctgctgttcagcctcccagaaagcctccaccctccccgcggcgaagccaagcggccgcggcgcgcgggcggtactcacgcagcaaactcagcaagcaaagcgcggtccagccccgcggcatcctgggccctgcgcgcgcgcccctgcggaccagcatccttcccgcgcggctcctagagagacgcaccgagtggaagacactactcggcttggccaggacgcgctcttcccgccccctccgcccgggagaggggtgggggattcttgcttttttcctctcttctcccctccctttttagtcttggcaaggcagcgcctctccttggctgctactaacttgagctcccctggttggtcccaaaggcggagggcgttaggagggaggctgggttgccgccgtcgaggccaaaaaagg

SEQ ID NO: 103591 - DNA, 54 bp, Homo sapiens; identical to SEQ ID NO: 68483
  chr1:208136458-208136512
  Hyper

SEQ ID NO: 103592 - DNA, 30 bp, Homo sapiens; identical to SEQ ID NO: 68484
  chr1:208281203-208281233
  Hypo

SEQ ID NO: 103593 - DNA, 35 bp, Homo sapiens; identical to SEQ ID NO: 68485
  chr1:208523515-208523550
  Hypo

SEQ ID NO: 103594 - DNA, 30 bp, Homo sapiens; identical to SEQ ID NO: 68486
  chr1:208677386-208677416
  Hypo

SEQ ID NO: 103595 - DNA, 18 bp, Homo sapiens
  chr1:208852030-208852048
  Hypo
aagggggaagctggccgg

SEQ ID NO: 103596 - DNA, 115 bp, Homo sapiens; identical to SEQ ID NO: 39230
  chr1:208951412-208951527
  Hypo

SEQ ID NO: 103597 - DNA, 88 bp, Homo sapiens; identical to SEQ ID NO: 68496
  chr1:209306269-209306357
  Hypo

SEQ ID NO: 103598 - DNA, 30 bp, Homo sapiens; identical to SEQ ID NO: 68497
  chr1:209364033-209364063
  Hyper

SEQ ID NO: 103599 - DNA, 544 bp, Homo sapiens; identical to SEQ ID NO: 68498
  chr1:209381087-209381631
  Hyper

SEQ ID NO: 103600 - DNA, 185 bp, Homo sapiens; identical to SEQ ID NO: 39232
  chr1:209601396-209601581
  Hypo

SEQ ID NO: 103601 - DNA, 237 bp, Homo sapiens; identical to SEQ ID NO: 68500
  chr1:209999727-209999964
  Hypo

SEQ ID NO: 103602 - DNA, 30 bp, Homo sapiens; identical to SEQ ID NO: 68501
  chr1:210070804-210070834
  Hypo

SEQ ID NO: 103603 - DNA, 1187 bp, Homo sapiens
  chr1:210110982-210112169
  Hyper
gctgtttctccacagcggagatctgagacgagtatgtggctgattcgggcaaaacaaaacaaaataaaaccaaacgaaaccaaaacagacttactattaccaaatctgagagtcagtgggtgggaatccttttcaaccaaggagacctgtccatggtcctgaccacatcatttgccactcgcctccttcatggacaccgtttgctccaagtaccggacgggagggcgcccggcgccaggaagcttgggcttgggcccccacacgagctcggcgcgcttcgggcgggtctcgggcgcgggcccgtggctctccgggccgggcacctgtttcgaatcgaggcgcgaggcgcggtggggcggtggggtggggtggggtaggttggggtgggggcggggtggcgtcacgtgccagcggcggccccgggaaggttccatttcttccgcggcccgcactcgcggcgctcggggcccctccctcgccccgcccgcggcgcccctcgcggccgcacagccgggcgactccgggccgggccccgcccctctcgctggcggactcagcgcgtcctccgccagccctcgcgtctgctgcccccgccatccagttggtgcggtccatggcgagcgcatcatggcgattgaaggtaagtggaggctgacagcggggagcgaggaccgggaccacccagctggcggggggctcggaggtgcgccggcaggccgaggcgctgacggggccgcctcctgtggtctggagccggctgaagacgcgcgggggtcctggccgcgtctcgggaggcgggtgggcggagcggcgccgctgggacgccgggcccgactggctcgctcgccccggccttcgtggttttgccggcctcccggcggccgcacgcggggcaaagcgggctggcgggcaggtacagcgtccgggccgccgcctcctgccggccgcgcggagtggaggtcggggtgaggccctgcagaccccacgggacgggctgggaggagcgaggggccacggggggctcaggctgccctttcttttctttccccggccgcggcaaaccatccttccgcaatacccaccttcctgccaaactgagagtccagttttttgtcccattcctaacccttccctgtgcccgctcgggctgatgctgggttacactctctgcccgttccccttctgtt

SEQ ID NO: 103604 - DNA, 58 bp, Homo sapiens; identical to SEQ ID NO: 68509
  chr1:210405727-210405785
  Hyper

SEQ ID NO: 103605 - DNA, 53 bp, Homo sapiens; identical to SEQ ID NO: 68510
  chr1:210406136-210406189
  Hyper

SEQ ID NO: 103606 - DNA, 49 bp, Homo sapiens; identical to SEQ ID NO: 68511
  chr1:210406479-210406528
  Hyper

SEQ ID NO: 103607 - DNA, 69 bp, Homo sapiens; identical to SEQ ID NO: 68515
  chr1:210465943-210466012
  Hyper

SEQ ID NO: 103608 - DNA, 235 bp, Homo sapiens; identical to SEQ ID NO: 68517
  chr1:211306663-211306898
  Hyper

SEQ ID NO: 103609 - DNA, 420 bp, Homo sapiens; identical to SEQ ID NO: 68518
  chr1:211307119-211307539
  Hyper

SEQ ID NO: 103610 - DNA, 33 bp, Homo sapiens; identical to SEQ ID NO: 39234
  chr1:211430421-211430454
  Hypo

SEQ ID NO: 103611 - DNA, 30 bp, Homo sapiens; identical to SEQ ID NO: 68520
  chr1:211504088-211504118
  Hypo

SEQ ID NO: 103612 - DNA, 30 bp, Homo sapiens; identical to SEQ ID NO: 68521
  chr1:211847757-211847787
  Hypo

SEQ ID NO: 103613 - DNA, 32 bp, Homo sapiens; identical to SEQ ID NO: 68522
  chr1:211871944-211871976
  Hyper

SEQ ID NO: 103614 - DNA, 29 bp, Homo sapiens
  chr1:212004453-212004482
  Hyper
acctgtctccttgacggctaaatgtccac

SEQ ID NO: 103615 - DNA, 17 bp, Homo sapiens
  chr1:212614848-212614865
  Hypo
gggcatggtggctcacg

SEQ ID NO: 103616 - DNA, 292 bp, Homo sapiens; identical to SEQ ID NO: 68525
  chr1:212873974-212874266
  Hyper

SEQ ID NO: 103617 - DNA, 96 bp, Homo sapiens; identical to SEQ ID NO: 68526
  chr1:212963883-212963979
  Hypo

SEQ ID NO: 103618 - DNA, 1459 bp, Homo sapiens
  chr1:213123589-213125048
  Hyper
cgcggggtcacttctcgggtggttttgtttctcctctgcttccacagttgcaaaccctcgaagtgccacgacccctggggaaactcgatcttaagtcccatggccaaacgctccagcccgcggggctctcaggacaccacagcgatcggatttcgcgtggccgccaggctccccctactcctgtcccctcccgccagagaacccctggagccaatcagagcgtcgcggagcccggggttgtagagtcccgagcccgggacccgcccctctttgttgcggtggccaatagacgcattcggaacatcggcggctgcccgggtgacttggttatatgtcacagaataacattcgagaatgggacatggaatgaggcgacggccccagcaagccccagcagccccagccccagccccaggcccagcagcagcagcagcagcccctgctctcccgccgcccggagaggctctgcagccatgaagccaaccgtcccgaggtaggatcttggagctgccgcgcgcccttcctgcgcgccgcccgcctgcagccagtccctcccggtgataggcgctggaactcggggaaaagggggcggatggagctctttccactagatccccgccggggtccgggagggcttcctggaagaaagcgggccgccttgcaagccaaggctgctgcagcgccctcgcgccagctctgggcgctcacatgccagcacgttcgtggctcccctcctctcttggccacatctgaggacccaggaatgtgtggagccttgcgggaacctcctgttccttcatgctacacaagctgtctttcttctccccacatcttgcgctccgcatcccccaagctccttgtgcccctccatccccaaccccccgggtttaggtgtgtgtgaagcttcgtggcacattttgagctgcctttctaggtaatcgcagggctggaagcccgtcatcgattctcagggaggctgtcagcgtgcaggggggagcggggagtgtcgtggagacactccgggacccctcactcggttccgctgtgcgtccacttagctgtggtgtcagctgtgtctccgctgatttcaggcaccgccggtaagcagggagcctccgcggagctcccgccgccgctcccccttggtgagtcctgccgcagcgagaggcatggagaaggccgcccccgcggggcgctgatcccctcgccgcgcccgcgcgcacacgccccccgccgccgccgccgctgccgccgccgcgcgcccccagtacctcgctccccgcccaggccccaccatgaccggctccgcggccgacactcaccgctgcccccaccccaaaggcgccaaaggcacccggtcccggagcagccacgcgcggcccgtgagcctcgccaccagcgggggctcagaggaggaggacaaagacggcggggtgctgttccacgtcaacaagagcgg

SEQ ID NO: 103619 - DNA, 180 bp, Homo sapiens; identical to SEQ ID NO: 39236
  chr1:213189664-213189844
  Hypo

SEQ ID NO: 103620 - DNA, 101 bp, Homo sapiens; identical to SEQ ID NO: 39237
  chr1:213190144-213190245
  Hypo

SEQ ID NO: 103621 - DNA, 80 bp, Homo sapiens; identical to SEQ ID NO: 68534
  chr1:214019656-214019736
  Hypo

SEQ ID NO: 103622 - DNA, 1209 bp, Homo sapiens
  chr1:214155741-214156950
  Hyper
cttctcttttcgctgcgtcaggcaggcacctacttatttctagcccactcctcaccctgaataaaagcttctggtaagatggacaatatggaaaacttcagtcctatcaccaaagcccctgaaaatggagcacccccgaattcacatccttgacgtgaaagaccaaagagagggaagctgggagtaacggccaaacatccttagagtaattgacaaaagaaagggggtgggcagaaagggagatttccatcccttcaaacgtgcacgcccctcccgcggtcccgggagggagtcccccctcccaggtcgagcgcgtccaccggctgtccccacagcaacaggcgggcggcgggggaggagaggccgcgggggcagcgcaggcctggcggcggccgaaatcccccggccaccacgacgttccccggctctgcggcgcgccgggagcaggtggttgccctctgcgtccagggcgtgtactgagcccaggctagctgagcgaggctgcagcccctgcgatggcccgggaagaggcaagtgccgcggggccagagcgaggagggaccagcagggcggcctggacccccacttggccgcgcaggcaggaggggcgcgccctctgcggagcgcggcgccgcggcagccgcagcatctggcgctcgctctctctggccggagaggccgcgacacctagcgcggggccgaggctaggaagggcgggccggggagggaggagggcactgggaggaagccgcgggcgaggaagccccgctcctgccgagtgcctggagaggagattcccagccttcctgcccaacccgaaacttttccaacacacgcaggcgtattcctcgcaggattcggcggtcccgagtcgcagtcagggaggaggctcgggaagcacacgtgccctggcacactggaggaggtacacaggcacaccaggagggacagggcctcttgggaggcggctgagggcgtgaaggcagcaggcggccacacatccgaaagggactccctgcgagcgggatcgagcgcttaaaaccctgccacagcttggaagtgtagcggtgcccagaggctttgcgtaactttgcccactgcgcccccgcgtgcaaaggtgtccccttcacactcacaccctcaccccatctcactccccttgagttgcggcccgagactgcctttgtacttaagcgacagcaaaagata

SEQ ID NO: 103623 - DNA, 437 bp, Homo sapiens
  chr1:214158780-214159217
  Hyper
cacggagctgggctgcgaaccgatctcgctcgcctagcgtggcgcgcgctcctatttcaagtcgccgctcctgcgccctaatgcgggctgcgaaccgccgcggcagagcgtcgcgagccgggagcctctgccgccgaggctgggggtgggagagcttccttgttcggcaagcgggttaccccgacttcgactcaggcctgcttttgcccacggcgtgacacaggacttactggggttctcagggaacttttcccgccgccagttcccgggcgtggtgtgtgcaaaacgtgcattcaagcgctatgtgcaattgacacaaacttgtgggctaaagtgcaagccatttttttcgcgtttgaatctttttctctgtccctgactcctttcttccccctactcccccctcctccttctctgctctccgcccttttaaatgt

SEQ ID NO: 103624 - DNA, 135 bp, Homo sapiens; identical to SEQ ID NO: 68541
  chr1:214159562-214159697
  Hyper

SEQ ID NO: 103625 - DNA, 319 bp, Homo sapiens; identical to SEQ ID NO: 68543
  chr1:214160107-214160426
  Hyper

SEQ ID NO: 103626 - DNA, 30 bp, Homo sapiens; identical to SEQ ID NO: 68544
  chr1:214162192-214162222
  Hyper

SEQ ID NO: 103627 - DNA, 393 bp, Homo sapiens; identical to SEQ ID NO: 68545
  chr1:214162457-214162850
  Hyper

SEQ ID NO: 103628 - DNA, 44 bp, Homo sapiens; identical to SEQ ID NO: 68546
  chr1:214193286-214193330
  Hypo

SEQ ID NO: 103629 - DNA, 573 bp, Homo sapiens
  chr1:214360467-214361040
  Hyper
gctgctgtaattctgcgatcccctgacgctggtatttgagaaacacactctggaaacgctgtggttgtttttcacaggaacccagggagctatcaaagtcggagaacgtgcctctgtttgcaggagaggtgggcaggcagcgagatccccgcgcaccgctcgctcgggctgcgggcaggcagcaatcagctaattgcctaatcggagtggggagctggtgcccgctcgccgcggtcgcctcgcgggtcacagacaagagagcggcttgttttctctctgtcacatcgtcgtcttgaaccgtgtggtctgttgcaggggaaggggccgagctggaggagcgagcgggcgggcggcgcttggcacatcccgaagaacgctgcctcggttgcctgcgaacgctcagggcaggcgccaagggggcttcagggggacaggagcccgtgagaaaacttagctcgccgcgctctgctcagctctacccggctccgctctcaggcgtgtgctcagaacacaccgagatcctttagaaataaatgtaatcgagactaatctggaaatcgtccctgcagccaa

SEQ ID NO: 103630 - DNA, 148 bp, Homo sapiens; identical to SEQ ID NO: 68550
  chr1:214387629-214387777
  Hyper

SEQ ID NO: 103631 - DNA, 73 bp, Homo sapiens; identical to SEQ ID NO: 68551
  chr1:214638017-214638090
  Hypo

SEQ ID NO: 103632 - DNA, 39 bp, Homo sapiens; identical to SEQ ID NO: 68552
  chr1:214724448-214724487
  Hyper

SEQ ID NO: 103633 - DNA, 43 bp, Homo sapiens; identical to SEQ ID NO: 68553
  chr1:214724743-214724786
  Hyper

SEQ ID NO: 103634 - DNA, 348 bp, Homo sapiens; identical to SEQ ID NO: 68554
  chr1:214725213-214725561
  Hyper

SEQ ID NO: 103635 - DNA, 1911 bp, Homo sapiens
  chr1:215255060-215256971
  Hyper
tcatcaggggattcccgctgagaaagtgggaaggaagagagtttagaaacggattgaagttccactacatcacgtgtgttgttagagaattcgcctattacgacgacagcaacgtctgatctcctggctttcttcccctccttggtgggttccgttccgtccccctgtcgctgcgagtttggctgtccctacgccggggtcttggagtttgggcggggtctggtacctgccaaatacggatcctgatggggaggaggtcggggagcgctaagttcaggctggagtctgagttctcccaccctgctgctcccacccaccgcgcttagaaacctatgtttccagcaaaggggtcttgctctgagagaacctaaccgggttttcttccattccctttgcatctctagatgtcttcgccctggctccaggtgcgttccccatccttttcggtcccggacgttctgcagattatagcgcccagctcatgtccagcaccgccggaggtgaagtggggcgagctggtgactccttaacccttcccgaaggtgtagactggaagaagccagggtcttcattacctcccctactccagggctctcaaggcgccaacggggacacttccctgtacaggtctggggggccacgagggcgaggaggacgccctagtgcaggggtccaaggactcgcgtcccagagcttggtcccacacccggtcccacaccccgaacgctggtcgggaaggagataggatgcagcgcagtgtgatgtggatgccagacagcgagagtgaggattttgcggggtggggatgggggttagtggaaggggctgagaggggaggaggcagcaggtgagccaaggggttgtgcccccaggaagagggaagagaggatctttagaagggagcatcttgcaggggcgacgcaggcaagggtagggctaggaggaggtgcggggaagcaagccctggcggtgagacaggagggggaggaggcgaagaggagggagttccgaaaggagggaaacgagccggcaaggggcgacaggagcgagccgggaagggagagcagcggagggctgcagagctgcgggcgcccggaccgtgccacacaccccccgcggggcacggagggcattgcggggggagacacacaaagacatgcgaagaggggctgaacgaggctcgcgcacaaagacgccggggcgcacggcagctggggctgcacccaccgcccccgcgccgcgccgtgccggggccgggccagcgagcagcccggggctgagcgcgtggcggcggcggcggcggcggcggcggcgggcaggcgcgggacccgggtcgcccgcgctctccgggtgacccgggcccggcagcaggcgcgcgcgggggcggcggcgcccaagcccaacttggcctccgcctcgccctctgcccagcccgccggtgtcccctccttcccgcgatttcgtttcttctcacgctcccccccccgccccctcccgcgtccagccccgctctccccaccttgtaaaacaaagccggggaaaatgcctgcccgtgcagctcggagcgcgcagcccgtctctgaataagaagtgagtacaatggcgtgtttgtaaaaaaaagcttcaagtccgtctttttcaaaaaacattttgaatgctgcatgcctcatgcttcccagcgcctcgcgggagagacccggctatagagcaggaggtgagaccccccctccggtacccccacccctctggccgcacgctctcctgccccagccttttctgggaggactgcaaatgccccctctcagcaagcggccgtttcccatcttcgcttcgcgtccaaagtgttgggtcataatctggatttggaggcaaacccttgccagatcctctccacgccgcttctcccccctc

SEQ ID NO: 103636 - DNA, 17 bp, Homo sapiens
  chr1:215745270-215745287
  Hypo
gccgagataaactttta

SEQ ID NO: 103637 - DNA, 30 bp, Homo sapiens; identical to SEQ ID NO: 68565
  chr1:216705663-216705693
  Hypo

SEQ ID NO: 103638 - DNA, 32 bp, Homo sapiens; identical to SEQ ID NO: 68566
  chr1:216774823-216774855
  Hyper

SEQ ID NO: 103639 - DNA, 113 bp, Homo sapiens; identical to SEQ ID NO: 68568
  chr1:216896454-216896567
  Hyper

SEQ ID NO: 103640 - DNA, 87 bp, Homo sapiens; identical to SEQ ID NO: 5901
  chr1:216896887-216896974
  Hyper

SEQ ID NO: 103641 - DNA, 30 bp, Homo sapiens; identical to SEQ ID NO: 68570
  chr1:216897216-216897246
  Hyper

SEQ ID NO: 103642 - DNA, 373 bp, Homo sapiens; identical to SEQ ID NO: 68572
  chr1:217262983-217263356
  Hyper

SEQ ID NO: 103643 - DNA, 30 bp, Homo sapiens; identical to SEQ ID NO: 68573
  chr1:217307206-217307236
  Hyper

SEQ ID NO: 103644 - DNA, 1839 bp, Homo sapiens; identical to SEQ ID NO: 68574
  chr1:217307467-217309306
  Hyper

SEQ ID NO: 103645 - DNA, 590 bp, Homo sapiens; identical to SEQ ID NO: 68575
  chr1:217309653-217310243
  Hyper

SEQ ID NO: 103646 - DNA, 1217 bp, Homo sapiens; identical to SEQ ID NO: 68576
  chr1:217310819-217312036
  Hyper

SEQ ID NO: 103647 - DNA, 800 bp, Homo sapiens
  chr1:217312947-217313747
  Hyper
tgaaaatataaaggacgctaggcaagtgagcttgcggtaattatccctggatagagaaaccaatctggctgggagaggcccctctgcaattgccggcggcggcggcggtgcgcgggcccgcgcagaggccggggacttcgggcgcttgctaggtcaccgcgccgggcgaccgccgctcgccggctatttaatatacatggggtgggaacggagcgaagcggatctccgagcctgcctgtcctgcagaaaaaaaaaatcaatttgctatttatttttgaaatatatagatttagggaatgttttttccagctcgacccccttcaagaatggcggcccacatttaattacgtcttttaatgacttttcccttatttgccatcgctattccacgttaagggcgggggcggggtggagtttctttggggggttttcaattctggtatcttcaaaaagatttgccttatgtgttaattgcatgctgttaagcacatctgggactgtgtgctgaccaactcagaccaacttttaattaacacattgacccggagaagaagcagccgcccagcctccccctctaaatatgtatattagccacgcggaggcggctcggcccgcgccgccagatgcaagcaaggaattgcctgcgtcgaggggcgggagggggtgcaaattgcaacggttctctctctttctgtgagcgttttttctcgcctcacctctaggaaaacaacaaagaaaaagagtaaatgaccggctcctgaatcaggcttcttacatcctttaggcgtgacttgacccca

SEQ ID NO: 103648 - DNA, 197 bp, Homo sapiens; identical to SEQ ID NO: 68580
  chr1:217805039-217805236
  Hypo

SEQ ID NO: 103649 - DNA, 2012 bp, Homo sapiens; identical to SEQ ID NO: 68582
  chr1:218337322-218339334
  Hyper

SEQ ID NO: 103650 - DNA, 30 bp, Homo sapiens; identical to SEQ ID NO: 68585
  chr1:218417045-218417075
  Hypo

SEQ ID NO: 103651 - DNA, 30 bp, Homo sapiens; identical to SEQ ID NO: 68587
  chr1:218519769-218519799
  Hyper

SEQ ID NO: 103652 - DNA, 543 bp, Homo sapiens
  chr1:218520108-218520651
  Hyper
tacctgcagcacactcgatatggaccagttcatgcgcaagaggatcgaggcgatccgcgggcagatcctgagcaagctgaagctcaccagtcccccagaagactatcctgagcccgaggaagtccccccggaggtgatttccatctacaacagcaccagggacttgctccaggagaaggcgagccggagggcggccgcctgcgagcgcgagaggagcgacgaagagtactacgccaaggaggtttacaaaatagacatgccgcccttcttcccctccgaaagtaagtacttattttgacttccatcccctgaggtttagctctgcccggagctctcaaaaccgcagcagctcccgggatcgcccttccctctcgcggttcccgttcgctcttttcccgttctcctgtccttcaccccaccacctccttttcagttgtatgcttgaggccatcaggctttaaaatgtttactttctactttattttctccatctttcccttccccctaacaattcggtgctttaaaaggcgttattctcttttt

SEQ ID NO: 103653 - DNA, 30 bp, Homo sapiens; identical to SEQ ID NO: 39240
  chr1:219253291-219253321
  Hypo

SEQ ID NO: 103654 - DNA, 330 bp, Homo sapiens; identical to SEQ ID NO: 68592
  chr1:219347186-219347516
  Hyper

SEQ ID NO: 103655 - DNA, 30 bp, Homo sapiens; identical to SEQ ID NO: 68596
  chr1:220012557-220012587
  Hypo

SEQ ID NO: 103656 - DNA, 1006 bp, Homo sapiens
  chr1:220101049-220102055
  Hyper
agaagaaaaagagggcgtggggtgagaagaaagggaccgggtgggaggaggaaggaagggccaagcggtccaaaggatgcaaccgaaaggcacctgctacgtttgcgaacacggtcgcccccttctcccgcttcctttccaccgaggtcccccggagggttacggccgagtccgagcctggggctgtcgggtccgccgcgcgccgcgggtcctccgcgccctgaggccccccgaaagcgccggggacacagccctccgccagctgctgccgctgctgcaggcggcgactgcgtccccggaggcagcacgcgaaccaggcggcgcagtcctggaagatgagcagccccaccacgttgaccaacagccccaggacgccgacgatgagcaccagctcggggtcatcgatgcgctcgggccgggccaggcgcagcacggcctccacgaagatggtgaagcagagcgcggtgaggaagaccgcgttgctcagcgcgcccaccacctcggcgcgggcgtagccgtaggtggcgctgaagccccgggtggggcgccgggcgatgtagccggcgctcaggcccacgcacagcgagatcaggtcggagagcatgttgaaggagtcggagagcagcgcgatggagttgcccaggtagccggagaccagctccgccacgaagaaggcgacggtgagcaccagcatgaagagcagccggcacgtcttgccagagtagcggcccatctcgccaccagccccgggcgcccggcgccgcccaggggagcgcagcccaccccgcgcgcagccacaggtggggggcgcggcgcggatccgtgaggcccggtacccgcctcccagattgtctcgccggccctgccccaccgctttttataacgcgaggccgagcgccaccagtccccgcacgtccagagtctaaaggagtggcgggggcagtatctgaacagcccgtgcaccgcctcccgcggcccttttcccctccctcgcggcctgggcctg

SEQ ID NO: 103657 - DNA, 277 bp, Homo sapiens
  chr1:220132215-220132492
  Hypo
caaagtgggaaaggacggcaaaagcatcggaggccaaggagagggagttgccaacgtaagcgatcactagttccatcacaaagaggaggatgctaacgacgcacatgaggattaaacggaagcttcttccggagtatcgccccatggcgtctcggtgccctggcagttcctctccctttcttgggaaggctgagctgctagggaagcagctatagattcagtgattacaactcctgggtaactcttcccttcagccctccggcgcttgtcatatttg

SEQ ID NO: 103658 - DNA, 86 bp, Homo sapiens; identical to SEQ ID NO: 68601
  chr1:220552703-220552789
  Hypo

SEQ ID NO: 103659 - DNA, 136 bp, Homo sapiens; identical to SEQ ID NO: 68602
  chr1:220636394-220636530
  Hypo

SEQ ID NO: 103660 - DNA, 137 bp, Homo sapiens; identical to SEQ ID NO: 68603
  chr1:220700814-220700951
  Hyper

SEQ ID NO: 103661 - DNA, 370 bp, Homo sapiens; identical to SEQ ID NO: 68604
  chr1:220702115-220702485
  Hyper

SEQ ID NO: 103662 - DNA, 553 bp, Homo sapiens; identical to SEQ ID NO: 68605
  chr1:220863640-220864193
  Hyper

SEQ ID NO: 103663 - DNA, 494 bp, Homo sapiens; identical to SEQ ID NO: 68607
  chr1:220921566-220922060
  Hyper

SEQ ID NO: 103664 - DNA, 602 bp, Homo sapiens; identical to SEQ ID NO: 68608
  chr1:220960001-220960603
  Hyper

SEQ ID NO: 103665 - DNA, 1937 bp, Homo sapiens
  chr1:221051973-221053910
  Hyper
cgctctcccgggtttcgggaggcagcctgttttgtagcctctgaggctccggggaaaggtttggctgcgtctaagagagacgtttggagccatccgtcttattttgtttgaaaagtcactcgttcaatttgtcactgtgtgacagctcagaataaaaccaatttgcggccgcccctcctcctcgcttcccggaggatctcctgggaggcacgaggcggacgcggtgctgagttgggccgggactcagggcggcaacatttgggcaagggcccaggaaagatgaggggctttgccgaggacacggactcctggaataaaagcagaatgaggtcaagagaagggaagcaaaggggccaaagcgcgctccgctctccaccgggaggcgggctttgcagagccctaaagagtgagattaccgtcccttccccacgcccccaactcgccccgggtgacaagcgcttcaggaaagctcctgtgatcaaccctccttgccccgtggcggttcggagctgcagaagttagaagagagtcagagccctccggagcggctgcctggcccctacgcagagtagcaagaagcactgcgatgtgcgctactaagcccacgcggccgcagcaaaaactttggcgtggccggggcgtggctagggtccggccaggcccccttgttcctaattcccctccactccccgctcccattggtcacgaggatgaccaatgagcgctcggatcgaggtcctaccccgggcctgactcgaaagctcctgccaaaactttgggagtttttagagacgagtttttttttttttctattacttttccccccccctaactaacggactattattgttgttgttttaaatttagctcttagggcttagctatttgggttttcttgcggtgtccggctcccgtctccctggctcccccgcccgccctgcggccccagcgcccctcgctctcatccagcccgcgaggagtgcgggcgccgcgccgcctttaaagcgaggccagggagcgaggcggtgaccggccgagatccggccctcgcctcctccctcggtggcgctagggctcccggcctctcttcctcagtgcgggcggagaagcgaaagcggatcgtcctcggctgccgccgccttctccgggactcgcgcgcccctccccgcgcgcccacccacccagtccggctggactgcggcagccgcgcggctcaccccggcaggatgttcgcagccgggctggctcccttctacgcctccaacttcagcctctggtcggccgcttactgctcctcggccggcccaggcggctgctccttccccttggaccccgccgccgtcaaaaagccctccttctgcatcgcagacattctgcacgccggcgtgggggatctgggggcggccccggagggcctggcaggggcctcggccgccgccctcaccgcgcacttgggctcggttcacccgcacgcctctttccaagcggcggccagatccccgcttcgacccaccccagtggtggcgccctccgaagtcccggctggcttcccgcagcggctgtctccgctctcagccgcctaccaccaccatcacccgcaacaacaacagcagcagcaacagccgcagcagcaacagcctccgcctccgccccgggctggcgccctgcagcccccggcctcggggacgcgagtggttccgaacccccaccacagtggctctgccccggccccctccagcaaagacctcaaatttggaattgaccgcattttatctgcagaatttgacccaaaagtcaaagaaggcaacacgctgagaggtaggtcttgggcgggaggctgcaggcctctgaccactgacccactccccggaccccgggctggcttggggtgcctttgagtgtttttacaattaaggacaaatcggtaaaacgggaga

SEQ ID NO: 103666 - DNA, 401 bp, Homo sapiens; identical to SEQ ID NO: 68611
  chr1:221067432-221067833
  Hyper

SEQ ID NO: 103667 - DNA, 36 bp, Homo sapiens; identical to SEQ ID NO: 68612
  chr1:221176286-221176322
  Hypo

SEQ ID NO: 103668 - DNA, 90 bp, Homo sapiens; identical to SEQ ID NO: 68613
  chr1:221252407-221252497
  Hypo

SEQ ID NO: 103669 - DNA, 38 bp, Homo sapiens; identical to SEQ ID NO: 68614
  chr1:221320657-221320695
  Hypo

SEQ ID NO: 103670 - DNA, 53 bp, Homo sapiens; identical to SEQ ID NO: 68617
  chr1:221706685-221706738
  Hypo

SEQ ID NO: 103671 - DNA, 357 bp, Homo sapiens; identical to SEQ ID NO: 68618
  chr1:221914136-221914493
  Hyper

SEQ ID NO: 103672 - DNA, 166 bp, Homo sapiens; identical to SEQ ID NO: 68619
  chr1:222210334-222210500
  Hypo

SEQ ID NO: 103673 - DNA, 167 bp, Homo sapiens; identical to SEQ ID NO: 68620
  chr1:222279248-222279415
  Hypo

SEQ ID NO: 103674 - DNA, 30 bp, Homo sapiens; identical to SEQ ID NO: 39244
  chr1:222391027-222391057
  Hypo

SEQ ID NO: 103675 - DNA, 135 bp, Homo sapiens; identical to SEQ ID NO: 68622
  chr1:222794527-222794662
  Hypo

SEQ ID NO: 103676 - DNA, 187 bp, Homo sapiens; identical to SEQ ID NO: 68623
  chr1:222987570-222987757
  Hypo

SEQ ID NO: 103677 - DNA, 267 bp, Homo sapiens; identical to SEQ ID NO: 68624
  chr1:223302777-223303044
  Hyper

SEQ ID NO: 103678 - DNA, 30 bp, Homo sapiens; identical to SEQ ID NO: 68626
  chr1:223361283-223361313
  Hypo

SEQ ID NO: 103679 - DNA, 30 bp, Homo sapiens; identical to SEQ ID NO: 68627
  chr1:223376610-223376640
  Hypo

SEQ ID NO: 103680 - DNA, 175 bp, Homo sapiens; identical to SEQ ID NO: 68629
  chr1:223536480-223536655
  Hyper

SEQ ID NO: 103681 - DNA, 304 bp, Homo sapiens; identical to SEQ ID NO: 68630
  chr1:223537183-223537487
  Hyper

SEQ ID NO: 103682 - DNA, 33 bp, Homo sapiens; identical to SEQ ID NO: 68631
  chr1:223537913-223537946
  Hyper

SEQ ID NO: 103683 - DNA, 423 bp, Homo sapiens; identical to SEQ ID NO: 68632
  chr1:223538158-223538581
  Hyper

SEQ ID NO: 103684 - DNA, 30 bp, Homo sapiens; identical to SEQ ID NO: 39246
  chr1:223841897-223841927
  Hypo

SEQ ID NO: 103685 - DNA, 18 bp, Homo sapiens
  chr1:223899327-223899345
  Hypo
tttgatatggagtttcgc

SEQ ID NO: 103686 - DNA, 189 bp, Homo sapiens; identical to SEQ ID NO: 39247
  chr1:223907491-223907680
  Hypo

SEQ ID NO: 103687 - DNA, 176 bp, Homo sapiens; identical to SEQ ID NO: 68637
  chr1:223922172-223922348
  Hypo

SEQ ID NO: 103688 - DNA, 25 bp, Homo sapiens
  chr1:223927954-223927979
  Hypo
cttgttccctggtgccgtaaagaaa

SEQ ID NO: 103689 - DNA, 630 bp, Homo sapiens
  chr1:223936580-223937210
  Hyper
ccaagtgcaagaaagcgcagccctgagcctcccaccccaggcctcggccgctgcgctagtgcgtccggcggtcccgcccggcagtaggacagagggagcgagggagtccgggaggaagggagagcgggtgcggccagtctgacggttgctgtgtttgcagatcaccagcgccgcggactcggaggccatcacgtttcagaagctggtgaaggggcacgcgtactcggtcaccggagccgaggaggtaacggccggcgcggatgtgcaggggtcctgctgtcctgacacgatggccacaggcacagtttgtggtgatgcccaggggcccgcgcggccccacggtggtccagtttacactcgggccccgcactcctgaagttccgcgcgggaggagaagggcgtccctttcgcagctcgggcgccgggtgcgccgcgctgccacctggtggccgcagtggccggcgccaggggccctggttttacttgttttagatgttaccctgttttacagttacaaccttactattttgataagctaaaaataataaaacaatgcatcttcatagtgttttatactctataaggtgctttctcttttgatctcgtaaaagtattcgtgcccatgttcaa

SEQ ID NO: 103690 - DNA, 30 bp, Homo sapiens; identical to SEQ ID NO: 68641
  chr1:223990949-223990979
  Hypo

SEQ ID NO: 103691 - DNA, 86 bp, Homo sapiens; identical to SEQ ID NO: 68642
  chr1:224072197-224072283
  Hypo

SEQ ID NO: 103692 - DNA, 30 bp, Homo sapiens; identical to SEQ ID NO: 39248
  chr1:224232559-224232589
  Hypo

SEQ ID NO: 103693 - DNA, 24 bp, Homo sapiens
  chr1:224251284-224251308
  Hypo
gattacaggcgtgagccaccacgc

SEQ ID NO: 103694 - DNA, 120 bp, Homo sapiens; identical to SEQ ID NO: 68645
  chr1:224267382-224267502
  Hypo

SEQ ID NO: 103695 - DNA, 159 bp, Homo sapiens; identical to SEQ ID NO: 68646
  chr1:224267802-224267961
  Hypo

SEQ ID NO: 103696 - DNA, 29 bp, Homo sapiens
  chr1:224300927-224300956
  Hypo
ggcgtgagtcaacacgcccagccttgtaa

SEQ ID NO: 103697 - DNA, 23 bp, Homo sapiens
  chr1:224361283-224361306
  Hypo
tgagattccgtctcaaaaaaaag

SEQ ID NO: 103698 - DNA, 152 bp, Homo sapiens; identical to SEQ ID NO: 68649
  chr1:224386053-224386205
  Hypo

SEQ ID NO: 103699 - DNA, 34 bp, Homo sapiens; identical to SEQ ID NO: 68650
  chr1:224400490-224400524
  Hypo

SEQ ID NO: 103700 - DNA, 277 bp, Homo sapiens; identical to SEQ ID NO: 68652
  chr1:224528612-224528889
  Hyper

SEQ ID NO: 103701 - DNA, 135 bp, Homo sapiens; identical to SEQ ID NO: 68654
  chr1:224803348-224803483
  Hyper

SEQ ID NO: 103702 - DNA, 2119 bp, Homo sapiens
  chr1:224803747-224805866
  Hyper
agtccctgctccaaccggtcccgccccacctccgctcggcctccagccctgcttgtactgctggcttcaagtttcctccgagaggcgggcgtgcacagctgcagtggcggcggcagcggccaccaagcgcccggcggcgcttcgccacccacctttcctcagcccccggcgctgcagtctccgcccgccggggagggcgcgctcagcggaacaggagtcgagggtggggcgccgagaggagggaatcccgggtcgcaccgctacagttctcgcagtggcaaaggcggcggcggcggcggcggcagcggcagcagcaggtggagcgagctacagcgtttggcctgaaacccactgctgcagccacccgggctggagttggcccgttgggtggagccagtgctcgccccggtccgacccccggtttccgggacacttgggttgcggaggccggctggccggagtcacggttggggacgggcgcgcctcggagcgcacggctgcgctggaagccgcgtctggggcgcaggaccaacgggacctacctcctcccggctacctaaagactccttctctcgggaaagagcgctgcccggctctgggatttgggaggagctcggaggccgctcgggcacctcgctggacactatccgtttgcgccccggtggcgcgggagggtccggagcggagcgctcgtctctcctcagcggtttagtggagaaaagcagagagctcttcctggggcgaatgggacctcctccctcggtcctccgtggagtcgtcgcatcgcttgtcgtgttggtctcgaggggctcacagcttggcactaatttgcaggtgttcgctgctgatttggtttcttcttcgatttgcggacggttccctccagcgactctcgacacacgttttcctgtcttcgccggagggccgggtctggggtcgccggagcctgcgggaatccagcgcttattcgctgaccctcgagtcgcttcgctagctgtgcgccctcctgggcactagcctggagaggagcgtgcagacgcggctccttggagggagtgcggtcctctagggaggcatcgggctcctaggggcttcttggcgtgtgtggtgggattggggtccgccggccatggccttcactttcgctgcgttctgctacatgctgtctctggtgctgtgcgctgcgctcatcttcttcgccatctggcacgtgagtaacacgctttggtctctcttctttcgccccaatttcgctaaatttccccgatttcaccccactttttccaccttgcgggcgtgggcgaaccggaaggttggaccttctgccgctccactgtcccggggcaggaggcagttcgctgcatcccgccgggcgcgccttcggtgccctggctggaggcgaggggccgctggtgcccaggtaggacaccctctgcagggcccgactgggcgtcccgggtcccgggcgccggggagtggcggctacaaccacaactaaccccttcctctcccgccccgtcctctcctgccggcgggaggcgaaggagaagcgccgccgtcggtcccggcaattagtcaagtagctataataactaaacatttaaaatgtcagcatctgtggtgggttgcatttagatataattggagacaaagtggaaacacgacgggagcgccttgtaagaggtagggagaagccgagcccacggagaggaaggagaccaggcgatgggggtcgaagtggaaggcggtgggggaaaggcgagaaggagaagagcaaggaggcgagggagactgggaagggcaggcatcattaaggccatggaggaaagtcacgaagagagaccgtggagagcgacgacggtgtcctccatctgccctcttggcgtctgaagtccgactcctgaagaccccctgcaggtggcgaacctccgctaggcccccagcgtccccagcccacacaagcttcctgtcacccttcccggggctacgccaggtggagggcagccgtggatcccagttctttaggtgtgggtgggaatagaggagcgcaagcttctgaataggggaagagaagtactgagagagcgcgcaggagtgcgtacgccggtcctctcaaaga

SEQ ID NO: 103703 - DNA, 29 bp, Homo sapiens
  chr1:225113123-225113152
  Hypo
aaatttgtggccaggcgccatggctcacg

SEQ ID NO: 103704 - DNA, 425 bp, Homo sapiens; identical to SEQ ID NO: 68661
  chr1:225117226-225117651
  Hyper

SEQ ID NO: 103705 - DNA, 120 bp, Homo sapiens; identical to SEQ ID NO: 68662
  chr1:225118168-225118288
  Hypo

SEQ ID NO: 103706 - DNA, 169 bp, Homo sapiens
  chr1:225632491-225632660
  Hyper
caacagataacaaatcgacattgtcgtgcataaatgtagagctgatccgtatttcatgtcaaaggcctggactgtgtgaaattggctggtatttgttccagaagcacttgttcatgttgaagatggggcagttctgagtgggttagcaggctgacgagcttggctcaga

SEQ ID NO: 103707 - DNA, 121 bp, Homo sapiens; identical to SEQ ID NO: 14333
  chr1:226062878-226062999
  Hypo

SEQ ID NO: 103708 - DNA, 36 bp, Homo sapiens; identical to SEQ ID NO: 68666
  chr1:226069474-226069510
  Hyper

SEQ ID NO: 103709 - DNA, 30 bp, Homo sapiens; identical to SEQ ID NO: 68667
  chr1:226085269-226085299
  Hypo

SEQ ID NO: 103710 - DNA, 90 bp, Homo sapiens; identical to SEQ ID NO: 68668
  chr1:226109616-226109706
  Hypo

SEQ ID NO: 103711 - DNA, 99 bp, Homo sapiens; identical to SEQ ID NO: 68669
  chr1:226150253-226150352
  Hyper

SEQ ID NO: 103712 - DNA, 86 bp, Homo sapiens; identical to SEQ ID NO: 39254
  chr1:226163129-226163215
  Hypo

SEQ ID NO: 103713 - DNA, 30 bp, Homo sapiens; identical to SEQ ID NO: 39255
  chr1:226284013-226284043
  Hypo

SEQ ID NO: 103714 - DNA, 127 bp, Homo sapiens; identical to SEQ ID NO: 39256
  chr1:226303892-226304019
  Hypo

SEQ ID NO: 103715 - DNA, 146 bp, Homo sapiens; identical to SEQ ID NO: 68674
  chr1:226314896-226315042
  Hypo

SEQ ID NO: 103716 - DNA, 1012 bp, Homo sapiens
  chr1:226410992-226412004
  Hyper
caggcaaggtgcttccgccgctcttaacggggatttgacccggagaagagagttctgtcgcctgcggcccgcgcacccgggcccctccgggctgcccctcccaggcaaatagtccttcggggatgtggattgcgccgtccgggcgggtgggcggggaagaacacggagggggccgggacccaagttcacgcctccctcctgcatcccgcagccggcggaagcgattattccccggcgtctggcggggccgggggcgggctcgcacccggaggagacacgggtctccccgagcccacctttgatcgcaccgccccgccttcccagcccctggcccgggagggtataagtgcggcccgcgcccctccgagcggcgcgctgggttccggagcgatggccacagccgagtcccgtgcgctccagtttgccgagggcgccgcgtttccagcgtaccgggccccccacgccggcggggcgctcctgccgcccccgagccctgcggcagccctgctccctgcgccgcccgcgggccccggcccagcgacctttgcgggcttcctcggccgggaccccgggccggccccgccgccccccgccagcctgggctcgcctgcgccccccaaaggcgcggccgccccgtcggcgtcgcagcgccgcaagcgcacgtctttcagcgccgaacagctgcagctgctggagctcgtcttccgccggacccggtaccccgacatccacttgcgcgagcgcctggccgcgctcaccctgctccccgagtccaggatccaggtgagggcccgctgcgttcgcaagtgcgcgctggagcggaggcgctgcggactctaggtctggactgcgggctcctgaggccacacccgggacgttgcaggcacggtgcttcccctgaggctctgcgtactagactgaaatagggggtgatatcggcacctgctgcatagggtggttgcgaggcctgtgtgaaataatttaggcctgcactgaacgatttctctcatta

SEQ ID NO: 103717 - DNA, 43 bp, Homo sapiens; identical to SEQ ID NO: 39258
  chr1:226620644-226620687
  Hypo

SEQ ID NO: 103718 - DNA, 16 bp, Homo sapiens
  chr1:226702271-226702287
  Hypo
ccgataaacacaagag

SEQ ID NO: 103719 - DNA, 30 bp, Homo sapiens; identical to SEQ ID NO: 39259
  chr1:226725373-226725403
  Hypo

SEQ ID NO: 103720 - DNA, 249 bp, Homo sapiens; identical to SEQ ID NO: 68682
  chr1:226735996-226736245
  Hyper

SEQ ID NO: 103721 - DNA, 1021 bp, Homo sapiens; identical to SEQ ID NO: 68683
  chr1:226736532-226737553
  Hyper

SEQ ID NO: 103722 - DNA, 72 bp, Homo sapiens; identical to SEQ ID NO: 68684
  chr1:226737889-226737961
  Hyper

SEQ ID NO: 103723 - DNA, 139 bp, Homo sapiens; identical to SEQ ID NO: 68685
  chr1:226816229-226816368
  Hypo

SEQ ID NO: 103724 - DNA, 18 bp, Homo sapiens
  chr1:226816428-226816446
  Hypo
ctccgtgacaactacaca

SEQ ID NO: 103725 - DNA, 37 bp, Homo sapiens; identical to SEQ ID NO: 68687
  chr1:226826631-226826668
  Hypo

SEQ ID NO: 103726 - DNA, 54 bp, Homo sapiens; identical to SEQ ID NO: 68688
  chr1:226829338-226829392
  Hypo

SEQ ID NO: 103727 - DNA, 300 bp, Homo sapiens; identical to SEQ ID NO: 68689
  chr1:226846358-226846658
  Hypo

SEQ ID NO: 103728 - DNA, 82 bp, Homo sapiens; identical to SEQ ID NO: 68691
  chr1:226908374-226908456
  Hypo

SEQ ID NO: 103729 - DNA, 887 bp, Homo sapiens
  chr1:226924772-226925659
  Hyper
cctcttggcctcctccggccctggcggggagagggtaccggctgccaccacctgctgccggtcccctcgcaggcgaccagcccaacttgggctgctcacgctactgccgctgctgccgctgccactgccgctgctactattcagcctgcgccggccgctccgccagcccccggggctccggggctcctcgggggacagcgactcggctggggggaagaggaaagaggcgcctctcccggggctgaaaacgctgccggggctcagcactgccctcctcgggggcgggggcgtctcgctgccactgggccccgggccgccgccgctcttcatctcgttggcgctattcatgatcaccaggctattgagcgcatagcagtacacagccatagtactgggtcccgcgctgcccgccgccgcggctcccgctcctgctccgccgccggcgcctcctcctcccggcgctcccggctcagccccggaggcccggcagccgcggctccgcgcgcagatggggcggcatggcctgggcagcgggctgggggcacgaccgcgggctcagcccccgcccaaagctccataaacaaccgtgcggctgtggagatacaaggagaaaagtcaggaccctggagggcgcgcggggggagttgggggtcgcctgcagaacccagagagagccccgggaacacaatctatccgggacccagcgccaccggacatctcacctatggggacggcgaggctcggcgagggcatgccccggctgcctcggtcgccagcgcggtttcgggtgtgcttccccgccccccacctcgccccaggctgcgatgcgctttatgaggtcccttcaaatcccaatcctaatactcgtctcgcggaccggcgagaag

SEQ ID NO: 103730 - DNA, 86 bp, Homo sapiens; identical to SEQ ID NO: 68694
  chr1:226926865-226926951
  Hyper

SEQ ID NO: 103731 - DNA, 38 bp, Homo sapiens; identical to SEQ ID NO: 39263
  chr1:226954853-226954891
  Hypo

SEQ ID NO: 103732 - DNA, 30 bp, Homo sapiens; identical to SEQ ID NO: 68696
  chr1:226972978-226973008
  Hypo

SEQ ID NO: 103733 - DNA, 30 bp, Homo sapiens; identical to SEQ ID NO: 68699
  chr1:227163741-227163771
  Hypo

SEQ ID NO: 103734 - DNA, 55 bp, Homo sapiens; identical to SEQ ID NO: 68700
  chr1:227174055-227174110
  Hypo

SEQ ID NO: 103735 - DNA, 343 bp, Homo sapiens; identical to SEQ ID NO: 68703
  chr1:227505516-227505859
  Hyper

SEQ ID NO: 103736 - DNA, 913 bp, Homo sapiens
  chr1:227729731-227730644
  Hyper
cgcgcatgcgggagccgaggccgcagcactgggtgggcagctagctcaccgaagacccacgcagcgggccaggcgccagcggccgctaggtctgggcgcggggccgggccggcgagagaagggtccggggcacccagtgggctcggatctcgagcggtccccgtgacggccccgcgactgcgcgacttcccgctctagagagtttatggaccctgtcccaggagggctccgcagccgccagggaggtaccggagggaccgcggcgctgggagagggtggcgccaggcggccctggagccctgggcgacgcggccgggccggccagagggcggagaagtccaaagcagcagcccggacagccgcttccgcccctgcgccgccctcccggcccaggtgaccggtcgccctacccggggagcagcgccctcctcctcctgggccggagccgggcgtgggggtcgcaggctggtgccacagcctgaggacaccgcggcctctgccccggggagcacgccaaatgccggacggagcggctgttgcagacggtgaggccgcagccccgcttgagggtagggtcgggcggggtgtcggggtcctggcagaggccgcggcgagggcaggagccggtgcgctggccgctgcacatgcgccgcccggcaccgggaccctgcgggcgcgccccctggtggcagccagcgggaggtggcgtccctgtccccagccaggcggcagcgcgaagctgcctccccgcggggggagcggaagtggcccagctgctcgagtgacttactagttaaaaagctggggttggagctgccacgcggggaagtgtggaggcctgcggggctccgcctagactttctgggtgtcctcctgggacctcaggttcctcacctgtcgcagaggactgatg

SEQ ID NO: 103737 - DNA, 203 bp, Homo sapiens; identical to SEQ ID NO: 68707
  chr1:227750829-227751032
  Hypo

SEQ ID NO: 103738 - DNA, 30 bp, Homo sapiens; identical to SEQ ID NO: 14336
  chr1:227921541-227921571
  Hypo

SEQ ID NO: 103739 - DNA, 53 bp, Homo sapiens; identical to SEQ ID NO: 68710
  chr1:227921780-227921833
  Hypo

SEQ ID NO: 103740 - DNA, 61 bp, Homo sapiens; identical to SEQ ID NO: 39268
  chr1:227926624-227926685
  Hypo

SEQ ID NO: 103741 - DNA, 151 bp, Homo sapiens; identical to SEQ ID NO: 68712
  chr1:227955886-227956037
  Hypo

SEQ ID NO: 103742 - DNA, 71 bp, Homo sapiens; identical to SEQ ID NO: 68713
  chr1:227975163-227975234
  Hyper

SEQ ID NO: 103743 - DNA, 360 bp, Homo sapiens; identical to SEQ ID NO: 68714
  chr1:227976261-227976621
  Hyper

SEQ ID NO: 103744 - DNA, 30 bp, Homo sapiens; identical to SEQ ID NO: 68715
  chr1:228071573-228071603
  Hypo

SEQ ID NO: 103745 - DNA, 43 bp, Homo sapiens; identical to SEQ ID NO: 68716
  chr1:228074452-228074495
  Hyper

SEQ ID NO: 103746 - DNA, 375 bp, Homo sapiens; identical to SEQ ID NO: 68717
  chr1:228074787-228075162
  Hyper

SEQ ID NO: 103747 - DNA, 153 bp, Homo sapiens; identical to SEQ ID NO: 68718
  chr1:228082129-228082282
  Hypo

SEQ ID NO: 103748 - DNA, 221 bp, Homo sapiens; identical to SEQ ID NO: 39270
  chr1:228083399-228083620
  Hypo

SEQ ID NO: 103749 - DNA, 30 bp, Homo sapiens; identical to SEQ ID NO: 68720
  chr1:228092133-228092163
  Hypo

SEQ ID NO: 103750 - DNA, 47 bp, Homo sapiens; identical to SEQ ID NO: 68721
  chr1:228117865-228117912
  Hypo

SEQ ID NO: 103751 - DNA, 30 bp, Homo sapiens; identical to SEQ ID NO: 68722
  chr1:228126165-228126195
  Hypo

SEQ ID NO: 103752 - DNA, 200 bp, Homo sapiens; identical to SEQ ID NO: 68723
  chr1:228134691-228134891
  Hyper

SEQ ID NO: 103753 - DNA, 614 bp, Homo sapiens
  chr1:228135107-228135721
  Hyper
aagctgctaggtgggcgatggccaggggctgaggactcaggctccagccttttggcaaggacacggcggcccaaggaagtcgggacctgatcccagtccctaagcgcgaggcagtcctgctcacggcggcgactacgacgacgacgactctgcggtcacggaggaccgcggcccggcgcaagccggacgggtccacccgcctctctagccgtgccgcgcagcggacggagcgacgcgcgcgccgcaaacaaacagcgccaggcaacccggcggccccgccgcgccccggccccagccaccccgggtgcctcggggactccggacgaccccgccccggccccgccgcccccgcccaccagtgcgcgccggccgccgaaggcacctacccgaagtaggcggccgaagggcgcagcgcggcgagcagcagcgtcagcccgaaggccgcggccagccagcgcgccagcggggacccatccagcatcttgccgcgcctcggcggccgaccatcgcgctcccagctccgcgcagggcgcgccgcggccgccgccctcttatagcgcccggagcgcggccagctgggcccggccccgccccgcgcccgggaggggatcacg

SEQ ID NO: 103754 - DNA, 46 bp, Homo sapiens; identical to SEQ ID NO: 68726
  chr1:228136106-228136152
  Hyper

SEQ ID NO: 103755 - DNA, 30 bp, Homo sapiens; identical to SEQ ID NO: 68727
  chr1:228136517-228136547
  Hyper

SEQ ID NO: 103756 - DNA, 30 bp, Homo sapiens; identical to SEQ ID NO: 68728
  chr1:228193886-228193916
  Hyper

SEQ ID NO: 103757 - DNA, 2443 bp, Homo sapiens
  chr1:228194126-228196569
  Hyper
cagctctggtctcagcggaaggagtccggccgcaggcagacggggccaaaggacgtgcacccgacaaccgtccgctccctccccaaacccccgccccgagaaggttgatggatgaaggggagccctagcccagccacctcgggggcaagagacggagctcgccacagaccaggagcgagagggggactgcgggtcccaccgtgagcgcagggcgcgcggggctggaaacccaggacgcggcccgggagctccaggagggcgcctgcggatcgcgcggccccgggccggccgcctgcccatctggcgcaccccagcgcgccgcgcacacctgggggcccgcacaccagcacgtcctcagacacaccgacacccacggcagcaggcgggggccaacgccgccgccgcggttcgggctcccgtggccccgcctgcccctgcctgccccgcccgggccccggccccggcgggcgccccccgcggcgctgccccgcccccgccgccccgcgccgccccgggcctcggcccgcagcccggccgccggcccacctggcgcagcgccgccctcggagcccgcgcacacccgcgcacccgcggccgcaggagggcccagcgacgccgccgcgccagctcccagggcccggccccccccggcgctcacgctctcggggcggactcccggccctccgcgccctctcgcgcggcgatggccccactcggatacttcttactcctctgcagcctgaagcaggctctgggcagctacccgatctggtggtgagtgagcctcctcgcgttcgcccctgcccctgtgcgccgcgcccgcagcagacggtcccctcgggcagggaccccgcggtggcccgagcccgcgcccttctgctccagccccgcgtgcgggccgcgggcggttggttttccttgacggccactttggacctgttcaggccgctgggacgcgtgggtggcggagtttccggagacattgattcccgagcgggggagtaggggaggttgcggaggtcctagctgcccctggcgtcggacagggcgagcagtgggctggggagaggctgaaagaaggtcggcacgcacggtcaccgaggggacaggcagctcgaggccaggggacaggcgagggaagagggccagcgagagagaattcgccggagactttcctcaaaaaccgtatcttacacacaaacacacacacacgttttaaaacaaagtcgatgagacaagactgaacagctcggagcagcgtggttacgtaaagaaagctgggacccggcggggagtggcgcagagccggcggcggggcgcactgggggccggccctgggccccgcgcgcctccccgccgcagtccgggcacgggggtttccaggggccctctctgcgagccctccgcatgggtccacctggcaatgaggggctgctgtagagagagttaagggtgagttaagcacggggtgtgaggggctccaggaccctcaatcagaaagcgctgtgctgcgccctccacaccagaaaaggcgcgttccgtgagaccctccccagcctggcgatggaagtgcagataaaccaaaggaagggtcccgaaaggtctctctcaggcctcccacctccactgcacatatcctgtgggagggggaacggtggccacactttcgccagggcttgtgatccctcagagccctcaccaagcaaggatcaccccagttccgaattaagggcgctctgagatgcccaagattgaggaacacaagtgggaggaatgtgggcgcgcagggccgggcgcagcgctggtaggacccacagttggagagaagcctccccacaagcatgcacactcccccccatccttctccgacggcagcctggaattataataattacgccgaggggaaggggggagacccagcgagccgaggtacatctaatccgataataatttttctcttcgagatggttcaggagcgggggctcccgcggtaggggcgccgggccaggagcagcggggaggggaaggggcagccctaggcagctgaagggcctggaagaggccacgaggccgcggggacgcgcttcggggacccccgcgcgcccctatttccgcgtgccccatttcccgtgcggcacctgctgcgcccagtggcccacctgagggtcaggctcggggctcgccttggggtgcggggatactgacgcgcgtccagacggccgcagggagccaggggcagcgcgtccgtccgagagagccccgagggctgccggcttacgcaccaggcttctaattagaacccgccgccgcgttcctgagcgcaaaaggaagctccttcgccccgcgcccttcccataaatgtcgccagcctcctggcaaccccgcgccctaggatctttgtcttgtcggccctgagggttcctagcctcggtccccatccacc

SEQ ID NO: 103758 - DNA, 102 bp, Homo sapiens; identical to SEQ ID NO: 68731
  chr1:228201221-228201323
  Hypo

SEQ ID NO: 103759 - DNA, 413 bp, Homo sapiens; identical to SEQ ID NO: 68732
  chr1:228225526-228225939
  Hyper

SEQ ID NO: 103760 - DNA, 79 bp, Homo sapiens; identical to SEQ ID NO: 68733
  chr1:228238495-228238574
  Hypo

SEQ ID NO: 103761 - DNA, 38 bp, Homo sapiens; identical to SEQ ID NO: 68734
  chr1:228247050-228247088
  Hyper

SEQ ID NO: 103762 - DNA, 30 bp, Homo sapiens; identical to SEQ ID NO: 68735
  chr1:228247856-228247886
  Hyper

SEQ ID NO: 103763 - DNA, 497 bp, Homo sapiens; identical to SEQ ID NO: 68736
  chr1:228248302-228248799
  Hyper

SEQ ID NO: 103764 - DNA, 30 bp, Homo sapiens; identical to SEQ ID NO: 68737
  chr1:228264825-228264855
  Hypo

SEQ ID NO: 103765 - DNA, 30 bp, Homo sapiens; identical to SEQ ID NO: 68738
  chr1:228322401-228322431
  Hypo

SEQ ID NO: 103766 - DNA, 78 bp, Homo sapiens; identical to SEQ ID NO: 68739
  chr1:228331863-228331941
  Hypo

SEQ ID NO: 103767 - DNA, 30 bp, Homo sapiens; identical to SEQ ID NO: 39274
  chr1:228342820-228342850
  Hypo

SEQ ID NO: 103768 - DNA, 30 bp, Homo sapiens; identical to SEQ ID NO: 68741
  chr1:228343136-228343166
  Hypo

SEQ ID NO: 103769 - DNA, 163 bp, Homo sapiens; identical to SEQ ID NO: 68742
  chr1:228397736-228397899
  Hypo

SEQ ID NO: 103770 - DNA, 72 bp, Homo sapiens; identical to SEQ ID NO: 68743
  chr1:228398961-228399033
  Hypo

SEQ ID NO: 103771 - DNA, 66 bp, Homo sapiens; identical to SEQ ID NO: 68744
  chr1:228400877-228400943
  Hyper

SEQ ID NO: 103772 - DNA, 30 bp, Homo sapiens; identical to SEQ ID NO: 68745
  chr1:228444438-228444468
  Hypo

SEQ ID NO: 103773 - DNA, 700 bp, Homo sapiens; identical to SEQ ID NO: 68746
  chr1:228463170-228463870
  Hyper

SEQ ID NO: 103774 - DNA, 30 bp, Homo sapiens; identical to SEQ ID NO: 39275
  chr1:228466507-228466537
  Hypo

SEQ ID NO: 103775 - DNA, 30 bp, Homo sapiens; identical to SEQ ID NO: 68748
  chr1:228473902-228473932
  Hypo

SEQ ID NO: 103776 - DNA, 206 bp, Homo sapiens; identical to SEQ ID NO: 68749
  chr1:228495816-228496022
  Hypo

SEQ ID NO: 103777 - DNA, 47 bp, Homo sapiens; identical to SEQ ID NO: 68750
  chr1:228501386-228501433
  Hypo

SEQ ID NO: 103778 - DNA, 35 bp, Homo sapiens; identical to SEQ ID NO: 68751
  chr1:228502582-228502617
  Hypo

SEQ ID NO: 103779 - DNA, 293 bp, Homo sapiens; identical to SEQ ID NO: 68752
  chr1:228504399-228504692
  Hypo

SEQ ID NO: 103780 - DNA, 591 bp, Homo sapiens; identical to SEQ ID NO: 68753
  chr1:228528791-228529382
  Hypo

SEQ ID NO: 103781 - DNA, 30 bp, Homo sapiens; identical to SEQ ID NO: 68754
  chr1:228533007-228533037
  Hypo

SEQ ID NO: 103782 - DNA, 94 bp, Homo sapiens; identical to SEQ ID NO: 68755
  chr1:228536497-228536591
  Hypo

SEQ ID NO: 103783 - DNA, 30 bp, Homo sapiens; identical to SEQ ID NO: 14339
  chr1:228552593-228552623
  Hypo

SEQ ID NO: 103784 - DNA, 33 bp, Homo sapiens; identical to SEQ ID NO: 68757
  chr1:228554180-228554213
  Hypo

SEQ ID NO: 103785 - DNA, 172 bp, Homo sapiens; identical to SEQ ID NO: 68758
  chr1:228554797-228554969
  Hypo

SEQ ID NO: 103786 - DNA, 865 bp, Homo sapiens; identical to SEQ ID NO: 68759
  chr1:228558699-228559564
  Hypo

SEQ ID NO: 103787 - DNA, 32 bp, Homo sapiens; identical to SEQ ID NO: 68760
  chr1:228560007-228560039
  Hypo

SEQ ID NO: 103788 - DNA, 45 bp, Homo sapiens; identical to SEQ ID NO: 26914
  chr1:228566475-228566520
  Hyper

SEQ ID NO: 103789 - DNA, 246 bp, Homo sapiens; identical to SEQ ID NO: 68762
  chr1:228566723-228566969
  Hyper

SEQ ID NO: 103790 - DNA, 1013 bp, Homo sapiens
  chr1:228603596-228604609
  Hyper
cacagatgcacatatcggtaaacatacatgcatgtacacacaggtacacgcgcgcacacacgcacaggcacacaagcatgcacatagatgccccctgcaatctcaacactcgcgaccccacgcagtggagatctacagactttcgcctacgccacggggttgctatggggaccgagttgcagaaggagttgaaaatcgcgtctacactgcaagcacgattctccccttccgttctgccatcccctaaagcgagggcgtctaggggtctcagacttccccggctctgtcccacgtccagtttctcggagctttctgcacgccaaccacccggcgccagccctccgactccccccaagagccctaacggaggcacccagcccaccctgaccgaagccgggcagggacagcggcagcgggcctggggctctggctctggctgccgggatggctgtccttcccgctctggtccgctagggtcccggtagagttaccttgttgaagcgcgctagcccctccagggacgcggcggccggcggaggcgggaaggccgggcgttggagggcgaggaggaccgggttaggcttaggtcgtggcccaggcgccacaggagggtagcctaggcggcggggtgggggctactcaccgcggggaaggggggcccgcacagcgcctagtgcacctggccgagcgctcgctgccgggaaaggctgggtctgcccccacgaagcccaggaggctgcggcccggcccggggcgtggggacctggggtcgggaggcctagggactttgtggcgtcagcgggggctggggggcggcgggggaggggaatgctgggcgagggagtgttcggcggccgggactggggcggcgcctcttaggagaggttgggggtggcttggggaaggaaggcggcagggggtggaaggctctggacgagccggggacaggcgcagcgggtgctgactgggcggtggggaggatgtggtccacagcccagcgaagggaggagtct

SEQ ID NO: 103791 - DNA, 774 bp, Homo sapiens
  chr1:228633487-228634261
  Hyper
aaggcgcctgtcactcgtcactctccacgcgggctggctctggaaagcccaaaggaaaaaaccctcactttcaggaagaataagcctcagcccatgtatctagggaacacgtgatgctgcaagaaaccagtgacttaacgcgtgtaaaagcaggagagcgtcagaggttctgaccccgggggaggagcagacccgcggcagcgtgcggagacttagcgggcggaatctgccaccaacgcaacctggcccagaggttttgaactgaccaactgggagacgtccccgagcttgaataagggcctcaaaagcttagcgttttatgcagagtcgcaaccacccagcgctgggaacctgagcctgcacaacccactagaaagcacccgtgaccgtcccctgcgcccgttatccctgcgccccgcacccctgtatccccggcttctctgcagctgtacaccctgcactgcggcgccccccagtcccgctgtccgctccatcgcgcaggtctccaaaacgaatcccggcttggaggggctcagcggccctgggcctgtgcgccgttgcggccgggagggtcattttcatgcctaaggacccgccccttgcacgcaacctcgggtagccagccggaaacggcgtcccgggctccaaaggacatctctttttacatttcagcaaaacagccgcacaccttctccccagatggcctctgtgcagcctgaaaatgcccgctccctccaagtccctgggcaattgctgggacgcatctcagagact

SEQ ID NO: 103792 - DNA, 990 bp, Homo sapiens
  chr1:228644901-228645891
  Hyper
acacgttgcccacctcgcaagtatgcagcccaatcagtccccagggtctcggttcccgttgcgcccttccccatggccactgcgctcattcatgagcctagggtgatcaggcctccggcctataaagaactgcaggatcagtgcggctcttttctcgagatagtaggtggctctgaaaagagcctttatgtccatcaaaggggccccgggggcggcgggcggcctcacttgcccttggccttgtggtggctctccgtcttcttgggcagcagtacggcctggatgttgggcaggacgccaccctgcgcgatggtcacgcggcccagcagcttgttgagctcctcgtcgttgcggatggccagctgcaggtggcgcgggatgatgcgcgtcttcttgttgtcgcgcgccgcgttgccggcaagctccaggatctcggcagtcaagtactcgagcaccgcggccagatagaccggggcgccggcgcccacgcgctccgaatagttgcccttgcggagcaaccggtgcacgcggcccacggggaactgcagccccgcgcgcgacgagcgcgacttagccttggcgcgcgccttgccaccctgcttaccacgaccggacatttccgagtcaaggaaaaaagacaacggcaaccgaaaagcgagactaaaaacaagagggcagtgaaggccagcgagcccttatgtatggtacagaggtaggctagaccgcggcgttcgattggatggctatggtagccaatcagaaaaagaacctggcactcctaatttgcgtattcctttcccagcgatgacgtagaacaacgtttgatccaatcagaagtgagcaaatcctgagccttcatttgaatacaaaacgtacaaatagagttactccgagcgccgcgcgtttctgtttggagagactcagccatcatgccagacccgtccaaatcggctcctgcgcccaagaagggttctaaaaaggctgtcacca

SEQ ID NO: 103793 - DNA, 360 bp, Homo sapiens; identical to SEQ ID NO: 68770
  chr1:228646191-228646551
  Hyper

SEQ ID NO: 103794 - DNA, 90 bp, Homo sapiens; identical to SEQ ID NO: 68771
  chr1:228646851-228646941
  Hyper

SEQ ID NO: 103795 - DNA, 123 bp, Homo sapiens; identical to SEQ ID NO: 68772
  chr1:228647194-228647317
  Hyper

SEQ ID NO: 103796 - DNA, 688 bp, Homo sapiens
  chr1:228651254-228651942
  Hyper
tttgggggtaaaatacgagaatcccttaattggggaaattttagctgagtgataaggagatctgtgagcctgctgttttgatgtttcaagcaggaaggcgtggcataaagagctgcttaggcgcaacgctgctgaaatggttttggctagaagctcacagtgtctagttgtggctaaggagggaggaaaggggcgggagaagaacggacccaagcgcctccgcccagacggcgcgataaccccctcacctccaaccccggacctcagtgagcacgtcctccagtctcagccgccaggaggcactgggggcggggacgtggcacaagatcttcccggaggtgacccacgctcctcgcgcgcagggcgtaagccacacacagatctttggatgggatccatggcgcaatcgcctgtactgccccctctctgactttgcctgtggccaacacaagacgaacgcagcctttctaagggaaatatgccgttacaaacaagaagcctaattttgtctctaagacttgcgcccccacggctcagtctactttccctcattactccaattgaatcacaggtcacaaccagaccaggtggcacgctccttttggagcttggaggtggctctgaaaagagcctttgggttcggggcgccgggacgcacctcacttggagctggtgtacttggtgacag

SEQ ID NO: 103797 - DNA, 387 bp, Homo sapiens
  chr1:228652242-228652629
  Hyper
gccttcttggagccctttttagaagccggagccgcccgcgatggctccggcatggcgaggtgacaagagcgcctagacgaacgcggatgcggggccggcagggctatttgccatctttatattcaaattaaggctccaaatttgtagtgtctgattggacggcctgactccgcggccgccactgggaggaatttctgtaaatagcagagtccggttcttctttcctattggacggcggtccaaccaatcccaaggcatatccgccgcgcgccggagctgaggttgcgcatctttgttcaaagcctttgttttaaacctggagatttttgtgtctgcagcggatctggaggtagctaaagagaaactgaaaaacggttgcaaccccaa

SEQ ID NO: 103798 - DNA, 30 bp, Homo sapiens; identical to SEQ ID NO: 68776
  chr1:228671304-228671334
  Hypo

SEQ ID NO: 103799 - DNA, 134 bp, Homo sapiens; identical to SEQ ID NO: 68777
  chr1:228677767-228677901
  Hypo

SEQ ID NO: 103800 - DNA, 94 bp, Homo sapiens; identical to SEQ ID NO: 68778
  chr1:228870805-228870899
  Hyper

SEQ ID NO: 103801 - DNA, 369 bp, Homo sapiens; identical to SEQ ID NO: 68779
  chr1:228871227-228871596
  Hyper

SEQ ID NO: 103802 - DNA, 46 bp, Homo sapiens; identical to SEQ ID NO: 39283
  chr1:228919370-228919416
  Hypo

SEQ ID NO: 103803 - DNA, 30 bp, Homo sapiens; identical to SEQ ID NO: 68790
  chr1:229354058-229354088
  Hypo

SEQ ID NO: 103804 - DNA, 748 bp, Homo sapiens
  chr1:229542788-229543536
  Hyper
cccgccctggtctctcggtttagttcatgctgaggttggtcgcttgtttcattcactgtctcctacgcagtccatgccacgggggataagtttttcacaagtggctttttttccccacagtgaagagacgtggcctgggtctggagttcctcaaccggcaaaatacgacgtgaacagctcctgcacccaaaaaggccccgagttaactctgctgcataggcgaggcaggcaccgcgccgccagtcggggacgcagagcgagcgcgtcctctgggatttgaaggccgcccccgtcaaagttggcattcgggggcctgcgtgttccggagctacggagcggcaactgaggcaggagctcaggactggggggagaaagagagaccctggaagcgattaacgtgccccttgctttacagatgtggcagataagacacgagagggagctctggtccccgaggggctgtcccgggagggagcgaggtggggagggggagcaggccctgccccgagcaccccgcggactgagcgtctggcgtgcacggcggaggggttaccgcggggaggtgacaccccagggtggtgagggcacgcagatgaggctggcctgaggggtgcctgctttggggaaagcagtctgtggagggagggaaggagggcgatcgcggccccacgcgggttgtgctgctgaggctccgcgccgcaggaaaggcaccctagccggattcgccctcggacgccccagctgggca

SEQ ID NO: 103805 - DNA, 257 bp, Homo sapiens; identical to SEQ ID NO: 26933
  chr1:229566603-229566860
  Hyper

SEQ ID NO: 103806 - DNA, 1287 bp, Homo sapiens
  chr1:229567087-229568374
  Hyper
gttaatgtatgtacacgttataaacactgtgtcagtttacgatggcagcaacggaagttgttacaaagaaagtgactgcggggtggctggagctcagccgcccccccattgagaagattcgtcgtcctgagaagtcgcgtgctggaggtggagtgtgtctagaagcatttgcggtggacgatggaagggccggcctcgtcgtactcctgcttggtgatccacatctgctggaaggtggacagcgaggccaggatggagccgccgatccacaccgagtatttgcgctccggcggggcgatgatctgcaagacagcgcgtgaggtggggagacctcaccctggagcccaccccgccgacagcccgcgcaggccaccacccaccttgatcttcatggtgctgggtgccagcgcggtgatctctttctgcatgcggtcagcgatcccagggtacatcgtggtgccccccgacatgacgttgttggcatacaggtccttcctgatgtcgatgtcacacttcatgatgctgttgtaggtggtctcgtgaatgcccgccgactccatacctggggaccgcggcggggagcgtgagcagaagctcggggcgccgggggccggcggggcctgggggccggggcgagggcgagcggggctcaccgatgaaggagggctggaagagcgtctccgggcagcggaagcgctcgttgccgatggtgatgacctgcccgtctggcagctcgtagctcttttccagggaggaggaggaggcggccgtcgccatctcgttctcgaagtccagggccacgtagcacagcttctccttgatgtcgcgcacgatctcgcgctcagctgcggagggcagaagcaggagaggagccctcactcaggggccgccgccggccctcccgcccggggtgcaggggcgccgcgcacctgtggtcacgaaggagtagccacgctcagtgaggatcttcatcaggtagtcggtgagatcgcggcccgccaggtccaggcgcatgatggcgtgcggcagcgcgtagccctcataaatgggcacgttgtgggtgacgccgtcgccggagtccagcacgatgcctgtgcgcgcgcgggagagagtgagtggctgggggcgaggccgaggctaggctctcagcgctagcggcgggggcgggggcgggggcgggggcgggagaggggactgggggcagcgggcactcaccggtggtcctgccggaggcgtagagggacagcacggcctggatggccacgtacatggcgggcacgttgaagg

SEQ ID NO: 103807 - DNA, 1128 bp, Homo sapiens; identical to SEQ ID NO: 26937
  chr1:229569458-229570586
  Hyper

SEQ ID NO: 103808 - DNA, 33 bp, Homo sapiens; identical to SEQ ID NO: 68798
  chr1:229706004-229706037
  Hypo

SEQ ID NO: 103809 - DNA, 30 bp, Homo sapiens; identical to SEQ ID NO: 68799
  chr1:229764690-229764720
  Hypo

SEQ ID NO: 103810 - DNA, 30 bp, Homo sapiens; identical to SEQ ID NO: 68800
  chr1:229911522-229911552
  Hypo

SEQ ID NO: 103811 - DNA, 150 bp, Homo sapiens; identical to SEQ ID NO: 68801
  chr1:230080008-230080158
  Hypo

SEQ ID NO: 103812 - DNA, 64 bp, Homo sapiens; identical to SEQ ID NO: 39285
  chr1:230107209-230107273
  Hypo

SEQ ID NO: 103813 - DNA, 30 bp, Homo sapiens; identical to SEQ ID NO: 26938
  chr1:230240615-230240645
  Hyper

SEQ ID NO: 103814 - DNA, 132 bp, Homo sapiens; identical to SEQ ID NO: 68805
  chr1:230404233-230404365
  Hypo

SEQ ID NO: 103815 - DNA, 72 bp, Homo sapiens; identical to SEQ ID NO: 39287
  chr1:230423782-230423854
  Hypo

SEQ ID NO: 103816 - DNA, 176 bp, Homo sapiens; identical to SEQ ID NO: 68807
  chr1:230424479-230424655
  Hypo

SEQ ID NO: 103817 - DNA, 65 bp, Homo sapiens; identical to SEQ ID NO: 68809
  chr1:230453297-230453362
  Hypo

SEQ ID NO: 103818 - DNA, 73 bp, Homo sapiens; identical to SEQ ID NO: 68810
  chr1:230453632-230453705
  Hypo

SEQ ID NO: 103819 - DNA, 54 bp, Homo sapiens; identical to SEQ ID NO: 68811
  chr1:230458365-230458419
  Hypo

SEQ ID NO: 103820 - DNA, 796 bp, Homo sapiens; identical to SEQ ID NO: 68812
  chr1:230561177-230561973
  Hyper

SEQ ID NO: 103821 - DNA, 30 bp, Homo sapiens; identical to SEQ ID NO: 68815
  chr1:230841649-230841679
  Hypo

SEQ ID NO: 103822 - DNA, 128 bp, Homo sapiens; identical to SEQ ID NO: 39292
  chr1:230992827-230992955
  Hypo

SEQ ID NO: 103823 - DNA, 35 bp, Homo sapiens; identical to SEQ ID NO: 68819
  chr1:231019380-231019415
  Hypo

SEQ ID NO: 103824 - DNA, 30 bp, Homo sapiens; identical to SEQ ID NO: 68820
  chr1:231037612-231037642
  Hypo

SEQ ID NO: 103825 - DNA, 43 bp, Homo sapiens; identical to SEQ ID NO: 68821
  chr1:231150213-231150256
  Hypo

SEQ ID NO: 103826 - DNA, 53 bp, Homo sapiens; identical to SEQ ID NO: 39293
  chr1:231163086-231163139
  Hypo

SEQ ID NO: 103827 - DNA, 28 bp, Homo sapiens
  chr1:231205699-231205727
  Hypo
aaccgcagtgtccatcggtggatgaatg

SEQ ID NO: 103828 - DNA, 30 bp, Homo sapiens; identical to SEQ ID NO: 68824
  chr1:231269325-231269355
  Hypo

SEQ ID NO: 103829 - DNA, 852 bp, Homo sapiens
  chr1:231296717-231297569
  Hyper
gccccaagccctgggcgcaggctgcagcttccccctgcctgaccccgccagcctgcgcctcctcacccggggactagcagaagcctgggcccgcgcctggcgctacgactccggtctttagtctttgtttggagcacgggagaacctgggacggagggaggcatgacttcaatattcatatcgttgttaaataaacgatttcctaatttgtatctgtttcatgccagcgtgaaacttctgtaggcagagccggctgcgctgccagcactttcttctgctcgtccccacccacctctgcctcccccacccagccttccctcggcagcagcggggaagaacagccgagcagaccaaacagccggggccgcgggtgggaggctgttcccgcagctcgtggctggcgttggagaatgtggagattttcccattcataaaaggaacgtctccgcttgccgccttcccgtccgccgcacaccgccacatccgcagcggggtagggctgggtctgggggcgctgggttcccaggggtctacccgggcgcgctctcgcctttctcaggaaaccccattttgtgagcggcaccgcgtgtcctctctcagtccgtgcacacagttgacctggagcgcggatgagcacccttggttgaaaggaagagacaaaatggcttgtggttcaattcataaataaaacctcacccttggacttcaggctgcccgacattttgggacttggatttttttgctttatcgtagttttaggaagcgactgtcaggccatgttgcctatccatttctaaacgactggctttttaggatcccgttttcacccttctatggcggtgggttgggggt

SEQ ID NO: 103830 - DNA, 1422 bp, Homo sapiens
  chr1:231297797-231299219
  Hyper
gaaattacaactcctcggcgcgccgcgcggggaggcagcggcagcggcgggagggaggcggggaggggattcccgagccagccggacgctcgccctccgcccgccggctgcagcgtcgcgcggcccaaggtcagaggcgccgcaggagcagcagctgggaaccagggaagcgggtcaatcccggccgcagggagaaagccccagggcgcagtcagccggcgtccacagccgcccaggagtagggtgagcggctgtctccgggccggtcgggtcccgccgaggtggccgcggccccagcgacccggcgggtggcggcccaggggtcggcgagcaggcagctggagccccaccttcggctcccgggcgctgtccgccgcctcgtggtgctgatcccagccccacggctgagcggccttcgcacctgcctgtctcacctcgctatcaccccgataaggagttgggccggggcagaaggggggcctcggggtagccgcccaccggagccaggggctgaagcagcgagcgcacagcagcccggccgctggtcctggggtggagaggaggcgcgcgctgcagccggcggcggcgctggtgctgattcatcacctaaagctcctcgcaggccaccgcgagggcagccgaccggctccggaatctggccgcaggttgaagccgctggtgcgggaccctcgggcaggaggtgaggaccccctcccttctctcgcccctcaatcatcttagggcggtggctacaggacagagagaggggcgtgcccctcggctgtgaagtgggcatgcccgtgtgatgcccccgcccgtcgtctcaccggggcgcaccgcgctggtcctcctccgccagtctcccgagctccggccattcatccccagcgcagagcagcgctggcagccggcgccgcgatggaggaagagctgaagtgtcccgtgtgcggctctctgtttcgggagcctatcatcctgccctgttcccacaatgtctgcctgccttgcgctcgcaccatcgcggtgcagaccccggacggtgagcagcacctgccccagccgctcctgctttcccggggatcggggctgcaggcgggcgccgccgccgctgcctctctggagcacgacgctgcggctggcccggcctgcggcggtgcaggcgggagtgcagctggcggcctcggcggcggtgcgggaggtggcggagaccacgcggacaagctcagcttgtacagcgagacagacagcggctacgggtcctacaccccgagcctcaagtcccccaacggggttcgcgtgctgcccatggtgcccgcaccacccggctcctcggctgcggcggctcggggtgccgcctgctcctcgctgtcctcgtcttcgagctccatcacgtgcccgcagtgccaccgcagcgcatccctg

SEQ ID NO: 103831 - DNA, 218 bp, Homo sapiens
  chr1:231299423-231299641
  Hyper
aagtgccatccatcccggggacccttcgccaagcatcgcctggtgcagccgccgccgccgccgccgccgcccgccgaggcagcctccgggcccactggcaccgcccagggcgcccccagcggaggcggcggctgcaagagcccgggaggcgcgggggcgggggcgactgggggcagcacggcccgcaagttccccacgtgtcccgagcatgaaatgga

SEQ ID NO: 103832 - DNA, 145 bp, Homo sapiens; identical to SEQ ID NO: 68833
  chr1:231475674-231475819
  Hypo

SEQ ID NO: 103833 - DNA, 114 bp, Homo sapiens; identical to SEQ ID NO: 68835
  chr1:231663293-231663407
  Hypo

SEQ ID NO: 103834 - DNA, 120 bp, Homo sapiens; identical to SEQ ID NO: 68836
  chr1:231738890-231739010
  Hypo

SEQ ID NO: 103835 - DNA, 30 bp, Homo sapiens; identical to SEQ ID NO: 68837
  chr1:232761027-232761057
  Hypo

SEQ ID NO: 103836 - DNA, 30 bp, Homo sapiens; identical to SEQ ID NO: 39296
  chr1:232761388-232761418
  Hypo

SEQ ID NO: 103837 - DNA, 60 bp, Homo sapiens; identical to SEQ ID NO: 68839
  chr1:232765315-232765375
  Hyper

SEQ ID NO: 103838 - DNA, 30 bp, Homo sapiens; identical to SEQ ID NO: 68841
  chr1:233116414-233116444
  Hypo

SEQ ID NO: 103839 - DNA, 30 bp, Homo sapiens; identical to SEQ ID NO: 68842
  chr1:233118122-233118152
  Hypo

SEQ ID NO: 103840 - DNA, 292 bp, Homo sapiens; identical to SEQ ID NO: 68845
  chr1:233750219-233750511
  Hyper

SEQ ID NO: 103841 - DNA, 1377 bp, Homo sapiens
  chr1:234040247-234041624
  Hyper
gtactgaactgggagcggcagggtttgagtcaaaagagaagggtggaggagcgcgtccggtgccccaaggcttccaggcggagcgcgggcgcgaggtgcgggctccggggcggagcgcacgcccgggaggcgggaagtgggcagcagcgcccccgcctggcccctgtgcgccccgacccgacgcctccccgcccgaccaggtgcctcgagagcgcacagctgggagggctctcccggtcgcggcgagactcacgcctgcggtgtgctagggcggcggcgacggtgacgggcgtggggcgcggcgctgcctcggctgccgggtcgttgcggcgagcgcgcgggccggcctggagtcaccgggctgaaccgccgcgcctgcatcgtgccgcacgccgcggaggcgctcgggtacagaccgcgcgggcgcgcacaaagcggcccggggcggccggcgcggcgcagaccctcggtgggcagcgcactccagtcttcccaggctagcggctgcagggagctccggcccgcggcccctccgcctcaagtctgggagctgccggtcccactctgtctttgcctatggggattcgagagtttcccagcggcgcacccaggggcaagagcattgccgtgtgagtagcgccccgggcgtgggtgagcgagccggcgggcgggaggccggagcgccggggtagccctttgcagctgggacactgggcagtctgaggctcggggaagggcggcgcgcgcggtggagctgctcgggaagtttcagtcattctttccctcgccactcgccccaacccgcactgccccgagacgcccaggatagggcactggggacagctgcccggggaagtgggtgagtggcggcgggaagggaggagcgcgggctctgccgcggcgctcgcccccggagggccccggccgcgctcttgctctcgccctgggatctgctcctcacgaatcccctcctctctgtccatgctccccctgcccacccacctgcccgtggcgcctgcgaccgcagtggcatgaggaggtcaccggacgtcagcccccggagactgtccgacatcagcccccagctccggcagctcaagtacttggtggtggacgaggcgattaaggaggatctgaaatggtcgcgctccgtggaggatctcaccagcgggccggtggggctcacgtccatcgaggagcggatcctgcgcatcactggctactatggctaccagccctgggcagcgagctgcaaaagtaagaccccctcacgtcatgtttcccgttcactggtccatcttcttaccattgtcacagcagcctcggggagcgcacgcagtgaggcgtccagccaccccctcccgccctgcctgctga

SEQ ID NO: 103842 - DNA, 472 bp, Homo sapiens
  chr1:234349869-234350341
  Hyper
cagggatgagggctgcggggctgggcgtcccggggaggagggcggagcaggtgagctgcggggtgggagcagggagtgcacttgtacgtgacgttggagtttgcagcaacctccaagtaggaggctgtgcgcgcgtgtgtgtggagtggctgcgcggccggggaggatgtgcgctgcagggcggccgccgcagtgagcaacgcggcaaccggagcccggcgggcagccggggaggccgggactgagaggggcgagccgctggtgctccccggcggcagagggccgcgtcggccacgggcccgggagagacgcgctccagccggccccaggatgtaggcgatcggcggcagcgctcctgcaggcggccggctcatcatgaagaagcactcggcccgggtggccccgctcagcgcctgcaacagtccggtcctgacccttaccaaagtggaaggtaatgcgcggccgcctcgcc

SEQ ID NO: 103843 - DNA, 30 bp, Homo sapiens; identical to SEQ ID NO: 39297
  chr1:234445373-234445403
  Hypo

SEQ ID NO: 103844 - DNA, 278 bp, Homo sapiens; identical to SEQ ID NO: 39298
  chr1:234621065-234621343
  Hypo

SEQ ID NO: 103845 - DNA, 42 bp, Homo sapiens; identical to SEQ ID NO: 68855
  chr1:234625024-234625066
  Hypo

SEQ ID NO: 103846 - DNA, 30 bp, Homo sapiens; identical to SEQ ID NO: 39300
  chr1:234724806-234724836
  Hypo

SEQ ID NO: 103847 - DNA, 30 bp, Homo sapiens; identical to SEQ ID NO: 68857
  chr1:234736426-234736456
  Hyper

SEQ ID NO: 103848 - DNA, 30 bp, Homo sapiens; identical to SEQ ID NO: 39301
  chr1:234795478-234795508
  Hypo

SEQ ID NO: 103849 - DNA, 30 bp, Homo sapiens; identical to SEQ ID NO: 68859
  chr1:234812002-234812032
  Hyper

SEQ ID NO: 103850 - DNA, 94 bp, Homo sapiens; identical to SEQ ID NO: 68860
  chr1:234845049-234845143
  Hypo

SEQ ID NO: 103851 - DNA, 36 bp, Homo sapiens; identical to SEQ ID NO: 68861
  chr1:234881213-234881249
  Hypo

SEQ ID NO: 103852 - DNA, 169 bp, Homo sapiens; identical to SEQ ID NO: 39303
  chr1:234882410-234882579
  Hypo

SEQ ID NO: 103853 - DNA, 242 bp, Homo sapiens; identical to SEQ ID NO: 68863
  chr1:234959367-234959609
  Hypo

SEQ ID NO: 103854 - DNA, 42 bp, Homo sapiens; identical to SEQ ID NO: 68864
  chr1:234964788-234964830
  Hypo

SEQ ID NO: 103855 - DNA, 140 bp, Homo sapiens; identical to SEQ ID NO: 68865
  chr1:235003811-235003951
  Hypo

SEQ ID NO: 103856 - DNA, 39 bp, Homo sapiens; identical to SEQ ID NO: 39306
  chr1:235005711-235005750
  Hypo

SEQ ID NO: 103857 - DNA, 128 bp, Homo sapiens; identical to SEQ ID NO: 68867
  chr1:235034454-235034582
  Hypo

SEQ ID NO: 103858 - DNA, 30 bp, Homo sapiens; identical to SEQ ID NO: 68869
  chr1:235260531-235260561
  Hypo

SEQ ID NO: 103859 - DNA, 155 bp, Homo sapiens; identical to SEQ ID NO: 68870
  chr1:235267075-235267230
  Hypo

SEQ ID NO: 103860 - DNA, 76 bp, Homo sapiens; identical to SEQ ID NO: 39308
  chr1:235292638-235292714
  Hypo

SEQ ID NO: 103861 - DNA, 16 bp, Homo sapiens
  chr1:235325301-235325317
  Hypo
ccaggtgcggtggctc

SEQ ID NO: 103862 - DNA, 120 bp, Homo sapiens; identical to SEQ ID NO: 68873
  chr1:235325377-235325497
  Hypo

SEQ ID NO: 103863 - DNA, 15 bp, Homo sapiens
  chr1:235325557-235325572
  Hypo
cggcagaccctggct

SEQ ID NO: 103864 - DNA, 30 bp, Homo sapiens; identical to SEQ ID NO: 68875
  chr1:235443853-235443883
  Hypo

SEQ ID NO: 103865 - DNA, 30 bp, Homo sapiens; identical to SEQ ID NO: 39311
  chr1:235793720-235793750
  Hypo

SEQ ID NO: 103866 - DNA, 1146 bp, Homo sapiens; identical to SEQ ID NO: 68877
  chr1:235812015-235813161
  Hyper

SEQ ID NO: 103867 - DNA, 581 bp, Homo sapiens
  chr1:235813621-235814202
  Hyper
cgggggggaaatcaccggaggggtctggggcggggccggggttgctggaggggtctggggacggggccgcggtcagcgcgggctccccgaagcctcaggtaccgccctcgctcggggtgagctccagcgcctgggccgttggggcgcgggccgcttcccaccctgcaccaagggacgcctcggaagcctccggccaaggcggggaacggcggagaaacgcggaatacctgtgcgaattcgcgcggccgcgtcgccactaacccggcgaaggctgacccgacgttgctgagtgacggggaccaggggccggcgaggcccccactccggggggagcgaggccgggagggcggagggcgcgtgctggaggcgggggtgcccttcgcgccccggttctaggagcgactgctctccaggcctcgtccctgtggcaccgcaggcttttgcgctggagattttaaaacactttagtgattacagccctcttcctttcagggaaaaaacagtttaagcgccgtccattttccgacttggtaaaataatacgaaaccttgggaatagagaagcaacgaaaacatttcacg

SEQ ID NO: 103868 - DNA, 93 bp, Homo sapiens; identical to SEQ ID NO: 68880
  chr1:235872465-235872558
  Hypo

SEQ ID NO: 103869 - DNA, 27 bp, Homo sapiens
  chr1:236044127-236044154
  Hypo
aagaattccatttagcggccgggcacg

SEQ ID NO: 103870 - DNA, 30 bp, Homo sapiens; identical to SEQ ID NO: 39313
  chr1:236081438-236081468
  Hypo

SEQ ID NO: 103871 - DNA, 30 bp, Homo sapiens; identical to SEQ ID NO: 68885
  chr1:236087376-236087406
  Hypo

SEQ ID NO: 103872 - DNA, 30 bp, Homo sapiens; identical to SEQ ID NO: 68886
  chr1:236184191-236184221
  Hypo

SEQ ID NO: 103873 - DNA, 30 bp, Homo sapiens; identical to SEQ ID NO: 68887
  chr1:236192796-236192826
  Hypo

SEQ ID NO: 103874 - DNA, 1389 bp, Homo sapiens
  chr1:236227462-236228851
  Hyper
aggcccggccagtcacggggaggatccagggagctgtaggtcatctggtcccgctcctcgtttggggcctccgtggtgacaatgcctggccacaggaaatgggatcactgggagccctgtgtttcccgctctggactctggactctgaaacgagcccaactggaaagcagcatcactgccaagacacatccggagtccacacacaaatacaggaggctgccggcgaaactctcccgcagccacaagagtcccggggcccgcgcgcagactgcgatccagctccggctcttgccctgcggaggctccgcgcgagaacctggctccacccgggaccggccaggtcctagccccgaagggactggacagccgagggacgcggactgacctccctgcggcgatgcagcccacagccgccggggaggaagctccgcggggtccatgggtgccggggtcacggcccggggcgcgcggagccacccagaccccgcgacccgctcttcggatagcagggaccgggtcgggaagaccttcgcggaccctgcagaggcgggagaccctgcgccgtgcccggtgccccggcggccagcgggtccgggtccccgcctgctacgcccaagtccgtccggctccacgggcgcccccggcccgccgcgccctgcagcccctcgcccgccctcccggggctcactcacgtagactgcgtcgatgtcggatctgtcgtagaagcggagcgccccactcagctccagggcaggagagacgaagtcatccccgtcctccagctccaggtccccctgtccggggccgaagggaaagagctcctggcggctcaggcagcccacaggccccgccagcagcagcggcagcagcagcgcccgcgtccacgcagcccggatccggctgctcgaggccaacatgttcccgaactgcggtcccgcaaacccggtcccgcggccaggacagaggaaggcggggatgtaaccggacgcccctggcagccccctctcctcccgcctcccggcgttcccaccccgggaaataggggaggggagcggaggggagagcggagggccccgccccgtccagcgggcgcgccgcggggcagcccaatggccgcgagggggagggcgaggggcgaagccgaacctcccgccttgggcgccggtgcctgcgattctcgaaaccagcccgactcccagcgaacggcgcctccgggagggggagcagagcgcgggacccgcaccgtggtcctctgattagggttgggtcgtggagagccggcgacgtggaaacgctccggattcaggaacggcgcccaccccattgccgctcggccgcgtccggggtccaattcgcttgaccctggtaggaagacggggtgggagctgg

SEQ ID NO: 103875 - DNA, 29 bp, Homo sapiens
  chr1:236252519-236252548
  Hypo
gcttaccaggccaggcgtggtggctcatg

SEQ ID NO: 103876 - DNA, 55 bp, Homo sapiens; identical to SEQ ID NO: 68893
  chr1:236304825-236304880
  Hyper

SEQ ID NO: 103877 - DNA, 30 bp, Homo sapiens; identical to SEQ ID NO: 68894
  chr1:236464650-236464680
  Hypo

SEQ ID NO: 103878 - DNA, 1063 bp, Homo sapiens
  chr1:236558422-236559485
  Hyper
tgtctcagctgagggcgtgagtagggagccaggaaagcgacccgcgactgcagccgtttcttaaggccagtccttcgctcgcagtctgtcccgggcggcagtcgtgtcagccccccgctaggacccgcccagggggacgtgggtaccgggcaggacgcgcgctctgggcgctggggacgcccgggacactcggggccccgccttgcgtcccagccccgggtcgcggcaccccggctcccgccccgcgcctctggagggaggtaccgagggacgcgcagcgaaggggctttgctaattgccaaagcaggaagtgagctcgtggaagaagcgaaggaggagaagaagaagggaggggaaggcggaggagggcaggggcgcgcagagccacggtttgctccaggcgcgtcggaaccgcaggacttttcatccccgtggtcccacggtcctcccgcgccccggaggcctgccagccccgctcggacgctcgtttgcccctaacccgccgccatggcttcaccggacgaccctctgcgcgcaggtaaagggacacagcgccgcgcccgctcctggagcgagcaccgcggggcgggagctcgggaggcgctcgcagcagccgcagggctatcgaggccgggcctcggcgacccccgagggaggcccgggaaccacccccgacccaggcgccagacccggagtcgcacggggctcccagtccagccccgcgagcggctgctgaccgcccctcccgcgctcgccagggcccctgccccgcgtcagccaccgcgcgccttccccctgcccatgccgcagcccccgtggcttttgttctggactcgggatgccaggttgagacacgtcctgcaaacctctggcagaaatgggcgcaagggggtggatttcgttttcgcctcccgggctttttctttctccccgctcacatgccttctcattactcctcttcctctctcccattgcactttgatgaaatggttttgtctgtctaaacattggccctcggagctatttcatcagatagtatccgcagaatcgagaggcggatccc

SEQ ID NO: 103879 - DNA, 37 bp, Homo sapiens; identical to SEQ ID NO: 68898
  chr1:236607992-236608029
  Hypo

SEQ ID NO: 103880 - DNA, 84 bp, Homo sapiens; identical to SEQ ID NO: 68899
  chr1:236614144-236614228
  Hypo

SEQ ID NO: 103881 - DNA, 51 bp, Homo sapiens; identical to SEQ ID NO: 68900
  chr1:236687037-236687088
  Hyper

SEQ ID NO: 103882 - DNA, 204 bp, Homo sapiens; identical to SEQ ID NO: 68901
  chr1:236768620-236768824
  Hypo

SEQ ID NO: 103883 - DNA, 83 bp, Homo sapiens; identical to SEQ ID NO: 68902
  chr1:236771371-236771454
  Hypo

SEQ ID NO: 103884 - DNA, 30 bp, Homo sapiens; identical to SEQ ID NO: 39317
  chr1:236811244-236811274
  Hypo

SEQ ID NO: 103885 - DNA, 755 bp, Homo sapiens
  chr1:236849457-236850212
  Hyper
gtccctcccctggctcgcgatcacccacccgggacaccgacggaccccgcgccgctaaccagccgctctcagagcgtgggtggcaggcgtggctctgctcggggccggccgctcccctcacgttcccggaggcctcggcggaaggcgtgcaggcggcctctgggcggcggctgcaggggagacagtggaggggcccggcgcccttgtccgcccgcacgtgctcggggcggggcggctggggcccgacgggcggggccgggggcggtggcggcgggggcgtggccgggcggccacgtgacgggcggcgcggctattaagccgcgcggcagctgctcgcagccggagctggtgcttcgcccgagacccagcgcccaggcgtgtcgccccgagaggagccgcgcgaaggtcaccccgcgcccgccgcccgccgcccgccgcctccgtgggtccgtttgccagtcagcccgtgcgtccgagcccctcgcgccccgccgcagccccggccaaccgagcgccatgaaccagatagagcccggcgtgcagtacaactacgtgtacgacgaggatgagtacatgatccaggaggaggagtgggaccgcgacctgctcctggacccagcctgggagaagcagcagaggaaggtcagcaggggcccgcgggccgcccgcgcgtggtggggccgggtcccccgcggggctcccgtgcgcgtggccgcgtggcctggcgactggcgagagggcgctttgtggaggtg

SEQ ID NO: 103886 - DNA, 113 bp, Homo sapiens; identical to SEQ ID NO: 68906
  chr1:236900491-236900604
  Hypo

SEQ ID NO: 103887 - DNA, 116 bp, Homo sapiens; identical to SEQ ID NO: 68907
  chr1:236907863-236907979
  Hypo

SEQ ID NO: 103888 - DNA, 29 bp, Homo sapiens
  chr1:236931484-236931513
  Hypo
tgatctgcctgcctcggcctcccaaagtg

SEQ ID NO: 103889 - DNA, 127 bp, Homo sapiens; identical to SEQ ID NO: 68912
  chr1:237056379-237056506
  Hypo

SEQ ID NO: 103890 - DNA, 30 bp, Homo sapiens; identical to SEQ ID NO: 68913
  chr1:237204993-237205023
  Hyper

SEQ ID NO: 103891 - DNA, 1479 bp, Homo sapiens
  chr1:237205256-237206735
  Hyper
gcccagggaccccagcggggcgcaggtaggaggctgtgcgctcgccgggtgcgctccggccccgattcccagcgcagccagtaagtggcgctgggcctcgggtttggcggcccggaggagcgggctgcggattacctgcagcagcggggagccgccgagctcctccccgcccgcccccacaccccacccccaccgctgcactaaccccggctcagctggctccgcgcacttgctcggaggagccggggccgagcggaccgccggctgcaggcagcgagcgcggctgggctgcggggctgcttccccgcgtcctccgggcccgggccgccctcctcccgcacagtgcggagcagggaggccccgcgcctcgaccacccgcgcccgagcgtccgcgcctcctcctccgctctgcaggcggggaccgcccggcgctcggcacccggcagcgcggccccctccagcccccggctcccggcagcagaagcagaaggcagcgccaggggccgccgccgccgccgagctccgcggggctcgggagccggccccggcgaggaggcgcggaaccatggccgatgggggcgagggcgaagacgagatccagttcctgcgaactgtaagcgccgtgcgtcgcgtgtgctgtcaggggaagggggcgtcagggcatccactagcggggtccgggcagagtgacagcgggcagcggggactcgcgggcggggcgagggggtgccccctgaggatgcgggaggagcgggcatcaccaagtgtgtgcaggtgtgcgtgttggggcgagggaaggcaagggcgcgtgtctgtgcgcgcgtgtggaaagctagaggatggagcgcggctagccggcggcaggcgcccgggctcggacccggggcaccggggacaggagcgtcggagctgcgggaaccgggagaggaggggacggccggtccggcctgcctggtggcacggctgggacctcccgggcggccgggggcagggtgcagagcagggtggcccgtgggggcgcggggagcggcgggaactcgggctgtttctgggaataccgccgccgggaggtttcttgggctttcgggctggacccgcgcgttgtcacggagcgaagacgttggttcgcttactccgtgtagcgtgcggcgcagctgaccgggggcgggggtgatggtgcaggacgctgcgcggaggtttcccccaagtcaaggtgctgcgaaagcggaggaggagtcgcctccgtggtccccgcggttcccggggctggtgccatccgtggtggtgctgtgaccgcttgcaaagcgtggaaggcatgggaagcgagcgtgtgtttgcgtgtgtgcgcgcgcgcgggtggtggtggggagaacatcgtgaacgtgtcgttctctaaatgctggcttattgcatgccaagtgaagcaaagtgtgtgtgtgtaagtgtaagggcagggtggctgcccgggaaaggttggct

SEQ ID NO: 103892 - DNA, 27 bp, Homo sapiens
  chr1:237230203-237230230
  Hypo
tgggattacaggcgtgagccaccgcgc

SEQ ID NO: 103893 - DNA, 30 bp, Homo sapiens; identical to SEQ ID NO: 68920
  chr1:237732599-237732629
  Hypo

SEQ ID NO: 103894 - DNA, 30 bp, Homo sapiens; identical to SEQ ID NO: 39319
  chr1:237753724-237753754
  Hypo

SEQ ID NO: 103895 - DNA, 30 bp, Homo sapiens; identical to SEQ ID NO: 68922
  chr1:237919696-237919726
  Hypo

SEQ ID NO: 103896 - DNA, 71 bp, Homo sapiens; identical to SEQ ID NO: 68923
  chr1:237947252-237947323
  Hypo

SEQ ID NO: 103897 - DNA, 135 bp, Homo sapiens; identical to SEQ ID NO: 68924
  chr1:238018308-238018443
  Hypo

SEQ ID NO: 103898 - DNA, 43 bp, Homo sapiens; identical to SEQ ID NO: 68925
  chr1:238027719-238027762
  Hyper

SEQ ID NO: 103899 - DNA, 30 bp, Homo sapiens; identical to SEQ ID NO: 68926
  chr1:238081199-238081229
  Hypo

SEQ ID NO: 103900 - DNA, 35 bp, Homo sapiens; identical to SEQ ID NO: 68927
  chr1:238235527-238235562
  Hypo

SEQ ID NO: 103901 - DNA, 29 bp, Homo sapiens
  chr1:238508028-238508057
  Hypo
tttgtccttacacgcgtgagccactgcgc

SEQ ID NO: 103902 - DNA, 19 bp, Homo sapiens
  chr1:239516662-239516681
  Hypo
agagcgatactctgattaa

SEQ ID NO: 103903 - DNA, 192 bp, Homo sapiens; identical to SEQ ID NO: 39322
  chr1:239523114-239523306
  Hypo

SEQ ID NO: 103904 - DNA, 231 bp, Homo sapiens; identical to SEQ ID NO: 68935
  chr1:239549584-239549815
  Hyper

SEQ ID NO: 103905 - DNA, 1184 bp, Homo sapiens; identical to SEQ ID NO: 68936
  chr1:239550034-239551218
  Hyper

SEQ ID NO: 103906 - DNA, 125 bp, Homo sapiens; identical to SEQ ID NO: 68938
  chr1:239987328-239987453
  Hypo

SEQ ID NO: 103907 - DNA, 23 bp, Homo sapiens
  chr1:240102287-240102310
  Hypo
caagactccgtctcaaaaaaaaa

SEQ ID NO: 103908 - DNA, 250 bp, Homo sapiens; identical to SEQ ID NO: 39324
  chr1:240118753-240119003
  Hypo

SEQ ID NO: 103909 - DNA, 564 bp, Homo sapiens
  chr1:240160929-240161493
  Hyper
ggactggggaggctccgagggagcaagacatttaaacccgggcggtgggggggcgggcggtgtcagacgcccaacgaccacctccctcccggcccgcgccgagcccggccacaccctccccgcgacacccgcgatcgccccccaggactggcggccccgggccccgctcccacccacccacctacgcagggggcgtcctgctcaggcaattcctcccgcgcgccccgtcggggaccgggcggggacgggagaaggaaaagggcccctggctccgggaccagggctccggagggtgccgggcggggagcggaacagggaacgggctggtggcggccccaagcgggagggacggaccgacacgcggccccctggcggccttgcgactcgccgacctgcggaacctcgtcgccgccctcacagccccgcggccaccgccgacccgggccggtccccggggcgtcgcgggtgttaaagggcgagtctacgcggatgtcacggtcgccgcgggcaaggaccgcgaggttgcggccctgctccgaatcccggctgcgctggccacgctcc

SEQ ID NO: 103910 - DNA, 2209 bp, Homo sapiens
  chr1:240254819-240257028
  Hyper
tatgtggctgtgacccgatggcacctctaaactggaattgggcttcagtttttctccgtgtaaaaatttcttcttttttatttaacttttctcttggcaggtccagcagctttgaagatcagagtgcatcttccagctgacgatctcttcggtcggggacaatgcattcgattcgcacggtggagattaaagtccccgagatagaggaaacgtttttcgcgcccaggttcagcgaggagccgcgcgggggcagagggggcggcggcggcgggcggggagccaggcccgagctgcgttctgcgcagccattggtgggcgccgcgctctgcactgagcatgttcgcgccccgccggcccctagccgcagccgcagccgcagcgacggcagccacgggagccgccgcgcattatgcaaagcggcggcagatgcgagcggggccagccgggcgcgcgtcggcctcccctcccagcggctccccccgccgccgcctgactctcccgggagactccctaggcccggacctggggccgaggagggccgggatggcctgagtgcccgcggcgcggcggcgcagcagcgggattgcaccatggggaaccaggatgggaagctgaagaggagcgcaggtgatgctttgcacgaaggcggcggtggcgccgaggatgcgctggggcccagggatgtggaagccacaaagaaggggagcgggggcaagaaggcgctaggcaagcacggcaaggggggagggggcggcggcggcggcggggagtcgggcaagaagaagagcaagtccgactccagagcctcggtgttttccaacctgcggatcaggaagaatctgtccaaggggaaaggcgccggcggctcccgcgaagatgtactggattcccaggccctgcagaccggggagctggacagcgctcactccctgctcaccaagactccagacctcagcctctcggcggacgaggccggcctgtcggataccgagtgtgcggacccttttgaggtgaccggtccagggggtcctgggcctgccgaggctagggtcgggggccggccgatcgccgaggatgtggaaactgcagcaggggcgcaggatggacaaaggaccagctcgggctcggacacggacatctatagcttccattcggctacggagcaagaggatttgctttcagacatccagcaggcgatccgcctgcagcagcagcagcagcagcagctccagctccagctccagcaacagcagcagcagcagcagctccagggcgccgaggagcctgcagcgccccccactgccgtctcccctcagcccggggccttcctgggcctggaccggttcctgctggggccgagcggcggggctggggaggccccgggcagtccggacaccgagcaggcgctgtccgcgctctccgacctgcccgagagcctggccgccgagccccgggagccccagcaaccgccgtcccccggcggcctcccggtctccgaggcgcccagtctcccggcagcgcaacccgcggccaaagactcgccctcctccacggctttcccatttcccgaggccgggccgggggaggaagcggccggagcccccgtgcgaggggctggggacacggatgaggagggtgaggaggatgcttttgaggatgcgccccggggctctccgggggaggagtgggccccggaggtgggagaggacgccccgcagaggctgggggaagagccggaggaggaggcgcaaggacctgacgcccccgcggccgcttccctgcccggcagccccgcgcctagccagcgctgtttcaagccctacccgctcatcaccccctgctacatcaagaccaccacccggcagctcagctcgcccaatcactccccgtctcagtcccctaatcagagccccaggatcaagaggcggccggaaccctccctgagccgagggtccagaactgccctggcctccgtagccgccccggccaagaagcaccgggccgacggcggccttgcggccggcctgagccgctcggctgactggacggaggagctaggcgcccgcacgccccgggtgggaggctccgcgcacctgctggagcgcggggtggcgagtgacagcggcggtggggtgtccccagcactggccgccaaggcgtctggggcccccgcggctgcggatggcttccagaacgtgttcacaggtga

SEQ ID NO: 103911 - DNA, 38 bp, Homo sapiens; identical to SEQ ID NO: 68947
  chr1:240267184-240267222
  Hypo

SEQ ID NO: 103912 - DNA, 30 bp, Homo sapiens; identical to SEQ ID NO: 39325
  chr1:240308662-240308692
  Hypo

SEQ ID NO: 103913 - DNA, 120 bp, Homo sapiens; identical to SEQ ID NO: 68949
  chr1:240372826-240372946
  Hypo

SEQ ID NO: 103914 - DNA, 169 bp, Homo sapiens; identical to SEQ ID NO: 14351
  chr1:240463082-240463251
  Hypo

SEQ ID NO: 103915 - DNA, 34 bp, Homo sapiens; identical to SEQ ID NO: 68951
  chr1:240655738-240655772
  Hypo

SEQ ID NO: 103916 - DNA, 535 bp, Homo sapiens
  chr1:240774920-240775455
  Hyper
aagagaaagaaagagcgatcacggtcaagtttgaaggtccttatgttacacccacgcataattcaataggtgaataaaccttgtggcccccagacacacgccaacagcttgaattacccggggtgaaaccggcgagacgtccactcagggctttcggtcctgaccagccacggaacaaacaacgtcaattcattctaagtgcctggtgaaggtagaaatcagaaaccgtgtctgtgtcacgttagtcgtgacaagctgcgtacctgcaatgacgtgatggaagcctcctcctcgggtcccttctctctctctctctccctctccctctgccttctctgagttctctagtccacagcggggtctaagtttggtctcccgccgccgctttcagttcgaccgcagccagactgcagcagacgcccataagagaagcgcgccggctgagggtgcaggagaggcgagagcgcgccccgcgccgcgcggtcccaggctggctgctcctgcagatgtgaaaggagcccggagacttagctct

SEQ ID NO: 103917 - DNA, 40 bp, Homo sapiens; identical to SEQ ID NO: 68954
  chr1:240892900-240892940
  Hypo

SEQ ID NO: 103918 - DNA, 40 bp, Homo sapiens; identical to SEQ ID NO: 68955
  chr1:240893180-240893220
  Hypo

SEQ ID NO: 103919 - DNA, 56 bp, Homo sapiens; identical to SEQ ID NO: 68956
  chr1:240986717-240986773
  Hypo

SEQ ID NO: 103920 - DNA, 142 bp, Homo sapiens; identical to SEQ ID NO: 68957
  chr1:241052144-241052286
  Hypo

SEQ ID NO: 103921 - DNA, 39 bp, Homo sapiens; identical to SEQ ID NO: 39330
  chr1:241096456-241096495
  Hypo

SEQ ID NO: 103922 - DNA, 462 bp, Homo sapiens; identical to SEQ ID NO: 68960
  chr1:241520071-241520533
  Hyper

SEQ ID NO: 103923 - DNA, 30 bp, Homo sapiens; identical to SEQ ID NO: 68961
  chr1:241520759-241520789
  Hyper

SEQ ID NO: 103924 - DNA, 772 bp, Homo sapiens
  chr1:241587106-241587878
  Hyper
gcaggcagtcctgagcggccgctgccatcgcgccggctgcagcggaaaggtacaagcggtggcggcaggagccgctgtgggagcagcagtggcggcagtgggagccctgtgccacgcgtcccctgtgcgccgtgtccccaaggcagctgactacacctcccccaccctcctgcagcagggtggatcccacctagcgggactccccacccacccctccaggccttctccactccggactctggccacttgccaccgttgtcgcccgccgccgctgcagggagggtgcacggagggagcagaccgtctccggagcccgccgccctgggggctgcagtgatggggccgggctgaggcacctgccggcggggtagcagggcagtcgagcacggagggaggggcgggcctccaggggacttcagcgggagccgggcctggggcggtgccgcacttgcacacggagtgtggggggccaggcctgggaccaggagctggggccgggcttcggcgcagaggcaggaagaggaagcggcacccgcttcggggacccagccggcggccaggccaccgcgcccacccggccgatggcaccgtgttcctgcgcctcgggagggaggaggctctgcgcgggactgcaggttctgccccgcatcggagtgatcgctgagcctgacgctctcgaaggctgggcctggggcccgcaatctactccggaggctttcccactgggcagggtcgctagcagggtgagagaaagccccgggccatccccgag

SEQ ID NO: 103925 - DNA, 87 bp, Homo sapiens; identical to SEQ ID NO: 68964
  chr1:241647308-241647395
  Hypo

SEQ ID NO: 103926 - DNA, 123 bp, Homo sapiens; identical to SEQ ID NO: 68965
  chr1:241753208-241753331
  Hypo

SEQ ID NO: 103927 - DNA, 30 bp, Homo sapiens; identical to SEQ ID NO: 68966
  chr1:241888798-241888828
  Hypo

SEQ ID NO: 103928 - DNA, 30 bp, Homo sapiens; identical to SEQ ID NO: 39332
  chr1:241913315-241913345
  Hypo

SEQ ID NO: 103929 - DNA, 30 bp, Homo sapiens; identical to SEQ ID NO: 68968
  chr1:241979590-241979620
  Hypo

SEQ ID NO: 103930 - DNA, 30 bp, Homo sapiens; identical to SEQ ID NO: 68969
  chr1:242012857-242012887
  Hypo

SEQ ID NO: 103931 - DNA, 38 bp, Homo sapiens; identical to SEQ ID NO: 68970
  chr1:242013289-242013327
  Hypo

SEQ ID NO: 103932 - DNA, 85 bp, Homo sapiens; identical to SEQ ID NO: 68971
  chr1:242087513-242087598
  Hypo

SEQ ID NO: 103933 - DNA, 27 bp, Homo sapiens
  chr1:242122948-242122975
  Hypo
catgagccaccccgcccagcccacttt

SEQ ID NO: 103934 - DNA, 54 bp, Homo sapiens; identical to SEQ ID NO: 68973
  chr1:242161776-242161830
  Hyper

SEQ ID NO: 103935 - DNA, 30 bp, Homo sapiens; identical to SEQ ID NO: 68974
  chr1:242182244-242182274
  Hypo

SEQ ID NO: 103936 - DNA, 20 bp, Homo sapiens
  chr1:242194963-242194983
  Hypo
gccaccgcacccggctgcta

SEQ ID NO: 103937 - DNA, 177 bp, Homo sapiens; identical to SEQ ID NO: 14352
  chr1:242286750-242286927
  Hypo

SEQ ID NO: 103938 - DNA, 31 bp, Homo sapiens; identical to SEQ ID NO: 68978
  chr1:242633349-242633380
  Hypo

SEQ ID NO: 103939 - DNA, 2004 bp, Homo sapiens
  chr1:242686691-242688695
  Hyper
agagccaattcacttcgcgtgaagtcggcactccttgggagtagaggtcccctctcaccggctcccaccctccagaggggaggatttctggggagcccgacgatccgctcgcttttagcctttctccttgcaacgcgcaaatctctccctagttgggctcaagtagagaggatcaccaactgctcatcccagcggacactctgcaaaaaactctaatggcttgtgcgcgggtccacgctggtcgctagcggcgccaactttactcattcgttaatttgctagtttttggactgagtaaaacagcccccaaagacgcgggcaaacgccgctctaaagcccactaccatgcaacgccaggttgctcggagccacgctggtggcacttccccttcgtgctcactctgcacaggcacctccagaaccccgtgcaaatgaaccctaccgggagacgcaggtgggcaggtcgggtcggcagggaccaagagcctgaaagggaacctgccctcccctccccgcagcccggtcattaaggcaagaaactgcaggcagagaagcccccgaatccgacctaggacgtcggcgcctgccaggatcccctcgcctgccccccgcgccccgcgcgcgctcatgccaccaccacggggagggtgcatgcggcaggtgcctggccgaggcccccgggagcgagtcgcccttacgtgctccagcttgtctttcctccgaagccagacgctggcgctgtagtcctgctgcttgacgctgctgtagaagttcgcgcccactcgggtcaggcttggggagggctccttggggcggcttttgagcctcatctgctcgaagccctcatggggggaggccgagagccactcgtgctgccggatctccatcctgacatgaccgggcggccgccggcgagcagcggactcgggacgggcgcgcggggagccgggcgcggagggcgagcgggaggcccagcgggagccggaggtggagctggagactgagctggaggagctggaggagcgagcgggcgcggggagcgcggggtgctgagcgccagctgggagcgcggccgggcgggagggggcgatcgcgggaggcgcggggcggaaggagggagggcgaggtgcgggcgggggcgggggcgggggcggagggggacggacggggagaagggggacgagaggggacagggagggaaaggaacctgctccggggagacagaagtgcccggtgcggcggcgacgtcgcccggcggctgcggtcccgagcgggcgctccgctcgccggctccttgcggcacctactgggacccgggccggctcccggggcggcggcggcggcgggggtggggtgcggtgggaggggccgcggctggcccagccagcccgcgcctgcaggttggtgcagtgaggagccgccgccgcccctcccgccgcgcccaggcccgggcggccgcgctcccgctccgcacccgcctttcccgagcaggctacacctctccctggcgcatctttactggaaagccggcaggcgaggggagaagtgagcgccgtctccgcgcctcctcggtcctgctggctgagcgcggggatggctccggagggagacactcaggaaaccacctccgcccttcccccatctctatccagcggcgccccctcaccctgcccccggctcgcttgggctgcgccttcccccattctgaaagttcactaacttcccaccccaagggacttagagcagagggtgcccagcattcccccctgaaaatagccgagagacatgtgttttctggagccgtacacgctactttcatccgatggtgtggcgatgcaaatacgcccgggggcagtagcccctcgggcaggcacgcgggaccggttgctccccagccctcggtgtccacctagaaccgggctccccgggccgcacccattccgatcctgggagggtgatccagggctcctctgcaacgctccgcttgtgcggtgactgttcctt

SEQ ID NO: 103940 - DNA, 30 bp, Homo sapiens; identical to SEQ ID NO: 68983
  chr1:242843570-242843600
  Hypo

SEQ ID NO: 103941 - DNA, 140 bp, Homo sapiens; identical to SEQ ID NO: 68984
  chr1:242973108-242973248
  Hypo

SEQ ID NO: 103942 - DNA, 30 bp, Homo sapiens; identical to SEQ ID NO: 68985
  chr1:243002516-243002546
  Hypo

SEQ ID NO: 103943 - DNA, 260 bp, Homo sapiens
  chr1:243053773-243054033
  Hyper
ccggccagcaggcctcgcgctgctctcggtcctgggcgcagggagagccgcggaggcggagagcagggctggcgggccggctcctgggcctcgctgaagagcttcccgcgggccaggctcggccccagcacgacctgaacaacgtctgcttcttgcaagccgccacccggcctatgggcgcgaactccacccgctcgccccctccacgtccccgcctggcctgccgctgatgggggcgggcagggcggaattccagcaac

SEQ ID NO: 103944 - DNA, 17 bp, Homo sapiens
  chr1:243057071-243057088
  Hypo
gccaggtgcggttaccg

SEQ ID NO: 103945 - DNA, 84 bp, Homo sapiens; identical to SEQ ID NO: 68990
  chr1:243080471-243080555
  Hypo

SEQ ID NO: 103946 - DNA, 16 bp, Homo sapiens
  chr1:243120279-243120295
  Hypo
ccgtctcaaaaaaaac

SEQ ID NO: 103947 - DNA, 29 bp, Homo sapiens
  chr1:243139472-243139501
  Hypo
caggcgtgagccaccgtgcccggcctctc

SEQ ID NO: 103948 - DNA, 82 bp, Homo sapiens; identical to SEQ ID NO: 68993
  chr1:243145032-243145114
  Hypo

SEQ ID NO: 103949 - DNA, 400 bp, Homo sapiens
  chr1:243646379-243646779
  Hyper
tgcactctctcaaaacgacagtcgccctgaaacggacgctggaagaggtttccaggcccgtggcgacggtgaggggggtgaaggtcgcaggtggagggcacggggcggcggctgcggagcccggggaggaggcggcgggcgcccgggtcttcctcggagcgcgccccctgggctgggcggcgtgtccctgcctcccgccggcgccctcgtccccgcagcagcgtccccgccgccaccccgctgcctcgtcgcctttctcgcaaacagcggtgccctctacgtgggggatcctggaggctgctgagcacgagcgccctccgcgacccgcccctgctcccgcctccactcttgcctcggggggagggtctcagtcttctgcctaaggcgccctcctcccttg

SEQ ID NO: 103950 - DNA, 30 bp, Homo sapiens; identical to SEQ ID NO: 68998
  chr1:243844807-243844837
  Hypo

SEQ ID NO: 103951 - DNA, 120 bp, Homo sapiens; identical to SEQ ID NO: 68999
  chr1:243982361-243982481
  Hypo

SEQ ID NO: 103952 - DNA, 424 bp, Homo sapiens; identical to SEQ ID NO: 69000
  chr1:244014247-244014671
  Hyper

SEQ ID NO: 103953 - DNA, 30 bp, Homo sapiens; identical to SEQ ID NO: 69001
  chr1:244019046-244019076
  Hypo

SEQ ID NO: 103954 - DNA, 364 bp, Homo sapiens; identical to SEQ ID NO: 69002
  chr1:244080431-244080795
  Hyper

SEQ ID NO: 103955 - DNA, 170 bp, Homo sapiens; identical to SEQ ID NO: 69003
  chr1:244087001-244087171
  Hypo

SEQ ID NO: 103956 - DNA, 44 bp, Homo sapiens; identical to SEQ ID NO: 69004
  chr1:244115675-244115719
  Hypo

SEQ ID NO: 103957 - DNA, 30 bp, Homo sapiens; identical to SEQ ID NO: 39341
  chr1:244139857-244139887
  Hypo

SEQ ID NO: 103958 - DNA, 111 bp, Homo sapiens; identical to SEQ ID NO: 69006
  chr1:244142957-244143068
  Hypo

SEQ ID NO: 103959 - DNA, 35 bp, Homo sapiens; identical to SEQ ID NO: 69007
  chr1:244198767-244198802
  Hypo

SEQ ID NO: 103960 - DNA, 105 bp, Homo sapiens; identical to SEQ ID NO: 39343
  chr1:244200765-244200870
  Hypo

SEQ ID NO: 103961 - DNA, 206 bp, Homo sapiens; identical to SEQ ID NO: 69009
  chr1:244243925-244244131
  Hypo

SEQ ID NO: 103962 - DNA, 180 bp, Homo sapiens
  chr1:244318992-244319172
  Hypo
ctatggagctgtcagcgtaaatatagaggctggttacatgggctcctcaaactctcccaccgtataaccctgcttgattcattcctgtttctttccccgacgccagtgtctccaggaggagtgggcatcacaggcggctgcgtgcttattaccccctcttcctgccgtgtaggggtggtg

SEQ ID NO: 103963 - DNA, 30 bp, Homo sapiens; identical to SEQ ID NO: 69013
  chr1:244402710-244402740
  Hypo

SEQ ID NO: 103964 - DNA, 21 bp, Homo sapiens
  chr1:244625361-244625382
  Hypo
tcctgccggggcctcccaaag

SEQ ID NO: 103965 - DNA, 30 bp, Homo sapiens; identical to SEQ ID NO: 69015
  chr1:244805002-244805032
  Hypo

SEQ ID NO: 103966 - DNA, 16 bp, Homo sapiens
  chr1:244893239-244893255
  Hyper
atttttttgacggggc

SEQ ID NO: 103967 - DNA, 1035 bp, Homo sapiens
  chr1:244893315-244894350
  Hyper
gtttgagtccagcccgggcaacatagttggttttttttttttttctcctgtctcaaaaaaaaggcattgcagagattgaaaaccgtttcccaccttctcccctgcagtgtttaggaagagacaatccgcccccgattcagcgcttcccagcccgcagcaactgcgcagcggggggaacccagggctccgcggcacccgcaggctttagttactgctccgaggccctcggaccaaagagaggctgcgaggaggacgcggctcgtttagctcgctgcgaacctcaagataacccttggtttccatgcacatccccccaacattgcatgtgctttcattcctacggtgctggggttactttcatttattgcttttgttgaccaaaaagaaaaaaacaatcctgagcgtgcacagggggcgcaacgggggaccggctcctcgtggctgaccggcggcggggctggcgcgcgggggcggcctgcgcgggccgcccggggacgctgctctggggtccggccgcggcctcgtggccgccctgcgcgcggtccagcaccagcagcgggatctcctccagccggtccggccgctccttgcgccgcaggtagcgccgcctccacgtcgccagcctctgaagcagcctctgcaggctcgaggggccccacaggccgcgctccggggcctccttgcctgcgcgcgcgtgagcttgcctgagcttcttcctgcgcgggccgcggaacagccgccgccagcaccagcacccagagcaggagccgccgtcgccggccaccgcgcgccgcccgaccgcctccggatccccgcgcggaggggggccccgctccaggcgcgccgccttctccagcagctcgtgctgcgcgccgccgcgccgggggccaccaaaccggggggccgccatggcccgcgcaggcctcttctcggagcgcggggcccacatctcgggaaccgtcgggctggacaacaacgctgccgcctccaggactccaaagggcccctcgcgtcctctcccgggaatgtacccac

SEQ ID NO: 103968 - DNA, 30 bp, Homo sapiens; identical to SEQ ID NO: 39346
  chr1:244914578-244914608
  Hypo

SEQ ID NO: 103969 - DNA, 23 bp, Homo sapiens
  chr1:245032177-245032200
  Hypo
accgtgcccggcctatatgcagt

SEQ ID NO: 103970 - DNA, 180 bp, Homo sapiens; identical to SEQ ID NO: 39347
  chr1:245060866-245061046
  Hypo

SEQ ID NO: 103971 - DNA, 144 bp, Homo sapiens; identical to SEQ ID NO: 69022
  chr1:245135719-245135863
  Hypo

SEQ ID NO: 103972 - DNA, 32 bp, Homo sapiens; identical to SEQ ID NO: 69023
  chr1:245254414-245254446
  Hypo

SEQ ID NO: 103973 - DNA, 50 bp, Homo sapiens; identical to SEQ ID NO: 69024
  chr1:245305933-245305983
  Hypo

SEQ ID NO: 103974 - DNA, 178 bp, Homo sapiens; identical to SEQ ID NO: 69025
  chr1:245317376-245317554
  Hyper

SEQ ID NO: 103975 - DNA, 82 bp, Homo sapiens; identical to SEQ ID NO: 69026
  chr1:245318718-245318800
  Hyper

SEQ ID NO: 103976 - DNA, 311 bp, Homo sapiens; identical to SEQ ID NO: 69027
  chr1:245319150-245319461
  Hyper

SEQ ID NO: 103977 - DNA, 37 bp, Homo sapiens; identical to SEQ ID NO: 69028
  chr1:245376976-245377013
  Hypo

SEQ ID NO: 103978 - DNA, 151 bp, Homo sapiens; identical to SEQ ID NO: 39350
  chr1:245461494-245461645
  Hypo

SEQ ID NO: 103979 - DNA, 30 bp, Homo sapiens; identical to SEQ ID NO: 69030
  chr1:245472787-245472817
  Hypo

SEQ ID NO: 103980 - DNA, 32 bp, Homo sapiens; identical to SEQ ID NO: 69031
  chr1:245494495-245494527
  Hypo

SEQ ID NO: 103981 - DNA, 32 bp, Homo sapiens; identical to SEQ ID NO: 69032
  chr1:245498973-245499005
  Hypo

SEQ ID NO: 103982 - DNA, 182 bp, Homo sapiens; identical to SEQ ID NO: 69033
  chr1:245499593-245499775
  Hypo

SEQ ID NO: 103983 - DNA, 31 bp, Homo sapiens; identical to SEQ ID NO: 69034
  chr1:245522555-245522586
  Hypo

SEQ ID NO: 103984 - DNA, 38 bp, Homo sapiens; identical to SEQ ID NO: 69035
  chr1:245627605-245627643
  Hypo

SEQ ID NO: 103985 - DNA, 120 bp, Homo sapiens; identical to SEQ ID NO: 69036
  chr1:245627763-245627883
  Hypo

SEQ ID NO: 103986 - DNA, 30 bp, Homo sapiens; identical to SEQ ID NO: 69037
  chr1:245633295-245633325
  Hypo

SEQ ID NO: 103987 - DNA, 170 bp, Homo sapiens; identical to SEQ ID NO: 69038
  chr1:245725716-245725886
  Hypo

SEQ ID NO: 103988 - DNA, 176 bp, Homo sapiens; identical to SEQ ID NO: 69039
  chr1:245750646-245750822
  Hypo

SEQ ID NO: 103989 - DNA, 38 bp, Homo sapiens; identical to SEQ ID NO: 69040
  chr1:245753462-245753500
  Hypo

SEQ ID NO: 103990 - DNA, 95 bp, Homo sapiens; identical to SEQ ID NO: 69041
  chr1:245755482-245755577
  Hypo

SEQ ID NO: 103991 - DNA, 30 bp, Homo sapiens; identical to SEQ ID NO: 69042
  chr1:245761829-245761859
  Hypo

SEQ ID NO: 103992 - DNA, 297 bp, Homo sapiens; identical to SEQ ID NO: 69043
  chr1:245772571-245772868
  Hypo

SEQ ID NO: 103993 - DNA, 30 bp, Homo sapiens; identical to SEQ ID NO: 69044
  chr1:245786226-245786256
  Hypo

SEQ ID NO: 103994 - DNA, 30 bp, Homo sapiens; identical to SEQ ID NO: 69045
  chr1:245835512-245835542
  Hypo

SEQ ID NO: 103995 - DNA, 32 bp, Homo sapiens; identical to SEQ ID NO: 69046
  chr1:245859338-245859370
  Hypo

SEQ ID NO: 103996 - DNA, 23 bp, Homo sapiens
  chr1:245969918-245969941
  Hypo
aaagagggagaaggccgggcgcg

SEQ ID NO: 103997 - DNA, 141 bp, Homo sapiens; identical to SEQ ID NO: 69048
  chr1:245979706-245979847
  Hypo

SEQ ID NO: 103998 - DNA, 178 bp, Homo sapiens; identical to SEQ ID NO: 69049
  chr1:245986618-245986796
  Hypo

SEQ ID NO: 103999 - DNA, 30 bp, Homo sapiens; identical to SEQ ID NO: 69053
  chr1:246171927-246171957
  Hypo

SEQ ID NO: 104000 - DNA, 109 bp, Homo sapiens; identical to SEQ ID NO: 39357
  chr1:246172251-246172360
  Hypo

SEQ ID NO: 104001 - DNA, 30 bp, Homo sapiens; identical to SEQ ID NO: 39358
  chr1:246330476-246330506
  Hypo

SEQ ID NO: 104002 - DNA, 30 bp, Homo sapiens; identical to SEQ ID NO: 69057
  chr1:246363402-246363432
  Hypo

SEQ ID NO: 104003 - DNA, 30 bp, Homo sapiens; identical to SEQ ID NO: 39359
  chr1:246363735-246363765
  Hypo

SEQ ID NO: 104004 - DNA, 165 bp, Homo sapiens; identical to SEQ ID NO: 69060
  chr1:246488142-246488307
  Hypo

SEQ ID NO: 104005 - DNA, 17 bp, Homo sapiens
  chr1:246666970-246666987
  Hypo
taagtgatttcaggccg

SEQ ID NO: 104006 - DNA, 142 bp, Homo sapiens; identical to SEQ ID NO: 69065
  chr1:246899152-246899294
  Hypo

SEQ ID NO: 104007 - DNA, 39 bp, Homo sapiens; identical to SEQ ID NO: 69066
  chr1:246912280-246912319
  Hypo

SEQ ID NO: 104008 - DNA, 70 bp, Homo sapiens; identical to SEQ ID NO: 69067
  chr1:246959219-246959289
  Hypo

SEQ ID NO: 104009 - DNA, 120 bp, Homo sapiens; identical to SEQ ID NO: 69068
  chr1:246964078-246964198
  Hypo

SEQ ID NO: 104010 - DNA, 95 bp, Homo sapiens; identical to SEQ ID NO: 69069
  chr1:246991090-246991185
  Hypo

SEQ ID NO: 104011 - DNA, 561 bp, Homo sapiens
  chr1:247171005-247171566
  Hyper
cagcggccgggatcccgctgccggcccggcccccacctgcgcgggacgggactgagggccgagctgcgccagcgggactcggccgcacactccggagccgaccgccgggaggcccggggccgccagcgctggttccagccaattccaaccgattccaaccaccccctctcccttctcgggacaccctgctccgcacactcaccatttcccagcttttgggggtcccagcgtcctccctataaatctcgcaatacctgcaggccacagggcgatggagcctgcggcagtcacccgggactctccgagaggcagcagacgggaacccagcaccccgccggccgcaaggagacaaaggccccgccagatccccaaggccgccccttcctctctggctgcacgcctgattggacagttctcacgctagcgccgctgactggatggggctccaggccccaccccctcaggtcttgagtgacaggaggtgcgatcagacactgggccgaatgaaacaagagtgacaggtttttgggtgcagcccttttgaagcgacattcctcacgg

SEQ ID NO: 104012 - DNA, 176 bp, Homo sapiens; identical to SEQ ID NO: 69073
  chr1:247185335-247185511
  Hypo

SEQ ID NO: 104013 - DNA, 274 bp, Homo sapiens; identical to SEQ ID NO: 69075
  chr1:247274326-247274600
  Hyper

SEQ ID NO: 104014 - DNA, 204 bp, Homo sapiens; identical to SEQ ID NO: 69076
  chr1:247274826-247275030
  Hyper

SEQ ID NO: 104015 - DNA, 121 bp, Homo sapiens; identical to SEQ ID NO: 69077
  chr1:247275546-247275667
  Hyper

SEQ ID NO: 104016 - DNA, 30 bp, Homo sapiens; identical to SEQ ID NO: 69078
  chr1:247278844-247278874
  Hypo

SEQ ID NO: 104017 - DNA, 91 bp, Homo sapiens; identical to SEQ ID NO: 69079
  chr1:247399809-247399900
  Hypo

SEQ ID NO: 104018 - DNA, 30 bp, Homo sapiens; identical to SEQ ID NO: 69081
  chr1:247582310-247582340
  Hypo

SEQ ID NO: 104019 - DNA, 30 bp, Homo sapiens; identical to SEQ ID NO: 69082
  chr1:247587392-247587422
  Hypo

SEQ ID NO: 104020 - DNA, 261 bp, Homo sapiens; identical to SEQ ID NO: 69083
  chr1:247589856-247590117
  Hypo

SEQ ID NO: 104021 - DNA, 224 bp, Homo sapiens; identical to SEQ ID NO: 69084
  chr1:247615881-247616105
  Hypo

SEQ ID NO: 104022 - DNA, 30 bp, Homo sapiens; identical to SEQ ID NO: 69085
  chr1:247617725-247617755
  Hypo

SEQ ID NO: 104023 - DNA, 38 bp, Homo sapiens; identical to SEQ ID NO: 69086
  chr1:247682027-247682065
  Hypo

SEQ ID NO: 104024 - DNA, 195 bp, Homo sapiens; identical to SEQ ID NO: 69088
  chr1:247694897-247695092
  Hypo

SEQ ID NO: 104025 - DNA, 209 bp, Homo sapiens; identical to SEQ ID NO: 69089
  chr1:247709336-247709545
  Hypo

SEQ ID NO: 104026 - DNA, 203 bp, Homo sapiens; identical to SEQ ID NO: 69090
  chr1:247752018-247752221
  Hypo

SEQ ID NO: 104027 - DNA, 40 bp, Homo sapiens; identical to SEQ ID NO: 69091
  chr1:247910639-247910679
  Hypo

SEQ ID NO: 104028 - DNA, 28 bp, Homo sapiens
  chr1:247994928-247994956
  Hypo
tattctggccaggtgcggtggctcatgc

SEQ ID NO: 104029 - DNA, 32 bp, Homo sapiens; identical to SEQ ID NO: 39368
  chr1:248002278-248002310
  Hypo

SEQ ID NO: 104030 - DNA, 1034 bp, Homo sapiens
  chr1:248020315-248021349
  Hyper
tgggtgtgtgtgtgacgggggcggggaaccacaacgttaattttatccccgacatagggagcgcctgagtggtggcttttcaccgggtgtggctcgtctgagctcttgaactgaagccagcggacaccacccgtcggcgcctgctttcctggggcgtgggctcctccccctgtgcagaccgcgaggggagacggtgcgggcggccgggagcgcagccctccgggaggcgggtcatggcctgggcgccgcccggggagcggctgcgcgaggatgcgcggtgcccggtgtgcctggatttcctgcaggagccggtcagcgtggactgcggccacagcttctgcctcaggtgcatctccgagttctgcgagaagtcggacggcgcgcagggcggcgtctacgcctgtccgcagtgccggggccccttccggccctcgggctttcgccccaaccggcagctggcgggcctggtggagagcgtgcggcggctggggttgggcgcggggcccggggcgcggcgatgcgcgcggcacggcgaggacctgagccgcttctgcgaggaggacgaggcggcgctgtgctgggtgtgcgacgccggccccgagcacaggacgcaccgcacggcgccgctgcaggaggccgccggcagctaccaggtgaggcgccccccggcgggggctgcgggcgctgcggtgaccgggaagcgggcgacagtccggagcggagccgccgaggccacccgtctcctgagcggctcccacggccgctccccccaccgcgcgccgtcccccccgcccacgcggctcactcagtgtgggtctctttgccttggctgtggtaaccccctttgcgacacacacccattattttacaccgtccgcccctcccccaagcactctcctgtcgtcgaactcgcgctgggctggtttctcccgatgcggatagtctggtccctcagctgggctctggtcgggagggctgtgtggtccagttcattcttggtaacaattgtacgtctatatcgtaaacttgccata

SEQ ID NO: 104031 - DNA, 22 bp, Homo sapiens
  chr1:248026563-248026585
  Hypo
gggcacagtggctcacgcctgt

SEQ ID NO: 104032 - DNA, 141 bp, Homo sapiens; identical to SEQ ID NO: 69098
  chr1:248026825-248026966
  Hypo

SEQ ID NO: 104033 - DNA, 294 bp, Homo sapiens; identical to SEQ ID NO: 39370
  chr1:248027965-248028259
  Hypo

SEQ ID NO: 104034 - DNA, 30 bp, Homo sapiens; identical to SEQ ID NO: 69100
  chr1:248029451-248029481
  Hypo

SEQ ID NO: 104035 - DNA, 197 bp, Homo sapiens; identical to SEQ ID NO: 39371
  chr1:248034262-248034459
  Hypo

SEQ ID NO: 104036 - DNA, 113 bp, Homo sapiens; identical to SEQ ID NO: 69102
  chr1:248039213-248039326
  Hypo

SEQ ID NO: 104037 - DNA, 22 bp, Homo sapiens
  chr1:248047093-248047115
  Hypo
taaattatgacaggccgggcgt

SEQ ID NO: 104038 - DNA, 120 bp, Homo sapiens; identical to SEQ ID NO: 69104
  chr1:248047790-248047910
  Hypo

SEQ ID NO: 104039 - DNA, 37 bp, Homo sapiens; identical to SEQ ID NO: 69105
  chr1:248048162-248048199
  Hypo

SEQ ID NO: 104040 - DNA, 34 bp, Homo sapiens; identical to SEQ ID NO: 69106
  chr1:248074314-248074348
  Hypo

SEQ ID NO: 104041 - DNA, 90 bp, Homo sapiens; identical to SEQ ID NO: 69107
  chr1:248074687-248074777
  Hypo

SEQ ID NO: 104042 - DNA, 90 bp, Homo sapiens; identical to SEQ ID NO: 69108
  chr1:248074837-248074927
  Hypo

SEQ ID NO: 104043 - DNA, 32 bp, Homo sapiens; identical to SEQ ID NO: 69109
  chr1:248092102-248092134
  Hypo

SEQ ID NO: 104044 - DNA, 21 bp, Homo sapiens
  chr1:248098787-248098808
  Hypo
aatgtatgggccaggcgcggt

SEQ ID NO: 104045 - DNA, 30 bp, Homo sapiens; identical to SEQ ID NO: 39377
  chr1:248099290-248099320
  Hypo

SEQ ID NO: 104046 - DNA, 424 bp, Homo sapiens; identical to SEQ ID NO: 69112
  chr1:248099705-248100129
  Hypo

SEQ ID NO: 104047 - DNA, 203 bp, Homo sapiens; identical to SEQ ID NO: 69113
  chr1:248140923-248141126
  Hypo

SEQ ID NO: 104048 - DNA, 30 bp, Homo sapiens; identical to SEQ ID NO: 69114
  chr1:248244670-248244700
  Hypo

SEQ ID NO: 104049 - DNA, 30 bp, Homo sapiens; identical to SEQ ID NO: 69115
  chr1:248292238-248292268
  Hypo

SEQ ID NO: 104050 - DNA, 203 bp, Homo sapiens; identical to SEQ ID NO: 39379
  chr1:248328673-248328876
  Hypo

SEQ ID NO: 104051 - DNA, 30 bp, Homo sapiens; identical to SEQ ID NO: 39380
  chr1:248329246-248329276
  Hypo

SEQ ID NO: 104052 - DNA, 30 bp, Homo sapiens; identical to SEQ ID NO: 69119
  chr1:248538382-248538412
  Hypo

SEQ ID NO: 104053 - DNA, 30 bp, Homo sapiens; identical to SEQ ID NO: 69120
  chr1:248685560-248685590
  Hypo

SEQ ID NO: 104054 - DNA, 126 bp, Homo sapiens; identical to SEQ ID NO: 69121
  chr1:248792899-248793025
  Hypo

SEQ ID NO: 104055 - DNA, 24 bp, Homo sapiens
  chr1:249121618-249121642
  Hypo
gagccaccacgcccagcctagctt

SEQ ID NO: 104056 - DNA, 30 bp, Homo sapiens; identical to SEQ ID NO: 69123
  chr1:249151579-249151609
  Hypo

SEQ ID NO: 104057 - DNA, 129 bp, Homo sapiens; identical to SEQ ID NO: 69124
  chr1:249212385-249212514
  Hypo

SEQ ID NO: 104058 - DNA, 30 bp, Homo sapiens; identical to SEQ ID NO: 71417
  chr10:467990-468020
  Hypo

SEQ ID NO: 104059 - DNA, 30 bp, Homo sapiens; identical to SEQ ID NO: 42428
  chr10:482288-482318
  Hypo

SEQ ID NO: 104060 - DNA, 30 bp, Homo sapiens; identical to SEQ ID NO: 71466
  chr10:518309-518339
  Hypo

SEQ ID NO: 104061 - DNA, 163 bp, Homo sapiens; identical to SEQ ID NO: 71470
  chr10:524508-524671
  Hypo

SEQ ID NO: 104062 - DNA, 30 bp, Homo sapiens; identical to SEQ ID NO: 71566
  chr10:673796-673826
  Hypo

SEQ ID NO: 104063 - DNA, 39 bp, Homo sapiens; identical to SEQ ID NO: 71568
  chr10:679363-679402
  Hypo

SEQ ID NO: 104064 - DNA, 73 bp, Homo sapiens; identical to SEQ ID NO: 71656
  chr10:734976-735049
  Hyper

SEQ ID NO: 104065 - DNA, 30 bp, Homo sapiens; identical to SEQ ID NO: 71675
  chr10:741557-741587
  Hypo

SEQ ID NO: 104066 - DNA, 60 bp, Homo sapiens; identical to SEQ ID NO: 71686
  chr10:746643-746703
  Hypo

SEQ ID NO: 104067 - DNA, 35 bp, Homo sapiens; identical to SEQ ID NO: 42430
  chr10:769828-769863
  Hypo

SEQ ID NO: 104068 - DNA, 259 bp, Homo sapiens; identical to SEQ ID NO: 71772
  chr10:819352-819611
  Hypo

SEQ ID NO: 104069 - DNA, 353 bp, Homo sapiens; identical to SEQ ID NO: 71775
  chr10:821379-821732
  Hypo

SEQ ID NO: 104070 - DNA, 179 bp, Homo sapiens
  chr10:830731-830910
  Hyper
gagcttccagcctcccgggtctaggggactgggggatgcgtcttcctcccgcccccgcagcgcccggggcaggagtggcatcggcgtccccggcgtccccgcatcgggcttctctggtcctttgtgaatcgggcctgagtcatccccggctcacggctgcgccacgtacccactgggcg

SEQ ID NO: 104071 - DNA, 197 bp, Homo sapiens; identical to SEQ ID NO: 71783
  chr10:833140-833337
  Hypo

SEQ ID NO: 104072 - DNA, 43 bp, Homo sapiens; identical to SEQ ID NO: 71791
  chr10:838096-838139
  Hypo

SEQ ID NO: 104073 - DNA, 255 bp, Homo sapiens; identical to SEQ ID NO: 71792
  chr10:851249-851504
  Hypo

SEQ ID NO: 104074 - DNA, 30 bp, Homo sapiens; identical to SEQ ID NO: 71854
  chr10:963402-963432
  Hypo

SEQ ID NO: 104075 - DNA, 267 bp, Homo sapiens; identical to SEQ ID NO: 71857
  chr10:978811-979078
  Hypo

SEQ ID NO: 104076 - DNA, 30 bp, Homo sapiens; identical to SEQ ID NO: 70233
  chr10:1035526-1035556
  Hypo

SEQ ID NO: 104077 - DNA, 165 bp, Homo sapiens; identical to SEQ ID NO: 70376
  chr10:1156723-1156888
  Hypo

SEQ ID NO: 104078 - DNA, 30 bp, Homo sapiens; identical to SEQ ID NO: 70474
  chr10:1206813-1206843
  Hypo

SEQ ID NO: 104079 - DNA, 52 bp, Homo sapiens; identical to SEQ ID NO: 42435
  chr10:1209169-1209221
  Hypo

SEQ ID NO: 104080 - DNA, 196 bp, Homo sapiens; identical to SEQ ID NO: 70490
  chr10:1218175-1218371
  Hypo

SEQ ID NO: 104081 - DNA, 150 bp, Homo sapiens; identical to SEQ ID NO: 70501
  chr10:1233090-1233240
  Hypo

SEQ ID NO: 104082 - DNA, 30 bp, Homo sapiens; identical to SEQ ID NO: 70506
  chr10:1233724-1233754
  Hypo

SEQ ID NO: 104083 - DNA, 135 bp, Homo sapiens; identical to SEQ ID NO: 70517
  chr10:1245923-1246058
  Hypo

SEQ ID NO: 104084 - DNA, 30 bp, Homo sapiens; identical to SEQ ID NO: 42437
  chr10:1248527-1248557
  Hypo

SEQ ID NO: 104085 - DNA, 43 bp, Homo sapiens; identical to SEQ ID NO: 70547
  chr10:1250432-1250475
  Hypo

SEQ ID NO: 104086 - DNA, 229 bp, Homo sapiens; identical to SEQ ID NO: 70548
  chr10:1252126-1252355
  Hypo

SEQ ID NO: 104087 - DNA, 30 bp, Homo sapiens; identical to SEQ ID NO: 70551
  chr10:1252590-1252620
  Hypo

SEQ ID NO: 104088 - DNA, 221 bp, Homo sapiens; identical to SEQ ID NO: 42439
  chr10:1259797-1260018
  Hypo

SEQ ID NO: 104089 - DNA, 35 bp, Homo sapiens; identical to SEQ ID NO: 70566
  chr10:1260381-1260416
  Hypo

SEQ ID NO: 104090 - DNA, 30 bp, Homo sapiens; identical to SEQ ID NO: 70672
  chr10:1313323-1313353
  Hypo

SEQ ID NO: 104091 - DNA, 30 bp, Homo sapiens; identical to SEQ ID NO: 70993
  chr10:1367578-1367608
  Hypo

SEQ ID NO: 104092 - DNA, 43 bp, Homo sapiens; identical to SEQ ID NO: 70999
  chr10:1383819-1383862
  Hypo

SEQ ID NO: 104093 - DNA, 30 bp, Homo sapiens; identical to SEQ ID NO: 71008
  chr10:1406940-1406970
  Hypo

SEQ ID NO: 104094 - DNA, 79 bp, Homo sapiens; identical to SEQ ID NO: 71009
  chr10:1416159-1416238
  Hypo

SEQ ID NO: 104095 - DNA, 30 bp, Homo sapiens; identical to SEQ ID NO: 71011
  chr10:1418261-1418291
  Hypo

SEQ ID NO: 104096 - DNA, 64 bp, Homo sapiens; identical to SEQ ID NO: 71014
  chr10:1438451-1438515
  Hypo

SEQ ID NO: 104097 - DNA, 92 bp, Homo sapiens; identical to SEQ ID NO: 71015
  chr10:1443474-1443566
  Hypo

SEQ ID NO: 104098 - DNA, 38 bp, Homo sapiens; identical to SEQ ID NO: 71016
  chr10:1451436-1451474
  Hypo

SEQ ID NO: 104099 - DNA, 332 bp, Homo sapiens; identical to SEQ ID NO: 71025
  chr10:1506252-1506584
  Hypo

SEQ ID NO: 104100 - DNA, 30 bp, Homo sapiens; identical to SEQ ID NO: 42442
  chr10:1555620-1555650
  Hypo

SEQ ID NO: 104101 - DNA, 244 bp, Homo sapiens; identical to SEQ ID NO: 71036
  chr10:1558592-1558836
  Hypo

SEQ ID NO: 104102 - DNA, 129 bp, Homo sapiens; identical to SEQ ID NO: 71041
  chr10:1585292-1585421
  Hypo

SEQ ID NO: 104103 - DNA, 30 bp, Homo sapiens; identical to SEQ ID NO: 71044
  chr10:1621521-1621551
  Hypo

SEQ ID NO: 104104 - DNA, 149 bp, Homo sapiens; identical to SEQ ID NO: 71050
  chr10:1669194-1669343
  Hypo

SEQ ID NO: 104105 - DNA, 38 bp, Homo sapiens; identical to SEQ ID NO: 71056
  chr10:1708651-1708689
  Hypo

SEQ ID NO: 104106 - DNA, 35 bp, Homo sapiens; identical to SEQ ID NO: 71057
  chr10:1714389-1714424
  Hypo

SEQ ID NO: 104107 - DNA, 186 bp, Homo sapiens; identical to SEQ ID NO: 71058
  chr10:1716294-1716480
  Hypo

SEQ ID NO: 104108 - DNA, 30 bp, Homo sapiens; identical to SEQ ID NO: 71059
  chr10:1725740-1725770
  Hypo

SEQ ID NO: 104109 - DNA, 165 bp, Homo sapiens; identical to SEQ ID NO: 71074
  chr10:1767764-1767929
  Hypo

SEQ ID NO: 104110 - DNA, 1488 bp, Homo sapiens
  chr10:1778568-1780056
  Hyper
gagtttgtcagtggccgctgtcagccggctgcttttcctgctttcctggtttgcggtttttttctaccactaacaaaatatgatgcttctttctgttttcctgtattcatttctgcttatttctccaaggacgagccctgtgttctctttacgacccaatgtttacaaatcgacgggcaccacattgagtaaaaactgccagccaatttggagaggcgatcgcagggcttcgcctatcccttcctccgggacagtttggatgggagtagctggcgcgagggctcgttcccccgtttttgggtaattcctttggcactgggagacgagatggcctccggagggtggaaggcagtgccagcccggccggccactggggactgcggggcccggagacgcgcggggtccccggggagctcctcgccgccctcgccccacttcgtccgggtccctcaaacatgtcgcagcgtggctgctcactgtcccctctgggcaagaggaggccccagacatttccacgggatctgaactcccgagcgccctgcacggagcagccatcccgccagcaccccaaagtgaagctgctcacaacggacaagcccggagaccccatgagaggccggggtggagaagccgggggtgaaggggggcaggggccggcgcgccacgcggtccttacctttccgcttggacctccgcctcctcctcctcttggacttgcatttgagttgactgctcagccctccagaccctctgccgctccccaggaccgaggccatggccgagacccaggcgcggagcccagagccgcctccctcctgcacctgcacctgcctccttcccggcagccgccgccgccgctgctgcgaagcttgaggttgcaaacccgggagcggctcacttttcaggactgagcaggaaagcgcgctccgtctctctgtctctcgaattgttctctatgacttgctcccactgggctgggggcctcggctgggcgcctggagcgagctgctccctggtcagggagggcggggaagggcgcgcggcgtcctgagtgctccgagcttcccgcgggctctgcctcctgctctgggctcccagcgcagggaggctacttttgcgcctctgctagttgtttggcaccagccactttgaagccaatcacgcagggagcttgtctatttgctgcagcagcgtctaattagatccaatcacaactgctttctggctctgacatcagcagcagcaccagccgcaccgccgcctggccgcttgcaaactcagctcccgtttggacggtgaagctcccaggaccggcggctggagggaggctgctcccggggaacaaggacgcggcgcgggtgcgtctgggagagaccgggggagcctccaggagggaccctgcccgggaggacgaggcctcctgccgcagcctcgcggacagctcagctcgccctgctcagaaagacacagggacgggtttttccaacc

SEQ ID NO: 104111 - DNA, 41 bp, Homo sapiens; identical to SEQ ID NO: 71078
  chr10:1789225-1789266
  Hypo

SEQ ID NO: 104112 - DNA, 30 bp, Homo sapiens; identical to SEQ ID NO: 71079
  chr10:1829119-1829149
  Hypo

SEQ ID NO: 104113 - DNA, 90 bp, Homo sapiens; identical to SEQ ID NO: 42447
  chr10:1850230-1850320
  Hypo

SEQ ID NO: 104114 - DNA, 30 bp, Homo sapiens; identical to SEQ ID NO: 71088
  chr10:1889085-1889115
  Hypo

SEQ ID NO: 104115 - DNA, 30 bp, Homo sapiens; identical to SEQ ID NO: 71091
  chr10:1981745-1981775
  Hypo

SEQ ID NO: 104116 - DNA, 389 bp, Homo sapiens; identical to SEQ ID NO: 71093
  chr10:1994909-1995298
  Hypo

SEQ ID NO: 104117 - DNA, 30 bp, Homo sapiens; identical to SEQ ID NO: 71095
  chr10:2005972-2006002
  Hypo

SEQ ID NO: 104118 - DNA, 193 bp, Homo sapiens; identical to SEQ ID NO: 71102
  chr10:2094436-2094629
  Hypo

SEQ ID NO: 104119 - DNA, 30 bp, Homo sapiens; identical to SEQ ID NO: 71131
  chr10:2264537-2264567
  Hypo

SEQ ID NO: 104120 - DNA, 30 bp, Homo sapiens; identical to SEQ ID NO: 15322
  chr10:2283030-2283060
  Hypo

SEQ ID NO: 104121 - DNA, 126 bp, Homo sapiens; identical to SEQ ID NO: 71167
  chr10:2374203-2374329
  Hypo

SEQ ID NO: 104122 - DNA, 102 bp, Homo sapiens; identical to SEQ ID NO: 42450
  chr10:2452926-2453028
  Hypo

SEQ ID NO: 104123 - DNA, 30 bp, Homo sapiens; identical to SEQ ID NO: 71191
  chr10:2620590-2620620
  Hypo

SEQ ID NO: 104124 - DNA, 30 bp, Homo sapiens; identical to SEQ ID NO: 42451
  chr10:2706731-2706761
  Hypo

SEQ ID NO: 104125 - DNA, 222 bp, Homo sapiens; identical to SEQ ID NO: 71244
  chr10:2758950-2759172
  Hypo

SEQ ID NO: 104126 - DNA, 54 bp, Homo sapiens; identical to SEQ ID NO: 71245
  chr10:2775287-2775341
  Hypo

SEQ ID NO: 104127 - DNA, 30 bp, Homo sapiens; identical to SEQ ID NO: 71261
  chr10:2871024-2871054
  Hypo

SEQ ID NO: 104128 - DNA, 30 bp, Homo sapiens; identical to SEQ ID NO: 71270
  chr10:2908213-2908243
  Hypo

SEQ ID NO: 104129 - DNA, 30 bp, Homo sapiens; identical to SEQ ID NO: 71272
  chr10:2921407-2921437
  Hypo

SEQ ID NO: 104130 - DNA, 30 bp, Homo sapiens; identical to SEQ ID NO: 71274
  chr10:2932563-2932593
  Hypo

SEQ ID NO: 104131 - DNA, 30 bp, Homo sapiens; identical to SEQ ID NO: 71275
  chr10:2969923-2969953
  Hypo

SEQ ID NO: 104132 - DNA, 91 bp, Homo sapiens; identical to SEQ ID NO: 71283
  chr10:3063272-3063363
  Hypo

SEQ ID NO: 104133 - DNA, 266 bp, Homo sapiens
  chr10:3108902-3109168
  Hyper
gggaaatggcagcttcgtcatggcccagcccgccacgctcaccttttcccaccacctggaggatccactctccgtccgtccttcccgacctcaggctgcagaggaaacctgggggcgggggtcgaggaagccgagccccgaggctcccagcgccgccccaggaggaatcttgcgggccactagaagctgtgcgcgcggccgggctcggcccccacaacggcccgagcggccgggcctgccgcgagcctccgcgtccaggtggggtc

SEQ ID NO: 104134 - DNA, 34 bp, Homo sapiens; identical to SEQ ID NO: 71293
  chr10:3118378-3118412
  Hypo

SEQ ID NO: 104135 - DNA, 183 bp, Homo sapiens; identical to SEQ ID NO: 71297
  chr10:3160988-3161171
  Hypo

SEQ ID NO: 104136 - DNA, 138 bp, Homo sapiens; identical to SEQ ID NO: 71302
  chr10:3216467-3216605
  Hypo

SEQ ID NO: 104137 - DNA, 30 bp, Homo sapiens; identical to SEQ ID NO: 71310
  chr10:3280167-3280197
  Hypo

SEQ ID NO: 104138 - DNA, 23 bp, Homo sapiens
  chr10:3285542-3285565
  Hypo
aacaaatgagccaggcgtgctgg

SEQ ID NO: 104139 - DNA, 83 bp, Homo sapiens; identical to SEQ ID NO: 71312
  chr10:3285685-3285768
  Hypo

SEQ ID NO: 104140 - DNA, 30 bp, Homo sapiens; identical to SEQ ID NO: 71314
  chr10:3329449-3329479
  Hypo

SEQ ID NO: 104141 - DNA, 270 bp, Homo sapiens; identical to SEQ ID NO: 71315
  chr10:3329539-3329809
  Hypo

SEQ ID NO: 104142 - DNA, 30 bp, Homo sapiens; identical to SEQ ID NO: 71316
  chr10:3330158-3330188
  Hypo

SEQ ID NO: 104143 - DNA, 204 bp, Homo sapiens; identical to SEQ ID NO: 71317
  chr10:3330414-3330618
  Hypo

SEQ ID NO: 104144 - DNA, 30 bp, Homo sapiens; identical to SEQ ID NO: 71324
  chr10:3438367-3438397
  Hypo

SEQ ID NO: 104145 - DNA, 39 bp, Homo sapiens; identical to SEQ ID NO: 71325
  chr10:3440138-3440177
  Hypo

SEQ ID NO: 104146 - DNA, 83 bp, Homo sapiens; identical to SEQ ID NO: 71338
  chr10:3641339-3641422
  Hypo

SEQ ID NO: 104147 - DNA, 82 bp, Homo sapiens; identical to SEQ ID NO: 71339
  chr10:3678219-3678301
  Hypo

SEQ ID NO: 104148 - DNA, 261 bp, Homo sapiens; identical to SEQ ID NO: 71340
  chr10:3678601-3678862
  Hypo

SEQ ID NO: 104149 - DNA, 30 bp, Homo sapiens; identical to SEQ ID NO: 71347
  chr10:3862581-3862611
  Hypo

SEQ ID NO: 104150 - DNA, 177 bp, Homo sapiens; identical to SEQ ID NO: 71349
  chr10:3895354-3895531
  Hypo

SEQ ID NO: 104151 - DNA, 163 bp, Homo sapiens; identical to SEQ ID NO: 71350
  chr10:3983403-3983566
  Hypo

SEQ ID NO: 104152 - DNA, 228 bp, Homo sapiens; identical to SEQ ID NO: 71411
  chr10:4599777-4600005
  Hypo

SEQ ID NO: 104153 - DNA, 30 bp, Homo sapiens; identical to SEQ ID NO: 32855
  chr10:4698935-4698965
  Hyper

SEQ ID NO: 104154 - DNA, 185 bp, Homo sapiens; identical to SEQ ID NO: 42464
  chr10:5507960-5508145
  Hypo

SEQ ID NO: 104155 - DNA, 30 bp, Homo sapiens; identical to SEQ ID NO: 42465
  chr10:5523260-5523290
  Hypo

SEQ ID NO: 104156 - DNA, 355 bp, Homo sapiens; identical to SEQ ID NO: 71484
  chr10:5530764-5531119
  Hypo

SEQ ID NO: 104157 - DNA, 163 bp, Homo sapiens; identical to SEQ ID NO: 71485
  chr10:5538775-5538938
  Hypo

SEQ ID NO: 104158 - DNA, 877 bp, Homo sapiens; identical to SEQ ID NO: 42469
  chr10:5540651-5541528
  Hypo

SEQ ID NO: 104159 - DNA, 30 bp, Homo sapiens; identical to SEQ ID NO: 71487
  chr10:5546861-5546891
  Hypo

SEQ ID NO: 104160 - DNA, 44 bp, Homo sapiens; identical to SEQ ID NO: 71488
  chr10:5551853-5551897
  Hypo

SEQ ID NO: 104161 - DNA, 47 bp, Homo sapiens; identical to SEQ ID NO: 42470
  chr10:5553281-5553328
  Hypo

SEQ ID NO: 104162 - DNA, 87 bp, Homo sapiens; identical to SEQ ID NO: 71490
  chr10:5567123-5567210
  Hypo

SEQ ID NO: 104163 - DNA, 30 bp, Homo sapiens; identical to SEQ ID NO: 71491
  chr10:5567536-5567566
  Hypo

SEQ ID NO: 104164 - DNA, 58 bp, Homo sapiens; identical to SEQ ID NO: 71492
  chr10:5576230-5576288
  Hypo

SEQ ID NO: 104165 - DNA, 30 bp, Homo sapiens; identical to SEQ ID NO: 71493
  chr10:5576653-5576683
  Hypo

SEQ ID NO: 104166 - DNA, 211 bp, Homo sapiens; identical to SEQ ID NO: 71494
  chr10:5588268-5588479
  Hypo

SEQ ID NO: 104167 - DNA, 30 bp, Homo sapiens; identical to SEQ ID NO: 71495
  chr10:5617971-5618001
  Hypo

SEQ ID NO: 104168 - DNA, 30 bp, Homo sapiens; identical to SEQ ID NO: 71503
  chr10:5757140-5757170
  Hypo

SEQ ID NO: 104169 - DNA, 160 bp, Homo sapiens; identical to SEQ ID NO: 42473
  chr10:5868078-5868238
  Hypo

SEQ ID NO: 104170 - DNA, 570 bp, Homo sapiens; identical to SEQ ID NO: 42474
  chr10:5874775-5875345
  Hypo

SEQ ID NO: 104171 - DNA, 48 bp, Homo sapiens; identical to SEQ ID NO: 42475
  chr10:5952951-5952999
  Hypo

SEQ ID NO: 104172 - DNA, 294 bp, Homo sapiens; identical to SEQ ID NO: 71509
  chr10:5998554-5998848
  Hypo

SEQ ID NO: 104173 - DNA, 45 bp, Homo sapiens; identical to SEQ ID NO: 42476
  chr10:6003482-6003527
  Hypo

SEQ ID NO: 104174 - DNA, 26 bp, Homo sapiens
  chr10:6009733-6009759
  Hypo
agaataggctgggtgcggtagctcac

SEQ ID NO: 104175 - DNA, 30 bp, Homo sapiens; identical to SEQ ID NO: 71512
  chr10:6018636-6018666
  Hyper

SEQ ID NO: 104176 - DNA, 44 bp, Homo sapiens; identical to SEQ ID NO: 71513
  chr10:6024581-6024625
  Hypo

SEQ ID NO: 104177 - DNA, 30 bp, Homo sapiens; identical to SEQ ID NO: 71518
  chr10:6041312-6041342
  Hypo

SEQ ID NO: 104178 - DNA, 205 bp, Homo sapiens; identical to SEQ ID NO: 15336
  chr10:6042309-6042514
  Hypo

SEQ ID NO: 104179 - DNA, 28 bp, Homo sapiens
  chr10:6055232-6055260
  Hypo
tgcagttgtgctgtccgataacacagac

SEQ ID NO: 104180 - DNA, 88 bp, Homo sapiens; identical to SEQ ID NO: 71521
  chr10:6055320-6055408
  Hypo

SEQ ID NO: 104181 - DNA, 30 bp, Homo sapiens; identical to SEQ ID NO: 71525
  chr10:6109019-6109049
  Hypo

SEQ ID NO: 104182 - DNA, 24 bp, Homo sapiens
  chr10:6127024-6127048
  Hypo
gagccaccgcgcccagccttcttt

SEQ ID NO: 104183 - DNA, 205 bp, Homo sapiens; identical to SEQ ID NO: 71530
  chr10:6159761-6159966
  Hypo

SEQ ID NO: 104184 - DNA, 87 bp, Homo sapiens; identical to SEQ ID NO: 42482
  chr10:6162138-6162225
  Hypo

SEQ ID NO: 104185 - DNA, 24 bp, Homo sapiens
  chr10:6199196-6199220
  Hypo
tttttttttttgagacggagtctc

SEQ ID NO: 104186 - DNA, 18 bp, Homo sapiens
  chr10:6222017-6222035
  Hypo
tgtgtgggccaggctcgg

SEQ ID NO: 104187 - DNA, 152 bp, Homo sapiens; identical to SEQ ID NO: 71535
  chr10:6242759-6242911
  Hyper

SEQ ID NO: 104188 - DNA, 30 bp, Homo sapiens; identical to SEQ ID NO: 71537
  chr10:6261147-6261177
  Hypo

SEQ ID NO: 104189 - DNA, 133 bp, Homo sapiens; identical to SEQ ID NO: 42484
  chr10:6462190-6462323
  Hypo

SEQ ID NO: 104190 - DNA, 186 bp, Homo sapiens; identical to SEQ ID NO: 42485
  chr10:6505370-6505556
  Hypo

SEQ ID NO: 104191 - DNA, 130 bp, Homo sapiens; identical to SEQ ID NO: 71552
  chr10:6520821-6520951
  Hypo

SEQ ID NO: 104192 - DNA, 178 bp, Homo sapiens; identical to SEQ ID NO: 71553
  chr10:6527860-6528038
  Hypo

SEQ ID NO: 104193 - DNA, 140 bp, Homo sapiens; identical to SEQ ID NO: 42487
  chr10:6531036-6531176
  Hypo

SEQ ID NO: 104194 - DNA, 30 bp, Homo sapiens; identical to SEQ ID NO: 71555
  chr10:6531585-6531615
  Hypo

SEQ ID NO: 104195 - DNA, 163 bp, Homo sapiens; identical to SEQ ID NO: 71556
  chr10:6562091-6562254
  Hypo

SEQ ID NO: 104196 - DNA, 118 bp, Homo sapiens; identical to SEQ ID NO: 42489
  chr10:6577643-6577761
  Hypo

SEQ ID NO: 104197 - DNA, 30 bp, Homo sapiens; identical to SEQ ID NO: 71558
  chr10:6586370-6586400
  Hypo

SEQ ID NO: 104198 - DNA, 21 bp, Homo sapiens
  chr10:6586866-6586887
  Hypo
ccactgcgcccagacccacat

SEQ ID NO: 104199 - DNA, 23 bp, Homo sapiens
  chr10:6591880-6591903
  Hypo
accgcgcccggctgaaattcacc

SEQ ID NO: 104200 - DNA, 186 bp, Homo sapiens; identical to SEQ ID NO: 71561
  chr10:6622520-6622706
  Hyper

SEQ ID NO: 104201 - DNA, 30 bp, Homo sapiens; identical to SEQ ID NO: 71563
  chr10:6661702-6661732
  Hypo

SEQ ID NO: 104202 - DNA, 198 bp, Homo sapiens; identical to SEQ ID NO: 71564
  chr10:6666769-6666967
  Hypo

SEQ ID NO: 104203 - DNA, 26 bp, Homo sapiens
  chr10:6680303-6680329
  Hypo
attttcttaagaagtcggtcacgcct

SEQ ID NO: 104204 - DNA, 21 bp, Homo sapiens
  chr10:6781373-6781394
  Hypo
ttgcatagccgggctcggtgg

SEQ ID NO: 104205 - DNA, 25 bp, Homo sapiens
  chr10:6810214-6810239
  Hypo
attaagcttgtaggccgggcgtggt

SEQ ID NO: 104206 - DNA, 106 bp, Homo sapiens; identical to SEQ ID NO: 71575
  chr10:6962043-6962149
  Hyper

SEQ ID NO: 104207 - DNA, 30 bp, Homo sapiens; identical to SEQ ID NO: 71576
  chr10:6984700-6984730
  Hypo

SEQ ID NO: 104208 - DNA, 40 bp, Homo sapiens; identical to SEQ ID NO: 71578
  chr10:7028274-7028314
  Hypo

SEQ ID NO: 104209 - DNA, 75 bp, Homo sapiens; identical to SEQ ID NO: 71585
  chr10:7105495-7105570
  Hypo

SEQ ID NO: 104210 - DNA, 192 bp, Homo sapiens; identical to SEQ ID NO: 71601
  chr10:7139938-7140130
  Hypo

SEQ ID NO: 104211 - DNA, 30 bp, Homo sapiens; identical to SEQ ID NO: 71604
  chr10:7156226-7156256
  Hypo

SEQ ID NO: 104212 - DNA, 30 bp, Homo sapiens; identical to SEQ ID NO: 71605
  chr10:7164293-7164323
  Hypo

SEQ ID NO: 104213 - DNA, 158 bp, Homo sapiens; identical to SEQ ID NO: 71608
  chr10:7202969-7203127
  Hypo

SEQ ID NO: 104214 - DNA, 110 bp, Homo sapiens; identical to SEQ ID NO: 71610
  chr10:7205677-7205787
  Hypo

SEQ ID NO: 104215 - DNA, 30 bp, Homo sapiens; identical to SEQ ID NO: 71611
  chr10:7209019-7209049
  Hypo

SEQ ID NO: 104216 - DNA, 30 bp, Homo sapiens; identical to SEQ ID NO: 71612
  chr10:7211951-7211981
  Hypo

SEQ ID NO: 104217 - DNA, 378 bp, Homo sapiens; identical to SEQ ID NO: 71613
  chr10:7212745-7213123
  Hypo

SEQ ID NO: 104218 - DNA, 833 bp, Homo sapiens; identical to SEQ ID NO: 71614
  chr10:7213624-7214457
  Hypo

SEQ ID NO: 104219 - DNA, 314 bp, Homo sapiens; identical to SEQ ID NO: 71615
  chr10:7215974-7216288
  Hypo

SEQ ID NO: 104220 - DNA, 166 bp, Homo sapiens; identical to SEQ ID NO: 71616
  chr10:7216521-7216687
  Hypo

SEQ ID NO: 104221 - DNA, 43 bp, Homo sapiens; identical to SEQ ID NO: 71617
  chr10:7219062-7219105
  Hypo

SEQ ID NO: 104222 - DNA, 30 bp, Homo sapiens; identical to SEQ ID NO: 71624
  chr10:7234209-7234239
  Hypo

SEQ ID NO: 104223 - DNA, 155 bp, Homo sapiens; identical to SEQ ID NO: 42498
  chr10:7236090-7236245
  Hypo

SEQ ID NO: 104224 - DNA, 30 bp, Homo sapiens; identical to SEQ ID NO: 71626
  chr10:7237870-7237900
  Hypo

SEQ ID NO: 104225 - DNA, 30 bp, Homo sapiens; identical to SEQ ID NO: 71627
  chr10:7240552-7240582
  Hypo

SEQ ID NO: 104226 - DNA, 52 bp, Homo sapiens; identical to SEQ ID NO: 71632
  chr10:7255513-7255565
  Hypo

SEQ ID NO: 104227 - DNA, 81 bp, Homo sapiens; identical to SEQ ID NO: 71633
  chr10:7258531-7258612
  Hypo

SEQ ID NO: 104228 - DNA, 102 bp, Homo sapiens; identical to SEQ ID NO: 71635
  chr10:7271976-7272078
  Hypo

SEQ ID NO: 104229 - DNA, 22 bp, Homo sapiens
  chr10:7288388-7288410
  Hypo
gaatgtgagagaggccgggtgc

SEQ ID NO: 104230 - DNA, 88 bp, Homo sapiens; identical to SEQ ID NO: 71639
  chr10:7288706-7288794
  Hypo

SEQ ID NO: 104231 - DNA, 67 bp, Homo sapiens; identical to SEQ ID NO: 71640
  chr10:7290469-7290536
  Hypo

SEQ ID NO: 104232 - DNA, 30 bp, Homo sapiens; identical to SEQ ID NO: 71650
  chr10:7323490-7323520
  Hypo

SEQ ID NO: 104233 - DNA, 166 bp, Homo sapiens; identical to SEQ ID NO: 71651
  chr10:7339896-7340062
  Hypo

SEQ ID NO: 104234 - DNA, 30 bp, Homo sapiens; identical to SEQ ID NO: 71659
  chr10:7367191-7367221
  Hypo

SEQ ID NO: 104235 - DNA, 30 bp, Homo sapiens; identical to SEQ ID NO: 42503
  chr10:7391910-7391940
  Hypo

SEQ ID NO: 104236 - DNA, 36 bp, Homo sapiens; identical to SEQ ID NO: 71668
  chr10:7401231-7401267
  Hypo

SEQ ID NO: 104237 - DNA, 127 bp, Homo sapiens; identical to SEQ ID NO: 71670
  chr10:7407101-7407228
  Hypo

SEQ ID NO: 104238 - DNA, 74 bp, Homo sapiens; identical to SEQ ID NO: 71671
  chr10:7409558-7409632
  Hypo

SEQ ID NO: 104239 - DNA, 19 bp, Homo sapiens
  chr10:7414170-7414189
  Hypo
cgcccggccttcttgaaat

SEQ ID NO: 104240 - DNA, 44 bp, Homo sapiens; identical to SEQ ID NO: 42505
  chr10:7414544-7414588
  Hypo

SEQ ID NO: 104241 - DNA, 30 bp, Homo sapiens; identical to SEQ ID NO: 71676
  chr10:7424626-7424656
  Hypo

SEQ ID NO: 104242 - DNA, 186 bp, Homo sapiens; identical to SEQ ID NO: 71677
  chr10:7443826-7444012
  Hypo

SEQ ID NO: 104243 - DNA, 3082 bp, Homo sapiens
  chr10:7449954-7453036
  Hyper
aaaacttgggcccttcgagaaccctgtggaatgttctttgtaatcaactgtacatccgcttccacggcacggcctcgtgcaaaatcgcgggtttcggggccttggagcaaattgcgcttgtcagcggcgacgtcaggaggacaaggggaggggttcgcggctgaaactgcagcttcgcagcacagagccattttaggctgctccccacctcgcggggcccatgggaaagccggccccgggagggcgcgcccaaacgcaggctggaggagccacggacgcgtcctggccggcgtgtcgccatcgttcagcctcgctgcccaggtgggaggggtcacctgccgcggggtctccaagccagtgccgcttgctcccggcccccacccactgacagcacggcgtccgagtgaccctgtctagcctcgttctgcgctcctgcaaaccacgttgctgcgctaactacaaacctggccaacatgtctttgtaaccctatcatttaaaaacgcttccaggcacctggccgctgccagatcaggttcgcgggcccggaggaggtcctcccacctgcccccgccagccccggggaccgtgcgcggcctccgtgtggcccccgcccacgaggtccctcgggcaggaaccgccgcgcgacctctgttcagcggccgcgtcctggccacgggcgacccctgtcgggaaccctgttcccggctaagctgcgttcccgcattccggtggctctcacccgagctcgcgtttgctggctttccctctggctcctctgcctgaccccgattttgtctccgaactccactcccagatcctccccgccctggaacgccgacctttcccccgcacttcgccgcccactcacatcccccggcgactgcccggcctccatgcccgccaagacaagaagatgcccctctccgatgcgccgagagggttcctaagccgagcaagggacaatttcttccccaaacgctgtccccatcccccaccttccctagagcgcgaaacccaaaagtaaggaaggcaacccctcgcctcgaccctacgtgcttgtctcccagagccgcgcgctcccgcccttctgccccaccccaccaccaccaccaccactttggtcttctccaagcttcggtcccggtcccccacctcccaccccagagcggcgtggaggaaagcaggagcccactattaagtgcagcgcgccccctgcacacacgaaatccggctggcgtctgcagcccgattgcacccaatacccgggacagttagtccttttaataagcacctcctcgccccacctactcggggatctacccgcgcaggatccagcacacacaaggcgagagctagctcgtctcctagaaagacaaaataaatcactccctctgccctcatgtactttacaccacgtgtccgcagtttgtcacgtcaaatcatggcagggtctggttccaagacgcacacacacattcggggtggttctctttgacacacacacccaaaaaaactgcgcacacgcaggcctgcacactaatccacaggcacacacgacagttgcgtttcggtgccctggtccgggccaggggcacttctccatccctttcccccctagcaatggacttgacacacagactctaaccacggaaaaaaaaaaccggacagcccattccttctttttttccccacttaattcgctaaagcgcttcctggggtagccaaagagagtcgaaactaaggggtggaaacttcagctgggttttttcccacctcaaaacctttattttcagtttttaaaagccaccttagcccgccatattgaaactggcacggtttctaaagactccttccccgcagttgtggcgcttccaagaaaacacgagtacggatcaggctctggatgagtgtccggccaccgagaatcagccacttcccaccctccaggatcccccagctccctccagccccttcccaccgcccctggtcaaaatcaataaatacatctcgcagttcctacagttgcattttggcggatttctgcaaaacatacacacacatacacatacccacgcacgcatattaaaaaataaactccagaaccagctcaagtcagcaattttgaaagggggtcgaataagaggagacaaccggaaagcccctaagtgacaggatattactttaaagagaaaataatgaacaaaaagaccatcctcgctggagcacgctccaaaactactactgccaattttatttcagttgctcaggcaaatgtttccaagggagcgattccgaatgtctgcacgatttttacccccatgccggtctccgattccccgtcctcaccatctttttctcccacccaaaccaaaagaaaggggagaccccagcgcggaggagacgcgggagcgcggggtaggtagcagcggcggctgcgtcgctaaaatgagtgcagaaacgaggaaggtgggcggcgggaggggacaggctgcgcccggggaaggaggacactttgcaactccggacggactcccgcacggctcggcttttccgagcccggagacgcaggcgaaggggacccgggaagcaaaaatgacaacctggagcgcacagaggagtttgaagcttcgctcaagtgcagtcgctttcttctcctgcccttctctttcgctcccctgcaccctccccagccttcccccacccgccacctccaaccccagctccctcaggcttccttcctttttttttttttccttttttttcctaggctggaaaaagcccctgaccagcgcactcaacctgcgggccgaagggctgctctccggccagcctgggcgccggggacagcagccggcgcggcgtcctacctggtgaagttcgtcctgccctcggcgtggacccaggccccggtcgccgcccgggagggcaccggcctcgctcgcttgctcgctcgcccgcccttgcccgctcgctccccgcccgccgcctccctcgcgcgcccgctccggtcctccggctcccactacagctcattccaatatggcatcctctctgtgcgcatgctcggcgctcttttttttt

SEQ ID NO: 104244 - DNA, 981 bp, Homo sapiens
  chr10:7453096-7454077
  Hyper
gcgaactccttcaacgaccttttccagcgcttgcaaaatttcttaagccaattagcctgcgggacgtgatcggctccttccccagccagctccgcgccattccctgcgcctaagcaggcgggcacccccaggaccctgggaccttccacgcccacgcggcctcctccccaccgcgctccccttcctcctttttgtgagctccctccatacatgatctgcagaaagttcccatcgcgggcgtttccgcacacccctccgcaaggacaactgggcaaactcccgtttccctggctgcggttcgtgagctgggtttccaatggctcagtcgaccgtgtgcacaaacttgcgctttatccgccggggatcgctgggagcggagataaattcaatccccagggcaatcttggccccgcccgccccaccccatcctgtgcttaaatagagcctttcttgaagctgcgaacatttccaggccccttgggcagggctggaggggccgaggagagctattcgagggaaaggtgccccgaggggcaggaaattaagttggggctgcccgggcgagctgccaggtagccgtgctcgccacggcgtctcatggggcacctagctagtggcgggcctcatagggcgggaaaagaatcgtcgctcacaccccagcaaaacgtggccctcgacggtccgttggagagccccggcggccgtgagccccgggcagggctggacgtctgcggagccctcgggcactttgtcccgggcgcctggggaggaacgcggagctcccagggccttaggtgcaacggctgcgcagagcccaaacgaaatgtccccagtgcggaaaagccggtgacgccctggtagcaagaccaagagcttccgaagaacgctgcgcccttaactagggggcctcgcagagatgcctgtgtgggcctgcattgtatatttctgcgaaatagcgaatggacacgtttgctcagggtt

SEQ ID NO: 104245 - DNA, 659 bp, Homo sapiens
  chr10:7454305-7454964
  Hyper
acagaggtcctcaggcgggccctctcctggacggtggggccggagctgatctagaagaaatacggagggacgtgccgagaagccgctctccttcgccgcgaccctggagagcgcctctccacccaaaggatctgccgagctgagagatccagggcgggcgtccgcagccgtgaggccccctgcgccgccagtatgggaagatcctgcctccttacaccttggagaacgctgggcgacgactaaagcgccttccgccggcctgtcactccatgtgacacaggagccacgtgagacccagaagagtccagcgactcgccgcgcggcgcactttaaactctagcctgagtctgcgacccctccagctctccagtccccagctgttggggacatcaagccggagccctgggctctctgccctgtgggtcgctgaaagcagagactcctcaaaccaaccgaaccgggcgcattaaccctctcgcctgcaccccgctgcctcccggttgagccccgaggcggctccaggtagaacctgctggactgactgcggcgtccagaaatctggagtgtgggctccagacactctccacggtttggccccgggtctcaacacccaagtcgcctcttctggctccttcaccacacagcggggcctgtggaaa

SEQ ID NO: 104246 - DNA, 40 bp, Homo sapiens; identical to SEQ ID NO: 71687
  chr10:7472551-7472591
  Hypo

SEQ ID NO: 104247 - DNA, 352 bp, Homo sapiens; identical to SEQ ID NO: 71688
  chr10:7488720-7489072
  Hypo

SEQ ID NO: 104248 - DNA, 30 bp, Homo sapiens; identical to SEQ ID NO: 71689
  chr10:7498536-7498566
  Hypo

SEQ ID NO: 104249 - DNA, 30 bp, Homo sapiens; identical to SEQ ID NO: 71692
  chr10:7505493-7505523
  Hypo

SEQ ID NO: 104250 - DNA, 36 bp, Homo sapiens; identical to SEQ ID NO: 71697
  chr10:7542725-7542761
  Hypo

SEQ ID NO: 104251 - DNA, 156 bp, Homo sapiens; identical to SEQ ID NO: 71705
  chr10:7608010-7608166
  Hypo

SEQ ID NO: 104252 - DNA, 30 bp, Homo sapiens; identical to SEQ ID NO: 71706
  chr10:7641473-7641503
  Hypo

SEQ ID NO: 104253 - DNA, 30 bp, Homo sapiens; identical to SEQ ID NO: 71708
  chr10:7673219-7673249
  Hypo

SEQ ID NO: 104254 - DNA, 21 bp, Homo sapiens
  chr10:7678984-7679005
  Hypo
gcctggcgacagaggacttcg

SEQ ID NO: 104255 - DNA, 30 bp, Homo sapiens; identical to SEQ ID NO: 71712
  chr10:7698170-7698200
  Hypo

SEQ ID NO: 104256 - DNA, 579 bp, Homo sapiens
  chr10:7708410-7708989
  Hyper
agactgccccccacgcgtgataaggaaaaaaccttgtaattataataacttttggagctacctcagaaattaacaacgacgaacagaaatctgcgcaatcaacaggagccaagaagaaaaactcggctccgcaggacaagtcccgggcacagttctgcaggaagcctcaggccagatcaggcaccgcggctcacacagaggtgacgcacgagtgacccacagagagggacccctgggcctctggtgggggcctgggagacggtcgaagggggcccgggcagaagctccgcggccgggccggcggagggaagggggcggccgcgcccgggacccggctcccctcggctccacttacctgctccgaagagtggccccagctctgcgcctcttcctgcgaccccacacacagggacagccccaggcacagccccagcagcaggagcatggcggggcgagggcgcgggacgctcggggacccggcgggacacgctttgcagcgcccagggctccagccactgcgggacgctctcggggccgcccaccccgcggtcccagcccggaccccgcccaccccacgga

SEQ ID NO: 104257 - DNA, 66 bp, Homo sapiens; identical to SEQ ID NO: 71718
  chr10:7709654-7709720
  Hyper

SEQ ID NO: 104258 - DNA, 58 bp, Homo sapiens; identical to SEQ ID NO: 42508
  chr10:7765067-7765125
  Hypo

SEQ ID NO: 104259 - DNA, 30 bp, Homo sapiens; identical to SEQ ID NO: 42509
  chr10:7780425-7780455
  Hypo

SEQ ID NO: 104260 - DNA, 30 bp, Homo sapiens; identical to SEQ ID NO: 71728
  chr10:7786837-7786867
  Hypo

SEQ ID NO: 104261 - DNA, 34 bp, Homo sapiens; identical to SEQ ID NO: 42510
  chr10:7985160-7985194
  Hypo

SEQ ID NO: 104262 - DNA, 30 bp, Homo sapiens; identical to SEQ ID NO: 42511
  chr10:8025070-8025100
  Hypo

SEQ ID NO: 104263 - DNA, 30 bp, Homo sapiens; identical to SEQ ID NO: 42512
  chr10:8067803-8067833
  Hypo

SEQ ID NO: 104264 - DNA, 1444 bp, Homo sapiens
  chr10:8075930-8077374
  Hyper
gctggcagccaacttcgtttctatggcggaactcagggttcccacgctcttggagtaggaccaggatgggatcgccctgggcacgtggtatcccctccgcctgcggggtcacgacagcctaggcgacggacagtcccgggcttagggagggaggctgatcccgggagctctcaggagtccttccacctgccacctaggagcccagttcgcatctctacagcgccacacatctaggccagcccagctccggtcccagtcggtctctgcggagccccagccagctccgcgtcttggtcctggcttgcgggtggcacacagacaagcgaccggggtggcccggagaggtcgtgcccctggctgcgagacgacgcgacagcagggcgctccgggggccgcagcggcgtcgaaggcggtccctgggggcggggctctggcacgagggggaccctcccgggtcaagttcacagaggcggaggggcctgggctgcgccccagagccccagggggtcctctgctcccataaaaaacaaagacgggggcggcggagggtgtggaaggaaagaaattgaaaagggagtgcgggcgactgagggaagctggaggggaaataggggcctcggccaccagtggcctatgtccataactgccctttggttttggtggccttgcaggccgggaatcgagtctgccatgttcgctttcagacgggcctcctggcaagctcttggttgactgtccccagatgttccgggaacccacccctcccccacaccctcccgccccaaccctccgcagagaagccgaggaccacatccatccgcttcctaggaacctgcccgcaccagcaggccctgtttcctggacaaactgggcaaagaaacctaagaaccgcgcgatcccggcaggtggctttctgcggagccagggctgccagcgcggccgggcggcgcctcgggacccggcctggcatccgcgggcgcccggggagggccttggcgtcggcgggggtgggggtgggcggcagatccgaagcagggtcggggaaaaacggcgttgcgggagggttggggggtggcctctgaggaagtgggacaaaaggctttatttcagaaggtacgccaggaaaggggcgtgggtcaccaagtcctgcgcagcagagttggcgcggcctgggagccggggtcccttctgaccacagacgtggccaccgcctcttctcatcccgaaggtcccagccatcccgaggtggtcagagaagaccccgacgggcggatcgggcagtggagagacccgtggtcctcgcgcctgctgtgtcgctgtgtcaatgaccgtgacactcagggcaatccttaccaacacagagcaggacaacgataccccgcacccccccgtacaagtgcaaactagtttctgtgttgggggaaaaaagcgaataaaagtttaa

SEQ ID NO: 104265 - DNA, 369 bp, Homo sapiens; identical to SEQ ID NO: 71743
  chr10:8077874-8078243
  Hyper

SEQ ID NO: 104266 - DNA, 63 bp, Homo sapiens; identical to SEQ ID NO: 71744
  chr10:8078628-8078691
  Hyper

SEQ ID NO: 104267 - DNA, 30 bp, Homo sapiens; identical to SEQ ID NO: 71745
  chr10:8079285-8079315
  Hyper

SEQ ID NO: 104268 - DNA, 30 bp, Homo sapiens; identical to SEQ ID NO: 32867
  chr10:8079721-8079751
  Hyper

SEQ ID NO: 104269 - DNA, 42 bp, Homo sapiens; identical to SEQ ID NO: 71747
  chr10:8083222-8083264
  Hyper

SEQ ID NO: 104270 - DNA, 1052 bp, Homo sapiens
  chr10:8084996-8086048
  Hyper
gagtcactttggacccgagaaaagcaagtgcccgcgtcagcagaaaaggaacgaggagcgaggccgccagatcgacgggaaacaggcggagagagggtcgtcggcgctcagggccggggtggcccgggggacggaggagagataggagagcccgccctgggtctcagagggtgctgttgcgtgctgcaggttctaagggaaaagggctttcccctggcaggagagccaaaggcggggaagggagaaggaggggcgggagaatgaggaccagaagccggagaagggaggctggaggaagacgcaagtggcccctccgacctagtggacggcgagttgaggtacagttaatgcccgggccaaggagacaactgtcgccgccttggtgacggatgccccctccctgggcccccgccctagtccccatggggggagcagcgcgccagaagggagtaggcgttgttgggaccctctgggggtctggaatgccagcgacacttctcttcccagccgcaggggccttcctgggacaggccaggtagaccccacccccccgaccccgttcgtcagggcaacaggttgggtgcaagctgtcaagagatggccttctccctgggtcctcaaaacgcgccaagaacgtggctctgccacttggtggcggaaggcgggaggcacagggcaggaaggtggaggaggggctgcattcgtgacgacgggggagcagagagggaaggacttagggactccccagagggcagacagacctggccagcttggcaaatcataaatccctctccctggaccctcggcctaaacctacccccagggtgtgcagcggaggcgcacaggggttggctgacgggctggggtgcgcctgggtggaggctggtttggggttctggcgtctggaggcaggccatggaaccagaggagagggcaggagggcccaccgcgcagagctgcggcccggctcctagagtggcgcccccagcctgggcatcgcgctcaactgctctctgaaccccatgtccacgagggttcgccctcaaaccacc

SEQ ID NO: 104271 - DNA, 55 bp, Homo sapiens; identical to SEQ ID NO: 71749
  chr10:8086685-8086740
  Hyper

SEQ ID NO: 104272 - DNA, 359 bp, Homo sapiens; identical to SEQ ID NO: 71750
  chr10:8087043-8087402
  Hyper

SEQ ID NO: 104273 - DNA, 337 bp, Homo sapiens
  chr10:8090421-8090758
  Hyper
ggacggaggagaggtcgggtctagaagtagcaagcccctggctaggagtcactgatgccactgggggcagggtaagatgtccaaagcccgggagacccagggacgccggctgggctgcctccaccccttcttttcctcccgtggcacccacctgtccccccacctgccaaggccaggagggagggagagagctgaaaagggcacttttcctccagggtgactccaattcctttccactcaccctcaaggcgagttccttctctcccacccaacccggggctccccccaactgccactcgcctcacgtgtgagttgttaaacccgaaagcagaaatcc

SEQ ID NO: 104274 - DNA, 639 bp, Homo sapiens; identical to SEQ ID NO: 71753
  chr10:8091359-8091998
  Hyper

SEQ ID NO: 104275 - DNA, 89 bp, Homo sapiens; identical to SEQ ID NO: 32874
  chr10:8092446-8092535
  Hyper

SEQ ID NO: 104276 - DNA, 680 bp, Homo sapiens
  chr10:8093360-8094040
  Hyper
tcgcctgctcggctgcgggatgcttgctcccaaggtcccaggcgtccaggttgatcgccagccccttaccctggtgagggaggccttgcgccctgcagaagccccgggccctgcggcggcggcggcggcatcctcctggtcgcctcctcgctttcctccacccgagctccgccggctgctccttgggaggaaggggactcgctagaccaggccgaggcccaggtacctgggagggggtcgcgtcaggtctgcgggaaggcgctcaggcttctccgcaggaggccaggatcagctttgtggcggtggcacagggagaatcaggaccacctttcccccttacccccggccaggatccccctttccctcccccgcccgccaagggaggaggaagcccggcctgctcttgccggcgaggcgggtcaggccggcgcctggcctggcccggacccccgcagcccggctctccgcctcaggccacgcgccgcagcctctccagcctcgctcccttcccccttccttccccgtgggtcccgaggccgacctcggccctccctcctcggcatccccctcccatccttttcccttccccgctgccctgtgctccgggctccggggctgggcccgtgacgtcaaacccagtgtggcgtcggcgagactggccggcgcgggccatcaaaaga

SEQ ID NO: 104277 - DNA, 67 bp, Homo sapiens
  chr10:8094243-8094310
  Hyper
gcccttctccatccccggccagtccgacttggtgctcgcgattgaatttaaacgaataatccctact

SEQ ID NO: 104278 - DNA, 491 bp, Homo sapiens
  chr10:8095198-8095689
  Hyper
tatggggtagaggagcgaagagggaacaatgtctccaattcaaataaaaccccaaattaagctctcagccccatcggtgggatagcctgcgggggaacccactccctctcctggcagcattgccctgggggcgagcagagagtggatttggagtcttcttttcccgcctgacccctgctcgcccgagcagcattttcgggccagcggctgcagccacccgggcgccgctaggggatgcagtggctcaaaggaccgagcgggcggtgcaggttggaacccgcggggcggaccaatcgcggctcggccacagcctcgcccgctgattggtccctccaggccccgcccccgctcgccccgcccctctcgctggggcgcctcggagccgcgtgccctccgccccggggtgcccattgcgcagagcgtggcctggagacccgcgagccggggaaggtcgccgtggagtcccgaccagaggccggggttggggtcgg

SEQ ID NO: 104279 - DNA, 1593 bp, Homo sapiens; identical to SEQ ID NO: 71761
  chr10:8095944-8097537
  Hyper

SEQ ID NO: 104280 - DNA, 403 bp, Homo sapiens; identical to SEQ ID NO: 71790
  chr10:8374325-8374728
  Hyper

SEQ ID NO: 104281 - DNA, 30 bp, Homo sapiens; identical to SEQ ID NO: 71793
  chr10:8556196-8556226
  Hypo

SEQ ID NO: 104282 - DNA, 19 bp, Homo sapiens
  chr10:9071404-9071423
  Hypo
ttttagacagagtctcgct

SEQ ID NO: 104283 - DNA, 30 bp, Homo sapiens; identical to SEQ ID NO: 71855
  chr10:9637898-9637928
  Hypo

SEQ ID NO: 104284 - DNA, 182 bp, Homo sapiens; identical to SEQ ID NO: 70292
  chr10:10767560-10767742
  Hypo

SEQ ID NO: 104285 - DNA, 40 bp, Homo sapiens; identical to SEQ ID NO: 70293
  chr10:10769445-10769485
  Hypo

SEQ ID NO: 104286 - DNA, 30 bp, Homo sapiens; identical to SEQ ID NO: 42513
  chr10:10770967-10770997
  Hypo

SEQ ID NO: 104287 - DNA, 196 bp, Homo sapiens; identical to SEQ ID NO: 70296
  chr10:10854925-10855121
  Hypo

SEQ ID NO: 104288 - DNA, 36 bp, Homo sapiens; identical to SEQ ID NO: 70299
  chr10:10867457-10867493
  Hypo

SEQ ID NO: 104289 - DNA, 30 bp, Homo sapiens; identical to SEQ ID NO: 70306
  chr10:10910269-10910299
  Hypo

SEQ ID NO: 104290 - DNA, 1424 bp, Homo sapiens
  chr10:11059322-11060746
  Hyper
aaaaggcagtgccatcgtgcagagacaggtttgtcttccttagggcactgcgataagtccctaaatgtcacttgggtcatagatctgatctttattttgcctaaacctcctatatcctttcggtgatcgcccttagttcctgcccgggcaagcacaccacaccgaggagcatcgaagcgaaccctcgggctgctcgcctcccgcggctgggctctgggagcgcggctcgggtatggaagtggagcgggctttggcgcctgggtggccctaaacctactccgagcggccacggcggcctcttgccagggacccccgggcgggggagcagagccaggcggggagcgggtttgccttcgggggcccaggggaccctgagaagtctggccgtgcccgggcggtgagcgcggaggcggcccgccctgtgtccccgcggggcggagccgggttcggggccgcgctctgggccggcgggcccgcaggggttaagcggcggcgggcgccccgcgagctccgcccccgcccgccgcacctggcgctcggcagccggccgccccggcgctggatttcggaggggattggcggagcgcgaggagagaatgtgacaagtgccggctcggcggccgccgggggaggccgcgcgcacctgtccctgcccgtctcgcgccgcccgcggccgctcggacgcgcgcagagccgccccccgccgctgccgccgcgtgcgcccgcgaacatgacttctgccttcaagctggatttcctcccggacatgatggtcgagggccgcctgctcgttcctgacagaatgtgagtggcgccgcgtcccgaggccgggcgagcgggcgtcctcctcccagagtcggcggcgcgaaggggacgggcgtcgcccgcagctcccgggcgcgactcggccgcttcggatccgtcgcctccctcggccttcggaggccggcacgggacgcgggaggagggagcgggtgcggacgagcagcgccggcggtgcagggcgcggggcttcccggagggacgagcggagcgcggcgtcccggggaccgggcggggtccgcgagtccgggtgaggaccagcgggccgagcgcggcgtcccgggtccccgcggggtgagtgggggacgggcggggtccaccgaccggcgcgaggacccgcgagcagggtgagcggggcgcggcgtcccggggtccgggcggggtccatgagtccaagtgggaccggcgagccgggcgcggagtcccggggtccggtggggcgggcggggaccgggcggggtctgggggtccgggtgaggactgagcggagcgcggcgtgacggggaccgggcggggaccggcgagcgggcacggggtccgggcggggtgcgcgcgtgcgagtgtgcacgcttgtgtcatttgaaatgcggggctgacggagc

SEQ ID NO: 104291 - DNA, 30 bp, Homo sapiens; identical to SEQ ID NO: 70335
  chr10:11201306-11201336
  Hypo

SEQ ID NO: 104292 - DNA, 454 bp, Homo sapiens
  chr10:11206876-11207330
  Hyper
tgcaaattcatcacccgcatcttgcattagtcatctgacggactgccaagtgtttcattttctttccatgtgactttattattaccacctctctcctctcttccaaaaacctcccaaaaagggcggtggggcggggggcggggcagggagagggagagaaatccagcagacatctagctctgcctttctttcccagccacagccagggtagggctgataaggcgctgatgcgttgatggcagccttgcagagctagacctgcacttaacttgcagctgcctcccgagcctccaagatgtccacgccctgggtgacaggcggcagggcgctgccccgtgctcccccggctctgctcgacagcagcacgcagtgagagcctcgccgccgccgaggagcaactcatggtgcctccgctttgttttagttcatcaaatttctacgactcattaggcac

SEQ ID NO: 104293 - DNA, 135 bp, Homo sapiens
  chr10:11207589-11207724
  Hyper
cgtctaccagatcaacgtcctccgggaccggagtcagaaccctccgcagagtaaaggtacagagcgcggggcgggggtcgccaggcgtccaggtgggcgtcgcggggcactggggctgtccgagcccccagcctg

SEQ ID NO: 104294 - DNA, 30 bp, Homo sapiens; identical to SEQ ID NO: 70355
  chr10:11343824-11343854
  Hypo

SEQ ID NO: 104295 - DNA, 30 bp, Homo sapiens; identical to SEQ ID NO: 42515
  chr10:11344374-11344404
  Hypo

SEQ ID NO: 104296 - DNA, 30 bp, Homo sapiens; identical to SEQ ID NO: 70357
  chr10:11344756-11344786
  Hypo

SEQ ID NO: 104297 - DNA, 155 bp, Homo sapiens; identical to SEQ ID NO: 70358
  chr10:11357627-11357782
  Hypo

SEQ ID NO: 104298 - DNA, 30 bp, Homo sapiens; identical to SEQ ID NO: 70360
  chr10:11367015-11367045
  Hypo

SEQ ID NO: 104299 - DNA, 30 bp, Homo sapiens; identical to SEQ ID NO: 70362
  chr10:11381701-11381731
  Hypo

SEQ ID NO: 104300 - DNA, 30 bp, Homo sapiens; identical to SEQ ID NO: 70363
  chr10:11405472-11405502
  Hypo

SEQ ID NO: 104301 - DNA, 30 bp, Homo sapiens; identical to SEQ ID NO: 70364
  chr10:11429024-11429054
  Hypo

SEQ ID NO: 104302 - DNA, 57 bp, Homo sapiens; identical to SEQ ID NO: 70365
  chr10:11436196-11436253
  Hypo

SEQ ID NO: 104303 - DNA, 151 bp, Homo sapiens; identical to SEQ ID NO: 42517
  chr10:11472842-11472993
  Hypo

SEQ ID NO: 104304 - DNA, 30 bp, Homo sapiens; identical to SEQ ID NO: 70371
  chr10:11480033-11480063
  Hypo

SEQ ID NO: 104305 - DNA, 30 bp, Homo sapiens; identical to SEQ ID NO: 42518
  chr10:11486576-11486606
  Hypo

SEQ ID NO: 104306 - DNA, 71 bp, Homo sapiens; identical to SEQ ID NO: 70397
  chr10:11700944-11701015
  Hypo

SEQ ID NO: 104307 - DNA, 295 bp, Homo sapiens
  chr10:11784135-11784430
  Hyper
caaacgccacattcccggtgttggtgcaaaaagaaatcatcctactcctcccctcgcttaaactttcccacaggccttgtcaaacaacccctggagccggcctgcaggttttcaatgcgcgcctttcaccgtgcggggcgcggcggggagcggcgagccgggggcgggcctcgtgggggcggggcggggcgtgccggggcggggaggggcgtgccggggcggggcggggcgtgccggggcggggcgtagtacggactgggcctggcctggggcgtccccgcgaagcctgggcctg

SEQ ID NO: 104308 - DNA, 30 bp, Homo sapiens; identical to SEQ ID NO: 70409
  chr10:11825336-11825366
  Hypo

SEQ ID NO: 104309 - DNA, 30 bp, Homo sapiens; identical to SEQ ID NO: 42519
  chr10:12139715-12139745
  Hypo

SEQ ID NO: 104310 - DNA, 35 bp, Homo sapiens; identical to SEQ ID NO: 70502
  chr10:12331252-12331287
  Hypo

SEQ ID NO: 104311 - DNA, 30 bp, Homo sapiens; identical to SEQ ID NO: 70511
  chr10:12398063-12398093
  Hypo

SEQ ID NO: 104312 - DNA, 30 bp, Homo sapiens; identical to SEQ ID NO: 70516
  chr10:12436198-12436228
  Hypo

SEQ ID NO: 104313 - DNA, 30 bp, Homo sapiens; identical to SEQ ID NO: 70519
  chr10:12464455-12464485
  Hypo

SEQ ID NO: 104314 - DNA, 119 bp, Homo sapiens; identical to SEQ ID NO: 70521
  chr10:12481458-12481577
  Hypo

SEQ ID NO: 104315 - DNA, 189 bp, Homo sapiens; identical to SEQ ID NO: 70552
  chr10:12531976-12532165
  Hypo

SEQ ID NO: 104316 - DNA, 29 bp, Homo sapiens
  chr10:12554507-12554536
  Hypo
cctcagcagctgcccgttgggagactcgg

SEQ ID NO: 104317 - DNA, 44 bp, Homo sapiens; identical to SEQ ID NO: 70589
  chr10:12685417-12685461
  Hypo

SEQ ID NO: 104318 - DNA, 38 bp, Homo sapiens; identical to SEQ ID NO: 70606
  chr10:12828013-12828051
  Hypo

SEQ ID NO: 104319 - DNA, 30 bp, Homo sapiens; identical to SEQ ID NO: 42522
  chr10:12844882-12844912
  Hypo

SEQ ID NO: 104320 - DNA, 30 bp, Homo sapiens; identical to SEQ ID NO: 70609
  chr10:12872726-12872756
  Hypo

SEQ ID NO: 104321 - DNA, 30 bp, Homo sapiens; identical to SEQ ID NO: 70610
  chr10:12876451-12876481
  Hypo

SEQ ID NO: 104322 - DNA, 76 bp, Homo sapiens; identical to SEQ ID NO: 70640
  chr10:13027839-13027915
  Hypo

SEQ ID NO: 104323 - DNA, 781 bp, Homo sapiens
  chr10:13043120-13043901
  Hyper
cctggctctaggtaacggcgacctcgggaggtggcgcagagagagagagaggtggcggcggcgccgccgggctcacctgaggaagaagaaataggagtagtcctggaccacggtgtgggagtggcacgagaagtagcccaggccggtgaggttgagcctggagccggcgggcacctccagcatgctgccccacgcctggtcgcacagcatctcgacctcggccgagtagaagaggcccccctggccggcgtggtactgccagggcaggtggttgtagaggccgggcgcctcggggtgcagcgccagcaccctggcgtacacgatggtctcggccagctcggcgcggcagccctcgctcaggggcctccactcggagggcagctggcaggcgcgcgcgggcgctgggggacccgccaggcagagcgcggcgagcagcagctggcgcagcatgccgggccctcccggggcgcacggggcggcggcggggagcccggggagcccgccggcccgggaagggcagccctgggcgctcggctgctcgggccgctcccgggagctgagcgcaccgctgtctccgccacggggctcggcatgcccggccctggcgcgccacgctttaaaagggtcccggggactggacgcgccgggcgcccgcctcccgccctgccccctgcggctggggcgtgggcgggggaggggcggggagtcgggcgggtcccggcgccggctggggcggggaccagggactcggagaacgcggggacgccgggacccagccctg

SEQ ID NO: 104324 - DNA, 203 bp, Homo sapiens; identical to SEQ ID NO: 70655
  chr10:13081775-13081978
  Hypo

SEQ ID NO: 104325 - DNA, 23 bp, Homo sapiens
  chr10:13130732-13130755
  Hypo
tgaatattagctgggcgcagtgg

SEQ ID NO: 104326 - DNA, 75 bp, Homo sapiens; identical to SEQ ID NO: 70673
  chr10:13137668-13137743
  Hypo

SEQ ID NO: 104327 - DNA, 155 bp, Homo sapiens; identical to SEQ ID NO: 70675
  chr10:13140531-13140686
  Hypo

SEQ ID NO: 104328 - DNA, 34 bp, Homo sapiens; identical to SEQ ID NO: 70676
  chr10:13140986-13141020
  Hypo

SEQ ID NO: 104329 - DNA, 30 bp, Homo sapiens; identical to SEQ ID NO: 70722
  chr10:13276800-13276830
  Hypo

SEQ ID NO: 104330 - DNA, 17 bp, Homo sapiens
  chr10:13345114-13345131
  Hypo
tttttttttttgagacg

SEQ ID NO: 104331 - DNA, 222 bp, Homo sapiens; identical to SEQ ID NO: 70745
  chr10:13355033-13355255
  Hypo

SEQ ID NO: 104332 - DNA, 29 bp, Homo sapiens
  chr10:13404822-13404851
  Hypo
gaaaagatctcaaaccggccgggcgcggt

SEQ ID NO: 104333 - DNA, 149 bp, Homo sapiens; identical to SEQ ID NO: 70792
  chr10:13405091-13405240
  Hypo

SEQ ID NO: 104334 - DNA, 24 bp, Homo sapiens
  chr10:13426145-13426169
  Hypo
cgcgcccagcggagtatggtagac

SEQ ID NO: 104335 - DNA, 80 bp, Homo sapiens; identical to SEQ ID NO: 70992
  chr10:13571373-13571453
  Hyper

SEQ ID NO: 104336 - DNA, 30 bp, Homo sapiens; identical to SEQ ID NO: 70994
  chr10:13706037-13706067
  Hypo

SEQ ID NO: 104337 - DNA, 40 bp, Homo sapiens; identical to SEQ ID NO: 70995
  chr10:13715561-13715601
  Hypo

SEQ ID NO: 104338 - DNA, 30 bp, Homo sapiens; identical to SEQ ID NO: 70996
  chr10:13725649-13725679
  Hypo

SEQ ID NO: 104339 - DNA, 149 bp, Homo sapiens; identical to SEQ ID NO: 42529
  chr10:13751257-13751406
  Hypo

SEQ ID NO: 104340 - DNA, 41 bp, Homo sapiens; identical to SEQ ID NO: 70998
  chr10:13771406-13771447
  Hypo

SEQ ID NO: 104341 - DNA, 30 bp, Homo sapiens; identical to SEQ ID NO: 71000
  chr10:13854970-13855000
  Hypo

SEQ ID NO: 104342 - DNA, 161 bp, Homo sapiens; identical to SEQ ID NO: 42530
  chr10:13898478-13898639
  Hypo

SEQ ID NO: 104343 - DNA, 975 bp, Homo sapiens
  chr10:13933436-13934411
  Hyper
acagtatgtgccccacgtgggatttgcatttaaaaactgtaacatacgcgaaataaacgactccaggcccccagtaaagaagcagcggcgcgtcccttttccccggcccagcgtgaaaacacggaaggcgaagggctgccgtcagtcgcctccctgccaccgcgaccgggaaacaaagacacattaccttttattttttgcgcttccaagggatccgaggaacttctggctgcaagcggctggtaccccggaacgggcgtcccattcgcccgggcgaaggcccttggcctactaggcggccttggcgcccgcagctggcgagcccccgccccgtccccgccgccgcccccgccgcgggccctcggcgtcagcccatagcccgctcgcgcctctcgcgccgagcctggcccggcgccagtgagccccgccgccggcccgcccctcgcccgcgcccggcccgccgcatggtgcgcccagcgcgccccgagccagtccccggcgcgctgctaggtcgggtgctaggcggccaccgcgcgccaccgccgccgccaccgcccgccgcccgatcctggacaacaatgcgcgcccccgcccccccagaaagccagggacgcccccagtcgccgccagagctggctcggcttcccagcccctctccgtggcacccgcaggcgagacaaagttcgctcccggtgaggctgcgcgcgtccaaagcgtgcgggatgcccagcacggaggtccccaagcgggggacccctggctcccccacaaaacccacccaaagccaccgctcgaggccctctcctaccctgagagcccggagacagcagctcccttggctgaaggcacagctcttacccctcgatctagtccaattgtattgaattttaatctcccctcaactcttcaatggaagttgctgcaggataaccgaggcatgtggctattgtcaaggcttcgcgacaatgactggga

SEQ ID NO: 104344 - DNA, 45 bp, Homo sapiens; identical to SEQ ID NO: 71007
  chr10:14000240-14000285
  Hypo

SEQ ID NO: 104345 - DNA, 23 bp, Homo sapiens
  chr10:14166365-14166388
  Hypo
aaactgaagctcagacgaattta

SEQ ID NO: 104346 - DNA, 242 bp, Homo sapiens; identical to SEQ ID NO: 71012
  chr10:14215671-14215913
  Hyper

SEQ ID NO: 104347 - DNA, 106 bp, Homo sapiens; identical to SEQ ID NO: 32899
  chr10:14216190-14216296
  Hyper

SEQ ID NO: 104348 - DNA, 124 bp, Homo sapiens; identical to SEQ ID NO: 71017
  chr10:14966088-14966212
  Hypo

SEQ ID NO: 104349 - DNA, 41 bp, Homo sapiens; identical to SEQ ID NO: 71018
  chr10:14996911-14996952
  Hypo

SEQ ID NO: 104350 - DNA, 101 bp, Homo sapiens; identical to SEQ ID NO: 71019
  chr10:14997192-14997293
  Hypo

SEQ ID NO: 104351 - DNA, 24 bp, Homo sapiens
  chr10:15000601-15000625
  Hypo
aacatgtaaattggccgggcgcgg

SEQ ID NO: 104352 - DNA, 120 bp, Homo sapiens; identical to SEQ ID NO: 71021
  chr10:15003045-15003165
  Hypo

SEQ ID NO: 104353 - DNA, 141 bp, Homo sapiens; identical to SEQ ID NO: 71022
  chr10:15003225-15003366
  Hypo

SEQ ID NO: 104354 - DNA, 30 bp, Homo sapiens; identical to SEQ ID NO: 71023
  chr10:15009037-15009067
  Hypo

SEQ ID NO: 104355 - DNA, 19 bp, Homo sapiens
  chr10:15026279-15026298
  Hypo
tttccgaggagatttcgtc

SEQ ID NO: 104356 - DNA, 23 bp, Homo sapiens
  chr10:15131223-15131246
  Hypo
taaatatgtattggccgggcgcg

SEQ ID NO: 104357 - DNA, 120 bp, Homo sapiens; identical to SEQ ID NO: 71027
  chr10:15140508-15140628
  Hypo

SEQ ID NO: 104358 - DNA, 24 bp, Homo sapiens
  chr10:15140868-15140892
  Hypo
atgagactccgtctcaaaaaaaaa

SEQ ID NO: 104359 - DNA, 30 bp, Homo sapiens; identical to SEQ ID NO: 71029
  chr10:15255450-15255480
  Hypo

SEQ ID NO: 104360 - DNA, 30 bp, Homo sapiens; identical to SEQ ID NO: 42535
  chr10:15255872-15255902
  Hypo

SEQ ID NO: 104361 - DNA, 51 bp, Homo sapiens; identical to SEQ ID NO: 71031
  chr10:15412536-15412587
  Hyper

SEQ ID NO: 104362 - DNA, 30 bp, Homo sapiens; identical to SEQ ID NO: 42536
  chr10:15484112-15484142
  Hypo

SEQ ID NO: 104363 - DNA, 82 bp, Homo sapiens; identical to SEQ ID NO: 71033
  chr10:15536670-15536752
  Hypo

SEQ ID NO: 104364 - DNA, 29 bp, Homo sapiens
  chr10:15568455-15568484
  Hypo
tgagccaccgcacccggcccattataaga

SEQ ID NO: 104365 - DNA, 1187 bp, Homo sapiens
  chr10:15760927-15762114
  Hyper
tgggcgccacaaaaccgtgcgcatgcaatgcagtctctgtaacctcctgcccggggacactggggcaggcgtggagggcatgaacgtatttatgatgaggaccgactgtcaaacttgatttcctcttggaaacgggggtccgcaacctggtttgcaagaatgcaaacggtcctgcttctctaggtggagctctgtgggtacagtgagatgagagaagggggtggggtaggaggaagccaaggacagagcccagctgctggtagccgacagctcttgcgcccagacgcaatggttacagactctgcataaacagacctcgctgtggtggcggttttaactggcttgggtcttctgggtcctgttctctcctttgtaggatgcgtgcgtcttggtacctggaacacccaggacttgcgtgttctatgcaagtggcatgtctctagctcaaaattcacaaggcacatctagcatggcaggggagagaaggggctggtggcggggagagggacgggaccccgggcaggcggcaggacggggatcccaggctgcggggggactccgcggcagagccgctgggacctgacccgggagcgccttcgtccccgcgcgcacctccccgggtcgggcgacttacgtgcgggcgtcgggtatgtggaagtccacggcgtagccgaagtagctgcccttggggccgctgtacactgtgagcttttccacgtccaggttgaacgcctgacaggcgggggaccacagcaacatccccagcgcggccgcggcgcagcagaggggcgcgatcagcggcgcctggcttccccggggaccgcggctggccccgggcgacatctccctccgccccggtgggtggctgctacccaggagcgcgagccgaggacccctgcggggcaaggggggctggtggaatctggcggtccccagctgcccgtgtcccgggtcggtgcgctcggcgcacccgtggtgacagtgcccggcgtctgctcccacccgcccgcccgcccagccggctcggggggctggcccaggggctctagccctcctccggccgcgggcagggaccagctctctcgcggcgcctcctcgcggctggtctagagccagggactcccgggcggcccagctggtggctggagcgctgggtgcctcttcgggctgcccggatttctattgca

SEQ ID NO: 104366 - DNA, 30 bp, Homo sapiens; identical to SEQ ID NO: 71039
  chr10:15762409-15762439
  Hyper

SEQ ID NO: 104367 - DNA, 31 bp, Homo sapiens; identical to SEQ ID NO: 71040
  chr10:15783191-15783222
  Hypo

SEQ ID NO: 104368 - DNA, 28 bp, Homo sapiens
  chr10:15932007-15932035
  Hypo
ctgtgaaatcacacgatgccaagcatta

SEQ ID NO: 104369 - DNA, 194 bp, Homo sapiens; identical to SEQ ID NO: 71043
  chr10:16086369-16086563
  Hypo

SEQ ID NO: 104370 - DNA, 30 bp, Homo sapiens; identical to SEQ ID NO: 71045
  chr10:16468573-16468603
  Hypo

SEQ ID NO: 104371 - DNA, 1994 bp, Homo sapiens
  chr10:16562050-16564044
  Hyper
ctgccacgcccattccggactcccccaggcctctccactccccagaaagcccgtaagctaccctctgttgcggaggatcccacggccaggggtcgcttcccgcgccgggactccccagcgcacgagctgtccccgggacccagctcccggcttcccgcccctcgagggtcgcgctcgcaggggcgcgcaccgatcgagggtcccagactccggaactgccctctccaggccgcggggcgccctcctgcgcgcacgacccccgcctctccagggtgggacggcgtccccccttgccgtcgctccagggagcccggccgccgcgcccttcctccgcgggctcccacccccatttccggggtctcctccctctcgcccgcaccttcccgcgctccctccccgccctccccgccgcccgcccgcgctcacctggttgtttttgcagagatcagcccacatgctggtgccgtcccctccgcgcatcaggacgtggtaggtgaagaagtagatgcccgggatggagcaggtgaacttgccggtggtggggtcgtagtggtttccgaggttggtgaccacgtcgtcgaacttgagcacctcgtagccttcatgctgccgcttgaggccggcgtagaaggcgatcttgggcaccgtgctgtaggtggcggcgctgatggccccggccgcgttcaggccgggcgccccgggcgggcccggcaggccttggcggcccggctcgcccttctcgcccgggggccccatggggccgggtggcccgggctctccggggggcccgcgcggacccgccttcccgggcctgccggcctcgcctttggggccctggatgaaggtgggcagggactgcatgaggccgcggtcgggcgtggcagcggtgctgggcgccttggtgcccccgtaggggtcgcagaccatgcggcaggtgcccagcatctcgtagtgcgccgacgtgccggccgagctcaccagcaccgggatgaggatcaccagcagcagcaccatcaccacccccagcgccccggcggcgatcaggcgcctcctgctgcccaccagccggctcagcgcggggcgatcctcttgtctgcttttggacagaattttgaaggttgggcggggacctcttcagagccgaaaacaaccccctgcgaaccccaactcccctgggcgtgcgtgcgccggccgctgctgccgactcctgctccccccgcggaggctgcggctggggagggagcgcgggcgcccagtgacttgagccgaagtcccgagcccggggtgggggccgggggaggggtgcgcggggcgccctcgccccccgcgagctccttcgcacctgtggctgcagccggcgccggcgcggccaccgggagggcagagccagccgccgcctcctgagctcgcccgggcagctcacacttttatgccgccgccgcctgcgatcgacttttccgtttttgcagactgcgcctgttcgcaccaactttccgtctgaagttgcctttttctgcctcctcctcctcttctttcgctcgctcagttcgcccgtccgctgccttttttttttattgcctcctttctctcttcctcctttgccaccaccacaactcgaatagacgcgcaccccaaagccccgcgtgggcccgggcgtcccccgggtgcgcccagcggcggcggcggcgggcacggtcggcacggcgaggctcagagctggggcggaggagcgagcgagcagcggcgagcgcctcacggccgggagcggagcgagagagagactgaaggcagaattctgcctgggtaccacctgccaggagaagaggaggctgacaaacgcgcgccggagcaatttataggcacccaaggcacagaggaaggggagccgctttggcatctcattgcagcatctgctctgctcatcccactcagagagagtttggcattactctgacaatgtgggatttttttttttttttcggcctctctttttt

SEQ ID NO: 104372 - DNA, 30 bp, Homo sapiens; identical to SEQ ID NO: 42540
  chr10:16714330-16714360
  Hypo

SEQ ID NO: 104373 - DNA, 49 bp, Homo sapiens; identical to SEQ ID NO: 71052
  chr10:16715583-16715632
  Hypo

SEQ ID NO: 104374 - DNA, 96 bp, Homo sapiens; identical to SEQ ID NO: 71053
  chr10:16928712-16928808
  Hypo

SEQ ID NO: 104375 - DNA, 30 bp, Homo sapiens; identical to SEQ ID NO: 71054
  chr10:17050934-17050964
  Hypo

SEQ ID NO: 104376 - DNA, 78 bp, Homo sapiens; identical to SEQ ID NO: 71055
  chr10:17079889-17079967
  Hypo

SEQ ID NO: 104377 - DNA, 211 bp, Homo sapiens
  chr10:17270234-17270445
  Hyper
gatctgggaggcccacgtatggcgcctctccaaaggctgcagaagtttcttgctaacaaaaagtccgcacattcgagcaaagacaggctttagcgagttattaaaaacttaggggcgctcttgtcccccacagggcccgaccgcacacagcaaggcgatggcccagctgtaagttggtagcactgagaactagcagcgcgcgcggagcccg

SEQ ID NO: 104378 - DNA, 1580 bp, Homo sapiens
  chr10:17270653-17272233
  Hyper
cccccaacatctctccgccaaggcaagtcgatggacagaggcgcgggccggagcagcccccctttccaagcgggcggcgcgcgaggctgcggcgaggcctgagccctgcgttcctgcgctgtgcgcgcccccaccccgcgttccaatctcaggcgctctttgtttctttctccgcgacttcagatctgagggattccttactctttcctcttcccgctcctttgcccgcgggtctccccgcctgaccgcagccccgagaccgccgcgcacctcctcccacgcccctttggcgtggtgccaccggacccctctggttcagtcccaggcggacccccccctcaccgcgcgaccccgcctttttcagcaccccagggtgagcccagctcagactatcatccggaaagcccccaaaagtcccagcccagcgctgaagtaacgggaccatgcccagtcccaggccccggagcaggaaggctcgagggcgcccccaccccacccgcccaccctccccgcttctcgctaggtccctattggctggcgcgctccgcggctgggatggcagtgggaggggaccctctttcctaacggggttataaaaacagcgccctcggcggggtccagtcctctgccactctcgctccgaggtccccgcgccagagacgcagccgcgctcccaccacccacacccaccgcgccctcgttcgcctcttctccgggagccagtccgcgccaccgccgccgcccaggccatcgccaccctccgcagccatgtccaccaggtccgtgtcctcgtcctcctaccgcaggatgttcggcggcccgggcaccgcgagccggccgagctccagccggagctacgtgactacgtccacccgcacctacagcctgggcagcgcgctgcgccccagcaccagccgcagcctctacgcctcgtccccgggcggcgtgtatgccacgcgctcctctgccgtgcgcctgcggagcagcgtgcccggggtgcggctcctgcaggactcggtggacttctcgctggccgacgccatcaacaccgagttcaagaacacccgcaccaacgagaaggtggagctgcaggagctgaatgaccgcttcgccaactacatcgacaaggtgcgcttcctggagcagcagaataagatcctgctggccgagctcgagcagctcaagggccaaggcaagtcgcgcctgggggacctctacgaggaggagatgcgggagctgcgccggcaggtggaccagctaaccaacgacaaagcccgcgtcgaggtggagcgcgacaacctggccgaggacatcatgcgcctccgggagaagtaaggctgcgcccatgcaagtagctgggcctcgggagggggctggagggagaggggaacgcccccccggcccccgcgagagctgccacgcccttggggatgtggccggggggaggcctgccagggagacagcggagagcggggctgtggctgtggtggcgcagccccgcccagaacccagaccttgcagttcgcatttcctcctctgtccccacacattgcccaaggacgctccgtttcaagttacag

SEQ ID NO: 104379 - DNA, 29 bp, Homo sapiens
  chr10:17272601-17272630
  Hyper
cctggcggtttcctcgttcccctttggtt

SEQ ID NO: 104380 - DNA, 38 bp, Homo sapiens; identical to SEQ ID NO: 71064
  chr10:17347136-17347174
  Hypo

SEQ ID NO: 104381 - DNA, 96 bp, Homo sapiens; identical to SEQ ID NO: 15356
  chr10:17429165-17429261
  Hypo

SEQ ID NO: 104382 - DNA, 96 bp, Homo sapiens; identical to SEQ ID NO: 15357
  chr10:17429561-17429657
  Hypo

SEQ ID NO: 104383 - DNA, 288 bp, Homo sapiens
  chr10:17495392-17495680
  Hyper
gcccccccccaaccccgcgccctcttcaaacacacgcacactcttacactcactcgcgccgtcccagcctgcctactcccaacgagtccaagccggtgcagccgcgccccatgcccggctcgcagctcccgagccccagtccgcccgcgctgggcgccgctgtacctgttagtggcgcgcggtaccgcggtcgccgggctccggagcgtcctcagcgctgcgggggtgccgtgggtggcctccctgctttcctccaccagaatcctgcacagccggggagaaaactta

SEQ ID NO: 104384 - DNA, 842 bp, Homo sapiens
  chr10:17496002-17496844
  Hyper
actccactctcaggccgtcgccgcccgtgggctgctccccgccgcggccaaaagtctccgcgcccgaggggaagcgatgggcggcttgggggtccgggggcgccaggcggggcgcgcggcgcggggcgcggccggcgggtgggtgggttacctggcgcggccgggcgcgtctgccgggcaccagagcaggcgcagcagcagcagcagcagcaggctggcgagcagggcgagcagtgcgccccccggccgcatcctgagccacaggcgccgccgccaccgctgctgccggggcgaagcacagcccgggcggccccgactcgcggctcccgccgccgccgccaccgccgccgtggccgcagccccgcgcacccacagcgttcacaggcggcagcgaggggcgcccgcagcccacccggcagagtctccgcggcgggcggagaagaagccgcgttcgggctcgccccgggctcccggccccggcccgcggagcgccgcgatcggctggcagatgacgattcgccgagctcgccgcctgtcctcccggaggcgctcggagctgctgcgggctccggtcgccgctgccactgctgctgccgccgccgccgcgcggggtcacctgaaggttggggcgcggaagctcaactccgtgctgattgggctccaagttttctgcgccctcgcctcgtcccgagtgcccgcgaatcccccggacgcccacgcagaccacccagccacaccacaactctgcctgcggagagaggagaggagaaaaaggggccgcttcaaaaactttcaaaactgtgcagtcgcttggctggatcctcccacgcatgaagaaagct

SEQ ID NO: 104385 - DNA, 43 bp, Homo sapiens; identical to SEQ ID NO: 71071
  chr10:17505922-17505965
  Hypo

SEQ ID NO: 104386 - DNA, 18 bp, Homo sapiens
  chr10:17531563-17531581
  Hypo
gagagaagtcttggccgg

SEQ ID NO: 104387 - DNA, 95 bp, Homo sapiens; identical to SEQ ID NO: 42544
  chr10:17579985-17580080
  Hypo

SEQ ID NO: 104388 - DNA, 183 bp, Homo sapiens; identical to SEQ ID NO: 71080
  chr10:18349201-18349384
  Hypo

SEQ ID NO: 104389 - DNA, 38 bp, Homo sapiens; identical to SEQ ID NO: 71081
  chr10:18363159-18363197
  Hypo

SEQ ID NO: 104390 - DNA, 30 bp, Homo sapiens; identical to SEQ ID NO: 71082
  chr10:18393639-18393669
  Hypo

SEQ ID NO: 104391 - DNA, 1066 bp, Homo sapiens
  chr10:18429181-18430247
  Hyper
gcgcagcggctgagtcggagcccacgcggcgcgcgcctcccgcgaggaacttttcggcttgtaggctgcttgtcactctcgctttccgacgcgcctccccctggctcgcgctcccggagttccctcccctcctggcgaggacctttcccggcgcccgcggctccgatccccgccgcgctgcgcccgctctcccggccccggctgccccgctgagggctcccctctcccaggcaccgcagccgcgcccccgcgtcccgcctcccgagcggctcgcttcgcccgatgccccggccccgtcccgcgcactgagcgcctggcagcagggcgccgagtcccggggcgctgcggggcgctgcgccgagaacggccgggcctgagccctgggcggcccccagagccgatcagagcgcggggaggcgggggcgaggaggaggggacccgccgccgggggctggctgcttcgctccgagccgacttttcgccaatggtccaaagggacatgtccaagtcgcctcccacagcggcggcggcggtggcgcaggagatccagatggaactgctagagaacgtggctcccgcgggggcgctcggagccgccgcacaggtagcgagagcgcggcgccttctccttcctttgtgagccgccgggcagggcaccgacctcgggttctcccggcgcctccactgcagggatctctagcctcgcacctcctcccctcgtcgcctgcccaccctctgctcctctcctggcgccggggaccctgcccctttgcgccttttcctggctctgcctcggcttccatttttctctgcttccgaaaagccagtggggaagggcgggggagacctgccagtcctcccagacttctcccgggttgctccagctggccctcctcgccccttcccgggagaggcacatggagagacatgaatcaggggagtggactggacctgctgaagatcgtgagtccgggtgggcgggagggggcccgcttcccgcagcgctttctacgatgccgactctcctggccacgctccgagccggggtgggcgtgggtgtgaggat

SEQ ID NO: 104392 - DNA, 122 bp, Homo sapiens; identical to SEQ ID NO: 71087
  chr10:18672520-18672642
  Hypo

SEQ ID NO: 104393 - DNA, 30 bp, Homo sapiens; identical to SEQ ID NO: 71089
  chr10:18950336-18950366
  Hypo

SEQ ID NO: 104394 - DNA, 39 bp, Homo sapiens; identical to SEQ ID NO: 71090
  chr10:18979783-18979822
  Hypo

SEQ ID NO: 104395 - DNA, 30 bp, Homo sapiens; identical to SEQ ID NO: 71092
  chr10:19907854-19907884
  Hypo

SEQ ID NO: 104396 - DNA, 76 bp, Homo sapiens; identical to SEQ ID NO: 71094
  chr10:20056020-20056096
  Hypo

SEQ ID NO: 104397 - DNA, 152 bp, Homo sapiens; identical to SEQ ID NO: 71096
  chr10:20069005-20069157
  Hypo

SEQ ID NO: 104398 - DNA, 54 bp, Homo sapiens; identical to SEQ ID NO: 71097
  chr10:20104308-20104362
  Hyper

SEQ ID NO: 104399 - DNA, 237 bp, Homo sapiens; identical to SEQ ID NO: 71098
  chr10:20105418-20105655
  Hyper

SEQ ID NO: 104400 - DNA, 243 bp, Homo sapiens; identical to SEQ ID NO: 71099
  chr10:20106451-20106694
  Hyper

SEQ ID NO: 104401 - DNA, 32 bp, Homo sapiens; identical to SEQ ID NO: 71100
  chr10:20106927-20106959
  Hyper

SEQ ID NO: 104402 - DNA, 30 bp, Homo sapiens; identical to SEQ ID NO: 71101
  chr10:20754862-20754892
  Hypo

SEQ ID NO: 104403 - DNA, 336 bp, Homo sapiens; identical to SEQ ID NO: 71103
  chr10:21461963-21462299
  Hyper

SEQ ID NO: 104404 - DNA, 53 bp, Homo sapiens; identical to SEQ ID NO: 71104
  chr10:21462618-21462671
  Hyper

SEQ ID NO: 104405 - DNA, 60 bp, Homo sapiens; identical to SEQ ID NO: 71105
  chr10:21463573-21463633
  Hyper

SEQ ID NO: 104406 - DNA, 359 bp, Homo sapiens
  chr10:21783399-21783758
  Hyper
gaaagcaatcgtgagcgcggatcagtttctgtctttcccagaaagcgggctttttattgaggggaaacttagctgggaaaagtcagctcgtacgtttgttttggtttttcgtctatttgcttcccaatttaaaagtggccgcctaggcgacaggcctgcggttttcacagtgtaaaacggatcagagggaaagctccagcccctctcgactttcgcttgcggtttgcaacccctggggtgggtctgaccccgcgcggcacttgcccaggcgagcttccctcgtcgcggcccgacccgcgcgcggactcggcttccccaggtcaggacccactaggtgggccgctcggccccaagcctgg

SEQ ID NO: 104407 - DNA, 67 bp, Homo sapiens; identical to SEQ ID NO: 71107
  chr10:21784179-21784246
  Hyper

SEQ ID NO: 104408 - DNA, 97 bp, Homo sapiens; identical to SEQ ID NO: 71108
  chr10:21789041-21789138
  Hyper

SEQ ID NO: 104409 - DNA, 269 bp, Homo sapiens; identical to SEQ ID NO: 71109
  chr10:21805094-21805363
  Hyper

SEQ ID NO: 104410 - DNA, 124 bp, Homo sapiens; identical to SEQ ID NO: 71110
  chr10:21810083-21810207
  Hypo

SEQ ID NO: 104411 - DNA, 137 bp, Homo sapiens; identical to SEQ ID NO: 42546
  chr10:22033212-22033349
  Hypo

SEQ ID NO: 104412 - DNA, 30 bp, Homo sapiens; identical to SEQ ID NO: 71112
  chr10:22040753-22040783
  Hypo

SEQ ID NO: 104413 - DNA, 40 bp, Homo sapiens; identical to SEQ ID NO: 71113
  chr10:22047461-22047501
  Hypo

SEQ ID NO: 104414 - DNA, 41 bp, Homo sapiens; identical to SEQ ID NO: 42547
  chr10:22450029-22450070
  Hypo

SEQ ID NO: 104415 - DNA, 97 bp, Homo sapiens; identical to SEQ ID NO: 71115
  chr10:22465341-22465438
  Hypo

SEQ ID NO: 104416 - DNA, 439 bp, Homo sapiens; identical to SEQ ID NO: 71116
  chr10:22518011-22518450
  Hyper

SEQ ID NO: 104417 - DNA, 18 bp, Homo sapiens
  chr10:22518510-22518528
  Hyper
cttcggtgtcattttccc

SEQ ID NO: 104418 - DNA, 1871 bp, Homo sapiens
  chr10:22540725-22542596
  Hyper
gagcctcctcctgggcgggcgacgctcggctgatgggaccgggccgcgcaagcctcggatgcagccgggtggggggcaccaggcgctaggcgaaggagcgcaggaccaaaggagatgcttggctcctaagataacacctttaaaaagaagaagaagaaagaaagaaaaacaaacaaacaaactcgatacttagcctcacgatccttgccaccccctccctgctccgccacccacacacaaaataaagtgagccgggcgggggagtgcgcgccctgaaagggaacaagaagcaaggcgcctgtgacacaaaatggagaaagaggaaccgggagtggaaaggaagaaggaaaaccgagtaaaggaggttattcataagaacaggaaaggggccgaggggtagagaacacccgaaggaaagcgcaggaggccctcgtgagagggcaagggggaaaagatcgacgaagtaagagcgaaaagaggaaaggaaagaaagactttctagatgcggagtctccattttcagcagcgccatattcgcttttcctctcgccgcttttggctgggttttgtgtgcggcggtggacaggcgccagcacatttctgcagcttcagcagctctgctcagacacctggggagggccgcagggcccgggcgggggacgcgcgctcttggcccaggcccgggcgcggccccctccccggcctggcggttcctgcgcagcgccagccccgcgctcctctaggctgcaaagggggcctccgactcgggcccggcccggaggggacacctcactcggggccccgcggcagcccccaggggacgcgggccctctagtttcgcccacggtgtggctgggcatgcgtgccaaggggatgcgtaaccgagaaccgaaaaagacgaacttaaccttcggggaggaggagagggcgcacgctgcgggtaccggggcttgggggcgctcctggaggtgacggggtcacctccacctgcgcggggccactctctgggagccggcgatcgatgcccgccgcggcgcctggcccaggcccccaggcctctcgcggctcccggaaaaacgtccgaggtcggggctcggccgggagccccaagcgggtcccctggcctcgggacgccagtccgggaggcggccggaactccggttttcgcggttctcagcgatattaggcgcggccagtgtctgaaagctcctcggggttacgtcctggggcgactggaggcggctcacgactcagaaagtcggggcttctcgccccggatccccaccgctggcgtctgtcgaatccccacctcggtcctcgggtagaggcgcaagcgcgccccaagaccattctcttcgcgcccacccccgttattcttcactttcacttgacatcgttcttcactcaaggttaggtcctcgctagtgccagagaagcccctgggtccccagtgccctcagccccgcagcgtagggagcagccggcccgggagataaggaggccacagccatggaggccccaggcccggagtccccgcgccgtcgggttttgagccgcgcggctggccaggaccgccggctccttctctgtcccggtcctccgctcgcagccccgcagaggtgacggtacctggaggctggaagcgacggtttcctcgggccggtggagggaaacatgtcagggtcacagcgaaggaaaccgagacccacaggggtccccgggcgtccgggacgcgtcgctggttttgctcctagaaggaaaggccttcccgcttttgttccaccggctcaccaggtcctcccttcctggccaactctaacctcagctttgtgcgtgtcacccggccccgggataatcggatcctcccagac

SEQ ID NO: 104419 - DNA, 25 bp, Homo sapiens
  chr10:22566939-22566964
  Hypo
tagcatggttgttaacggtggaggg

SEQ ID NO: 104420 - DNA, 84 bp, Homo sapiens; identical to SEQ ID NO: 71122
  chr10:22567324-22567408
  Hypo

SEQ ID NO: 104421 - DNA, 2081 bp, Homo sapiens
  chr10:22624022-22626103
  Hyper
gaggaggggtggctgcgcggcgggaatctcaagatctgggcaaaggctcgcgtctcgggacgcgaagtcgacgccaaaatgggtccccggacaaggcgaccctgggagtgccggcgcccccggccgggcagaggagcgggtgggccgaggctgggacatcgcctccgaaagctgccgggacgcggcggcttcctgcagagcctgcgcctgccggatccccagaacacagaagcttctcggacatgggagctccccgtgcgccctaaaaccaggagaggaagggacgacttgggaaaagggactggggaaacagcggagaagtgaaagcggcctaaaatgggcgacggcgggcgagtcctctttatcagtgcagcaggctgccggagccgccatttggtggcggatctcggtagttcagtagcacgttgtgctgaacgtcacaactggcttgtctacgtggcatcgtcatttcttaaccgcggttttacgaaatgcaaatttccccctggccttcctcctccgcggccgtcgacccccctcggcgctccgggtggacggctccggggcgcggctcgtccctcgggtggtgcagcccccgcggcccgagacccggggagggccgggggtactttctgcgaggcgccttccccgcggcttctgcccgcgccaaagcctggtggaatccagcgcagacctaaagcacgcttgacaccccgatttttcgagactaggacgactctctgagccagcagctttcctctccctctcggggagaatctcatttccttggggtggtgagggtgacgggcactgtcttttggccccgcgtgtccgttccccggtctcccgcctcacccctctgcgaggtgaggaggggaaacggcgagcttaggcctggcgggaaggagcctacccgacgagagggctccgcggggagggtcggttggaatcccgccctagcgcctcctgctctgcccggtccccaccggggacggggaatgccagtcatttctgttgagtgctagcagggccggtgtcaccacctcgggtggccgaggcttcgaggttttcatgaaaagcccccgaagcgtgaggcgcccgcccagtggagaacaaagggccgagggccgaaggcgaggcgaggcagcgcgcgcggctcccttggctcgacctagctgggagtcgggggcgcgggcagggctcactcccggcctagaaactggagcccgccacccccgccccgcaggcgaccgcagggatcccattcttggagcccgagctgccatgttgccttcgcggaggccgccagtcacttgacgcttccgagacagcgaagcccccaacctgagagcccttcggccgtctttgccgcacagctgcagtcaaggcccggagggactgcgggacgcgggcgggagcgagagccctgtgggctgccaagccggcgcggccgcgccgcggcagccgcttcccttgccaccttcgttccaggggctgcggggctgcgcgctcggcagaggctcggttgccagtagcaaccacacgacggcgatttgcagccagggccgccgccgcagccgctggtacctctgcctcctcctacacctcgggctcgagcatttgaaaccctgggggttgccttcggtgacatctcccgcccccacctccagtcctcagtctccaaaatcctcagctctgctcaaaagccagcgcccccggctgggccctgcccccaccgcagacaataggagcggctgggagcgcacagggcggcgcgcgccgcgagcagcgggcacctgagcccccaaatccgggcgcgtcgctgagtctcagccccaggtgccctcttcgcggagttgatcagcaattctttttcagtggccaattagaaagcttttcttgacatcagaaataagggtggtgccaaagaaagaagtcaaacgcccactccctttctaataacatcgacacaaagaagagctcatggttgcgtctgcgcttggtaacagtggctttcctctgggttagagccacaggcacaagcacccgctgctatctttcttcttcgcctaccatgaata

SEQ ID NO: 104422 - DNA, 791 bp, Homo sapiens
  chr10:22633985-22634776
  Hyper
cattcatgtgttgatcggattgtacaatgtgacgtgtgagatttctcgggaccgtcgaagctcagacaactccagggctgcaatttactcgtctggctgccctcgaaccaggctcccttggcgcgtggggctctcccggcgcttggtcccgacccgcgccgcagtcaggataccacggcaatctggggtcgctttgtaaggagctccgacctccgggcagtgcagggatactcgacggcgcgcgatgtcccggcggctccgcgagcctggcgcgctgagagccccagcagtccgagtcctcgagctcgggcgtcttcgcgccgccgccccgctcagtgcgcccaggcaccgcggccgtgacgtcacgcccgggactggccgttgcagcaagacggccgcgttccggttccggtaggttgcccgggagacgcgggtacacagagaagcggctcccgtcggaggccgagtcgtcgccacgatcgcccccttggtggactcgcaggccgagcggcttccccgcagagctcgaggagggcagacggcggcgggggcgccatgagtcagaggcaggtgctgcaaggtagggccgaggcgggcaggtgccctaactagctggcgccgaggagacccgggtgcggtgggctccaccgactctctctcccgcagtgttcgagcaataccagaaggccaggacccagttcgtgcagatggtggcggagctggcgactagaccccaaaacatcgagacgctgcagaacgcgggtgagcccggagcccgaacccccgtcgcc

SEQ ID NO: 104423 - DNA, 125 bp, Homo sapiens; identical to SEQ ID NO: 71132
  chr10:22725790-22725915
  Hyper

SEQ ID NO: 104424 - DNA, 1336 bp, Homo sapiens
  chr10:22764573-22765909
  Hyper
tgcgtaaataatactcgattaccatgccacctacatctttttgttaaaaatgcctttatgaaggctataatccttatcaaattaaaccctgcggatcccccttttaatacacagggagtcctcctcatttatgggcgtcggcgctaagcagctctggaaacgggcagacccagctgtgcagcgatgtccagtgtcgccgcatctgccccgcggggtgcagcatgagtcttcctttgtggcgtgcggctccatcggaacgcgcgttgcgacgacaaattccttttttcccccccgcagttaacagttctggggcagaggctggtggagaggtccagagcccactcagaccgagatgaagatgaggaaaagcatgagcaggaagaggctggcggctgcggcggccacagggaagagctcggtgcgcggcgcagcctcccgcgaccgcgactcctgggctgcgtcgaggagccgcgttgccataggaaccgtagcggcgccccagtgaaaccctgcgttcggacaggagaagctaaccgcggccgcccactcccacccgcgcttcctccccgcccccaccggccgtgcgcgaaaagcagagatccgagaaccgcgtgcggtacaaacggcaaaagcttcgcgcgcattttccgggagttgagcgcgcggccgcaggccgggaacctaccgctctcaggctcccagcccgggcgctacgaccctgtgggcgccgcctgtgcagcccctccttccagcccgctcgggcgcatcccccaggccgggccagcgacgcgggcaccgggagcccctcccgccggtccgggctttggcccacacccggggaccgcggagtgggaaaggaaccaaagcgcggcgcctggccgaccgcggacgaaattcgaggccggagggcgttttcttttttgcaaaattgccccaaagccagggccgcatgtacctactgtctcctttgccccacatgctccaagaaaataagacacattctaccccgagtcctaattattgggccatttccttaacgcgcggtctgtccccgtgggcagaaacatactgcgagatgcagtttgggtaattaacaaagagacgagacctaactgggcttccgaaatgctggatactgcggccgggtcgccccgcattcgggcatcgcgcggttcccggccttcgggacgttccggcccggccggactttgaccgctggcgtaattaggagaaacgcagaaggcggacgctccccaatttccccatcgagccttctcctcccgagtctgcgaagcccctggctcaggagacaccggctccgcgcctgggcctgcaa

SEQ ID NO: 104425 - DNA, 137 bp, Homo sapiens; identical to SEQ ID NO: 71134
  chr10:22823423-22823560
  Hypo

SEQ ID NO: 104426 - DNA, 48 bp, Homo sapiens; identical to SEQ ID NO: 71136
  chr10:22831077-22831125
  Hypo

SEQ ID NO: 104427 - DNA, 102 bp, Homo sapiens; identical to SEQ ID NO: 71137
  chr10:22832580-22832682
  Hypo

SEQ ID NO: 104428 - DNA, 64 bp, Homo sapiens; identical to SEQ ID NO: 71138
  chr10:22833946-22834010
  Hypo

SEQ ID NO: 104429 - DNA, 30 bp, Homo sapiens; identical to SEQ ID NO: 71139
  chr10:22869695-22869725
  Hypo

SEQ ID NO: 104430 - DNA, 138 bp, Homo sapiens; identical to SEQ ID NO: 71140
  chr10:22869936-22870074
  Hypo

SEQ ID NO: 104431 - DNA, 34 bp, Homo sapiens; identical to SEQ ID NO: 71141
  chr10:22949402-22949436
  Hypo

SEQ ID NO: 104432 - DNA, 78 bp, Homo sapiens; identical to SEQ ID NO: 71142
  chr10:23001906-23001984
  Hyper

SEQ ID NO: 104433 - DNA, 30 bp, Homo sapiens; identical to SEQ ID NO: 71143
  chr10:23002198-23002228
  Hyper

SEQ ID NO: 104434 - DNA, 305 bp, Homo sapiens
  chr10:23216825-23217130
  Hyper
ctggattcaggtaatcgcggacgcacttggctcctcccgcactggccgctgccctcggcgggacaatgggcgccctagcagccccgagcgttcccagggcgcaggcgcggcgcggcgtggcgtcgcctagcaacgaggcacaacaagggactgggggttcgtctgctgggtttgcggagcagctagctactcggcgggatctcccggcaggtaaaggtaaccccgtggggtggggaggcccaaggcagaggcctgaggaaaacctgggaaaggagaaggtgccacgtgggcgcagactgcttggg

SEQ ID NO: 104435 - DNA, 242 bp, Homo sapiens; identical to SEQ ID NO: 71146
  chr10:23460221-23460463
  Hyper

SEQ ID NO: 104436 - DNA, 2936 bp, Homo sapiens
  chr10:23461141-23464077
  Hyper
taccaactgtcaccacgatccgcagttcttcgcccctccctctgtcccaattatctagaaacaaaaagagtagaaaatcgaaaatgagatggaggtcggcaggggtgtgaggccacggatggctgctgcttccttgcttccttcttttgaagccagaatcgactctgctcttgctcgatgacagcccctcgccggaggcgcggctcctggcctctgcgggggtccgcgcaatccgggcgcctccagctgcccccctcctccgagggtcgcagccacagagcgcaggcccaagctggggcagaccaagggcggctggggtgctcatgccggtgccggcatcactgccggagccgccctgggcgcactgcacccagcgctgcttctctcgctggttctgtgccgctgctcctcccgatgcttgggggaccgcagggaggccgaatgacaaccggggagcctcggggccgcgcctgaggcccagagtctgggctgtgcagagcgcagagccccagcttccccagctccctcctggattaatgcttggtgccagggagaagcgcagggctctttccgcctcctccccaagtgcacccgggcgcgcttccatctgattagaatgtttcttccatcttattagaatgacagtagctttcaagtcattcattatgagaagaattttagtcttaaaagaaaaaagggagtcccactgtaattgtgagttgtaataaatgcaaacttctggtgccttcctctgcagcatggaagacagtaaaaaatgtgtctcgtccaaacgcaccccctctccaagcccattgtgaagtcagtcgccaacaaaggggacgtgtgaatattcaacaccgactctttcacttgttttttccggaatccctgagtcgactcaccccctctcctttttttttttttttaaatgggcgaatacctgtttaagttttaaaagcacatggaaattgcccgcgagcgaccatataatttgatttgccaggcaatctgcagagcgatcgcacgtcatttataatgttcattgagcattttgcctaattgtgtctgtctctgaaagggcagcgcaccccctcccgaccgctagcagcacaagtggcgacattcccatggagcggccgcgccgcagcttgccgcattcagcgcggacggcctggccgcgcgcttccccgcccggacgaccgggcgcgcctgacactaatagctcgcggctcaggtacgagcgggcgccgcatttgactcaattcaattcacaaccggccgcgcttgcaggtgtcgccttttgaaaccgccattcaggcggccgctgttcacttctcgctgcgccgcgggttctgtagaagcgcaagaatggggctgattattccggtgcccacatgccgcccccacacgcccccacccccgtccggcgcaagacttcccttggccaaaagaggcgtttaattagttctggggccgcggagagccagcgtggccgacaaagcccggctccccaggtaacccgggttccctgcggacccgggagggggcgcgcggggccggagcaccggccttgggctgcgcgctccctccggcgacactgccgtccccctggcctccggcccggtcccccgcaggccaaaggctcatctgccgggcttgggtggcccgggccagcgccgcctgcggtccccgagtgcggctggctctaaggccggcgccctctccccggctttcagtgctcagagccaggccagcgggaaagaaggcagcatggtccgcaaaagacaggtggcagtggcagtcttgcatgatacttgtccttcttccctgttccccattttggggaaacactggaaacacttttctctttatgcgcattcgcgtctcagcaccgagtgctccaagccctgcgcgcagcgccgggcttggaaggcggcgaatggctgcctagccgccgcccctactagtgacactcggccgccagcccccgcccaggatgtgcacatctgctggcagcactggcccgggtggcagtcaccgggccacccactccacaggtacaaccgcacccaatccaacctggaactcggagggctgtgcgcgccgagctgggatcgcgccccagcgagccgggcctttggctgcgccagggcccaggccgagtcatcccgccgctcgcgtcgccgcgaggcgggacaccgtgtgatacctttgccgtgggctgggcgtcggccgcggggcggagagcgggtgtcccacctcgcctcatcatttgatttccgccagcgtctgaggacggcgcacccaattcgttccactcgctgcgctctgtgaaccagcggcgggcagggcgggggaggccgggctgggggagggcagggtggtcccaatcccccgcccccgccccgccggcctcgcggagcacaagtgttgggattcccacgggcaggcgtgctctgcggctggaggcccgagcgcccagggcccaggagacgtggcggacacagaggggtttgtaggcacggtgacctccgtgctcctgctctgaaagggcctgaaaggagcggtttatggtgcattaccagtcaagggctcaggtaccagcgccttgtgtcgggaacccgggcggccgcccgtgctgcaggtgtctgctatacaaacgccccgggagggggagggcaggccgccggattgggggccggggaggggcctccggcctggcctgctcctgccactcgcgcggtttcgctcttgctcctctgcagccatagcagccagccaggggtgcagacggagatcctagctgccgggacagaaaaagctgcaggggcctggctgcccagtcccgatttggtttcaagactaacggcagcaggaggtcacaggaggcttgaacctctccggggagacaaccgctgtgccggggaagaaacatt

SEQ ID NO: 104437 - DNA, 2592 bp, Homo sapiens
  chr10:23479876-23482468
  Hyper
ttggaatttgagaggcgtctgaatacccaacagaagcctctagtgagacaagtgcctgaaaaaggaagcggcccaggaggacgactcctttcagtcctctgtagagagaatacgcacgatggctgcgcttctgaactctcccggggtggaagctgcagcctggcttttaaccggaattgcccagaccttgaaagtgtttctttgttgctcttaaaaagaggaattcacgttgcatcgcagtctgtgataaagtctgtcttggggcagagctgcatacgttttgtgttttttttttttttcagaaaagaaaggtcgagaaagaaaaaaacaagtcattcagggatggtccctgtggccagtcggaaaggtgagagactcgggctttgaaaacgattcacattctgccctttaacttcaatgccttccctccggactgcgccggagcagacgattcaatggactccttttgtatccagtttattgctcagaatccctagggtctagatttgctctcagaagaaacgcgccccgctgagctgctctgggggctgcccctcccgtctccccattcctttctccgggccggggagggcaggggaggcagccactgagccgatgtcgctggggacccgcaccaggcaccacagccaggctccagagcggagtcccataggtgcgctcccagcccccgtgttgcgtctggaacgcagtgggagtgggcccggatcaccttccaatgacacccgcatatactctgcaaactgtgcaaaagcccttgaaaagtccagagatgggacagaagcccccagcagaacccaggccggagccccgcgcacctcggataagggggtggcggaatgcacccacctggtccctgagggcagcacccttagattgcccaggctgccgcggaggaggacgatcgccgcgcgggctccgctctcgccgtctgggccaccggcgcgcacccctaggaacttctctggccgcgtgtagacgcggcgcgcggctgccccagtcccagggcggaaggagccggcgctgctcagcgcgcgcgggtacgcagcgggcaccgcgggacgcaggtgcccctggagccgcacgcggggcaggtacagaatccagtatgcagaggcagaggagagggaagagagcggtgcgaggagccccgggccgcgcgaccccgccttttcctcgccccaggagctcccaaagggagcaaaacgccccccacccccgcccaccgccgcgcctccgggccccctcgccgccggcacaccgcgctctgattggctggcgcgatgggtccctggcacgcgcctatggatgttgttataagaatcctcgcgtgccggccctcagctccaggaagtccgccacagccctccccagcgcagcgcgagcgcgggccagagcgcagcggccgcgggcactccagggaggcccgggggcgggcagcccggcggccgcctagctgcccccagccagggccccgggagggaggggctcggacgggccttagaaactcaccaagaactaacacgcgcagcccggcagtcccgctgcccactgcggcggcgagcatggacgcggtgttgctggagcacttccccgggggcctagacgcctttccttcttcgtacttcgacgaggacgacttcttcaccgaccagtcttcacgggaccccctggaggacggcgatgagctgctggcggacgagcaggccgaggtggagttccttagccaccagctccacgagtactgctaccgcgacggggcgtgcctgctgctgcagcccgcgcccccggccgccccgctagcgctcgccccgccgtcctcggggggcctcggtgagccagacgacggcggcggcggcggctactgctgcgagacgggggcgcccccaggcggcttcccctactcgcccggctcgccgccctcgtgcctggcctacccgtgcgccggggcggcagtactgtctcccggggcgcggctgcgcggcctgagcggagcggcggctgcggcggcgcggcgccggcggcgggtgcgctccgaggcggagctgcagcagctgcggcaggcggccaacgtgcgcgagcggcggcgcatgcagtccatcaacgacgccttcgaggggctgcgctcgcacatccccacgctgccctacgagaagcgcctctccaaggtggacacgctgcgcctggccatcggctacatcaacttcctcagcgagctcgtgcaggccgacctgcccttgcgcggcggtggcgcgggcggctgcggggggccgggcggcggcgggcgcctgggcggggacagcccgggcagccaggcccagaaggtcatcatctgccatcggggcacccgtaagtgcttccgcttcccagctcagggagaaggggtcgggcactcgaaggctccggaggggctgggggagctgactgccaagcagacagtcggaccgacggattgtcggtgggcacggaaaaacttgaatgcgagctcgcgtttctcgtttttttttttttttttatttttctgccacgttgaccgcggctctcaagggcgcgcgtccccgccagacttgcagc

SEQ ID NO: 104438 - DNA, 1052 bp, Homo sapiens; identical to SEQ ID NO: 71158
  chr10:23483566-23484618
  Hyper

SEQ ID NO: 104439 - DNA, 30 bp, Homo sapiens; identical to SEQ ID NO: 71159
  chr10:23484874-23484904
  Hyper

SEQ ID NO: 104440 - DNA, 207 bp, Homo sapiens; identical to SEQ ID NO: 71160
  chr10:23486207-23486414
  Hyper

SEQ ID NO: 104441 - DNA, 2313 bp, Homo sapiens
  chr10:23487742-23490055
  Hyper
gcattactttcaagccgaacaaaggccagggccggggggaggcgggggaagggctcggctgtaatgaagcgcctctaaggcggaggtgctgccgtggaggctgaggcggcggcggagcgcgctgctgcgtttgtgcgcaagtgactctcctgtgccacacacaaaaggcctccctcttcccaccttctgccgcctttcagccctccggctcctgccgagcccgctcctgggactctgggggggatcctggctgcatccccagggcagcctgacctttgggacatccgccgctgccagggcaaacctcgccaaactttccccaaactccgcaggccggggagggaccctggccggaggcgcgcatgcgccccgcccgctgctccgcgttcccagggttccggagagccggggtggagtcggacgagtgtccccggaggcccgcctagcccttgctcccaggggcattcgggactcctgtgctgcctgtcttcgcttgaggctggaagtggctgcccgacgccttgctctccgcagttctgctatctttgcgcatggaagtctccaagaggggctccaggaagcagcgagcagggaggggagcgaacggccaaaaggagatccggggatgggaccccaggcttcttcggaggaggcccggggcaactacgccccgcggccgggagggaagccctcgggcggccgcctgtagagggccccgtggcccggggcgcaggttgtggcgagctggtttttgcctctgggccgaggcgccagcgctagcagcgacagcagcggggggcgcaggtttctagccagtccccactttcggacctctgggggtctgcccttgcttctcggggagtcttggcccttgactgatccccgcaacttaaggccaatcccatccctagctggccggcacctgttccaaacaacctgttgcgctgacatcgctttggagaggcgccggcgctttgctggtggaggcgggttgtgtggaggccccaagccttcaggaaatagtttagggttccgttgtggtgagaggcaccccctccccgcttcctgtggcatgtggggtgtttcacctctgcctgtgtcccaggaacccaaggcgtcctgggcacctctgcacctcgcccactctagggacttctcatgtagagctcggcagtttgggtggattagacaaagatgaggattagagacacaccgccggctaattaaatgggctcttctcctctcctcgtcccctccccgcaacccgcagccagataggactcttcggttccctacccccactcctaggccctatgtaagtgcggatggagaaagctagttacattagcccttctgtcttagaggtaccggcacctcggggcattctcgctcttaaagatgcgttttctgaattatttctagttttacaatttctcttcggtgactgcacaggatcccttctagctcttttcctgttggagtcgctggacgtctcccaaacagctagttagtcgcctatctctggagcgcaggccttcggaattggattcagggtatgagtctagctaggggatgtttctagaagttttataaaatccatttgggcaagcgttggcattcggattttaaaaatatagacgtgcactggcattgggcaactcaaaaaaaaatgtgtctcctggcgcttgtcagtgacatgctaattacaaattttaaaacaagccacttctaagcgaaggacgcctggctgcaaccccacaactcacaccggtgcatataataaaatattagggttcaacagttggcatatgtggcaatagcaaatgtgacacctcgaagcgattatctggaagtttttccgtacttttgaaaatacacttgccgcctcatttctctgatggccgctcaatagacactgggagatggtagctgggccacccctcccaagagttcttcttgcgtgcagcgctttcatccagggcttgaattgtgttgtcaaagtttagcagacaagaggagggggcatgagaacgggagggtgtcttgaaaagtcttggaaatcggtgtattttgcaggtgtagaagtgcctaataaccatggctagtgcgcgctccccaatggcgagggtatgacagggacagctggctcagttttcagtgtgaaaacaccccctcggtggaccaaacacaacgacactgacctttcttcggggggaaccagggatgtgcctttgactgaattagccataaagacgtcttgctatgacttttgttccccacgaaagcaaagaaatattgcgtttaatatgagaa

SEQ ID NO: 104442 - DNA, 76 bp, Homo sapiens; identical to SEQ ID NO: 71163
  chr10:23491161-23491237
  Hyper

SEQ ID NO: 104443 - DNA, 79 bp, Homo sapiens
  chr10:23632945-23633024
  Hyper
cgcctcccgcggagccgctcgctctcctgagtcggagtcgggaacccggcgtccgttgccatggcgactcccaggtaac

SEQ ID NO: 104444 - DNA, 123 bp, Homo sapiens; identical to SEQ ID NO: 32958
  chr10:23633374-23633497
  Hyper

SEQ ID NO: 104445 - DNA, 29 bp, Homo sapiens
  chr10:23708959-23708988
  Hypo
tacaaatgggccaggcgcggtggctcaca

SEQ ID NO: 104446 - DNA, 2603 bp, Homo sapiens
  chr10:23982384-23984987
  Hyper
ctcgcagttaaaaaccgttgccactcgacggtggcaaaattgctggctgcactggagatcactgcagagcgctcctgatgcctcgatgctgacggcggatctggcgcgggctggggcgcattgcacattctgctccagccgggaggcggcgggcgggcaactccgggttggtcactcggcagccggcagaggtgcgcagaaggcgcacagaaccaggcactcagcctcaaggatgtctgggtctctgctaagggacaaacgctccaggaacaaggaacaacctctagccatcccagcaccacctaacgaaccttcgtttggctctctcgcagaaagtctcttctatttttggcccccaagacaatttcagagaaccagtaaagttgggtgacaacgtggatcgctttctagtgtaaggtcccggggaatggcaaaactcaaatgtagcctcactgatgagctcaaggaactctgcttggagttgtcacccctacgactgacctcagacccaggacccaagggcggggccctcttgcatctggaatccagcctcggccttgacccctttcgcttgttcggagtgctttcgcccagcttctggcggaggttcacgcagggaggggactcaggtggaaaaggctggcccctttgatctctttgcaggaacttagtagacaggggccccgggctggagatttgcttcgagtaggctagaggcgcccttggcgcaccgaagctggctgccttgctggaacctgccgcgggggtggaggttgaaaggactctgagctcttcttccccaagccgaactccctcctacaggagcgtggaaaccaactctcccacaccgtctatcccactcttcccccctaaacctctagcgcagctttttaaaggcatcctgtgcagcctccaactttggggaaagagaatgcccaactcccgctctccaactacccgtactgccttcttccttttcctgcggtcgcctccaaactctgcttccctggtatccccgccccgacctggaagcgagcgcccccggctgctcgcggcagcccctcggcgcccgtttgcagggagcgagctctggctcctcacaggatccagacgcggttcccatccgtccccagccctgcagggcacacgcgcgcgtgcacacgcacgcgcttacactccagctcacactcgcgcgtcctcactccctgcaccccaccctccgcgccgctcctccgcggggtggggggtggtgggggtgacgtcaggactgcagtccagaagagagcggctggagagggctgcgcgcttctcgccaagcaagcgggaggcgcactggggccgccgccgttcccgcgctcctccctctcctctgcacccactgtcacgctacccgcccgcgggggagcctcgagagcctccaggtgaattgaaagtcgtttccgggggaggacggagagggtgctgcagtcctggcatgccctgaaactgcaagtcgggcagaaacgacccggcggaggagcagggcgcgcagcgccctgcgcagcatccccgggctgccagaagaggccaccactcggctggcagccgcgagcggcggccgaacctcggccccagactcgggcccccggcacgctcgcccgggagataccccttccccctcttgcgcatttcgcagctgcgctggtgtggggcatgagagcgaggtggctccaggtctccgcggagcagctgccagtgggagagcgaggagaggcgagggggcggcagcctcggcccgaagtaagtgcagcagaagtttgcgtcggttgccccgccgctcccccagcgcgagtgggaggcacatctcccctccttggataaggaaaccgaggggagacttacaagggagccttgcgcgggagagcaagtgagcgtttcgagagagggcaaggacccccccaggagggccaggccgggaggggtcccggtgcggtgatggggtgccaaaaggagaagacccccaactgggaggagggactggagaggaaccggaccccggggatctcagaaagggaaggatgtggggagagtgaaggtggaggcagtcacacctatcctggtgaccttggcgtgcccccctggagtggcgagccaggggcttatataggtgcgactaggatgttgcctcgtttttcactcggggctgcgaagagggcattgctctttctgatggctggaagacaggggcaaggagagagagaaccggccccgagacgggctggagggtggggacactggggagtttggagctgggggttcggagtgggaggtttgggtcttctgagacgctccagactctccggaggcggcagaggtcgaggcaggaggcgaatgtgacgcttagggtcgctacggttgatgttgggcgcctttggaagctggtcattaattcttgtcatcgggaggtttcgcggagggcgacagcgcccgggagcagggtgacccccacagcggccggccttccggctggctgccctccccgctcgccgctctccccgcgccgctgcgggtcctccgagaccccggactgtcctgagctgcttcgagggcgggcgagaccctgt

SEQ ID NO: 104447 - DNA, 145 bp, Homo sapiens; identical to SEQ ID NO: 71171
  chr10:24440378-24440523
  Hypo

SEQ ID NO: 104448 - DNA, 44 bp, Homo sapiens; identical to SEQ ID NO: 71172
  chr10:24497697-24497741
  Hyper

SEQ ID NO: 104449 - DNA, 30 bp, Homo sapiens; identical to SEQ ID NO: 71173
  chr10:24498138-24498168
  Hyper

SEQ ID NO: 104450 - DNA, 104 bp, Homo sapiens; identical to SEQ ID NO: 71175
  chr10:24841749-24841853
  Hypo

SEQ ID NO: 104451 - DNA, 24 bp, Homo sapiens
  chr10:24842550-24842574
  Hypo
caggaaagggccaggcgaggtggc

SEQ ID NO: 104452 - DNA, 30 bp, Homo sapiens; identical to SEQ ID NO: 71177
  chr10:24860681-24860711
  Hypo

SEQ ID NO: 104453 - DNA, 42 bp, Homo sapiens; identical to SEQ ID NO: 71178
  chr10:24908420-24908462
  Hypo

SEQ ID NO: 104454 - DNA, 42 bp, Homo sapiens; identical to SEQ ID NO: 42555
  chr10:24988521-24988563
  Hypo

SEQ ID NO: 104455 - DNA, 51 bp, Homo sapiens; identical to SEQ ID NO: 71180
  chr10:25241140-25241191
  Hyper

SEQ ID NO: 104456 - DNA, 274 bp, Homo sapiens; identical to SEQ ID NO: 71181
  chr10:25241730-25242004
  Hyper

SEQ ID NO: 104457 - DNA, 42 bp, Homo sapiens; identical to SEQ ID NO: 71182
  chr10:25408449-25408491
  Hypo

SEQ ID NO: 104458 - DNA, 452 bp, Homo sapiens; identical to SEQ ID NO: 71183
  chr10:25463441-25463893
  Hyper

SEQ ID NO: 104459 - DNA, 299 bp, Homo sapiens; identical to SEQ ID NO: 71184
  chr10:25464520-25464819
  Hyper

SEQ ID NO: 104460 - DNA, 499 bp, Homo sapiens
  chr10:25465101-25465600
  Hyper
gcgcaaggacgggctcggcggggacaagagccacttcaagtggtctccgccttatctggagtgcgagaacgggagttacaagcccgggtggctggttactctttcctctgccatctacgggttgcagcctaacctggtcccggaattcaggtagggagggccggggggcaggggggaaggcaaaagcgaagctttccttccggtcttgtgggtgggtgcacgtgtgaggaaggaacccttggctgtgacgcgaacgcttctcaccctcagagtagagacccgggctgagggacaccccacgcgggcgcgggtgcttgggggcaagaagcgccccacgcccgtcagcttccggcgctcggcgaaagccattcattctctcggaccagtttccccgcactgggcgagggacaggcagcccttggcaggacggagacacccccgctgctctgtgcttccctccaattgtccggagagcagggaggggcgttccccaccgggg

SEQ ID NO: 104461 - DNA, 67 bp, Homo sapiens; identical to SEQ ID NO: 71187
  chr10:25465877-25465944
  Hyper

SEQ ID NO: 104462 - DNA, 148 bp, Homo sapiens; identical to SEQ ID NO: 42556
  chr10:25592447-25592595
  Hypo

SEQ ID NO: 104463 - DNA, 183 bp, Homo sapiens; identical to SEQ ID NO: 32968
  chr10:26055811-26055994
  Hyper

SEQ ID NO: 104464 - DNA, 32 bp, Homo sapiens; identical to SEQ ID NO: 42557
  chr10:26127993-26128025
  Hypo

SEQ ID NO: 104465 - DNA, 30 bp, Homo sapiens; identical to SEQ ID NO: 42558
  chr10:26211012-26211042
  Hypo

SEQ ID NO: 104466 - DNA, 1105 bp, Homo sapiens
  chr10:26222992-26224097
  Hyper
cgaggatgtggatggcgcggatggcgcggcctccacctgcgggcagtggagagagcggcgagaggaagaatattccccgcgagccgggataaggggccccttcggctcggttgacccaggtcagatcctcccgccgaccttcggcccgccctctacaggcggcccagttcttcccctgctcggctgcccctgcccgcccctcgagggagcgcccgtagccagcgcccccgtaaagaaataaggaggcgcccggcttcccgcccaggtacgtgtcgggacagcgcaggggactggcttggggcggcggtgggtagcggcgcccgcgcggcgctggaaacggccccgcttccttggaccccggggcttgcagggcgggcccggggctctctgagcgcgaggctgccgcgaccgcccgcccgcccaggtcagatccggaggacctgtgtgtttgtcggggcctggggtgagagaggggactcgaggggagaagtagagcgggaaaccaagagggggaatgtgaggcttgaacgagctggatgggagagctcgaggggaggagagggatgaacttgagggggaaacgggggcgggggtgaactcgagggggagccaggaggagggaacgggaagggtgaacctgaggggtggacttgagggaagatcttgtgggtgaacccgaggagggaacgcgaggggatagtgaggggggatctcgaggagggaacgtgaggaatgaacttgaggagggaacgggaggggtgaacgtgaagtggaaacaggaggagggaacgggaagggtggcgtaaggggtgaaggaagatctttaggggtgaacttgggaaggaaacgtaaggggaggacctcgaagagtaacgaggggcgagaactgagggggccctgcagggagactggagggaggaggcgccgagtctggcgggtgtcgcctcggagacctgtggcgcgcgcgggctttgcggcgccgcccacaggtggcgctgggtcggcccgtccctgagggaactgcgttccgggtgatttctcagaacaagcaggtcggtggagctgggctccctgcaaccccaaatgcatccgtaaaggagtttta

SEQ ID NO: 104467 - DNA, 30 bp, Homo sapiens; identical to SEQ ID NO: 71196
  chr10:26494015-26494045
  Hypo

SEQ ID NO: 104468 - DNA, 652 bp, Homo sapiens
  chr10:26500510-26501162
  Hyper
aagctttagttagcacgtatctaaacaccattaccaggctccaccagcccctctgctcctcagcttagaggagtttttaaaacctgttgagaattatcgcagatacgtttggccattatccagtcgtttcgattgtgcctttcctaaatgtccgcggttggcagaacgtgggaggaagaggacccgcctaactcggggtaggtggggacgcgctgctcactgtggtgaggttgacacttgggccctgggtttcacttgcaggtgctgggcggcggagagccccgagaaggaggaggagagagagccagcagccaacccctacgacttcaggaggctcctgcgcaaaacctcccagcgccggcgcctcgtccagcagtcctaaccgttcaacgaggcagtcaccgccgtcggaaggcgctggagcctgcggggcagcaggggccaagcaggcactctggggctggcaccagcaggcactgaagctgcggccctgatctccgcagaggctgcctgctgcgctcggccctcaagtgcccgggccggccttcgtgctccgaaacaagagacctgggagccctcgggaaacctcccccgacgctctctctcggaactcccgcaccctcctttctcaccagcccgccagttgtggcaa

SEQ ID NO: 104469 - DNA, 143 bp, Homo sapiens; identical to SEQ ID NO: 71199
  chr10:26501446-26501589
  Hyper

SEQ ID NO: 104470 - DNA, 3737 bp, Homo sapiens
  chr10:26503693-26507430
  Hyper
tgagccctgagttttcgaccacccgggctcccacagcctggaacagacttcacctagcacgctcagtgccagccttcggcaggacgctatcaacgcccgactggtttcctgctctcatcctggcgcctgggcccagttgccatagtgtggatcccatgactcctcagggaacccctggactcaggcacgcgagaagaagacagcgctttgtggagagaattgaccagggacagttatgctcgagcacacaggacttgggcctgtatgcgtccagcatgggccccaggatgtcccttctaagcgagggtcgaggggtgctcgcccagacgggatccccgggtctctgctttgttagcagctttggtggctggttcaggaggtcagagaaataaaacgacttgtgaacacaatggaaatgacaggcgctctggccaggcgcggggaaggcagccgcctcgggaagccgacctcagccctttcctctctctccctccctccgtctcccccagagccccggagctccgaggtgcacttgaagttcatctccactgccaggagaacgcagcgcaaactgtcaaagggctcccaatccttagggcgtcctccctgtctgcaatagctttttgtagaaaggaaatcatcagaacgattctgactttctcctcctttctttattagaaaaagagaaaccgcctcctaatacgcctcagagagaaccaatctcgcgcttccgggtcacccgctaccgcgaagattctctgggggcgagggggggcattggtttgaagccccttaaaacgagggccctgcaggcgatgccttctttcctactcggatttgtaaagccgagattgcttagttggaaaccctgttctcccctcccaggcgcacacagatcccccttacacgcaagcagcgggcgcttccacgcctccgcgggccaaggtcaccaaatgccctgattccatcccccacccgccatcaatcctgccgactctggccgctctgcctcattctcttccaagaagtttccattcgttttatttttttttccccagcccgaggtcctcagtagactccagcgtggattttaattgcctcaatcagcagtcattctccccagccgtcactcagagcctggacggtgggtcccgcgatctagcccttggctacgcaggaacggtgcgcccccgggtacggcgcggttcagcaggcaggcgtcaggttctaccaaggcgctgaaatgagcccatcagcgggtaggagcccttcccccgccgtcccctccccaggctcgtgaacggcgcctgatgcccgcccggggcgcgagctctcgaggtcgcagtgacctcagcacctgcttggaggaaaacggcgcgggaaccccgcttccttcccctcagctggagccagacctcaaacaaaaccccaatcgatgcacacagaaaactcctctgggccacgcttcccgcctcgccgaggtctccccagtctgcccctcgctgacgctggcgcgcagcggctgtggcagcacccgggacagcggccgcccgcacttcccgcctctggctcgcccgaggacgcgctggcacgcctcccaccccctcactctgactccagctggcgtgcatggtctgcctcgcatcctcacgactcagctccctccctctctcgtgtttttttcctccgccgccccctcattcatccccactgggctccctttccctcaaatgctctggggctctccgcgctttcctgagtccgggctccgaggacccttaggtagtcccggtctcttttaaagctccccggcttccaaagggttgccacgtccctaaaccctgtctccagctcgcatacacacacgcacagacacgcacgttttctgttcctgcgtgacacccgccctcgccgctcggccccgccggtccccgcgcggtgccctcctcccgccacacgggcacgcacgcgcgcgcagggccaagcccgaggcagctcgcccgcagctcgcactcgcaggcgacctgctccagtctccaaagccgatggcatctccgggctctggcttttggtctttcgggtcggaagatggctctggggattccgagaatcccggcacaggtaggaaggagaacgggggcctgcggcgggcgagttttgcggtggtctggggtttgcggaactacggagaagacgaaggaggtttttccacctgcaacaggaaacttcttcgggcgcttctccctgcttttgggctaagtccttgacggcccaagagctcaagacctctacagcctcttgtaccctgggaagacgcccaaatagtctcaggcccgttccacagaaggttggaagagccccccaaagaccgcggtgtctcggggacatggaattccgtggtcctggggcgctgctaagatccgggtgtctggaccctggggtgggacggagtgaccgtgaagatagaaaaaaaaaatgggaaaggtgagagatttctttatctagaaagacagtctgcgaaaaaatggatagcttcagtgtttaggaaaactcgtccaaggtaggcagggagaggaatttgcctgagccgattggcacctggaagggcagcggtgtgggcttctcctcgggaaacagataaaggaaatgagggctggcccgggccgccagcctcccgcttgccttctgcacctgccggcctcaccgagtcctgagcggcccccaggaggaaggcggcccctcctaggaccccggactgattgattttcacatagaacgaaatttcacacgtccgtctgttgttctctttctgcctcgctgtctgcctgcctattcttccttgcagcgcgagcctggtgccaagtggctcagaagttcacgggcggcatcggaaacaaactgtgcggtgagtgcccagggaccggggcggccaaggtcggcccgcggggtccaagcagtcttctcacctccgcatcccagtcagcggagtcggggtttcctggctgcgggtaggcgggagcgagggagccgggcccggcggaggattgacgaggcccgcgttcggtgtccttacccagccctgctctacggagacgccgagaagccggcggagagcggcgggagccaacccccgcgggccgccgcccggaaggccgcctgcgcctgcgaccagaagccctgcagctgctccaaagtggatgtcaactacgcgtttctccatgcaacaggtaaagactcagcggggagccccggggcgcccctgcccctctctctgccccgcccaccgcggccggtgcgggtccggcgctgagagccggacaggggcgtcgaggtggcagcggaggcgggacctgccagaatcttcagataaaagcgagaaatgcgggacctgcccgctgggtccaagcccccgaacctggcctcggagctccaagagggctctgaggccgtggcgctcttcccccagcgcggcccttgggatggcgggtggccgacgatccaggcgctcgtgcgctcactgaatcgatgacggctggcttccctaggccgctggggcctcgggtgggactcagtttccaaataccgtgcccgagaattcagaattgcattttttttaggtctttagatcacgagagtgatttgtagctgcaattgcacaagagaacgattccattcacatgaaacccgcgcgccgagttttacccccgtgcacttacacaccgtctcccaaatgtacg

SEQ ID NO: 104471 - DNA, 36 bp, Homo sapiens; identical to SEQ ID NO: 71208
  chr10:26634123-26634159
  Hypo

SEQ ID NO: 104472 - DNA, 30 bp, Homo sapiens; identical to SEQ ID NO: 71209
  chr10:26634775-26634805
  Hypo

SEQ ID NO: 104473 - DNA, 139 bp, Homo sapiens; identical to SEQ ID NO: 71210
  chr10:26638399-26638538
  Hypo

SEQ ID NO: 104474 - DNA, 32 bp, Homo sapiens; identical to SEQ ID NO: 71211
  chr10:26676768-26676800
  Hypo

SEQ ID NO: 104475 - DNA, 430 bp, Homo sapiens
  chr10:26680701-26681131
  Hyper
acctgctggaaagctcgcagcagggcccgctcccggtcctgggcaggcccaggcgcgtcaagacgccgcggctacctctgcggagcgcggccgctcggccaccagccccttcccgccccccgagctccgcggcactggagtccccgggcggtgccatgcgtccctggagcgcacgacactttcgggccctggggaccccgggaggccgggatctggcctggggtggagggcgaggccagtcggcccccacctgctcaccgggcagactgtacccgggcaacggctccccgcagctccggctttttgcctgaagccccctgcaggcaaattccgcgtcgcgcgggcccgcgggcgcgctgcagtctccgagccccaggaagcagagacccaggtaggcaaagccaccgcctggccgcgtcagctcatgtgg

SEQ ID NO: 104476 - DNA, 26 bp, Homo sapiens
  chr10:26699638-26699664
  Hypo
atgcacctgtcgtcccggctactagg

SEQ ID NO: 104477 - DNA, 85 bp, Homo sapiens; identical to SEQ ID NO: 71215
  chr10:26699784-26699869
  Hypo

SEQ ID NO: 104478 - DNA, 201 bp, Homo sapiens; identical to SEQ ID NO: 71216
  chr10:26710933-26711134
  Hypo

SEQ ID NO: 104479 - DNA, 30 bp, Homo sapiens; identical to SEQ ID NO: 71217
  chr10:26716901-26716931
  Hypo

SEQ ID NO: 104480 - DNA, 30 bp, Homo sapiens; identical to SEQ ID NO: 42560
  chr10:26720842-26720872
  Hypo

SEQ ID NO: 104481 - DNA, 1032 bp, Homo sapiens
  chr10:26727076-26728108
  Hyper
tcctccacccccacccgagagacagctgaactccggccgggacgcgcgtgttgccagtccagccctgcaccgcgtcccctgagggcgggctgcaggcggccgggaagccttgcacaaccggcccaaaagaggaagcccagaaagtgctgaagtaaacactttgggagaccgttgcaacataaagcggcctctcagtctttggtggaaccatcactaggccccaatcccttagtccctcttgcgtcgaggctgcaaaatggttccattcgccaggagacgctcctgagagaagggcgcgcgcggcacaggtagggggaggcgcaacgtttcccagaattaaaataaaataaaataaaataaaataaaaatcccttcaaggtggttgtgtagtaggggtgggatgggggagagaaaatcaggcgcagactcgatgagttggagaaagcagcccctaactcggagtcctttacgcatatgtttgtctgtcccactgtctctaaccaggggccttccttgcacctcggagcaaagcagctcggatagcgccacacgtctgcgcgctgcgtgggaagggcagggctgacagcacttcctccccggggcagcgacctggagcccgggtgcggcagtctgcaccgcgcgtcgctttcccggccggagtctcgccgccttcccgcgccccgcagcgccccgcagagcagtcgaggtaagtggcgctcccagtcccgggagccctgggagcgccagcacgggcccctcggggctgtcaggaacccgtttgtcaagcccgtcgggtccgacgccgggggcagctccaggatctggcctcgtgaacgcgtgcccccaggcgtggccctcgagcgcagcgggtccccagggtcccctccgctgatctccactctggacccggctcgcgagggtgggggtgtgagggtttggggttcgggtttgctttttcccgagctattgcaacagatttgacagatttcctgcccaggaaattgctgcaaggtcaaacggggaactgctatg

SEQ ID NO: 104482 - DNA, 162 bp, Homo sapiens; identical to SEQ ID NO: 71221
  chr10:26733284-26733446
  Hypo

SEQ ID NO: 104483 - DNA, 30 bp, Homo sapiens; identical to SEQ ID NO: 15362
  chr10:26739045-26739075
  Hypo

SEQ ID NO: 104484 - DNA, 30 bp, Homo sapiens; identical to SEQ ID NO: 71223
  chr10:26746969-26746999
  Hypo

SEQ ID NO: 104485 - DNA, 93 bp, Homo sapiens; identical to SEQ ID NO: 71224
  chr10:26775009-26775102
  Hypo

SEQ ID NO: 104486 - DNA, 23 bp, Homo sapiens
  chr10:26783462-26783485
  Hypo
aaaccaattctagaccgggcaca

SEQ ID NO: 104487 - DNA, 21 bp, Homo sapiens
  chr10:26791280-26791301
  Hypo
gtctcttgggccaggcgtggt

SEQ ID NO: 104488 - DNA, 39 bp, Homo sapiens; identical to SEQ ID NO: 42564
  chr10:26801561-26801600
  Hypo

SEQ ID NO: 104489 - DNA, 99 bp, Homo sapiens; identical to SEQ ID NO: 42565
  chr10:26801660-26801759
  Hypo

SEQ ID NO: 104490 - DNA, 30 bp, Homo sapiens; identical to SEQ ID NO: 71229
  chr10:26816959-26816989
  Hypo

SEQ ID NO: 104491 - DNA, 81 bp, Homo sapiens; identical to SEQ ID NO: 71230
  chr10:26832035-26832116
  Hypo

SEQ ID NO: 104492 - DNA, 207 bp, Homo sapiens; identical to SEQ ID NO: 71231
  chr10:26854203-26854410
  Hypo

SEQ ID NO: 104493 - DNA, 30 bp, Homo sapiens; identical to SEQ ID NO: 71232
  chr10:26871319-26871349
  Hypo

SEQ ID NO: 104494 - DNA, 60 bp, Homo sapiens; identical to SEQ ID NO: 71233
  chr10:26873385-26873445
  Hypo

SEQ ID NO: 104495 - DNA, 197 bp, Homo sapiens; identical to SEQ ID NO: 71234
  chr10:26877695-26877892
  Hypo

SEQ ID NO: 104496 - DNA, 161 bp, Homo sapiens; identical to SEQ ID NO: 71235
  chr10:26902350-26902511
  Hypo

SEQ ID NO: 104497 - DNA, 24 bp, Homo sapiens
  chr10:26907325-26907349
  Hypo
caccgcacccggcccaaaaatatg

SEQ ID NO: 104498 - DNA, 45 bp, Homo sapiens; identical to SEQ ID NO: 42570
  chr10:26942249-26942294
  Hypo

SEQ ID NO: 104499 - DNA, 30 bp, Homo sapiens; identical to SEQ ID NO: 71238
  chr10:26964475-26964505
  Hypo

SEQ ID NO: 104500 - DNA, 22 bp, Homo sapiens
  chr10:27004609-27004631
  Hypo
gccaccgcgcctgggcactcct

SEQ ID NO: 104501 - DNA, 15 bp, Homo sapiens
  chr10:27542296-27542311
  Hypo
cgcagttggactcat

SEQ ID NO: 104502 - DNA, 1030 bp, Homo sapiens
  chr10:27547520-27548550
  Hyper
ctgctaacttgtccccgaccccacaactgctcacgaccttcgtgaaggtcaacctttcctaccgcgtggagtgagttgggatgcatactggggagttgtataagagtgtctgagaaagggaaatgcagagttgaatgaaagtgtttcccgggaggggccgagtggaaagcagcaggtggccggcgcgggtggaacccagcgcgggcgcagagcgtctctggcgtgggcattcggtgcagcgagtccgcgggaatcttggatgcgcggaggtccccggaccgcggtgacggacggggctgcgatcgtggccggtgagactgggagcggagggctggggcggcgcccgagggagggcacaaacccgggaggcctcagccgacggcgcagctttacgcggccgtagggcgcccggggttgagtggtgtcctagcaacaggtgggcgccgactgcggcggggcagggcgctgcaggtgacttcggccgggggtccccaggcccaccccatgggggctctgcagccggccgcgtagatcgggaaaccggggccgctctccggccccgccgctgctgctctcgcctgcttccctttccctcccgggggccgagacctgccccctccccttttctctcccaggcccatctcgctccttcctccccgcgagaccctgcctcggccctcggttggggaccgtctgctcctcagtccctgcgcccctctctgcactaccctggacccatcacctcccggatcggttctccacttaccccgctgtttccctgtctctccttccgcgagcccatctttctccttcgcccttgcagctcggcctcccgctcccaacgtggtgttcgccgtcacttcccacctcgtccctttaccgaatccattcttggaaacttagggtctcagctctgacgcccccttcttgtaacgagtctggtgggggccgtcatcccacactaggcttagctttgattttacttagggccctgttcatgccagttctaaaagttcgattttctgtaggt

SEQ ID NO: 104503 - DNA, 17 bp, Homo sapiens
  chr10:27794496-27794513
  Hypo
atttattttttgagacg

SEQ ID NO: 104504 - DNA, 42 bp, Homo sapiens; identical to SEQ ID NO: 71247
  chr10:27846677-27846719
  Hypo

SEQ ID NO: 104505 - DNA, 640 bp, Homo sapiens; identical to SEQ ID NO: 71248
  chr10:28030465-28031105
  Hyper

SEQ ID NO: 104506 - DNA, 324 bp, Homo sapiens; identical to SEQ ID NO: 32990
  chr10:28031314-28031638
  Hyper

SEQ ID NO: 104507 - DNA, 881 bp, Homo sapiens; identical to SEQ ID NO: 32991
  chr10:28031863-28032744
  Hyper

SEQ ID NO: 104508 - DNA, 2884 bp, Homo sapiens
  chr10:28032952-28035836
  Hyper
gatttgggggattttcgtgttttctagatcgtggatggtttggttgaaacccccgcatcttctgtccgccaaggtcccccggggtgaggttgggttcaaggacaggaaaaagttaagtggcgtcaggacgaaagcaccacttctcccccttctctcccagaatcttcctatcatcccccaacgcgccccgggaagtgcatggtcctaaggtccaaggcgccaggacccaggtccccagagccctcaatcagtgccattctcttccgcagcgcgggtgtcagccgcgagctcgtagcccctcgacacccgcctctctctggggtctccggggaccctttcagaggctgtaaaggtgtcagaagcccaaggcaggaggcagcttggtcggcgcacctcccgggccactgctgccactgtcggggagagccagcagctcacctctggggtcgcggaggccctgagcctctgcctgccgcgcaccggcgtcaggagcaagtccgcgcggccgcggagccgcagagttacagccccaaggcgcgcggcggacttcgcccgccccatctcctcgcctcgcgcctcgggacagctcccgtttcctccgagcggcctcagcttcgctgccagcgccccctttgcccgtccagccgcggcatgggctgctactccactaacacacgcgcgcgcgcatacacacacacacacacacacacacacacacacaccctttgcctcgccaagcgcccacactcgccaacgcccccgccccgcccttcggccaccgcagcagaggccacgcgtgacatttaggaccacgcgtgaccaccgcgatcaaacgacggctacggtctgtgttcgtagggaagtgaagtcagacctctgctggatgtcgtgtgtcccctaggactgcgtcctcccgcgcagacaggtacgtgcctggggtgtgcacatagcctcggtgataagtgtcaaagagaattttcgtgcttgcagcccctgttctacagtcaagactcgcgttggtgttttcttttaaaatcatgcccttagggatgtgtgttcatgctgctttatttgtacaagacacccttccccggcccggccttctccgagccaccccagcgcgtcctcctagatgcgacgacgtgtttttcctagcgaagtcatcacgaggttagccacctcggacacttccccggcagccccaagcccacgcagagatcgcagacacagacacccggcgcgctgtaggtctgcaggcagcaggctcagaggcaagcgatggcaaaggtccgagcgctgtcctgtcgcaaggggtccgggggcgtgtgaaccacacttgctgaccctcccaggactcccgcgcgcggccacccgcgcctcttctcaaatcacttaccccgattcactccagactgtggccggggaggtcactccctgcagaagtgtccccctcccccaacgccggcgaataattttaaagcaaaggaggcgcggccaggtgggctcccaagctccgcgcagacccttgggccagccttggccgctacccgagcgcctctccaccagaccttggagggaagttgggggaagggcgggagagcaccggcgcccagggcgcaggggccagagcgagcctggcgttccgccgcagccggctgagactcggcgacgcgggggctgtacctgtggctgcggggccgacggccggctgcagggcggctggctctcccgcctcgagactaggcgcactcccatccccgccgcatgttctccacgcgggctccagcgcgctcaccaccgccaccgccgtcgtctcggctttatttacccagcccggcgcgcgccgcccgggaacaggaatagcgaggccttctcatgtttcctgactgccggtcccagccggcgaacatcctgcgggcgcggtatccacgttcccgggcgggtggagaggaagcgtccgcgcccgcccggccgcgggggctgctgttaacccctagcagaggagccgctgccggggagccccgggcccgccgagtcctccggagccgggcgcggctcccagatccgccggccttgcagtcgtggagcagacggggcttttcccttcgcactttaggagagaaattggagaagctgccgggagcgctcggctccggctccagaagctgagaggctgcggtgcaaatcccgtgtcttagctggcccgattgccggaaatttcactgcgcgtggctaggcgggagaggccactgtgacgcgccctgtattttcctctcgattagctggagggaagttagagctccgttttgcacctacagccctggagcgtattgcgggaagtgctagtgcccaggagcctcttttctgatgtcactgggcttctggggtcctagttgtctcagtcaaagccaggcacacattcacctccggggcaagggctggtgaggctgccctcgccgctgggtatagggatgggggaaagcaaggatgggatgagttcagcccaggtggccaacccgcggtggcccaagtgcagaagaggaagcgcgcccaaagccaaggatctgcacgcagcaaaggagatggaacttagaagaatcacaagctgggacacagggcaaagagagagaatggctaccagattctctgattgatgatactttgcttcctaacattaccgcaaatataagtagcgaaagcggcggtttaggtgcaactgcaagctcagagcttctggcagcccagaagatccccaaggtgccaacacgaagctgcctgcgctctcgccgaaggccctgtggtcctagcgaactttcgccctttttaaagaacaaacttagatttccccccaccaagcttaaagaaatagcgccatttgtccttt

SEQ ID NO: 104509 - DNA, 30 bp, Homo sapiens; identical to SEQ ID NO: 71255
  chr10:28036088-28036118
  Hyper

SEQ ID NO: 104510 - DNA, 137 bp, Homo sapiens; identical to SEQ ID NO: 71256
  chr10:28258201-28258338
  Hypo

SEQ ID NO: 104511 - DNA, 39 bp, Homo sapiens
  chr10:28287341-28287380
  Hyper
ggacggcgaaaaccacgctgggagcgggaggcagagctg

SEQ ID NO: 104512 - DNA, 429 bp, Homo sapiens; identical to SEQ ID NO: 71258
  chr10:28287777-28288206
  Hyper

SEQ ID NO: 104513 - DNA, 30 bp, Homo sapiens; identical to SEQ ID NO: 71259
  chr10:28504430-28504460
  Hypo

SEQ ID NO: 104514 - DNA, 32 bp, Homo sapiens; identical to SEQ ID NO: 71260
  chr10:28559044-28559076
  Hypo

SEQ ID NO: 104515 - DNA, 22 bp, Homo sapiens
  chr10:28791009-28791031
  Hypo
gccaccacgccctgccagtatg

SEQ ID NO: 104516 - DNA, 256 bp, Homo sapiens; identical to SEQ ID NO: 71263
  chr10:28850452-28850708
  Hypo

SEQ ID NO: 104517 - DNA, 706 bp, Homo sapiens
  chr10:28957423-28958129
  Hyper
actcccgggctcccacgcggtttatttttaagacgctggtttaaatttctcgagttacggggggaaggggttgcggtgggagcgagactgagaaccacagcgcgaacaggggcgcattggtaccaggatcggtacagggatgtctccagttcctatagactctagcctcggggggagtctgtccagactacaagtgtctgtgcccctgttttattttgagacaagtcggggtcgctcaatgagtcagcacagaggaggcagtgggggagacagacagcggctgggacgcgcgggactggggcgcgccttgcgcgctgggcaccggagctgcgcacgggcggcccggggcgggggccccagagagcccgggagggcgtggactcggccggggaggggcgggctcgggcgcgtctgggttggagctggatgatgtaaaacagcgcggagctccttggcgcctcggcaccattaccttcaattatcataattggtgcctctctccagcgtttgcatttcccccgagggatctctcactagttcccgttccttctcctcgccctctctcgctcactcgctctcggctcccgatcgctctcccagcctcgccctcccctcagtatcgatctttttggatgttctccctgcctaaaacggatgctaatatctcttcgattgaaccgaaatggcgctgcggctgctacttttc

SEQ ID NO: 104518 - DNA, 192 bp, Homo sapiens; identical to SEQ ID NO: 71266
  chr10:28965689-28965881
  Hyper

SEQ ID NO: 104519 - DNA, 30 bp, Homo sapiens; identical to SEQ ID NO: 71267
  chr10:28967236-28967266
  Hyper

SEQ ID NO: 104520 - DNA, 146 bp, Homo sapiens; identical to SEQ ID NO: 71268
  chr10:29011016-29011162
  Hyper

SEQ ID NO: 104521 - DNA, 133 bp, Homo sapiens; identical to SEQ ID NO: 71269
  chr10:29011504-29011637
  Hyper

SEQ ID NO: 104522 - DNA, 202 bp, Homo sapiens; identical to SEQ ID NO: 71271
  chr10:29164926-29165128
  Hypo

SEQ ID NO: 104523 - DNA, 38 bp, Homo sapiens; identical to SEQ ID NO: 71273
  chr10:29300117-29300155
  Hypo

SEQ ID NO: 104524 - DNA, 28 bp, Homo sapiens
  chr10:29718763-29718791
  Hypo
aaatatggtagtggccgggcatggtggc

SEQ ID NO: 104525 - DNA, 204 bp, Homo sapiens
  chr10:30025527-30025731
  Hyper
gagagaggacatctccgagaccttcccgggggtgcgcccacactcacgcgcccacactcgcgtccccaccttcccccccgtctcacctccgcgcgctcctgcagagcccgactgcgcccgccctcctcgcccacctgccgggcccgggccgggggtgcacactagcgcggggccttggtggtgcggcaccgtcccctgcccaag

SEQ ID NO: 104526 - DNA, 218 bp, Homo sapiens
  chr10:30025952-30026170
  Hyper
ggccggcggggccggcgccacccaccccctcggcgcgcgcccggcccagggacgcgcccacgcgcacgcgcccagcggctcagggctccctggctctcaccggctctgctgcccggaggcagccgcttaccctggagccctgagaggcccctttgagtctccagaccttccagggataaataaaatctggcgacctgtgccaacgctgtgggccagtt

SEQ ID NO: 104527 - DNA, 30 bp, Homo sapiens; identical to SEQ ID NO: 71279
  chr10:30198419-30198449
  Hypo

SEQ ID NO: 104528 - DNA, 121 bp, Homo sapiens; identical to SEQ ID NO: 71280
  chr10:30259002-30259123
  Hypo

SEQ ID NO: 104529 - DNA, 882 bp, Homo sapiens
  chr10:30347841-30348723
  Hyper
gagcgggagcggggccgcggcgggagccccccaccgtcccgggcagtccagacggccggggcagcgtgggaactgggacctcggggacccagcgcggcggctgtcagctctggggtgaggtccgcgagatctgggcgcgagggcgcgggaggggttggtggacacaggctggggagggcgacttcgagaggggagtgagtgaccccggccccccaggccctccgcgcgccgaggggcgacgcgagcgctaacgccagccgcggcccgcggtgcccgccccgggacccccgcgctccgagcggggcacctgaggggaggggacgcccctcccgggctggcaggcgccctccaccccgaggctgccgggctaggcaccgcgcggggggcccaggcggggctgcgactgggggtgcagacatcccccaccgccagggtggctggaaccggagcgacgtcccagctggagaagttggggggagtgcgggaggctgcgggtgaggcccgcgaagcgccgtgggagcggccctaatggacggtgggagccaggagggttagacgccgggacttaccgagcggctccctcatgccgcctcgcgccgccaccgccgccgctccggccggccggggaccagcgcgacccgccccgcctgcagccgccgaggccgagcatgcccggagaaccgccgtccgccccgcccaccgcccgggcccgccccgcccaccgcccggggctgcctcctctgcgctgagggcggtatccaggccacgagcttcctaggcttttggggtccgcctgcgtgggtcgcgcagaaggcacaagtgagctgaccaccattccctcttttcttgtcacttgggtttgggccacgtcaaccctgtgga

SEQ ID NO: 104530 - DNA, 30 bp, Homo sapiens; identical to SEQ ID NO: 71282
  chr10:30509201-30509231
  Hyper

SEQ ID NO: 104531 - DNA, 30 bp, Homo sapiens; identical to SEQ ID NO: 71284
  chr10:30736669-30736699
  Hypo

SEQ ID NO: 104532 - DNA, 32 bp, Homo sapiens; identical to SEQ ID NO: 42573
  chr10:31006068-31006100
  Hypo

SEQ ID NO: 104533 - DNA, 213 bp, Homo sapiens; identical to SEQ ID NO: 71286
  chr10:31073224-31073437
  Hyper

SEQ ID NO: 104534 - DNA, 38 bp, Homo sapiens; identical to SEQ ID NO: 71287
  chr10:31073843-31073881
  Hyper

SEQ ID NO: 104535 - DNA, 101 bp, Homo sapiens; identical to SEQ ID NO: 71288
  chr10:31074105-31074206
  Hyper

SEQ ID NO: 104536 - DNA, 144 bp, Homo sapiens; identical to SEQ ID NO: 71291
  chr10:31152656-31152800
  Hypo

SEQ ID NO: 104537 - DNA, 30 bp, Homo sapiens; identical to SEQ ID NO: 71292
  chr10:31167819-31167849
  Hypo

SEQ ID NO: 104538 - DNA, 285 bp, Homo sapiens; identical to SEQ ID NO: 71294
  chr10:31422831-31423116
  Hyper

SEQ ID NO: 104539 - DNA, 672 bp, Homo sapiens; identical to SEQ ID NO: 71295
  chr10:31608744-31609416
  Hyper

SEQ ID NO: 104540 - DNA, 439 bp, Homo sapiens; identical to SEQ ID NO: 71296
  chr10:31609668-31610107
  Hyper

SEQ ID NO: 104541 - DNA, 220 bp, Homo sapiens; identical to SEQ ID NO: 71298
  chr10:31769214-31769434
  Hypo

SEQ ID NO: 104542 - DNA, 154 bp, Homo sapiens; identical to SEQ ID NO: 71299
  chr10:31874052-31874206
  Hypo

SEQ ID NO: 104543 - DNA, 384 bp, Homo sapiens; identical to SEQ ID NO: 71300
  chr10:31892881-31893265
  Hypo

SEQ ID NO: 104544 - DNA, 98 bp, Homo sapiens; identical to SEQ ID NO: 71301
  chr10:31951749-31951847
  Hypo

SEQ ID NO: 104545 - DNA, 16 bp, Homo sapiens
  chr10:32171091-32171107
  Hypo
tcggcctcccaaagtg

SEQ ID NO: 104546 - DNA, 39 bp, Homo sapiens; identical to SEQ ID NO: 71304
  chr10:32176855-32176894
  Hypo

SEQ ID NO: 104547 - DNA, 198 bp, Homo sapiens; identical to SEQ ID NO: 71305
  chr10:32499001-32499199
  Hypo

SEQ ID NO: 104548 - DNA, 30 bp, Homo sapiens; identical to SEQ ID NO: 71306
  chr10:32621991-32622021
  Hypo

SEQ ID NO: 104549 - DNA, 30 bp, Homo sapiens; identical to SEQ ID NO: 42577
  chr10:32638913-32638943
  Hypo

SEQ ID NO: 104550 - DNA, 153 bp, Homo sapiens; identical to SEQ ID NO: 71308
  chr10:32670730-32670883
  Hypo

SEQ ID NO: 104551 - DNA, 42 bp, Homo sapiens; identical to SEQ ID NO: 71309
  chr10:32736495-32736537
  Hypo

SEQ ID NO: 104552 - DNA, 193 bp, Homo sapiens; identical to SEQ ID NO: 71313
  chr10:33233331-33233524
  Hypo

SEQ ID NO: 104553 - DNA, 47 bp, Homo sapiens; identical to SEQ ID NO: 33011
  chr10:33622724-33622771
  Hyper

SEQ ID NO: 104554 - DNA, 206 bp, Homo sapiens; identical to SEQ ID NO: 71319
  chr10:33623014-33623220
  Hyper

SEQ ID NO: 104555 - DNA, 394 bp, Homo sapiens; identical to SEQ ID NO: 71320
  chr10:33624053-33624447
  Hyper

SEQ ID NO: 104556 - DNA, 143 bp, Homo sapiens; identical to SEQ ID NO: 71321
  chr10:33624698-33624841
  Hyper

SEQ ID NO: 104557 - DNA, 582 bp, Homo sapiens; identical to SEQ ID NO: 71322
  chr10:33625288-33625870
  Hyper

SEQ ID NO: 104558 - DNA, 59 bp, Homo sapiens; identical to SEQ ID NO: 71323
  chr10:34001866-34001925
  Hypo

SEQ ID NO: 104559 - DNA, 32 bp, Homo sapiens; identical to SEQ ID NO: 71326
  chr10:35103047-35103079
  Hyper

SEQ ID NO: 104560 - DNA, 52 bp, Homo sapiens; identical to SEQ ID NO: 71327
  chr10:35103482-35103534
  Hyper

SEQ ID NO: 104561 - DNA, 39 bp, Homo sapiens; identical to SEQ ID NO: 71328
  chr10:35104078-35104117
  Hyper

SEQ ID NO: 104562 - DNA, 353 bp, Homo sapiens; identical to SEQ ID NO: 71329
  chr10:35104860-35105213
  Hyper

SEQ ID NO: 104563 - DNA, 38 bp, Homo sapiens; identical to SEQ ID NO: 71330
  chr10:35152333-35152371
  Hypo

SEQ ID NO: 104564 - DNA, 38 bp, Homo sapiens; identical to SEQ ID NO: 71331
  chr10:35207255-35207293
  Hypo

SEQ ID NO: 104565 - DNA, 1470 bp, Homo sapiens
  chr10:35929088-35930558
  Hyper
caggaaccatgtgagcgacaagatcacccaccagatggagctggccatgccgaagaagtagaccagcaagaagaccacggtgcacagcgcggggccggtggtctcgtagcgcacgtgctgctccaccgcgcccagctcctcgtactcgccgcgcccgcccgggccgcccgcgcccgcgcccgccgcgcccgcgcccgccgccgcgccgcccgcgcccccagcgccccccgcgcccggcgcgccaccgctgcacgccaccttctcgtggcccgccaccaggcgcactaggtagcccaccgacacgaagaggtagcaggccgagaggaagataatgggccgctccgggtacttgaagcgctccatgtcgataaggaaggtggagacggtggcgaaggtggacacgaagcagagcaccgaccacaggccgatccagaagacggtgaaggcgcgctcgtcctggctgaaaaaggggttgtggcagggcagcgcgcagttagcgatctggcctgtcttgacgcggttgtagagcgggtggcgctcgctggacacgctcaccataggcgcgcggcactggcacccgggctcgcagggagccgcgccgccgccagggggccgcgccttcccgccaccgccgccgccgcgagctgggggcgccgccgcgtccccgccgccaccgcccctgccgccgccgcggtgcgggggcctggcccccggcgggcggccgtggccgctgcccgaaggcggctgctcgccgggcggcggcggcggcaggcggcgcggcgggctgggcgcggcggtggttaggtcggtgcggttgtagtccatgcacagcgtgtcagggttgccttgctcgggcagccggtcgcagcgcatgcggtcgggccaggcgaagccgtactggcgcatgagcggcgcgcagccggccttggcgcgctcgcacaccgagcggcagggcggcagcggcttcttgtagtcctctaggcagatgggcgtgtacatgctgcacaggaagaacttgagatcgggcgagcactggatctccaccagcggccagaactggtgcacctccaggcccgcctcgtcttgcgtgtcgtggttgaactgattgggcatgtaggtgtagttgtagccgatgcccttacacagcggcacggtgatctcttggcatgccagctccttggccgaggcggccgcagcgccgctagagcgctgcagcagcgccaaggcggccagcagcgaggtcacttccaacaggtaaccccactccatgctgtgcgcctcggcccggtgccctcgccctccaggcggcgcgcagaggggtgccggggggggggcccacgagagagccgcagacgggtacagcgggtgatctggggtctcccttatgcttcgcccgggaggggggtctgccgataatctaaccccttctaggggcgcgtccgcagcggcgcggcccgcagcctgggcagg

SEQ ID NO: 104566 - DNA, 35 bp, Homo sapiens; identical to SEQ ID NO: 71333
  chr10:35931026-35931061
  Hyper

SEQ ID NO: 104567 - DNA, 30 bp, Homo sapiens; identical to SEQ ID NO: 71334
  chr10:35931404-35931434
  Hyper

SEQ ID NO: 104568 - DNA, 242 bp, Homo sapiens; identical to SEQ ID NO: 71335
  chr10:35931778-35932020
  Hyper

SEQ ID NO: 104569 - DNA, 30 bp, Homo sapiens; identical to SEQ ID NO: 71336
  chr10:35989914-35989944
  Hypo

SEQ ID NO: 104570 - DNA, 30 bp, Homo sapiens; identical to SEQ ID NO: 71337
  chr10:36211085-36211115
  Hypo

SEQ ID NO: 104571 - DNA, 301 bp, Homo sapiens; identical to SEQ ID NO: 71341
  chr10:37106743-37107044
  Hypo

SEQ ID NO: 104572 - DNA, 94 bp, Homo sapiens; identical to SEQ ID NO: 71342
  chr10:37923450-37923544
  Hypo

SEQ ID NO: 104573 - DNA, 94 bp, Homo sapiens; identical to SEQ ID NO: 71343
  chr10:37923604-37923698
  Hypo

SEQ ID NO: 104574 - DNA, 35 bp, Homo sapiens; identical to SEQ ID NO: 71344
  chr10:38078895-38078930
  Hypo

SEQ ID NO: 104575 - DNA, 23 bp, Homo sapiens
  chr10:38301640-38301663
  Hypo
tgaggcaccgtgtctggccaaga

SEQ ID NO: 104576 - DNA, 249 bp, Homo sapiens; identical to SEQ ID NO: 71346
  chr10:38445833-38446082
  Hypo

SEQ ID NO: 104577 - DNA, 30 bp, Homo sapiens; identical to SEQ ID NO: 71348
  chr10:38690543-38690573
  Hypo

SEQ ID NO: 104578 - DNA, 54 bp, Homo sapiens; identical to SEQ ID NO: 71351
  chr10:42777495-42777549
  Hypo

SEQ ID NO: 104579 - DNA, 19 bp, Homo sapiens
  chr10:42862078-42862097
  Hypo
ttcctcactgcctctcgta

SEQ ID NO: 104580 - DNA, 59 bp, Homo sapiens; identical to SEQ ID NO: 71353
  chr10:43046988-43047047
  Hypo

SEQ ID NO: 104581 - DNA, 30 bp, Homo sapiens; identical to SEQ ID NO: 71354
  chr10:43187000-43187030
  Hypo

SEQ ID NO: 104582 - DNA, 2388 bp, Homo sapiens
  chr10:43248537-43250925
  Hyper
tggctgctccagcctcgaggccgcaggtcaccgcgcgggccccgtgcctactggcccggcagtcctgcgggtcagctcaggggagtgctctggagagccctgagcccacctcctgcgccccgcccaacctcgggtccccaggcccagcctctgacacgccgctcccagcgcggccacgccacagctccgggctgcgctcccccaggcaaaggcgccgccggcgcgtccagcgcggcctcctcctccaggcggcgcttgtgagtcaatggaaaagtccttggcgaactgagcagccgcctagtatatctctgaagcctcctgcggagacttcacggcttgtcccaggagcttctacaacagcctggcattgagagtagagttgtaatattttccgccagtttttcccagcccggccccgaagcgtctgatcttaaagtccacgtatcagactccggggggcgtccctgcaagagcgccaggtccccgacacccaccagggaatgaatctgcgcccaggtccccgacacccgccagggaatgaatctccgtcccaggagaagggcgtggcgaggggagaagcaacaaccacaggacccgtgacagtggccaagccttagaggccccgcatgcctgccaggcgcccgagcccacgcagtccaggtttccccatccgggcgggaaccagctgtttcccctgcacgggcgagggcgctggggtcacctccgccgacgccaggcgtgagctccagaacccgctcccaaccgcccggtcccgtgagcgcggggagcctggctctcgcctgacaataaagaaatcatcacggacagaaggaaagaggagcgaggctgggaagggagcggctttaatccggggtccgcccccttcaattctccagcgcagcggccccgaaagtggggtggggacggggattgaggctgagctcgcttcttccttgttttccgggtctcgcgcctctgaagcgaactgggcctggaggggtgctggggatcgagggagcggcgttggtgggtgaccgagggaaaggtggggccagcccctgggcaccggtcggaggaggattacgaggcggagccgctgcctgcccgcgcctcacccgcttggtccacccaatagctccgctgtagactcgcggcggcaggagcggcgggccagatggtgattacaacccggggcgctatccctttggaacctgacccccaactccgctcagtaaccggatttccggaagccgcgacctcgaagcccccagcgtttctccaccgacggcggggccggggctcctggaagcctcggagccgcagctccagcctgcagcgcacgccttggcccccagggagcagagaggcagagtacccccctgcatccggagcatagcaagcatgccccaggctgaggacctgcgacttggtgggacttcggtgcccgcccctccgccactacagggagcagaggcggctctggaagtcggtttagtgcggagaccgcgaccggaggagcgcagaacgctcctcccagcgtcctgggctccgcaggcacaatttttaaaccagaggcgaaatccgagtcccgccgccctccggggagggagcgtggccgcctagccgagccccttctctggctccgcccgcttttgcgccgcgaggccgcctggtgagttccagggccctgtggtcccccagccgccggcgctctcgggtgtcttttggccgcggcaggaacggagctgggcgctcagacggcgccggggtcgtttctgtgcccccgcccggtggccggagccgcagccttgccccttccccactggggcagcgcctgcctttctcgcggccggaccgcgccggagtcccaggccccaggcagcccgggccgcagctgtcatggagaagcccggcgcgtacttggggtgcccggcaggagccccggccgcctcgcgcccttcttctcacccacgactgtggccggcggcggcctctgcttcccggacaaagctggagatgctgctgcggagtcggccctgggacctgcttcttctcttggctccggggcccgcagccgtcggggcccggaagggctccccggggcgttccctcaggagcggtggccagggctgatggggcgtgtacgacgcgggaccccgagcccggcagcagccaagtatggcaaggaccagcgcgagcatctccccactgcggccggggacggcgtggggtgggagccgacccgggacatccaggtgggatcggccaccgctcaggcgctgtcccaggcgaacgccgccaggggcaggctcagcaccgcccaggccgccggctcggtgagcgcagagaggggcccccggtttatgccaaacgcgtgtcttctccaac

SEQ ID NO: 104583 - DNA, 36 bp, Homo sapiens; identical to SEQ ID NO: 42584
  chr10:43265217-43265253
  Hypo

SEQ ID NO: 104584 - DNA, 30 bp, Homo sapiens; identical to SEQ ID NO: 71359
  chr10:43265495-43265525
  Hypo

SEQ ID NO: 104585 - DNA, 30 bp, Homo sapiens; identical to SEQ ID NO: 71360
  chr10:43332265-43332295
  Hyper

SEQ ID NO: 104586 - DNA, 252 bp, Homo sapiens
  chr10:43332534-43332786
  Hyper
cagcgcggctccccacggcgtgcaggacccgggactgtcgcgccgcgcccggggacgcacaggaggtgggaccccggagcgaagcccctgcagcgtcccgggctggacgtggccctgcacccccggctgctgggcgggccggggcatgtacgagatcgcgcgctttacaaactgtcggtcgttctgggaaagttaaagaacgcgctgcagctacttcacctgctgctgaaaggagcccgggcagggctggtc

SEQ ID NO: 104587 - DNA, 178 bp, Homo sapiens; identical to SEQ ID NO: 71363
  chr10:43361545-43361723
  Hyper

SEQ ID NO: 104588 - DNA, 350 bp, Homo sapiens; identical to SEQ ID NO: 71364
  chr10:43361980-43362330
  Hyper

SEQ ID NO: 104589 - DNA, 30 bp, Homo sapiens; identical to SEQ ID NO: 71365
  chr10:43364192-43364222
  Hypo

SEQ ID NO: 104590 - DNA, 385 bp, Homo sapiens
  chr10:43393461-43393846
  Hyper
attttcacctttcatcgcaagggtcttcgcggcagaacgtggccgtccccacagccgtcgggggtttcgggttggatcccgcgttcgctccgctgcttggcctgcgcttcagcctctagcgacccagcgggggcgcgacttccgagccgcctccgcctcccgcctctaccgcggggccggggcgaccccaggtctgcacggccgaccgctgcgtccagagagatggggccgagcctccctgcggagcagaaccgtgggacggagggcggtgggctccgcagggagggggcgcagtccgggacagaccccagcacaggctccttccaccctcccgggacagctccgaaatcccagccctacgccggagctgcggtttgcaaagcgc

SEQ ID NO: 104591 - DNA, 264 bp, Homo sapiens
  chr10:43428369-43428633
  Hyper
cctgctgaggaaagccggtgcctcctgctccccagccctgtgctcccgcgcccccagtctcagcgggttccggcttagtccggcaccctgggggaatgctgcgctctggctggcagcacgccctgcctgcgctcgccccgtctttgctcctggtcaccatgcgtcctgcacagttaccatccgtgcccacatgctgccccggggtcgccgtgtccagatgtggctgggtcttggtgtccccgctgcgctcgtccctcctgccac

SEQ ID NO: 104592 - DNA, 544 bp, Homo sapiens
  chr10:43428894-43429438
  Hyper
ggagggcaggatgcccgcccggggcggaagagccgagggcaggccctggggcggggcgctgggctatggagaccacgctcctccgcccagtcctgtctgtccgaagcgacgcggcagggcacaggcgtccgcagaacccgccaagcgcgggacgggcctctgctcctggctccgccggccttcccaggccccgggagccaggaaggtctgaatggagtgatgcgcctggacttttgttcggaaatcccgcgtggagggcggcctagcggggagaggctggaaacaggcgaggaggagcagggccgcggttgtacgggacaacgggaaccgggtcttccctcgctaagaaagggaagggtctcagccttactgagaggagcccctgtggaggaagcgggcctgcacctgcggcttccctgcaccccgcacgccgtgcccaggcacttcctccccaacacaagcaaaggtagcccagctgcagccggatcctccctgagcgcagcgcaggggtcacagcccccgacagctgcgcaagtctattcct

SEQ ID NO: 104593 - DNA, 30 bp, Homo sapiens; identical to SEQ ID NO: 71371
  chr10:43479981-43480011
  Hypo

SEQ ID NO: 104594 - DNA, 1032 bp, Homo sapiens; identical to SEQ ID NO: 71372
  chr10:43571966-43572998
  Hyper

SEQ ID NO: 104595 - DNA, 52 bp, Homo sapiens; identical to SEQ ID NO: 71373
  chr10:43573249-43573301
  Hyper

SEQ ID NO: 104596 - DNA, 47 bp, Homo sapiens; identical to SEQ ID NO: 71374
  chr10:43600276-43600323
  Hyper

SEQ ID NO: 104597 - DNA, 97 bp, Homo sapiens
  chr10:43600534-43600631
  Hyper
tgatggtgcccttcccggtgaccgtgtacgacgaggacgactcggcgcccaccttccccgcgggcgtcgacaccgccagcgccgtggtggagttcaa

SEQ ID NO: 104598 - DNA, 186 bp, Homo sapiens; identical to SEQ ID NO: 71376
  chr10:43615366-43615552
  Hypo

SEQ ID NO: 104599 - DNA, 109 bp, Homo sapiens; identical to SEQ ID NO: 33035
  chr10:43697887-43697996
  Hyper

SEQ ID NO: 104600 - DNA, 77 bp, Homo sapiens; identical to SEQ ID NO: 71378
  chr10:43698279-43698356
  Hyper

SEQ ID NO: 104601 - DNA, 902 bp, Homo sapiens; identical to SEQ ID NO: 71379
  chr10:43724462-43725364
  Hyper

SEQ ID NO: 104602 - DNA, 574 bp, Homo sapiens
  chr10:43762179-43762753
  Hyper
gagggaccccgggcccgcgcacgccgcgccctgcccgcgccggcgaccggagggcacggccccaggcgcgggcgggggccccgaggcactgagggtccgcggccgctgcctacctcggtccgggccagcgtcgctcccgcgccgccctcgcgccgcagtcgggccccgagcagcgcgcggccggcgccggcggcggctcatgctcggcgcccgggcccgcggcacccgcccacccgcggccgcccccgcgctgcgccagctgcgggcagagcagctccctccgcagccggcgccggggagcgcgagcgagcgagcgaacgagcgagcgcggagcgagcgccgagcgggcacggagcgggcgcgagagcgcggggagcgggggagcgggcgggcgcgggacgcggagggaggagggtgcggggcaaaggtgcagggggaggtagggcgcgggacggggctcgagcagagggcactgggacagggcgggcgccgggagagggcggccaggctttcatttaaaaaggataaggcatcacgcctgtaatcccagcactttgggaggccgagacgggcg

SEQ ID NO: 104603 - DNA, 69 bp, Homo sapiens; identical to SEQ ID NO: 71382
  chr10:43778482-43778551
  Hyper

SEQ ID NO: 104604 - DNA, 45 bp, Homo sapiens; identical to SEQ ID NO: 71383
  chr10:43800413-43800458
  Hyper

SEQ ID NO: 104605 - DNA, 30 bp, Homo sapiens; identical to SEQ ID NO: 33040
  chr10:43818377-43818407
  Hyper

SEQ ID NO: 104606 - DNA, 275 bp, Homo sapiens; identical to SEQ ID NO: 71385
  chr10:43857593-43857868
  Hyper

SEQ ID NO: 104607 - DNA, 151 bp, Homo sapiens; identical to SEQ ID NO: 71386
  chr10:43858289-43858440
  Hypo

SEQ ID NO: 104608 - DNA, 196 bp, Homo sapiens; identical to SEQ ID NO: 71387
  chr10:43892774-43892970
  Hyper

SEQ ID NO: 104609 - DNA, 45 bp, Homo sapiens; identical to SEQ ID NO: 42587
  chr10:43905839-43905884
  Hypo

SEQ ID NO: 104610 - DNA, 44 bp, Homo sapiens; identical to SEQ ID NO: 42588
  chr10:43906064-43906108
  Hypo

SEQ ID NO: 104611 - DNA, 30 bp, Homo sapiens; identical to SEQ ID NO: 71390
  chr10:43915503-43915533
  Hypo

SEQ ID NO: 104612 - DNA, 41 bp, Homo sapiens; identical to SEQ ID NO: 71391
  chr10:44069791-44069832
  Hyper

SEQ ID NO: 104613 - DNA, 30 bp, Homo sapiens
  chr10:44185028-44185058
  Hyper
gggggtgagggcgtgcgacacagcgtcaga

SEQ ID NO: 104614 - DNA, 703 bp, Homo sapiens; identical to SEQ ID NO: 33043
  chr10:44185340-44186043
  Hyper

SEQ ID NO: 104615 - DNA, 156 bp, Homo sapiens; identical to SEQ ID NO: 71393
  chr10:44197833-44197989
  Hypo

SEQ ID NO: 104616 - DNA, 30 bp, Homo sapiens; identical to SEQ ID NO: 42590
  chr10:44433895-44433925
  Hypo

SEQ ID NO: 104617 - DNA, 30 bp, Homo sapiens; identical to SEQ ID NO: 71395
  chr10:44441910-44441940
  Hypo

SEQ ID NO: 104618 - DNA, 595 bp, Homo sapiens; identical to SEQ ID NO: 71396
  chr10:44500784-44501379
  Hypo

SEQ ID NO: 104619 - DNA, 220 bp, Homo sapiens; identical to SEQ ID NO: 71397
  chr10:44547194-44547414
  Hypo

SEQ ID NO: 104620 - DNA, 38 bp, Homo sapiens; identical to SEQ ID NO: 42593
  chr10:44594208-44594246
  Hypo

SEQ ID NO: 104621 - DNA, 30 bp, Homo sapiens; identical to SEQ ID NO: 33044
  chr10:44788550-44788580
  Hyper

SEQ ID NO: 104622 - DNA, 315 bp, Homo sapiens; identical to SEQ ID NO: 71400
  chr10:44806359-44806674
  Hyper

SEQ ID NO: 104623 - DNA, 34 bp, Homo sapiens; identical to SEQ ID NO: 42594
  chr10:44869035-44869069
  Hypo

SEQ ID NO: 104624 - DNA, 245 bp, Homo sapiens; identical to SEQ ID NO: 71402
  chr10:44879151-44879396
  Hyper

SEQ ID NO: 104625 - DNA, 1207 bp, Homo sapiens
  chr10:44879823-44881030
  Hyper
cctggccaagagccccgcgagggtgtggggagaggatcggcttcgcagggagcggaggctgcgcggctgcatcggacctcacagcctcaagtcgcggcatgaggcgaactttgcaaagcgcgctctcgccatgcaccgcccgacctccagcactgtgcgcagcaggacctcggagcccattcgcctgtggaaaccgagcccgcagcgggaaggcagtgggtggagggtgggcaggcaggggtctggggtccgcggctccccaccctcgcgccttcccgcgccagtcccgaacgctctcttggggcgttcctgcccagttgtcccggctgacctcgctctgcagccagcttgaggtcaggcggtcgctctctgcaggtcacaaaccctcggcgcaaaagtagggctttgaacgcgacaccgcaccagagcgcccagctaagcgagctgcctccacccccactgtgtcgggcggcgcaaactgcgggcgcaggcagaggagccgcggctctgcgccgggcgggagccgaagcccagagcctcgccagggcctccccgccgagcgcacttaccgtcgctgaggcagagcgcggtcagcacgaggaccagcacgaccacgaccttggcgttcatggcgcgggcgggcgggcgggcgggcggacgagcgcgggtcgggggccggacgccgagcgggcaatgcggctgacggagagtgaaagtgcggcggtgggaggcgcgcgccgggcgctttagaggggagagccaggcggggcggggcggggcgcgcggtgaggggcgggcccggagccgagtgctggccgtggccggggtctctgacgcgcgactccctcggcggcaccccccacccatccccttcgcccctcctccgctccctctgtgctcccgaggcgcagtgcgctccggcctttgaccttctcaggctccgctgggccccgcaccgctggcccggtctgcagtgaggtccgcagcctgagcgacgccggctggagggccgcttattgtccctgtgacagggccccactggagagactgaggaccttaggcgtaaagtggggcgcgcgtggaaagctgcgggacggggcctttcgatggcgggaactgaatgagaaccaatgaaaagcaaacaagttagtcccgggcggagggcctgctggcggtggcggcccaaggcagccgagggggtcctgct

SEQ ID NO: 104626 - DNA, 65 bp, Homo sapiens; identical to SEQ ID NO: 71407
  chr10:44882297-44882362
  Hyper

SEQ ID NO: 104627 - DNA, 85 bp, Homo sapiens; identical to SEQ ID NO: 71408
  chr10:45374177-45374262
  Hyper

SEQ ID NO: 104628 - DNA, 96 bp, Homo sapiens; identical to SEQ ID NO: 71409
  chr10:45565093-45565189
  Hypo

SEQ ID NO: 104629 - DNA, 150 bp, Homo sapiens; identical to SEQ ID NO: 71410
  chr10:45568859-45569009
  Hypo

SEQ ID NO: 104630 - DNA, 30 bp, Homo sapiens; identical to SEQ ID NO: 71412
  chr10:46009559-46009589
  Hypo

SEQ ID NO: 104631 - DNA, 67 bp, Homo sapiens; identical to SEQ ID NO: 71413
  chr10:46009822-46009889
  Hypo

SEQ ID NO: 104632 - DNA, 30 bp, Homo sapiens; identical to SEQ ID NO: 71414
  chr10:46092104-46092134
  Hypo

SEQ ID NO: 104633 - DNA, 21 bp, Homo sapiens
  chr10:46098319-46098340
  Hypo
acagagcgaggctccatctca

SEQ ID NO: 104634 - DNA, 28 bp, Homo sapiens
  chr10:46221028-46221056
  Hypo
acaaacaaacaaacgacaacaaaaaaaa

SEQ ID NO: 104635 - DNA, 181 bp, Homo sapiens; identical to SEQ ID NO: 71420
  chr10:49393615-49393796
  Hypo

SEQ ID NO: 104636 - DNA, 30 bp, Homo sapiens; identical to SEQ ID NO: 42598
  chr10:49541963-49541993
  Hypo

SEQ ID NO: 104637 - DNA, 154 bp, Homo sapiens; identical to SEQ ID NO: 71422
  chr10:49652940-49653094
  Hypo

SEQ ID NO: 104638 - DNA, 407 bp, Homo sapiens; identical to SEQ ID NO: 71423
  chr10:49731394-49731801
  Hyper

SEQ ID NO: 104639 - DNA, 607 bp, Homo sapiens
  chr10:49732002-49732609
  Hyper
cggccctggacaccccgtggcgagtccccgaggcggggctggcagcctctggcggcggccgcagggagcggggcgcacgtgcgcgccggagttacctttgggcgctcgcaggtgtcccctccagtccttgcagcagcacagccccatggcagccgcccgcggccccgccgctcggctcctctccccgcctgccgcctgcgccccggggcggcgcggccgaggtccggcccacgggcagtgcccagctgggcgcagggtgcgcgggaccgccggcccgcggctcccgggccctcacactccaccgcggccccgcgcagcgggcatgccggcctccgggcagaccctgctaatcaataggagaacgcgcagatcgcgaccgccgcgccactgcccgcttttatctccgcgcgccggggcggccccgcgctgctccctgccctcgccggcgccctccccacggcccgttactctcccggggtgccgggccgcgcgctctcccaggagccgccagggggcgccacggagccggggctgcctccgcctccctgggagccaagcaggggtggggggccacaccggcctggcctccccgcgcagaatgggaaga

SEQ ID NO: 104640 - DNA, 187 bp, Homo sapiens; identical to SEQ ID NO: 71427
  chr10:49857079-49857266
  Hypo

SEQ ID NO: 104641 - DNA, 30 bp, Homo sapiens; identical to SEQ ID NO: 15370
  chr10:49929928-49929958
  Hypo

SEQ ID NO: 104642 - DNA, 30 bp, Homo sapiens; identical to SEQ ID NO: 71429
  chr10:49939380-49939410
  Hypo

SEQ ID NO: 104643 - DNA, 20 bp, Homo sapiens
  chr10:50007560-50007580
  Hypo
gctgtaatcccagcacgaag

SEQ ID NO: 104644 - DNA, 34 bp, Homo sapiens; identical to SEQ ID NO: 71431
  chr10:50078993-50079027
  Hypo

SEQ ID NO: 104645 - DNA, 30 bp, Homo sapiens; identical to SEQ ID NO: 71432
  chr10:50088696-50088726
  Hypo

SEQ ID NO: 104646 - DNA, 30 bp, Homo sapiens; identical to SEQ ID NO: 42602
  chr10:50105263-50105293
  Hypo

SEQ ID NO: 104647 - DNA, 30 bp, Homo sapiens; identical to SEQ ID NO: 71434
  chr10:50121842-50121872
  Hypo

SEQ ID NO: 104648 - DNA, 30 bp, Homo sapiens; identical to SEQ ID NO: 71435
  chr10:50160854-50160884
  Hypo

SEQ ID NO: 104649 - DNA, 30 bp, Homo sapiens; identical to SEQ ID NO: 71436
  chr10:50300840-50300870
  Hypo

SEQ ID NO: 104650 - DNA, 591 bp, Homo sapiens
  chr10:50323255-50323846
  Hyper
cgcgctcacgggaggcgtcctctgaaccttggggaggcgccgctgcgcccgccagaccctcggcgagcccaccggagcgcgctggcgacagtgacagcgccgccccccgcccgcgcccggaggtggcagggcctccccaccaggcccggagccccggcctccccggcgcggccgcccggcccccacccttcccgctcccgcctggccccgccgcgcttacccggagccggagcccgcgccagcagcgcggccgccgccagtgccagcagccgcatctccccgccgccgcccggcgctgtgacgcgggagagcgccgccgcctggcccggccgccgccagcccgccccgggcccgcgctcgcgcccgcccccggcccgccccttgggccgcctgccacgcggggccggggctgctgggtcccgaggcccgcaccgggcgcgggagccgccgcgcgatcggttcgctccaggatctgtggcgtctcctttcaacagccccatttcccagatgagaaaactgagtttctgcaaggtgatcgctggtgactcacagaacacacagctgcagtgcgaccggcggtcctctgcccac

SEQ ID NO: 104651 - DNA, 30 bp, Homo sapiens; identical to SEQ ID NO: 71439
  chr10:50340253-50340283
  Hypo

SEQ ID NO: 104652 - DNA, 108 bp, Homo sapiens; identical to SEQ ID NO: 71440
  chr10:50373584-50373692
  Hypo

SEQ ID NO: 104653 - DNA, 30 bp, Homo sapiens; identical to SEQ ID NO: 71441
  chr10:50376617-50376647
  Hypo

SEQ ID NO: 104654 - DNA, 41 bp, Homo sapiens; identical to SEQ ID NO: 71442
  chr10:50460235-50460276
  Hypo

SEQ ID NO: 104655 - DNA, 302 bp, Homo sapiens; identical to SEQ ID NO: 71443
  chr10:50507426-50507728
  Hypo

SEQ ID NO: 104656 - DNA, 420 bp, Homo sapiens; identical to SEQ ID NO: 71444
  chr10:50603003-50603423
  Hyper

SEQ ID NO: 104657 - DNA, 1141 bp, Homo sapiens; identical to SEQ ID NO: 71445
  chr10:50603748-50604889
  Hyper

SEQ ID NO: 104658 - DNA, 1620 bp, Homo sapiens; identical to SEQ ID NO: 33059
  chr10:50605142-50606762
  Hyper

SEQ ID NO: 104659 - DNA, 85 bp, Homo sapiens; identical to SEQ ID NO: 71447
  chr10:50607131-50607216
  Hyper

SEQ ID NO: 104660 - DNA, 86 bp, Homo sapiens; identical to SEQ ID NO: 71448
  chr10:50748356-50748442
  Hypo

SEQ ID NO: 104661 - DNA, 277 bp, Homo sapiens; identical to SEQ ID NO: 71449
  chr10:50815067-50815344
  Hyper

SEQ ID NO: 104662 - DNA, 2219 bp, Homo sapiens
  chr10:50817061-50819280
  Hyper
acctccaacctcagccgccctggagcctctctcccgccagtccgcccactggaacacgggttccatgtgccatccagggtcaacgccgctctggggacgcgtcaggcccagcgcacagcctgggcagctcagcctgtcagctgagcacgggcgcctcaaggggtgcggccctctcagaaggaaggtgagtctccctggagcccctgacgacagcgaagcggctgggcgctctccggggagtgggcgcggcacccaagaagggtttcttacagttccaagagaggaccccagccacagtcactccagagcccacccggggcttggaggaggctctggaaaatgagggatgggggagtgtgcagaacagggggcggaggctggcaggagccgagggagggcttggtcgggtgcgaagagtgcctgggaggagttagagtggggagggggtgcggcggcggggagagaagaggcggagctgggggaccagaccgctaaaggagaaagggggattccaggcaaggggaatgtggccaggcagtgcgggagggcggcagcggccaggctaatattcgcgaccccgactggggcgcggcaacttctgccctcagtccccacaagctcccggccgcgattcgcggccgagaaattctgcggaggggccggtgggtcagagccaggccaggcagttgctgagccttcccctcccctcctggcgggagtgtgtgtgcaaggggccagggggcggagtcggagaaagggttgggggtgtccgtgtccagcgctcctccggacgcggctccacaatccagctgcgagaacagatggacgcagcggcggctcacctcgggggcttcctgctcgctgtgcgccgaggtccaggctgaagcggagatcgcaagcctctggctcccgcctctcccaaggggcctcgaggaaccggctgccgcgcccccttccccaagaggagaagagcgggcgctgaccccgcgagtcctagaaccgcgggcggggggcaggcagggggcggggggcagagggccagctaccggcgcggaacgcccatcccaggggctggttcaagacttccacaccgagagcccttcctgggcctccagccctggagcatctggagagcggacccctgcccggccacgccccgcccccggcccccgccccgccgacgtcgcattagcatgagcgacgtaagtggcccgggcaccactcgggggctgggactcgccgcgtcacagccccgagtggaagggaaaaaaaaagaggaggcggcggaggaggcaagagccgacgcgaggggaggggagcgcagcggcggggctaacgggcgggcaagcgggcgggcggcaacagcatgtccctcggccagcgcgggcggcctcttagcgcggcgggggctgctctgggcgcgccccgggcgaagtgcgcccagtctccggccccggcccctcggcgcgcccgacttcccggccgcccctgagcccagcagccgcgggtcccgggatcggctaagagtagctgcaacgcctcgccggacggagtcctttcctttcccgggacgctgggccatgagctccgcggccacctgaggcacaggggagtctgctcggccaggacagcctccccgaagtcccgtgccctcgcctctgcactgcgggacgccagcgctcggccctggcggaggcgtcctcggaagagcatcggggtgggggcatggaatccgcggaacctgcgggccaggcccgggcggcggccaccaagctgtcggaggctgtgggcgcggcgctgcaggagccccggcggcagaggcgcctggtgcttgttatcgtgtgcgtggcgctgttactggacaacatgctgtacatggtcatcgtgcccatagtgcccgactacatcgcccacatgcgcgggggcggcgagggccccacccggactcccgaggtgtgggagcccaccctgccgctgcccactccggccaatgccagcgcctacacggccaacacctcggcgtccccgacagctgcgtggccagcgggctcagcccttcggccccgctaccctacggagagcgaagacgtgaagatcggggtgctgtttgcttccaaggctatcctgcagctgctagtgaaccccttgagcgggcccttcatcgaccgcatgagctacgacgtgccgctgctgatcggcctgggcgtcatgttcgcctc

SEQ ID NO: 104663 - DNA, 461 bp, Homo sapiens
  chr10:50819484-50819945
  Hyper
catcctctatgagttcgccggcaagcgcgtgcccttcttggtgctagctgccgtgtcgctctttgacgcgctgttgctgctggcagtggccaaacccttctcggcggctgcacgggctcgggccaacctgccagtgggcactcccatccaccgcctcatgctagacccctacattgccgtggtggccggcgcgctcaccacctgtaacattcccctcgccttcctcgaacccaccattgccacgtggatgaagcatacgatggcggcttccgagtgggagatgggcatggcctggctgccggccttcgtgcctcatgtgctgggcgtctacctcaccgtgcgcctggcggcgcgctacccacacctgcagtggctgtacggcgcgcttgggctggctgtgatcggcgccagctcgtgcatcgtgcccgcctgccgctccttcgcgccgctagtggtctcac

SEQ ID NO: 104664 - DNA, 422 bp, Homo sapiens; identical to SEQ ID NO: 71455
  chr10:50820239-50820661
  Hyper

SEQ ID NO: 104665 - DNA, 197 bp, Homo sapiens; identical to SEQ ID NO: 71456
  chr10:50821052-50821249
  Hyper

SEQ ID NO: 104666 - DNA, 229 bp, Homo sapiens; identical to SEQ ID NO: 33067
  chr10:50821472-50821701
  Hyper

SEQ ID NO: 104667 - DNA, 750 bp, Homo sapiens; identical to SEQ ID NO: 71458
  chr10:50822142-50822892
  Hyper

SEQ ID NO: 104668 - DNA, 380 bp, Homo sapiens
  chr10:50887456-50887836
  Hyper
gattcaaccagataacgcagggaaaatgcttcgcacgccgcctgacacgaacttactgtgcctggctgctgctgttatttatcactaacacttgccacaccagctcaaacgcgcgtatttgcggaccaggcgctgagggtcacgtgagcagcttggggccgggaggatcccctagcgccaccccggccccgcccggcgcgtagcgacgcccacgcgcccgggccggaagagaggttgcttagcagcgtgtgtttctcccttgcctctgcggcggcggaggcctggcgatgcccaagaacgcagtggtcatcctgcgctatgggccctacagcgcggcaggcctaccggtggagcaccacaccttccgcctgcagggcctg

SEQ ID NO: 104669 - DNA, 30 bp, Homo sapiens; identical to SEQ ID NO: 71462
  chr10:50966548-50966578
  Hypo

SEQ ID NO: 104670 - DNA, 516 bp, Homo sapiens; identical to SEQ ID NO: 33073
  chr10:50969896-50970412
  Hyper

SEQ ID NO: 104671 - DNA, 161 bp, Homo sapiens; identical to SEQ ID NO: 71464
  chr10:50976356-50976517
  Hyper

SEQ ID NO: 104672 - DNA, 357 bp, Homo sapiens
  chr10:50976747-50977104
  Hyper
ccggcggtgtctgtccgagcgcagacagaagccgcgcgagggaacgcggggtcgtgtcctggggcggcggggaggggctgggagggcgggtgtgcaggggcctgggctgcccgccggctaggggcggccaccttggccggagatccgacgcgcggggactcccggtccgcgctcctccagcaggccggatccgcgcggcagtcctgggctccgctcctcatcctcctgccgcggccgcgccccgctggggaaggtgcgaggtgcggcggacgaggacgattcttgacgctgagcctgtgggccaggcccgcgcccaccacaggaatctctcccgggaaagcccggaaagatgccagc

SEQ ID NO: 104673 - DNA, 741 bp, Homo sapiens
  chr10:52177735-52178476
  Hyper
aattggcactgattgcggtattttaatcggttcacaccgtctgttagtgtattctaatgaaccacagcatctccggagcaacacttacggtctctcgtccccggaggcagtgtctcctggaaagttcctggggcaccaagtttgcgcgcggctcctcgcgctcagggtgcgcgcagccagccctggcgcgggcggaaaggcgagcgcgctgagcggcgcgcagaccccgggcgcggctcttgctgggcgcccgcgccttgatcggtcccggcggtcccgttcccctgcttgccgggccctggtgctaggacagcggcgctgcggagcccggcgtctggagctggcgggcggccggatgcgccgatcctctcccggggggtcaactgcgagctagacgcccagccggacctcagaggctccaagagcggggttggcgggtgtggcccggcagcagagggtttttggaatgcagggtgtggccctctaccacggcaaaaaagaaatgagtcagcccgttcagtcctaaccaataagcatgttcagtgtcggttaaggcggaactttcctttcttgatttataccaagcttagaagcctttcacagccttttctttacgcctttgacaacttcgacacaacttctagaaaagggtaggttgcctttgaaaacgcttgggaaacaaggattaatcttacgaaagatacttcagtggatgtacattagtttcgattagtaaaagtt

SEQ ID NO: 104674 - DNA, 112 bp, Homo sapiens; identical to SEQ ID NO: 71469
  chr10:52419113-52419225
  Hypo

SEQ ID NO: 104675 - DNA, 214 bp, Homo sapiens; identical to SEQ ID NO: 71471
  chr10:52750888-52751102
  Hyper

SEQ ID NO: 104676 - DNA, 179 bp, Homo sapiens; identical to SEQ ID NO: 33079
  chr10:52751383-52751562
  Hyper

SEQ ID NO: 104677 - DNA, 166 bp, Homo sapiens; identical to SEQ ID NO: 71473
  chr10:52751795-52751961
  Hyper

SEQ ID NO: 104678 - DNA, 513 bp, Homo sapiens; identical to SEQ ID NO: 71474
  chr10:52833568-52834081
  Hyper

SEQ ID NO: 104679 - DNA, 395 bp, Homo sapiens; identical to SEQ ID NO: 33083
  chr10:52834361-52834756
  Hyper

SEQ ID NO: 104680 - DNA, 464 bp, Homo sapiens; identical to SEQ ID NO: 71476
  chr10:54068146-54068610
  Hyper

SEQ ID NO: 104681 - DNA, 833 bp, Homo sapiens; identical to SEQ ID NO: 71477
  chr10:54072904-54073737
  Hyper

SEQ ID NO: 104682 - DNA, 220 bp, Homo sapiens; identical to SEQ ID NO: 71478
  chr10:54074198-54074418
  Hyper

SEQ ID NO: 104683 - DNA, 111 bp, Homo sapiens; identical to SEQ ID NO: 71479
  chr10:54074714-54074825
  Hyper

SEQ ID NO: 104684 - DNA, 203 bp, Homo sapiens; identical to SEQ ID NO: 71480
  chr10:54700730-54700933
  Hypo

SEQ ID NO: 104685 - DNA, 147 bp, Homo sapiens; identical to SEQ ID NO: 71481
  chr10:54716651-54716798
  Hypo

SEQ ID NO: 104686 - DNA, 30 bp, Homo sapiens; identical to SEQ ID NO: 71496
  chr10:56782981-56783011
  Hypo

SEQ ID NO: 104687 - DNA, 1116 bp, Homo sapiens; identical to SEQ ID NO: 71497
  chr10:57387425-57388541
  Hyper

SEQ ID NO: 104688 - DNA, 1016 bp, Homo sapiens
  chr10:57389660-57390676
  Hyper
cacttggtgtgtgtgcgctggcgcgtttatgttgggaaggttgatcactaagagagcttacaaatatctgtaggctctcctgtgtaacctccttctcttcctagccagggccattcaccggtaggctctcaggcgccacttctagagcatcctctgatgttggtcctgaactgggagagtctgaccaaacttgacgaagaggactgtcaaaaggcgttagaaacttcggaaactggcaacagttacggcatttttgctctgcgaagaatacgcccagaaggttcagaaagaagtcgggagtggggatggggagaaaaacattgaagggctatggaaaagcgtcaataacataaactgactttaatttttcttcatagaaatgtttccggtgaaattttctaagaaatcaggggacagttaatttgcttggttgacgctcacactccttgctctcactaagtctcaggtcttccaagcctagcactctgtcaaaatgctttcgggttgagggggagggctttcctggattccgcgaccacaacccaccaccccaaaccccacttcccatgtccttgatttttgaggctttttgggagggcatgatttcagggaacattactcttggccagctcaggggagcatagtcggaaatcttcggttgtattcctgactcagcctgggtgcggagcgagcgcggacaggaaccgagatgcaaaggcggacgcaaccagcgcacccgcagacggcgcgcggcaagaaccaccttctagccctgagcctgcggtgccgggcgggctcaggaggctagtggggtattgtgatcactgggacatcaggatgaaggggtcactccaatcccttggagatcagattctcggggactccatggccagacccgaacggcgcccttcacatggtgggtggagagggtactccttggccgaattgacccctccctgtcccgcagggtcagccccgcgcccacccacacatccagtctccgggaacaaaactct

SEQ ID NO: 104689 - DNA, 227 bp, Homo sapiens; identical to SEQ ID NO: 71501
  chr10:57391133-57391360
  Hyper

SEQ ID NO: 104690 - DNA, 30 bp, Homo sapiens; identical to SEQ ID NO: 71502
  chr10:57478909-57478939
  Hypo

SEQ ID NO: 104691 - DNA, 17 bp, Homo sapiens
  chr10:57918195-57918212
  Hypo
atttgaatgtaaggccg

SEQ ID NO: 104692 - DNA, 30 bp, Homo sapiens; identical to SEQ ID NO: 71505
  chr10:58168698-58168728
  Hypo

SEQ ID NO: 104693 - DNA, 109 bp, Homo sapiens; identical to SEQ ID NO: 33091
  chr10:60272038-60272147
  Hyper

SEQ ID NO: 104694 - DNA, 758 bp, Homo sapiens
  chr10:60272555-60273313
  Hyper
gcgcggctgtaggggcggcgggcggggagggggcgccgagccctgcggatggaggcgcgggcagcgcggcgcgctcattccgcgcgggcgttgctggcggggggcggcgcagccactggacccggaccggggccgcgacccggggtggcgggtggcgtgggcggcgcccggggctgggatgcgccgggggctcagtggcggcggcggcgttggcggtggcgtcggcggctgcagggggacgagctagcgccgcggcgctgggagccagttgagcccggccggcgagcggaggcggcagcgcaggcagagcggcggcggcagcgggagcccgagcgctgcgcgcccaccatggccgcccagggagagcccggctacctggcggcgcagtcggaccccggctccaacagcgagcgcagcaccgactccccagtgcccggctccgaggacgacttggtcgccggggcgaccctgcacagcccggagtggagcgaggagcgcttccgcgtggacaggaagaaacttgaggccatgttacaaggtaggcatccctcgtgttctcggactctccgactgagcctctaactccttttcggacatccccaccgcgcgctccggcgcccgctactccagcctacggccggccggtttagctccaggcccgctcccccgcggagccggaggacacccagggactggagacttcgcgggactccccacccttccacgcctctcagatttccaggcgctgggggccctgt

SEQ ID NO: 104695 - DNA, 30 bp, Homo sapiens; identical to SEQ ID NO: 71517
  chr10:60273557-60273587
  Hyper

SEQ ID NO: 104696 - DNA, 170 bp, Homo sapiens; identical to SEQ ID NO: 71522
  chr10:60935826-60935996
  Hyper

SEQ ID NO: 104697 - DNA, 794 bp, Homo sapiens
  chr10:60936309-60937103
  Hyper
aagccctatacatcacgttccccgagagcagcgtcccctccccgccgggagcgcgcgcctcccatcctcgcgccgggtcctgctcggtctctcagagccgcacactccgcggagctcctgccacagccgtcgccttcgcggcggctctccagccccgcgcctcagcctcggcgccgcatcaccgcgtcccaggcctccttccctccctctgccactccccctccctttcccgctcttcttgcccacccggccggcagagagagcctggatacgaagcaggcgggcttcagagtgggttggaaaaatggaggtgccgcgcctggatcatgccctcaacagccccaccagcccctgtgaggaggtgatcaaaaacctcagcctggaggccattcagctgtgcgaccgggacggtaagagcggccgggaccgcgaggaaagggacagagttcgcgccgaggcgccggggccactctggctccgccgacgccgctcgccagggcggcagggtcttttgttgtcccctctgtgcaaataaatgcagatgtgggttaccctccgcccaccgccctcccctcaccccagaaacaaaaggaccccggggctcgcgccttggcgcggaaagtagccgtccacaaccgtggcgcccttcgccgccttcgcccgcctggcccggacgagggcgacgttcccgctcgcggctcctgccccgacgaggcgtttccgatctttgccgcagtccggatttcctgggtctctgggcactgaaggggaaatgccctcgggatgtttctagc

SEQ ID NO: 104698 - DNA, 146 bp, Homo sapiens; identical to SEQ ID NO: 71526
  chr10:61122490-61122636
  Hyper

SEQ ID NO: 104699 - DNA, 35 bp, Homo sapiens; identical to SEQ ID NO: 71528
  chr10:61468736-61468771
  Hyper

SEQ ID NO: 104700 - DNA, 102 bp, Homo sapiens; identical to SEQ ID NO: 71529
  chr10:61469892-61469994
  Hyper

SEQ ID NO: 104701 - DNA, 30 bp, Homo sapiens; identical to SEQ ID NO: 71532
  chr10:61658400-61658430
  Hypo

SEQ ID NO: 104702 - DNA, 54 bp, Homo sapiens; identical to SEQ ID NO: 71536
  chr10:62493236-62493290
  Hyper

SEQ ID NO: 104703 - DNA, 30 bp, Homo sapiens; identical to SEQ ID NO: 33098
  chr10:62702560-62702590
  Hyper

SEQ ID NO: 104704 - DNA, 100 bp, Homo sapiens; identical to SEQ ID NO: 71539
  chr10:62704183-62704283
  Hyper

SEQ ID NO: 104705 - DNA, 51 bp, Homo sapiens; identical to SEQ ID NO: 71540
  chr10:62761321-62761372
  Hyper

SEQ ID NO: 104706 - DNA, 1185 bp, Homo sapiens; identical to SEQ ID NO: 71541
  chr10:63212027-63213212
  Hyper

SEQ ID NO: 104707 - DNA, 39 bp, Homo sapiens; identical to SEQ ID NO: 71542
  chr10:63656895-63656934
  Hyper

SEQ ID NO: 104708 - DNA, 18 bp, Homo sapiens
  chr10:63795861-63795879
  Hypo
gcgcgagccactgcacct

SEQ ID NO: 104709 - DNA, 538 bp, Homo sapiens; identical to SEQ ID NO: 71544
  chr10:64133867-64134405
  Hyper

SEQ ID NO: 104710 - DNA, 1309 bp, Homo sapiens
  chr10:64574553-64575862
  Hyper
aaagcctcatccgcccggagcttttctccctcttttttgcctgggggttccacggctgaggcaccaagacaaacaccacccaagaatcgacctatcccagtcagtgccgtgatggtgccaaaccgagaggagagcccgagaagggggtgggtgatttcccggctgctccccatccccggcgccttgtgcctttttctccctccctctcccgctgcgcttcagccgagggctgctggagcgaatgggggatgtagaggaaggagtccgtaggtttccgtgccctcccaatcttctccgcctttcccgacagccgcgcgtccccgcctcagcccaaggccagtggcccggcctcgaggaaggcgcgggggccgcgagagacgactttccacagcatcgccaaggaaaccggcgtcgccggtgcccccgcgggcctccctcggcagtccgggggctgcttcccgccgttgcgcgccctcctccaccacccactcgctgcctccgccggccggagcccccgccttactaaccccctcaacttcgcgggcggcgggcaggtgggggcgcgcctccaggccgcaagaagggagcgctccgagattttcccggggtcggctctgcccaggagggagctaccgacgctttcccctggcgcttctccgccgctcggctctccaggcgcgcagctctccccgagagccccgaactttaccgtcactttgcccctgccccgggagaggggaggtcgaagtgctgccggccagagggcctacgcaagcctcgaaacccggggggacgcctcttccacccccatccctgcgctcgcccggggctgggcgcgccggggcgcacgcacgccggtttgctggcgacctggcgcatctgcccgcgcgccctggtctcagctgtcgcaggttcctcctgcacccacttccagtcttcaaagccagtgcagtcagcaccgtccacctggagccccaatcctctcctgcgattcccgcacacccactgcaccccatccaccacctccgggccgcgcaggtccgggcctgcgaagacacgcggcttacctccggccactccgttcatctggtcaaaggggcctcccagttcggcattgggaaagatggtcaccgacgtggcggcgaggtcctccaccgggtagatgttgtcagacagctggtgcacaaaaccactgagagttactgggattttgtctacggccttggcggtcatcatttgctcctcgcacaacctggagacccaactccctcgctacctggagtgtcagaaaagccgttttggagagggg

SEQ ID NO: 104711 - DNA, 401 bp, Homo sapiens
  chr10:64578287-64578688
  Hyper
gctgcgttcttaccacgtgcgccagcccactccgcctgcgctctggcgggtcccgcggcccccgcgctgaccatgggcaagacgacgcctcggaagggagtccgactcgcatctcgggccctgagtccgaaagaacgggggaaagccgaattatgcaaatgcggatccctgcgatggggctcgggttacggcccccgccggccccttaggtgaggcacccaccggcagcaagcgcgggcgaggcgactgctcgcgcttcgctcctctctgcgcacgtgggcggaccggcaggcgggcgagttgcccgggccgccccgcgactggcgctgctgccaaacccgccggcggtcgccgcgcgccaccccgagggggagctcctggacgcccgagtgcccggccag

SEQ ID NO: 104712 - DNA, 165 bp, Homo sapiens; identical to SEQ ID NO: 71550
  chr10:64812014-64812179
  Hypo

SEQ ID NO: 104713 - DNA, 30 bp, Homo sapiens; identical to SEQ ID NO: 71562
  chr10:66600483-66600513
  Hypo

SEQ ID NO: 104714 - DNA, 42 bp, Homo sapiens; identical to SEQ ID NO: 71570
  chr10:69283867-69283909
  Hypo

SEQ ID NO: 104715 - DNA, 86 bp, Homo sapiens; identical to SEQ ID NO: 71571
  chr10:69310933-69311019
  Hypo

SEQ ID NO: 104716 - DNA, 37 bp, Homo sapiens; identical to SEQ ID NO: 71572
  chr10:69521314-69521351
  Hypo

SEQ ID NO: 104717 - DNA, 42 bp, Homo sapiens; identical to SEQ ID NO: 71573
  chr10:69571254-69571296
  Hypo

SEQ ID NO: 104718 - DNA, 65 bp, Homo sapiens; identical to SEQ ID NO: 71574
  chr10:69578014-69578079
  Hypo

SEQ ID NO: 104719 - DNA, 30 bp, Homo sapiens; identical to SEQ ID NO: 71577
  chr10:69896480-69896510
  Hypo

SEQ ID NO: 104720 - DNA, 120 bp, Homo sapiens; identical to SEQ ID NO: 71579
  chr10:70288069-70288189
  Hypo

SEQ ID NO: 104721 - DNA, 907 bp, Homo sapiens; identical to SEQ ID NO: 71580
  chr10:70320021-70320928
  Hyper

SEQ ID NO: 104722 - DNA, 35 bp, Homo sapiens; identical to SEQ ID NO: 71581
  chr10:70377573-70377608
  Hypo

SEQ ID NO: 104723 - DNA, 105 bp, Homo sapiens; identical to SEQ ID NO: 71582
  chr10:70476531-70476636
  Hypo

SEQ ID NO: 104724 - DNA, 20 bp, Homo sapiens
  chr10:70482667-70482687
  Hypo
tactccgtctcaaaaaaaca

SEQ ID NO: 104725 - DNA, 18 bp, Homo sapiens
  chr10:70483311-70483329
  Hypo
taaaagtaaatgggccgg

SEQ ID NO: 104726 - DNA, 42 bp, Homo sapiens; identical to SEQ ID NO: 33108
  chr10:71267763-71267805
  Hyper

SEQ ID NO: 104727 - DNA, 41 bp, Homo sapiens; identical to SEQ ID NO: 33109
  chr10:71327725-71327766
  Hyper

SEQ ID NO: 104728 - DNA, 760 bp, Homo sapiens
  chr10:71328773-71329533
  Hyper
gcattccaatggccccgggacgcttttgtcctccgactgaggccggctgggggtggggtgggatgggggcagggcaccataaatctacctgcttgtgtgccagcgcggcttgactggaaggaggagcaagattcatgtgcggtttttctggaagccagtcttgggctcagacaaaagcagaagaaggggggagagccattcgacgagagggtctttcctgcccgggtttcggacactgttggagtttcagggagcttgggcgcaggcggcgatctcaaagcgcagcaggctccgcagaagaggcgggctccgggcagagaccgctagcagcgcggtttaaaaagccccaggactcaaaacgccgcaagaagtggaaggcggggacggtggtgcagagctagttggacaggccacccctagaaatgtttccgagcccttcttgctcaggggttctttggaaagaggcatggacgaggtttcccactccagcgtgattccacacacttagacggagctcatccagcacggaaccctaaactttgcctccgtgattcaaagaaaccctaaaccctcctccgccttctcctgacttggagagtggggctgactgctccgggggtctaatccgccccaacccaaggtggcggcctagcagccgagttggttaacccgtacgtgtgtgttttaatttgtggggcggaggaccagtctgtgtgtgttgggtgactaatggctccttaatgagcgccctcaaaagcag

SEQ ID NO: 104729 - DNA, 1112 bp, Homo sapiens
  chr10:71331434-71332546
  Hyper
taaaaaaaaaagatgcgcggtgctccaggcacctgcagcgcagctcacgtttcaggcgcagttcgcagggaggctggggagatgctccctggccgggctagcgctttcccagttcacagcctggtcttccgccccgggagggcaatggctccgaaaagtgcacgaggagaaggcagagggtcgccttcgtggctttaaggcagagtgaggcgccctgaaatcccggacctgattgggagtagagcagatcggcagcgtctttggagcaaggcaaggggagtaagcgctgagagaccaaacattggattgaatcacattggaggaggggtggtaagagactgagaggcagacagacttgagtgagggtagggcgacccaagacggtgggcggctccggccgggtagtgctaccattctagtattctttgaatgagattatggggtggtggcagagaggaggcctaaaatgagcgcactttgcaatgcccacttcgcgcgggcagcagcaagggttgcgtgcgttggcgcggctcggagggccggggaatgaacccagcctgccgcccccgtggaggcctgggccggccaggggtcagccagggagaagcagaaggaacaagtgcttttgagggccgccgccgtcggccaccctctacggctcccggctccctccctctcccttacccttagcacccacagcccagcgacagacaggtcctttcacagaaaatctgagaaagccagactgcctgggctcaagcaggcggaaaaggtggcccccagcagcccgggtcgctcctccagcgacgcggcgggactcaggctgccagcctgggagactggggagtagagggacccccagtccccgggggaaccgcctgggctgcccagctccccgcagtgcggcgccggcggctccagcgcgtacaagctgtggtccgctatgcgcagcgtttgagtcagcgcccagatgtagttgtgggcgaagcgcagcgtctcgatcttggtgagcttcgcgtcgtctgggaaggtgggcaggacaccgcgcagggcgtccagtgccgagttgaggttgtgcattcgattgcgctcgcggtcgttggccttctttc

SEQ ID NO: 104730 - DNA, 354 bp, Homo sapiens; identical to SEQ ID NO: 71592
  chr10:71332778-71333132
  Hyper

SEQ ID NO: 104731 - DNA, 96 bp, Homo sapiens; identical to SEQ ID NO: 71593
  chr10:71334295-71334391
  Hyper

SEQ ID NO: 104732 - DNA, 129 bp, Homo sapiens; identical to SEQ ID NO: 71594
  chr10:71334827-71334956
  Hyper

SEQ ID NO: 104733 - DNA, 371 bp, Homo sapiens; identical to SEQ ID NO: 71595
  chr10:71336120-71336491
  Hyper

SEQ ID NO: 104734 - DNA, 30 bp, Homo sapiens; identical to SEQ ID NO: 33118
  chr10:71337383-71337413
  Hyper

SEQ ID NO: 104735 - DNA, 30 bp, Homo sapiens; identical to SEQ ID NO: 71597
  chr10:71337640-71337670
  Hyper

SEQ ID NO: 104736 - DNA, 225 bp, Homo sapiens; identical to SEQ ID NO: 71598
  chr10:71338101-71338326
  Hyper

SEQ ID NO: 104737 - DNA, 100 bp, Homo sapiens; identical to SEQ ID NO: 71599
  chr10:71338575-71338675
  Hyper

SEQ ID NO: 104738 - DNA, 49 bp, Homo sapiens; identical to SEQ ID NO: 71600
  chr10:71390060-71390109
  Hyper

SEQ ID NO: 104739 - DNA, 44 bp, Homo sapiens; identical to SEQ ID NO: 71602
  chr10:71561793-71561837
  Hyper

SEQ ID NO: 104740 - DNA, 687 bp, Homo sapiens; identical to SEQ ID NO: 71603
  chr10:71562106-71562793
  Hyper

SEQ ID NO: 104741 - DNA, 799 bp, Homo sapiens; identical to SEQ ID NO: 71606
  chr10:71813100-71813899
  Hyper

SEQ ID NO: 104742 - DNA, 233 bp, Homo sapiens; identical to SEQ ID NO: 71607
  chr10:72015162-72015395
  Hyper

SEQ ID NO: 104743 - DNA, 426 bp, Homo sapiens
  chr10:72043494-72043920
  Hyper
cagcgggcagagggacggtctccgggcacttggttgcgggctgcgcccctgcctccgcgctccgcaggtccggtcggtccgggcagaggtgagcagggggcgtgcgctcccaggccccgggccctggccggtttccctcccctcgggctgactggctcccgcgcagcgctgctgcccgcagggctcagccgcccgccgcccctcgcctcccgaccaggggaaggagggggctcgtgaggcgcagtcgtcatggcacccgcgcacctgtgcccgccgagcgagggcgccccgggcccgcctcccgcatggcgctctctccacagagcccgagcgcccctccgaagtaggggacacacccctcctcccactgcagccctggcagcggcgtcccgtaattccccacctctctcccgtgcctcatatgcc

SEQ ID NO: 104744 - DNA, 1485 bp, Homo sapiens
  chr10:72200018-72201503
  Hyper
agtgaactggaaaagcgctccctcccttctttgccccctcccatccccggccgcttttcggttgaggggccgagcactccagcaaatttctcattgccccgcccccgagggtgtcccctggtctggctggtccccagatgacccttccggagagggtcaccggctgtctgaccccaggcgcgggagcgaagggcccccggcaccaggtcacaaggggcgggcaggcggcaggtcggatcagattagcgtttgtggattgcgccccggccccagggagggccgtctggcccccgcaggcggagggaggcgtgggcggccgcggctgcccaggcggcagaatgtggattgaggcgcggaaggggctccctctccgcagcacccacctgctcgccgcgctgggtgcccagaacgcgctgccaggtcctcgagggcgataccctcagatccctgccgtccttgacacccactcccctgcaaatcatggccccgaacccggggttaagcgagacacttgacacttccccggcgcggctggaggacccaaggctgccacagttcgcgacttcgggacagcccatccctgatctccgggccgtgagcccgaatccccgatgttaccagctcagctgccgatactcccgacgtcacaccccgggacccattcaccctcactcgcagaaagaaaaaaaaatcgccaagaccaaaccattacagtaataccaacgaccgttgactgtggctgtgccgggtactgcgctgagcgtttcgcgcgcattgtcatctcgcgctttccacagtctgataggcgaggtgttatttattacacctatcctacagatgcgcagacccaggctccgggataagcaacttcacaagactggagattagaagctcccacccttccgcgctgcgctccgcgcaatcccaaaccaaaacccagagacaatggtccccgtcgaggacacaccctgaacgctagaatcccttcccgactcggccgtggatacgcccccagccaccaacgctgcaccccgagcctgctgacgcggagacacccgcagagctaggccctgggctcgggacgcccgggcggctgcaaacccggctcggagccgcagcccccaacccacagcacttcccgagtccgctggctggacgcggcggaggcgccccgggggtgcccagcagggcgcggcacgcggcactgcctaccttctgcctgtaggctgcggatgatgtctgccctcggcagcgggtcgcggtagaggctcagcatgtacgccagaggggatggcgacgagggctgcccccgcgtacgcaggagcgcagtggccaccgtcgcagcacccgcctggagtagggcccaccaggcgtgcagaaggaagggcaggcagtgggcgtgcatggtgggctggccaggcctgaaagcagcacctccagcccttatatcctgggcctcagcagccgccccgcccccacctttcc

SEQ ID NO: 104745 - DNA, 150 bp, Homo sapiens; identical to SEQ ID NO: 71621
  chr10:72218318-72218468
  Hyper

SEQ ID NO: 104746 - DNA, 274 bp, Homo sapiens; identical to SEQ ID NO: 71622
  chr10:72238584-72238858
  Hyper

SEQ ID NO: 104747 - DNA, 30 bp, Homo sapiens; identical to SEQ ID NO: 71623
  chr10:72297836-72297866
  Hypo

SEQ ID NO: 104748 - DNA, 748 bp, Homo sapiens
  chr10:72431955-72432703
  Hyper
agagagcaggccctgcggccaagaaagggggcggagcagccatagaaagcggctttgggccaccactccggggatcccaggcgtctgaggggacaatcggtccgtgcgccaggaacccctgctctgtctccgcgtggcacttccgatccccggccgcaggcagctgcactccccagccgcgcgccccgcccccgggcgcccggcgccccagctccgacccgcgcccggccccgccccgcccagtgtgcccacccccggcccgtcccgccgccccgtcgcccggctcccgcggagtcccggagcgtcactgcgcgggcgggctgaccgaccagccggcagttggcaccgggtgcgctggcgcgtcagtggccccgctctccagccggcagcctcgcgcgcccggagccagcggtccaggcggcggcgccgcgcaggggacccggagcaggcgggagggaagcagctaggcggggaggcggctgaggcggcagcggcggcagccagccggtgctccgacagcccggggcgcaccctagcctcgccgccctcagcctgggacttggggatcgggcgcttgcccagcccgcgtcccagcgcggccacatggctccactccgcgcgctgctgtcctacctgctgcctttgcactgtgcgctctgcgccgccgcgggcagccggaccccaggtgcgtgcgggttgggcgcgcgggggcccgtggggtccggggtgcacgcggtcagggtggccc

SEQ ID NO: 104749 - DNA, 148 bp, Homo sapiens; identical to SEQ ID NO: 71630
  chr10:72470413-72470561
  Hypo

SEQ ID NO: 104750 - DNA, 175 bp, Homo sapiens; identical to SEQ ID NO: 71631
  chr10:72489751-72489926
  Hypo

SEQ ID NO: 104751 - DNA, 155 bp, Homo sapiens; identical to SEQ ID NO: 71634
  chr10:72675717-72675872
  Hypo

SEQ ID NO: 104752 - DNA, 30 bp, Homo sapiens; identical to SEQ ID NO: 71636
  chr10:72785075-72785105
  Hypo

SEQ ID NO: 104753 - DNA, 30 bp, Homo sapiens; identical to SEQ ID NO: 71637
  chr10:72799450-72799480
  Hypo

SEQ ID NO: 104754 - DNA, 109 bp, Homo sapiens; identical to SEQ ID NO: 71641
  chr10:72972434-72972543
  Hyper

SEQ ID NO: 104755 - DNA, 136 bp, Homo sapiens; identical to SEQ ID NO: 71642
  chr10:72972814-72972950
  Hyper

SEQ ID NO: 104756 - DNA, 159 bp, Homo sapiens; identical to SEQ ID NO: 71643
  chr10:72973223-72973382
  Hyper

SEQ ID NO: 104757 - DNA, 30 bp, Homo sapiens; identical to SEQ ID NO: 71644
  chr10:72977387-72977417
  Hyper

SEQ ID NO: 104758 - DNA, 82 bp, Homo sapiens; identical to SEQ ID NO: 71645
  chr10:72977625-72977707
  Hyper

SEQ ID NO: 104759 - DNA, 212 bp, Homo sapiens
  chr10:73156149-73156361
  Hyper
aaagccaacagatggcgcgggctcacctaggccgagcgcccgctcgcccgcccgggcttcccgggagcgttacctcgctctgcctgaggcgcggggcggacgagacgctgggggccccatccccctgcgcgcccctctgcgggacggctggcggcctggcggggcactgctctgtctcgcacctggggcctcttccgcgggcttcctccctg

SEQ ID NO: 104760 - DNA, 1317 bp, Homo sapiens
  chr10:73156640-73157957
  Hyper
gggggccgagcggggcgggggaagcaagggaaagttgatcgcggacttgagcggcggcggcggctcgggagagagggacgcgggctgcaggcgcgatgcttggctagaggacgcgtccgacggcggccggacgctgaggtggtcggggctagtcagcccggcctgggcatggagcgcggggtggcagagcctctggacgtttggggcgcgcccagtccgagcccccggcgcgcctgaagttgcgagcggcgagcggcgagcggcgagcggcccgcggagacccaggagctgccggcacgccgcggatgagccttcgcgccggcgggaagacgcggcggtggccagggccagagcaggcggcccgcgggggccgatccggcggagagcagagcccgaggcgaggcgaggcgcggcgccgctgcacacacgcacacggtacccggagccacgcaccgcctcttccctcctcgcttccctctccttcccctcgccgttcgcccgccgcgcggcggggaagttggtggtgaccgcggctgccgaaccacttgttcccagcgcggccatcgcccgtggcgggcgctcgcggcatccttcggtcccaggcccctggccctagcctcgcgccccgctccgagctccccgacgcgcggcaactttgattcctgggaactcgaattccattcgcgttggccttgggaggacaggcatcccatcccccatccccggtcctgggaccgcgaacatttgggggctttgctctcggcgctacggagagggtccaggtctggggtggagagattttcgagagtggagcgcgttgggatccaatcccctccccttctgagccctgggtccccatttggacagtggggatggggtggggcgcacccctactgcgggctgggcagaggcgctgaggggaactaaaggcacgtagttctcccctcccctcatcaagtccctgtgcccgcgggagaccccaggggacttacacatcctcccaaattcggtccagctatgggaagacgcgcccctcgaggagccgggagccttttgcggctctcgcttcgccttcctggccctggaactggtccgctacgagcggtgctggctgcccccaggagctggcacccgggagcactgcccctcatctccaccgtaggtcagcccaggactcgagcagagcccgcgtgttccaaggcagtgacggcgccagccggcggggactctgcctggctttctcggagcgggcacctagagaggctgcctccgtgctgtgagcggagatccgatgccagccgccgccccactgcgacc

SEQ ID NO: 104761 - DNA, 137 bp, Homo sapiens; identical to SEQ ID NO: 71652
  chr10:73429932-73430069
  Hypo

SEQ ID NO: 104762 - DNA, 123 bp, Homo sapiens; identical to SEQ ID NO: 71653
  chr10:73437184-73437307
  Hypo

SEQ ID NO: 104763 - DNA, 350 bp, Homo sapiens; identical to SEQ ID NO: 71654
  chr10:73466313-73466663
  Hypo

SEQ ID NO: 104764 - DNA, 43 bp, Homo sapiens; identical to SEQ ID NO: 71655
  chr10:73468779-73468822
  Hypo

SEQ ID NO: 104765 - DNA, 30 bp, Homo sapiens; identical to SEQ ID NO: 71657
  chr10:73505195-73505225
  Hypo

SEQ ID NO: 104766 - DNA, 30 bp, Homo sapiens; identical to SEQ ID NO: 42614
  chr10:73553133-73553163
  Hypo

SEQ ID NO: 104767 - DNA, 119 bp, Homo sapiens; identical to SEQ ID NO: 71660
  chr10:73723643-73723762
  Hyper

SEQ ID NO: 104768 - DNA, 514 bp, Homo sapiens; identical to SEQ ID NO: 71661
  chr10:73724102-73724616
  Hyper

SEQ ID NO: 104769 - DNA, 30 bp, Homo sapiens; identical to SEQ ID NO: 71662
  chr10:73724940-73724970
  Hyper

SEQ ID NO: 104770 - DNA, 374 bp, Homo sapiens
  chr10:73847007-73847381
  Hyper
ctgatccacaggtgccggtaaacaaaagtgccgcagctacccccccgcccccaccccgcggagttcggcccaaggttacgccggggttcgggcggcgcccgccgggggcccccaaacccagcttctggactctccccggcttctcaagcccaccgggccgggagccttcctctggctccgagctgctcccctcgctccaggctggattcccccctgaaatgttggtccgggaaaaccagcctgggtcctcgcgcgcccttctgcacggggaccccagcccacccccgtacggacacgccttccaccatctcgcctagaaggctgctgggaccccagacccagagccccggtcacactcccgtcccatgctgtcc

SEQ ID NO: 104771 - DNA, 534 bp, Homo sapiens
  chr10:73847688-73848222
  Hyper
ggggggtcccagggccgccggcccgggccgcagggacaggggaggggcgctgggctgtgacccccagtactgtttactttccgtgtaattagccggccaggctgcggagcctcgggctgcgacgtgcggcggccgctcccgcagaccccggagctcaatccccgaacccgcaaccccgggtctctgccttggcagccctgcggactcacgtctcggaagcggttccagtgcttgatcttgccgctgtactgcgagatggacgacagccattgctcgtcctccatgaaattgccgggggtctcgccctccttgagccccttggcgtcgccttcggccagggctgccgcggccaggagcagcagcggcagcaccagccgcccgcagcccggggcgcgcatcgtggtctgggttcgacctgggggggtcttgacttctgcagtattttaatgtccttcctcccaccccgctgctggcgaagcgcacgcggctgtcctcagctctcctcccgcggtctgcctccggtgactggcggag

SEQ ID NO: 104772 - DNA, 19 bp, Homo sapiens
  chr10:73975138-73975157
  Hypo
agagcgagacttcgtctca

SEQ ID NO: 104773 - DNA, 43 bp, Homo sapiens; identical to SEQ ID NO: 71667
  chr10:73976883-73976926
  Hypo

SEQ ID NO: 104774 - DNA, 30 bp, Homo sapiens; identical to SEQ ID NO: 71669
  chr10:74027842-74027872
  Hypo

SEQ ID NO: 104775 - DNA, 36 bp, Homo sapiens; identical to SEQ ID NO: 71672
  chr10:74100577-74100613
  Hypo

SEQ ID NO: 104776 - DNA, 148 bp, Homo sapiens; identical to SEQ ID NO: 71678
  chr10:74451157-74451305
  Hypo

SEQ ID NO: 104777 - DNA, 23 bp, Homo sapiens
  chr10:75011146-75011169
  Hypo
tctttgagatggaatcgccctct

SEQ ID NO: 104778 - DNA, 23 bp, Homo sapiens
  chr10:75011409-75011432
  Hypo
attacaggcgtgagccaccgtgc

SEQ ID NO: 104779 - DNA, 32 bp, Homo sapiens; identical to SEQ ID NO: 71693
  chr10:75118507-75118539
  Hyper

SEQ ID NO: 104780 - DNA, 153 bp, Homo sapiens; identical to SEQ ID NO: 71694
  chr10:75384262-75384415
  Hypo

SEQ ID NO: 104781 - DNA, 288 bp, Homo sapiens
  chr10:75407398-75407686
  Hyper
cagattctgcacccccggcccgaggcttttcatccaggttctgtaccagcgatagcagctcggggttgggcgagttcttcgtctcctcctttcccggccggaacatctgcttccgggtcccccggcgccgggcctcctgcaggatacccgtgcgggcagctggcacagagatgcgctgctcgcgagcgctggggggctcaggagcccctgggcctggggcaggcgcctctgggcgcgcagagggtcgcaaaggcgcagataggaagatagaagcggtggaggtcatgg

SEQ ID NO: 104782 - DNA, 22 bp, Homo sapiens
  chr10:75488953-75488975
  Hypo
gcaatatctagaggccgggcac

SEQ ID NO: 104783 - DNA, 84 bp, Homo sapiens; identical to SEQ ID NO: 42616
  chr10:75501525-75501609
  Hypo

SEQ ID NO: 104784 - DNA, 37 bp, Homo sapiens; identical to SEQ ID NO: 71700
  chr10:75633031-75633068
  Hypo

SEQ ID NO: 104785 - DNA, 30 bp, Homo sapiens; identical to SEQ ID NO: 71701
  chr10:75670725-75670755
  Hyper

SEQ ID NO: 104786 - DNA, 78 bp, Homo sapiens; identical to SEQ ID NO: 71702
  chr10:75808858-75808936
  Hypo

SEQ ID NO: 104787 - DNA, 224 bp, Homo sapiens; identical to SEQ ID NO: 71703
  chr10:75832369-75832593
  Hypo

SEQ ID NO: 104788 - DNA, 30 bp, Homo sapiens; identical to SEQ ID NO: 71704
  chr10:75966942-75966972
  Hypo

SEQ ID NO: 104789 - DNA, 30 bp, Homo sapiens; identical to SEQ ID NO: 71707
  chr10:76511158-76511188
  Hypo

SEQ ID NO: 104790 - DNA, 36 bp, Homo sapiens; identical to SEQ ID NO: 42617
  chr10:76784730-76784766
  Hypo

SEQ ID NO: 104791 - DNA, 33 bp, Homo sapiens; identical to SEQ ID NO: 33144
  chr10:76803629-76803662
  Hyper

SEQ ID NO: 104792 - DNA, 23 bp, Homo sapiens
  chr10:76997760-76997783
  Hypo
accgcacccggccaagaatccat

SEQ ID NO: 104793 - DNA, 248 bp, Homo sapiens
  chr10:77022081-77022329
  Hypo
gggggtattttgtcccgcacataggagaaacaaaaactcactctatttgggaacagggtaattgaatacagatgggaggaggtaaatgaaagaatttagcaaatatctcagtggaatagctaatgggaatgagacagaataggaaattaaaaattattcgaagcagatggaccattctttgagtttttaaaaatttattagggccgcgagaaaatgtgtctgtttattttctgcggccatgaaattaa

SEQ ID NO: 104794 - DNA, 90 bp, Homo sapiens; identical to SEQ ID NO: 71719
  chr10:77159927-77160017
  Hyper

SEQ ID NO: 104795 - DNA, 374 bp, Homo sapiens; identical to SEQ ID NO: 71720
  chr10:77161032-77161406
  Hyper

SEQ ID NO: 104796 - DNA, 68 bp, Homo sapiens; identical to SEQ ID NO: 71721
  chr10:77161623-77161691
  Hyper

SEQ ID NO: 104797 - DNA, 632 bp, Homo sapiens; identical to SEQ ID NO: 71722
  chr10:77162706-77163338
  Hyper

SEQ ID NO: 104798 - DNA, 64 bp, Homo sapiens; identical to SEQ ID NO: 71723
  chr10:77163662-77163726
  Hyper

SEQ ID NO: 104799 - DNA, 123 bp, Homo sapiens; identical to SEQ ID NO: 71724
  chr10:77169095-77169218
  Hyper

SEQ ID NO: 104800 - DNA, 520 bp, Homo sapiens; identical to SEQ ID NO: 33148
  chr10:77191185-77191705
  Hyper

SEQ ID NO: 104801 - DNA, 30 bp, Homo sapiens; identical to SEQ ID NO: 71729
  chr10:77892448-77892478
  Hypo

SEQ ID NO: 104802 - DNA, 187 bp, Homo sapiens; identical to SEQ ID NO: 42620
  chr10:77893300-77893487
  Hypo

SEQ ID NO: 104803 - DNA, 16 bp, Homo sapiens
  chr10:78601007-78601023
  Hypo
ccgccgatgtacatct

SEQ ID NO: 104804 - DNA, 2025 bp, Homo sapiens; identical to SEQ ID NO: 71732
  chr10:79396631-79398656
  Hyper

SEQ ID NO: 104805 - DNA, 146 bp, Homo sapiens; identical to SEQ ID NO: 33151
  chr10:79470925-79471071
  Hyper

SEQ ID NO: 104806 - DNA, 178 bp, Homo sapiens; identical to SEQ ID NO: 71734
  chr10:79491986-79492164
  Hypo

SEQ ID NO: 104807 - DNA, 30 bp, Homo sapiens; identical to SEQ ID NO: 71735
  chr10:79661214-79661244
  Hypo

SEQ ID NO: 104808 - DNA, 30 bp, Homo sapiens
  chr10:79937079-79937109
  Hypo
ttgggctgcttttgacgggggccaccagcc

SEQ ID NO: 104809 - DNA, 197 bp, Homo sapiens; identical to SEQ ID NO: 71739
  chr10:80683494-80683691
  Hypo

SEQ ID NO: 104810 - DNA, 99 bp, Homo sapiens; identical to SEQ ID NO: 71752
  chr10:80909885-80909984
  Hyper

SEQ ID NO: 104811 - DNA, 40 bp, Homo sapiens; identical to SEQ ID NO: 71762
  chr10:81024063-81024103
  Hypo

SEQ ID NO: 104812 - DNA, 30 bp, Homo sapiens; identical to SEQ ID NO: 71763
  chr10:81037768-81037798
  Hypo

SEQ ID NO: 104813 - DNA, 139 bp, Homo sapiens; identical to SEQ ID NO: 71764
  chr10:81070800-81070939
  Hypo

SEQ ID NO: 104814 - DNA, 51 bp, Homo sapiens; identical to SEQ ID NO: 71765
  chr10:81206300-81206351
  Hyper

SEQ ID NO: 104815 - DNA, 30 bp, Homo sapiens; identical to SEQ ID NO: 71766
  chr10:81206959-81206989
  Hypo

SEQ ID NO: 104816 - DNA, 636 bp, Homo sapiens; identical to SEQ ID NO: 71767
  chr10:81664437-81665073
  Hyper

SEQ ID NO: 104817 - DNA, 565 bp, Homo sapiens; identical to SEQ ID NO: 71768
  chr10:81741366-81741931
  Hyper

SEQ ID NO: 104818 - DNA, 409 bp, Homo sapiens; identical to SEQ ID NO: 71769
  chr10:81892268-81892677
  Hyper

SEQ ID NO: 104819 - DNA, 172 bp, Homo sapiens; identical to SEQ ID NO: 71770
  chr10:81921303-81921475
  Hypo

SEQ ID NO: 104820 - DNA, 123 bp, Homo sapiens; identical to SEQ ID NO: 71771
  chr10:81930494-81930617
  Hypo

SEQ ID NO: 104821 - DNA, 25 bp, Homo sapiens
  chr10:81966571-81966596
  Hypo
aacaagctgctggttcgattttcct

SEQ ID NO: 104822 - DNA, 626 bp, Homo sapiens; identical to SEQ ID NO: 71774
  chr10:82116580-82117206
  Hyper

SEQ ID NO: 104823 - DNA, 60 bp, Homo sapiens; identical to SEQ ID NO: 71776
  chr10:82168049-82168109
  Hyper

SEQ ID NO: 104824 - DNA, 239 bp, Homo sapiens; identical to SEQ ID NO: 71777
  chr10:82168477-82168716
  Hyper

SEQ ID NO: 104825 - DNA, 50 bp, Homo sapiens; identical to SEQ ID NO: 71778
  chr10:82383742-82383792
  Hypo

SEQ ID NO: 104826 - DNA, 37 bp, Homo sapiens; identical to SEQ ID NO: 71779
  chr10:82573954-82573991
  Hypo

SEQ ID NO: 104827 - DNA, 30 bp, Homo sapiens; identical to SEQ ID NO: 42625
  chr10:82607464-82607494
  Hypo

SEQ ID NO: 104828 - DNA, 510 bp, Homo sapiens; identical to SEQ ID NO: 71784
  chr10:83633649-83634159
  Hyper

SEQ ID NO: 104829 - DNA, 900 bp, Homo sapiens
  chr10:83634918-83635818
  Hyper
tctcggggggaggggcgtgggggcagggagcggatttgcatgcggccgccgcggccgctgcctgcgcccgagcccgccgccgccgccggagcccgcgcccgcgcccgcgcccggcccgcgcggccccatgcctctgccgcggccctcgggggggcgaaggtgaagaccggctcctaggatgagtgaaggggcggccgctgcctcgccacctggtgccgcttcggcagccgccgcctcggccgaggagggcaccgcggcggctgcggcggcggcagcggcgggcgggggcccggacggcggcggcgaaggggcggccgagcccccccgggagttacgctgtagcgactgcatcgtgtggaaccggcagcagacgtggctgtgcgtggtacctctgttcatcggcttcatcggcctggggctcagcctcatgcttctcaaatggatcgtggtgggctccgtcaaggagtacgtgcccaccgacctagtggactccaaggggatgggccaggaccccttcttcctctccaagcccagctctttccccaaggccatggagaccaccaccactaccacttccaccacgtcccccgccaccccctccgccgggggtgccgcctcctccaggacgcccaaccggattagcactcgcctgaccaccatcacgcgggcgcccactcgcttccccgggcaccgggtgcccatccgggccagcccgcgctccaccacagcacggaacactgcggcccctgcgacggtcccgtccaccacggccccgttcttcagtagcagcacgctgggctcccgacccccggtgccaggaactccaagtacccaggcaatgccctcctggcctactgcggcatacgctacctcctcctaccttcacgattctactccctc

SEQ ID NO: 104830 - DNA, 155 bp, Homo sapiens
  chr10:83636233-83636388
  Hyper
ctgcagacctgctggcgagctgccggatcccgctccagtagagggccagggagggagagagggccttcccgaaggcactgagccccttctccgcccgccggtaggaaggaaagaaagcaaagcacatgcaaattgaccgacgataaaccacaaaa

SEQ ID NO: 104831 - DNA, 76 bp, Homo sapiens; identical to SEQ ID NO: 71794
  chr10:85949225-85949301
  Hypo

SEQ ID NO: 104832 - DNA, 816 bp, Homo sapiens; identical to SEQ ID NO: 71795
  chr10:85954289-85955105
  Hyper

SEQ ID NO: 104833 - DNA, 73 bp, Homo sapiens; identical to SEQ ID NO: 71796
  chr10:86304014-86304087
  Hypo

SEQ ID NO: 104834 - DNA, 82 bp, Homo sapiens; identical to SEQ ID NO: 71797
  chr10:87967280-87967362
  Hypo

SEQ ID NO: 104835 - DNA, 190 bp, Homo sapiens; identical to SEQ ID NO: 71798
  chr10:88055214-88055404
  Hypo

SEQ ID NO: 104836 - DNA, 68 bp, Homo sapiens
  chr10:88123140-88123208
  Hyper
aacctggtggaggagcgctgcagagaagcgccgggctgaggctctgggggccgcggggcgcgaaacgc

SEQ ID NO: 104837 - DNA, 144 bp, Homo sapiens; identical to SEQ ID NO: 71799
  chr10:88124485-88124629
  Hyper

SEQ ID NO: 104838 - DNA, 2188 bp, Homo sapiens
  chr10:88125208-88127396
  Hyper
cccactccccctcggcgcgccccctcctcctctgcgctttcatcttctctcccggttctctctctctatccatctcttcccgctcagcatccccctaccccccgctgcccacgcttcttccctcggctcccaccacccagaccgtctgggcccccaagacttggaccacgcaaaactctaggactgtccaggatggggatgcagtcgccacaaccagatacacacgcactcacacatacaccaagggctacacagacacacaccggagaagcaggcagacactgtgtccactctaacaggctgacagacagtcgtgcacgcaccaacacacgctcagatggccccacacaccccaacaccctctcacagtaacaccgacaccgtgccaggcgcacacagcgacacacgctgacaacacgcacccacacacattcacacacggttccggtccggcctctttgatcttgccctgccaacttggcgagccccccgctgtacctccccctgccccccgctgctctgagctgcgcagaagggccctcccgacccgccgacggccccgctaagggcgcgggtctcgacgcgcgtccatcccggtgttccccgaagcgtcggccctaagtgtcggtagaggccgcggggccccgcgcggagatcggagccccggggagcggcaagcagccagcgggagcgcggcgcggccggtgcacagctcctccgccgggcggcgcggcgcggcccttcgggggagcaccgcccgccgagcccctcggcccagggaaacgccaagtttggacgccgcgcaccccctgccccgttggggcccccgcccagcctcggcccggcctccagccgcgcttaccgatgtggatgatggagtcggcccgcaccgacacgcactggcatatccaggggagaagccacagcgtcagcgcttccatgtcccccgggcgcgcggctcatccacccgggcccggggcgaggccgagggcagcgcgaagcggggaggcgctggtcccggtgcagtcccgggccgctccccgggagagccgagcccgcccgtgcgtcttcccccgcgcgcccgcccctgcgccctgcgcccgccccagcccagcccagcccagcccagcgcggtcgggctcccgctccggctccggtggcggctgcggcggtgctggcagcttgagcccaggccggcgcggcgggggcggcccgcggctgtggcagcggcgcttcccgcggctagagcggcttcgggggaggctgaggcggtggcggcggcggccgggccggcgtggcggctctgggctggctgtgtgtctgagccccggcgaggagcgaactgcggaggacgccccctcccctccccctccccctcagctccgctccccctcccctccctgcccgcctccctcccctccgcccgcctctctaccacgtgactgcggagcctcagcctcgccgcgcggctctcgcccgctcgcggctcggagggggcgccgggtgctccacgctcccggctcgggggacgctcggagaccggcacagcggcggggaccggcctgggctgcggcgcgccgagctctgacggttcgggcctccttctccggttcgccaggggcgggagaatggaggagggccggccgctaactgccctcgaggggctcccgaagcgccctggcgacctcagcagccgcgcgtctcgggtcatgtccccggccgaaacagaccgttcctcgtggagtgggacctggggagcaagaagagagaccggggcggggcgccgggccaggccccaggacagctggggagccagagggggccggccgccgcaagcatctcagagtagagcccgggccgtgggctcgaaccctggctggccgcgcggacctcggcgggcgcccatcccccgctccatgggcagcgcgctcagccgggagtcgggcaagaggctcggactctgaagcccaattcatggccggaaaccagcgcagccgtgaccgcggcgcctggacgtgaggagccttccaagcggccggcgggctcagactccgaccctgcacggagctttcatgtgcgagcccgggcgaagagcccgctcctcgcggccacagcggaacagggctccctccgcctccggtgcctgcctcgggccggccaccaccaaagagagcgttaagctgttgtg

SEQ ID NO: 104839 - DNA, 359 bp, Homo sapiens; identical to SEQ ID NO: 71803
  chr10:88149287-88149646
  Hyper

SEQ ID NO: 104840 - DNA, 32 bp, Homo sapiens; identical to SEQ ID NO: 71804
  chr10:88280081-88280113
  Hypo

SEQ ID NO: 104841 - DNA, 30 bp, Homo sapiens; identical to SEQ ID NO: 71805
  chr10:88282807-88282837
  Hypo

SEQ ID NO: 104842 - DNA, 457 bp, Homo sapiens; identical to SEQ ID NO: 71806
  chr10:88391908-88392365
  Hyper

SEQ ID NO: 104843 - DNA, 66 bp, Homo sapiens; identical to SEQ ID NO: 71807
  chr10:88414219-88414285
  Hypo

SEQ ID NO: 104844 - DNA, 70 bp, Homo sapiens; identical to SEQ ID NO: 71808
  chr10:88446786-88446856
  Hypo

SEQ ID NO: 104845 - DNA, 30 bp, Homo sapiens; identical to SEQ ID NO: 71809
  chr10:88731103-88731133
  Hyper

SEQ ID NO: 104846 - DNA, 58 bp, Homo sapiens; identical to SEQ ID NO: 71810
  chr10:89419357-89419415
  Hyper

SEQ ID NO: 104847 - DNA, 145 bp, Homo sapiens; identical to SEQ ID NO: 71811
  chr10:89605836-89605981
  Hypo

SEQ ID NO: 104848 - DNA, 77 bp, Homo sapiens; identical to SEQ ID NO: 71812
  chr10:89621759-89621836
  Hyper

SEQ ID NO: 104849 - DNA, 604 bp, Homo sapiens
  chr10:90342630-90343234
  Hyper
gggccttttcccgggcggcggaagtccccgatcacgtgacgaggcgcgccactcggcgcatgggccgcgctacacggccgctcagggagctgagggtatagcgttttcgccttagactttcttgggtgcaggcccacaccacctcagcagcctgcccggcagtcctcttttcccaggttttggcgtttagacaacccacctgagtcctcagccttgtcccacacagcaaggtacaagggaccggacgtctgcctcctcagcagcgcagcgcacaagcttcctgtcatcccggcgcccacgatcagcacctgcgccatggcgagagggagcagcgatccgcgctgagtctctgcggcggggccgttcggcccgggctttctggaaaggcggccgaaccggcgctagcgctctttggttccgtgctccctgggccgacctgggccctgagctttcctccggccggcctgcagggggcggaaaggaggcggccggagctgagaggcccctccgtccttgaggagcaaacctggggctgcggagaaccggggctgtctgtcttctcgctttgggggccgggcgccctgcccctcgcccagaaaagcct

SEQ ID NO: 104850 - DNA, 1661 bp, Homo sapiens; identical to SEQ ID NO: 71816
  chr10:90966508-90968169
  Hyper

SEQ ID NO: 104851 - DNA, 1050 bp, Homo sapiens
  chr10:91294888-91295938
  Hyper
tggtctctattccaccgagaagtctgcatttgaaaaccacaagagatggagatcaaagccgctcgttctccagccacctgcccaaaaactcggccgcagcgcagacccaacccagacagggcaagtgagcacgtgtctccctcccaacccaagctgcgcgccgacgcacccaagttagggtcccaggctcccggcgcgggatgggcgctagggcagcggagaatggagggtccccgtcctcctccagctccaacgacagcgccagcgccccgccgtcccgccgcccttccttgaaggatgcccgtgtcacctgagccaccgcgccctctgcacaaccgtgtcagggagagggaagagggggagccgaggaagcttcttggccagggcgctggggatccgggagcgggggccgccggcgagactgagcccgggacagcccagagctccagcgctccagcgctctgcagcccgcccagagcgcgcagaccacccccatgccccgcccgccctcctgccacacccgcccccagcccggccccgccgcctcctcacctcgccgggaccactgcagccctggcggtagcgcgcggacatgcccccggggcgcacccgccgagccgcgtccctgcgcagtggccccttcccgggccccaggctgcgcgatccgcgcttcggtggggcggggagcggactgggcggaggcgccggcgaggctggggccgggggcctagctggcaacgccgggagagggaagcgtagcgcggaaaatcccagtgctcggccttcgaaatgcaccggctcattcagccccgccagctccgccggggactctgcctggccggcaaagaggatttagcgcggggatccgctctaagtactgtggcttggctaggggcgaggggcgcagcggaggagggacgtctcgcggttatgtaatgcaccggctttctgtgtccccagccaaaccgctctaggactgccggaccctccccgggaagagccatgacccctgacctcggcaagccgaggggagctcggtgttcccaaaaa

SEQ ID NO: 104852 - DNA, 442 bp, Homo sapiens; identical to SEQ ID NO: 71821
  chr10:92617097-92617539
  Hyper

SEQ ID NO: 104853 - DNA, 30 bp, Homo sapiens; identical to SEQ ID NO: 71822
  chr10:92618047-92618077
  Hyper

SEQ ID NO: 104854 - DNA, 75 bp, Homo sapiens; identical to SEQ ID NO: 71823
  chr10:92913398-92913473
  Hypo

SEQ ID NO: 104855 - DNA, 30 bp, Homo sapiens; identical to SEQ ID NO: 71824
  chr10:92993186-92993216
  Hypo

SEQ ID NO: 104856 - DNA, 56 bp, Homo sapiens; identical to SEQ ID NO: 71825
  chr10:93392900-93392956
  Hyper

SEQ ID NO: 104857 - DNA, 24 bp, Homo sapiens
  chr10:93628551-93628575
  Hypo
tttctttttttgagacggagtctc

SEQ ID NO: 104858 - DNA, 24 bp, Homo sapiens
  chr10:93628635-93628659
  Hypo
ctaggttcacgccattcaaggagg

SEQ ID NO: 104859 - DNA, 625 bp, Homo sapiens
  chr10:93647037-93647662
  Hyper
gtaacaccccagggccgcgtgaatagcggggaaggtaacgtgactgcggagctcagggccggcccgggaggggcgcgggcctggccagtgggaaggtcggacgccgaggggcgaaatcaccccaccggcatcagaccaccgcctccattcagcggaggaatgtgggcgggcagaggacgcgcggtcccctcgcccggcgttaaccctgtgcgcgccgggagcttcgcccggagcatcgcagcatcgcgcagcgcccggagcccggggccctcacagctccaccggtgcccggagcatctatctccccgcgggcggtgctgccactcgccacgttcacattcctccacgtgcacgcgtgactcttttggtgttatttttaaaaatctcactatttaatcgccatgtttaccttccccagaaccacatagtctcatcgcaattcaaataatttagaaaacattttaagataatcgtggagcccacgaagccagtgcaacgtaggtggcttcccttgctggaagtcaccgcaccgaggccagaagaaggtagccagcgcccaggcaagcgcttaaaactgcagcctcctccacacctttgcacgtggggaaaccgaagcagaaccctg

SEQ ID NO: 104860 - DNA, 467 bp, Homo sapiens; identical to SEQ ID NO: 71830
  chr10:94180300-94180767
  Hyper

SEQ ID NO: 104861 - DNA, 41 bp, Homo sapiens; identical to SEQ ID NO: 71831
  chr10:94342632-94342673
  Hypo

SEQ ID NO: 104862 - DNA, 507 bp, Homo sapiens
  chr10:94448811-94449318
  Hyper
cttcaatagaaaacacgtgcaaaaccagagagccagactgcgcacagctgcgaccctcaagagccagcagaaaagacacggagcggcccccactggattgaagactgcacagcctctgcccggcgctgtaggacccgggcctccccttgattgctgctcgcagcggcttctgccagcatcctcgcggaagtggcttgagtccgaggcctccaaatgaaaccaggtggagcggccaagagtccgcagcacctgaactccagccatccgaatcccgccgggccgcagctaagggccgccgagcagccctaggaacccagggcactgtcccgctctgagctcgggaaacggccggtgtgacagccagcgccactgttaatccagggagcgcacccaccgaggaggcgtcttaggccagcggcctctgctcccgccgagtcccgctgctccccgcctggaaacagctgctgccaccccgggcccaggcctggacggcgcccccgaatttcg

SEQ ID NO: 104863 - DNA, 1041 bp, Homo sapiens
  chr10:94449685-94450726
  Hyper
aatgtagcgccgcggcgcgggccagcagctctgcgaggggccggagcgcggcggagccatgcagtacccgcaccccgggccggcggcgggcgccgtgggggtgccgctgtacgcgcccacgccgctgctgcaacccgcacacccgacgcccttttacatcgaggacatcctgggccgcgggcccgccgcgcccacgcccgcccccacgctgccgtcccccaactcctccttcaccagcctcgtgtccccctaccggaccccggtgtacgagcccacgccgatccatccagccttctcgcaccactccgccgccgcgctggccgctgcctacggacccggcggcttcgggggccctctgtaccccttcccgcggacggtgaacgactacacgcacgccctgctccgccacgaccccctgggtaaggcggccgggcgagggtgggggcgaggaagcgccacccggcaggtggcagcgcccgggaggccgagggggcgaagggggcaggcggtagacggctgtggcaaaagcgatggaaaagcagctgtcgggcacgcgcggggacgggaggcgcgcggccggggctgaccgcaccgtgactcagattggttttcctgcaccttgcaggcgtcggggcgcgcgggccggcggtagacctcgcggcgagggcagccgtggaccgcgcgtgttacccggggtggggctcccttagcgggagggacggggaaaggggcgtcgaggcgcccctggccggcccccgtggggcagggatcgcagccgggcccgggtggctacggggctggacctggttcaacaggcttgtgcagtgaaagagcctgaccctttccgttcatacaggaaatcttgagttctcgataggagtaaatctggtttcagaagctgttaagtgttttcctggctgcatgaagcagacccttcccccggagtagtgcacgctgctgattattttatcgacatcctcaatacagacaaattcaggaaacactcgacttctgatagccgggatccgtttttctgatatt

SEQ ID NO: 104864 - DNA, 135 bp, Homo sapiens; identical to SEQ ID NO: 71836
  chr10:94451369-94451504
  Hyper

SEQ ID NO: 104865 - DNA, 25 bp, Homo sapiens
  chr10:94603312-94603337
  Hypo
aagcatgcatttggccgggcgcggt

SEQ ID NO: 104866 - DNA, 53 bp, Homo sapiens; identical to SEQ ID NO: 71838
  chr10:94822354-94822407
  Hyper

SEQ ID NO: 104867 - DNA, 48 bp, Homo sapiens
  chr10:94822816-94822864
  Hyper
cagacgggacgccctcggcgcaccccgcgcgtccgtcacctctgctgg

SEQ ID NO: 104868 - DNA, 38 bp, Homo sapiens; identical to SEQ ID NO: 71839
  chr10:94826099-94826137
  Hyper

SEQ ID NO: 104869 - DNA, 904 bp, Homo sapiens
  chr10:94828028-94828932
  Hyper
cgtttccaggtgcctcgtggtcaggctgatctcctcgcctctctgcagggctaccagatccccaagggctggagcgtgatgtatagcatccgggacacgcacgagacggctgcggtgtaccgcagccctcccgaaggcttcgatccagagcgcttcggcgcagcgcgcgaagattcccggggcgcctccagccgcttccattacatcccgttcggcggcggtgcgcgcagctgcctcggccaggagctggcgcaagccgtgctccagctgctagctgtggagctagtgcgcaccgcgcgctgggaactggccacacccgccttccccgccatgcagacggtgcccatcgtgcacccagtggacgggctgcggctctttttccaccccctcacgccttcggttgcggggaatgggctatgcctctgacatgcttgcgctctaggacacggcttggccggtggctatggcgcgcacgcagcgccacccatctgccgctccccattgtagcgtcgcgcgcccactctttcactcgttcaacaatctttcaacaaatgttcgccaaacgcggatgtgtgccggactcgaggaaggaggagggcgagccaccgctgccgcgccagagaagcatctaagcccatgggaagatgccttctgcgctccgcgcccagaggaaggaaaatgtcgtgggccaagcaggaatggagggaatagatagatccccacgaggtgctgcttggcttccccttcccgagccaatccagggagggtgcatggatgggggaaggcgaggtaggggtggcaggggagtgggaatattgcaactcggggacattgcagagacccgacgcacgcggtgggacctgcaacccttgtaaggaagcgggcacgccgtgggcgcaaccct

SEQ ID NO: 104870 - DNA, 778 bp, Homo sapiens
  chr10:94831610-94832388
  Hyper
ttgagctgaacttggcgaggtggccccgcagagttcactcggatgtcacggtccggcctgcaggggtcacaggcgggtcaggcccgaggattgggaatgggccccaggtcacgtccccattcgtcggctttgcacaccggccggaggcgctgtccagaaaggggcggacccgggatttctgagaattacctccagcgcgattggcctggcttcctgcagtggccagaggttggttcgccgtgtttacagccaccaaatcgtttgccggagactgaaaccctgcccagagcctctgaaacactgggcaggttatggggaaacgctgaccccccgaaacactccctgtggcggcgactctggcttggagagtcgctaggattgtgcgggtccctccgacctctgcagatatttcctgatacctccgggtttggggactaccgcgagaagggcaacgcatttaaactctcaggagcagagttttccacctccaagggacgccttccaaggcgtgcggcgtgcttctgccagagacagtgttcagttttaaacaaatgcaggtcattctgtttcattttcggcgccgcaggtgcgttcagcgcccaaacccaggtagcgtgtgaccctgactggtcccgagccgggaagctccggcaggtggagagcagagagagcaggtgcgcgtcccgcagcgtctgagctccgggcattggcagctcagtagcagctgattgtagatgggcaaagtacagaagacttcccagtacggatcccttcaccc

SEQ ID NO: 104871 - DNA, 30 bp, Homo sapiens; identical to SEQ ID NO: 71844
  chr10:94832671-94832701
  Hyper

SEQ ID NO: 104872 - DNA, 623 bp, Homo sapiens; identical to SEQ ID NO: 71845
  chr10:94833026-94833649
  Hyper

SEQ ID NO: 104873 - DNA, 969 bp, Homo sapiens; identical to SEQ ID NO: 71846
  chr10:94834033-94835002
  Hyper

SEQ ID NO: 104874 - DNA, 30 bp, Homo sapiens; identical to SEQ ID NO: 71847
  chr10:95257302-95257332
  Hypo

SEQ ID NO: 104875 - DNA, 81 bp, Homo sapiens; identical to SEQ ID NO: 33196
  chr10:95326983-95327064
  Hyper

SEQ ID NO: 104876 - DNA, 281 bp, Homo sapiens; identical to SEQ ID NO: 71849
  chr10:95361159-95361440
  Hyper

SEQ ID NO: 104877 - DNA, 276 bp, Homo sapiens; identical to SEQ ID NO: 71850
  chr10:95753484-95753760
  Hyper

SEQ ID NO: 104878 - DNA, 82 bp, Homo sapiens; identical to SEQ ID NO: 71851
  chr10:95754132-95754214
  Hyper

SEQ ID NO: 104879 - DNA, 30 bp, Homo sapiens; identical to SEQ ID NO: 71852
  chr10:96157039-96157069
  Hypo

SEQ ID NO: 104880 - DNA, 120 bp, Homo sapiens; identical to SEQ ID NO: 15380
  chr10:96304080-96304200
  Hypo

SEQ ID NO: 104881 - DNA, 30 bp, Homo sapiens; identical to SEQ ID NO: 42632
  chr10:97202907-97202937
  Hypo

SEQ ID NO: 104882 - DNA, 593 bp, Homo sapiens; identical to SEQ ID NO: 71858
  chr10:98129731-98130324
  Hypo

SEQ ID NO: 104883 - DNA, 123 bp, Homo sapiens; identical to SEQ ID NO: 71859
  chr10:98272645-98272768
  Hyper

SEQ ID NO: 104884 - DNA, 30 bp, Homo sapiens; identical to SEQ ID NO: 71860
  chr10:98292766-98292796
  Hypo

SEQ ID NO: 104885 - DNA, 163 bp, Homo sapiens; identical to SEQ ID NO: 71861
  chr10:98398908-98399071
  Hypo

SEQ ID NO: 104886 - DNA, 93 bp, Homo sapiens; identical to SEQ ID NO: 71862
  chr10:98528133-98528226
  Hypo

SEQ ID NO: 104887 - DNA, 78 bp, Homo sapiens; identical to SEQ ID NO: 71863
  chr10:98808749-98808827
  Hypo

SEQ ID NO: 104888 - DNA, 32 bp, Homo sapiens; identical to SEQ ID NO: 71864
  chr10:98944809-98944841
  Hyper

SEQ ID NO: 104889 - DNA, 205 bp, Homo sapiens; identical to SEQ ID NO: 71865
  chr10:98945047-98945252
  Hyper

SEQ ID NO: 104890 - DNA, 274 bp, Homo sapiens; identical to SEQ ID NO: 71866
  chr10:98945472-98945746
  Hyper

SEQ ID NO: 104891 - DNA, 394 bp, Homo sapiens
  chr10:98945806-98946200
  Hyper
cccggcagtcatccatcaatcgaaaagcacacatccagggccaggctcctccccgccctcccccgccgcagcccccctctcccgacgaccactcagcggctgcaagccgcctacagtttcaaaggtggaacctccgaggcgccgtcagcgggcacggggctgcgggggatgggagaagagggaagggggtgtgactcgacccgccaagtcctggctgtacacacacacacacacacacacacacacacacacacacacacacggcgaggatgcgcacatttagacgcacgcaccccggcacccgcggccccagctgctagtccagggtgggagggagatcttattttgccgcttggacgccttcccggggagtcagacccgtttccccccatcc

SEQ ID NO: 104892 - DNA, 71 bp, Homo sapiens; identical to SEQ ID NO: 71869
  chr10:98955979-98956050
  Hyper

SEQ ID NO: 104893 - DNA, 30 bp, Homo sapiens; identical to SEQ ID NO: 71870
  chr10:98986334-98986364
  Hypo

SEQ ID NO: 104894 - DNA, 78 bp, Homo sapiens; identical to SEQ ID NO: 71871
  chr10:99051344-99051422
  Hypo

SEQ ID NO: 104895 - DNA, 272 bp, Homo sapiens; identical to SEQ ID NO: 71872
  chr10:99080175-99080447
  Hyper

SEQ ID NO: 104896 - DNA, 146 bp, Homo sapiens
  chr10:99080838-99080984
  Hyper
gcacgcactgggttgcgggacagagtagccaggttctgccggtgctcggagaagagcgcagtgttttgcaagtgctggagtctcctgaggacacgcgcgtcgccgccaccgcgggtgtgggaaagcgcggacgtgctgggcggctg

SEQ ID NO: 104897 - DNA, 964 bp, Homo sapiens
  chr10:99531097-99532061
  Hyper
cggcgatgcagaggtcgttgtccagggggaacttgtggcagtgcagcatctcaggccaggggaagccgtaggcctccatgagcggcgcgcagccggcgcgcacggcctcgcacagcgagcggcacgggtagatgggccggtcgagacagacgggcgcaaagagcgagcacaggaagacctgcgtatccgagtggcagcgcttggccagcagcggcagccagctgctcgcctgctgcttcacttcggccaggctctcgtgctccagcaggttgggcagccgcatgcgcttgtagcccaccgtgtggcagagcggcaggtcggcagggatgtcaaggcactgcggcggcttggagtaggagcggccgtgcagcggctcggcctgccagccatagtagtcgtactcctcgcagcgcgccggcgcccagtgcagcgcccccagcagcagcgccagcgcggccgtccgcacgcccccccccgccgccgccgcccgcatggctgcgccctctccaggtgcgcgccgcgcagccccccgacgctcggtgcccggcggcccaggtgttccggcgtgcgcccccggccctgactctacccagccgccgccgccgccgccgcggaggtcgcccaggtgggtggcagcctgcgctgcgggcgccccgactgatcctggcgcctcccacctcggggctccagcccgggcctcgccgtgcgccccagccaatctccggccgcctggccccagctccaaggcggggaggcagtgggggcggccctcagcccctcccgcaccctgcccgagcgtcccgcccagcgccaggtcttgcgcccctctcccggctcggctcccctgccgcagccctggcctcgcccagcgtttctccccagggctccctgcctccctgggcattttcctcgaccctcgccttctccatccttcctccttatctctctccgccacagcctctcc

SEQ ID NO: 104898 - DNA, 266 bp, Homo sapiens; identical to SEQ ID NO: 71877
  chr10:99789105-99789371
  Hyper

SEQ ID NO: 104899 - DNA, 1578 bp, Homo sapiens
  chr10:99789599-99791177
  Hyper
gggaagaccacacctcgtccagcataaggcggctagcagctacgccgcgcgcggggctggctcccggagctctctgccacccagcgctgtgcccgggaactcggcttcccaggggaggaagagccagcccgcggggctcttccccagcctggaagcgtaggcactcggccgaggccagtggcttcccaggcccgggtctcagcctggctgactgggagactctcccgatagcccggcacatccctcctcacccgctccgccccctccaggccccagaggccccctcccctgacagctgacctccagtgcgcccccaacactttctctgccagctgctggctgtcgcccccacacatcagctcccacctctccgccacctccaacccggccgccgcctcacccccagcccgcgggggaggctccgcgcgccaatcgagtccagcgcctcccagcaagttaggagcgaagccgccgccttcgcgatcccagtcttcccgggttcccgggcggcgtccccgccacccttgcgggcggatccgggggggcgcgcagagctggagaaactttctccgccttagggtggggggcaccggtgcagatactcacgccggggtcagcgctcggagccatcctcccgctctcggccccgccgcctaggggcgtgggaagcgggcgctcgctgccgcctctgccgccggcgccgccgcctgcttgctcccagccccggtcccgggctggcctcgagcctcccgccccgacgccgcgcgctcgctttatacaactccactcgagcgcgcccggtcttatgtaaaggctggcggaggcccgcagccaatggcgcggcagctggagccgggggcccggggtggggggcgccggcgcggccaatcgcggccccgagagcccggagagccgggcgtggggagggagcgcctccccgcgctgatttaggagccgggattgcggtggcagcagccggcagccaggctggcccggcgcggcgcggcggccactggggtgggcggcggcgaaggcggcggcgagggcgggcgccccccgcgccccgccactgcgtcgcgtaaccttcaggcggcagcgaggcctggcgaggaggggagagggcgcctggctgggcgctgggggccccaggccggagggaagcgagggtccctcgggaggcagcgcagggaaggaacgcgaagggggaggggagggcggcgagccccaggaccccgcggccacccctgcgcgcaggaccgagggtggaggcgggagcggctgcactgccttcccatttccccccaggatagcgatctggcgtcgccgggccgggccaaagcggccgagcgagccgcgctgatggcgagatttcgactacggagctagagccgagccgatctttatccagcctggggacgtgtccgagcacctcccggggactgctcagtatggagagcagggctccgcgacggcccccgcaggcggggagcgggcgagcgcagctcggagatcaggcgcgcagaggcccaggcggctgcgggcagcgccgcttctaccccaccccgtccccaccagcag

SEQ ID NO: 104900 - DNA, 52 bp, Homo sapiens; identical to SEQ ID NO: 70103
  chr10:100027893-100027945
  Hyper

SEQ ID NO: 104901 - DNA, 30 bp, Homo sapiens; identical to SEQ ID NO: 70104
  chr10:100171013-100171043
  Hypo

SEQ ID NO: 104902 - DNA, 84 bp, Homo sapiens; identical to SEQ ID NO: 70105
  chr10:100217160-100217244
  Hypo

SEQ ID NO: 104903 - DNA, 45 bp, Homo sapiens; identical to SEQ ID NO: 70106
  chr10:100504665-100504710
  Hypo

SEQ ID NO: 104904 - DNA, 39 bp, Homo sapiens; identical to SEQ ID NO: 70107
  chr10:100991943-100991982
  Hyper

SEQ ID NO: 104905 - DNA, 698 bp, Homo sapiens
  chr10:100992042-100992740
  Hyper
cacaaacacagcgggtgcttgcttccgctccccaaataaagaatggtaatcaagtttctcaccatcctcatagtttttgagatagtaatccgggcccgggcccccgcggcttttcgccgggttcctcaggttctggaactgcaggaagtcggtccttttgcccccgaagcgcagaaaggcgggcgaaagtccccgggccagggtcaccaagcgcttggagctgcagaggaagagaataagagaggaaaggttcccaggacaggacgagagcgcgtggggcacggagaagggccctcttcctactccctgagggcgacctggccggggctagaggctctgtgcctgccccagccggcagtccacgctggcccttggccgctgccctgcgccccagcccgccctcaccgcccggctctgggggctgtgcctcccgcttccagacgcccgcagcggccccctcccgcagacacccagatcctgatctcctaaaggctacagatagtgtttgttcatagagtgtttgtatggggtgggtgtacgtgctacgagcacggcgctaaagcgcagttgcccggcttctgccactgccaggaaagcgctccgggcggagacgcgctaggcgcgcctacctctggcttccgaccgttgccaaaaacttgtatgctgaaagccggcattgcctccgcagccccaggggc

SEQ ID NO: 104906 - DNA, 1208 bp, Homo sapiens
  chr10:100993487-100994695
  Hyper
tgtaaccagaatggtcgtttggcagaagtctccgggaccgcactccaggacaggcacagtcagggcgtcgcgtgggcctactgtggcaaaggagacgtccgcgcgaatccggtcctggggaaagggcagttccaacaacctttcatccagaagcctgcacagccaatgcgaatgcgccccgccaggacttcttccccgaaaatctgccttccagactcttttctgaggcaggaaagcattaggcgaacaggcagattttttaaaaaaagaaagaaagctggtgggggaaagggggtctgcgcagctgaaggagttcaatgaaagtgggacaagcgttgcggaaaactccgttgcaccctacattcggacgagctcatagacgcgctctgctgcacgaaagagctttcgaagaggaagctgggccgcgcggagctggctgttccgccctcgcggcaaccgcaccaacaggaaccgaaacggcctcggcaagggcagctacagcctctcagtcctccggctacctttcctccacgtggaaggagcgctccacgtggcgcctcccgctacctgccgcgtccgcagacccgacccgggccagggggacaaccccaagagctgagaggcgggcgcacctcaagaagcaaaactcgaatttcgcaaggagtgaaaaatacgaaggacgcacaacggacctggcctcggggcaaagtgggactgagagcgctgagggctcttcgaggggaacccacagctgaggctccaacttgtagggaatttttaaaaactcaacacttggattcgacattgcagaggatttatttcttattttacactgcaactctgtccctgatgggaagggatcgcagttgcctaactgccaaactgcaacaacccgggaagagtgtgagcccaattagattacaagccctagagcaaaggggatcacaaacctccgggtttgctaatctgctggtgcggagttcagatctccgaagcctccctggagtatttctaggactcttaccgcttcccttataacgctgtgaccccagcgaggattttttttttcctttaaagaaaagctaaactgtgcagttaccgcaggagatttaaggaggaggaactggcggggggaggggggcattccgtctataaaaagcgccttacaaagtcctgaagtctggaaatgacagcggaggatataaaat

SEQ ID NO: 104907 - DNA, 980 bp, Homo sapiens; identical to SEQ ID NO: 70113
  chr10:100995730-100996710
  Hyper

SEQ ID NO: 104908 - DNA, 562 bp, Homo sapiens; identical to SEQ ID NO: 70114
  chr10:101088914-101089476
  Hyper

SEQ ID NO: 104909 - DNA, 561 bp, Homo sapiens; identical to SEQ ID NO: 70115
  chr10:101089801-101090362
  Hyper

SEQ ID NO: 104910 - DNA, 313 bp, Homo sapiens; identical to SEQ ID NO: 70116
  chr10:101280172-101280485
  Hyper

SEQ ID NO: 104911 - DNA, 312 bp, Homo sapiens; identical to SEQ ID NO: 70117
  chr10:101283181-101283493
  Hyper

SEQ ID NO: 104912 - DNA, 1140 bp, Homo sapiens
  chr10:101290117-101291257
  Hyper
tcctcaagagacaaccgcttaggcctggcgcaaggtacctggcccgggagcggctggggcggcggaatttggggtagaggggcacccgtgggccggctggtggggaggagacagccccctgcatgagctcacagaggcgccctggtgggctccggcggctgcagagcgtctgtgggcgtgtattggcgatcaggcgctggaggggcgctttgtcctggtcgcagttttaagacctggattgttgggctagatttatgaaaggcctaggagcgaagcgagatgggaagcaagggaatgtaacaaggagaaatgcaggcttcggttggaaactggggagagagagattgtttcgatagcctttctccttttctttttccagaatcatgaaatcaccgaggagaagaaaactggggactagaagagagcagaaacatttcccctgagacagttttgccccggaggtggggtggggaagtggcgctggagctcagcttcctgcttttatgctcggcggccaccgtgatgcacacacactcgaggtccgccaccccgcagtgccgtgcacccctctgcccccacctcggaatttttgtgcccgagcgctcgggatccacggcaaaaccaggcacattcctccctctgcagactcaccgcctggtttgtagacactggtctccgcctggggcgtcaatagtttcaggatttaaagcagaaagacaccgggcgcccctgtggctgaggaatggcggttccagcacaagaccctgcccacagagggtctctccctactgcctgcgggccgccgctaccctaagtactccggggcgcacgtggcccgcgcggcatcccagctccccgggcggacccaggggctgcctctccacaacagttccgctcccttctgcagagccccgcctctcccacctcccgacaggctgttctttctcccttcaaccttgggcacccactcctgtcgccgttgcgggacccgcgtggcagccctccaccctcgtacccactcccagccggtgtcttatgccgctcggaggcaatgtccaccgtccctgcacctttcacctgccccttccaggtgagacgggtctctttcagctccgccatcctgaccgccaaaaaatgctt

SEQ ID NO: 104913 - DNA, 1639 bp, Homo sapiens; identical to SEQ ID NO: 70122
  chr10:101292333-101293972
  Hyper

SEQ ID NO: 104914 - DNA, 1075 bp, Homo sapiens
  chr10:101294528-101295603
  Hyper
cacgaaacgcgcctccgcctgctaagggcgttctttgggtactggggctgtctcagggtcccacagcgccaggagccacaaacgttcccaaaagtccagccatttactaccgcacgctctgcgcagccaccaaaaagggtcacggtgctccaggacaggagccgcggtgcggccgggaacagctaaggacgctgttgtttgcttcttccgcagaaagctgccagctgaagaagtctctagagacggccggagactgcaaggcggcggaggagagcgagaggccgaagccacgcagccgccggaagccccgggtcctcttctcgcaagcccaggtcttcgagctggaacgcaggttcaagcagcagcggtacctgtcggcacccgagcgcgagcacctcgccagcagcctgaagctcacatccactcaggtgaaaatctggttccagaatcgcaggtacaagtgcaagagacagcggcaggacaagtctctggagcttggcgcacacgcgcccccgccgccgccgcgccgcgtggctgtcccggtgctggtgcgggacggcaagccgtgcgtcacgcccagcgcgcaggcctacggcgcgccctacagcgtgggcgccagcgcctactcctacaacagcttccccgcctacggctatgggaactcggccgcggccgccgccgccgccgccgccgccgccgcagcagcggcggcctacagcagcagctatggctgtgcgtacccggcgggcggcggcggcggcggcggcgggacctccgcggcgaccactgccatgcagcccgcctgcagcgcggccggaggcggcccctttgtgaacgtgagcaacctaggaggcttcggcagcggcggcagcgcacagccgttgcaccagggtactgcagccggggccgcgtgcgctcagggcaccttgcagggcatccgggcctggtagggacggggcgggtcacgcggcgggcaccccagcgcagcctggcgccgcgggactgaagctcgagaagggcctgacctaaaggtcaggtcccctcgttaaaaaaatatgtacgtctagctcctcag

SEQ ID NO: 104915 - DNA, 236 bp, Homo sapiens
  chr10:101296564-101296800
  Hyper
agctgtatagacctgcgttcggtcaagtcttgcactctgccccacctcgagggtcgccagggaaaaggaagcctcgctcgcagtcccagctgttggccgcgcgaaggcggctccttccctggctgcagccagggctaccaacgcgcccgggggcgctgcgctgcgccccactgcggccgagctctcccccttggccgccctcccttctcccccggcggccgcggctttatgcggct

SEQ ID NO: 104916 - DNA, 66 bp, Homo sapiens; identical to SEQ ID NO: 70127
  chr10:101297064-101297130
  Hyper

SEQ ID NO: 104917 - DNA, 30 bp, Homo sapiens; identical to SEQ ID NO: 70128
  chr10:101297437-101297467
  Hyper

SEQ ID NO: 104918 - DNA, 499 bp, Homo sapiens; identical to SEQ ID NO: 70129
  chr10:101300095-101300594
  Hyper

SEQ ID NO: 104919 - DNA, 30 bp, Homo sapiens; identical to SEQ ID NO: 70130
  chr10:101363437-101363467
  Hypo

SEQ ID NO: 104920 - DNA, 23 bp, Homo sapiens
  chr10:101493051-101493074
  Hypo
cgagactccgtctcaaaaaaata

SEQ ID NO: 104921 - DNA, 30 bp, Homo sapiens; identical to SEQ ID NO: 70132
  chr10:101780649-101780679
  Hypo

SEQ ID NO: 104922 - DNA, 175 bp, Homo sapiens; identical to SEQ ID NO: 70133
  chr10:101874977-101875152
  Hyper

SEQ ID NO: 104923 - DNA, 77 bp, Homo sapiens; identical to SEQ ID NO: 70134
  chr10:101988087-101988164
  Hypo

SEQ ID NO: 104924 - DNA, 16 bp, Homo sapiens
  chr10:101988404-101988420
  Hypo
ccgtctcaaaaacaaa

SEQ ID NO: 104925 - DNA, 30 bp, Homo sapiens; identical to SEQ ID NO: 70136
  chr10:102282456-102282486
  Hypo

SEQ ID NO: 104926 - DNA, 270 bp, Homo sapiens; identical to SEQ ID NO: 70137
  chr10:102322032-102322302
  Hyper

SEQ ID NO: 104927 - DNA, 33 bp, Homo sapiens; identical to SEQ ID NO: 70138
  chr10:102332594-102332627
  Hypo

SEQ ID NO: 104928 - DNA, 64 bp, Homo sapiens; identical to SEQ ID NO: 70139
  chr10:102413884-102413948
  Hyper

SEQ ID NO: 104929 - DNA, 1276 bp, Homo sapiens
  chr10:102414410-102415686
  Hyper
tgcataagattaagccgaggctctcagctgcgcagcgactcccctccggttcccatgttgtcgaggcatgctgggagtacaagttccgagcgcacggccaggtgaacgcgccgccgccgccgtcgccgcgcgactccccaccccccctagccccctcccgcgggtcccgactggcccaccccggcgggactggtgacgccggcgcggcctgcgcctcccggaaacccaggcagatagcccgggtggaagcggcccggccctggggtcaccatcgcccctcaccccggggttcgacggcggccctggacgtccccgggcccccgtcttcctcctgggccttctctctagtccctggcagctgggagcggccctcccgcccctgcactccttcctgtcgcgctgtggttctgccctctggttgtcgctcccctagccctcccctctttctctctgcagtgtttcttggggctgttgtctttctgtctgtcactctgcgtctcggtctctctggagtccttctgcctctgtcgccctcccccgcctcgctgtgtctccgtgcgggtgcccctgcagctccctggctcgcccggcctgcgtccgtcggtctgtctgcctctcgcggtctcctcggctcccccctccccctctctcccctctcccctctcccggcgctggcggccaccgcactgcagcgcggcaccagcagtctatgacaaaaacattatccttctgctgctaaacaatccaataaacctctccacagggagaaagttaacctcttgtctcttcggctgatgccttcccgcccacgtgactgctgccacagtaaattcaaatcattagtctcctcaccccatcaaaaaacttctattagtaatggagacctcgccggagaccttccgcggagagcgctgccttcccaattcccagtggaaaaattctgcgcgaaaaactaattctacttttaataatctgtcatcaggaccagaggcagtcataaattatatgggagcgcgtgcgagagcgcgccacaagagggaaatcagggcgaaaaatcaaagcccaagtttgacaaactttcctgaagataaataataacttacaaacaggattagttgtaaagtcacgctccggcgcgcagccaccgcggcaatcacgtctgccgagggccgccaccgcgaggcacctgtcaccggccgccaccgcttccgagccttcctcctcgtcctcctccttgcctgcctcccctcctcctcttcctcgccctccagccttc

SEQ ID NO: 104930 - DNA, 715 bp, Homo sapiens
  chr10:102419132-102419847
  Hyper
tcagccccagacccacgcagtgcctcacgctcgcctgccccgcccgctccccgcgggcctgcgcgtgactttagcgcgcgcggctccgcccggaaggtcacctccttcatcacggattctatttgcatccggaatcgcatgtacatgaaaaatgtgtccgcgtgcggccccgactgcagacgcagatgaaattctgtgccgagcctgatgcgcggtaacctttgcagatggcgccgctattgctgagaaatggattgcttaataaagcgtatcatccggcatatttgctgcttggctagccaaatagaagttgttttttgcacaaatttccttgtcaaatttgtcaatgttcatgtcatttttgctttaggtcacagagcaaggtgcaaattcctggcatctttactagttgcagccaatttcggcgatttcggcggtgacggggattctcagaggagccgcgtgcccgtgcgctcccgcctgtcggccccagagagcgcagccctgacacctcctcccggaagcccgccggcccgaccctggtttggaaggagaggctcagggagtgggacagagggtatctctctttccccagcgtccacccccagacgcctcctacccccaaccagggaggttagaggggcagatgggagtacgaggcttacacccagctctcctatgccacttcctctccctaagacgtggccttttcccc

SEQ ID NO: 104931 - DNA, 468 bp, Homo sapiens; identical to SEQ ID NO: 70144
  chr10:102430682-102431150
  Hyper

SEQ ID NO: 104932 - DNA, 163 bp, Homo sapiens; identical to SEQ ID NO: 70145
  chr10:102440854-102441017
  Hyper

SEQ ID NO: 104933 - DNA, 407 bp, Homo sapiens
  chr10:102470039-102470446
  Hyper
gcgcctgatgggaagcgacagctccgccccgcctccctccactcctgccctcccgcggctcctcccgggcgccgcgtcccgcgctcctgctgccagcccagccggcctggggcgccctagccgctggtcctggcccaacaagtagccaccgacccctcccatgtggcctaggacgggaggagcttctgcccggcagttgggggtgacaaggatggggtaaagaggggcgccgggcaggcgcagggcggggggaaggggcagcccacagttggcgctacacgactccgcttctgttttccccgtgttgacatagaaatcagactggaaagaaagcaacatgtagaggggcttccccgggtgtgaggtgacaggtgggttttcctgtctttttgcggatctgtgtctcc

SEQ ID NO: 104934 - DNA, 726 bp, Homo sapiens
  chr10:102473283-102474009
  Hyper
tagaggcgggaactccggatgagaaagagacgagggggccaggatcccagggctggcagcgacaggaaggatgggaagaggtccgcaggcccgacgggtgcgggccagcctggccgcgcagggggagctgggagctgggtgggcggggtggggcggacgccaccaggcgtggcgcggggaacagagcagaatgaaatgcagatgcaaaacgtgctcataagagtttcctctctctccccatctgccaaagccgagattttaatctttaatccatgagcaatcagcgagcagcggcgaatggcacattacagatgttttactgtcgcgggcgctcgcagctttcgcgctcggcacaggcgcgccgggcgcccccgctccgcccgccccctcttctccccctctggttcttcttcctctcccctccccaggtccccgtttaacactatccccctcacctgcacgctcctggcccgcagcggaggtgggactggggagcagggcctgggactccgctggtgggggtacacgcaggggcactggcgggggcggggggcgacggcactcagaattgcgctgaggcaaattccccgccaggtccagattggggggcgcgaggacaggagcatcgagtgcccggatagctgagcccccccactccccatccccttcctggaccccacgtctagggccgctggcggctcctgcgattagcgctccagatgtttg

SEQ ID NO: 104935 - DNA, 699 bp, Homo sapiens
  chr10:102475261-102475960
  Hyper
gagagagtgaatggccgcgtcagccgcaaagaggcccagacagatggacgcaggcaggaagacggacaggagagagagagagacaacgtgcgcccgaggctgaagagctgggtcaagaagagattcggcttccgggagcaggggcgtccgggagggactgcccagggcgccccgctgcccgaagcccagccccgccccagccgccgccggcgccgtctgtcggcagccgccctgggcctaggccgcagggtccacaggcggccctgacaggcggcggcggcggtgagggaagccggagcgagaggcagcggagccgcgtgtgtgtttttattattattatttctgattaaagaggaattcatctcgtatctgcctcctgccaggggccgaggctccgccattggggttaacggtgcggaagaatacaaaaaaatttcattgaggaggattataaaagttactagctggaacattaacagaagagtaacttgtaaaaaatgcaatattacaatattcacaaggacggcagagcgtggtaaagctataaaattcaacattaaaaccttccacagcctagataacctagttaacaaacatgggattggaactacttttctgtggagacaggaatacgcgccggggctggtcacacctcttccgcgggaggggcggggtcggcggccacggcctagccgcgcc

SEQ ID NO: 104936 - DNA, 804 bp, Homo sapiens
  chr10:102483750-102484554
  Hyper
gcggggaggaagggacgaggggagggggctcgatgggggaattgccgggcgggcgctcgggcgctccgagctgcgcggctccccggggagaccgcagacactttgcggagatgttactccggagttggagacgatgataaatatgataatttgtataaaatctgaatgggtcttgttttcagggagaatgccttggatgatgaatgggcccggctttcagatagatggctgataaaaagtgtattggattgttgagagcgattttaattctcattctgtacctgcagatgccgcggccgccgcgcccggcctcctcctccctcctgcccactgcgcggggcggacgccggcccggccggcctcggcggctcaggaggcttctgaaatgactctaattacagagttattaattttaagaggagggtgagcggggggtttatgattattaatcgagcgcccgagctcggcgggcggggcttggcgggccgcgggctagcggcgctcggagtgcggaggacgcgcggggccccggggcggctccaagcccggcgggctccgcggcggcggcgaccaggctcgcttcccacttgggctgcgggcggcatggtccctctgcgcccatccggctctcctcacccctgccagtctccgacccggccgtccaacgtccctccctggccggctcgcctgcgcagccgagcatcaggctccgcgccggggtaggcgagcaggtccccagccccaggcccgcagctgtaggccggtgaggaacagctctgctagagaaagcgcaccccaccccca

SEQ ID NO: 104937 - DNA, 30 bp, Homo sapiens; identical to SEQ ID NO: 33257
  chr10:102489083-102489113
  Hyper

SEQ ID NO: 104938 - DNA, 536 bp, Homo sapiens
  chr10:102489328-102489864
  Hyper
agaagaccctgggaacgggcagaatctgagccgcgtctctgagtcgcagtgggaaggcggctcaggaaatgcgccctccgctggcgctgggtcgcggttctggctgcgttactttttccttgcatctgtggcccggcgcgccagcctggacactagatccgcaagaagggagttttcccagggccggctgaagaatgagaagtccgagctgcggggacgttgggggtctgtgcttagcggccacagcctgcccaccacgggttcccgccaccccgcctccccacctcccttcgcgccagggctgaaagtcccaggcgcccaatgcgtgcccaagaacgagccgtgaaccttttatctacccgtccccttccccgccatggacccaggacgacaccccacacccagacaccactctttccaggggcagatgctccggcgcgccccgcgccctgaagttcaacttggaatccaggtccgcgcgggaccccgcctagcgccccaagcgcacaggctgagcgccccgccctggcctcctg

SEQ ID NO: 104939 - DNA, 67 bp, Homo sapiens; identical to SEQ ID NO: 70160
  chr10:102490249-102490316
  Hyper

SEQ ID NO: 104940 - DNA, 69 bp, Homo sapiens; identical to SEQ ID NO: 70161
  chr10:102490646-102490715
  Hyper

SEQ ID NO: 104941 - DNA, 598 bp, Homo sapiens
  chr10:102495028-102495626
  Hyper
aagttgggaagtaggcgagaagccaggctgtgggtctggaggggggcgtgtgacagtgaagaagagggggttgggtgagagggtgtgccggcgtctaggctgggctgcggtccgtgggcgcctcaggcagcgagggtggctgcttgcctgcggctggctggggcctcggtgcgtgtgcacgcgtgtgcgcggggcggagaacccgggctcctcggggtgccggagcctctgcgcggccgggagtgagagagcgggcgcgggcggagcacacagccgtggcggcgggcggctcgggttatctgagccgcttggtgttgggtggctgcgcccagatctccgggcggcggcggcggcgaaggcgagacgcgttgtcgggccgcggaggagcgggacagccagacccagccccaggacgcggcggccgcggggagcctagcatggaagagcgcgcgggtccggcaggtaagagcggcagagacccgtccgcgccgcaggcgaggactaggggagagggatgggggcggccatggccggggcgggctcctctcctctttcatccctgtgctcagtacccggcgggcgacgtgaaggctgggga

SEQ ID NO: 104942 - DNA, 660 bp, Homo sapiens
  chr10:102497149-102497809
  Hyper
cctgacgggttagggcggccgcttacccggcgcgcgtggcacagcggccagcggcccgactccgcaccgcacttcctttcccttccctcttttcccgcctttgcgggtgcgggtctcgtgttccaggcagcagcagctccgggaaaggcgggggggagctgcggagctgggcaggagacagggctgtgtttgggaaaaggaaaccgcacttcgaggcggctccgcagagcagagctgcagagtcttccgccctcccagccgccttctccctttgcctctttctcttttcaccgccccctccctcatctcttcggtagccacgtttggccggggcacaactccctggaggccctgcccccctagacggccccgagcccttttggacctcatccggctagtttaaaatgacaatgacagaggcgcgtgaccgaacgtgcctgccggacgtcctggcgcaactgccgcagccgggtttgcgaaggatgcgggttttacttagtctcgctgagcctgttccggagcagcgaaaaccatcaggaaagggcgagagaaggaggaaggggattgaatcagcaactagggcaattgtggtcttcagctatcgctgcctatacccccagaacttacaaaaataagccgtttattcgatgccctcccttt

SEQ ID NO: 104943 - DNA, 275 bp, Homo sapiens; identical to SEQ ID NO: 70167
  chr10:102498176-102498451
  Hyper

SEQ ID NO: 104944 - DNA, 41 bp, Homo sapiens; identical to SEQ ID NO: 70168
  chr10:102498723-102498764
  Hyper

SEQ ID NO: 104945 - DNA, 340 bp, Homo sapiens; identical to SEQ ID NO: 70169
  chr10:102498824-102499164
  Hyper

SEQ ID NO: 104946 - DNA, 39 bp, Homo sapiens; identical to SEQ ID NO: 33269
  chr10:102499518-102499557
  Hyper

SEQ ID NO: 104947 - DNA, 30 bp, Homo sapiens; identical to SEQ ID NO: 70171
  chr10:102500820-102500850
  Hyper

SEQ ID NO: 104948 - DNA, 174 bp, Homo sapiens; identical to SEQ ID NO: 33270
  chr10:102501247-102501421
  Hyper

SEQ ID NO: 104949 - DNA, 743 bp, Homo sapiens; identical to SEQ ID NO: 33271
  chr10:102501726-102502469
  Hyper

SEQ ID NO: 104950 - DNA, 739 bp, Homo sapiens; identical to SEQ ID NO: 70174
  chr10:102503828-102504567
  Hyper

SEQ ID NO: 104951 - DNA, 42 bp, Homo sapiens; identical to SEQ ID NO: 70175
  chr10:102504907-102504949
  Hyper

SEQ ID NO: 104952 - DNA, 223 bp, Homo sapiens
  chr10:102505693-102505916
  Hyper
tggctgcagctgcagcgcgagccatgcgcccccagtgcaccccggcccggcccaccgccccggggccattctgctgaccgcccagccccgagccccgacagtggcaagttgcggctactgcagttgcaagctccggccaacccggaggagccccagcggggagcgcagtgctgcgccccccgcccccgcgcgccccgcagcagccgggcgttcactcatcctc

SEQ ID NO: 104953 - DNA, 598 bp, Homo sapiens
  chr10:102507395-102507993
  Hyper
taatcatatatttagcgttgcgggggttggggggggcgtttaaaaatacttctgggataaaatatatttttctaagtaatttccaagcgcaggaaagccgcgccgagggcatcaggcctccgcgggtctcggcgagcgggccggaaagcctcggtccttttcgggaggagtggaaccgggtccacacgccgttttcgcccagccagcctgcctcgcggcccgctgccacagctctcgttctccttttttgcggattccgccgggggtccgccgagtcctggctgcccgcgggcagccactttgaaacccaaaggtttctgcacggccaagcagaggtcggagggagagagccgcagcgcgggcccgcgggccggtggactggtgggtgagacaccgcagcccgagtcggtgctggcggccgtggcgcattccaggcccgactcagcgccgactcgctgcagtcccccagccctggactcccgccgtgtccccttcccatccccaccccttagactggggctgaggggccgggccctgagcccggggaggctgaattattcatctttaatctgcccgcagctgccgccttttcataccg

SEQ ID NO: 104954 - DNA, 1359 bp, Homo sapiens
  chr10:102508280-102509639
  Hyper
cagtccgggccgacccgactcggccgctagaagtctctgcgcttggattgctcagtacctgcggctacgggttgatcgctctgggtgcaggatttctagactgctgtaggccagggagaatggggcacaggaagcaccctcaggcctggcacccagtggccgcctcggttccgagatcgggagcccgcgctggagccgggttggaaaccccgtgcccttctcttggccgaaagagcaaaagcccgagccgctcggtttcctgggggggctgccgaggtctgaggggtcaaagggactcgagtcgggtttgggtcggctacacagggcgccccgagagttattaactcgccagcgaggcctatgccgtgccacctgggcgagacggtgggccccaaccaggctctgcgaggcgcggcaggcaggcgagcccaagcagccggcattctctgcctgctgcctggagccgctctgcctccctgtctctgagcgcagcagaccccgggcccctgcctcatccgccttccttgctctacttcagatactaaggaggtgaaagagagatacggtccccctacagataaataacattagaaaaacttcccatcaaaaacaaacaacacaggaaagaggtagaaaaattccgattacaatttaatactttttaaagaagaggcagagagcaaaggggggtgtgtgtgtcaggcacttatcccctgtctgtgctaggagctcggataaacagtcagccgagcctcgacgcccccaaatcgtccgcctccaagccccgcacgcgcggacagctcccgggttgcctgcggcgcaggcgggatgctgcttcgcactagtccagtcctctgccaggcccttcctctcctcgctttcttacgccctttccgctggcatgaattcccctttggcattttctcccctctcccctcttttctgtcatctggtttctctccagtcccccctttgctttctaccttgcgtcgcaaggcctgagtcgccctctcgcccagcccccagtcttcagcccagcgtctgtgcttccagtccccactcctccgcgtggtcgtggaggtccaccacctttcttctcaagctcgggaacatgcccttccgccctgcctgcttccttcgcccgtcccgggccgcggaccctgactaatggccggtccctgctgtgtgtggggtgttgtgtttttttcttgtctctccccagcagggcacgggggtgtgaaccagctcgggggggtgtttgtgaacggccggcccctacccgacgtggtgaggcagcgcatcgtggagctggcccaccagggtgtgcggccctgtgacatctcccggcagctgcgggtc

SEQ ID NO: 104955 - DNA, 38 bp, Homo sapiens; identical to SEQ ID NO: 70182
  chr10:102585759-102585797
  Hyper

SEQ ID NO: 104956 - DNA, 1031 bp, Homo sapiens
  chr10:102586054-102587085
  Hyper
acacaggagaaagggcgagggggaaacctggaggcctggcctttctcccgcagagggagggaggtagcttccgacgacggctcccaacccacgggccctccgctcaccgctagcggaccagcgggcagtccacctgcgccgcctccatcccctgccgcgtagcccacgcatccaacctcttgagggaaaggcgggagggcggtgtctcccaaaagagctcccacctcttgtgttggcactgcacattgatgccattcttaggactttctgggagaaaaatgtcccgaaggcctttcttcgccaccgccccccactcccatttccacccattaggggccatgcctcctagaaccggagtggcatctataaaggccctggcccccagcgcgacagggtggacgcgccccaatacaaacccttcgtgggtggccgcgagcgcctccgctgggaagccctgggcgggcaccggcccacaggtcccgcccgtgggtgtgcgagcgcgtcggtgcctcccgcctccccgggctctctccacgcggacgcggtgatcgccccacctccgcccggcccgcccgccacggccattaccctgcccgcgacacctgcgcctgagacccggcgggaggagcgggcggagaagccaccggccggactcgtggggtccgccctggcttgcaggcgtctgatccccactccccgaccctcccgcagggagcgagttctccggcaacccgtacagccacccccagtacacggcctacaacgaggcttggagattcagcaaccccgccttactaagtgagtacgccacctggctggccggcggctcagcgcggccgcgcggcttctgggcacggtcccactcccggcgacccgacctctggggacccggccgggccagggggacaggcttgttagtgcagcactgaggcccggggacccctcgaggacgcccgcacctcctgccctcccgtgccctccctggtcgctcgaaggctctgcgccgccctcgccctcggatcccctggagg

SEQ ID NO: 104957 - DNA, 115 bp, Homo sapiens
  chr10:102587306-102587421
  Hyper
ttattattatagtgccgccccccggggctccgcccctgccgctgctgccgctgcctatgaccgccactagttaccgcggggaccacatcaagcttcaggccgacagcttcggcct

SEQ ID NO: 104958 - DNA, 175 bp, Homo sapiens; identical to SEQ ID NO: 70184
  chr10:102588252-102588427
  Hyper

SEQ ID NO: 104959 - DNA, 1291 bp, Homo sapiens
  chr10:102589166-102590457
  Hyper
cgggcgtgccccgcgcgccccgggcggccgaaggccgggccgccccgtcccgccccgtagttgctctttcggtagtggcgatgcgccctgcatgtctcctcacccgtggatcgtgacgactcgaaataacagaaacaaagtcaataaagtgaaaataaataaaaatccttgaacaaatccgaaaaggcttggagtcctcgcccagatctctctcccctgcgagccctttttatttgagaaggaaaaagagaaaagagaatcgtttaagggaacccggcgcccagccaggctccagtggcccgaacggggcggcgagggcggcgagggcgccgaggtccggcccatcccagtcctgtggggctggccgggcagagaccccggacccaggcccaggcctaacctgctaaatgtccccggacggttctggtctcctcggccactttcagtgcgtcggttcgttttgattctttttcttttgtgcacataagaaataaataataataataaataaagaataaaattttgtatgtcactccccatggctccaagtttgtctctccctgtctctgagatgggcctcccctccattggtcgatccccaaaagccccttcaatgatcctcccaactacactcccgctgccacctccaactcctttgccgagacccccttggcggcagctgaaccacggcgaaggccgagactagcctgccctttagtagccaccctcccccacgcaccccggccctggggacaggaagttcttactctccgaaacttcagaataactcctagttaggcgcctatactaggccaactctgtggtcctaccagtacacccgcacccagatttagggtgctggctctcagaacccgaagtctgaggccttctccacgtgggtggaggggtggtcgtctgtcctatctcctccctccgttccctatccagtgcagttgcgcgtgggcgcagcagcaattttatccccgaagtctgcaatgaaacgcgaagaccgcagacgcttgccgcaagtttcctcgctctgcgtttacttctgggcccgaagaatgccccgcagaggccctaggagctggttcatgggacttcacgcgcctccagtgtcttgcggagccccagccccagcaagcagcggctgaaattggtgcgccttgtgctgtggtctgggtgtgtcccggagagggcgcgcaggcgcctatgtctgtcgcggggcggtcggcgggttcctgcataggtatggctttctgttcatctatgtgttcgtctgtatgtccct

SEQ ID NO: 104960 - DNA, 1379 bp, Homo sapiens
  chr10:102890870-102892249
  Hyper
ccgagtcttggtctccgtccctctatctctggctcctgcatctgtctcggcttctggccttcctctccccctcccctcccctccctcgcgctgtcattcaccccgctcctctccgcgcacagccaatggagagacccagtcgaaaccgcgaagctctcttgcaccgggctttttcgcctggtgattgatgtcccagagtcaacagcgagcgagcagccggagcggggaagcagaagccagagaggggaagaatacggcgccccctctctccctcccctcccccttctactttagcctttctgcgcacttcgcttccaagtctccgcgcagccaggagccgctgttgcctcccagcccctgctagctgccccccgagccgagcgcagcgagcgccgccgcccgggccccccggtggggccagggccagcatggagcacctgggtccgcaccacctccacccgggtcacgcagagcccattagcttcggcatcgaccagatcctcaacagcccggaccagggtggctgcatgggacccgcctcgcgcctccaggacggagaatacggccttggctgcttggtcggaggcgcctacacttacggcggcgggggctccgcggccgcgacgggggctggaggagcgggggcctatggtactggaggtcccggcggccccggaggcccggcaggcggcggcggcgcctgcagcatgggtcctctgaccggctcctacaacgtgaacatggccttggcaggcggccccggtcctggcggcggcggcggcagcagcggcggtgccggggcactcagcgctgcgggggtaatccgggtgccggcacacaggccgctcgccggagccgtggcccacccccagcccctggccaccggcttgcccaccgtgccctctgtgcctgccatgccgggcgtcaacaacctcactggcctcaccttcccctggatggagagtaaccgcagatacacaaaggacaggttcacaggtgagtccggcccgcgcgctccccgcctggccgcggcccgggctccgtgctacccctgccccgccgggtggctccccaaagccggttctgcgctccaggtcgcccagctcttcttggtgcttcccccaagttgagccgcccgcccgattctataacgcagactcgccatgcttgaagagttctctcagcctggacccctctctgtctcccgaaggacccctgctcggaggagctctccctggtcccctctccggatccactagccgggtcaggcagagagaaggaggccatagattcaggaccaccttctgcagctactcttggcctgggaatcttagagaaaggggtgcaacgtgaacagtttcttccgtcctggctgctgt

SEQ ID NO: 104961 - DNA, 1706 bp, Homo sapiens
  chr10:102893583-102895289
  Hyper
ctgaggggaggggagcgtgaccattagctcgccttagactgcccctggaggagaggcggcagggaggtggttgggctcgcgggagcccggggccagggaggcctccgtggtagcggcgacggcggcgtcggactggcgggcaggaggaggccgtttcccgccgtgggcttgtcgctgagggctaacgggaggatctcggccctgctcgtgggggttcagctgctgcgctcgctgactcgcggggtgttgggcctgggacgcttcctgacgctctgctgcttgcctctgccgtctgtctgtctcccgctccagtggccctctcacccttcactgtaacacgccgtataggtcacccctatcagaaccggacgccccccaagaagaagaagccgcgcacgtccttcacacgcctgcagatctgcgagctggagaagcgcttccaccgccagaagtacctggcctcggccgagcgcgccgccctggccaaggcgctcaaaatgaccgatgcgcaggtcaaaacctggttccagaaccggcggacaaagtggaggtgagcaagcggggcgggccggccgcccgcgagcggcgcggtctcaggcagctctcggttcattggcctctcgtggggcgcacatactttttccgctcgcggtttctgatcctttcggaggagcgagctcccgctaggcttgcggggagctggaagcaaccgaggccgatagctgggatggggctgaagagccctggctctgttttaccggaggcttcagggctttctggttggcacactctctgccggtgtagacgcggcaggtctattccgccgcttgggcaaacaggcgggttagtgcactccacgcagtccaggctccagggatctgtgagtcctggggagctttttgtttgcgcaaactcttgcttatggaatcctgctctgtcctggagactggatgcagaacagcccgcaccttgttgcagcgctccagccgggctcccggcagagggtctgtggccccagaccgcggccctgctgacggtctcctcccccagacacccggcctttgcgcagccggtccctaccctggaaggagaaaatcaatccgcgccggctgcggcggggtttcgcgggtcccactggaaggggaatcaattaggagcagatgggtgtgtgtgagaaagagaattttccttctcccatagccacaactctagttactacgcaatgggctttttgttttgttttgttttttcacatttacgctcacggacgtgaagcgtccccaacactctcgagcagcctccctctccgcgcgcactgacgctttctccggctgcaccctctggcacgctgcaccctctggcacgctgcaccctcccgcacatctggcccttgcccgccggagtttctcccctagctcaggccccatggggtagcgcgggagagtctgggcgaagtcggcggcgccgagacgggcgggccttggggcaggaggaaggaattggagtttcctctttttctgaacgaaggcgaggaatctgcctgggattccgcctacggggccacaaaggaagccatggccccacgattctaccacaacatttctgacgctgggaaaggagtgggggatgcggcctcagaccttggaacgctaaagagggagccagggctagctcgggggttggggggactccggtttccaaggcct

SEQ ID NO: 104962 - DNA, 1556 bp, Homo sapiens
  chr10:102899140-102900696
  Hyper
ggagggttcagggtccgaagacagcagccagcctttccgccccatccccgcaggcccgcggagtgctcaggttgggccctgacgagctgtgtggagcgtagtgagcaggttctggcggcagcgccgggtctgctgcaggtctcccgcattcaccggctgtggcacccagcgccaggccgcgcaaaatccagaaatagcctccagcacctcagaagtcgtctccctctacctgggcaggtctgctgtcccctctgctcccgcaggactggagccaccgagctcgcgccttcttctcggggtgcgatttctctcctcttttggactcaagatcaatgcttcccggccggcgcagatcacacagcaggaccccaggggagactgtggccttcttcccgcctcccaattccccaagaccgcctctagaggctgctgtgtccggagaactccgagcattttctggacacagattgcctaacagaggaacaggggttaggtggggagcggctggccggcccaaacacagcagccccaagctggctcccaagcctgggctctccacccccgctcccatcctctcttgagcacagttaggcccaacacccctgtcccccaaaacacctcctaccctccctcccccccagcccccatcttcaggaacatcacagggctcacactcactaaccgcggagagcacatgcaggccggagccctcagcccggcagctctcggaccctgcccagctcgacgcggactcatgcagaagaggacattccgcaggtaggtacaatcccagcgctggggcctggggcgtccggggggcggcctttgagcttcccggataccgctcgcctgctcccggagctgttcggccgccggctgcccgggtcgtgcactttcagtagggccccgctgactctcctgcccttgggctaggcctcccggggatgccagactcctggggacgctgggacccgcggcgcggcgggacacgcaggactcccgcctctccgcccggaattcgttgagacggaatctcagcggatcccgcgtccgccgagcgccgcggccagggagaaaggccggtgtggcggctggacccgcaaactccgtcccaagtggggcggaggctggaggggaggggggctgcgagggtcacagtcaaggccaactactcacaacagaaagctcgaaactctccctctacctcccctgccggaaatgacccgtctctgttcaaaaatagaaaaagaacgatcggaataattgttcgcagaggtgccgggagagaaggggaattaacaaacctgcctgcgcggagaggtctgcttccttctttggcttcagaaccgacggcaatcaccaaattcctgcggccagcgagccctgcccctcagatctggccctctggttgagtgggtggcggcctgaggggccccaggaacccaggcagggatggggtcctagaggccctgtgcagtgcggtgggtggcacacagagaatctggctcaacctgttaactataatagcggctttgtgtggccgcatctgtgcttgg

SEQ ID NO: 104963 - DNA, 119 bp, Homo sapiens; identical to SEQ ID NO: 70193
  chr10:102905699-102905818
  Hyper

SEQ ID NO: 104964 - DNA, 249 bp, Homo sapiens
  chr10:102906332-102906581
  Hyper
accccttgcttttcccgacgggctcccggagtctcatttctagaatgaggtgggagacctcgtgactacgcggaggccgccccagggctccgagggcaccgcacagggcaccaggcccttcccagctcaacccgggcccgtcgcggtagtgaattggcgcctgacgattgcgcggcagaggctggcgagcagcgctgggctgaagccgacccggcaccgcgcggcgcccggatccggagctgccagcag

SEQ ID NO: 104965 - DNA, 191 bp, Homo sapiens; identical to SEQ ID NO: 33291
  chr10:102975143-102975334
  Hyper

SEQ ID NO: 104966 - DNA, 325 bp, Homo sapiens; identical to SEQ ID NO: 70197
  chr10:102975555-102975880
  Hyper

SEQ ID NO: 104967 - DNA, 255 bp, Homo sapiens; identical to SEQ ID NO: 70198
  chr10:102976414-102976669
  Hyper

SEQ ID NO: 104968 - DNA, 1297 bp, Homo sapiens; identical to SEQ ID NO: 70199
  chr10:102976994-102978291
  Hyper

SEQ ID NO: 104969 - DNA, 433 bp, Homo sapiens; identical to SEQ ID NO: 70200
  chr10:102978742-102979175
  Hyper

SEQ ID NO: 104970 - DNA, 1773 bp, Homo sapiens
  chr10:102982194-102983967
  Hyper
aagcccaggtgcctccgggttcaggtgactggaaaagccagggcagggtgagtggacttccccggacttggcggctcagagggatggagaggtgggggggggggtccccgcggcgacgggaaggggcggagggtaggcgcgcggccccagctcgtccctttcaggggggactcatgcatcaaacttcaattttccggacgattgaattagtgattttttttctcctgaactaaaatacacttaagtctttgggattaattaccacgttctggtccctcagactggagtattacttatcggagctgcgtctgacaccggcccgacacctcgtaaaatagggaactgcgcctctctgcctcaccccgcgccgctcgccaggccaccaagccgggaaaggcggagcgaggggaagccgaacaagcgggatcggccgtccgcgcgcggaggggttcctagactggagagcagaaactacccgcgtcccgggacttggcaagccccgtcgagccccgggacacaacggggaagggagagacaaagccgagccgcctctcctggccagcccggaaccgaaagtgggtccgtagagagcccagagtcctgggggaacagatgggcaaagggctctaggaggtgatggaactcaggcccgaagggcaggcagcccacaggataccaagccttaacgaactacgccagaagaatgggcgtagggcccacagcccctcacacaacccaggccaagctccctcgtacactcagaccaggagaagaaacagacacgcaatacacaagccccgctcccttggagcctacacttgggcgaacacaccactgctgtttgcagtatcccgagacaggcccggcaggcgtgagctaagaggcctcgggcccgaacttgggatttgaggctctctcacatcgccggtcccagcggcagcgcctgaggcacagccaagaccatccgaggtccccgggccgcgcgcaggtagcagacttcttcagaactgggggagctaaagagagagtgggcttagagcccaggcctccctggatcccagatcctcgcctccgcctacagccaagcccctcagcttttgcccagagctgctgacttcctcgccgcctccctgcgcaatgggacctagagataagccccaagcccgggtgctagtccaggcagagtcgggtgctagtccaggcagagtccagtgctagtccgcggcctcaacagagctgtcggctgggctccggaagcccacccggaacctgatggaggcagcgaattcctcagagcagaggacactgcggagaggctcgaatccacttcccacattgtgcgggaccgagcgcgcagggcgctctcgcgtggcctccttagctcgggttcagccgaggctctcacgtacacttcgttaccccttccccccgccgcagctctggtccttccttccactggctctcttctctggcctatggaaacaacgaactacttttcgcctttcaaggcccgggtcccaagccacctcctctgtgaagccgccaacaccctggtagctgcctctcagtgttttgcaactggcacggccctgtccctcggtccgcttctactagcgctgggggtgctgcgagtcttgcccactagactaggagctccttgagggcaggaaccgaatctgattcgtttccattttcccagcccccctgcgcggcctggcgcagaaaagacgcgcaataaacatttgctgaattgaattgcgttttctccttatt

SEQ ID NO: 104971 - DNA, 236 bp, Homo sapiens
  chr10:102984305-102984541
  Hyper
cccaaagggacccagcggggccaggcccagggccgcgaagcagagagcggccggaggtgccagggccgcttcattgggattcatgagcgtgttgggcgggcggcctggggcttcgggcgcggggcgggggccgagtgggggggtgcgcacggcgggcgcagatgcccgggtgaccgacccgccgtggtccctgcgccgcctttgtgccgaggaggcgcgcgcggggacctaatcca

SEQ ID NO: 104972 - DNA, 2559 bp, Homo sapiens
  chr10:102985096-102987655
  Hyper
ctcacatcaattttgcggagaaagagagcccagcggcccggaggcgggaccccactccggtgacagcggctactcgccagcccagcgacaacaaaagcccggagagaaacccgctctgtccaggaaagtgaaagcggcctcagcccccgccccagccggccttggggcgccgcagacccgagagagtccttgcaagatccatacctctgcccccagcggtgtgccggggtgtggaggcagaattggttaatgttgccagaaattcacaccagctcccagacgcttgggcttacagttccaggtgcccacattgaaattcagcctggccttgatgcctttagcctttggcccccgactccccaaggatgaggccctcggggctagaatcgaaacttgggaacccaaggctccaccccgcgtctgactgagtgatacctgcagcgctcccggggctcagccctgttttcggggagtgcagggagaatgcccttgggtctggggtgggatgcaggaaatgcagggcaagaccccctcccaccctttgttcaacacaaattaatgttgtactgtggtgtgcccccacatacacaggcattttctcccagcatttcacggctcgttttttaccccgacctggcgaagcccgcttctctcccgatttagcagctgcctcaggtttatgggcaagaggcgcctcctcctgctgcttccccctcgcccttcactcttaagcctgtcctgaaaatcccccccaaatctccaaggctagggcgaccggcacgaagagcggcaagaagcccagcctgccgctgcttctcggaaacgggcccaccactcagacacggtcgccgccggttctagtaaaatggcaaagactttatttattggagaaagaggccttgggtacagtctagggaggagaggggaagggaggagcagggaaggggcactcgcagcccactcacatccagccaccctcctctggccaagtcgggtaggagtggggtgttcgaagtggcaagagagacccagagctgtggaggaggtgaggtgagggcttgggtcggcctcctctctgtctctgtcacatgcaaaaaaattctaaaaagagtacaaaataattatagggctttgggttctgttttcgatagttggttggttggatttccccctgcattgtccctaagagccggactccaacagtcagtccgaggaaatgcgggagggagggaggaatcttaaaaacagcattagtgggcattaggaggcagaaatggcatcgaaaacagacttttctctcagagggtggggaggaaagatcgattttgaaacttgcaagtcaggacctgactgcccacctcttcccctcccacatgaggaaaaaaggcccgaggaaatagaagtcaactgcaataaggccgagggaggcgaggaaggagcgggccggtgcattcgccacatgcagagaaaaatcaaaacagccggagctgccactcccctagaccgcagggttagtgttccccgccctggtttctgtctcgccctcagcaaacccggcagcccgagagctttgaaaacatcgaaatctccgagatttaaaaaataataataaaagaaaggaaaaatcaggctgcggtgggaagaacccgctatataggtttaaatatttatatagaagccatacagaattgcacggcgagggcttccggggcggcggaggccgctggtggcggccggcccggccggccagcctgggtttattgcttcgagagggaagaggcggctgccaggagccgagtccggggccggggacaggggaggaggcgggagttggcagaggaggtcccagctcccctcggcggtccggtccgggaggcgttgggctttcgagcgctaggagcccagggcggcggaagacccggggcgccgctcaatcgtccacgtcgatctcttcgtcttcctcgtcctccgagcagtcctggctgctggccggctggtccgtgagcggagaggcaggcgagagctgcagggcgccagcgcccggggccttcggggcgcctggggggaggaccggagagccgggcctcgacttggccctgccgcagccgccgccaccgccggctgtggcctccgagttctgctcgagttcggccagcgccacgatgtccatctgcccgctggggcccagtttcttggcggactctacgtcggccttcatctcctccaggtcccgcttgagcttagcgcgccgattctggaaccaggtgatgacttgcgcgttggtgaggcccagctgctgcgcgatttggtcgcgatcggcgggggacaggtacttctggtatagaaagcgcttttccaattcatagatctggtggttggtgaaggccgtgcgcgactttcgccgcttcttaggggtctgccgctgcccaaagatggtcataccgtcgcggcctgggaggaaaggacagtgtaggctcgcgttgggagagaggaagcccaccctggctctcgcccccgtaactccgtaacccacccaggcctgtccggcctgcagtctac

SEQ ID NO: 104973 - DNA, 418 bp, Homo sapiens; identical to SEQ ID NO: 70208
  chr10:102987947-102988365
  Hyper

SEQ ID NO: 104974 - DNA, 325 bp, Homo sapiens; identical to SEQ ID NO: 70209
  chr10:102988611-102988936
  Hyper

SEQ ID NO: 104975 - DNA, 1125 bp, Homo sapiens; identical to SEQ ID NO: 33305
  chr10:102989172-102990297
  Hyper

SEQ ID NO: 104976 - DNA, 1565 bp, Homo sapiens
  chr10:102996019-102997584
  Hyper
aggtctcactactgtcggggggcgccgggcgcaggccgggcatggggcctgagcttaggccaggtggaaaggtggaaggacctagtggggacagacgaagagaccgaggagccgcccgcccggctaaatggacacaggaaaggcctgagtcaggcttctcataataaataaactgcacgtgaataattcagcagtcgcgcgggggccggttgcatcagcgccgccgccgccgcgcggcgcccaattccccgcggaggggagtagccaattaaggcacttgaaaagggagtcgggtggaagatcccccgcccaccagtatcctggatttacccaggtcgagttcagagagcctccccggtcccaaccccctcgggccccatgggtcagggggccgcctgctgggaagtgctacctcagctaagccgctcaggtgtcccgagactccgggcaagggaagacaggcggcgagacggagccagaataagggatgcggacgtctgacctgtggaaaacccagcatctgcagtgcccagccgcacagggaacgtgggcggcgtggttccaagcacagtgaagacgccaggctcggatctgtgctcagagccgggatccctccgggctgcttcgtcctggccaggactttccttgccctgaagtgaggcgccagggaagctgcagggccctccgccctctctgaactcccacgtacttgggcctctcccagcctttcttggacctgtggaagcaattcctgcaggaccagactcccctgtctccccgcggccccctaggtacactccgtaacttccgaaaccttatttcgtttgagcgaaacccggcccctttggctcttcccacttcccacaagtccctgggttcccgatcctgagggattgcattcatcccatctcacacccaccaacgctcaatccctccagttcctccccagccccttcacttccattaattaggtcgactcccttccttcgccgctccctcctgtccccactcagcctccctacacctatgcggcgagcctcgggccaagacctccgccctggctccgccagtcctgcgggggccggcatgcaccagacctcaaaagggatcttcacgggaattccgcatagccagatcccaagcctccagggaggccaccagccctcccccatcttcttcttcctcctccgtctcctttcctcttccctccgcctctacgtatttctttctattcgtttcttttcgtttggtgaggtgccacccgccacagccctgtcccctagggagaggcctggactaactttgccgtcctcgtggccttagcccggactgtgagtctcgagcggcttccgagaggcagctcgggtgtcttcgcagagacagatgaggtgggctggcgattccctagcctcagatggctctgccaccagccagctctgtgatcctgggtaagtctttcaacctctctgagtcttgacgttggtaaaaggcaggagatttagagaaggtgttgggagactaaatcttttcattcgtttgagaaagggagtcgcctgtgttgggac

SEQ ID NO: 104977 - DNA, 624 bp, Homo sapiens; identical to SEQ ID NO: 70215
  chr10:102998278-102998902
  Hyper

SEQ ID NO: 104978 - DNA, 557 bp, Homo sapiens
  chr10:103043857-103044414
  Hyper
gaggggagcggggagcgaggggcgggggaggggcgcctgcctgcgcacagcagatgttgccgctcctcggatggagctgttaatgtaagtggagtttctgcaatggtaattaggagggccctcattaccctggcggagccggctgagagccgataaagccgagggggagaagggccgacatcagggtaatgggggagcagggccattgaggagctggagccgagccggggaccgctccgcgcgcagctggagcccggcgagagggccgcggaaggggggtgcgaaccggggccggaccccggggaggagccgggaggcgagcggcgaggggcactgcgcggctgggtctgccccggggtttcgcactgcgccgcgggtcgaagtaccgcgagttggccctgactgtctgcaggatgagggtgtcgaggagggttccaggccagcgtgcctgcctcgcctccagcccggggtaaggagatccacggaggcctctgcgcctaaactcaggtggccagacagagttggggcgggaggcgggtatacggaaaggacaccct

SEQ ID NO: 104979 - DNA, 482 bp, Homo sapiens; identical to SEQ ID NO: 70219
  chr10:103051132-103051614
  Hyper

SEQ ID NO: 104980 - DNA, 129 bp, Homo sapiens; identical to SEQ ID NO: 70220
  chr10:103052311-103052440
  Hyper

SEQ ID NO: 104981 - DNA, 95 bp, Homo sapiens; identical to SEQ ID NO: 70221
  chr10:103052659-103052754
  Hyper

SEQ ID NO: 104982 - DNA, 144 bp, Homo sapiens; identical to SEQ ID NO: 70222
  chr10:103106119-103106263
  Hypo

SEQ ID NO: 104983 - DNA, 147 bp, Homo sapiens; identical to SEQ ID NO: 70223
  chr10:103198991-103199138
  Hypo

SEQ ID NO: 104984 - DNA, 199 bp, Homo sapiens; identical to SEQ ID NO: 70224
  chr10:103326517-103326716
  Hyper

SEQ ID NO: 104985 - DNA, 30 bp, Homo sapiens; identical to SEQ ID NO: 70225
  chr10:103533282-103533312
  Hyper

SEQ ID NO: 104986 - DNA, 114 bp, Homo sapiens
  chr10:103534463-103534577
  Hyper
acaagctaccttcagcgcgccttaccgaaggggtcgccgtcctctgccatggcgttgatgcgcttgttggccaggacctgcacgtgcttcccgctggtgcggctgtagagttgg

SEQ ID NO: 104987 - DNA, 600 bp, Homo sapiens; identical to SEQ ID NO: 33318
  chr10:103534896-103535496
  Hyper

SEQ ID NO: 104988 - DNA, 206 bp, Homo sapiens
  chr10:103535710-103535916
  Hyper
cgccgcgggaggacgcgctgagcagggcgcgagcggagagggtgcgggtgcgggaggccggcggcgatcacgacgcggctccgcgggtcccgtggaacgtcgtgctcgccgcgccgcaccgaatcgctgtgcgccgctgccggagccggtggccgctggctgctcgggagccggagcgggcgggagggtcacgggctggcggggtg

SEQ ID NO: 104989 - DNA, 391 bp, Homo sapiens
  chr10:103536127-103536518
  Hyper
cgggaggggcgggggcggccggtctgggcgcctccccctatccccggcctgtcccctcgcgcgctccccggtcccggacgcgcggggatgggggcgcctagggctgcaaactctgcgggccgggagaccccgagcctgggcttccccgaccgcctggagcgcccgagtctggcgggtctgggtctccgcctccgggcccagccgcttccgccgccggctacgcagtggtctccgagccacctactgtgtgtcccgccgggcccctgggagcggccgctaaccatgcagcgaatggctgcgcacccggccctcgcgcagtgcgtgccggtgccacccggaccccgctcccctgtttcggccgcgtgccccgtcctgtcggtctctccagtct

SEQ ID NO: 104990 - DNA, 50 bp, Homo sapiens
  chr10:103539248-103539298
  Hyper
ttgcccagctgtgtccgcggggcgccccaaccggccgagaaactcttggg

SEQ ID NO: 104991 - DNA, 21 bp, Homo sapiens
  chr10:103548965-103548986
  Hypo
gaaaatgaggccaggcgcggt

SEQ ID NO: 104992 - DNA, 79 bp, Homo sapiens; identical to SEQ ID NO: 70234
  chr10:103579758-103579837
  Hypo

SEQ ID NO: 104993 - DNA, 90 bp, Homo sapiens; identical to SEQ ID NO: 70235
  chr10:103599532-103599622
  Hyper

SEQ ID NO: 104994 - DNA, 253 bp, Homo sapiens
  chr10:103603249-103603502
  Hyper
cacccgtgagctggtcgtaggagccgtccaggtctcgggaatcggacaaactctccttgcggccctggccccgcatggcccccggcgccccgctcccgcccgggccgtgggagggggcgccgggtggccgggatagggcgctcacacggcgccccctggcggcctactgtgctgtcggggctggggaagtccgggctgaggctgagtctgggaatgggcccggggtctgaggtctacccggaggtcctggagc

SEQ ID NO: 104995 - DNA, 30 bp, Homo sapiens; identical to SEQ ID NO: 42637
  chr10:103814237-103814267
  Hypo

SEQ ID NO: 104996 - DNA, 18 bp, Homo sapiens
  chr10:103818196-103818214
  Hypo
acacgaagagaaaaccca

SEQ ID NO: 104997 - DNA, 24 bp, Homo sapiens
  chr10:103897018-103897042
  Hypo
ccaggagaccgaacccatgagtgt

SEQ ID NO: 104998 - DNA, 139 bp, Homo sapiens; identical to SEQ ID NO: 70240
  chr10:103930132-103930271
  Hypo

SEQ ID NO: 104999 - DNA, 213 bp, Homo sapiens; identical to SEQ ID NO: 70241
  chr10:103986007-103986220
  Hyper

SEQ ID NO: 105000 - DNA, 43 bp, Homo sapiens; identical to SEQ ID NO: 70242
  chr10:103991502-103991545
  Hyper

SEQ ID NO: 105001 - DNA, 191 bp, Homo sapiens; identical to SEQ ID NO: 70243
  chr10:104000813-104001004
  Hyper

SEQ ID NO: 105002 - DNA, 587 bp, Homo sapiens; identical to SEQ ID NO: 70244
  chr10:104001210-104001797
  Hyper

SEQ ID NO: 105003 - DNA, 30 bp, Homo sapiens; identical to SEQ ID NO: 70245
  chr10:104086676-104086706
  Hypo

SEQ ID NO: 105004 - DNA, 83 bp, Homo sapiens; identical to SEQ ID NO: 70246
  chr10:104160053-104160136
  Hypo

SEQ ID NO: 105005 - DNA, 114 bp, Homo sapiens; identical to SEQ ID NO: 70247
  chr10:104161655-104161769
  Hypo

SEQ ID NO: 105006 - DNA, 276 bp, Homo sapiens; identical to SEQ ID NO: 70248
  chr10:104168609-104168885
  Hyper

SEQ ID NO: 105007 - DNA, 83 bp, Homo sapiens; identical to SEQ ID NO: 70249
  chr10:104169160-104169243
  Hyper

SEQ ID NO: 105008 - DNA, 825 bp, Homo sapiens
  chr10:104170037-104170862
  Hyper
gggccatggagctggcgcctgggaacgggacctgctcacagggagccagaaagcagtttctagctccagctttgcgctaactcgctgccagaccttggaaaagcttagtccctctcaggcccctctccctccgggttcctgcagcgcagcagcaccgggaaggtctttttggctgtccacgcggcgggggagcagtgtggagtgtacccccatccaatccctgtcccgtgcagggacccccgcaactcccgccttccaccccagcgcacactggaggaggggaactgaaggcaaacgcaggggccggggccgcctgctcgcgttttccagagccgggtcccctcccccgccgtgcgcagtcgcgaccgcacgcatgtgcgcatgttccgggagagcctgcgcgtggggcctggggagggggcggtccccaggctgagtcacgagagcccgggcttccgtggcaggagccgggggtcggcaagccccagccctgccctccctccgactctggactccgtcgccgactgggtcctccatccttcccctccagcgacttctaccctgccccgccccccaccttgagcagctccctagggaagtcgccgccatcattgaggccctccaggttcccgatgaagtccccgcaggtcatgcgcttcccgatgttctaaggaagggaacggaggcctgtgagtttggagggcccttggcctcccaggtcctgcatgtctggccaggggtttgttttccggctcctgcccgcccgcctccactcacatggccgtggagatccgtgttgagcagcatgagcgcacaggtcagcgt

SEQ ID NO: 105009 - DNA, 64 bp, Homo sapiens; identical to SEQ ID NO: 70253
  chr10:104416998-104417062
  Hypo

SEQ ID NO: 105010 - DNA, 115 bp, Homo sapiens; identical to SEQ ID NO: 70254
  chr10:104629233-104629348
  Hyper

SEQ ID NO: 105011 - DNA, 167 bp, Homo sapiens; identical to SEQ ID NO: 70255
  chr10:104679009-104679176
  Hyper

SEQ ID NO: 105012 - DNA, 213 bp, Homo sapiens; identical to SEQ ID NO: 70256
  chr10:104758202-104758415
  Hypo

SEQ ID NO: 105013 - DNA, 81 bp, Homo sapiens; identical to SEQ ID NO: 70257
  chr10:104812055-104812136
  Hypo

SEQ ID NO: 105014 - DNA, 124 bp, Homo sapiens; identical to SEQ ID NO: 70258
  chr10:104823124-104823248
  Hypo

SEQ ID NO: 105015 - DNA, 30 bp, Homo sapiens; identical to SEQ ID NO: 70259
  chr10:104835453-104835483
  Hypo

SEQ ID NO: 105016 - DNA, 30 bp, Homo sapiens; identical to SEQ ID NO: 70260
  chr10:104953416-104953446
  Hypo

SEQ ID NO: 105017 - DNA, 1616 bp, Homo sapiens
  chr10:105036450-105038066
  Hyper
gtaactggaaaaacacgacctcgccctcgggaaggctttctgtgcgcctcacctcaggatgagggtgggtgtaggggacacctcccagaaacccctaacctcccagtcggttaaagaagaggggatagggtcaagggatgcgacagagctgtgtggtttccggatgggaaacctcagtcgtttaggcacccctccgctcgagtcacttccgaagcagtcgattcttggggagaagcgctgcggaaaggggcgactccgatgcagatggccctgtcccggcgccccaggtcgtcgcgcgcgcagctgcggtagtcactgcgcctccccgcccccactcctggatgccccccttccctctcccggccagactctgagcaggagctccgcccccagcgcgccgccccagccccggcgccttaaaagccgggcgcaccgccccgccgcgccctgcctgccgcacctctcctttcttctgtagctcgcgttgaagccgcacgtccggccccgatcccggcaccatgagcttcggctcggagcactacctgtgctcctcctcctcctaccgcaaggtgttcggggatggctctcgcctgtccgcccgcctctctggggccggcggcgcgggcggcttccgctcgcagtcgctgtcccgcagcaatgtggcctcctcggccgcctgctcctcggcctcgtcgctcggcctcggcctggcctatcgccggccgccggcgtccgacgggctggacctgagccaggcggcggcgcgcaccaacgagtacaagatcatccgcaccaacgagaaggagcagctgcagggcctcaacgaccgcttcgccgtgttcatcgagaaggtgcatcagctggagacgcagaaccgcgcgttggaggccgagctggccgcgctgcgacagcgccacgctgagccgtcgcgcgtcggcgagctcttccagcgcgagctgcgcgacctgcgcgcgcagctggaggaggccagctcggctcgctcgcaggccctgctggagcgcgacgggctggcggaggaggtgcagcggctgcgggcgcgctgcgaggaggagagccgcggacgcgaaggcgccgagcgcgccctgaaggcgcagcagcgcgacgtggacggcgccacgctggcccgcctggacctggagaagaaggtggagtcgctgctggacgagctggccttcgtacgccaggtgcacgacgaggaggtagccgagctgctggccacgctgcaggcgtcgtcgcaggccgcggccgaggtggacgtgactgtggctaaaccagacctgacctcggctctgagggagatccgcgcccagtatgagtccctggccgctaagaacctgcagtccgcggaagaatggtacaagtccaagtttgccaacctgaacgagcaggcggcgcgcagcaccgaggccatccgggccagccgcgaggagatccacgagtatcggcgccagctgcaggcgcgcaccatcgagatcgagggcctgcgcggggccaacgagtccttggagaggcagatcctggagctggaggagcggcacagtgccgaggtagctggctaccaggtaagggccggggctgggcgtggggaggggtgc

SEQ ID NO: 105018 - DNA, 37 bp, Homo sapiens; identical to SEQ ID NO: 70266
  chr10:105038717-105038754
  Hyper

SEQ ID NO: 105019 - DNA, 171 bp, Homo sapiens; identical to SEQ ID NO: 70267
  chr10:105041598-105041769
  Hyper

SEQ ID NO: 105020 - DNA, 28 bp, Homo sapiens
  chr10:105119651-105119679
  Hypo
aaaattgaacacagccgggcgtggtggc

SEQ ID NO: 105021 - DNA, 40 bp, Homo sapiens; identical to SEQ ID NO: 70269
  chr10:105127036-105127076
  Hypo

SEQ ID NO: 105022 - DNA, 157 bp, Homo sapiens; identical to SEQ ID NO: 70270
  chr10:105155377-105155534
  Hypo

SEQ ID NO: 105023 - DNA, 175 bp, Homo sapiens
  chr10:105344345-105344520
  Hyper
cggcggccgtcgctgcggcgcgaggcggacgacgcgcgcctctcggtgagcctatgcgacctcaacgtgccgggcgcggacggcgacgaggccgcgccggccgccggctgccccatcccgcagaactcactcaactcgcagcacagccgcgcgctgccggcgcagctcgacggcg

SEQ ID NO: 105024 - DNA, 332 bp, Homo sapiens; identical to SEQ ID NO: 70271
  chr10:105413585-105413917
  Hypo

SEQ ID NO: 105025 - DNA, 56 bp, Homo sapiens; identical to SEQ ID NO: 70272
  chr10:105615662-105615718
  Hyper

SEQ ID NO: 105026 - DNA, 30 bp, Homo sapiens; identical to SEQ ID NO: 70273
  chr10:105632567-105632597
  Hypo

SEQ ID NO: 105027 - DNA, 38 bp, Homo sapiens; identical to SEQ ID NO: 70274
  chr10:105725883-105725921
  Hypo

SEQ ID NO: 105028 - DNA, 30 bp, Homo sapiens; identical to SEQ ID NO: 42647
  chr10:105796706-105796736
  Hypo

SEQ ID NO: 105029 - DNA, 30 bp, Homo sapiens; identical to SEQ ID NO: 70276
  chr10:105993190-105993220
  Hypo

SEQ ID NO: 105030 - DNA, 44 bp, Homo sapiens; identical to SEQ ID NO: 70277
  chr10:106014312-106014356
  Hyper

SEQ ID NO: 105031 - DNA, 30 bp, Homo sapiens; identical to SEQ ID NO: 70278
  chr10:106030700-106030730
  Hypo

SEQ ID NO: 105032 - DNA, 55 bp, Homo sapiens; identical to SEQ ID NO: 70279
  chr10:106034596-106034651
  Hyper

SEQ ID NO: 105033 - DNA, 30 bp, Homo sapiens
  chr10:106113431-106113461
  Hyper
tgcccaggtgccagccgcagaagctcctcc

SEQ ID NO: 105034 - DNA, 30 bp, Homo sapiens; identical to SEQ ID NO: 70281
  chr10:106160593-106160623
  Hypo

SEQ ID NO: 105035 - DNA, 80 bp, Homo sapiens; identical to SEQ ID NO: 70282
  chr10:106348683-106348763
  Hypo

SEQ ID NO: 105036 - DNA, 430 bp, Homo sapiens
  chr10:106398552-106398982
  Hyper
ctcctgctcagaggccgcgggaagctgcggggactggatggtgcacctccccagtgcgcataggacttgggagaccacactcctccgggctgtgtgagcctcgggtccgcccagatctcttatactgtggcacctccgcccagagcctgaagagaagagcagcaccgcgtccctcccgaaccccgagcttcggctcgggctgcagcgccgggcctcctccggcaggggcgctgggaactcgcggatggccggctctcgtccagcgcccgatcccgcgcccacctgggcctgcggcgctggaacttttcttaggaatacccgctactccctgtctttggaaacccacagatgccaggacccgcaccattctgggccggacgttgtcgctggcttggttctttggcccagcctcccccgctgctaattgcca

SEQ ID NO: 105037 - DNA, 3519 bp, Homo sapiens
  chr10:106399306-106402825
  Hyper
aactctatctactcccgaaggggaggagcagggctggaggctgtctctctctccctaagcctcctccctcctgcctcctcctttcttaatagctcctcctctagctcctctagtctcagacttttcaacccctagaatcccaggggcttctcggaggcggcgagctacaccacatgtcctggggcctgtaaaccgcagctcgaggtcgtctgtgggtttagctcatttcccttcagcccacctgaagtctccttcttcctacggtcacgaaggatctcagctgcaccaagcgcgcaggctacactcctgcagtagcggattggggaccagataagcccacgcggctcccgcctgagtaccctcttaactggcggccgacactttgaaacaattgagtccgttcagaaacggactggggagagtgagggcacgacctcaaaatcctaggcagcaaaatgaggtctggatcctccctggaagaacagacatctcgactactctctcgccccacctctggccgggaggtcggggcaaggagaatccctcaaccgagaagatctggcaagtccccgatcccaccggggccttccgcctcttttccctcatcccctaggaggctttatcaggttctaaccgcttgtagtgggggccgtgggtgctcggggcgccaagaggagggggctgccgagagcggcctgcctagttctcagcattgcctctttgaccactcgcaggctcctggaaatgcaaacacagcccgtgcgtgatccgcacgcgaccaaaagccgagcgcacacctcccgcccccgccccacttgccatcgctcacactaacgtgcacacatgctcgtgcaaacgcgcacgcacggaaccgcgcgccccctcacacccagccgcgctcccggcccggctcagccaggtgcccccacgcggcagcgcccggtctgcccgccggccccctgcgaacccctcgcctcacgcccgcctgcctgcgcgcacgcacgcgcacgcacgcattccccacgcccccgcgcgggggcgcaggccttgggtggcggggtttggccgggagccggccgggccagggagcggcgagcagagtccagggtgcatcccgcgcttggcttccgtgcgcagcctccccgcgcggaggcacctggctccctctcggctctagaacgcgaacagttggcgttgagcacacaactcctcctccttctcccccgagacccctgtaccctccccgcgcgccatctcccgcccctcataacaggcccgaagagtaaacccccaaacgcgtccagaagcggctcccaactcttcgccgggagcacgttggaggctggatttcggagagactcgggattggggtctattgccggcccctcctggatccggcttgattttcatattttaagaagattttcttattacctttgattactcctttttaccaaatttctggaggagctcagtggggaggattggggggaatctgattttaagaaagaaagcaccgaaggggcaattattaattttcctcgggtttggaatcaccctctggacaagagaacgggcgagcgggagctaggagggaagagtggagaggaccggcgaggcgcgccagccggagccacctccttcccggccgccccctccccactccccctacacacacacgctcgctcgctcgccggcgcgcgcacaccccccgcgccggacccgcacctcggcgggcgccacacactcggcagcccgagccgcggtagccgcagcgggatggaggcggcgcgcacggagcgccccgcaggcaggccgggggcgccgcttgtccggacggggctcctactcttgtcgacgtgggtcctggccggcgccgagatcacttgggacgcgacaggcggtcccggacgcccggcggccccggcttcgcggccaccggcgttgtctccactctcgccgcgggcagtggccagccagtggccggaggagctggcgtcggcgcggagagccgccgtgctggggcgccgggccggaccagagctgctgccccagcagggcggcggcagaggcggtgagatgcaggtggaagccggagggacatcaccggcaggcgagcggcggggccggggcatcccagctcctgccaagcttggcggcgcgaggaggagtcgccgggcgcagcccccaatcacccaggaacgcggggacgcctgggccactgctccggccgatggttccagaggaagccgtccccttgctaagggttcccgggaggaggtgaaggcgccgcgggctggggggtcggcggctgaagacctccggctgcccagcacctccttcgcgctgaccggggactcggcccacaaccaagccatggtgcactggtcgggacacaacagcagcgtgagtacccacccggcggcgggtccgcctgtttcctgacaccgaaggggaatgggggggtgggtgggagcgagggacagatagttgctcgggggtcgaggcgggggacgcctcgacttttcgagataacaggtttgtccgattccccccacgcccccaacaggttaacggagtttgttgttagacgctgtgtgtgtttgtttactggagaccctaggcttcggccgccgggaggggagtggaggaaggggcttcttaaagatgagtgggggagggatctgtgctcactttctccaatacttggcttggagggtcagttttcctgtttgcggggtgcttgaattcttggatgagaaaaagggctgacttggggcgggagccgctgaacagaccgattcctgcggctgccgggctccccctacccccaccccacccccaccccccctcccgtcacgcgaaagggaacccggaaggccattcggactcccagcctcctgctcgcctcggggtcgctgctatccgctccaggcgcgcagtcctccagcccaagagggaggctcggccaagtcggcccccagccttggccttcaggtaaccccggttcctccttcaaagtccagggagcggccctggaaagccgtagcagaggccgtaaaaaaaagtttaaagcgtgaagcgaaattccacacccatccagcgctcatgccacaccgctcgccctcacgcacgcacaggcacacggaagtcgctcagcagaaaactctcgacttcaccattgcgtcctgcgccacaaacggctccctgagcggagttgggtgcctgagcttcctgcacacctctccacccgcttttccccgccaccgggttctcctggacaaggatgtaccgagaggtggcgtcgttgagcccggtctggcctactccggcattccgaactgggcgcccgactgagcatcgcgcctgcctggcagctgcagcggcccgcagcgcgtgcccggaggggctccccctacctcgccggcacccagcgctgtgcagccaagcaaagaaaaggcgggggacaggttcccaccatctccccgacttccctccctcccgcggtccctactagag

SEQ ID NO: 105038 - DNA, 61 bp, Homo sapiens; identical to SEQ ID NO: 70291
  chr10:106440762-106440823
  Hyper

SEQ ID NO: 105039 - DNA, 21 bp, Homo sapiens
  chr10:108522437-108522458
  Hypo
agccaccgtgcccagcctatt

SEQ ID NO: 105040 - DNA, 27 bp, Homo sapiens
  chr10:108561564-108561591
  Hypo
ggcgtgagccaccgtgcccagctagta

SEQ ID NO: 105041 - DNA, 143 bp, Homo sapiens; identical to SEQ ID NO: 42649
  chr10:108578381-108578524
  Hypo

SEQ ID NO: 105042 - DNA, 20 bp, Homo sapiens
  chr10:108755052-108755072
  Hypo
cagagcgagactccatctca

SEQ ID NO: 105043 - DNA, 1110 bp, Homo sapiens
  chr10:108923771-108924881
  Hyper
tgagtctcccgtcagcgcaaacgtggtgctggtcagtctcagctcctccatccggaagcgggtggctttgtccgggtcccgctcccgagtcccaggctcctgctgccctccatctcttagcactccccgggggctccgactcgcgccctctccccgttctgccttctcctgatccgctccgctccgtctcctccggccggagcgtgcagcaaccgccatggatgccccagtgccccgagcccgctccagggatagcgctcggtccccgggggccactgagaacaggggacgcactacgaggggcaggggcgtggcaggagccctgcctggccgcccctggtgggaaaagcccctaggggtcgaggccgagcgtggagcggagctggggtgcggcgaggggcagcaggagccgccgccgcagacgcccggggcgcagaggatcaagagccccgcgccggcgaggagcgcgctcagccgggcttgggagccgccgccggcgccaacttttcccatcgcgggagcgaagagcagcggagagaggggtcccagaacgaaggtggcggcacgagctctgcgctggcggctgtggggggccggcgctcaggaccccaactccatccaagttgcgccgcggtgggggcgggcggaggcggcgccgggcaggtggcggccgcttgcccgggctgggcttgtgccgagcgcgggtccggacggagcgagccgccgccgcgcgggggtggagctgagctgaagtcactggcggagcgggcgcgggcgctggcgggcgacgcgggagggagggcaggcgctgccgggactccgggcgccgcgtcccgcggccgagctgcgctgcgcaccgggtctccgggcgctggaggcgccgccggcgacctcccctcggcctcgcaggcgctgccgccgcctctccccgccgcccactctgcgcccccgcggccgcgggtcccggcgctgagtccgcgcaccctgcccgcgggggcggtcgaccccgggctcccggagcagtcgatgtgtcgggagcttcctattcctgctttattgtttctatgagtctatgttgctgtttccttttttctccgtctttctggtctt

SEQ ID NO: 105044 - DNA, 791 bp, Homo sapiens
  chr10:109674181-109674972
  Hyper
ttcacactccctccccgcttcgctccccgaccccaccccatcaccactctgctactcgcaacgctgcctggtcgcacccaggaaccatctttgtgggtggggttcctcgtctccgcggacaggctgctagtgagccgcagctcctccatccggaagccagggatcttcatcttgccgcggagttccatgctgccgtcgcccccagtcttcagggactttgcgctcccgcaggctcctgctcacctctcccatcgttgggcgctggtggcaccccaggaggagagaggagcagcaggagcccggtctcgcagtgccggcacggacagtactctgggggtctgggccgcgtgccacgaggagcagaggagccaccggagccgcttccgcagacgccctgacacggaggacccagagcgccgcgccgcgccgccgaggaacgcgctcaccggcgccaaattttcccatcccgggagcgagggcggcggcgaagggtccgggacccgaggtggcggcgcggggctctgcgcgggcggctgtgggtgctggagctcaggaccctaactttagcgaagtcgggccgcggcggggcgggtggaggcggcgtgggcaggggctgccgcaggtgcggagtgaggcgccgccacacgggcgggggcaggagtctcaggaactcggcagccgccagcagagcccggtgcgggaccgggagctgccggggcctcagctccgctctccccacagctctccgtggctgcaggttgaggtcgaactgcaagcgccacggaccctgc

SEQ ID NO: 105045 - DNA, 30 bp, Homo sapiens; identical to SEQ ID NO: 70311
  chr10:109675175-109675205
  Hyper

SEQ ID NO: 105046 - DNA, 22 bp, Homo sapiens
  chr10:110168394-110168416
  Hypo
tttgtataaaattaacgggcgg

SEQ ID NO: 105047 - DNA, 22 bp, Homo sapiens
  chr10:110168716-110168738
  Hypo
aaattaacgggcaaaagtgcaa

SEQ ID NO: 105048 - DNA, 410 bp, Homo sapiens
  chr10:110225912-110226322
  Hyper
tctcctgcacctggtcgcggtggcgcgcccccatctcccgctgaaacccagaactttcggttcagcagggctgggaagcagccgccggcgcccacttttcccaccgcgggggcggagaacagcagagaggggtcccagaccgaaggtggcagcgcgtggctctgcgctggcggctgtggggggcaggcgctcaggaccccaattccctccaagttgggccgcggtgggggcgggtggaggtggcgccgggcagctggcggccgctcgctggggctgggtttgtgccgagcgcgagtctggaaggagcgagccgcagccgcgcgggggtggagccgaactgaagtcactggctgagcaggcacgggcgctggcgggcacgcgggaaggagggcggccgatgccaggtctcc

SEQ ID NO: 105049 - DNA, 233 bp, Homo sapiens; identical to SEQ ID NO: 70315
  chr10:110408434-110408667
  Hypo

SEQ ID NO: 105050 - DNA, 786 bp, Homo sapiens
  chr10:110671647-110672433
  Hyper
gtgtcttactccttccgtccagggcattccgcagactcctgctcccttcttcctctccacttgctctcaatagagggcgcgctgggcgaagtaggggcgtggcaggagccccgctccgcggatccaggttgaaattcctccctcctggaatccgaccgtgagcatttctgagcggtggtgaggaggaggccaccaagacacctccctcccgctgtgcaaaggaacgcaggagcccggcgcaggtggtgggcttaccgcgcgcacgcctggctggagaggtgacgccgctgtctgccaacctttcccagcttttcccacgattggagccaagagaggtccccggggatctcagttgggcaattgtaagggaaggagctcaggacactgacttcaagatgaagggggaggtcagcgaagacagttctagggtgggcggcggccgctgacagagcaggagccacagccaccggggcttggagataggagcaagtcgcaggcggagggggctgcgggctggctgcctgggcagcacaggacttgagggagctgcggggactcctggagtctcatcaggccttccagtcgctgtggggaccccggctgcgcgcggatcgcctgcgccactgtccccactgacccgcccgccgggtttgccaattaccagcgccacctggtcccgcacccaaccccacattttctctgtcaagggcttgtttccagggctccaggaactttcaaaatgttattggtgtgtgtcgggggggtggggggcgggggggttgtgtg

SEQ ID NO: 105051 - DNA, 890 bp, Homo sapiens
  chr10:111216345-111217235
  Hyper
agatgtgcagagagtcgcctgtcggagcaaatgtgacgctgattggcttcagctccccagctgcaaatgggtagctttgccggggtttctctcttgagctccaggcactctcaaggatccggttcatgtcttcgccctggcccgcttggtatagggggcgcacaggaagaggccaagaagtggaaagaacctcatctcgatgtcccaagtgacaaagcccccggggctcggggctttggtacagaggagcagcagaagccgccgccgcagacgcccggatgcggaggacccagagcgctgcgcagctgaggagcacctggggagccaccgccggcgccaacttttgccatcccgggagccatagcggcagagagggggtcccggacccgaggtggcagcgaggggctctgctttggcagctgtcggggctggagctcaggaccccaactccagccaagtcgggccgcggcggggcaggcgtaggctgcgcaggcaggggtggccgcgggtgctgagccagtcgccgccgcgcaggcgggcgctggagtctcagctacctggcgcgaccgccagcagcacccagcgcggggccgggagctgctgggggcccaggctccgctctccccaccgctctgcaccgctgccggctgcggacagacccgatgcgccaccaccaccgcagttgccacgacccccatggaatcgctggcgcctccgctccggttctctaacccggcgcactctgggatcccaaagcttgccgtgggttggaggcttcctactctttgtgcgttgaggctttgacctgacccagagcgcagcttatgccctggcttgggcagaaaataatattaattactgatcctttgtgctcccggtcctggcttcct

SEQ ID NO: 105052 - DNA, 30 bp, Homo sapiens; identical to SEQ ID NO: 70326
  chr10:111610387-111610417
  Hypo

SEQ ID NO: 105053 - DNA, 23 bp, Homo sapiens
  chr10:111674541-111674564
  Hypo
cgagactccgtctcaaaaaaaaa

SEQ ID NO: 105054 - DNA, 143 bp, Homo sapiens; identical to SEQ ID NO: 70328
  chr10:111902760-111902903
  Hypo

SEQ ID NO: 105055 - DNA, 30 bp, Homo sapiens; identical to SEQ ID NO: 70329
  chr10:111912926-111912956
  Hypo

SEQ ID NO: 105056 - DNA, 30 bp, Homo sapiens; identical to SEQ ID NO: 70330
  chr10:111921592-111921622
  Hypo

SEQ ID NO: 105057 - DNA, 33 bp, Homo sapiens; identical to SEQ ID NO: 42652
  chr10:111946090-111946123
  Hypo

SEQ ID NO: 105058 - DNA, 23 bp, Homo sapiens
  chr10:111954352-111954375
  Hypo
tgttgtacttttggccgggcgcg

SEQ ID NO: 105059 - DNA, 32 bp, Homo sapiens; identical to SEQ ID NO: 42653
  chr10:111979836-111979868
  Hypo

SEQ ID NO: 105060 - DNA, 30 bp, Homo sapiens; identical to SEQ ID NO: 70334
  chr10:111988079-111988109
  Hypo

SEQ ID NO: 105061 - DNA, 18 bp, Homo sapiens
  chr10:112030553-112030571
  Hypo
aaaaaaggtgttggccgg

SEQ ID NO: 105062 - DNA, 39 bp, Homo sapiens; identical to SEQ ID NO: 70339
  chr10:112079204-112079243
  Hypo

SEQ ID NO: 105063 - DNA, 94 bp, Homo sapiens
  chr10:112257148-112257242
  Hyper
ctataccccacccctcgaggcaaatctccgacgtcctctccttacacgcgcagacctcggtagcgacgggaatccgttccggactcctctgggg

SEQ ID NO: 105064 - DNA, 169 bp, Homo sapiens; identical to SEQ ID NO: 70342
  chr10:112257809-112257978
  Hyper

SEQ ID NO: 105065 - DNA, 77 bp, Homo sapiens; identical to SEQ ID NO: 70343
  chr10:112258331-112258408
  Hyper

SEQ ID NO: 105066 - DNA, 1047 bp, Homo sapiens; identical to SEQ ID NO: 70344
  chr10:112402947-112403994
  Hyper

SEQ ID NO: 105067 - DNA, 338 bp, Homo sapiens; identical to SEQ ID NO: 70345
  chr10:112404226-112404564
  Hyper

SEQ ID NO: 105068 - DNA, 253 bp, Homo sapiens; identical to SEQ ID NO: 33363
  chr10:112431872-112432125
  Hyper

SEQ ID NO: 105069 - DNA, 79 bp, Homo sapiens; identical to SEQ ID NO: 33364
  chr10:112432360-112432439
  Hyper

SEQ ID NO: 105070 - DNA, 30 bp, Homo sapiens; identical to SEQ ID NO: 70348
  chr10:112440386-112440416
  Hypo

SEQ ID NO: 105071 - DNA, 79 bp, Homo sapiens; identical to SEQ ID NO: 42655
  chr10:112524488-112524567
  Hypo

SEQ ID NO: 105072 - DNA, 161 bp, Homo sapiens; identical to SEQ ID NO: 70350
  chr10:112553605-112553766
  Hypo

SEQ ID NO: 105073 - DNA, 88 bp, Homo sapiens; identical to SEQ ID NO: 70351
  chr10:112582575-112582663
  Hypo

SEQ ID NO: 105074 - DNA, 63 bp, Homo sapiens; identical to SEQ ID NO: 70352
  chr10:112590867-112590930
  Hypo

SEQ ID NO: 105075 - DNA, 77 bp, Homo sapiens; identical to SEQ ID NO: 70353
  chr10:112836722-112836799
  Hyper

SEQ ID NO: 105076 - DNA, 32 bp, Homo sapiens; identical to SEQ ID NO: 70354
  chr10:112837138-112837170
  Hyper

SEQ ID NO: 105077 - DNA, 83 bp, Homo sapiens; identical to SEQ ID NO: 15387
  chr10:113623006-113623089
  Hypo

SEQ ID NO: 105078 - DNA, 45 bp, Homo sapiens; identical to SEQ ID NO: 70361
  chr10:113748400-113748445
  Hypo

SEQ ID NO: 105079 - DNA, 39 bp, Homo sapiens; identical to SEQ ID NO: 70366
  chr10:114571159-114571198
  Hypo

SEQ ID NO: 105080 - DNA, 39 bp, Homo sapiens; identical to SEQ ID NO: 70367
  chr10:114571498-114571537
  Hypo

SEQ ID NO: 105081 - DNA, 346 bp, Homo sapiens; identical to SEQ ID NO: 70368
  chr10:114712100-114712446
  Hyper

SEQ ID NO: 105082 - DNA, 43 bp, Homo sapiens; identical to SEQ ID NO: 70370
  chr10:114752064-114752107
  Hypo

SEQ ID NO: 105083 - DNA, 213 bp, Homo sapiens; identical to SEQ ID NO: 42662
  chr10:114829478-114829691
  Hypo

SEQ ID NO: 105084 - DNA, 30 bp, Homo sapiens; identical to SEQ ID NO: 42663
  chr10:115479125-115479155
  Hypo

SEQ ID NO: 105085 - DNA, 43 bp, Homo sapiens; identical to SEQ ID NO: 70375
  chr10:115585285-115585328
  Hypo

SEQ ID NO: 105086 - DNA, 54 bp, Homo sapiens; identical to SEQ ID NO: 70377
  chr10:115803627-115803681
  Hyper

SEQ ID NO: 105087 - DNA, 249 bp, Homo sapiens; identical to SEQ ID NO: 70378
  chr10:115804010-115804259
  Hyper

SEQ ID NO: 105088 - DNA, 748 bp, Homo sapiens
  chr10:115804539-115805287
  Hyper
gacttcgtcaccaaccgggcctacgccatcgcctcgtccgtagtctccttctacgtgcccctgtgcatcatggccttcgtgtacctgcgggtgttccgcgaggcccagaagcaggtgaagaagatcgacagctgcgagcgccgtttcctcggcggcccagcgcggccgccctcgccctcgccctcgcccgtccccgcgcccgcgccgccgcccggacccccgcgccccgccgccgccgccgccaccgccccgctggccaacgggcgtgcgggtaagcggcggccctcgcgcctcgtggccctgcgcgagcagaaggcgctcaagacgctgggcatcatcatgggcgtcttcacgctctgctggctgcccttcttcctggccaacgtggtgaaggccttccaccgcgagctggtgcccgaccgcctcttcgtcttcttcaactggctgggctacgccaactcggccttcaaccccatcatctactgccgcagccccgacttccgcaaggccttccagggactgctctgctgcgcgcgcagggctgcccgccggcgccacgcgacccacggagaccggccgcgcgcctcgggctgtctggcccggcccggacccccgccatcgcccggggccgcctcggacgacgacgacgacgatgtcgtcggggccacgccgcccgcgcgcctgctggagccctgggccggctgcaacggcggggcggcggcggacagcgactcgagcctggacgagc

SEQ ID NO: 105089 - DNA, 34 bp, Homo sapiens; identical to SEQ ID NO: 15388
  chr10:115844821-115844855
  Hypo

SEQ ID NO: 105090 - DNA, 147 bp, Homo sapiens; identical to SEQ ID NO: 70382
  chr10:115999036-115999183
  Hyper

SEQ ID NO: 105091 - DNA, 44 bp, Homo sapiens; identical to SEQ ID NO: 70383
  chr10:116045978-116046022
  Hypo

SEQ ID NO: 105092 - DNA, 162 bp, Homo sapiens; identical to SEQ ID NO: 70384
  chr10:116061168-116061330
  Hypo

SEQ ID NO: 105093 - DNA, 30 bp, Homo sapiens; identical to SEQ ID NO: 70385
  chr10:116064482-116064512
  Hyper

SEQ ID NO: 105094 - DNA, 477 bp, Homo sapiens; identical to SEQ ID NO: 70386
  chr10:116163144-116163621
  Hyper

SEQ ID NO: 105095 - DNA, 30 bp, Homo sapiens; identical to SEQ ID NO: 70387
  chr10:116163889-116163919
  Hyper

SEQ ID NO: 105096 - DNA, 238 bp, Homo sapiens; identical to SEQ ID NO: 70388
  chr10:116164126-116164364
  Hyper

SEQ ID NO: 105097 - DNA, 80 bp, Homo sapiens; identical to SEQ ID NO: 70389
  chr10:116164574-116164654
  Hyper

SEQ ID NO: 105098 - DNA, 72 bp, Homo sapiens; identical to SEQ ID NO: 42665
  chr10:116331126-116331198
  Hypo

SEQ ID NO: 105099 - DNA, 87 bp, Homo sapiens; identical to SEQ ID NO: 70391
  chr10:116391726-116391813
  Hyper

SEQ ID NO: 105100 - DNA, 41 bp, Homo sapiens; identical to SEQ ID NO: 70392
  chr10:116392017-116392058
  Hyper

SEQ ID NO: 105101 - DNA, 205 bp, Homo sapiens; identical to SEQ ID NO: 70393
  chr10:116675455-116675660
  Hypo

SEQ ID NO: 105102 - DNA, 195 bp, Homo sapiens; identical to SEQ ID NO: 33373
  chr10:116852246-116852441
  Hyper

SEQ ID NO: 105103 - DNA, 1378 bp, Homo sapiens
  chr10:116852647-116854025
  Hyper
tttctgctgaagctgcgaagcctgtgtcgatctctcattcgtggggctcccggggcgcggggtgcgggtggggccggggtgcccgcaccggccggggggaagggcacgcgggccacacctggggggcctgtctccagtcagcgcgcgggccaggcggggtgggcgcgcgcgcgtgggggagtccccggtccctgtcaggggcggggcgagaccaaggcgccgggcctgtggggaggagtgtaggcgcgcgcgagggcggggggcggccccacgcatcgtgggctcccggcgctgccgctgcggccggctcgaggcaccggagacagaatggctgccggggcgcccttgaccgccgggcgggcgaggcggggctgaccgccgcctccttgatcgcccccttccacgttgggcgcgcccacttcggggcgcccgctcggcccccgccctcctgggcgcgcggcgctcggagccgaggcagttggcgcgggccgcgggcgaggcggggccgcgcgcggggtcccctcctcctcccggtcaggtcccctcaggagcgccgggcgcagtctgcgcctcccgctccccgcctccggccgggtccgggacgccgcggctgtggggtcggcccgctaaggacaaggtcgggagactgggtggcgatgcccgagtgcgactggaggcagccgagcggaggcgacggcggttgggatctgtccctcctgaccggggagcgggactcggacgggcgccggtgaggaggaggagaagcggcggcggagaggttttctgcggccggaattcccttcaacagcatccctgtcggcgcccgcgagcgcagtctcgccgggcaggggcgccggggaagatggagactgggggccgggcccgcactggtaccccgcagccagcggccccgggggtgtggagggctcggccggcgggcggcggcggcgggggcgcctcctcctggctgctggacgggaacagctggctgctgtgctatggcttcctctacctggcgctctacgcgcaggtgtcccagtccaagccgtgcgagaggaccggctcctgcttctcgggccgctgtgtcaactccacctgcctctgcgacccgggctgggtgggggaccagtgccagcactgccagggcaggttcaagtaagtgccttcgccggaccccgaacctccagccctgcctcgctcccgtcgcggccttccccgcccccctcgcggcctcccccgcccccgtcgctgcctctgatcccccggccgtgagtgaacctcagcgcgcggcgggagcgggcgagagtggggcccgcgccgcgccccctccagccccggggcgccccgggagagctcgggcccgcgcggagccctgacc

SEQ ID NO: 105104 - DNA, 36 bp, Homo sapiens; identical to SEQ ID NO: 70398
  chr10:117011797-117011833
  Hypo

SEQ ID NO: 105105 - DNA, 30 bp, Homo sapiens; identical to SEQ ID NO: 70399
  chr10:117628246-117628276
  Hypo

SEQ ID NO: 105106 - DNA, 409 bp, Homo sapiens
  chr10:118030598-118031007
  Hyper
gccgctcacttcggccgacaggagcaagtctgcggggcagaggggagggagcctgagtgcggcgggcggggaccccggccgcccctgctccgggcgagggcgcgcgcccgggtcagggatgcttgaccagccttcgggggcgccctgctctgggagcgggtccacctctcgaccatccgggagtccattttcccgccccctggaattccagctcctctctcctcctcccgggcccgcaaggaagagtggcgcaggctcagcccgcgggcttcaagggtttgctccagagcctgcgctgcccaccgcgcacgtcggccctccgccccggggcatcctggcctgagcaacgacccgggctcccgggccacccccggctccagccacccgctccgcccggctgaaactcagg

SEQ ID NO: 105107 - DNA, 1883 bp, Homo sapiens
  chr10:118031302-118033185
  Hyper
aaaagcttcaggcagcgccgcgccgccaccgcctccctaacccggggattcgcgatcccattccccaaaaagacacttcttccttccacatccaccacacccgcgccccaattttggtgcggagggcggggtgggctgctgcaagcgaccctaggaaagactcagagggtaagaaagcccgcggcgggcctcgacttacccaagagcggcagcgcgaagtacagggtcgccaggaacatggtgccggcgcggggctggtccccgcccccccaaaaaaatcccgagccgccgctgggtcttgccgagggagctcagcgtgcagcgatccccggacagctgtgctgctctggccgcccaaagttcagctccatccagtgaaagaggaaactccgggtctggcagcagccaccgccgccggcgactcagctccgggatggcgagggcgggaggcggttccgcttttaggggttcaggtccgacccaacctggaagggagggcgcgctttgagatgagagcggagagcgccggagactccccccacagaaccctctcccctcccccgttcccgcctttggggaatttccaacaccggggtgaggacccacccccacccaggtcggggtgcatgtgcgtgttttccaggggccgctgacacggggatggaggtgagggctggagaggtctgaagagggttcctaaagtccaagggggtgtctgttgggttcaacccgagacgctgaacgcaagcaaataaataaataaacggtactttccgagcgtcgcgagcggagcctgcagctgcctggagtccgagccctcggtggcggcggcggcagctccctagccagccctggcgccgaaagagccccttctcccgggaagttggcctccccctcctcgcgtcagccagcgagctcgctcagccgccggccctccccactccgatcgccaatccctagccccagtcgccgccctccttctccccgggactcgtctccctccagaggccgccaagccagggggaaccgatgtcccgactggggctgaaacccggttcctgcgcccctaccccctacccgccgcgcgtcctcggctccctcctgggcgtccgctcctctcacactctcgcccggtgcccaggactcgggcgcttccgcaccccagcccagggcgagcgcgccggcccgcagtcccggcgtgccccggcaggtgcagcccggcgccacgagcgccccccgggccctaaagttgggagacgccagcaaaaagaaaggggtggccggaggaggggggaagaaggagtggggaagagggacgggaagcggcaatgggttcccaaacagaacgaaaaaaactccaaatgccaccaacctggactcaaccgaccgcgtccagctgcggcgaggagccagtttgtttatttacttatttattctttcagggcaatggtgtccccgccccctccttccctttccgggctcactttatctgcgctaggaaaagaaaaaaaagaaaaaaaaatagatgcggtaatcttcgagagctcgaagggccgagttgggccaggacgatttccgagcagagccctcggctcggatgctcgttagggatgttagtggttattggaagcggcgcggagaatggcgtgttccgaggccagatttcttctggccagaggaccctcggcctgctcctgttcccgccgctccgcagctccagctccctcctaagctcgcccgccaggcagccgcagctgcacacgcccgcttgcggtgggacccgcggccggacccgtactcgcgcacaggacacgcagtgttctgcagccggccgcgggtgctgccagacacacacactctctctctctctctctctctctgtc

SEQ ID NO: 105108 - DNA, 923 bp, Homo sapiens
  chr10:118033245-118034168
  Hyper
acaagggctctttcttcttagggcaatcgagccagacccttcttcggaacacaaagttttcccccacgtcactagtggctgtgattcaagacttggtgctttcaagacacactcagacccaggacgctggagcggcgatcctgggatgcgcccatccgttcgtccacgccagcgcgtgcacactcacactcacacgcacacatgcacacgcagtctctacctctctcctggagctccgacaaggagacaaaagcggagcccccagcccactgcatttaaacccggccagacctggctttagaaaatttataagctgacctccattttggctgtttcgagagtaaattaacaacaacaaaaaaagcctaacatgtacacagcccttcgccccaacccctgggaccgctggttcccagtcgtgctgctcaccccccgccccccacgcctgacacacgctccccttcccgcacgccggggggcgcccggggcaccgaagtctacactgggtcgggagaccggtctaggagccagccggcagtgctcgggatctttgctgatgtccaagttcatctctcggggagaccgagtttgaatcaaatctgcgtgcgcccagctgtcaaatctgcaaacctatcacgccagacaatgggccgccgcggaggacagacaagaatggctcattttgatcgaggggggtaaattgaaaagggcacgggctttggttgaagtttgaggcccgggtgtcagggcggggagaagaagaggaggaaggaggagggttgggccgctctccattcaaccacacatcagccaggcgcgcccctcggctgcagcggctgcttgcaggcgggctgcatattgtgtggagtcgccaaagagggtctgcgcctcggggcgcgccccaaacccgggggacatcctac

SEQ ID NO: 105109 - DNA, 56 bp, Homo sapiens; identical to SEQ ID NO: 70410
  chr10:118547540-118547596
  Hyper

SEQ ID NO: 105110 - DNA, 261 bp, Homo sapiens; identical to SEQ ID NO: 70411
  chr10:118608457-118608718
  Hyper

SEQ ID NO: 105111 - DNA, 861 bp, Homo sapiens
  chr10:118890913-118891774
  Hyper
tgaactgtctgtgggcggctgctgtgatctcagcaaaaagcggagctcaaggctcagggactccgccgcccacactgtgccccgccttattttggatgcctccaacttcagcttcaggcacagtacacgagtaggggcagtaaggcctggctagggccggtgccgcacgggagctgcgggtccctgcaacacccaggtgtgcaggcgctacaagaaggagccggggccgctgcccccgcagcgcggacttcgccccgtgctgcacacgctttagaagagcgtgtccggaagtgtcctccccggccctcctcgcttcccaagatttgtttgcaacgtctacacccgtcaccaccgcataagcaccagggtgaggaggtctctttgcaggaattaatatcgatttcagtctcctgctccttcaaagtttctctttgacgatggcgagacttatattctaagtcagaagaaaataaaaccttgcctattctgggcccatgattgcacaaaatccaaaatgctgccggcatgaagatgcagctggaagactctagaaacctagcattaggaggcagagactttatagtgcccagagatgagttcctaaataaactaagaattacgcagtgggaaattaaggaggagggtctgaggggccgacctcagagggacagatagagaaatcgagagcgaaacactcaaggaagtggaacaaatcgtcgtagccaggcgtctctgcctctccggaaacccgaaatccgcccaaacctcatcccaggcgctcacggtaccagtcgcagggccccgcactataggggctgccaccctctgcccccggagtccccacgccgagactcatcattt

SEQ ID NO: 105112 - DNA, 2487 bp, Homo sapiens
  chr10:118892013-118894500
  Hyper
gagggggagagtttccgacgtaaataatttacaataaaattactattttaaaaaagtgtttttcgcttgcttcagatggatgaatacattctagacactgcggcacctcgcagtctgggtctgtgattttggttaaaatgtgggtggccgtggctgtagggacgatcgccgctgcgcagggtaaggaaagagggtgtcgcggttcgtgttctgatttgggaccactgaaaccctaagactggggaggcgaggggagtgtctttcctatcaatcacacaagacgctatctggactccgagactactgctagaggaggcccgaccacccagcggcgtccctgcctccccttccgcaaagaactgctcagaaatccagacgtttcctgcgtgcaggaagggttttgtgaatccgggtgtttgggagaggaggcaatgagtgctgactcgttttccaaaccgagcaattgtgcccgaagctacgcgcctgggaggccgtagggtgaagcgccggctgcgcaggctaccgccggcagccgctttgctctttcctggaggagtgggaagctgtcggccaccgccccgaacaggctcggagaaaagattctgaatttcctttgattagcggcgttaccttttcctttgcttttcccccattaaattcctgtttaaagttacaacacccagaaccttaattttgcattgccctgtggggcattctgtatcctgaattttcttacaccttccaaatttcatcattggaagtatttaaaaactggttccacttcatctggttttacgtagcaattgcttttattgctgattagatcaaatttatcagtgtcgttgcctactacgacgtttgttactgtttcctggggtcgggggtggttgtgattggagttgccctaaaggggagaaaaaccgcaggatttgcccgccaggaagctgtgttgtgtaccgactatcccgagaggtccgcaaagcggggcccaggggctcccacaagccctggtttccctggcaagaggaaggaacgtcctccttttttggtctaaagaaacctggaagcccctggggtctgcgcgcagttttcctctttcaaatattcctaggaatagtcggcagcggcagcagccgcagcagccgcggatctagagcaaacgtcctgtgctttggagttagaaccagtcttttccctcctgggctgggcacggggtcagggcatcaggttgactaactcgggcatttttcccaattctttggatcgctcctggattcagaaggaagttgggggttggggaggaatctcagaggaaaggtagtagaaaaaaaaaatagcccgaatgagatgaaattggtagcagagtctagtgggaaaggagagctgtcagaggcctggtgggagccaggagcccagcgcaggagctctgggcacctaatgcgcgtgagtccataaatatcaccacaatagatactataaatataaatacagggaaacacttaaaatcagtccagcgcttttttctcggccccttctttattgttggtccgggagtaaggctcgaaggccgaggagctcagatatcgggcggagagttcttgcaaattcccagctagcgaaccagccattgttaacggggcggaggacaggcggctggcgacggagccgagcagcgagggcaccggcaggctgaagaggctgtggcccgcggccggggcgcctgcgtgcaatccccccggcccggcgggcccgggacctggagcaccgcccacagccggcgggtgcggggatgcagcgcccgctgggcccggggcggcggcggcggctgcggcggccgagcctgcagcggcgcccgcgcccagggccggcaagctgggcccgcgcagcgctgagccgagagcgcccgtggcgcaaggcggcagcagcgcaggcaggccgggcggcgacaacaggcggccctgctccagcagccgtagcacgctgcacgtggccgcggtctccgacaccaccgagcgtagctccgagtccttgccctggtccttcttctgcttggtgcgccggttctggaaccagaccttcacctgcgcgccggggtgcggggagagttggagagaggggcagggaagaccagcgtcaaaggaagcgagctcccggggcgcgcggctccggggctctccccaagtcccagccctatccgcagccccacccagcagccggaggggtccgggccggggcgctgctgggggagctggcgccgccacgagggggacacagctgctccaccgggctgcgcttccgggtcagggaagcaggcccaggcaggcgccgcttacacagaacaaagtaataaaatgcccacggcaggaactcgaaggaagaccggaaagggtttcactggcttccgcgctaccccgcagcggtgtttggggctcacagatgtgtgaatcagtgcagtcccaaagccggaatttccggtggagggtgtga

SEQ ID NO: 105113 - DNA, 1978 bp, Homo sapiens
  chr10:118896177-118898155
  Hyper
aggggagatgtcagccgccagaaccctcccgtccccctccacctccttggcccgagctggatttggggacacagtccccagaagcgtgcagttttggggatggggggcggggtgcggagcgcgaccacaaccaggtagcaaagacactgtgtggagggcaaggggcctaactccataccgctgaccgaaggagggaccacactttgtctttttgtagagtcctccagacaggggagagaaaaaaatccaatcaattccacataggcggacgtttcttccggcctgggggggcctcggctgagccttccgggtcccctgtagcctgagggtacccttgtcgccccgcccgggtcctgcgggccccagctctgggcttgccgaccagaccgtgatccagacgtccccacccccaccctcgagtctccttccctccggagtccgcgcggcggaaggaggagggactgagtcggggccggccgggcccggagatctgctgctggctggggcggcgccgggccggggcccggcctcgcagcctccgccgccggggctaagtgcacgccgcgccatccgagagcggcagagcagagcaccaaagcggcaaccgcggctccgtaaccaagcccagctgcctctcccggcggcagcggtcgggcaccgatcgcggccgtggggtcctcggcccagtgcactaactggcagggccgtagcccgcgatcggcagctgttctccggggctcgcgttcccccttgggtgcgctcagccctccagagcgcgggagtcccctggccggctcccggcaggtcgtccggcccttggagcgcgcacacctcctcccggagttttctgctcctttcccgggtcggaggccgcagcccgatgcccggccgcacccgcgcagcccctcatctccccccgcagcccggtcagcggggcccctccgggcgtggagggccgaggcccctggagagcgcaccggagagtcccaggcgcttgtccccagccggactcggggcggggagggccaacaactttctcccaagtcccagccggcactccttcccaccggcctgtgtcggcggcagcgcgcagctccggccccggagtcgaccccaaagaacgcgcctggcagccctgcccatccctacctcggaccaggatccggcggcagtaatccgggtccgctgcggaattggatttacttttgttacaatcctcagcagcgcccgacgctgagaaggcgccctgcggctccttgaggaaggcggctgggaggttcccctccgcgcccttgctctcccgactctccttgtgcgcgttcttcgagacccgggcagcctcggcgtccgagtggcatcgaacgtccattttgtctggtttcccgaacataggcaagaacaacaacaaaaacagaaaggaaaaaaaaagcaaaaaaaaaaaaaaggggggggggcggagaaggaaaaaaaaaagaggaaaaaggggacaaaacccccgacaacgcggcccgtacgcccggcccggcgacaggcaaggggcaagaatgaatgtccccgcggggaggcttcggcggccgcgcgcgggtcagcggcgacgggagagtggcgcgctcgccgagaggcggccagtctggtccaggatcctggtggagctgcggcgaggccgcctcgtcagcacccgcgtcctctgagcacgtccagtgtccccagcctggcgatcaggtagcgaacagcgcaactccgaaatgctgcggctcccgcctgtttctgagacggcgagttgtagttgtccgacacccggggggacgcacactcgctgttgcaattgattacgggtaatttcgcagcccccacgtttcggttacctcatgaatacactaaattgtttggataatatatcagatcgtaatggatggtttctgtccttgtccccaatcaagtaggggtttagccagtgaataaacggaaatgattggtc

SEQ ID NO: 105114 - DNA, 1663 bp, Homo sapiens
  chr10:118898853-118900516
  Hyper
tgctccagcccttctcgtcaccttgccggggcagaagccctctccacgccgctctccccattcattcctttatgggaaatgcggagcaaaaggagtgaaagatggcaattatctaattggactattaacaaacagtcctctgagtgcggcggtctggcgtggctcctgggcgggggaagggccgtgttccctgccctcattcacaaagagtgcaggggccggggaggaaaggggttttttaaagggggtgggtggggggagaggagaggtgggaggtttggctgagaatttttccacacaattccaagaatggggcggaggcggggggaggggagggggttggggagggggtcgcggcgagcgggtgggaggaaggccgggagggggaggggtgcgagtgtgtgtggcgggcccctaggggctccagctcgcagcgacgcgcgcaccgtccgcacctcccgccccgccgccacctcccctgcctccgccgccaccccgcgggacccctctaccgtcccaagccaggagggggccccctgagcggggtctttcgcgctgtccacccagccacccctccagccacttaggggcacccaggtttggcccagctccggagggcatctctggccctgcaggccgacatcaggcttccactttagttgactgggcggagcggtggaactgtcccgagctactctccgcagggcggcgggtttccagggtccccagcgggctgatcgcccctcagcccggcttcgctgcgcacgctgccctcgaagtccgacgccgactgggcgcccggggaaagtgcctttgattacgagctctgctccggcgggttggtgaggcgggtgggagcagagacgggtaagaggggtaagggactttgcggccaccctgttctgaagatgtagagtgggattgtgttaaaatccggcgaactctcctgttacctcccgcaacgctcaaaagcccagactggcgccttgaggcaccgagggctttgctcccatgcggccaagccgtcgggggtgcagccgccgggtcttgactcccactaccgcgtcgcgggtgcgggtccctgggattcgggtcctcctgatgggggtccctgcagcagatggggcattcacttccctgcagagctcggcccgagggagctcctgggcctccttgggcagggaggggtgcgaccgaattccctggcacaccggcccttccttgccccctaccctggaggggttggaggggtcggaccctcggactacgcgagatcgggtgcgcaggaggattctaggccttcctcagccctttaggagccctgcaggcggcggaagtcccaaaccgcagccttggcccaaatgggacccagatggctctgggtccccggcccggccgcacccctctgtacggcctccttctgtcggtgaaggccgcagcggcctgggaaacccatgcggacacctgcggcgcccggtcaaagacctggaagaaagctttttaaaaaataaaaatggcccaacccattacattttcttttaggtagatgggggagctggggggcggggcgggggcagtcagggaacaaacagctgcccttagaaatgacacgccctgtgggcaatggcggcgctgggacgtctgcagccgcattcactgccac

SEQ ID NO: 105115 - DNA, 674 bp, Homo sapiens; identical to SEQ ID NO: 70427
  chr10:118922143-118922817
  Hyper

SEQ ID NO: 105116 - DNA, 544 bp, Homo sapiens; identical to SEQ ID NO: 70428
  chr10:118923031-118923575
  Hyper

SEQ ID NO: 105117 - DNA, 1704 bp, Homo sapiens; identical to SEQ ID NO: 70429
  chr10:118924354-118926058
  Hyper

SEQ ID NO: 105118 - DNA, 588 bp, Homo sapiens; identical to SEQ ID NO: 70430
  chr10:118927006-118927594
  Hyper

SEQ ID NO: 105119 - DNA, 150 bp, Homo sapiens
  chr10:118927889-118928039
  Hyper
cccggcgcctctagccgctccacccgcacccccagttcgcgctgcggcggccagcctcttccccgacggccgaccgaatgtccctcagagctttccgtgaccggccagggcgcgtggctgtccggagcccctccacgttccccagcagca

SEQ ID NO: 105120 - DNA, 181 bp, Homo sapiens; identical to SEQ ID NO: 70433
  chr10:118928343-118928524
  Hyper

SEQ ID NO: 105121 - DNA, 1123 bp, Homo sapiens
  chr10:119000420-119001543
  Hyper
ggtccccaaggcactcggccacgcgctgggtccggggaagaggcgcggccgcggccgaggcggggacagggaggcggcagcccctcctgcgcagcgacggcgcgggcgggcggaggccggggcgccccagccccccgcccccgctccctccggccgtgacgtcagagccggacggggtaaactgagcggcggcggcggggcgctggggcggagactgcgacccggagccgcccggactgacggagcccactgcggtgcgggcgttggcgcgggcacggaggacccgggcaggcatcgcaagcgaccccgaggtaacacggccccggttccctgctcgcagggcgcggtgccggaggggagcgggcccgggggaggcagggaggcagggaggcccccagagctacgcgggcggggctgcggggaccccggggcagccggggcgcagggcgcagggcgcaaggtgcacggggccgagcgtgcagtttgggaggtggcacagttgggggcggcggggatcagggcagcgtcctgggggttctaggttgggtctccagattgggtccccgacggcgctcgcgggcgctctttccagggagcgcgggctctcgtggggacgcgctcgaggcaggtgagccgaggctggggcgcccgggggtgtccccggatgccggtgcgcgcggctccctgacccgcccttccgcggcctgggggacgggagaatggggggtccacggccgccttgggtcctcaccgcgcaccgcgcccgcagcggagccccggagccatggccctgagcgagctggcgctggtccgctggctgcaggagagccgccgctcgcggaagctcatcctgttcatcgtgttcctggcgctgctgctggacaacatgctgctcactgtcgtgggtacgtgcggacagggcacccctgccccggcaccccagccccagcgccccttccccggcactccacttacccctgcgcggtcccggagctccgccaaggcccgggaaagttggagaactcgctttgcaaaaaagacatcccctccaggctgccgcgccggggctaggaggagccgcgttgtgtggcttcgctttcctgatgctcgggtcaaaaactgt

SEQ ID NO: 105122 - DNA, 30 bp, Homo sapiens; identical to SEQ ID NO: 70437
  chr10:119016775-119016805
  Hypo

SEQ ID NO: 105123 - DNA, 31 bp, Homo sapiens; identical to SEQ ID NO: 70438
  chr10:119136226-119136257
  Hypo

SEQ ID NO: 105124 - DNA, 74 bp, Homo sapiens
  chr10:119292269-119292343
  Hyper
ggggcagaggacctgcgggagcccgcgcagcgcctccgctctgccaggcccctccgcatcgggcacccaggctg

SEQ ID NO: 105125 - DNA, 1135 bp, Homo sapiens
  chr10:119294281-119295416
  Hyper
ggtgggaggacacttcgggcccagcgtagaggaggcctccgaggcccaagcgggcttcggctgctgcgagtccccagaggctccctcgggcctcactcgcggtgtctcctccagacgccaggggcaggccacgaagccgagggctccgcgtggccgtgggagaagcggggtgcacggagccttcccgcgcccagacgccgaggggatgcaaacaggggagccgggcctggtatggccaacctccaggatcgaggggccccagaatgtgcgtgtggccgggggcgggggcagctgcgggggccagaactagagtattccttcgctctcccctgggggccgggcccccacgagttgcagcagagcccgtctgtaattagggcctcctggtccggcaaagctgcggctgctcccagagagagttggggtcttctcagggcccgcgatgggggagtggtcgtggtcagacccccgtgagccccttcggaaggtcccagtccctgtccattcttctgtcccgcagctctctccgcgcaggcggggcagagccggggaagaagacgctggacgaggggtcttggggccgcctcgctggctgcggttggaagcacccgttttcccgcccgcccgcgcaggcgctgctctgtggccaccagcagaggtttcccggccgctgtgagtcgcccacgcgagcgacgtggggatacggggcgcacggagtctcagctgccgccacgcagcgcttgccctgcccgagcttcggctcactggcagcggcgaggccaccgaccaccctccgccttccagtcctaaactcggggctggagaccgcaggagctaaaccaggaagaagaaagagggcagggcctgaggccgggaagagcggcccgggggtcaacggtgagcgggtgcatacgaggcaagagccagagtgacattaagtggggccgcccgggcaaaccttgcgcgtgcaccccggcccacctgcagggcattctcccctgccttttctccttggcttgagtgcgggcggctgactcctgtgggcggggaggagagggtggtcttcccagggctccaagtggagtgatcactgcacccatggccaggaggtgggggtgcgcggagtgatttttgt

SEQ ID NO: 105126 - DNA, 1059 bp, Homo sapiens
  chr10:119296629-119297688
  Hyper
ggagccaggctgccccgggatggatggggtccgcgcgctccgagaggaatgggctagtcaatgtgcgctgctaggagtgtgtggtaatcaatcgccacccctgccaaaaccaaggaccccctgtgtcgggcgtcttcagccagccgcgagggggcgcggatctgagagagtcgcaccccgggaccccagctcttcctactccaccccaggcagggcccgcgcaggccgtccaaggcctgttctctgaaccacctgggttgggccgcgaaatatgggacctcaggcatggaattgtggctgcacaggtgatcacggcttcctagtccttcttagagcagaacctgtcccactccagcccacctctgcgcccccttcggaaggaagcctactggagctggaattccagcgtgggtggcgaactctcaagccaagagctggagctgatggaggcaggagggacgcacttccaagccatccgggctcctccgtagccagtgagcctcctttaacccctccactggcctggatgacggcctaggcgagactttggcagtgtggcgcgaccccagcgctcccccgccctcgggctcgggggcgcggtgggtaccgcgcccgcgcccggccctcgccactaggcgccgctgcgctcacgccgatcggggccccgggtcgccgcgcccgcctggcgagaggcctctggggaagacgccagaaagggatttgtcgtaataatttttaaaaaatgtttttagggcattaattatacttttcgttttctcaccgccaccctgcgcgttcggagaggccggcgtgactggggatctcagtgggttggaggaattcttaacgcccccgaggcctttccaactcgggacaccattctcgcgcctcgggccgggaaagggctcgcccttcacgggcgtcggtgcggtccgcggcgagccgcgggagcacagggcgggctcagcattctggttcaacgtgaggaccagaacctcggcgatcagggaccaggacgtggcagagtgcagcgggtagcttcgacggcacaaggccatg

SEQ ID NO: 105127 - DNA, 917 bp, Homo sapiens
  chr10:119300923-119301840
  Hyper
tgatcataattatgccgccgcgcgagccaatggggacgagggaactcggtcctaaaatcatcccaaaaccgaaggcgagctcgaaaatgcggacacggcccgggaccggagatgcgatccgtagtcgttagttgcactgggtttgcacagcaaccaccacccccccaccaaccccgggacaacagatggcataataataataatagaaataataataataaaataatatcatctataataataataacattgaccacactgacaaaaataattacgacggaaccttaatagtacagtagcaccatatcgggctctcccctgaccttggactgccggtcccagatattccagaaggaattgttttggggaaggaggtgagcaccctcccagacagaaaacgctagagaccgtggggcgagagagggagagagttggaagcccactgctccggcggggtcggcagctcccggtctcaactcgcaaacgaacgagccgggtcaagaatcgcgaacgcaccgaccctgggacctcgaggctaagcgtggttgatggggtgggaggaccccgtacccctcactccaggatccctcctggcctaggaaaccgctgggagttttgctaagtgtggggattggtataaccgaacggcgcctttagcccgggaaccagcccctgcccgcttaccctcgcggtgctcttggggcgatcccagttctcccgacgcggggccgcgtaaggcagcagcggcggagcgctaggctagaggaatctgtctgtccttctgtcctaccagcttgggcgaggcaggctcgggattcagggggccgcagcggaggcggcgccggccagggactctgcagggaccggggtgccccggagggagtggtgctggtggaggaggaggcggtggctgaggg

SEQ ID NO: 105128 - DNA, 77 bp, Homo sapiens; identical to SEQ ID NO: 70446
  chr10:119301900-119301977
  Hyper

SEQ ID NO: 105129 - DNA, 1028 bp, Homo sapiens; identical to SEQ ID NO: 70447
  chr10:119302693-119303721
  Hyper

SEQ ID NO: 105130 - DNA, 1334 bp, Homo sapiens
  chr10:119303950-119305284
  Hyper
tgttttcatttcttgcgatattttttatttgtttgtttttctctgggtacggggtgggaggaggagagttaaaacttcagaaaaaggagtaattagtttacggattggagtcagtaaaagacctacctccggcggcagccgatcaatactccgcggcttgtccattcattaacccattgcgttcctgccggagcctagaatcgggtagatgtcacccccctccccatattttaaaaaatcaaaccaaaggaaaaaaaacccaaaaagccttttacccttaatcccgaactggatttgcctgcatcctgcctggactgtcggcttgtttttctttgtttgggttttcggtgaatcgatttcctatgctaatgagtgaacccaaaactctgaggctttgcttgaaaagtttagggctgcccttcctcattcgctatcagtcatgcttatggtcccctcaccagacccggagccgctgggatcttcctgcgttacagactgtcctggcggtgtctgcaagtcggtaaccccccgggtttcgatcccttcgctcgcgtttctcttctagttctcgggagccgggagccccggagcccagttcgcgagaggcagcagcggctgtagccaagcacacccgccggccagatttctgtcccgatcgggcttcaacgactcgccccgcctctatacttttccggaggggcaataaaacaaataatttaaaaataaatctccatgaaaactctggagagcagcccgccgcctttccaccgtgggtcaaagttccccgagaggttagaaagaagagaaagtagtttcttcgggttgtgggcgccaatcccctggccaggctctgcggctccctcccctgcctccagcgcccggcgaggaggtggcgaggcccgcggcgccagggcggctgcggagccggccgaggtcaggagcctggggactggctcctctgcgacagcggctggttgggtgccgcaccggtggagacccggcgttccgggccgggcagctgagcaggcgttcccttcgtgagcccttgggaggaccaccggcccccgcaggtcgagcggcgcggctatgcgaaggccctgagcacggtgccgggccagcccggctcgggagaagtgcgcggctccggtcagagcagccccccctaatgggatttctgctgtgctccccgcagggaacgacactagccccgagagtttccttttgcacaacgcgctggcccgaaagcccaagcggatccgaaccgccttctccccgtcccagcttctaaggctggaacacgcctttgagaagaatcactacgtggtgggcgccga

SEQ ID NO: 105131 - DNA, 256 bp, Homo sapiens
  chr10:119306116-119306372
  Hyper
ccgaggagggcctggcgggtttgtgcggagcccggcacaaggcgcggcccggctgatttctcctggacagccgaggcggcggtggtctttgtccgcctcgctgcccacgctgcctggagtctttgtgtgcgtgtcaagccccgagcgcaccgacgcgcgccttgggccagcgccggggagaaatgaaccgtcctccccctcaattagcaaactcaaagcaaattaaattcagccttgttcccgctcagcttttttc

SEQ ID NO: 105132 - DNA, 52 bp, Homo sapiens; identical to SEQ ID NO: 70454
  chr10:119307022-119307074
  Hyper

SEQ ID NO: 105133 - DNA, 68 bp, Homo sapiens; identical to SEQ ID NO: 70455
  chr10:119307830-119307898
  Hyper

SEQ ID NO: 105134 - DNA, 30 bp, Homo sapiens; identical to SEQ ID NO: 70456
  chr10:119310948-119310978
  Hyper

SEQ ID NO: 105135 - DNA, 293 bp, Homo sapiens; identical to SEQ ID NO: 70457
  chr10:119311443-119311736
  Hyper

SEQ ID NO: 105136 - DNA, 30 bp, Homo sapiens; identical to SEQ ID NO: 70458
  chr10:119311979-119312009
  Hyper

SEQ ID NO: 105137 - DNA, 1202 bp, Homo sapiens
  chr10:119312341-119313543
  Hyper
ctagctgtccttgtgcgtctagattgttttgagttagggccagcacgtgcagttgtgaggctgcagagtgcctatgacggtgtggaaatgcagtttattgaatgtgtgtgccgcggtctggttgcactgtgtatctgcgaattcgtctggagttgcacatctcagaagatgggggtggcctcggtgtgtgtggcttgcggggacgtttctcggtgtttggatgggggtccctgtgatggatgtccatgcccagccctagggcaacatctgtgtgtcttgggatcgaggcgtgtgtgtctagtgaggaggcttgggctggggtgtcgttccagcagcgccccactaactccggagtttggcaaacaacagccgttttgtgtaactgcgcatttttctagaccagtctttattattccagcaatcagcgctggaattactggggcgccgcctagaagcaaccgccggcggggcggcagaggatgccggcctccagcgtcgggggaccgcgcccgaaagccgggctgctttgtggggcctctcgcgcctcgcccgcagcttccggcccgcgccctccgctcgaccgccgattttctcgccccagccagccccgtagccagaggaaagtgggagttttgagaaccctctgaccccagccgtgacccctctccgggaggtggcttctcccgcaggacccggtgcgccagaaaactctaggcggcgccacgcttggaagcgcaaggtccattcatcagccgcgccccagcgtctaattggccttttgtttattagtgtctgttgcccggctgggagtctccggagggccccggagctgcgagtcggggtgccagaagcggacggcgggccagcgcccagagctggggtccgggtagggcagaggcgcgtcgcactcctctgagggggcgccagagcgcgccaaagatcacgcccacgtgcggagatgcgcgcatggaggctggactccaagtgctggagcctggtcctcccggctgctaacgccccaggcttcgcccctgcccccacctccacctgcagaccgagccctccccatctctccacaccctcaggatttcagacccgccttcctgcctctcctaagtacccatcccaggcgctggccttgtggctcggttccgctcacgtcccgcccttcctcgttcttcgtgcttcgagttcattagtcg

SEQ ID NO: 105138 - DNA, 114 bp, Homo sapiens; identical to SEQ ID NO: 70461
  chr10:119469814-119469928
  Hypo

SEQ ID NO: 105139 - DNA, 42 bp, Homo sapiens; identical to SEQ ID NO: 33430
  chr10:119494127-119494169
  Hyper

SEQ ID NO: 105140 - DNA, 682 bp, Homo sapiens
  chr10:119494374-119495056
  Hyper
taggaagcctagggtcgccgatgttccaggatggaatgttctggtgtcaccgtgcgggggggtggggggtgtcacagagctgggaactcgctcagagccagggtctctgctggggtcagcgtctgtacgctaaagccagggcgcaaagtgcgtgggcactgcggacactagaggcttatggcgctggaaatacaaggccgagttgccggcgcaaagagttccccgggcgggttggtgatgcggcgcgctttgataacaggttaatccggccaacattcgctccgcgagagagccatcggagggctccgggagactgcggcgccacggagggagaggcggcgagaggcccctctgcgagcaccctctgggcgcagtgcggtgggctatgctctgcgcagccccgggcgcgcctgggttctcagagcccaagacctgagccgctccgagcgcagggcgccagttctctttcagaagcgggagaagttcaggtgggacaggagacacgggggtgaggagatctttgagagggccggccgggaaagtgggggtcgcctgtggctgagagggccgcatgccgaaggtcccgaccccaggctcacgacaggcagcctggcacgcaggaaggggctttgggatagaacgtagcacctggctgagtgcttaacaacgattgaactgacct

SEQ ID NO: 105141 - DNA, 30 bp, Homo sapiens; identical to SEQ ID NO: 70465
  chr10:119777112-119777142
  Hypo

SEQ ID NO: 105142 - DNA, 181 bp, Homo sapiens; identical to SEQ ID NO: 70466
  chr10:119806950-119807131
  Hypo

SEQ ID NO: 105143 - DNA, 38 bp, Homo sapiens; identical to SEQ ID NO: 70467
  chr10:120127513-120127551
  Hypo

SEQ ID NO: 105144 - DNA, 708 bp, Homo sapiens
  chr10:120353807-120354515
  Hyper
gcaccagcccaaaggcgtaagggtcgatggcgtgggggtcgaggtcccgcagcaggttgaagacgtgcagcggcagccagcagacggcgaacaccaccacgatcaccaccagcaagcagaaggtgcgccggcgccgagcgcggtcccagtcggcctggctctgggtcacgcagcccggcaccacgcggttgcggagcttcactgacacccggacgtaagacaggaggatgaccagcagagggagcaggtaggtgaccagcagcagcccccaggcgtagagctggcgctggcgctcctgggagccccagaactcctcgcagaggcgcacgtcgtgcggcttgagctccacgtgataggtgtgcacggcggcgggcagcgccagcaccgcggacagcgcccagatggccagcacagcgtaggcgctgaggcgcagcgagatgcgccgcctcagcgggtgcaccagcacgacgtagcggtccactgcgatggtggtgagcgtgaacaccgacacatagacggtgaccggctgcaggaagaagaccaggtggcacaggccgccgccgaacacccagccgcgtggctcgaaggcataggccagcgtgagcggcacgcaggcggtgcacatgagcacgtcggacaaggccaggttgccgatgaggaagttcgtcacgttgtgcagccggcgcacccgcgcgatcaccagcacca

SEQ ID NO: 105145 - DNA, 378 bp, Homo sapiens
  chr10:120355260-120355638
  Hyper
gcgctctgccatgctcggtgcttagagaactagtgaagaggacagtgtggggaggatggaatccgaaacgggaggaggggccggcaaacctggccagagcagcgaagaggacgaatctctactgcaggagcttgcacggcccctggagggtcagggtccggaggagcgcacagtggaggagggcggaggagaggcgcgaagcgtcaggctatcgggaggagccggtgcagtcttaggagggaaggagcggggaaggaagtagcggtgggagattgcaatgcagctgggggcttgagagaggcacgactgacccgttcttaaaggctggatcctgcctagcggccaggttgcggagggcagagacgctagagggctcgg

SEQ ID NO: 105146 - DNA, 45 bp, Homo sapiens; identical to SEQ ID NO: 70472
  chr10:120355967-120356012
  Hyper

SEQ ID NO: 105147 - DNA, 126 bp, Homo sapiens; identical to SEQ ID NO: 70473
  chr10:120668218-120668344
  Hypo

SEQ ID NO: 105148 - DNA, 420 bp, Homo sapiens; identical to SEQ ID NO: 70475
  chr10:120766813-120767233
  Hypo

SEQ ID NO: 105149 - DNA, 42 bp, Homo sapiens; identical to SEQ ID NO: 42669
  chr10:120791236-120791278
  Hypo

SEQ ID NO: 105150 - DNA, 120 bp, Homo sapiens; identical to SEQ ID NO: 70477
  chr10:120841443-120841563
  Hypo

SEQ ID NO: 105151 - DNA, 30 bp, Homo sapiens; identical to SEQ ID NO: 70478
  chr10:120863286-120863316
  Hypo

SEQ ID NO: 105152 - DNA, 30 bp, Homo sapiens; identical to SEQ ID NO: 42670
  chr10:120922882-120922912
  Hypo

SEQ ID NO: 105153 - DNA, 30 bp, Homo sapiens; identical to SEQ ID NO: 70481
  chr10:121228977-121229007
  Hypo

SEQ ID NO: 105154 - DNA, 178 bp, Homo sapiens; identical to SEQ ID NO: 70482
  chr10:121249843-121250021
  Hypo

SEQ ID NO: 105155 - DNA, 43 bp, Homo sapiens; identical to SEQ ID NO: 42672
  chr10:121256846-121256889
  Hypo
